United States Patent
Rioux

(10) Patent No.: US 11,278,029 B2
(45) Date of Patent: Mar. 22, 2022

(54) **ANTIFUNGAL *METHYLOBACTERIUM* COMPOSITIONS AND METHODS OF USE**

(71) Applicant: NEWLEAF SYMBIOTICS, INC., St. Louis, MO (US)

(72) Inventor: Renée Rioux, Morrisville, NC (US)

(73) Assignee: NewLeaf Symbiotics, Inc., St. Louis, MO (US)

(*) Notice: Subject to any disclaimer, the term of this patent is extended or adjusted under 35 U.S.C. 154(b) by 717 days.

(21) Appl. No.: 15/580,208

(22) PCT Filed: Jun. 10, 2016

(86) PCT No.: PCT/US2016/036968
§ 371 (c)(1),
(2) Date: Sep. 10, 2018

(87) PCT Pub. No.: WO2016/201284
PCT Pub. Date: Dec. 15, 2016

(65) Prior Publication Data
US 2018/0295841 A1   Oct. 18, 2018

Related U.S. Application Data

(60) Provisional application No. 62/173,789, filed on Jun. 10, 2015.

(51) Int. Cl.
| A01N 63/30 | (2020.01) |
| C12N 1/20 | (2006.01) |
| A01N 63/20 | (2020.01) |
| A01N 25/04 | (2006.01) |
| C12R 1/26 | (2006.01) |

(52) U.S. Cl.
CPC ............. *A01N 63/30* (2020.01); *A01N 25/04* (2013.01); *A01N 63/20* (2020.01); *C12N 1/20* (2013.01); *C12N 1/205* (2021.05); *C12R 2001/26* (2021.05)

(58) Field of Classification Search
CPC ........ A01N 63/10; A01N 63/00; A01N 25/04; A01N 63/30; A01N 63/20; C12N 1/20; C12N 1/205; C12R 1/26; C12R 2001/26
See application file for complete search history.

(56) References Cited

U.S. PATENT DOCUMENTS

| 6,014,451 A | 1/2000 | Berry et al. |
| 6,133,196 A * | 10/2000 | Ocamb ................. A01N 63/30 504/100 |
| 9,181,541 B2 | 11/2015 | Bogosian |
| 9,845,462 B2 | 12/2017 | Bogosian |
| 10,098,353 B2 | 10/2018 | Breakfield et al. |
| 10,111,438 B2 | 10/2018 | Floro et al. |
| 10,212,939 B2 | 2/2019 | Floro et al. |
| 10,287,544 B2 | 5/2019 | Bogosian |
| 10,368,547 B2 | 8/2019 | Floro et al. |
| 10,448,645 B2 * | 10/2019 | Breakfield ............. A01N 63/00 |
| 10,450,556 B2 | 10/2019 | Bogosian |
| 10,716,307 B2 | 7/2020 | Breakfield et al. |
| 10,757,946 B2 | 9/2020 | Allen et al. |
| 2008/0148432 A1 | 6/2008 | Abad |
| 2011/0053771 A1* | 3/2011 | Goodwin ................. C05G 3/60 504/100 |
| 2014/0147425 A1 | 5/2014 | Henn et al. |
| 2015/0044327 A1* | 2/2015 | Feinberg .................. C12N 1/20 426/2 |
| 2015/0337256 A1 | 11/2015 | Bogosian |
| 2016/0073641 A1 | 3/2016 | Allen et al. |
| 2016/0120188 A1 | 5/2016 | Bogosian |
| 2016/0295868 A1 | 10/2016 | Jones et al. |
| 2016/0302423 A1 | 10/2016 | Jones et al. |
| 2016/0302424 A1 | 10/2016 | DiDonato et al. |
| 2016/0302425 A1 | 10/2016 | DiDonato et al. |
| 2017/0086464 A1 | 3/2017 | Floro et al. |
| 2017/0135352 A1 | 5/2017 | Breakfield et al. |
| 2017/0164618 A1 | 6/2017 | Breakfield et al. |
| 2017/0238553 A1 | 8/2017 | Jones et al. |
| 2018/0142230 A1 | 5/2018 | Bogosian |
| 2018/0295841 A1 | 10/2018 | Rioux |
| 2019/0021334 A1 | 1/2019 | DiDonato Floro et al. |
| 2019/0116803 A1 | 4/2019 | DiDonato Floro et al. |
| 2019/0241865 A1 | 8/2019 | Bogosian |
| 2019/0297895 A1 | 10/2019 | Floro et al. |
| 2019/0364905 A1 | 12/2019 | Rioux et al. |
| 2020/0315181 A1 | 10/2020 | Breakfield et al. |
| 2020/0318095 A1 | 10/2020 | Bogosian |

FOREIGN PATENT DOCUMENTS

| CA | 2183275 A1 | 2/1998 |
| CN | 101028008 A | 9/2007 |
| CN | 104508118 A | 4/2015 |
| WO | 2013181610 A1 | 12/2013 |
| WO | 2015/085063 A1 | 6/2015 |

(Continued)

OTHER PUBLICATIONS

International Search Report and Written Opinion for PCT/US2016/36968 dated Dec. 7, 2016.
Madhaiyan et al., "Growth Promotion and Induction of Systemic Resistance in Rice Cultivar Co-47 (*Oryza sativa* L.) by *Methylobacterium* spp.", Bot. Bull. Acad. Sin., 2004, pp. 315-324, vol. 45.
Madhaiyan et al., "Pink Pigmented Facultative Methylotrophic Bacteria (PPFMs): Introduction to Current Concepts", Korean J. Soil Sci. Fert., 2004, pp. 266-287, vol. 37, No. 4.
Madhaiyan et al., "Plant Growth-Promoting Methylobacterium Induces Defense Responses in Groundnut (*Arachis hypogaea* L.) Compared with Rot Pathogens", Current Microbiology, 2006, pp. 270-276, vol. 53.
Poorniammal et al., "In Vitro Biocontrol Activity of Methylobacterium Extorquens Against Fungal Pathogens", International Journal of Plant Protection, 2009, pp. 59-62, vol. 2, No. 1.

(Continued)

*Primary Examiner* — Sue X Liu
*Assistant Examiner* — Andriae M Holt
(74) *Attorney, Agent, or Firm* — Stinson LLP

(57) ABSTRACT

Compositions comprising *Methylobacterium* with anti-fungal activity, methods for controlling plant pathogenic fungi, and methods of making the compositions are provided.

23 Claims, 3 Drawing Sheets
Specification includes a Sequence Listing.

(56) References Cited

FOREIGN PATENT DOCUMENTS

| WO | 2015085115 A1 | 6/2015 |
| WO | 2015085116 A1 | 6/2015 |
| WO | 2015085117 A1 | 6/2015 |
| WO | 2015/142393 A1 | 9/2015 |
| WO | 2015/200902 A2 | 12/2015 |
| WO | 2016/069564 A1 | 5/2016 |
| WO | 2016/201284 A2 | 12/2016 |
| WO | 2018106899 A1 | 6/2018 |
| WO | 2020117689 A1 | 6/2020 |
| WO | 2020117690 A1 | 6/2020 |

OTHER PUBLICATIONS

Savitha, "Studies On Pink Pigmented Facultative Methylotrophs Of Major Chilli Growing Areas of North Karnataka", Jun. 1, 2015, pp. 1-139, retrieved from: http://krishikosh.egranth.ac.in/bitstream/69836/1/th10680.pdf.

International Search Report and Written Opinion for PCT/US2016/036968 dated Dec. 7, 2016.

International Search Report and Written Opinion for PCT/US2017/065081 dated Mar. 12, 2018.

Menpara et al., "Endophytic Bacteria-Unexplored Reservoir of Antimicrobials for Combating Microbial Pathogens", Microbial Pathogens and Strategies for Combating them: Science, Technology and Education, Dec. 1, 2013, pp. 1095-1103, vol. 2.

Nascimento et al., "Endophytic Bacteria from Piper Tuberculatum Jacq.: Isolation, Molecular Characterization, and in Vitro Screening for the Control of *Fusarium solani* f. sp. *piperis*, the Casual Agent of Root Rot Disease in Black Pepper (*Piper nigrum* L.)", Genetics and Molecular Research, Jan. 1, 2015, pp. 7567-7577, vol. 14, No. 3.

Tani et al., "High-Throughput Identification and Screening of Novel *Methylobacterium* Species Using Whole-Cell MALDI-TOF/MS Analysis", PLoS ONE, Jul. 12, 2012, pp. 1-13, vol. 7, No. 7.

Ardanov et al., "Effects of *Methylobacterium* sp. on emergence, yield, and disease prevalence in three cultivars of potato (*Solanum tuberosum* L.) were associated with the Shift in Endophytic Microbial Community", Plant and Soil, May 2015, pp. 299-310, vol. 405, No. 1, Kluwer Academic Publishers.

Extended European Search Report for EP17877804.9 dated Jun. 26, 2020.

Schlaeppi et al., "The Plant Microbiome at Work", MPMI vol. 28, No. 3, 2015, p. 217; http://dx.doi.org/10.1094/MPMI-10-14-0334-FI.

Tani et al. Supplemental Data S2 Table downloaded from the internet site https://doi.org/10.1371/journal.pone.0129509.s005 on Nov. 20, 2020, and reformatted for conversion to PDF.

Tani et al, "*Methylobacterium* Species Promoting Rice and Barley Growth and Interaction Specificity Revealed with Whole-Cell Matrix-Assisted Laser Desporption/Ionization-Time-of-Flight Mass Spectrometry (MALDI-TOF/MS) Analysis", PLOS One, Jun. 8, 2015, pp. 2-15.

\* cited by examiner

FIGURE 1A, B, C, D, E

ANTIFUNGAL *METHYLOBACTERIUM* COMPOSITIONS AND METHODS OF USE

CROSS-REFERENCE TO RELATED APPLICATIONS

This is a U.S. National Phase application of PCT/US2016/036968, filed on Jun. 10, 2016, which claims the benefit of U.S. Provisional Patent Application No. 62/173,789, filed Jun. 10, 2015, both of which are incorporated herein by reference in their entireties.

SEQUENCE LISTING STATEMENT

A sequence listing containing the file named 53907_153532_SL.txt which is 14,824,692 bytes (measured in MS-Windows®) and created on Jun. 10, 2016, comprises 9,188 sequences, is provided herewith via the USPTO's EFS system, and is incorporated herein by reference in its entirety.

BACKGROUND

One-carbon organic compounds such as methane and methanol are found extensively in nature, and are utilized as carbon sources by bacteria classified as methanotrophs and methylotrophs. Methanotrophic bacteria include species in the genera *Methylobacter, Methylomonas, Methylomicrobium, Methylococcus, Methylosinus, Methylocystis, Methylosphaera, Methylocaldum*, and *Methylocella* (Lidstrom, 2006). Methanotrophs possess the enzyme methane monooxygenase that incorporates an atom of oxygen from $O_2$ into methane, forming methanol. All methanotrophs are obligate one-carbon utilizers that are unable to use compounds containing carbon-carbon bonds. Methylotrophs, on the other hand, can also utilize more complex organic compounds, such as organic acids, higher alcohols, sugars, and the like. Thus, methylotrophic bacteria are facultative methylotrophs. Methylotrophic bacteria include species in the genera *Methylobacterium, Hyphomicrobium, Methylophilus, Methylobacillus, Methylophaga, Aminobacter, Methylorhabdus, Methylopila, Methylosulfonomonas, Marinosulfonomonas, Paracoccus, Xanthobacter, Ancylobacter* (also known as *Microcyclus*), *Thiobacillus, Rhodopseudomonas, Rhodobacter, Acetobacter, Bacillus, Mycobacterium, Arthobacter*, and *Nocardia* (Lidstrom, 2006).

Most methylotrophic bacteria of the genus *Methylobacterium* are pink-pigmented. They are conventionally referred to as PPFM bacteria, being pink-pigmented facultative methylotrophs. Green (2005, 2006) identified twelve validated species in the genus *Methylobacterium*, specifically *M. aminovorans, M. chloromethanicum, M. dichloromethanicum, M. extorquens, M. fujisawaense, M. mesophilicum, M. organophilum, M. radiotolerans, M. rhodesianum, M. rhodinum, M. thiocyanatum*, and *M. zatmanii*. However, *M. nidulans* is a nitrogen-fixing *Methylobacterium* that is not a PPFM (Sy et al., 2001). *Methylobacterium* are ubiquitous in nature, being found in soil, dust, fresh water, sediments, and leaf surfaces, as well as in industrial and clinical environments (Green, 2006).

*Fusarium graminearum* is the causal agent of *Fusarium* head blight (FHB) on wheat, barley, and other cereals. This pathogen is also responsible for ear and stalk rot in corn. In addition to causing significant reductions in yield and grain quality, *F. graminearum* produces harmful mycotoxins that are a major concern in the animal feed industry. Furthermore, there is an increasing problem in farming with fungal pathogens such as *F. graminearum* becoming resistant to a wide range of chemical fungicides. Thus there exists a need in the farming and animal feed industries for the development of effective new approaches for control of fungal pathogens.

*Rhizoctonia solani* is a polyphagous basidiomycete fungus, with a broad host range that encompasses many economically important monocot and dicot plants. *R. solani* is known primarily as a damping off pathogen because it attacks young seedlings, either preventing their emergence from the soil or killing them shortly after emergence. This soil-borne pathogen persists for years in soil both by surviving as a saprophyte and by forming dormant survival structures known as sclerotia. Aside from fumigation, which is often not feasible due to expense and environmental concerns, multi-year rotations away from host crops, chemical seed treatment, and cultural practices that promote plant health are preferred methods of disease management. None of these treatments, however, is completely effective, particularly in cool, wet years that promote pathogen growth and stress seedling health.

*Sclerotinia sclerotiorum* is a polyphagous ascomycete fungus, with a host range that encompasses thousands of dicot plants. White mold, caused by *S. sclerotiorum*, on soybean and other leguminous crops is of particular agronomic importance. Under cool, moist environmental conditions, this disease causes premature senescence and drastically reduced yields. There is no available complete genetic resistance to white mold and partial resistance is only marginally effective. Further, fungicide applications specifically for white mold are only applied in years when disease is highly likely and must be applied within a narrow window to provide effective protection.

Sudden death syndrome of soybean first appeared in Arkansas in 1971 and has since spread to states across the Midwestern region of the United States (Rupe et al. 1991). The disease is caused by the soil-borne fungus *Fusarium virguliforme*, previously known as *Fusarium solani* f. sp. glycines, and is exacerbated by conditions of high soil moisture and soil compaction (Ringler, 1995; Roy et al. 1997). Symptoms of SDS include a mosaic-like appearance of leaf tissue in which main veins remain green while other leaf areas become chlorotic or necrotic, reddish discoloration of xylem tissue, blackening or rotting of root tissue, and significant reductions to overall plant health and yield. From 1994-2010, soybean yield losses to diseases caused by *Fusarium* species were estimated at c. 36.2 million bushels/year and the majority of these losses were attributed to *F. virguliforme* (Wrather et al. 2010).

Lack of effective disease management measures is the primary reason that the majority of soybean yield losses to *Fusarium* spp. during this time can be attributed to *F. virguliforme*. Due to the soilborne nature of this disease, there are few options to eradicate the pathogen once it has been introduced. Consequently, cultural methods that promote plant health, resistant cultivars, and seed treatment are preferred SDS management tactics. None of these tactics provides complete control of the disease, and options for resistant cultivars and seed treatments labeled for SDS are limited. Further, iLevo (fluopyram; Bayer CropScience), the primary seed treatment option for SDS, is expensive and has a negative impact on early-season plant health. Applications of PPFM bacteria in conjunction with other strategies to combat SDS provide an attractive method for improving suppression of this economically important disease and combating the significant yield losses to which it contributes.

SUMMARY

Provided herein are compositions comprising *Methylobacterium* that inhibit growth of a plant pathogenic fungus, methods of using the compositions to control fungal infections of plants, plant parts, and plants derived therefrom, and methods of making the compositions. Such *Methylobacterium* that inhibit growth of a plant pathogenic fungus are in certain instances referred to herein as "*Methylobacterium* that inhibit plant pathogenic fungi" or, in certain contexts, as simply "*Methylobacterium*". In certain embodiments, *Methylobacterium* that inhibit growth of a plant pathogenic fungus can be distinguished from other *Methylobacterium* that do not inhibit plant pathogenic fungi by assaying for the ability of the *Methylobacterium* to inhibit fungal disease in a plant or isolated plant part.

Provided herein are compositions comprising a mono- or co-culture of *Methylobacterium* that inhibit growth of a plant pathogenic fungus and an agriculturally acceptable excipient and/or an agriculturally acceptable adjuvant. In certain embodiments, the *Methylobacterium* sp. is selected from the group consisting of *M. aminovorans, M. extorquens, M. fujisawaense, M. mesophilicum, M. radiotolerans, M. rhodesianum, M. nodulans, M. phyllosphaerae, M. thiocyanatum*, and *M. oryzae*. In certain embodiments, the *Methylobacterium* is not *M. radiotolerans* or *M. oryzae*. In certain embodiments, the plant pathogenic fungus is selected from the group consisting of an *Alternaria* sp., an *Ascochyta* sp., an *Aspergillus* sp., a *Bipolaris* sp., a *Botrytis* sp., a *Bremia* sp., a *Cercospora* sp., a *Cochliobolus* sp., a *Colletotrichum* sp., a *Diplodia* sp., an *Erysiphe* sp., an *Exserohilum* sp., a *Fusarium* sp., *Gaeumanomyces* sp., *Macrophomina* sp., a *Magnaporthe* sp., a *Nectria* sp., a *Peronospora* sp., a *Phakopsora* sp., a *Phialophora* sp., a *Phoma* sp., a *Phymatotrichum* sp., a *Phytophthora* sp., a *Plasmopara* sp., a *Puccinia* sp., a *Podosphaera* sp., a *Pyrenophora* sp., a *Pyricularia* sp, a *Pythium* sp., a *Rhizoctonia* sp., a *Sclerotium* sp., a *Sclerotinia* sp., a *Septoria* sp., a *Stagonospora* sp., a *Thielaviopsis* sp., an *Uncinula* sp, an *Ustilago* sp., a *Venturia* sp., and a *Verticillium* sp. In certain embodiments, the *Fusarium* sp. is selected from the group consisting of *Fusarium graminearum, Fusarium verticillioides, Fusarium oxysporum, Fusarium virguliforme*, and *Fusarium solani*. In certain embodiments of any of the aforementioned compositions, the composition comprises a solid substance wherein a mono-culture or co-culture of *Methylobacterium* is adhered thereto. In certain embodiments, the plant pathogenic fungus is a *Rhizoctonia* sp. or a *Sclerotinia* sp. In certain embodiments, the *Rhizoctonia* sp. is *Rhizoctonia solani* or *Rhizoctonia cerealis*. In certain embodiments, the *Sclerotinia* sp. is *Sclerotinia sclerotiorum* or *Sclerotinia homoeocarpa*. In certain embodiments, the composition comprises a colloid formed by the solid substance wherein a mono-culture or co-culture of *Methylobacterium* is adhered thereto and a liquid. In certain embodiments, the colloid is a gel. In certain embodiments of any of the aforementioned compositions, the composition is an emulsion. In certain embodiments of any of the aforementioned compositions, the *Methylobacterium* is NLS0066 (NRRL B-50940), NLS0089 (NRRL B-50933), a combination of NLS0066 and NLS0017 (NRRL B-50931), or a derivative thereof. In certain embodiments of any of the aforementioned compositions, the composition further comprises *Methylobacterium* strain NLS0020 (NRRL B-50930) or a derivative thereof. In certain embodiments of any of the aforementioned compositions, the *Methylobacterium* is NLS0066, NLS0089, a combination of NLS0066 and NLS0017, a combination of NLS0066 and NLS0020, a combination of NLS0089 and NLS0020, or a derivative thereof. In certain embodiments, the *Methylobacterium* is NLS0089 and the plant pathogenic fungus is a *Rhizoctonia* sp. or a *Sclerotinia* sp. In certain embodiments, the *Methylobacterium* is NLS066, NLS066 and NLS0017, NLS0089, or NLS0089 and NLS0020 and the plant pathogenic fungus is *Fusarium graminearum, Cercospora zeae-maydis*, or *Colletotrichum graminicola*. In certain embodiments, the *Methylobacterium* is NLS0089, or NLS0089 and NLS0020 and the plant pathogenic fungus is *Septoria tritici, Stagonospora nodorum, Pythium* spp., *Rhizoctonia solani*, a *Fusarium* spp., *Magnaportha grisea, Pyrenophora tritici-repentis, Microdochium nivale, Sclerotinia sclerotiorum, Cercospora sojina, Cercospora kikuchii, Fusarium* spp., *Rhizoctonia solani, Fusarium virguliforme, Pythium* spp., *Rhizoctonia solani, Gibberella zeae*, or a *Pythium* spp. In certain embodiments of any of the aforementioned compositions, the *Methylobacterium* sp. that inhibits growth of a plant pathogenic fungus has at least one polymorphic DNA element or orthologous gene that is present in *Methylobacterium* isolate NLS0066 but that is absent from one or more *Methylobacterium* isolates NLS0020 and NLS0037 that do not inhibit *Fusarium graminearum* infections of plants. In certain embodiments, the *Methylobacterium* sp. that inhibits growth of a plant pathogenic fungus has at least one gene that is orthologous to, or that has at least 95%, 97%, 98%, 99%, 99.5%, or 100% sequence identity to, at least one gene selected from the group consisting of SEQ ID NO: 7279-9187, and 9188. In certain embodiments, the *Methylobacterium* sp. that inhibits growth of a plant pathogenic fungus has at least one gene that is orthologous to, or that encodes a protein having at least 95%, 97%, 98%, 99%, 99.5%, or 100% sequence identity to, at least one protein selected from the group consisting of SEQ ID NO: 2585-4593, and 4594. In any of the aforementioned embodiments, the plant pathogen fungus that is inhibited can be in its anamorphic form, its teleomorphic form, or in both its anamorphic form and its teleomorphic forms. In any of the aforementioned embodiments, the composition can comprise a fungal inhibitory concentration of the mono- or co-culture of *Methylobacterium*. In any of the aforementioned embodiments, the composition can further comprise an antifungal compound selected from the group consisting of an azole, dithiocarbamate, strobilurin, and benzimidazole. In certain embodiments, the azole is ipconazole. Use of any of the aforementioned compositions for coating or partially coating a plant part (e.g., a seed) to inhibit growth of any of the aforementioned plant pathogenic fungi is also provided herein.

Also provided are plants or plant parts that are at least partially coated with any of the aforementioned compositions comprising a mono- or co-culture of *Methylobacterium*. In certain embodiments, the at least partially coated plant or plant part is a cereal plant or cereal plant part. In certain embodiments, the at least partially coated cereal plant is selected from the group consisting of a rice, wheat, corn, barley, millet, sorghum, oat, and rye plant. In certain embodiments, the at least partially coated cereal plant part is selected from the group consisting of a rice, wheat, corn, barley, millet, sorghum, oat, and rye plant part. In certain embodiments the at least partially coated plant or plant part is a dicot plant part. In certain embodiments, the dicot plant or plant part is a soybean, peanut, or tomato plant part. In certain embodiments of any of the aforementioned plants or plant parts, the *Methylobacterium* in the composition was obtained from a plant genus, plant species, plant subspecies, or plant cultivar that is distinct from the genus, species, sub-species, or cultivar of the plant or plant part that is coated with the composition. Also provided are processed plant products that comprise a detectable amount of any of the *Methylobacterium* of any of the aforementioned compositions. In certain embodiments, the *Methylobacterium* that is detected was obtained from a plant genus, plant species, plant sub-species, or plant cultivar that is distinct from the genus, species, sub-species, or cultivar used to obtain the processed plant product. In certain embodiments, the *Methylobacterium* is NLS066, NLS066 and NLS0017, NLS0089, or NLS0089 and NLS0020, the plant pathogenic fungus that is inhibited is *Fusarium graminearum* and the plant or plant part is a wheat plant or plant part. In certain embodiments, the *Methylobacterium* is NLS066, NLS066 and NLS0017, NLS0089, or NLS0089 and NLS0020, the plant pathogenic fungus that is inhibited is *Cercospora zeae-maydis*, or *Colletotrichum graminicola*, and the plant or plant part is a corn plant or corn plant part. In certain embodiments, the *Methylobacterium* is NLS0089 or NLS0089 and NLS0020, the plant pathogenic fungus that is inhibited is *Septoria tritici, Stagonospora nodorum, Pythium* spp., *Rhizoctonia solani*, a *Fusarium* spp., *Magnaportha grisea, Pyrenophora tritici-repentis, Microdochium nivale*, and the plant or plant part is a wheat plant or wheat plant part. In certain embodiments, the *Methylobacterium* is NLS0089 or NLS0089 and NLS0020, the plant pathogenic fungus that is inhibited is *Sclerotinia sclerotiorum, Cercospora sojina, Cercospora kikuchii, Fusarium* spp., *Rhizoctonia solani, Fusarium virguliforme, Pythium* spp., and the plant or plant part is a soybean plant or soybean plant part. In certain embodiments, the *Methylobacterium* is NLS0089 or NLS0089 and NLS0020 and the plant pathogenic fungus that is inhibited is a *Fusarium* spp., *Pythium* spp., or *Gibberella zeae*, and the plant or plant part is a corn plant or corn plant part. In certain embodiments, the plant or plant part comprises a fungal inhibitory amount of the *Methylobacterium*. In certain embodiments, a fungal inhibitory amount of the *Methylobacterium* applied to a plant part (e.g., a seed) is about $1.0 \times 10^3$, $1.0 \times 10^4$, or $1.0 \times 10^5$ to about $1.0 \times 10^7$ or $1.0 \times 10^8$ CFUs of PPFM bacteria/plant part (e.g., a seed). In certain embodiments, the *Methylobacterium* is heterologous to the plant or plant part. In certain embodiments of any of the aforementioned plant parts, the plant part is a leaf, a stem, a flower, a root, a tuber, or a seed.

Also provided are methods of making any of the aforementioned compositions containing the *Methylobacterium* that inhibit growth of a plant pathogenic fungus that comprise combining a *Methylobacterium* that inhibit growth of a plant pathogenic fungus with an agriculturally acceptable excipient and/or with an agriculturally acceptable adjuvant. In certain embodiments of the methods, the *Methylobacterium* sp. is selected from the group consisting of *M. aminovorans, M. extorquens, M. fujisawaense, M. mesophilicum, M. radiotolerans, M. rhodesianum, M. nodulans, M. phyllosphaerae, M thiocyanatum*, and *M. oryzae*. In certain embodiments of the methods, the *Methylobacterium* is not *M. radiotolerans* or *M. oryzae*. In certain embodiments of the methods, the *Methylobacterium* is NLS0066, NLS0089, a combination of NLS0066 and NLS0017, or a derivative thereof. In certain embodiments of any of the aforementioned methods, the composition further comprises *Methylobacterium* strain NLS0020 or a derivative thereof. In certain embodiments of any of the aforementioned methods, the *Methylobacterium* is NLS0066, NLS0089, a combination of NLS0066 and NLS0017, a combination of NLS0066 and NLS0020, a combination of NLS0089 and NLS0020, or a derivative thereof. In certain embodiments, the plant or plant part is a soybean plant or soybean plant part. In certain embodiments, the plant or plant part is selected from the group consisting of a rice, wheat, corn, barley, millet, sorghum, oat, and rye plant or plant part. In certain embodiments, the *Methylobacterium* is NLS0089 and the plant pathogenic fungus is a *Rhizoctonia* sp. or a *Sclerotinia* sp. In certain embodiments of the methods, the *Methylobacterium* sp. that inhibit growth of a plant pathogenic fungus has at least one polymorphic DNA element or orthologous gene that is present in NLS0066 but that is absent from one or more *Methylobacterium* isolates NLS0020 and/or NLS0037 that do not inhibit *Fusarium graminearum* infections of plants. In certain embodiments of the methods, the *Methylobacterium* sp. that inhibits growth of a plant pathogenic fungus has at least one gene that is orthologous to, or that has at least 95%, 97%, 98%, 99%, 99.5%, or 100% sequence identity to, at least one gene selected from the group consisting of SEQ ID NO: 7279-9187, and 9188. In certain embodiments of the methods, the *Methylobacterium* sp. that inhibits growth of a plant pathogenic fungus has at least one gene that is orthologous to, or that encodes a protein having at least 95%, 97%, 98%, 99%, 99.5%, or 100% sequence identity to, at least one protein selected from the group consisting of SEQ ID NO: 2585-4593, and 4594. In certain embodiments of the methods, the plant pathogenic fungus is selected from the group consisting of an *Alternaria* sp., an *Ascochyta* sp., an *Aspergillus* sp., a *Bipolaris* sp., a *Botrytis* sp., a *Bremia* sp., a *Cercospora* sp., a *Cochliobolus* sp., a *Colletotrichum* sp., a *Diplodia* sp., an *Erysiphe* sp., an *Exserohilum* sp., a *Fusarium* sp., *Gaeumanomyces* sp., *Macrophomina* sp., a *Magnaporthe* sp., a *Nectria* sp., a *Peronospora* sp., a *Phakopsora* sp., a *Phialophora* sp., a *Phoma* sp., a *Phymatotrichum* sp., a *Phytophthora* sp., a *Plasmopara* sp., a *Puccinia* sp., a *Podosphaera* sp., a *Pyrenophora* sp., a *Pyricularia* sp, a *Pythium* sp., a *Rhizoctonia* sp., a *Sclerotium* sp., a *Sclerotinia* sp., a *Septoria* sp., a *Stagonospora* sp., a *Thielaviopsis* sp., an *Uncinula* sp, an *Ustilago* sp., a *Venturia* sp., and a *Verticillium* sp. In certain embodiments of the methods, the plant pathogenic fungus is a *Fusarium* sp. In certain embodiments of the methods, the *Fusarium* sp. is selected from the group consisting of *Fusarium graminearum, Fusarium verticillioides, Fusarium oxysporum, Fusarium virguliforme*, and *Fusarium solani*. In certain embodiments of any of the aforementioned methods, the mono- or co-culture of *Methylobacterium* is adhered to a solid substance. In certain embodiments of the methods, the *Methylobacterium* that is adhered to the solid substance is combined with a liquid to form a composition that is a colloid. In certain embodiments of the methods, the colloid is a gel. In certain embodiments of the methods, the mono- or co-culture of *Methylobacterium* adhered to the solid substance is provided by culturing the *Methylobacterium* in the presence of the solid substance. In certain embodiments of the methods, the composition comprises an emulsion. In certain embodiments of the methods, the *Methylobacterium* is provided by culturing the *Methylobacterium* in an emulsion. In any of the aforementioned embodiments, the plant pathogen fungus that is inhibited can be in its anamorphic form, its teleomorphic form, or in both its anamorphic and teleomorphic forms. In any of the aforementioned embodiments, the composition can further comprise an antifungal compound selected from the group consisting of an azole, dithiocarbamate, strobilurin, and benzimidazole. In certain embodiments, the azole is ipconazole.

Also provided are methods for controlling a plant pathogenic fungus that comprise applying any of the aforementioned compositions that contain a *Methylobacterium* that inhibits growth of a plant pathogenic fungus to a plant or a plant part in an amount that provides for inhibition of infection by the plant pathogenic fungus in the plant, plant part, or a plant obtained therefrom relative to infection of a control plant, plant part, or plant obtained therefrom that had not received an application of the composition. In certain embodiments of the methods, the application of the composition provides for at least 40%, 50%, 75%, at least 85%, or at least 95% inhibition of a plant pathogenic fungal infection in the plant, plant part, or a plant derived therefrom relative to infection of the control plant, plant part, or plant obtained therefrom. In certain embodiments of the methods, the plant part is selected from the group consisting of a leaf, a stem, a flower, a root, a tuber, and a seed. In certain embodiments of the methods, the method further comprises the step of harvesting at least one plant part selected from the group consisting of a leaf, a stem, a flower, a root, a tuber, or a seed from the plant or plant part. In certain embodiments of the methods, the mycotoxin levels in the plant part are reduced by at least 50%, at least 75%, at least 85%, or at least 95% relative to a plant part obtained from the control plant, plant part, or plant obtained therefrom. In certain embodiments of the aforementioned methods, the method further comprises obtaining a processed food or feed composition from the plant or plant part. In certain embodiments of the aforementioned methods, the mycotoxin levels in the processed food or feed composition are reduced by at least 50%, at least 75%, at least 85%, or at least 95% relative to a processed food or feed composition obtained from the control plant, plant part, or plant obtained therefrom. In certain embodiments, a fungal inhibitory amount of the *Methylobacterium* is applied to the plant part. In certain embodiments, the fungal inhibitory amount of the *Methylobacterium* applied to a plant part (e.g., a seed) is about $1.0\times10^3$, $1.0\times10^4$, or $1.0\times10^5$ to about $1.0\times10^7$, $1.0\times10^8$, $1.0\times10^9$, or $1.0\times10^{10}$ CFUs of *Methylobacterium*/plant part (e.g., a seed). In certain embodiments, the *Methylobacterium* is heterologous to the plant or plant part. In certain embodiments of any of the aforementioned methods, the plant part is a leaf, a stem, a flower, a root, a tuber, or a seed. In certain embodiments of the methods, the *Methylobacterium* is NLS0066, NLS0089, a combination of NLS0066 and NLS0017, or a derivative thereof. In certain embodiments of any of the aforementioned methods, the composition further comprises *Methylobacterium* strain NLS0020 or a derivative thereof. In certain embodiments of any of the aforementioned methods, the *Methylobacterium* is NLS0066, NLS0089, a combination of NLS0066 and NLS0017, a combination of NLS0066 and NLS0020, a combination of NLS0089 and NLS0020, or a derivative thereof. In certain embodiments, the plant or plant part is a soybean plant or soybean plant part. In certain embodiments, the plant or plant part is selected from the group consisting of a rice, wheat, corn, barley, millet, sorghum, oat, and rye plant or plant part. In certain embodiments, the *Methylobacterium* is NLS0089 and the plant pathogenic fungus is a *Rhizoctonia* spp. or a *Sclerotinia* spp. In certain embodiments, the *Methylobacterium* is NLS066, NLS066 and NLS0017, NLS0089, or NLS0089 and NLS0020, the plant pathogenic fungus that is inhibited is *Fusarium graminearum* and the plant or plant part is a wheat plant or plant part. In certain embodiments, the *Methylobacterium* is NLS066, NLS066 and NLS0017, NLS0089, or NLS0089 and NLS0020, the plant pathogenic fungus that is inhibited is *Cercospora zeae-maydis*, or *Colletotrichum graminicola*, and the plant or plant part is a corn plant or corn plant part. In certain embodiments, the *Methylobacterium* is NLS0089 or NLS0089 and NLS0020, the plant pathogenic fungus that is inhibited is *Septoria tritici, Stagonospora nodorum, Pythium* spp., *Rhizoctonia solani*, a *Fusarium* spp., *Magnaportha grisea, Pyrenophora tritici-repentis, Microdochium nivale*, and the plant or plant part is a wheat plant or wheat plant part. In certain embodiments, the *Methylobacterium* is NLS0089 or NLS0089 and NLS0020, the plant pathogenic fungus that is inhibited is *Sclerotinia sclerotiorum, Cercospora sojina, Cercospora kikuchii, Fusarium* spp., *Rhizoctonia solani, Fusarium virguliforme, Pythium* spp., and the plant or plant part is a soybean plant or soybean plant part. In certain embodiments, the *Methylobacterium* is NLS0089 or NLS0089 and NLS0020 and the plant pathogenic fungus that is inhibited is a *Fusarium* spp., *Pythium* spp., or *Gibberella zeae*, and the plant or plant part is a corn plant or corn plant part.

Also provided are isolated *Methylobacterium* that inhibit growth of a plant pathogenic fungus. In certain embodiments, the *Methylobacterium* has at least one polymorphic DNA element or orthologous gene that is present in NLS0066 but that is absent from one or more *Methylobacterium* isolates NLS0020 and/or NLS0037 that do not inhibit *Fusarium graminearum* infections of plants. In certain embodiments, the *Methylobacterium* sp. that inhibits growth of a plant pathogenic fungus has at least one gene that is orthologous to, or that has at least 95%, 97%, 98%, 99%, 99.5%, or 100% sequence identity to, at least one gene selected from the group consisting of SEQ ID NO: 7279-9187, and 9188. In certain embodiments, the *Methylobacterium* sp. that inhibits growth of a plant pathogenic fungus has at least one gene that is orthologous to, or that encodes a protein having at least 95%, 97%, 98%, 99%, 99.5%, or 100% sequence identity to, at least one protein selected from the group consisting of SEQ ID NO: 2585-4593, and 4594. In certain embodiments, the *Methylobacterium* is selected from the group consisting of *M. aminovorans, M. extorquens, M. fujisawaense, M. mesophilicum, M. radiotolerans, M. rhodesianum, M. nodulans, M. phyllosphaerae, M. thiocyanatum*, and *M. oryzae*. In certain embodiments, the *Methylobacterium* is not *M. radiotolerans* or *M. oryzae*. In certain embodiments, the plant pathogenic fungus is selected from the group consisting of an *Alternaria* sp., an *Ascochyta* sp., an *Aspergillus* sp., a *Bipolaris* sp., a *Botrytis* sp., a *Bremia* sp., a *Cercospora* sp., a *Cochliobolus* sp., a *Colletotrichum* sp., a *Diplodia* sp., an *Erysiphe* sp., an *Exserohilum* sp., a *Fusarium* sp., *Gaeumanomyces* sp., *Macrophomina* sp., a *Magnaporthe* sp., a *Nectria* sp., a *Peronospora* sp., a *Phakopsora* sp., a *Phialophora* sp., a *Phoma* sp., a *Phymatotrichum* sp., a *Phytophthora* sp., a *Plasmopara* sp., a *Puccinia* sp., a *Podosphaera* sp., a *Pyrenophora* sp., a *Pyricularia* sp, a *Pythium* sp., a *Rhizoctonia* sp., a *Sclerotium* sp., a *Sclerotinia* sp., a *Septoria* sp., a *Stagonospora* sp., a *Thielaviopsis* sp., an *Uncinula* sp, an *Ustilago* sp., a *Venturia* sp., and a *Verticillium* sp. In any of the aforementioned embodiments, the plant pathogen fungi that is inhibited can be in its anamorphic form, its teleomorphic form, or in both its anamorphic and teleomorphic forms.

BRIEF DESCRIPTION OF THE DRAWINGS

The accompanying drawings, which are incorporated in and form a part of the specification, illustrate certain embodiments of the present disclosure. In the drawings.

DESCRIPTION

Definitions

Figure 1:
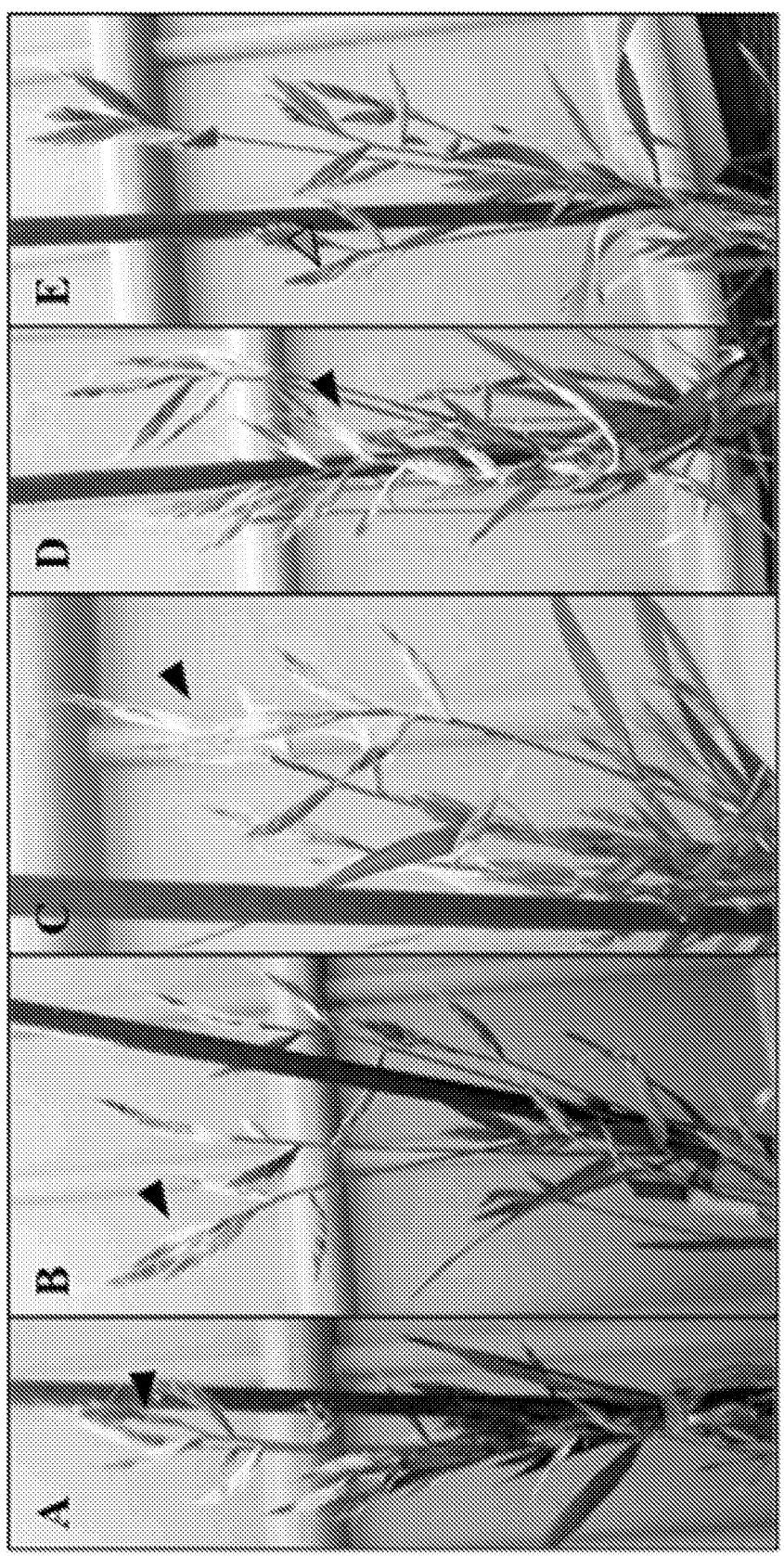
FIG. 1 is a photograph of representative disease outcomes on PPFM-treated *Brachypodium distachyon* plants. Black arrowheads indicate significant disease development, as evidenced by the presence of abundant white fungal mycelia and spikelet necrosis, on plants receiving A) no-PPFM control treatment, B) PPFM strain NLS0017 seed treatment, C) PPFM strain NLS0020 seed treatment and D) PPFM strain NLS0037 seed treatment. Plants receiving E) seed treatment with PPFM strain NLS0066 had significantly reduced spikelet necrosis and abundance of fungal mycelia, as indicated by the grey arrowhead.

As used herein, the phrases "adhered thereto" and "adherent" refer to *Methylobacterium* that are associated with a solid substance by growing, or having been grown, on a solid substance.

As used herein, the phrase "agriculturally acceptable adjuvant" refers to a substance that enhances the performance of an active agent in a composition comprising a mono-culture or co-culture of *Methylobacterium* for treatment of plants and/or plant parts.

As used herein, the phrase "agriculturally acceptable excipient" refers to an essentially inert substance that can be used as a diluent and/or carrier for an active agent in a composition for treatment of plants and/or plant parts. In certain compositions, an active agent can comprise a mono-culture or co-culture of *Methylobacterium*.

As used herein, the phrase "derivatives thereof", when used in the context of a *Methylobacterium* isolate, refers to any strain that is obtained from the *Methylobacterium* isolate. Derivatives of a *Methylobacterium* isolate include, but are not limited to, variants of the strain obtained by selection, variants of the strain selected by mutagenesis and selection, and genetically transformed strains obtained from the *Methylobacterium* isolate.

As used herein, the term "*Methylobacterium*" refers to bacteria that are facultative methylotrophs of the genus *Methylobacterium*. The term *Methylobacterium*, as used herein, thus does not encompass includes species in the genera *Methylobacter, Methylomonas, Methylomicrobium, Methylococcus, Methylosinus, Methylocystis, Methylosphaera, Methylocaldum*, and *Methylocella*, which are obligate methanotrophs.

As used herein, the phrase "co-culture of *Methylobacterium*" refers to a *Methylobacterium* culture comprising at least two strains of *Methylobacterium* or at least two species of *Methylobacterium*.

As used herein, the term "cultivar" refers to any plant known only in cultivation and includes asexually propagated plants, sexually propagated plants, inbred lines, and hybrids.

As used herein, the phrase "contaminating microorganism" refers to microorganisms in a culture, fermentation broth, fermentation broth product, or composition that were not identified prior to introduction into the culture, fermentation broth, fermentation broth product, or composition.

As used herein, the term "emulsion" refers to a colloidal mixture of two immiscible liquids wherein one liquid is the continuous phase and the other liquid is the dispersed phase. In certain embodiments, the continuous phase is an aqueous liquid and the dispersed phase is liquid that is not miscible, or partially miscible, in the aqueous liquid.

As used herein, the phrase "essentially free of contaminating microorganisms" refers to a culture, fermentation broth, fermentation product, or composition where at least about 95% of the microorganisms present by amount or type in the culture, fermentation broth, fermentation product, or composition are the desired *Methylobacterium* or other desired microorganisms of pre-determined identity.

As used herein, the phrase "a fungal inhibitory concentration of the mono- or co-culture of *Methylobacterium*" is a concentration that provides for at least a 40%, 50%, 75%, at least 85%, or at least 95% inhibition of a plant pathogenic fungal infection in a plant, plant part, or a plant derived therefrom relative to infection of the control plant or plant part.

As used herein, the term "heterologous", when used in the context of *Methylobacterium* that at least partially coats a plant or plant part, refers to a *Methylobacterium* that is not naturally associated with a plant or plant part of the same species as the plant or plant part that is at least partially coated with the *Methylobacterium*. In certain embodiments, the heterologous *Methylobacterium* that is used to at least partially coat a plant or plant part of a first plant species is a *Methylobacterium* that was isolated, or can be isolated, from a second and distinct plant species.

As used herein, the phrase "inanimate solid substance" refers to a substance which is insoluble or partially soluble in water or aqueous solutions and which is either non-living or which is not a part of a still-living organism from which it was derived.

As used herein, the phrase "mono-culture of *Methylobacterium*" refers to a *Methylobacterium* culture consisting of a single strain of *Methylobacterium*.

As used herein, a "pesticide" refers to an agent that is insecticidal, fungicidal, nematocidal, bacteriocidal, or any combination thereof.

As used herein, the phrase "bacteriostatic agent" refers to agents that inhibit growth of bacteria but do not kill the bacteria.

As used herein, the phrase "pesticide does not substantially inhibit growth of the *Methylobacterium*" refers to any pesticide that when provided in a composition comprising a fermentation product comprising a solid substance wherein a mono-culture or co-culture of *Methylobacterium* is adhered thereto, results in no more than a 50% inhibition of *Methylobacterium* growth when the composition is applied to a plant or plant part in comparison to a composition lacking the pesticide. In certain embodiments, the pesticide results in no more than a 40%, 20%, 10%, 5%, or 1% inhibition of *Methylobacterium* growth when the composition is applied to a plant or plant part in comparison to a composition lacking the pesticide.

As used herein, the term "PPFM bacteria" refers without limitation to bacterial species in the genus *Methylobacterium* other than *M. nodulans*.

As used herein, the phrase "solid substance" refers to a substance which is insoluble or partially soluble in water or aqueous solutions.

As used herein, the phrase "solid phase that can be suspended therein" refers to a solid substance that can be distributed throughout a liquid by agitation.

As used herein, the term "non-regenerable" refers to either a plant part or processed plant product that cannot be regenerated into a whole plant.

As used herein, the phrase "substantially all of the solid phase is suspended in the liquid phase" refers to media wherein at least 95%, 98%, or 99% of solid substance(s) comprising the solid phase are distributed throughout the liquid by agitation.

As used herein, the phrase "substantially all of the solid phase is not suspended in the liquid phase" refers to media where less than 5%, 2%, or 1% of the solid is in a particulate form that is distributed throughout the media by agitation.

To the extent to which any of the preceding definitions is inconsistent with definitions provided in any patent or non-patent reference incorporated herein by reference, any patent or non-patent reference cited herein, or in any patent or non-patent reference found elsewhere, it is understood that the preceding definition will be used herein.

Methylobacterium that Inhibit Plant Pathogenic Fungi, Compositions Comprising Methylobacterium that Inhibit Plant Pathogenic Fungi, Methods of their Use, and Methods of Making Various Methylobacterium that inhibit plant pathogenic fungi, compositions comprising these Methylobacterium, methods of using the compositions to inhibit plant pathogenic fungi, and methods of making the compositions are provided herein. As used herein, inhibition of the growth of a plant pathogenic fungus includes any measurable decrease in fungal growth, where fungal growth includes but is not limited to any measurable decrease in the numbers and/or extent of fungal cells, spores, conidia, or mycelia. As used herein, inhibition of infection by a plant pathogenic fungus and/or inhibition of the growth of a plant pathogenic fungus are also understood to include any measurable decrease in the adverse effects caused by fungal growth in a plant. Adverse effects of fungal growth in a plant include, but are not limited to, any type of plant tissue damage or necrosis, any type of plant yield reduction, any reduction in the value of the crop plant product, and/or production of undesirable fungal metabolites or fungal growth by-products including, but not limited to, mycotoxins. Plant pathogen fungi that are inhibited by the compositions and Methylobacterium provided herein can be in their anamorphic form, their teleomorphic form, or in both their anamorphic and teleomorphic forms.

Methylobacterium and compositions comprising the same that inhibit growth of a plant pathogenic fungus are provided herein. In certain embodiments, the Methylobacterium is selected from the group consisting of M. aminovorans, M. extorquens, M. fujisawaense, M. mesophilicum, M. radiotolerans, M. rhodesianum, M. nodulans, M. phyllosphaerae, M. thiocyanatum, and M. oryzae. In certain embodiments, Methylobacterium is not M. radiotolerans or M. oryzae. In certain embodiments, the Methylobacterium or composition provides for at least about 25%, at least about 40%, at least about 50%, or at least about 75% inhibition of plant pathogenic fungal growth in comparison to a control treatment upon exposure to a plant pathogenic fungus. In certain embodiments, the plant pathogenic fungus that is inhibited is selected from the group consisting of an Alternaria sp., an Ascochyta sp., an Aspergillus sp., a Bipolaris sp., a Botrytis sp., a Bremia sp., a Cercospora sp., a Cochliobolus sp., a Colletotrichum sp., a Diplodia sp., an Erysiphe sp., an Exserohilum sp., a Fusarium sp., Gaeumanomyces sp., a Macrophomina sp., a Magnaporthe sp., a Nectria sp., a Peronospora sp., a Phakopsora sp., a Phialophora sp., a Phoma sp., a Phymatotrichum sp., a Phytophthora sp., a Plasmopara sp., a Puccinia sp., a Podosphaera sp., a Pyrenophora sp., a Pyricularia sp, a Pythium sp., a Rhizoctonia sp., a Sclerotium sp., a Sclerotinia sp., a Septoria sp., a Stagonospora sp., a Thielaviopsis sp., an Uncinula sp, an Ustilago sp., a Venturia sp., and a Verticillium sp. In certain embodiments, the plant pathogenic fungus that is inhibited is a Fusarium sp. In certain embodiments, the Fusarium sp. that is inhibited is selected from the group consisting of Fusarium graminearum, Fusarium verticillioides, Fusarium oxysporum, Fusarium virguliforme, and Fusarium solani. In certain embodiments, the isolated Methylobacterium is NLS0066, NLS0089, a combination of NLS0066 and NLS0017, or a derivative thereof. In certain embodiments, the composition further comprises Methylobacterium strain NLS0020 or a derivative thereof. Plant pathogen fungi that are inhibited by the compositions and Methylobacterium provided herein can be in their anamorphic form, their teleomorphic form, or in both their anamorphic and teleomorphic forms.

Also provided are compositions that comprise Methylobacterium that inhibit growth of a plant pathogenic fungus. In certain embodiments, the compositions further comprise an agriculturally acceptable excipient and/or an agriculturally acceptable adjuvant. In certain embodiments, the Methylobacterium sp. is selected from the group consisting of M. aminovorans, M. extorquens, M. fujisawaense, M. mesophilicum, M. radiotolerans, M. rhodesianum, M. nodulans, M. phyllosphaerae, M. thiocyanatum, and M. oryzae. In certain embodiments, the Methylobacterium is not M. radiotolerans or M. oryzae. In certain embodiments, a the composition provides for at least about 25%, about 50%, or about 75% inhibition of plant pathogenic fungal growth in comparison to a control treatment upon exposure to a plant pathogenic fungus. In certain embodiments, the plant pathogenic fungus that is inhibited is selected from the group consisting of an Alternaria sp., an Ascochyta sp., an Aspergillus sp., a Bipolaris sp., a Botrytis sp., a Bremia sp., a Cercospora sp., a Cochliobolus sp., a Colletotrichum sp., a Diplodia sp., an Erysiphe sp., an Exserohilum sp., a Fusarium sp., Gaeumanomyces sp., a Macrophomina sp., a Magnaporthe sp., a Nectria sp., a Peronospora sp., a Phakopsora sp., a Phialophora sp., a Phoma sp., a Phymatotrichum sp., a Phytophthora sp., a Plasmopara sp., a Puccinia sp., a Podosphaera sp., a Pyrenophora sp., a Pyricularia sp, a Pythium sp., a Rhizoctonia sp., a Sclerotium sp., a Sclerotinia sp., a Septoria sp., a Stagonospora sp., a Thielaviopsis sp., an Uncinula sp, an Ustilago sp., a Venturia sp., and a Verticillium sp. In certain embodiments, the plant pathogenic fungus that is inhibited is a Fusarium sp. In certain embodiments, the Fusarium sp., which is inhibited is selected from the group consisting of Fusarium graminearum, Fusarium verticillioides, Fusarium oxysporum, Fusarium virguliforme, and Fusarium solani. In certain embodiments of any of the aforementioned compositions, the composition comprises a solid substance wherein a mono-culture or co-culture of Methylobacterium is adhered thereto. In certain embodiments where the Methylobacterium is adhered to a solid substance, the composition comprises a colloid formed by the solid substance wherein a mono-culture or co-culture of Methylobacterium is adhered thereto and a liquid. In certain embodiments, the colloid is a gel. In certain embodiments of certain aforementioned compositions, composition is an emulsion that does not contain a solid substance. In certain embodiments of any of the aforementioned compositions, the Methylobacterium has at least one polymorphic DNA element or orthologous gene that is present in NLS0066 but that is absent from one or more Methylobacterium isolates NLS0020 and/or NLS0037 that do not inhibit Fusarium graminearum infections of plants. In certain embodiments of any of the aforementioned compositions, the Methylobacterium sp. that inhibits growth of a plant pathogenic fungus has at least one gene that is orthologous to, or that has at least 95%, 97%, 98%, 99%, 99.5%, or 100% sequence identity to, at least one gene selected from the group consisting of SEQ ID NO: 7279-9187, and 9188. In certain embodiments of any of the aforementioned compositions, the *Methylobacterium* sp. that inhibits growth of a plant pathogenic fungus has at least one gene that is orthologous to, or that encodes a protein having at least 95%, 97%, 98%, 99%, 99.5%, or 100% sequence identity to at least one protein selected from the group consisting of SEQ ID NO: 2585-4593, and 4594. In certain embodiments of any of the aforementioned compositions, the *Methylobacterium* is NLS0066, NLS0089, a combination of NLS0066 and NLS0017, or a derivative thereof. In certain embodiments of any of the aforementioned compositions, the composition further comprises *Methylobacterium* strain NLS0020 or a derivative thereof. In any of the aforementioned embodiments, the plant pathogen fungi that are inhibited can be in their anamorphic form, their teleomorphic form, or in both their anamorphic and teleomorphic forms.

In certain embodiments, the *Methylobacterium* sp. inhibit plant pathogenic fungi can be identified by testing newly isolated candidate *Methylobacterium* sp. for the presence of polymorphic nucleic acid, orthologous gene, or gene sequences that are present in *Methylobacterium* sp. provided herein that inhibit certain plant pathogenic fungi and that are absent from *Methylobacterium* sp. provided herein that do not inhibit *Fusarium graminearum* infections of plants. A candidate *Methylobacterium* sp. has at least one gene that is orthologous to a gene present in *Methylobacterium* sp. that inhibits certain plant pathogenic fungi when a chromosome and/or any extrachromosomal DNA in that candidate *Methylobacterium* sp.: (i) contains a gene encoding a protein that has at least 50%, at least 60%, at least 70%, at least 80%, at least 90%, at least 95%, at least 97%, at least 98%, at least 99%, or 100% sequence identity across the entire length of the amino acid sequence of that protein that is present in the *Methylobacterium* sp. that inhibits certain plant pathogenic fungi; or (ii) contains a gene that has at least 50%, at least 60%, at least 70%, at least 80%, at least 90%, at least 95%, at least 97%, at least 98%, at least 99%, at least 99.5%, or 100% sequence identity across the entire length of the nucleic acid sequence of that gene that is present in the *Methylobacterium* sp. that inhibits certain plant pathogenic fungi. In certain embodiments, the polymorphic nucleic acid, orthologous gene, or gene sequences that are present in the identified *Methylobacterium* sp. that inhibit certain plant pathogenic fungi are also present in the *Methylobacterium* sp. isolate NLS0066 provided herein that inhibit certain plant pathogenic fungi but are absent from one or more of the *Methylobacterium* sp. isolates NLS0020 and/or NLS0037 provided herein that do not inhibit *Fusarium graminearum* infections of plants. In certain embodiments, the polymorphic nucleic acid, orthologous gene, or gene sequences that are present in the identified *Methylobacterium* sp. that inhibit plant pathogenic fungi are present in the *Methylobacterium* sp. isolate NLS0066 but are absent in two of the *Methylobacterium* sp. isolates NLS0020 and NLS0037 that do not inhibit *Fusarium graminearum* infections of plants. In certain embodiments, protein sequences present in NLS0066 that can be useful in identifying *Methylobacterium* that inhibit plant pathogenic fungi include, but are not limited to, SEQ ID NO: 2585-4594. Corresponding gene sequences (i.e. nucleic acid sequences) present in NLS0066 that can be useful in identifying *Methylobacterium* that inhibit plant pathogenic fungi include, but are not limited to, SEQ ID NO: 7279-9188. In certain embodiments, a *Methylobacterium* that inhibits plant pathogenic fungi has at least one gene that is orthologous to, or has at least 95%, 97%, 98%, 99%, 99.5%, or 100% sequence identity to at least one gene selected from the group consisting of SEQ ID NO: 7279-9187, and 9188. In certain embodiments, the *Methylobacterium* that inhibits plant pathogenic fungi has at least one gene that encodes a protein having at least 95%, 97%, 98%, 99%, 99.5%, or 100% sequence identity to at least one protein selected from the group consisting of SEQ ID NO: 2585-4593, and 4594. In certain embodiments, the *Methylobacterium* sp. that inhibits plant pathogenic fungi can also have at least one, two, three, four, six, eight, 10, 15, 20, or 50 genes encoding proteins that are: (i) orthologous to proteins having an amino acid sequence of SEQ ID NO: 2585-4593, and 4594; or that (ii) encode proteins having at least 95%, 97%, 98%, 99%, 99.5%, or 100% sequence identity to a protein selected from the group consisting of SEQ ID NO: 2585-4593, and 4594. In certain embodiments, the *Methylobacterium* sp. that inhibits plant pathogenic fungi can have at least one, two, three, four, six, eight, 10, 15, 20, or 50 genes that are orthologous to, or that have at least 95%, 97%, 98%, 99%, 99.5%, or 100% sequence identity to, one or more gene(s) selected from the group consisting of SEQ ID NO: 7279-9187, and 9188.

Such nucleic acid polymorphisms that occur in the *Methylobacterium* sp. that inhibit plant pathogenic fungi can include, but are not limited to, single nucleotide polymorphisms, RFLP, AFLP and/or other DNA variations such as repetitive sequences, insertion sequences, transposons, and genomic islands occurring as a result of insertions, deletions, and substitutions (Indels) in the bacterial genome which includes both the chromosomal DNA as well as any extrachromosomal nucleic acid elements that can be present in the *Methylobacterium* sp. that inhibit plant pathogenic fungi. Such extrachromosomal nucleic acid elements include, but are not limited to, plasmids, bacteriophage DNA or RNA, and the like. Methods used to identify such nucleotide polymorphisms include, but are not limited to, single base extension (SBE) techniques, allele specific hybridization (ASH), real-time PCR detection (i.e. TaqMan™; U.S. Pat. Nos. 5,804,375; 5,538,848; 5,487,972; and 5,210,015, which are each incorporated herein by reference in their entireties), combinations of ASH and RT-PCR (KASP™ detection systems, LGC Genomics, Middlesex, UK) and deep sequencing techniques (U.S. Patent Appl. No. 20120264632, incorporated herein by reference in its entirety).

A *Methylobacterium* sp. can be determined to contain a gene encoding a protein that is orthologous to a protein that is present in a *Methylobacterium* sp. that inhibits plant pathogenic fungi but absent from one or more of the *Methylobacterium* sp. isolates by a variety of different techniques. In certain embodiments, a *Methylobacterium* sp. can be determined to contain a gene encoding a protein that is orthologous to a protein that is present in NLS0066 but absent from one or more of the *Methylobacterium* sp. isolates NLS0020 and/or NLS0037 or that is orthologous to a protein present in NLS0066. In certain embodiments, a *Methylobacterium* sp. can be determined to contain a gene encoding a protein that is orthologous to such proteins by assembling a complete electronic genomic sequence comprising chromosomal and extrachromosomal DNA sequences present in that *Methylobacterium* sp. with a computer and associated software, and determining if any of the open reading frames (ORF) present in that DNA sequence encode a protein having the aforementioned percent sequence identity. In certain embodiments, the ORF can be identified by performing a six-way translation of the electronically assembled sequence and querying the translated sequences with a protein sequence that is present in NLS0066 but absent from one or more of the *Methylobacterium* sp. isolates NLS0020 and/or NLS0037 or with an amino acid sequence of SEQ ID NO: 2585-4594. In other embodiments, the presence or absence of a given sequence within a *Methylobacterium* sp. can be determined by a nucleic acid analysis or protein analysis technique. Examples of nucleic acid sequences that encode the proteins of SEQ ID NO: 2585-4594 include, but are not limited to, SEQ ID NO: 7279-9188 respectively. Such nucleic acid analyses include, but are not limited to, techniques based on nucleic acid hybridization, polymerase chain reactions, mass spectroscopy, nanopore based detection, branched DNA analyses, combinations thereof, and the like. Protein analysis techniques include, but are not limited to, immunodetection, mass spectroscopy, combinations thereof, and the like.

Protein and gene sequences found in the *Methylobacterium* isolate NLS0017 are also provided herewith as SEQ ID NO: 1-2584 and 4595-7278, respectively. *Methylobacterium* isolate NLS0017 has been deposited as NRRL B-50931 with the AGRICULTURAL RESEARCH SERVICE CULTURE COLLECTION (NRRL) of the National Center for Agricultural Utilization Research, Agricultural Research Service, U.S. Department of Agriculture, 1815 North University Street, Peoria, Ill. 61604 U.S.A. under the terms of the Budapest Treaty on the International Recognition of the Deposit of Microorganisms for the Purposes of Patent Procedure). The identification of SEQ ID NO: 1-9188 is described in the co-assigned International Patent Application PCT/US2014/068611, which is incorporated herein by reference in its entirety. Various *Methylobacterium* sp. isolates provided herein are disclosed in Table 1.

TABLE 1

*Methylobacterium* sp. isolates

| NLS | Inhibition of *Fusarium graminearum* | Origin | USDA ARS NRRL No.[1] |
|---|---|---|---|
| NLS0017 | –[2] | Obtained from a peppermint plant grown in Saint Louis County, Missouri, USA | NRRL B-50931 |
| NLS0020 | – | Obtained from a horse nettle plant grown in Saint Louis County, Missouri, USA | NRRL B-50930 |
| NLS0037 | – | Obtained from a tomato plant (cultivar "Champion") grown in Saint Louis County, Missouri, USA | NRRL B-50941 |
| NLS0066 | + | Obtained from the corn hybrid "MC534" (Masters Choice 3010 State Route 146 East Anna, IL 62906) | NRRL B-50940 |
| NLS0089 | + | Obtained from a broccoli plant grown in Saint Louis County, Missouri, USA | NRRL B-50933 |

[1]Deposit number for strain deposited with the AGRICULTURAL RESEARCH SERVICE CULTURE COLLECTION (NRRL) of the National Center for Agricultural Utilization Research, Agricultural Research Service, U.S. Department of Agriculture, 1815 North University Street, Peoria, Illinois 61604 U.S.A. under the terms of the Budapest Treaty on the International Recognition of the Deposit of Microorganisms for the Purposes of Patent Procedure. Subject to 37 CFR §1.808(b), all restrictions imposed by the depositor on the availability to the public of the deposited material will be irrevocably removed upon the granting of any patent from this patent application.
[2]Can improve activity of NLS0066 in a combined NLS0066 + NLS0017 treatment in comparison to NLS0066 alone.

Also provided herein are methods for controlling a plant pathogenic fungus that comprise applying any of the aforementioned compositions comprising the *Methylobacterium* that are provided herein to a plant or a plant part in an amount that provides for inhibition of infection by the plant pathogenic fungus in the plant, plant part, or a plant obtained therefrom relative to infection of a control plant, plant part, or plant obtained therefrom that had not received an application of the composition. In certain embodiments, application of the composition provides for at least about 40%, at least about 50%, at least about 75%, at least about 85%, or at least about 95% inhibition of a plant pathogenic fungal infection in the plant, plant part, or a plant derived therefrom relative to infection of the control plant, plant part, or plant obtained therefrom. In certain embodiments, the plant part is selected from the group consisting of a leaf, a stem, a flower, a root, a tuber, and a seed. In certain embodiments, the method further comprises the step of harvesting at least one plant part selected from the group consisting of a leaf, a stem, a flower, a root, a tuber, or a seed from the plant or plant part. In certain embodiments of any of the aforementioned methods, the mycotoxin levels in the plant part are reduced by at least 50%, at least 75%, at least 85%, or at least 95% relative to a plant part obtained from the control plant, plant part, or plant obtained therefrom. In certain embodiments of any of the aforementioned methods, the methods further comprise obtaining a processed food or feed composition from the plant or plant part. In certain embodiments of the aforementioned methods, mycotoxin levels in the processed food or feed composition are reduced by at least 50%, at least 75%, at least 85%, or at least 95% relative to a processed food or feed composition obtained from the control plant, plant part, or plant obtained therefrom. In certain embodiments of any of the aforementioned methods, the composition comprises a *Methylobacterium* that has at least one polymorphic DNA element, orthologous gene, or gene that is present in NLS0066 but that is absent from one or more *Methylobacterium* isolates NLS0020 and/or NLS0037 that do not inhibit *Fusarium graminearum* infections of plants. In certain embodiments of any of the aforementioned methods, the composition comprises the *Methylobacterium* isolate NLS0066, NLS0089, a combination of NLS0066 and NLS0017, or a derivative thereof. In certain embodiments of any of the aforementioned methods, the composition further comprises *Methylobacterium* strain NLS0020 or a derivative thereof. In certain embodiments of any of the aforementioned methods, the composition comprises a *Methylobacterium* sp. that has at least one gene that is orthologous to, or that has at least 95%, 97%, 98%, 99%, 99.5%, or 100% sequence identity to, at least one gene selected from the group consisting of SEQ ID NO: 7279-9187, and 9188. In certain embodiments of any of the aforementioned methods, the composition comprises a *Methylobacterium* sp. that has at least one gene that that is orthologous to, or that encodes a protein having at least 95%, 97%, 98%, 99%, 99.5%, or 100% sequence identity to, at least one protein selected from the group consisting of SEQ ID NO: 2585-4593, and 4594.

Also provided are methods of making the compositions useful for controlling plant pathogenic fungi that comprise combining a *Methylobacterium* that inhibit growth of a plant pathogenic fungus with an agriculturally acceptable excipient and/or with an agriculturally acceptable adjuvant. In certain embodiments of the methods, the *Methylobacterium* sp. is selected from the group consisting of *M. aminovorans, M. extorquens, M. fujisawaense, M. mesophilicum, M. radiotolerans, M. rhodesianum, M. nodulans, M. phyl-*

*losphaerae, M thiocyanatum*, and *M. oryzae*. In certain embodiments of the methods, the *Methylobacterium* is not *M. radiotolerans* or *M. oryzae*. In certain embodiments of the methods, the *Methylobacterium* that has at least one polymorphic DNA element that is present in NLS0066 but that is absent from one or more *Methylobacterium* isolates NLS0020 and/or NLS0037 that do not inhibit *Fusarium graminearum* infections of plants. In certain embodiments of any of the aforementioned methods, the composition comprises a *Methylobacterium* sp. that has at least one gene that is orthologous to, or that has at least 95%, 97%, 98%, 99%, 99.5%, or 100% sequence identity to, at least one gene selected from the group consisting of SEQ ID NO: 7279-9187, and 9188. In certain embodiments of any of the aforementioned methods, the composition comprises a *Methylobacterium* sp. that has at least one gene that that is orthologous to, or that encodes a protein having at least 95%, 97%, 98%, 99%, 99.5%, or 100% sequence identity to, at least one protein selected from the group consisting of SEQ ID NO: 2585-4593, and 4594. In certain embodiments of any of the aforementioned methods, the composition comprises the *Methylobacterium* isolate NLS0066, NLS0089, a combination of NLS0066 and NLS0017, or a derivative thereof. In certain embodiments of any of the aforementioned methods, the composition further comprises *Methylobacterium* strain NLS0020 or a derivative thereof. In certain embodiments of the methods, the compositions provide for at least about 25%, at least about 50%, or at least about 75% inhibition of plant pathogenic fungal growth in comparison to a control composition that lacks *Methylobacterium* that inhibit a plant pathogenic fungus upon exposure to the plant pathogenic fungus. In certain embodiments of the methods, the plant pathogenic fungus is selected from the group consisting of an *Alternaria* sp., an *Ascochyta* sp., an *Aspergillus* sp., a *Bipolaris* sp., a *Botrytis* sp., a *Bremia* sp., a *Cercospora* sp., a *Cochliobolus* sp., a *Colletotrichum* sp., a *Diplodia* sp., an *Erysiphe* sp., an *Exserohilum* sp., a *Fusarium* sp., *Gaeumanomyces* sp., a *Macrophomina* sp., a *Magnaporthe* sp., a *Nectria* sp., a *Peronospora* sp., a *Phakopsora* sp., a *Phialophora* sp., a *Phoma* sp., a *Phymatotrichum* sp., a *Phytophthora* sp., a *Plasmopara* sp., a *Puccinia* sp., a *Podosphaera* sp., a *Pyrenophora* sp., a *Pyricularia* sp, a *Pythium* sp., a *Rhizoctonia* sp., a *Sclerotium* sp., a *Sclerotinia* sp., a *Septoria* sp., a *Stagonospora* sp., a *Thielaviopsis* sp., an *Uncinula* sp, an *Ustilago* sp., a *Venturia* sp., and a *Verticillium* sp. In certain embodiments of the methods, the *Fusarium* sp. is selected from the group consisting of *Fusarium graminearum, Fusarium verticillioides, Fusarium oxysporum*, and *Fusarium solani*. In certain embodiments of the methods, the *Methylobacterium* is adhered to a solid substance. In certain embodiments of the methods, the *Methylobacterium* adhered to the solid substance is combined with a liquid to form a composition that is a colloid. In certain embodiments of the methods, the colloid is a gel. In certain embodiments of the methods, the *Methylobacterium* adhered to the solid substance is provided by culturing the *Methylobacterium* in the presence of the solid substance. In certain embodiments of the methods, the composition comprises an emulsion. In certain embodiments of the methods, the *Methylobacterium* is provided by culturing the *Methylobacterium* in an emulsion. In certain embodiments of any of the aforementioned methods, the plant pathogenic fungus is a *Fusarium* sp. and/or the plant is a cereal plant. In certain embodiments of any of the aforementioned methods, the plant pathogenic fungus is a *Fusarium* sp. and the plant is a cereal plant selected from the group consisting of a rice, wheat, corn, barley, millet, sorghum, oat, and rye plant. In certain embodiments of any of the aforementioned methods, the plant pathogenic fungus is *Fusarium graminearum* and the plant is a cereal plant selected from the group consisting of a rice, wheat, corn, barley, millet, sorghum, oat, and rye plant. In any of the aforementioned embodiments, the plant pathogen fungi that is inhibited can be in its anamorphic form, its teleomorphic form, or in both its anamorphic and teleomorphic forms.

Methods where *Methylobacterium* are cultured in biphasic media comprising a liquid phase and a solid substance have been found to significantly increase the resultant yield of *Methylobacterium* relative to methods where the *Methylobacterium* are cultured in liquid media alone. In certain embodiments, the methods can comprise growing the *Methylobacterium* in liquid media with a particulate solid substance that can be suspended in the liquid by agitation under conditions that provide for *Methylobacterium* growth. In certain embodiments where particulate solid substances are used, at least substantially all of the solid phase can thus be suspended in the liquid phase upon agitation. Such particulate solid substances can comprise materials that are about 1 millimeter or less in length or diameter. In certain embodiments, the degree of agitation is sufficient to provide for uniform distribution of the particulate solid substance in the liquid phase and/or optimal levels of culture aeration. However, in other embodiments provided herein, at least substantially all of the solid phase is not suspended in the liquid phase, or portions of the solid phase are suspended in the liquid phase and portions of the solid phase are not suspended in the liquid phase. Non-particulate solid substances can be used in certain biphasic media where the solid phase is not suspended in the liquid phase. Such non-particulate solid substances include, but are not limited to, materials that are greater than about 1 millimeter in length or diameter. Such particulate and non-particulate solid substances also include, but are not limited to, materials that are porous, fibrous, or otherwise configured to provide for increased surface areas for adherent growth of the *Methylobacterium*. Biphasic media where portions of the solid phase are suspended in the liquid phase and portions of the solid phase are not suspended in the liquid phase can comprise a mixture of particulate and non-particulate solid substances. Such particulate and non-particulate solid substances used in any of the aforementioned biphasic media also include, but are not limited to, materials that are porous, fibrous, or otherwise configured to provide for increased surface areas for adherent growth of the *Methylobacterium*. In certain embodiments, the media comprises a colloid formed by a solid and a liquid phase. A colloid comprising a solid and a liquid can be pre-formed and added to liquid media or can be formed in media containing a solid and a liquid. Colloids comprising a solid and a liquid can be formed by subjecting certain solid substances to a chemical and/or thermal change. In certain embodiments, the colloid is a gel. In certain embodiments, the liquid phase of the media is an emulsion. In certain embodiments, the emulsion comprises an aqueous liquid and a liquid that is not miscible, or only partially miscible, in the aqueous liquid. Liquids that are not miscible, or only partially miscible, in water include, but are not limited to, any of the following: (1) liquids having a miscibility in water that is equal to or less than that of pentanol, hexanol, or heptanol at 25 degrees C.; (2) liquids comprising an alcohol, an aldehyde, a ketone, a fatty acid, a phospholipid, or any combination thereof; (3) alcohols selected from the group consisting of aliphatic alcohols containing at least 5 carbons and sterols; (4) an animal oil, microbial oil, synthetic oil, plant oil, or combination thereof; and/or, (5) a plant oil selected from the group consisting of corn, soybean, cotton, peanut, sunflower, olive, flax, coconut, palm, rapeseed, sesame seed, safflower, and combinations thereof. In certain embodiments, the immiscible or partially immiscible liquid can comprises at least about 0.02% to about 20% of the liquid phase by mass. In certain embodiments, the methods can comprise obtaining a biphasic culture media comprising the liquid, the solid, and *Methylobacterium* and incubating the culture under conditions that provide for growth of the *Methylobacterium*. Biphasic culture medias comprising the liquid, the solid, and *Methylobacterium* can be obtained by a variety of methods that include, but are not limited to, any of: (a) inoculating a biphasic media comprising the liquid and the solid substance with *Methylobacterium*; (b) inoculating the solid substance with *Methylobacterium* and then introducing the solid substance comprising the *Methylobacterium* into the liquid media; (c) inoculating the solid substance with *Methylobacterium*, incubating the *Methylobacterium* on the solid substance, and then introducing the solid substance comprising the *Methylobacterium* into the liquid media; or (d) any combination of (a), (b), or (c). Methods and compositions for growing *Methylobacterium* in biphasic media comprising a liquid and a solid are disclosed in co-assigned U.S. patent application Ser. No. 13/907,161, filed May 31, 2013, which is incorporated herein by reference in its entirety, and in co-assigned International Patent Application PCT/US13/43722, filed May 31, 2013, which is incorporated herein by reference in its entirety.

Methods where *Methylobacterium* are cultured in media comprising an emulsion have also been found to significantly increase the resultant yield of *Methylobacterium* relative to methods where the *Methylobacterium* are cultured in liquid media alone. In certain embodiments, the methods for making the compositions provided herein can comprise growing the *Methylobacterium* in an emulsion under conditions that provide for *Methylobacterium* growth. Medias comprising the emulsion and *Methylobacterium* can be obtained by a variety of methods that include, but are not limited to, any of: (a) inoculating a media comprising the emulsion with *Methylobacterium*; (b) inoculating the aqueous liquid with the *Methylobacterium*, introducing the non-aqueous liquid, and mixing to form an emulsion; (c) inoculating the aqueous liquid with the *Methylobacterium*, introducing the non-aqueous liquid, and mixing to form an emulsion; or (d) any combination of (a), (b), or (c). In certain embodiments, the emulsion comprises an aqueous liquid and a liquid that is not miscible, or only partially miscible, in the aqueous liquid. Non-aqueous liquids that are not miscible, or only partially miscible, in water include, but are not limited to, any of the following: (1) liquids having a miscibility in water that is equal to or less than that of n-pentanol, n-hexanol, or n-heptanol at 25 degrees C.; (2) liquids comprising an alcohol, an aldehyde, a ketone, a fatty acid, a phospholipid, or any combination thereof; (3) alcohols selected from the group consisting of aliphatic alcohols containing at least 5, 6, or 7 carbons and sterols; (4) an animal oil, microbial oil, synthetic oil, plant oil, or combination thereof, and/or, (5) a plant oil selected from the group consisting of corn, soybean, cotton, peanut, sunflower, olive, flax, coconut, palm, rapeseed, sesame seed, safflower, and combinations thereof. In certain embodiments, the immiscible or partially immiscible non-aqueous liquid can comprise at least about 0.02% to about 20% of the emulsion by mass. In certain embodiments, the immiscible or partially immiscible non-aqueous liquid can comprise at least about any of about 0.05%, 0.1%, 0.5%, or 1% to about 3%, 5%, 10%, or 20% of the emulsion by mass. Methods and compositions for growing *Methylobacterium* in media comprising an emulsion are disclosed in co-assigned U.S. Provisional Patent Application No. 61/829,987, filed May 31, 2013, and in co-assigned PCT Application No. PCT/US14/40218, filed May 30, 2014, which are both incorporated herein by reference in their entireties.

In certain embodiments, the fermentation broth, fermentation broth product, or compositions that comprise *Methylobacterium* that inhibit plant pathogenic fungi can further comprise one or more introduced microorganisms of predetermined identity other than *Methylobacterium*. Other microorganisms that can be added include, but are not limited to, microorganisms that are biopesticidal or provide some other benefit when applied to a plant or plant part. Biopesticidal or otherwise beneficial microorganisms thus include, but are not limited to, various *Bacillus* sp., *Pseudomonas* sp., *Coniothyrium* sp., *Pantoea* sp., *Streptomyces* sp., and *Trichoderma* sp. Microbial biopesticides can be a bacterium, fungus, virus, or protozoan. Particularly useful biopesticidal microorganisms include various *Bacillus subtilis, Bacillus thuringiensis, Bacillus pumilis, Pseudomonas syringae, Trichoderma harzianum, Trichoderma virens*, and *Streptomyces lydicus* strains. Other microorganisms that are added can be genetically engineered or isolates that are available as pure cultures. In certain embodiments, it is anticipated that the bacterial or fungal microorganism can be provided in the fermentation broth, fermentation broth product, or composition in the form of a spore.

In certain embodiments, the liquid culture medium is prepared from inexpensive and readily available components, including, but not limited to, inorganic salts such as potassium phosphate, magnesium sulfate and the like, carbon sources such as glycerol, methanol, glutamic acid, aspartic acid, succinic acid and the like, and amino acid blends such as peptone, tryptone, and the like. Examples of liquid media that can be used include, but are not limited to, ammonium mineral salts (AMS) medium (Whittenbury et al., 1970), Vogel-Bonner (VB) minimal culture medium (Vogel and Bonner, 1956), and LB broth ("Luria-Bertani Broth").

In general, the solid substance used in the methods and compositions that provide for the efficient growth of *Methylobacterium* can be any suitable solid substance which is insoluble or only partially soluble in water or aqueous solutions. Such suitable solid substances are also non-bacteriocidal or non-bacteriostatic with respect to *Methylobacterium* that inhibit plant pathogenic fungi when the solid substances are provided in the liquid culture media. In certain embodiments, such suitable solid substances are also solid substances that are readily obtained in sterile form or rendered sterile. Solid substances used herein can be sterilized by any method that provides for removal of contaminating microorganisms and thus include, but are not limited to, methods such as autoclaving, irradiation, chemical treatment, and any combination thereof. These solid substances include substances of animal, plant, microbial, fungal, or mineral origin, manmade substances, or combinations thereof. In certain embodiments, the solid substances are inanimate solid substances. Inanimate solid substances of animal, plant, microbial, or fungal origin can be obtained from animals, plants, microbes, or fungi that are inviable (i.e. no longer living) or that have been rendered inviable. Diatom shells are thus inanimate solid substances when previously associated diatom algae have been removed or otherwise rendered inviable. Since diatom shells are inanimate solid substances, they are not considered to be photosynthetic organisms or photosynthetic microorganisms. In certain embodiments, solid substances include, but are not limited to, sand, silt, soil, clay, ash, charcoal, diatomaceous earth and other similar minerals, ground glass or glass beads, ground ceramic materials, ceramic beads, bentonite, kaolin, talc, perlite, mica, vermiculite, silicas, quartz powder, montmorillonite, and combinations thereof. In certain embodiments, the solid substance can be a polymer or polymeric beads. Polymers that can be used as a solid substance include, but are not limited to, various polysaccharides such as cellulosic polymers and chitinous polymers which are insoluble or only partially soluble in water or aqueous solutions, agar (i.e. galactans), and combinations thereof. In certain embodiments, the solid substance can be an insoluble or only partially soluble salt crystal. Salt crystals that can be used include, but are not limited to, insoluble or only partially soluble carbonates, chromates, sulfites, phosphates, hydroxides, oxides, and sulfides. In certain embodiments, the solid substance can be a microbial cell, fungal cell, microbial spore, or fungal spore. In certain embodiments, the solid substance can be a microbial cell or microbial spore wherein the microbial cell or microbial spore is not a photosynthetic microorganism. In certain embodiments, the microbial cell or microbial spore is not a photosynthetic microorganism, where the photosynthetic microorganism is selected from the group consisting of algae, cyanobacteria, diatoms, *Botryococcus braunii, Chlorella, Dunaliella tertiolecta, Gracilaria, Pleurochrysis carterae, Sargassum*, and *Ulva*. In still other embodiments, the solid substance can be an inactivated (i.e. inviable) microbial cell, fungal cell, microbial spore, or fungal spore. In still other embodiments, the solid substance can be a quiescent (i.e. viable but not actively dividing) microbial cell, fungal cell, microbial spore, or fungal spore. In still other embodiments, the solid substance can be cellular debris of microbial origin. In still other embodiments, the solid substance can be particulate matter from any part of a plant. Plant parts that can be used to obtain the solid substance include, but are not limited to, cobs, husks, hulls, leaves, roots, flowers, stems, bark, seeds, and combinations thereof. Products obtained from processed plant parts including, but not limited to, bagasse, wheat bran, soy grits, crushed seed cake, stover, and the like can also be used. Such plant parts, processed plants, and/or processed plant parts can be milled to obtain the solid material in a particulate form that can be used. In certain embodiments, wood or a wood product including, but not limited to, wood pulp, sawdust, shavings, and the like can be used. In certain embodiments, the solid substance can be a particulate matter from an animal(s), including, but not limited to, bone meal, gelatin, ground or powdered shells, hair, macerated hide, and the like.

In certain embodiments, the solid substance is provided in a particulate form that provides for distribution of the solid substance in the culture media. In certain embodiments, the solid substance is comprised of particle of about 2 microns to about 1000 microns in average length or average diameter. In certain embodiments, the solid substance is comprised of particle of about 1 microns to about 1000 microns in average length or average diameter. In certain embodiments, the solid substance is a particle of about 1, 2, 4, 10, 20, or 40 microns to any of about 100, 200, 500, 750, or 1000 microns in average length or average diameter. Desirable characteristics of particles used in the methods and compositions provided herein include suitable wettability such that the particles can be suspended throughout the media upon agitation.

In certain embodiments, the solid substance is provided in the media as a colloid wherein the continuous phase is a liquid and the dispersed phase is the solid. Suitable solids that can be used to form colloids in liquid media used to grow *Methylobacterium* that inhibit plant pathogenic fungi include, but are not limited to, various solids that are referred to as hydrocolloids. Such hydrocolloids used in the media, methods and compositions provided herein can be hydrophilic polymers, of plant, animal, microbial, or synthetic origin. Hydrocolloid polymers used in the methods can contain many hydroxyl groups and/or can be polyelectrolytes. Hydrocolloid polymers used in the compositions and methods provided herein include, but are not limited to, agar, alginate, arabinoxylan, carrageenan, carboxymethylcellulose, cellulose, curdlan, gelatin, gellan, β-glucan, guar gum, gum arabic, locust bean gum, pectin, starch, xanthan gum, and mixtures thereof. In certain embodiments, the colloid used in the media, methods, and compositions provided herein can comprise a hydrocolloid polymer and one or more proteins.

In certain embodiments, the solid substance can be a solid substance that provides for adherent growth of the *Methylobacterium* that inhibit plant pathogenic fungi on the solid substance. *Methylobacterium* that inhibit plant pathogenic fungi that are adhered to a solid substance are *Methylobacterium* that cannot be substantially removed by simply washing the solid substance with the adherent *Methylobacterium* that inhibit plant pathogenic fungi with growth media whereas non-adherent *Methylobacterium* can be substantially removed by washing the solid substance with liquid growth media. In this context, "substantially removed" means that at least about 30%, 40%, 50%, 60%, 70%, or 80% the *Methylobacterium* present are removed when the solid substance is washed with three volumes of liquid growth media. Such washing can be effected by a variety of methods including, but not limited to, decanting liquid from a washed solid phase or passing liquid through a solid phase on a filter that permits flow through of bacteria in the liquid. In certain embodiments, the adherent *Methylobacterium* that inhibit plant pathogenic fungi that are associated with the solid can include both *Methylobacterium* that are directly attached to the solid and/or *Methylobacterium* that are indirectly attached to the solid substance. *Methylobacterium* that are indirectly attached to the solid substance include, but are not limited to, *Methylobacterium* that are attached to another *Methylobacterium* or to another microorganism that is attached to the solid substance, *Methylobacterium* that are attached to the solid substance by being attached to another substance that is attached to the solid substance, and the like. In certain embodiments, at least 10%, 20%, 30%, 40%, 50%, 60%, 70%, 80%, 90%, 95%, 98%, 99%, 99.5% or 99.9% of the *Methylobacterium* in the fermentation broth, fermentation broth product, or compositions are *Methylobacterium* that are adhered to the solid substance. In certain embodiments, adherent *Methylobacterium* that inhibit plant pathogenic fungi can be present on the surface of the solid substance in the fermentation broth, fermentation broth product, or composition at a density of at least about 1 *Methylobacterium*/20 square micrometers, of at least about 1 *Methylobacterium*/10 square micrometers, of at least about 3 *Methylobacterium*/10 square micrometers, of at least about 1 *Methylobacterium*/5 square micrometers, of at least about 1 *Methylobacterium*/2 square micrometers, or of at least about 1 *Methylobacterium*/square micrometer. In certain embodiments, adherent *Methylobacterium* that inhibit plant pathogenic fungi can be present on the surface of the solid substance in the fermentation broth, fermentation broth product, or composition at a density of at least about 1 *Methylobacterium*/20 square micrometers to about 1 *Methylobacterium*/square micrometer, of at least about 1 *Methylobacterium*/10 square micrometers to about 1 *Methylobacterium*/square micrometer, of at least about 1 *Methylobacterium*/10 square micrometers to about 1 *Methylobacterium*/square micrometer, of at least about 1 *Methylobacterium*/5 square micrometers to about 1 *Methylobacterium*/square micrometer, or of at least about 1 *Methylobacterium*/2 square micrometers to about 1 *Methylobacterium*/square micrometer. In certain embodiments, adherent *Methylobacterium* that inhibit plant pathogenic fungi can be present on the surface of the solid substance in the fermentation broth, fermentation broth product, or composition at a density of at least about 1 *Methylobacterium*/20 square micrometers to about 1 *Methylobacterium*/2 square micrometers, of at least about 1 *Methylobacterium*/10 square micrometers to about 1 *Methylobacterium*/2 square micrometers, of at least about 1 *Methylobacterium*/10 square micrometers to about 1 *Methylobacterium*/2 square micrometers, or of at least about 1 *Methylobacterium*/5 square micrometers to about 1 *Methylobacterium*/2 square micrometers. Biphasic fermentation broths provided herein can comprise a liquid phase that contains non-adherent *Methylobacterium*. In certain embodiments, titers of non-adherent *Methylobacterium* in the liquid phase can be less than about 100,000, 10,000, or 1,000 CFU/ml.

Fermentation products and compositions with a mono- or co-culture of *Methylobacterium* that inhibit plant pathogenic fungi at a titer of greater than about $5 \times 10^7$ colony-forming units per milliliter, at a titer of greater than about $1 \times 10^8$ colony-forming units per milliliter, at a titer of greater than about $5 \times 10^8$ colony-forming units per milliliter, at a titer of greater than about $1 \times 10^9$ colony-forming units per milliliter, at a titer of greater than about $1 \times 10^{10}$ colony-forming units per milliliter, at a titer of at least about $3 \times 10^{10}$ colony-forming units per milliliter are provided herein. In certain embodiments, fermentation products and compositions provided herein can comprise *Methylobacterium* that inhibit plant pathogenic fungi at a titer of at least about $5 \times 10^7$, $1 \times 10^8$, or $5 \times 10^8$ colony-forming units per milliliter to at least about $3 \times 10^{10}$ colony-forming units per milliliter, at least about $5 \times 10^8$ colony-forming units per milliliter to at least about $4 \times 10^{10}$ colony-forming units per milliliter, or at least about $5 \times 10^9$ colony-forming units per milliliter to at least about $6 \times 10^{10}$ colony-forming units per milliliter. In certain embodiments, fermentation products and compositions provided herein can comprise *Methylobacterium* that inhibit plant pathogenic fungi at a titer of at least about $1 \times 10^9$ colony-forming units per milliliter to at least about $3 \times 10^{10}$ colony-forming units per milliliter, at least about $1 \times 10^9$ colony-forming units per milliliter to at least about $4 \times 10^{10}$ colony-forming units per milliliter, or at least about $1 \times 10^9$ colony-forming units per milliliter to at least about $6 \times 10^{10}$ colony-forming units per milliliter. In certain embodiments, fermentation products and compositions provided herein will comprise *Methylobacterium* that inhibit plant pathogenic fungi at a titer of at least about $1 \times 10^{10}$ colony-forming units per milliliter to at least about $3 \times 10^{10}$ colony-forming units per milliliter, at least about $1 \times 10^{10}$ colony-forming units per milliliter to at least about $4 \times 10^{10}$ colony-forming units per milliliter, or at least about $1 \times 10^{10}$ colony-forming units per milliliter to at least about $6 \times 10^{10}$ colony-forming units per milliliter. In certain embodiments, fermentation products and compositions provided herein will comprise *Methylobacterium* that inhibit plant pathogenic fungi at a titer of, at least about $3 \times 10^{10}$ colony-forming units per milliliter to at least about $4 \times 10^{10}$ colony-forming units per milliliter, or at least about $3 \times 10^{10}$ colony-forming units per milliliter to at least about $6 \times 10^{10}$ colony-forming units per milliliter. In any of the aforementioned fermentation products or compositions, the indicated concentrations can be fungal inhibitory concentrations. In any of the aforementioned fermentation products or compositions, the fermentation products or compositions can be essentially free of contaminating microorganisms, can comprise *Methylobacterium* that are adhered to and/or associated with materials that the *Methylobacterium* are not are adhered to and/or associated with in nature, or any combination thereof.

Fermentation products and compositions with *Methylobacterium* that inhibit plant pathogenic fungi at a titer of greater than about $5 \times 10^7$, $1 \times 10^8$, or $5 \times 10^8$ colony-forming units per gram, at a titer of greater than about $1 \times 10^9$ colony-forming units per gram, at a titer of greater than about $1 \times 10^{10}$ colony-forming units per gram, at a titer of at least about $3 \times 10^{10}$ colony-forming units per gram are provided herein. In certain embodiments, fermentation products and compositions provided herein can comprise *Methylobacterium* that inhibit plant pathogenic fungi at a titer of at least about $5 \times 10^7$, $1 \times 10^8$, or $5 \times 10^8$ colony-forming units per gram to at least about $3 \times 10^{10}$ colony-forming units per gram, at least about $5 \times 10^7$, $1 \times 10^8$, or $5 \times 10^8$ colony-forming units per gram to at least about $4 \times 10^{10}$ colony-forming units per gram, or at least about $5 \times 10^7$, $1 \times 10^8$, or $5 \times 10^8$ colony-forming units per gram to at least about $6 \times 10^{10}$ colony-forming units per gram. In certain embodiments, fermentation products and compositions provided herein can comprise *Methylobacterium* that inhibit plant pathogenic fungi at a titer of at least about $1 \times 10^9$ colony-forming units per gram to at least about $3 \times 10^{10}$ colony-forming units per gram, at least about $1 \times 10^9$ colony-forming units per gram to at least about $4 \times 10^{10}$ colony-forming units per gram, or at least about $1 \times 10^9$ colony-forming units per gram to at least about $6 \times 10^{10}$ colony-forming units per gram. In certain embodiments, fermentation products and compositions provided herein will comprise *Methylobacterium* that inhibit plant pathogenic fungi at a titer of at least about $1 \times 10^{10}$ colony-forming units per gram to at least about $3 \times 10^{10}$ colony-forming units per gram, at least about $1 \times 10^{10}$ colony-forming units per gram to at least about $4 \times 10^{10}$ colony-forming units per gram, or at least about $1 \times 10^{10}$ colony-forming units per gram to at least about $6 \times 10^{10}$ colony-forming units per gram. In certain embodiments, fermentation products and compositions provided herein will comprise *Methylobacterium* that inhibit plant pathogenic fungi at a titer of, at least about $3 \times 10^{10}$ colony-forming units per gram to at least about $4 \times 10^{10}$ colony-forming units per gram, or at least about $3 \times 10^{10}$ colony-forming units per gram to at least about $6 \times 10^{10}$, $1 \times 10^{13}$, or $5 \times 10^{13}$ colony-forming units per gram. In any of the aforementioned fermentation products or compositions, the fermentation or composition can comprise a mono- or co-culture of *Methylobacterium* that is adhered to a solid substance. In any of the aforementioned fermentation products or compositions, the indicated concentrations can be fungal inhibitory concentrations. In any of the aforementioned fermentation products or compositions, the indicated concentrations can be fungal inhibitory concentrations. In any of the aforementioned fermentation products or compositions, the fermentation products or compositions can be essentially free of contaminating microorganisms, can comprise *Methylobacterium* that are adhered to and/or associated with materials that the *Methylobacterium* are not are adhered to and/or associated with in nature, or any combination thereof.

Solid substances with adherent *Methylobacterium* that inhibit plant pathogenic fungi can be obtained as fermentation products can be used to make various compositions useful for treating plants or plant parts to inhibit infection by plant pathogenic fungi. Alternatively, compositions provided herein comprising solid substances with *Methylobacterium* that inhibit plant pathogenic fungi or adherent *Methylobacterium* that inhibit plant pathogenic fungi can be used to treat plants or plant parts. Plants, plant parts, and, in particular, plant seeds that have been at least partially coated with the fermentation broth products or compositions comprising *Methylobacterium* that inhibit plant pathogenic fungi are thus provided. Also provided are processed plant products that contain the fermentation broth products or compositions with *Methylobacterium* that inhibit plant pathogenic fungi or adherent *Methylobacterium* that inhibit plant pathogenic fungi. Solid substances with adherent *Methylobacterium* that inhibit plant pathogenic fungi can be used to make various compositions that are particularly useful for treating plant seeds. Seeds that have been at least partially coated with the fermentation broth products or compositions are thus provided. Also provided are processed seed products, including, but not limited to, meal, flour, feed, and flakes that contain the fermentation broth products or compositions provided herein. In certain embodiments, the processed plant product will be non-regenerable (i.e. will be incapable of developing into a plant). In certain embodiments, the solid substance used in the fermentation product or composition that at least partially coats the plant, plant part, or plant seed or that is contained in the processed plant, plant part, or seed product comprises a solid substance and associated or adherent *Methylobacterium* that inhibit plant pathogenic fungi that can be readily identified by comparing a treated and an untreated plant, plant part, plant seed, or processed product thereof.

Compositions useful for treating plants or plant parts that comprise *Methylobacterium* that inhibit plant pathogenic fungi or a solid substance with adherent *Methylobacterium* that inhibit plant pathogenic fungi, emulsions containing the *Methylobacterium* that inhibit plant pathogenic fungi or combinations thereof can also comprise an agriculturally acceptable adjuvant or an agriculturally acceptable excipient. An agriculturally acceptable adjuvant or an agriculturally acceptable excipient is typically an ingredient that does not cause undue phytotoxicity or other adverse effects when exposed to a plant or plant part. In certain embodiments, the solid substance can itself be an agriculturally acceptable adjuvant or an agriculturally acceptable excipient so long as it is not bacteriocidal or bacteriostatic to the *Methylobacterium*. In other embodiments, the composition further comprises at least one of an agriculturally acceptable adjuvant or an agriculturally acceptable excipient. Any of the aforementioned compositions can also further comprise a pesticide. Pesticides used in the composition include, but are not limited to, an insecticide, a fungicide, a nematocide, and a bacteriocide. In certain embodiments, the pesticide used in the composition is a pesticide that does not substantially inhibit growth of the *Methylobacterium*. As *Methylobacterium* are gram negative bacteria, suitable bacteriocides used in the compositions can include, but are not limited to, bacteriocides that exhibit activity against gram positive bacteria but not gram negative bacteria. Compositions provided herein can also comprise a bacteriostatic agent that does not substantially inhibit growth of the *Methylobacterium*. Bacteriostatic agents suitable for use in compositions provided herein include, but are not limited to, those that exhibit activity against gram positive bacteria but not gram negative bacteria. Any of the aforementioned compositions can also be an essentially dry product (i.e. having about 5% or less water content), a mixture of the composition with an emulsion, or a suspension.

Agriculturally acceptable adjuvants used in the compositions that comprise *Methylobacterium* that inhibit plant pathogenic fungi, emulsions containing the *Methylobacterium* that inhibit plant pathogenic fungi, or combinations thereof include, but are not limited to, components that enhance product efficacy and/or products that enhance ease of product application. Adjuvants that enhance product efficacy can include various wetters/spreaders that promote adhesion to and spreading of the composition on plant parts, stickers that promote adhesion to the plant part, penetrants, extenders, and humectants that increase the density or drying time of sprayed compositions. Wetters/spreaders used in the compositions can include, but are not limited to, non-ionic surfactants, anionic surfactants, cationic surfactants, amphoteric surfactants, organo-silicate surfactants, and/or acidified surfactants. Stickers used in the compositions can include, but are not limited to, latex-based substances, terpene/pinolene, and pyrrolidone-based substances. Penetrants can include mineral oil, vegetable oil, esterified vegetable oil, organo-silicate surfactants, and acidified surfactants. Extenders used in the compositions can include, but are not limited to, ammonium sulphate, or menthene-based substances. Humectants used in the compositions can include, but are not limited to, glycerol, propylene glycol, and diethyl glycol. Adjuvants that improve ease of product application include, but are not limited to, acidifying/buffering agents, anti-foaming/de-foaming agents, compatibility agents, drift-reducing agents, dyes, and water conditioners. Anti-foaming/de-foaming agents used in the compositions can include, but are not limited to, dimethopolysiloxane. Compatibility agents used in the compositions can include, but are not limited to, ammonium sulphate. Drift-reducing agents used in the compositions can include, but are not limited to, polyacrylamides, and polysaccharides. Water conditioners used in the compositions can include, but are not limited to, ammonium sulphate.

Methods of treating plants and/or plant parts with the fermentation broths, fermentation broth products, and compositions comprising *Methylobacterium* that inhibit plant pathogenic fungi, or combinations thereof are also provided herein. Treated plants, and treated plant parts obtained therefrom, include, but are not limited to, corn, *Brassica* sp. (e.g., *B. napus, B. rapa, B. juncea*), alfalfa, rice, rye, sorghum, millet (e.g., pearl millet (*Pennisetum glaucum*)), proso millet (*Panicum miliaceum*), foxtail millet (*Setaria italica*), finger millet (*Eleusine coracana*), sunflower, safflower, soybean, tobacco, potato, peanuts, cotton, sweet potato (*Ipomoea batatus*), cassava, coffee, coconut, pineapple, citrus trees, cocoa, tea, banana, avocado, fig, guava, mango, olive, papaya, cashew, macadamia, almond, sugar beets, sugarcane, oats, barley, tomatoes, lettuce, green beans, lima beans, peas, cucurbits such as cucumber, cantaloupe, and musk melon, ornamentals, and conifers. Plant parts that are treated include, but are not limited to, leaves, stems, flowers, roots, seeds, fruit, tubers, coleoptiles, and the like. Ornamental plants and plant parts that can be treated include, but are not limited to azalea, hydrangea, hibiscus, roses, tulips, daffodils, petunias, carnation, poinsettia, and chrysanthemum. Conifer plants and plant parts that can be treated include, but are not limited to, pines such as loblolly pine, slash pine, ponderosa pine, lodge pole pine, and Monterey pine; Douglas-fir; Western hemlock; Sitka spruce; redwood; true firs such as silver fir and balsam fir; and cedars such as Western red cedar and Alaska yellow-cedar. Turfgrass plants and plant parts that can be treated include, but are not limited to, annual bluegrass, annual ryegrass, Canada bluegrass, fescue, bentgrass, wheatgrass, Kentucky bluegrass, orchard grass, ryegrass, redtop, Bermuda grass, St. Augustine grass, and zoysia grass. In certain embodiments, the treated plant or plant part is a cereal plant or plant part selected from the group consisting of a rice, wheat, corn, barley, millet, sorghum, oat, and rye plant or plant part. Seeds or other propagules of any of the aforementioned plants can be treated with the fermentation broths, fermentation broth products, fermentation products, and/or compositions provided herein.

In certain embodiments, plants and/or plant parts are treated by applying the fermentation broths, fermentation broth products, fermentation products, and compositions that comprise *Methylobacterium* that inhibit plant pathogenic fungi, or combinations thereof as a spray. Such spray applications include, but are not limited to, treatments of a single plant part or any combination of plant parts. Spraying can be achieved with any device that will distribute the fermentation broths, fermentation broth products, fermentation products, and compositions to the plant and/or plant part(s). Useful spray devices include a boom sprayer, a hand or backpack sprayer, crop dusters (i.e. aerial spraying), and the like. Spraying devices and or methods providing for application of the fermentation broths, fermentation broth products, fermentation products, and compositions to either one or both of the adaxial surface and/or abaxial surface can also be used. Plants and/or plant parts that are at least partially coated with any of a biphasic fermentation broth, a fermentation broth product, fermentation product, or compositions that comprise a solid substance with *Methylobacterium* that inhibit plant pathogenic fungi adhered thereto are also provided herein. Also provided herein are processed plant products that comprise a solid substance with *Methylobacterium* that inhibit plant pathogenic fungi adhered thereto.

In certain embodiments, seeds are treated by exposing the seeds to the fermentation broths, fermentation broth products, fermentation products, and compositions that comprise *Methylobacterium* that inhibit plant pathogenic fungi, or combinations thereof. Seeds can be treated with the fermentation broths, fermentation broth products, and compositions provided herein by methods including, but not limited to, imbibition, coating, spraying, and the like. Seed treatments can be effected with both continuous and/or a batch seed treaters. In certain embodiments, the coated seeds can be prepared by slurrying seeds with a coating composition containing a fermentation broth, fermentation broth product, or compositions that comprise the solid substance with *Methylobacterium* that inhibit plant pathogenic fungi and air drying the resulting product. Air drying can be accomplished at any temperature that is not deleterious to the seed or the *Methylobacterium*, but will typically not be greater than 30 degrees Centigrade. The proportion of coating that comprises a solid substance and *Methylobacterium* that inhibit plant pathogenic fungi includes, but is not limited to, a range of 0.1 to 25% by weight of the seed, 0.5 to 5% by weight of the seed, and 0.5 to 2.5% by weight of seed. In certain embodiments, a solid substance used in the seed coating or treatment will have *Methylobacterium* that inhibit plant pathogenic fungi adhered thereon. In certain embodiments, a solid substance used in the seed coating or treatment will be associated with *Methylobacterium* that inhibit plant pathogenic fungi and will be a fermentation broth, fermentation broth product, or composition obtained by the methods provided herein. Various seed treatment compositions and methods for seed treatment disclosed in U.S. Pat. Nos. 5,106,648; 5,512,069; and 8,181,388 are incorporated herein by reference in their entireties and can be adapted for use with fermentation products or compositions provided herein. In certain embodiments, the composition used to treat the seed can contain agriculturally acceptable excipients that include, but are not limited to, woodflours, clays, activated carbon, diatomaceous earth, fine-grain inorganic solids, calcium carbonate and the like. Clays and inorganic solids that can be used with the fermentation broths, fermentation broth products, or compositions provided herein include, but are not limited to, calcium bentonite, kaolin, china clay, talc, perlite, mica, vermiculite, silicas, quartz powder, montmorillonite and mixtures thereof. Agriculturally acceptable adjuvants that promote sticking to the seed that can be used include, but are not limited to, polyvinyl acetates, polyvinyl acetate copolymers, hydrolyzed polyvinyl acetates, polyvinylpyrrolidone-vinyl acetate copolymer, polyvinyl alcohols, polyvinyl alcohol copolymers, polyvinyl methyl ether, polyvinyl methyl ether-maleic anhydride copolymer, waxes, latex polymers, celluloses including ethylcelluloses and methylcelluloses, hydroxy methylcelluloses, hydroxypropylcellulose, hydroxymethylpropylcelluloses, polyvinyl pyrrolidones, alginates, dextrins, malto-dextrins, polysaccharides, fats, oils, proteins, karaya gum, jaguar gum, tragacanth gum, polysaccharide gums, mucilage, gum arabics, shellacs, vinylidene chloride polymers and copolymers, soybean-based protein polymers and copolymers, lignosulfonates, acrylic copolymers, starches, polyvinylacrylates, zeins, gelatin, carboxymethylcellulose, chitosan, polyethylene oxide, acrylamide polymers and copolymers, polyhydroxyethyl acrylate, methylacrylamide monomers, alginate, ethylcellulose, polychloroprene and syrups or mixtures thereof. Other useful agriculturally acceptable adjuvants that can promote coating include, but are not limited to, polymers and copolymers of vinyl acetate, polyvinylpyrrolidone-vinyl acetate copolymer and water-soluble waxes. Various surfactants, dispersants, anticaking-agents, foam-control agents, and dyes disclosed herein and in U.S. Pat. No. 8,181,388 can be adapted for use with a fermentation products or compositions provided herein.

Provided herein are compositions that comprise *Methylobacterium* that inhibit plant pathogenic fungi and that provide control of plant pathogenic fungal infections of plants, plant parts, and plants obtained therefrom relative to untreated plants, plant parts, and plants obtained therefrom that have not been exposed to the compositions. In certain embodiments, plant parts, including, but not limited to, a seed, a leaf, a fruit, a stem, a root, a tuber, or a coleoptile can be treated with the compositions provided herein to control fungal disease. Treatments or applications can include, but are not limited to, spraying, coating, partially coating, immersing, and/or imbibing the plant or plant parts with the compositions provided herein. In certain embodiments, a seed, a leaf, a fruit, a stem, a root, a tuber, or a coleoptile can be immersed and/or imbibed with a liquid, semi-liquid, emulsion, or slurry of a composition provided herein. Such seed immersion or imbibition can be sufficient to provide for fungal disease inhibition in a plant or plant part in comparison to an untreated plant or plant part. Such fungal disease inhibition includes, but is not limited to decreases in fungal growth and/or the adverse effects of fungal growth relative to untreated plants. In certain embodiments, plant seeds can be immersed and/or imbibed for at least 1, 2, 3, 4, 5, or 6 hours. Such immersion and/or imbibition can, in certain embodiments, be conducted at temperatures that are not deleterious to the plant seed or the *Methylobacterium*. In certain embodiments, the seeds can be treated at about 15 to about 30 degrees Centigrade or at about 20 to about 25 degrees Centigrade. In certain embodiments, seed imbibition and/or immersion can be performed with gentle agitation.

Amounts of the compositions that comprise *Methylobacterium* that inhibit plant pathogenic fungi that are sufficient to provide for an inhibition of fungal infection of a plant or plant part can thus be determined by measuring any or all of fungal growth and/or the adverse effects of fungal growth in treated plants or plant parts relative to untreated plants or plant parts. Adverse effects of fungal growth in a plant that can be measured include any type of plant tissue damage or necrosis, any type of plant yield reduction, any reduction in the value of the crop plant product, and/or production of undesirable fungal metabolites or fungal growth by-products including, but not limited to, mycotoxins. Mycotoxins comprise a number of toxic molecules produced by fungal species, including, but not limited to, polyketides (including aflatoxins, demethylsterigmatocystin, O-methylsterigmatocystin etc.), fumonisins, alperisins (e.g., $A_1$, $A_2$, $B_1$, $B_2$), sphingofungins (A, B, C and D), trichothecenes, fumifungins, and the like. Methods of quantitating mycotoxin levels are widely documented. Moreover, commercial kits for measurement of the mycotoxins such as aflatoxin, fumonisin, deoxynivalenol, and zearalenone are also available (VICAM, Watertown, Mass., USA).

Compositions provided herein comprising *Methylobacterium* that inhibit plant pathogenic fungi are therefore expected to be useful in inhibiting fungal growth and/or infection in a wide variety of plant pathogenic fungi, including, but not limited to the anamorphic and/or teleomorphic stages of those phytopathogenic fungi in the following genera and species: *Alternaria* (*Alternaria alternata; Alternaria brassicicola; Alternaria solani*); *Ascochyta* (*Ascochyta pisi*); *Bipolaris* (*Bipolaris maydis*); *Botrytis* (*Botrytis cinerea*); *Bremia* (*Bremia lactucae*); *Cercospora* (*Cercospora kikuchii; Cercospora zeae-maydis*); *Cochliobolus* (*Colchliobolus maydis; Cochliobolus heterostrophus; Cochliobolus carbonum*); *Colletotrichum* (*Colletotrichum lindemuthianum; Colletotrichum graminicola; Colletotrichum cereale*); *Diplodia* (*Diplodia maydis*); *Erysiphe* (*Erysiphe graminis* f. sp. *graminis; Erysiphe graminis* f. sp. *hordei*); *Exserohilum* (*Exserohilum turcicum*); *Fusarium* (*Fusarium nivale; Fusarium oxysporum; Fusarium graminearum; Fusarium culmorum; Fusarium solani; Fusarium moniliforme; Fusarium virguliforme*); *Gaeumanomyces* (*Gaeumanomyces graminis* f. sp. *tritici*); *Macrophomina* (*Macrophomina phaseolina*); *Magnaporthe* (*Magnaporthe oryzae; Magnaporthe grisea*); *Nectria* (*Nectria haematococca*); *Peronospora* (*Peronospora manshurica; Peronospora tabacina*); *Phakopsora* (*Phakopsora pachyrhizi*); *Phialopora* (*Phialophora gregata*); *Phoma* (*Phoma betae*); *Phymatotrichum* (*Phymatotrichum omnivorum*); *Phytophthora* (*Phytophthora cinnamomi; Phytophthora cactorum; Phytophthora phaseoli; Phytophthora parasitica; Phytophthora citrophthora; Phytophthora megasperma* f. sp. *sojae; Phytophthora infestans*); *Plasmopara* (*Plasmopara viticola*); *Podosphaera* (*Podosphaera leucotricha*); *Puccinia* (*Puccinia sorghi; Puccinia striiformis; Puccinia graminis* f sp. *tritici; Puccinia asparagi; Puccinia recondita; Puccinia arachidis; Puccinia coronata*); *Pythium* (*Pythium aphanidermatum; Pythium ultimum*); *Pyrenophora* (*Pyrenophora tritici-repentis*); *Rhizoctonia* (*Rhizoctonia solani; Rhizoctonia cerealis*); *Sclerotium* (*Sclerotium rolfsii*); *Sclerotinia* (*Sclerotinia sclerotiorum; Sclerotinia homoeocarpa*); *Septoria* (*Septoria lycopersici; Septoria glycines; Septoria nodorum; Septoria tritici*); *Setosphaeria* (*Setosphaeria turcica*); *Stagonospora* (*Stagonospora nodorum*); *Thielaviopsis* (*Thielaviopsis basicola*); *Uncinula* (*Uncinula necator*); *Ustilago* (*Ustilago maydis*); *Venturia* (*Venturia inaequalis*); *Verticillium* (*Verticillium dahliae; Verticillium albo-atrum*). Compositions provided herein comprising *Methylobacterium* that inhibit plant pathogenic fungi are also expected to be useful in inhibiting fungal growth and/or infection by *Fusarium graminearum, Fusarium verticillioides* and/or *Fusarium proliferatum*. Compositions provided herein comprising *Methylobacterium* that inhibit fungal growth and/or infection by *Fusarium graminearum, Fusarium verticillioides* and/or *Fusarium proliferatum* can be used to control infections of cereal plants infected by these fungi. Infections of cereal plants selected from the group consisting of a rice, wheat, corn, barley, millet, sorghum, oat, and rye plants by *Fusarium* sp can be controlled by the compositions provided herein. In any of the aforementioned embodiments, the plant pathogenic fungus that is inhibited can be in its anamorphic form, its teleomorphic form, or in both its anamorphic and teleomorphic forms. Certain *Methylobacterium* isolates or combinations of isolates can also be used to inhibit certain plant pathogenic fungi in certain crops as disclosed in Table 2. In certain embodiments where a combination of isolates are used (e.g., NLS0066 and NLS0017 or NLS0089 and NLS0020), the isolates can be applied either simultaneously or sequentially. In certain embodiments where a combination of isolates are used (e.g., NLS0066 and NLS0017 or NLS0089 and NLS0020), the isolates can be applied in either the same mode(s) (e.g., via a seed treatment, a foliar application, or in furrow) or by distinct modes.

TABLE 2

*Methylobacterium* isolates and combinations of isolates for use in controlling certain plant pathogenic fungi in certain crops

| NLS Isolate(s) | Crop | Pathogen | Disease Common Name(s) | Mode(s) of Application |
|---|---|---|---|---|
| NLS066 | Wheat | *Fusarium graminearum* | *Fusarium* head blight | Seed treatment; foliar |
| | Corn | *Cercospora zeae-maydis* | Gray leaf spot | In-furrow; foliar |
| | | *Colletotrichum graminicola* | Anthracnose leaf blight and stalk rot | |
| NLS0066 + NLS0017 | Wheat | *Fusarium graminearum* | *Fusarium* head blight | Seed treatment; foliar |
| | Corn | *Cercospora zeae-maydis* | Gray leaf spot | In-furrow; foliar |
| | | *Colletotrichum graminicola* | Anthracnose leaf blight and stalk rot | |

TABLE 2-continued

*Methylobacterium* isolates and combinations of isolates for use in controlling certain plant pathogenic fungi in certain crops

| NLS Isolate(s) | Crop | Pathogen | Disease Common Name(s) | Mode(s) of Application |
|---|---|---|---|---|
| NLS0089 | Wheat | *Fusarium graminearum* | *Fusarium* head blight | Seed treatment; foliar |
| | | *Septoria tritici* *Stagonospora nodorum* | *Septoria*/*Stagonospora* blotch | |
| | | *Pythium* spp. | *Pythium* root rot | |
| | | *Rhizoctonia solani* | *Rhizoctonia* root rot | |
| | | *Fusarium* spp. | *Fusarium* root, crown, and foot rot | |
| | | *Magnaportha grisea* | Head blast | |
| | | *Pyrenophora tritici-repentis* | Tan spot | |
| | | *Microdochium nivale* | Snow mold | |
| | Soybean | *Sclerotinia sclerotiorum* | *Sclerotinia* white mold/stem rot; | Seed treatment; foliar |
| | | *Cercospora sojina* | Frogeye leaf spot; | |
| | | *Cercospora kikuchii* | *Cercospora* leaf blight and purple seed stain | |
| | | *Fusarium* spp. | *Fusarium* seed rot, blight/wilt, root rot and pod and collar rot | |
| | | *Rhizoctonia solani* | *Rhizoctonia* damping off and root rot | |
| | | *Fusarium virguliforme* | Sudden death syndrome | |
| | | *Pythium* spp. | *Pythium* root rot | |
| | | *Rhizoctonia solani* | *Rhizoctonia* crown and root rot | |
| | | *Fusarium* spp. | *Fusarium* root rot; | |
| | | *Colletotrichum graminicola* | Anthracnose leaf blight and stalk rot | |
| | Corn | *Cercospora zeae-maydis* | Gray leaf spot | In-furrow; foliar |
| | | *Gibberella zeae* | *Gibberella* stalk rot; | |
| | | *Fusarium* spp. | *Fusarium* stalk rot; | |
| | | *Pythium* spp. | *Pythium* stalk rot | |
| NLS0089 + NLS0020 | Wheat | *Fusarium graminearum* | *Fusarium* head blight | |
| | | *Septoria tritici* *Stagonospora nodorum* | *Septoria*/*Stagonospora* blotch | |
| | | *Pythium* spp. | *Pythium* root rot | |
| | | *Rhizoctonia solani* | *Rhizoctonia* root rot | |
| | | *Fusarium* spp. | *Fusarium* root, crown, and foot rot | |
| | | *Magnaportha grisea* | Head blast | |
| | | *Pyrenophora tritici-repentis* | Tan spot | |
| | | *Microdochium nivale* | Snow mold | |
| | Soybean | *Sclerotinia sclerotiorum* | *Sclerotinia* white mold/stem rot; | |
| | | *Cercospora sojina* | Frogeye leaf spot; | |
| | | *Cercospora kikuchii* | *Cercospora* leaf blight and purple seed stain | |
| | | *Fusarium* spp. | *Fusarium* seed rot, blight/wilt, root rot and pod and collar rot | |
| | | *Rhizoctonia solani* | *Rhizoctonia* damping off and root rot | |
| | | *Fusarium virguliforme* | Sudden death syndrome | |
| | | *Pythium* spp. | *Pythium* root rot | |
| | | *Rhizoctonia solani* | *Rhizoctonia* crown and root rot | |
| | | *Fusarium* spp. | *Fusarium* root rot; | |
| | | *Colletotrichum graminicola* | Anthracnose leaf blight and stalk rot | |
| | Corn | *Cercospora zeae-maydis* | Gray leaf spot | |
| | | *Gibberella zeae* | *Gibberella* stalk rot; | |
| | | *Fusarium* spp. | *Fusarium* stalk rot; | |
| | | *Pythium* spp. | *Pythium* stalk rot | |

In certain embodiments, an amount of a composition provided herein that is sufficient to provide for inhibition of fungal infection in a plant or plant part can be a composition with *Methylobacterium* that inhibit plant pathogenic fungi at a titer of at least about $5 \times 10^8$ colony-forming units per milliliter, at least about $1 \times 10^9$ colony-forming units per milliliter, at least about $1 \times 10^{10}$ colony-forming units per milliliter, or at least about $3 \times 10^{10}$ colony-forming units per milliliter. In certain embodiments, an amount of a composition provided herein that is sufficient to provide for inhibition of fungal disease in a plant or plant part can be a composition with *Methylobacterium* that inhibit plant pathogenic fungi at a titer of about $5 \times 10^8$ colony-forming units per milliliter to at least about $6 \times 10^{10}$ colony-forming units per milliliter. In certain embodiments, an amount of a composition provided herein that is sufficient to provide for inhibition of fungal disease in a plant or plant part can be a fermentation broth product with a *Methylobacterium* that inhibit plant pathogenic fungi titer of a solid phase of that product is at least about $1 \times 10^7$, $5 \times 10^7$, $1 \times 10^8$, or $5 \times 10^8$ colony-forming units per gram to at least about $6 \times 10^{10}$ $1 \times 10^{13}$, or $5 \times 10^{13}$ colony-forming units of *Methylobacterium* per gram of the solid phase wherein a mono-culture or co-culture of *Methylobacterium* that inhibit plant pathogenic fungi is adhered thereto. In certain embodiments, an amount of a composition provided herein that is sufficient to provide for inhibition of fungal disease in a plant or plant part can be a composition with a *Methylobacterium* titer of at least about $1 \times 10^7$, $5 \times 10^7$, $1 \times 10^8$, or $5 \times 10^8$ colony-forming units per gram to at least about $6 \times 10^{10}$, $1 \times 10^{13}$, or $5 \times 10^{13}$ colony-forming units of *Methylobacterium* per gram of particles in the composition containing the particles that comprise a solid substance wherein a mono-culture or co-culture of *Methylobacterium* that inhibit plant pathogenic fungi is adhered thereto. In any of the aforementioned compositions, the indicated concentrations can be fungal inhibitory concentrations.

EXAMPLES

The following examples are included to demonstrate various embodiments. It will be appreciated by those of skill in the art that the techniques disclosed in the following examples represent techniques discovered by the Applicants to function well. However, those of skill in the art should, in light of the instant disclosure, appreciate that many changes can be made in the specific embodiments that are disclosed, while still obtaining like or similar results, without departing from the scope of the disclosure.

Example 1. Suppression of *Fusarium graminearum* by PPFMs

PPFM cultures for seed treatment were grown in AMS-GP medium amended with 0.2% w/v diatomaceous earth (International Patent Application PCT/US13/43722, filed May 31, 2013). Cells were harvested by centrifugation and resuspended in water to a final concentration of approximately $1.3 \times 10^8$ CFU/ml. *Brachypodium distachyon* seeds of inbred line Bd21-3 were treated by incubating overnight in plastic germination boxes between two sheets of germination paper saturated with 30 ml of the PPFM suspension. The germination boxes were placed in the dark at 4° C. for the duration of the seed treatment period. Seeds for the control group were treated similarly, except that water was applied to germination paper.

Treated seeds were planted into soilless potting media and grown in a controlled environment growth chamber (24° C., 50% relative humidity, and light intensity of 200 µmol/m²/s) with a 20 h day-length to promote flowering. Forty-two±two days after planting, reproductively mature *B. distachyon* plants were moved to the greenhouse (21-24° C., 40% relative humidity). In order to allow plants time to acclimate to greenhouse conditions, inoculations were performed two days after transfer to the greenhouse.

*Fusarium graminearum* was maintained on potato dextrose agar (PDA). One week prior to the intended inoculation date, three 8×8 mm agar plugs from the advancing edge of an approximately one-week old *F. graminearum* colony were transferred to 75 ml CMC medium (Cappellini and Peterson, Mycologia 57: 962-966, 1965) in a 250 ml flask. Flasks were wrapped in tin foil and incubated at ambient temperature for six days with shaking (175 rpm). After the sixth day, conidia were harvested by filtering through a double-layer of sterile cheesecloth, followed by centrifugation. The pelleted conidia were then resuspended in sterile deionized (DI) water and the conidial concentration was determined using a hemacytometer. For inoculation, a final concentration of $1 \times 10^5$ conidia/ml was prepared in sterile DI water amended with 0.01% Tween (v/v).

Plants were inoculated by spraying the conidial suspension directly onto spikelets until droplet run-off. Control plants received a mock-inoculation treatment of sterile DI water amended with 0.01% Tween 20. Immediately following inoculation, individual plants were bagged to maintain high humidity and prevent cross-contamination. All plants were then arranged in a randomized complete block design with six replications. Humidity domes were placed over each flat for the first five days to maintain relative humidity near 100%. At 7 days post inoculation, disease incidence and severity were rated for each plant. Incidence was rated as the number of symptomatic spikelets affected divided by the total number of spikelets per plant. The total area of the spikelets per plant showing disease symptoms was used to rate severity and was scored on a 0-5 scale with 0 indicating absence of spikelet symptoms, 1=1-20%, 2=21-40, 3=41-60%, 4=61-80%, and 5=81-100% symptomatic spikelet area per plant.

Of the four NLS strain seed treatments tested (PPFM strains NLS0017, NLS0020, NLS0037, and NLS0066) only the plants from seeds treated with PPFM strain NLS0066 exhibited significantly reduced (95-99% confidence interval) FHB symptom incidence (Table 3) and severity (Table 4) relative to the DI water-treated control. The reduction was at or near 50% for both disease metrics. Seed treatment with PPFM strain NLS0017 decreased both symptom severity and incidence relative to control plants approximately 27%; however, this difference was not significant at the 95% confidence limit. PPFM strains NLS0020 and NLS0037 did not affect either spikelet incidence or symptom severity.

TABLE 3

Spikelet Incidence

| Treatment | Inoculation | Mean | SE | % Difference from Control | Significance |
|---|---|---|---|---|---|
| Water | *F. graminearum* | 27.78 | 3.68 | 0.00 | NS |
| NLS0017 | *F. graminearum* | 20.27 | 7.15 | −27.03 | NS |
| NLS0020 | *F. graminearum* | 30.27 | 5.25 | +8.96 | NS |

TABLE 3-continued

Spikelet Incidence

| Treatment | Inoculation | Mean | SE | % Difference from Control | Significance |
|---|---|---|---|---|---|
| NLS0037 | F. graminearum | 33.44 | 3.34 | +20.27 | NS |
| NLS0066 | F. graminearum | 14.67 | 6.21 | −47.20 | >95% |

TABLE 4

Symptom Severity

| Treatment | Inoculation | Mean | SE | % Difference from Control | Significance |
|---|---|---|---|---|---|
| Water | F. graminearum | 2.12 | 0.33 | 0.00 | NS |
| NLS0017 | F. graminearum | 1.56 | 0.26 | −26.50 | NS |
| NLS0020 | F. graminearum | 1.78 | 0.31 | −16.04 | NS |
| NLS0037 | F. graminearum | 2.17 | 0.26 | +2.36 | NS |
| NLS0066 | F. graminearum | 1.06 | 0.21 | −50.00 | >99% |

Example 2. Identification of PPFM Strains that Confer Resistance to FHB of Wheat in Growth Chamber and Field Tests

*Fusarium* Head Blight (FHB) susceptible wheat cultivar Bobwhite or another FHB-susceptible cultivar will be used for growth chamber studies. For each PPFM isolate to be tested, the seeds will be planted without any PPFM treatment and grown in the growth chamber. The spikes of fifteen plants will be sprayed with a suspension of each PPFM strain at $10^6$ or $10^8$ cfu/ml. Two spikes from each plant will be point-inoculated by injecting the individual florets in the middle of the spike at anthesis with a 10 μl of conidial suspension of *F. graminearum* PH-1 or another virulent *F. graminearum* isolate(s) ($10^5$ spores/ml) or water control (mock) in 0.01% Triton 60 or Tween 20 solution (Goswami and Kistler, 2005). After inoculation, the plants will be placed in a growth chamber at 16° C. for 8 h (night) and 18° C. for 16 h (day). To ensure proper disease severity, the spikes will be covered with plastic bags for 48 h to increase the humidity. The first disease evaluation will be performed 7 days after inoculation. The number of spikelets that exhibit symptoms will be counted for each inoculated spike and recorded. Evaluation will be repeated at 14 days after inoculation. Disease severity will be calculated as percentage of diseased spikelets per spike (disease severity rating) for each date of evaluation. To test the overall treatment effect, area under the disease progress curve (AUDPC) will be calculated for each plant. We anticipate that plants treated with a few PPFM strains will have much lower disease scores (AUDPC) than the control plants. We anticipate that some PPFM strains applied as floral spray will provide resistance to FHB in these growth chamber tests.

PPFM isolates that have been determined to provide FHB resistance in the growth chamber tests will be advanced for testing in the field for their ability to provide FHB resistance. Field tests will be conducted in two or more locations. Field experiments will be conducted using a randomized complete block design with four rows and six replications per treatment. Fifty PPFM-treated seeds per replication will be sown at each location. Four border rows will surround the experiment site and will not be treated with PPFMs. About 2 weeks before anticipated anthesis, yellow dent air-dried corn kernels colonized by a single, aggressive isolate of *F. graminearum* will be spread uniformly at ~25 kernels per m$^2$ throughout the test area. Perithecia will appear on the kernels within a few days and start releasing ascospores at the time of anthesis when wheat is most susceptible to infection by this pathogen. At the time of flowering spikes, PPFM suspension of each strain at $1\times10^8$ cfu/ml in water containing 0.04% Tween 80 or similar surfactant will be applied using a $CO_2$ backpack sprayer as described (Schisler et al., 2002). The control treatments will be sprayed with water containing 0.04% Tween 80 or similar surfactant but no PPFM. During anthesis, spikes will be kept moist by using small, overhead sprinklers for 3 min every hour from morning to dusk.

When plants reach the late milk development stage in the field, assessments of FHB incidence and severity will be made by evaluating 60 heads per replicate as described (Stack and McMullen, 1995). Wheat spikes will be harvested by hand, threshed and evaluated for 100-kernel weight. Ten to 20 g samples of each replicate will be analyzed for its deoxynivalenol (DON) content using the Veratox™ 5/5 quantitative DON test kit (Neogen Corp., Lansing, Mich., USA).

The statistical analysis of the disease incidence and severity and of the DON data will be performed with PROC GLIMMIX of SAS (SAS Institute, Research Triangle Park, N.C.) or the 'lme' and related packages in R (http://www.R-project.org). Data will be considered significantly different at a P value of <0.05. Correlation analysis will be conducted on means for FHB severity and DON content using PROC REG of SAS (SAS Institute, Research Triangle Park, N.C.), which calculates Pearson's correlation coefficient.

(1) Cappellini R A, Peterson J L (1965) Macroconidium formation in submerged cultures by a non-sporulating strain of *Gibberella zeae*. Mycologia 57: 962-966.

(2) Spelbrink R G, Dilmac N, Allen A, Smith T J, Shah D M, et al. (2004) Differential antifungal and calcium channel-blocking activity among structurally related plant defensins. Plant Physiol 135: 2055-2067.

(3) Broekaert W F, Terras F R, Cammue B P, Vanderleyden J (1990) An automated quantitative assay for fungal growth inhibition. FEMS Microbiology Letters 69: 55-60.

(4) Holland, M. A, Polacco, J. C. (1994) PPFMs and other covent contaminants: Is there more to plant physiology than just plant. Annu. Rev. Plant Physiol. Plant Mol Biol 45: 197-208.

(5) Jacobson, B. J. (2006) Biological control of plant diseases by phyllosphere applied biological control agents. In M J Bailey, A K Lilley, T M Timms-Wison, P T N Spencer-Phillips, eds, Microbial ecology of aerial strains in a controlled model system. CAB International, United Kingdom, Wallingford, pp 133-147.

Example 3. Suppression of *Fusarium* Headblight on Greenhouse Grown Wheat

Frozen PPFM concentrates ($1\times10^8$ CFU/mL) were thawed to room temperature immediately prior to use in seed treatment. PPFM concentrates were then vortexed for 10 seconds and 75 μL of each treatment was pipetted into a 15 mL conical tube containing 100 seeds of spring wheat (*Triticum aestivum* L., cv. 'Bobwhite'). To simulate standard industry seed treatments, 66.8 uL of an agricultural polymer solution (Flo Rite 1706 Plantability Polymer, BASF, North Carolina, USA), prepared by combining 6.1 mL polymer with 40 mL deionized water, was added to each treatment tube. Tubes were capped and vortexed for approximately 90 seconds to thoroughly coat seeds. Treated seeds were allowed to air dry under a Kimwipe™ on a lab benchtop prior and a maintained at room temperature prior to use. All seeds were used within one week of treatment. Excess seed were checked for PPFM concentration and viability by placing ten seeds into sterile distilled water, vortexing for ten second, and plating 100 uL of the resulting seed wash onto PPFM-selective medium. Control seeds were treated with a solution of PPFM growth medium and polymer solution.

Treated seeds were planted into a 50/50 mix of soilless potting media/field soil and grown in an air-conditioned greenhouse (70° F. night/68° F. day, 40-90% RH, 16 h day-length) until anthesis. Plants received water daily and fertilizer solution two times per week.

*Fusarium graminearum* was maintained on potato dextrose agar (PDA). One week prior to the intended inoculation date, three 8×8 mm agar plugs from the advancing edge of an approximately one-week old *F. graminearum* colony were transferred to 75 mL CMC medium (Cappellini and Peterson, 1965) in a 250 mL flask. Flasks were incubated at ambient temperature for six days with shaking (175 rpm). After the sixth day, conidia were harvested by filtering through a double-layer of sterile cheesecloth, followed by centrifugation. The pelleted conidia were then resuspended in sterile deionized (DI) water and the conidial concentration was determined using a hemacytometer. For inoculation, a final concentration of $1.0\text{-}2.0 \times 10^5$ conidia/ml was prepared in sterile DI water amended with 0.01% Tween (v/v).

Plants were inoculated by spraying the conidial suspension directly onto spikelets with an airbrush calibrated to 20 psi. Ten mL of conidial suspension were applied evenly across each flat of 18 pots. Control plants received a mock-inoculation treatment of sterile DI water amended with 0.01% Tween. Just prior to inoculation, pots of each treatment were arranged in a randomized complete block design with eighteen replications per treatment. Plants were placed in a mist chamber at 90% relative humidity for 72 h following inoculation then moved to a greenhouse benchtop. At ten days post inoculation, disease severity was rated for each plant. The total area of each head with visible disease symptoms was rated on a 0-100% scale and the individual severity values for heads within a pot was averaged in final analysis.

NLS0089 demonstrated consistent disease suppression relative to control (GlyC) plants, by suppressing disease in four of six trials (Table 5).

TABLE 5

Greenhouse Testing for *Fusarium* Head Blight control

| Treatment | Rep 1 | Rep 2 | Rep 3 | Rep 4 | Rep 5 |
|---|---|---|---|---|---|
| GlyC | 79.5 | 41.9 | 86.7 | NA | NA |
| NLS0089 | 76.8 | 40.0 | 90.1 | NA | NA |
| GlyC | 19.7 | 46.6 | 43.4 | 13.3 | NA |
| NLS0020 | 20.8 | 54.2 | 49.6 | 10.8 | NA |
| NLS0037 | 11.4 | 52.9 | 57.8 | 12.2 | NA |
| NLS0066 | 24.4 | 52.1 | 50 | 10.3 | NA |
| NLS0089 | 19.1 | 56.5 | 47.9 | 6.8 | NA |
| GlyC | 20.4 | 5.2 | 10.7 | NA | NA |
| NLS0017 | 26.3 | 3.6 | 16.2 | NA | NA |
| NLS0017 + 21 | 38.6 | 11.6 | 15.3 | NA | NA |
| NLS0021 | 30.5 | 12.7 | 12.6 | NA | NA |

Example 4. Suppression of FHB in the Field by PPFM Seed Treatment

A field trial to assess *Fusarium* Head Blight (FHB) suppression by PPFM seed treatment was conducted in Brookings, S. Dak. in the spring of 2015. Spring wheat cultivar 'Select' was used for the trial and seeds were sown in the first week of July, with harvest in late September. Due to the late planting date of this trial, yield data were not usable.

The trial was arranged as a randomized complete block design (RBCD) with ten replications. Each block consisted of four 10 foot rows with 254 seeds per plot. In-row seed spacing was ~8.5" apart with 2.11 seeds per linear inch. Two blanks row spaces were left between plots within a replication and a blank plot space was left between replications to provide separation between treatments. Disease rating data were collected only from the two center rows within plots. Throughout the trial, plots were maintained using standard agronomic practices with the exception that no foliar fungicide applications were made for disease control.

PPFM were applied to wheat seed using standard industry treatment practices and were planted within 24 h of seed treatment. The base treatment consisted of Rancona® Summit fungicide for control of seedling disease (8.33 fl oz/cwt), Gaucho® 480 insecticide (3.0 fl oz/cwt), and industry standard seed treatment polymer (1.0 fl oz/cwt; Flo Rite 1706 Plantability Polymer, BASF Corporation, North Carolina, USA). Concentrated PPFM treatments were supplied frozen on dry ice and thawed immediately prior to use in seed treatment. PPFM solutions were applied to achieve a target of $1.0 \times 10^6$ CFUs of PPFM bacteria/seed. Treatments are listed in Table 6.

TABLE 6

| Treatment No | Treatment | Product |
|---|---|---|
| 1 | Base | Rancona ® Summit Gaucho ® 480 Polymer (FR 1706) |
| 2 | Base + NLS0017 | Rancona ® Summit Gaucho ® 480 Polymer (FR 1706) NLS0017 |
| 3 | Base + NLS0020 | Rancona ® Summit Gaucho 480 Polymer (FR 1706) NLS0020 |
| 4 | Base + NLS0066 | Rancona Summit Gaucho ® 480 Polymer (FR 1706) NLS0066 |
| 5 | Base + NLS0089 | Rancona Summit Gaucho ® 480 Polymer (FR 1706) NLS0089 |
| 6 | Base + NLS0017 NLS0066 | Rancona Summit Gaucho ® 480 Polymer (FR 1706) NLS0017 NLS0066 |

Prevailing environmental conditions were highly favorable to disease, resulting in strong natural FHB pressure. Artificial inoculation in the form of locally sourced *Fusarium graminearum* conidia was applied to half of the replications in the trial. Inoculum was applied at a concentration of $1 \times 10^4$ conidia/mL and 25 mL were applied per plot. Disease data for inoculated and naturally infected plots were not significantly different; thus, data points were pooled for final analysis. Disease ratings were taken approximately one month following inoculation. Metrics collected were percent FHB incidence, determined on a plot level by visual inspection, and disease severity, determined by rating a sample of 20 individual detached heads collected from the field. A disease index was also calculated for each plot using the formula: [(Incidence×Severity)/100].

Disease data were analyzed using the JMP (version. 11) statistical discovery software package from SAS (SAS Institute, Research Triangle Park, N.C.). Data were analyzed using a mixed model with 'treatment' and 'inoculation' specified as fixed effects and 'block' as a random effect. After the determination that 'inoculation' had no significant effect on disease outcomes, this factor was dropped from the model. A summary of results is provided in Table 7.

TABLE 7

| Treatment | FHB Incidence (%) | FHB Severity (%) | Disease Index |
|---|---|---|---|
| Control (Base) | 94.2 | 55.42 | 52.15 |
| NLS0017 | 84.3***$^a$ | 52.97 | 44.54 |
| NLS0020 | 85.8*** | 59.58 | 51.26 |
| NLS0066 | 84.3*** | 57.77 | 48.73 |
| NLS0089 | 84.7*** | 46.60* | 39.43** |
| NLS0017 + NLS0066 | 84.1*** | 51.02 | 42.90 |

Asterisks indicate statistical significance relative to the control treatment (Base treatment without PPFM) as follows: *$P < 0.10$, $P < 0.05$, *$P < 0.01$.

NLS0089 significantly reduced disease by all metrics, decreasing disease index by 24% relative to the control. The combination of NLS0017 and NLS0066 reduced disease by all metrics, performed best for reduction in FHB disease incidence, and performed better than either strain applied singly. NLS0017 alone also reduced disease by all metrics. NLS0020, which had not shown suppression of FHB in controlled environment trials was included as a negative control, and performed as expected.

Example 5. Suppression of *Rhizoctonia*-Damping Off Disease

PPFMs were tested for their ability to suppress *Rhizoctonia*-damping off disease. For these assays, PPFM strains, a non-treated control, and a positive control (*Pseudomonas fluorescens*) were arranged into three blocks on a 96-well plate, grown for 24 h at 30° C. with shaking at 250 rpm, then stored at −80° C. Frozen stock plates were used to start new cultures as needed. For the *Rhizoctonia* damping off assay, cultures started from −80° C. stocks were grown for 5 days in a 1 mL well-volume 96-well plate in ammonium mineral salts (AMS) medium containing peptone, glutamate as the carbon source, and an appropriate solid substrate for promotion of *Methylobacterium* growth (International Patent Application PCT/US13/4372, filed May 31, 2013).

Growth conditions were 30° C. with shaking on a platform shaker at 250 rpm. Five-hundred uL of PPFM culture from each well of the 96-well plate was pipetted into a correspondingly labeled two mL microcentrifuge tube and three pea seeds (*Pisum sativum* L., cv. Sugar snap; Johnny's Seeds, Maine, USA) were placed in each tube. After peas were placed into a tube, it was capped and shaken to coat seeds with bacterial solution. After c. one hour, seeds were planted into pathogen-infested potting media.

*Rhizoctonia solani* inoculum was prepared by autoclaving a mixture of ground yellow cornmeal and sand two times, then inoculating with agar plugs excised from the advancing edge of fungal cultures less than one-week old. The inoculated cornmeal-sand mixture was incubated for approximately two weeks on a lab benchtop and shaken every few days to evenly disperse inoculum. After two weeks, inoculum was dried overnight in a sterile biological safety food, then stored at 4° C. until use. A small sample from each inoculum batch was plated onto potato dextrose agar at the time of harvest to check for colonization and to ensure that contaminants were not present in the inoculum. Inoculum was incorporated into potting media just before planting at a final rate of 0.73 g inoculum per cup and deionized water was added to potting media at a final rate of 6.25 mL per cup. Pathogen-infested potting media was placed 96 cups, one labeled for each well in the 96-well bacterial culture plate, and the three seeds from the corresponding well seed treatment tube were planted into each cup. Cups were then covered with a lid to create a high humidity environment and placed into a growth chamber with a 14-hour day-length and constant temperature of 27° C. Dixie ice cream cups were used for this experiment because 1) the closed cup prevent risk of cross-contamination between treatments and 2) the cups come with lids that can be used to increase humidity and prevent the need for watering during the experiment.

Plants were rated for disease severity at one week after planting/inoculation. Ratings included pre-emergence damping off, post-emergence damping off, and plant health. Pre-emergence damping off was rated by counting the total number of seeds per pot that did not germinate; post-emergence damping off was rated by counting the number of seeds per pot that were killed shortly after germination; plant health was rated on a 0-5 scale as follows: 0=dead plant; 1=severely stunted/necrotic plant; 2=moderate to severe stunting and necrosis; 3=moderate stunting and/or necrosis; 4=generally healthy plant with small lesions or slight growth delay; 5=healthy plant. For data analysis, the total number of seedlings with damping off and average plant health per pot values were averaged across the three replicates per treatment. These values were compared to the control. Strains for which [strain average−one standard error of the mean] did not overlap with [non-treated control average+one standard error of the mean] were considered to provide disease suppression. Disease rating data is summarized in Table 8 and plant health data is summarized in Table 9.

TABLE 8

*Rhizoctonia* Average Plant Health Ratings

| Treatment | Avg Plant Health Rating ± SEM |
|---|---|
| No treatment control | 0.89 ± 0.59 |
| *Pseudomonas fluorescens* | 0.56 ± 0.29 |
| NLS0017 | 2.67 ± 0.33 |
| NLS0020 | 1.00 ± 0.58 |
| NLS0037 | 1.67 ± 0.38 |
| NLS0038 | 1.44 ± 0.78 |
| NLS0089 | 2.67 ± 0.69 |

$^a$Average calculated from combining plant health scores from three replicate pots per treatment with each pot containing three seedlings. SEM calculated using n = 3 for the three replicate pots.

TABLE 9

*Rhizoctonia* Average Number of Damped-Off Seedlings

| Treatment | Avg Plant Health Rating ± SEM |
|---|---|
| No treatment control | 2.33 ± 0.67 |
| *Pseudomonas fluorescens* | 2.33 ± 0.33 |
| NLS0017 | 0.67 ± 0.33 |

TABLE 9-continued

Rhizoctonia Average Number of Damped-Off Seedlings

| Treatment | Avg Plant Health Rating ± SEM |
|---|---|
| NLS0020 | 2.00 ± 0.58 |
| NLS0037 | 1.33 ± 0.33 |
| NLS0038 | 1.67 ± 0.67 |
| NLS0089 | 0.67 ± 0.33 |

[a]Average calculated by combining seedling counts from three replicate pot per treatment with each pot containing three seedlings. SEM calculated using n = 3 for the three replicate pots.

Cumulative seedling damping off and plant health were measured and analyzed separately. Strains NLS0017 and NLS0089 suppressed overall seedling damping off and increased overall plant health. These *Methylobacterium* spp. strains have potential for use as seed or in-furrow treatments to protect against *Rhizoctonia*-related diseases.

Example 6. Suppression of White Mold (*Sclerotinia sclerotiorum*) in Soybean by PPFMs Two mL frozen PPFM stock solutions at a concentration of approximately $1 \times 10^8$ CFU/mL were thawed to room temperature directly prior to seed treatment. Thawed PPFM stocks were pelleted by centrifuging, washed once with sterile distilled water, then re-suspended in a final volume of 20 mL sterile distilled water. The 20 mL solution was placed in a 50 mL conical tube and 40 soybeans seeds were placed into the tube with the PPFM solution. The tube was placed on its side and agitated every 10 minutes for a total of 30 minutes. After the 30 minute treatment period, excess liquid was decanted and treated seeds were planted immediately.

Seeds were planted into either potting media, field soil, or a 50/50 mix of potting media and field soil, depending on the specific experiment. In all experiments, flats holding 18 pots each were used and the pots containing individual treatments were organized into randomized complete blocks either at planting or just prior to inoculation. Immediately after planting, pots were moved to a greenhouse (75-80° F.; RH 40-90%; 16 h day-length) and grown there for one month. Plants were watered daily and received supplemental fertilizer two times per week.

One-month old plants were inoculated with 5-7 day-old cultures of *Sclerotinia sclerotiorum* grown on potato dextrose agar PDA in the dark. A modified version of the cut petiole inoculation technique was used (Hoffman et al. 2002. Plant Dis. 86:971-980). Briefly, the petiole of the third trifoliate was cut with scissors approximately one inch from the stem. The broad end of a 1000 uL pipet tip was used to excise an agar disk from the outer edge of an *S. sclerotiorum* culture. The tip was then placed over the cut petiole such that the broad end of the pipet tip was in contact with the stem and petiole base and the cut end of the petiole was in contact with the mycelium side of the agar plug. A small piece of parafilm was wrapped around the tip and stem to prevent the tip from falling off. Inoculated plants were incubated in the greenhouse for 7-10 days to allow for disease development prior to rating.

Lesion length and wilt severity were collected as disease metrics. Length of brown or bleached lesions was measured using a ruler. Wilt severity was rated on a 0-5 scale with 0 indicating a completely health plant and 5 indicating a dead plant. The experiment was conducted as a randomized complete block design with nine blocks per experimental repetition and the experiment was repeated three times, for a sample size of 27 experimental units for each treatment group. Data were analyzed using mixed models analysis in JMP v11.2 (SAS Institute; Cary, N.C.). Wilt and lesion length data were analyzed separately. In each case, repetition was included as a random effect and treatment as a fixed effect. Model fitting criteria determined that blocks within repetitions did not contribute significantly and this factor was dropped from final analysis.

Figure 2:
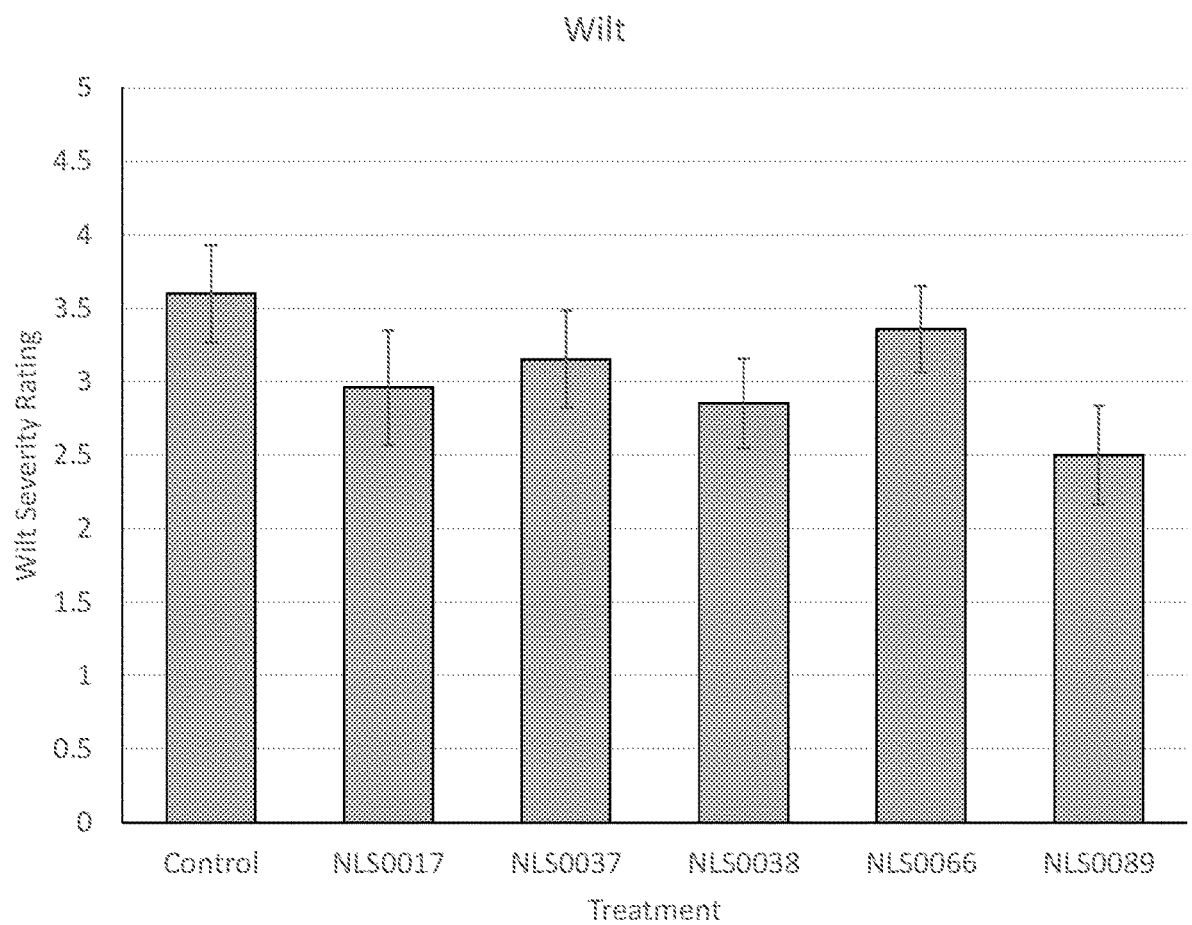
FIG. 2 is a bar chart showing suppression of soybean white mold wilt symptom severity by NLS0089.
Figure 3:
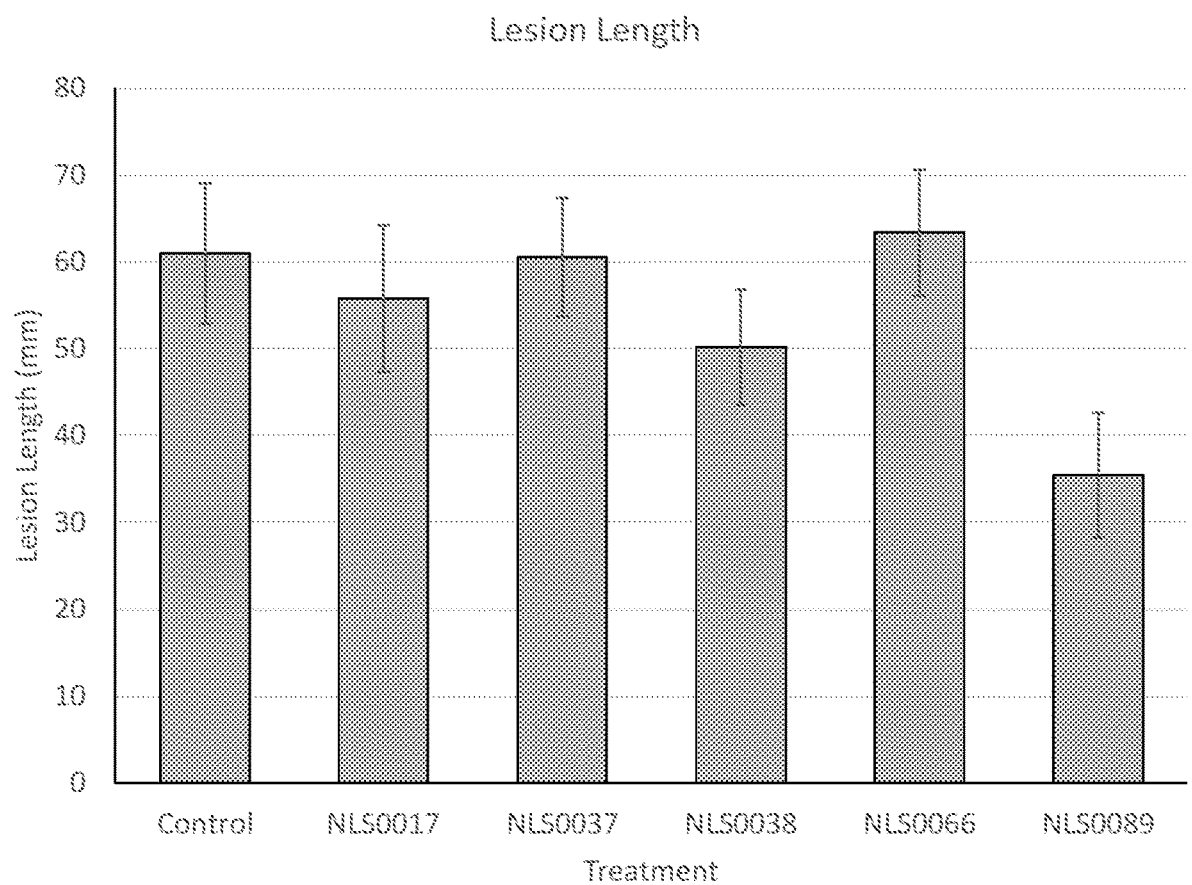
FIG. 3 is a bar chart showing suppression of soybean white mold lesion length development by NLS0089.

Across all three repetitions of the experiment, treatment with NLS0089 significantly reduced both wilt (FIG. 2) and lesion length (FIG. 3) relative to the non-treated control group (Two-sample independent t-test; P<0.01). No other treatment had a significant effect on either disease severity metric. NLS0089 decreased wilt severity by >30% compared to the control group and decreased lesion length relative to the control group by >40%.

Of the five strains tested in this experiment, only NLS0089 significantly reduced both indicators of white mold severity relative to the control group. This strain has the potential to provide suppression of the disease under agronomic conditions and could provide a valuable complement to current white mold disease management practices.

Example 7. Suppression of Soybean Sudden Death Syndrome by PPFMs

Frozen PPFM stock solutions at a concentration of approximately $1 \times 10$ CFU/mL were thawed to room temperature directly prior to seed treatment. Batches of 200 seeds were treated in a laboratory scale seed treater with 1 uL/seed of PPFM concentrate and 0.89 uL/seed of dilute polymer solution (FR1706, Becker Underwood; 6.1 mL polymer diluted in 40 mL deionized water). After treatment, seeds were allowed to dry overnight and were used within one week of treatment. To assess PPFM colonization and viability, aliquots of ten seeds were vortexed for 10 seconds in 10 mL of sterile 0.9% saline solution and 100 uL of the resulting wash solution was plated on PPFM-specific agar plates. Control seeds were treated with stock solutions of PPFM growth medium/polymer solution. The treater was thoroughly cleaned with 70% ethanol between each treatment to prevent cross contamination.

*Fusarium virguliforme* isolates were obtained from the USDA-ARS NRRL culture collection. Cultures were maintained at room temperature on PDA and clarified V8 juice agar. Isolates were also stored at in glycerol at −80° C. and were re-isolated from plants every few months to ensure continued aggressiveness. Inoculum was prepared by soaking sorghum grain overnight in tap water in a 500 mL Erlenmayer flask with a vented lid, draining all water the following day, and autoclaving on a one-hour liquid cycle for two consecutive days. The day after autoclaving was completed, the sterile sorghum grain was inoculated with six agar plugs excised from a 2-4 week-old culture of *Fusarium virguliforme*. Inoculated flasks were incubated on a lab benchtop for approximately two weeks and shaken every few days to evenly disperse inoculum. After two weeks, the colonized grains were plated onto PDA to check for contamination and the inoculum was moved to 4° C. until use. Inoculum was discarded and no longer used for screening assays after one month in storage.

Inoculation occurred at the time of planting. Pots were filled half-full with a 50:50 non-sterile field soil:sand mix and treatments were arranged into a randomized complete block with both inoculated and un-inoculated pots for each PPFM treatment within each block. Inoculated pots received 5 g of sorghum grain inoculum, which was incorporated into the soil mixture prior to the addition of seeds. Two seeds were planted into each pot and then covered with approximately two centimeters of sand:soil mix. For the first two weeks after planting, the experiments were maintained in a growth chamber at 20° C. and watered daily to provide conditions conducive to SDS. After two weeks, the experiments were transferred to a greenhouse at around 23-27° C. and incubated for another two weeks to allow development of aboveground SDS symptoms.

SDS disease severity ratings and plant biomass measurements were taken one month after planting and inoculation. Aboveground disease severity measurements were rated on a 0-5 scale with 0 indicating a completely health plant and 5 indicating a dead plant. After rating, plants were harvested and roots were washed to remove adherent soil before drying. Dry root and shoot biomasses were taken individually to allow for between treatment comparisons for each plant part. Raw data and data on effect size, the difference between inoculated and uninoculated plants for each treatment, were analyzed with Excel and JMP version 11.2 (SAS Institute, Cary, N.C.).

PPFM strains were tested in groups alongside a mock-treated control, which was included in all testing groups. Due to differences between experiments, data for different testing groups are shown separately. In one testing group, NLS0066, strongly reduced the effect size of SDS-related disease metrics, particularly root biomass, indicating that these strains restricted development of disease symptoms and protected plants from growth decreases caused by SDS infection (Tables 10-12). Effect size was calculated as the difference between the inoculated and un-inoculated plants for a given treatment. In the absence of pathogen pressure, NLS0066 had no effect on plant growth.

TABLE 10

Effect Size of PPFM Treatments on SDS Severity[a]

| Treatment | Control Severity ± SEM | Inoculated Severity ± SEM | Effect Size[b] |
|---|---|---|---|
| GlyC-Control | 0.88 ± 0.07 | 2.32 ± 0.04 | −1.44 |
| NLS0038 | 0.92 ± 0.07 | 2.24 ± 0.04 | −1.32 |
| NLS0046 | 0.5 ± 0.07 | 2.46 ± 0.04 | −1.96 |
| NLS0066 | 1.29 ± 0.07 | 2.32 ± 0.03 | −1.03 |

[a]Severity was rated on a 0-5 scale with 0 indicating a fully healthy plant and 5 a dead plant. Sample size of n = 54 per treatment.
[b]A less negative value for effect size indicates a small increase in symptom severity with pathogen inoculation

TABLE 11

Effect Size of PPFM Treatments on Root Weight[a] of SDS-Inoculated Plants

| Treatment | Control Root Weight ± SEM | Inoculated Root Weight ± SEM | Effect Size[b] |
|---|---|---|---|
| GlyC-Control | 960.37 ± 16.57 | 545.99 ± 7.59 | 414.38 |
| NLS0038 | 845.25 ± 14.29 | 540.52 ± 7.67 | 304.73 |
| NLS0046 | 822.73 ± 18.92 | 459.93 ± 7.04 | 362.80 |
| NLS0066 | 737.63 ± 8.84 | 619.58 ± 9.98 | 118.05 |

[a]Root weights given in units of mg. Sample size of n = 54 per treatment.
[b]A smaller effect size indicates a reduced effect of pathogen inoculation.

TABLE 12

Effect Size of PPFM Treatments on Shoot Weight[a] of SDS-Inoculated Plants

| Treatment | Control Root Weight ± SEM | Inoculated Root Weight ± SEM | Effect Size[b] |
|---|---|---|---|
| GlyC-Control | 685.82 ± 11.63 | 455.99 ± 5.19 | 229.83 |
| NLS0038 | 525.57 ± 10.25 | 429.13 ± 3.76 | 96.44 |
| NLS0046 | 497.85 ± 11.25 | 440.84 ± 4.73 | 57.01 |
| NLS0066 | 411.43 ± 7.96 | 448.97 ± 4.23 | −37.54 |

[a]Shoot weights given in units of mg. Sample size of n = 54 per treatment.
[b]A smaller effect size indicates a reduced effect of pathogen inoculation.

Seed treatment of soybean with NLS PPFM strain NLS0066 resulted in strong effects on development of disease caused by the SDS pathogen $F.$ $virguliforme$ under greenhouse conditions. These strains offer potential as biological control agents that could be used singly or in combination with other strains and/or disease mitigation strategies to provide effective and sustainable management of SDS.

Example 8. Corn and Soybean Field Trials Summer of 2015

In the summer of 2015, field trials to evaluate disease suppression in corn and soybeans by PPFMs were performed at two independent locations: Bethel, Mo. and Troy, Ohio. Both trial locations were managed by contract research organizations. NewLeaf Symbiotics personnel visited each site at least twice to ensure proper trial implementation. The same strains and application rates were tested at both locations. The trials were arranged as a split-plot within an RCBD (randomized complete block design) with six replications at the Bethel site and four replications at the Troy site. Treatments for corn are described in Table 13 and treatments for soybean are described in Table 14. In-furrow treatments were applied at a rate of 1,250 mL 10×PPFM concentrate per acre and foliar treatments were applied at a rate of 5,000 mL 10×PPFM concentrate per acre. The split-plot design allowed for the evaluation of in-furrow treatment, foliar treatment, response to sequential PPFM treatments, and interactions between different PPFMs.

TABLE 13

2015 Pathology Corn Field Trial Treatments

| Treatment Number | Whole-plot treatment | Sub-plot treatment |
|---|---|---|
| 1 | Mock | Mock |
| 2 | NLS0020 | Mock |
| 3 | Mock | NLS0020 |
| 4 | NLS0020 | NLS0020 |
| 5 | Mock | NLS0066 |
| 6 | NLS0020 | NLS0066 |

TABLE 14

2015 Pathology Soybean Field Trial Treatments

| Treatment Number | Whole-plot treatment | Sub-plot treatment |
|---|---|---|
| 1 | Mock | Mock |
| 2 | NLS0089 | Mock |
| 3 | Mock | NLS0020 |
| 4 | NLS0089 | NLS0020 |
| 5 | Mock | NLS0066 |
| 6 | NLS0089 | NLS0066 |

At each site, conventional row spacing was used and standard agronomic practices were followed. Corn and soy hybrids with similar genetics but suitable for the specific trial locations were supplied for each site. Sub-plot sizes were no less than four 20' rows. A five-foot border was left between sub-plots to mitigate neighbor effects. Additionally, observations were taken from only the center two rows of each plot. Whole-plots consisted of the four sub-plots plus five foot borders between plots. Trial locations were selected in areas with natural disease pressure and no artificial inoculations were made. As a result, the same diseases were not evaluated at each location. Diseases rated in corn were anthracnose (*Colletotrichum graminicola*), grey leaf spot (*Cercospora zeae-maydis*), and common rust (*Puccinia sorghi*). Diseases rated in soybean were brown spot (*Septoria glycines*) and other foliar diseases. For each disease present, incidence and/or severity ratings were collected and analyzed to determine treatment effects.

Disease ratings and statistical analysis results are reported in Tables 3-5. Due to the different disease ratings and replication number at each site, data from the two trial locations were analyzed separately. Data analyses were performed using SAS JMP software v11.2 (SAS Institute, Cary, N.C.). Data were analyzed according to JMP guidelines for split-plot analysis within the 'Fit Model' function, which uses the REML technique for mixed models. Student's T and Tukey's HSD post hoc tests were applied to determine differences between treatment groups ($\alpha$=0.05). Contrasts were used to make comparisons between specific groups of interest.

TABLE 15

Soybean Foliar Disease - Bethel, Missouri

| Whole-plot (in-furrow) Treatment | Sub-plot (foliar) Treatment | Brown spot severity early (%) | Brown spot severity late (%) | Leaf spot severity early (%) | Leaf spot severity late (%) |
|---|---|---|---|---|---|
| Mock | Mock | 3.00 | 8.33 | 1.67 | 5.50 |
| Mock | NLS0020 | 1.33$^T$ | 4.17$^{T,H}$ | 0.17$^{T,H}$ | 2.00$^{T,H}$ |
| Mock | NLS0066 | 1.67$^T$ | 4.83$^T$ | 0.67$^T$ | 4.17 |
| NLS0089 | Mock | 1.17$^T$ | 5.00$^T$ | 0.17$^T$ | 2.50$^{T,H}$ |
| NLS0089 | NLS0020 | 1.17$^T$ | 5.17$^T$ | 0.33$^{T,H}$ | 2.50$^{T,H}$ |
| NLS0089 | NLS0066 | 1.67 | 5.17$^T$ | 0.33$^{T,H}$ | 4.33 |

$^T$Treatment significantly different from control (Mock, Mock) by Student's T-test ($\alpha$ = 0.05)
$^H$Treatment significantly different from control (Mock, Mock) by Tukey's HSD ($\alpha$ = 0.05)

TABLE 16

Corn Foliar Disease - Bethel, Missouri

| Whole-plot (in-furrow) Treatment | Sub-plot (foliar) Treatment | Anthracnose severity (%) | Gray leaf spot severity early (%) | Gray leaf spot severity late (%) | Common rust severity (%) |
|---|---|---|---|---|---|
| Mock | Mock | 21.17 | 3.17 | 13.00 | 12.17 |
| Mock | NLS0020 | 18.83 | 2.00$^{T,H}$ | 11.33 | 11.67 |
| Mock | NLS0066 | 9.50$^{T,H}$ | 1.83$^{T,H}$ | 10.83$^T$ | 10.50 |
| NLS0020 | Mock | 18.67 | 2.17$^T$ | 11.83 | 10.67 |
| NLS0020 | NLS0020 | 17.83 | 2.00$^T$ | 11.50 | 11.33 |
| NLS0020 | NLS0066 | 9.17$^T$ | 1.00$^{T,H}$ | 9.50$^{T,H}$ | 9.67$^T$ |

$^T$Treatment significantly different from control by Student's T-test ($\alpha$ = 0.05)
$^H$Treatment significantly different from control by Tukey's HSD ($\alpha$ = 0.05)

TABLE 17

Corn Foliar Disease - Troy, Ohio

| Whole-plot (in-furrow) Treatment | Sub-plot (foliar) Treatment | Gray leaf spot severity (%) | Tip dieback severity (%) | Tip dieback incidence (%) | Stalk rot severity (%) |
|---|---|---|---|---|---|
| Mock | Mock | 67.50 | 11.00$^i$ | 0.17$^i$ | 1.55 |
| Mock | NLS0020 | 67.50 | 8.25 | 0.14 | 1.60 |
| Mock | NLS0066 | 62.50 | 12.50 | 0.18 | 1.45 |
| NLS0020 | Mock | 65.00 | 7.50* | 0.12* | 1.85 |
| NLS0020 | NLS0020 | 67.50 | 10.00 | 0.16 | 1.55 |
| NLS0020 | NLS0066 | 60.00 | 9.00 | 0.14 | 1.45 |

$^i$The average across all mock in-furrow treatments was significantly different from the average across all NLS0020 in-furrow treatments by contrast ($\alpha$ = 0.05)
*Treatment significantly different from control (Mock, Mock) by contrast ($\alpha$ = 0.10)

All treatments applied to soybeans demonstrated disease suppression against both brown spot (*Septoria glycines*) and other foliar leaf spot diseases. Foliar application of NLS0020 without in-furrow treatment resulted in the lowest rating for all diseases and was the most effective treatment for suppression of disease relative to the control. Foliar application of NLS0020 following NLS0089 in-furrow treatment also demonstrated disease suppression across all treatments. In-furrow treatment with NLS0089 alone significantly reduced all diseases and had a particularly strong effect against foliar leaf spot diseases.

In corn at the Bethel, Mo. site, in-furrow application of NLS0020 improved the disease suppression provided by NLS0066 foliar applications in all examples. This demonstrates enhanced efficacy through multiple applications of these specific PPFM strains. No application of NLS0020, including in-furrow followed by foliar, provided suppression of more than one disease.

At the Troy, Ohio location, the in-furrow application of NLS0020 alone suppressed both the severity and incidence of tip dieback, which can be indicative of an effect on disease and abiotic stressors. Additionally, all applications of in-furrow NLS0020 combined suppressed tip dieback metrics relative to all mock in-furrow treatments combined, indicating an overall positive effect of NLS0020 in-furrow treatment.

Example 9. Identification of Nucleic Acid Polymorphisms Present in *Methylobacterium* that Inhibit Plant Pathogenic Fungi Whole genome sequencing libraries for the Illumina™ high-throughput sequencing platform are generated for *Methylobacterium* sp. isolates provided in Table 1 using Illumina TRUSEQ™ or NEXTERA™ DNA sample preparation kits (described on the internet sites res.illumina.com/documents/products/datasheets/datasheet_truseq_dna_sample_prepkits.pdf and res.illumina.com/documents/products/datasheets/datasheet_nextera_dna_sample_prep.pdf) using the methods described by the manufacturer. The resultant libraries are then subjected to pyrosequencing (Siqueira J F et al. J Oral Microbiol. 2012; 4: 10.3402/jom.v4i0.10743).

Raw pyrosequencing-generated genomic sequence data are subjected to adaptor- and quality-based trimming for quality control. Whole-genome Shotgun Sequence Assembly (1) is achieved by assembling quality-passed data using the de novo assembler Velvet (2). For gene finding and annotation, reference training data is leveraged from TIGR-FAM (9), Pfam, COG (10), and UniRef100 (11). The rRNAs are identified with RNAmmer (5), protein-coding genes are identified with Glimmer (3) or Maker (6), and tRNAs are identified with tRNAscan-SE (4). Gene functions are assigned with blastx (7), blastp (7), HMMER (8), and InterProScan against comprehensive protein databases described above (Reference Data).

Detection of polymorphisms (SNP or other DNA variations occurring as a result of insertions, deletions, and substitutions (Indels)) in the *Methylobacterium* sp. isolates of Table 1 is performed with BWA (12) and the Samtools suite (on the internet at samtools.sourceforge.net/), structural variation is identified with BreakDancer (on the internet at breakdancer.sourceforge.net/) and CoGE (on the internet at genomevolution.org/CoGe/). Polymorphisms diagnostic for *Methylobacterium* that inhibit plant pathogenic fungi are identified by comparisons of the sequences of *Methylobacterium* isolate NLS0066 that inhibits plant pathogenic fungi but that are absent from one or more *Methylobacterium* isolates NLS0020 and/or NLS0037 that do not inhibit *Fusarium graminearum* infections of plants. Polymorphisms present in *Methylobacterium* isolate NLS0066 that inhibit plant pathogenic fungi but that are absent in *Methylobacterium* isolates NLS0020 and/or NLS0037 that do not inhibit *Fusarium graminearum* are then used to identify other *Methylobacterium* isolates that inhibit plant pathogenic fungi.

REFERENCES FOR EXAMPLE 9

1. Miller J R, Koren S, Sutton G (2010) Assembly algorithms for next-generation sequencing data. Genomics 95: 315-327.
2. Zerbino D R, Birney E (2008) Velvet: algorithms for de novo short read assembly using de Bruijn graphs. Genome Res 18: 821-829.
3. Delcher A L, Bratke K A, Powers E C, Salzberg S L (2007) Identifying bacterial genes and endosymbiont DNA with Glimmer. Bioinformatics 23: 673-679.
4. Lowe T M, Eddy S R (1997) tRNAscan-S E: a program for improved detection of transfer RNA genes in genomic sequence. Nucleic Acids Res 25: 955-964.
5. Lagesen K, Hallin P, Rodland E A, Staerfeldt H H, Rognes T, et al. (2007) RNAmmer: consistent and rapid annotation of ribosomal RNA genes. Nucleic Acids Res 35: 3100-3108.
6. Cantarel B, Korf I, Robb S, et al. (2008) MAKER: An easy-to-use annotation pipeline designed for emerging model organism genomes. Genome Research 18: 188-196.
7. Altschul S F, Madden T L, Schaffer A A, Zhang J, Zhang Z, et al. (1997) Gapped BLAST and PSI-BLAST: a new generation of protein database search programs. Nucleic Acids Res 25: 3389-3402.
8. Eddy S R (2009) A new generation of homology search tools based on probabilistic inference. Genome Inform 23: 205-211.
9. Haft D H, Selengut J D, White O (2003) The TIGRFAMs database of protein families. Nucleic Acids Res 31: 371-373.
10. Tatusov R L, Fedorova N D, Jackson J D, Jacobs A R, Kiryutin B, et al. (2003) The COG database: an updated version includes eukaryotes. BMC Bioinformatics 4: 41.
11. Suzek B E, Huang H, McGarvey P, Mazumder R, Wu C H (2007) UniRef: comprehensive and non-redundant UniProt reference clusters. Bioinformatics 23: 1282-1288.
12. Li H. and Durbin R. (2009) Fast and accurate short read alignment with Burrows-Wheeler Transform. Bioinformatics, 25:1754-60.

Example 10. Identification of Orthologous Genes Present in *Methylobacterium* sp. that can Inhibit Plant Pathogenic Fungi The PPFM strains listed in Table 1 (NLS066, NLS0020, NLS0037) and/or other PPFM strains that do or do not inhibit plant pathogenic fungi can be grown on solid agar media comprising Ammonium Mineral Salts (AMS) plus glycerol and peptone at 30° C. for 5 days, essentially as described in co-assigned U.S. Patent Application Publication No. US20130324407 and incorporated herein by reference in its entirety. Genomic DNA can be extracted using MO-BIG (Carlsbad, Calif.) Ultra Clean™ Microbial DNA Isolation kit, and 1 μg of high quality DNA can be used for Illumina Nextera™ XT library preparation followed by Illumina 2×100 paired-end sequencing on a HiSeq2000™ system. Raw Illumina genomic sequence data can be subjected to adaptor- and quality-based trimming for quality control. Whole-genome Shotgun Sequence Assembly can be achieved by assembling quality-passed data using the de novo assembler SPADES (33). For gene finding and annotation, reference training data can be leveraged from TIGRFAM (9), Pfam, COG (10), and UniRef100 (11). The rRNAs can be identified with RNAmmer (5), protein-coding genes can be identified with Glimmer (3) and Maker (6), and tRNAs can be identified with tRNAscan-SE (4). Gene functions can be assigned with blastx (7), blastp (7), HMMER (8), and InterProScan against comprehensive protein databases described above (Reference Data). Detection of polymorphisms (SNP or other DNA variations occurring as a result of insertions, deletions, and substitutions (Indels)) in the *Methylobacterium* sp. isolates can be performed with BWA (12) and the Samtools suite (on the internet at samtools.sourceforge.net/) and the Genome Analysis Toolkit (GATK, on the world wide web internet site "broadinstitute.org/gatk/"), structural variation can be identified with BreakDancer (on the internet at breakdancer.sourceforge.net/) and CoGE (on the internet at genomevolution.org/CoGe/). Such methods for analyzing *Methylobacterium* sp. genomes of isolates that improve tomato production are disclosed in International Patent Application PCT/US2014/068611, which is incorporated herein by reference in its entirety.

Genes that encode open reading frames can be predicted from the assembled whole genomic sequences of NLS0020, NLS0037, and NLS066 essentially as described above. Within and between genome orthologous genes can be clustered using OrthoMCL (available on the world wide web internet site "orthomcl.org/orthomcl/"). Putative functional annotations can be assigned to gene products using BLASTP (available on the internet site "blast.ncbi.nlm.nih.gov/Blast.cgi") against the UniProt database (available on the world wide web internet site "uniprot.org/"). Genes present in individual genomes of the NLS0066 (as shown in Example 1) or other isolate that could inhibit plant pathogenic fungi but that are absent in the genome of NLS0037 and/or NLS0020 (as shown in Example 1) or other isolate that do not inhibit plant pathogenic fungi can be identified in OrthoMCL clusters using custom software.

REFERENCES FOR EXAMPLE 10

1. Miller J R, Koren S, Sutton G (2010) Assembly algorithms for next-generation sequencing data. Genomics 95: 315-327.

2. Zerbino D R, Birney E (2008) Velvet: algorithms for de novo short read assembly using de Bruijn graphs. Genome Res 18: 821-829.
3. Delcher A L, Bratke K A, Powers E C, Salzberg S L (2007) Identifying bacterial genes and endosymbiont DNA with Glimmer. Bioinformatics 23: 673-679.
4. Lowe T M, Eddy S R (1997) tRNAscan-S E: a program for improved detection of transfer RNA genes in genomic sequence. Nucleic Acids Res 25: 955-964.
5. Lagesen K, Hallin P, Rodland E A, Staerfeldt H H, Rognes T, et al. (2007) RNAmmer: consistent and rapid annotation of ribosomal RNA genes. Nucleic Acids Res 35: 3100-3108.
6. Cantarel B, Korf I, Robb S, et al. (2008) MAKER: An easy-to-use annotation pipeline designed for emerging model organism genomes. Genome Research 18: 188-196.
7. Altschul S F, Madden T L, Schaffer A A, Zhang J, Zhang Z, et al. (1997) Gapped BLAST and PSI-BLAST: a new generation of protein database search programs. Nucleic Acids Res 25: 3389-3402.
8. Eddy S R (2009) A new generation of homology search tools based on probabilistic inference. Genome Inform 23: 205-211.
9. Haft D H, Selengut J D, White O (2003) The TIGRFAMs database of protein families. Nucleic Acids Res 31: 371-373.
10. Tatusov R L, Fedorova N D, Jackson J D, Jacobs A R, Kiryutin B, et al. (2003) The COG database: an updated version includes eukaryotes. BMC Bioinformatics 4: 41.
11. Suzek B E, Huang H, McGarvey P, Mazumder R, Wu C H (2007) UniRef: comprehensive and non-redundant UniProt reference clusters. Bioinformatics 23: 1282-1288.
12. Li H. and Durbin R. (2009) Fast and accurate short read alignment with Burrows-Wheeler Transform. Bioinformatics, 25:1754-60.

REFERENCES

Abanda-Nkpwatt, D., M. Musch, J. Tschiersch, M. Boettner, and W. Schwab. 2006. Molecular interaction between *Methylobacterium extorquens* and seedlings: growth promotion, methanol consumption, and localization of the methanol emission site. J. Exp. Bot. 57: 4025-4032.

Broekaert W F, Terras F R, Cammue B P, Vanderleyden J (1990) An automated quantitative assay for fungal growth inhibition. FEMS Microbiology Letters 69: 55-60 Cappellini R A, Peterson J L (1965) Macroconidium formation in submerged cultures by a non-sporulating strain of *Gibberella zeae*. Mycologia 57: 962-966.

Cao, Y-R, Wang, Q., Jin, R-X., Tang, S-K., He, W-X., Lai, H-X, Xu, L-H., and C-L Jiang. 2011. *Methylobacterium soli* sp. nov. a methanol-utilizing bacterium isolated from the forest soil. Antonie van Leeuwenhoek (2011) 99:629-634.

Cappellini R A, Peterson J L (1965) Macroconidium formation in submerged cultures by a non-sporulating strain of *Gibberella zeae*. Mycologia 57: 962-966 Corpe, W. A., and D. V. Basile. 1982. Methanol-utilizing bacteria associated with green plants. Devel. Industr. Microbiol. 23: 483-493.

Corpe, W. A., and S. Rheem. 1989. Ecology of the methylotrophic bacteria on living leaf surfaces. FEMS Microbiol. Ecol. 62: 243-250.

Correll J C, Klittich C J R, Leslie J F (1987) Nitrate nonutilizing mutants of *Fusarium graminearum* and their use in vegetative compatibility tests. Phytopathology 77: 1640-1646.

Green, P. N. 2005. *Methylobacterium*. In Brenner, D. J., N. R. Krieg, and J. T. Staley (eds.). "Bergey's Manual of Systematic Bacteriology. Volume two, The Proteobacteria. Part C, The alpha-, beta-, delta-, and epsilonproteobacteria." Second edition. Springer, New York. Pages 567-571.

Green, P. N. 2006. *Methylobacterium*. In Dworkin, M., S. Falkow, E. Rosenberg, K.-H. Schleifer, and E. Stackebrandt (eds.). "The Prokaryotes. A Handbook on the Biology of Bacteria. Volume 5. Proteobacteria: Alpha and Beta Subclasses." Third edition. Springer, New York. Pages 257-265.

Holland, M. A. 1997. *Methylobacterium* and plants. Recent. Res. Devel. in Plant Physiol. 1: 207-213.

Holland, M. A., and J. C. Polacco. 1994. PPFMs and other covert contaminants: Is there more to plant physiology than just plant? Annu. Rev. Plant Physiol. Plant Mol. Biol. 45: 197-209.

Kutschera, U. 2007. Plant-associated methylobacteria as co-evolved phytosymbionts. A hypothesis. Plant Signal Behav. 2: 74-78.

Lidstrom, M. E. 2006. Aerobic methylotrophic prokaryotes. In Dworkin, M., S. Falkow, E. Rosenberg, K.-H. Schleifer, and E. Stackebrandt (eds.). "The Prokaryotes. A Handbook on the Biology of Bacteria. Volume 2. Ecophysiology and biochemistry." Third edition. Springer, New York. Pages 618-634.

Madhaiyan, M., S. Poonguzhali, H. S. Lee, K. Hari, S. P. Sundaram, and T. M. Sa. 2005. Pink-pigmented facultative methylotrophic bacteria accelerate germination, growth and yield of sugarcane clone Co86032 (*Saccharum officinarum* L.) Biol. Fertil. Soils 41: 350-358.

Madhaiyan, M., S. Poonguzhali, M. Senthilkumar, S. Seshadri, H. Chung, J. Yang, S. Sundaram, and T. Sa. 2004. Growth promotion and induction of systemic resistance in rice cultivar CO-47 (*Oryza sativa* L.) by *Methylobacterium* spp. Bot. Bull. Acad. Sin. 45: 315-324.

Madhaiyan, M., S. Poonguzhali, and T. Sa. 2007. Influence of plant species and environmental conditions on epiphytic and endophytic pink-pigmented facultative methylotrophic bacterial populations associated with field-grown rice cultivars. J Microbiol Biotechnol. 2007 October; 17(10): 1645-54.

Ringler, G. A. 1995. Reaction of soybean to inoculation with *Fuusarium solani*. M S thesis. Univ. of Illinois, Urbana-Champaign.

Roy, K. W., J. C. Rupe, D. E. Hershman, and T. S. Abney. 19997. Sudden death syndrome of soybean, Plant Dis. 81:1100-1111.

Rupe, J. C, E. E. Gbur, and D. M. Marx. 1991. Cultivar responses to sudden death syndrome of soybean. Plant Dis. 75:47-50.

Spelbrink R G, Dilmac N, Allen A, Smith T J, Shah D M, et al. (2004) Differential antifungal and calcium channel-blocking activity among structurally related plant defensins. Plant Physiol 135: 2055-2067.

Stanier, R. Y., N. J. Palleroni, and M. Doudoroff. 1966. The aerobic pseudomonads: A taxonomic study. J. Gen. Microbiol. 43: 159-271.

Sy, A., Giraud, E., Jourand, P., Garcia, N., Willems, A., De Lajudie, P., Prin, Y., Neyra, M., Gillis, M., Boivin-Masson, C., and Dreyfus, B. 2001. Methylotrophic *Meth-* ylobacterium Bacteria Nodulate and Fix Nitrogen in Symbiosis with Legumes. Jour. Bacteriol. 183(1):214-220,
Sy, A., A. C. J. Timmers, C. Knief, and J. A. Vorholt. 2005. Methylotrophic metabolism is advantageous for *Methylobacterium extorquens* during colonization of *Medicago truncatula* under competitive conditions. Appl. Environ. Microbiol. 71: 7245-7252.
Vogel, H. J., and D. M. Bonner. 1956. Acetylornithinase of *Escherichia coli*: Partial purification and some properties. J. Biol. Chem. 218: 97-106.
Vogel, H. J. 1956. A convenient growth medium for *Neurospora* (Medium N). Microbial Genet Bull 13: 42-43
Whittenbury, R., S. L. Davies, and J. F. Wilkinson. 1970. Enrichment, isolation and some properties of methane-utilizing bacteria. J. Gen. Microbiol. 61: 205-218.
Wrather, J. A. 2010. Soybean disease loss estimates for the United States 1996-2010. Missouri Agric. Res. Sta., Delta Research Center. http://aes.missouri.edu/delta/research/soyloss.htm The inclusion of various references herein is not to be construed as any admission by the Applicant that the references constitute prior art. Applicants expressly reserve their right to challenge any allegations of unpatentability of inventions disclosed herein over the references included herein.

Having illustrated and described the principles of the present disclosure, it should be apparent to persons skilled in the art that the disclosure can be modified in arrangement and detail without departing from such principles.

Although the materials and methods of this disclosure have been described in terms of various embodiments and illustrative examples, it will be apparent to those of skill in the art that variations can be applied to the materials and methods described herein without departing from the concept, spirit and scope of the disclosure. All such similar substitutes and modifications apparent to those skilled in the art are deemed to be within the spirit, scope and concept of the disclosure as defined by the appended claims or otherwise disclosed herein.

SEQUENCE LISTING (9188 sequences)

SEQ ID NO: 1 - protein, 362 aa, Methylobacterium sp.
VSPDAPSKTAPTPARPDRGGRSDTAASVLPGIGLCAVITAVAMAAQALEERVAGHPYIEALVLAILIGIAVRTAWTPPAQFRTGIAFSAKQLLEVAVVLLGASLSLGAILASGPALLAGIVGTVVLGIAASVAICRALGLPARMAILVACGNAICGNSAIAAVAPVIGAEAKDIAAAIAFTAVLGVLMVLGLPLFVPLAGMTDNQYGVLAGLTVYAVPQVLAATVPVSLLSTQVGTLVKLVRVLMLGPVVVVFSLIAPRLPQAAGAPPAPSRPGFTKLVPWFILGFLALATLRSLGLVPDPAVKPLTQLAGVLTVLSMAALGLGVDVRVLARVGGRVTLAVTASLAVLIALSLTLIRALGIG

SEQ ID NO: 2 - protein, 469 aa, Methylobacterium sp.
VAGAMWTLPAWILRRETLLLAGAALLGAGGVAAWYLLQATVLTIAVAPRDGTEPGLIKAYADALEAAHENVRLKILSFDDVRESAAALQDGRADLAVVRPDVLLPTNGLTLAILRDQAMVIASPEQAGITSFPKLAGKRLGIAAHRDADLWLLRNLLGYYGLTLEEAAGPVRDSTVLLVPVDQEAVAGAFREKRIDAFVSIIAPSAPKALALVSAVQGVARGGKVAFVAVEDDGAVIERFPRLQAVTVPGGLFGGRPKLPADDVKTVGASYRLMARASLSRVVAADVTQQLFEKRSAAALATDAAEYVQAPAYDTTVAATSARIPIHPGAIDYYERDQHGFIERYGDTLYLLGALVGGLVSVLAWIRQRLASLRRERIDELLDRLLEIAGQARALRDPAAIEALTVEVDALAMDVVRYAREREPDTRTMSAASVAIDTARATIADCRARAAEDGARAGRPVRLHGAAGA

SEQ ID NO: 3 - protein, 471 aa, Methylobacterium sp.
MRRFASLFLRQEFVFLMLAILLSVGAGVAYWASRATVLTIAVAPKDGTEPALIQAYADALAKRHKEIRLKILPFDDVRDSAEALGDGRADLAIVRPDVELPDNGLTLAILRDQAMIIASPESAGIARFPDLDRKRLAILAHRDADEALIRAMLEHYGLTLVTTEPAGALPPRHVALVEMAESDLGAAFARKRVDAVISVIAPTAPTAQRIVGLVQAASRDRKISFVDVENAEAIVARLPRLQVVTMPAETFGGSPKVPDEEVHTVGASYRLMARANLARSVAADVTQHLFELRSAMANVTPAADYFQAPAYDGTVGATSARLPIHPGAVDYYEREQQSFIERYETWIYLLAFLGGGIGSALAWIGQRLSRLRRERVEEATDRLLRIRQEAQETTEPARLESLAREIDDLAGDIAKHALERPTEARTMSAAAIAIDAARSTVKRAITTGRSAEDGSALAGRTVASDAGPSGA

SEQ ID NO: 4 - protein, 356 aa, Methylobacterium sp.
MAQTVCVLLDASDAARLVAIASDRSRPLKHIQRARIVLLSAERLSVQDVAQRAGVSRPAVWRWQRRYAEAGVEGLLRDKTRPPGTPPHSTETVAEVLALTCSEPPGEVTHWTGRAVARAIGISLRAVQRIWDAHRLQPHRLRTFKRSRDPAFAAKVEDVVGLYMAPPAHAVVLSIDEKSQIQALERTRPDRPLAPGHPAAQTHDYTRHGTTTLFAALDVLAGTVLGRCMQRHRNGEFIRFLNAVEATVPPGKAIHAILDNVATHKHPKVRAWLARHPRWTFHFTPTSASWLNAVEGFFSALTRRRLRRGSFTGVVDLQAAIKRYIAEHNRSARPFVWTKPATDILAAVSRSPEPSV

SEQ ID NO: 5 - protein, 163 aa, Methylobacterium sp.
MRFRHIDAAKKDFPVARLCKVLDVSPSGYFAWKNRPASTRQREDLVLLAHVRSAFTLSHETYGSPRMTHELREQGLAAGRRRVARLMRENGLKARQPRRFRRTTDSGHAFPIAPNHLDQDFTAAGPDRKWETTSPTSGRGRAGCTWRVITQACDGWVQAPMVL

SEQ ID NO: 6 - protein, 286 aa, Methylobacterium sp.
VTFAFIEQHARTWPVRLMCRVLGVSPSGFYGWRSRPESARSASNRQLLDDVRRIHAAHHRRYGSPRVHAALRAEGRSVSRGRVERLMRRHGIRALAGRRFRPCTTDSRHDLPIAPNLLKQDFSAARPNTVWLADITYLPTGEGWLYLAAVLDLATRKIVGWSMRDHMRTELSVAALMMAAQRQRPTAGLICHSDRGSQYAAEAYRRQLAGMGAKPSMSRTACCYDNAPMESFFHTLKVELVHQRRWATRDEARRDLFAYIEGYYNRQRIHSALGYLTPEQAERTAK

SEQ ID NO: 7 - protein, 326 aa, Methylobacterium sp.
MRYPASEKLEIIRLVEQSHLPVRATLDKLGYTRATFYRWYDAFQRGGLEALADRPSRPSRVWNRLPAEVRDQIVALALEEPELSPRELAVRFTDERRYFVSEATVYRLLKAQDLITSPAYIVIKAANEFRDKTTAPNQLWQTDFTYLKVIGWGWYYLSTVLDDFSRFIVAWKLCATMQVGDVTATLDRALAAAGLDHVQVAHRPRLLSDNGSSYVAGDLADWLGSRGMTHIRGAPRHPQTQGKIERWHQTLKNRILLEHAYLPGELEARVAAFVEHYNQARAHESLGNLTPADVYFGRGEAILQERARIKRQTLIDRRLRHHAQAA

SEQ ID NO: 8 - protein, 145 aa, Methylobacterium sp.
MRYPASEKLEIIRLVEQSHLPVRATLDKLDITRSTFYRWYDAYSRGGPEALADRPSRPSRVWNRLPTEVRDQIVALALEEPELSPRELAVRFTDERRYFVSEATVYRLLKAQGLITSPAYIVVKAADEFRDKTTAPSQLWQTDLT

SEQ ID NO: 9 - protein, 232 aa, Methylobacterium sp.
LREVFNGLRYVVRSGCPWRLMPHDLPPWFVVYQQAQRWLSAGCFEQLAEDLRAVLRLAAGRAPEPTAAVLDSRTLRSSPESGERAGYDGAKRKKGSKLHMAVDTLGHLLALHVTPADADNRAQVGRLAKAVQAATGESVEVAFVDQGYTGEKPATAAREHGIALEVVKLPEAKRGFVLLPRRWVVERSFAWATRFRRLVKDYERYASTLADLHLVAFVCLMLRQAAQLATDS

SEQ ID NO: 10 - protein, 135 aa, Methylobacterium sp.
MQSRHAYPSDVSDEEWALVAPYLTLLPETAAQREHSLREVFNGLRYVVRYGVAWRAMPHDLPPWHAVYDQAQRWLKAGCFETLVHDLRAVLRVASGRTEEPSAVVLDSRTLRSTPESGARAAWVITHALARDGFR

SEQ ID NO: 11 - protein, 400 aa, Methylobacterium sp.
VRLVRAAPLPTQPEPRIVGIDEWAWRRGRSYGTMLVDLERHTVLDLLPDRDAGSVAAWLRAHPGIEVIARDRADVFVEGARAGAPQAQHVLDRFHLLRNLSVALRAIVAHHHGVIRAVGRARVDHDVDAAQAATEAARAPTAIEVRKRATHALRRARYSELKRLSEAGASVAGMARALDLDRKTVRVWLSQDAPPSWRRRRTVPTILDPYRDHLEARWQAGCRNATELARGLIRTGADIRPRVVRDWAMKRRRASTDVMDATPGSTSVTRWRPPSINRTAWLLQADPSALVADDRRFLDRLRVEAPDLARSVAVATRFADLVRRRSGESLEAWFAAAAATPLAKFAAGLERDRDALRGAITTPWSTSPVEGQIGRLKMLKRTMFGRAGFALLRQRALTAT

SEQ ID NO: 12 - protein, 379 aa, Methylobacterium sp.
VIAALGVVEILAWGSSFYLPAVMAAPIAESTGWPLAWVVGGLAFGLLVAALASPHVGAAIHRSGGRPVLALAALLLAAGLTVVAVAPNLPIYLAGWLILGAGMGCGLYDPAFATLGRLYGAAARPAITTLTLWGGFASTVCWPLSAFLVAHVGWRGACLTYAGLHLAVTLPLILAMIPHAPALPVSDGPQEAGSASLSTRERRAFLLFAGVLVLGGAIMSQVSVHLLTLLQARGVSLAAAVSYGALIGPAQVSARVAEISLKGRHHPLWTLTAAFGLIALGLWLLAAGLPGVALWLVLYAGGNGIYSIARGTVPLALFGPVRYPLVVGRLARPALAAQALAPPAGAVVLTHAGPGALWWLLLALALAALGLIGALWRAR

SEQ ID NO: 13 - protein, 146 aa, Methylobacterium sp.
LIGPAQVAARVIEMSNKGRHHPLWTLTAAFGLVALGLSLMALGVPGLGVWLVLYGGGNGIYSIARGTVPLALFGPDRYAGLMGRLARPGLIAQALAPPLGASVVTHGGADALFVVLTVLAAGNLSVIAALWTVLRKDLRRQKQVLL

SEQ ID NO: 14 - protein, 328 aa, Methylobacterium sp.
MAGTALITAENRAVGDRAPDALDQAALALARASKSPATLRAYKFDFADFSGWLQDQKLEHPADARDVARYLAAQVQAGLRASTIERRCAAIGFHYRAMGQDNPCSREVVRAVLAGMKRTIGVKPDKKKALTVDLLKKVVQKIRGDDVKALRDKAMILICFGAALRRSELVGLDVDDITFKRRGLMLQLGRTKTDQSGKGKQLAIPDGKLKIPAAVRAYMTAAGLVDDDRVIAEGPLFRAILKGDRVTDRRIDTESFVRMLKARCEAAGLDPKKFSGHSPRRGFATTAGDEGADLRRTADAMRHKKLETTLGYMEEGNLLDEAVGKLFL

SEQ ID NO: 15 - protein, 274 aa, Methylobacterium sp.
VLAYLIDHAATLKVVTLQRRLAAIREQHAAAGFDLETSSSAFRDTWRGIKRAHGQPAVKKRPLMTVDLRRAVATLPDTLPGRRDRALILVGFAAALRRSELVGLEVARRDGAAWVEERPDGLVVHLARSKTDQSGEGAEIGVPYGSNMETCPVRSYRAWLNAAHLTEGPAFRPIDRHGHIGTEAVTDRAVARIVQRTVEAAALADGYSPEEARQLAAAYAGHSLRSGLATSAAANDAPGHAIQRQLRHKRFDTTSGYIRSGQLFKQNPAGMAGL

SEQ ID NO: 16 - protein, 311 aa, Methylobacterium sp.
MTLPATLAARARAFADEALSENSRRAYRADWQHYARWCSGHDLAPLPAGPEQVASYLTSMAETHKRATIERRLVTIGQAHKLQGLQWIPAHPAVRAALRGMFRRYGRPKTQAAALGVPETLRIVAACDGTVAALRDRALFLLSFAGAFRRSEVARIRHEDLAFRDGAVDVFLPHSKGDQDGEGTIVTVLAGGSPATCPVAALRRWLQAAPADGYVFRAVRADGTVMDDGLHPDSVGRIVQKRAAEAGLVAGPRERISAHGFRAGFITEAYRRGSRDEEIMAHSRHRDLKTMRGYVRRAKLADAHPGRDLGL

SEQ ID NO: 17 - protein, 255 aa, Methylobacterium sp.
MPNGYNAPMEMLARKLDSIARLSDSDRAALLDLPHTVRNLPARHDIVRFGDRPTHSCLVLQGWVYRYAALAEGGRQILSFYIAGDVPDLQSLHLHRMDHNLATLTSCVVALIAHDDLRAVLLRNPGLAGTLWRDSLIDAAHYRERITSLGRRQALGRVAHLFCELYLRQKAVGLARGMSCPLVPKQSELADALGLTSVHLNRVLRTLRGRGLVTLSGGILTIEDWDALTEVAEFDQTFLHLANNPAPAREIAEAV

SEQ ID NO: 18 - protein, 250 aa, Methylobacterium sp.
MYETPQPSGREPFLRRIETVALFRLTDAERAALVALPLQVAQFEANQDIIREGDRPSRSFTLLSGIACTYKSTRAGKRQVMSYHVPGDVPDFQSLFLEVLDINIATVSACRLGFVQHDAVRAMLRAHPRLNEVFWRATLIDAALVREWMLNTGRREAYARMAHLFCELVTRLDAVGLAPDRTCDLPMTQPELADALGITSVHVNRTIRDLKAAGLVTLRGRRLTVHDWAELQEAAEFDPTYLHLRNAETR

SEQ ID NO: 19 - protein, 928 aa, Methylobacterium sp.
MITAQLSQAVYEPDRLAALDALAILDTPSEPGFDDVVRLATRLCAVPVALVSFVAADRQWFKARVGFPACETDLDRSVCKFAISAPDLLIIPDLTADPRTASNPLVTGDPHIRFYVGAPLRLSSGLVVGSLCAIDTVPRPEGLTPDQADDLRALARQVVTQLELRTALHAKDVAADTERRLTTDLRRSEVRYRSLFESMDAGFCVIAVKFDADADAPRAIDYRFMEVNPAFAAQTGLADAAGRWMRDLAPGHEQHWFDLYGHVALTGEAIRFENGAGALDRWYDVQAYRVGEPEERRVAILFNDISAKRTAEIALRASDTRSRLAQEAGQVGTFEFDVASGEVTVSAEYCRLHGLPVRPVYTMGDITAPVLLADRGKLSTAVSRADGSAAEPIEYRIRRVDDGALRWITRQWQPTRDEAGAIVRWFGTVRDVTERYITQEALRISEERLSLAFEASGSLGWWDWDIPNDRLYAGAHFARMYGVDPDLAAAGAPLEAFVGGIHPEDQGWVGERIEQVLASAGEFAEEYRLLAADGTVTWIFARGRCYHDPGGQPLRFPGVATDVTDAKQAGLRQDALLRLGDRLRDLDTIAALVQAAAEIVADVLDASRAGYGVIDIANDALAIPTDWCAPGMATLAGVHRLSDYGRHVDDLRRGEIVLVGDVVLDPRSRATAELGLTADVQTMINVPVMERGRLVGLGFVHYAHERRFRPEELAFVRTVTDRVQVAVARIQAEQQRVLLNGELSHRLKNTLAMVQGIAGQTLRNVTDQAPVQAFTERLIALSQAHDVLMQDSWVGAPIRSVVEKVLALQTSLDRFRIEGPPLALAPQATLSLSLLLHELTTNAIKYGSLSAEAGYVSLSWRIEEGAERTVVLSWRERGGPPAIAPTRRGFGARLIQTGLVGTRDTRLDYPNDGLDAEFRAPISQVVAS

SEQ ID NO: 20 - protein, 574 aa, Methylobacterium sp.
MAFSSTPPALQIDSEAARRLLEPMLPRRLRACLAQDLRVASACSELALEITTLAPDAEALVSAWIGAASSEGGLWRDRRWIARRSALIRFLDVWAVEHDQPVARALADVATLLSCAGDDRRAAARLAQPLWLEREAVLDLRNGFAALAEAQTRLTIGRVAEQGADSDITGATDLAVALQAAWHDALTDALLTFSEKTSSAIAAAAALACGADDAFASDVALVHALVPVGEVLTRPVADSAATRERRRWKTIEAQLVKKSEARRREKAATVDTMPQRPDADAPPAEVHKGHVLVVPAIQETGSDRGKSIARGYEHIIGKPLPLVAVPDLADVRARLVFEFPYAQTMIDRLLADLIGREHATFRPTLLIGPPGAGKSRIVARIAHHLGLGLWRVDATRDAGASLGGLDRRWATSEPAHPIMAVARSGTANPLMLIDELEKAATRADHGRLWDALLPMLEPETARTYQDPCFQTEVDISRVSWLATANGVGNILGPLLDRLRVLEMTAPSQADLEALLGPVLEGIAANRGLDPAFEAPLDGEAVALLRRSWRGGSVRRLTRLVEAFVTARETLAVRH

SEQ ID NO: 21 - protein, 73 aa, Methylobacterium sp.
MTVRTIAIAALAAVPMIGTAWADESISLTPPLYREQARPTAAVRPASELATTPRLVPASPASRRVVATAVPAR

SEQ ID NO: 22 - protein, 305 aa, Methylobacterium sp.
MRTVTFPLLAVLGLCGANTARAADLDYDYLRGADYDPVPAPVVDWSGVYVGGHGGFTSTSLGFGNTAQPIVANDLRQTSVESQYHVSTLMSSNANRRVNGTSFGAFVGYNIQFDEIVLGIEADYTHFGSGGSVTDTISRQMVTDDGFVNYVNLASSSRTKLNDYATLRARAGYAFGNVLPFVTGGFAIGSAQIADHVSVQVAGYDQTTYRANQAITDATKPAFVGRYGYSSFDASNPNAGILADPLVFNRAKTKIVGGFSAGTGVEYAITPNILLRAEYQYVLFDAFDGHKVNLNTVRAGAAVKF

SEQ ID NO: 23 - protein, 160 aa, Methylobacterium sp.
MFDLAIDSKLRGCDIVKLKIGDLVSGGRVRSRAIVIQRKTGRPVQFELLEPARTSILAWLEARGGTLDDYAFPSRLDGVTHISTRQYARLVDEWVTGIGLRSEDYGTHSLRRTKASLIYKRTGNLRAVQILLGHTKIESTVRYLGVDVEDALTLAEGTEI

SEQ ID NO: 24 - protein, 351 aa, Methylobacterium sp.
MSSEERNRDPDAAPAGGEAPGGEVACLRFEPPGDPAALGRAWQDHLAPIFDVSFRPETDLTVPIAMRSYHLGDLLVGDVVAPAHTLVRTREMIGQQGLDHILLQFYRRGQSLVETDQGSGPVNEVQCIVFDLAQPVRIVAAAVDATNVVIPRALLEKQGCHPDALHGRPLDHDGDPFGRLVHNFVANVVACGDLLDRREALAASAAITQLCASWLRGQEEGRPSQHQDIRIRVRRLVEAELGNPKLTPALIATRLGLSRSTLYRLFAPNGIVAYIRDRRLMAAMRMLVRDDAPKPLRISQVAFAVGFSDERTFRRAFKRRFGFIPSDASQRLETGPDPAPGAVLRNWIESL

SEQ ID NO: 25 - protein, 168 aa, Methylobacterium sp.
MEDAMAHPAPTREDAPATAHARGRTRHADDLYTWVQEQVALLRAGRVDALDLDNIAEELSDVGLSEYYRLQSAVEIIILHMLKWDHQPERRSRSWALSIAEHRERATIQLRKSPGLKSSLDEIRHDGFRLGRLGAARQMKRAPKTLPTDCPYSWDEILNRPFAFDDDR

SEQ ID NO: 26 - protein, 213 aa, Methylobacterium sp.
VWPPPPSRADSRAEALTLLRETDLTCDAIAARLGVHPKTVHTWNARAGWPRPRQQRPRLLTGRWPAARRAALIRLLCTPGADPGDVTEILGLGRLDPAMMATAFGADLPLPPAVTGRGDPAADPATLRARLRAHIARQIAAFDAALSGAGAGAGDSARILRDLGGLKRLLDTVDAEGARGAAGEGGDGTGRDTEPGTEPGTEPDLPALRAEIA

SEQ ID NO: 27 - protein, 439 aa, Methylobacterium sp.
MAVTTAAPAAGPGQNQSARAALAAFVGTTIEWYDFFIYGTAAALVFGPLFFTTESPYIATLSAFGTFAVGFLARPLGGLIFGHLGDRFGRKRALVATLVMMGIATSGIGLLPTYASIGIWAPVMLVVLRLIQGLAVGGEWGGAVLMAAEHAPAGRNTFFASFAQLGSPAGQILSLLAFRLAGLLDKESFLTWGWRVPFLVSILLLGVGLAIRLGVAESPAFEKARAAGGPPPAPVREVLTTCLKPVLLAAGANTFAIASVYLFNTFMIAFTTQYLGIARATILDALLIAAMVQLVMTPVGARIAELIRNERLFLQGTLVWAMLAPYPLFWLVETKSVPLIVLGLALNVIGSATFYAVIAGYLAGAFPTRVRYTAISIAYQFCGALAGGLTPIVGTVLAERFQGHWWPIAVFGTALAGVSFLCVTAIGGYRARQRGFLDG

SEQ ID NO: 28 - protein, 424 aa, Methylobacterium sp.
VPVADRRQIVWSSVIGTTVEWYDFLIYGTATALVFNKLFFPSFDPLVGTIAAFGSYAVGFLARPLGGVIFGHFGDKIGRKAMLSLTIIIMGLGTFLIGCLPTYAQIGIWAPILLVALRLVQGIGIGGEWGGAVLMVVESVPAERRGFFGSIVQLGYPLGVIASIGAFALCGFLPEADFLAWGWRIPFLASALLVGLGLFIRLRLHETPAFQRVKRRSAVARLPVMEILTEHPRTFLKAVGLKVSEIAYVSVVTVFSISYVTGQLGLSRSIILNGILVAAVIELFTLPAFGWLSDRYGRRTLFVAACLFSIAFAFPLFTLLDTRDPTIITLTVAVALSFGQGIMFGTGAAWMSELFDARLRYSGASLGFQVGAALSGGFTPLIAAALLGWSSGATWPISVYLIALACITLTATLLAPETARKPID

SEQ ID NO: 29 - protein, 469 aa, Methylobacterium sp.
VEQVRVPFLEAMEDQLPADRRRRFDLFVKEFVAYQTDTAELGLTVSPKAAQIQATDEATVRNRERMVAEIGILGREVLNRLNARRAADAADRRQARITLVAVPAAALAFGLLAAIWIIVSQVRRPLHRLKDGMTALAANDLGRAIPFTHRRDEIGEMAAAIAAFQTALIEKRDLDAEAQTRRDRDRSRAEALAAATRTFEAETHRAVTDLADSAEAMQAAADTLSGNAGAMAAESAVVAGASEQSAGLVDSIASAAEELSASAREIEARVRHTSAIATSALSDTQGLKETVMSLSQAAEEIGAVVTLIREVAEQTNLLALNATIEAARAGAAGRGFAVVAAEVKALAGQTALATDRITGQVGAIQGAAGRTVGAIGTIGETIARMSLIASEVADATDQQGQASQEIARAIFGAAAEARQVSESVAGVQAAAASNEAQAGQVRGSAARVNAGTHSLQRAIETFMVEVHGA

SEQ ID NO: 30 - protein, 435 aa, Methylobacterium sp.
MATLDRPASGLGAPERAAPTVGGADAAAPGIAAPQAIVTSLKRSDAVTPYRFRDLLALDDFERYARKLLPPMIFQYVAGGVETGSALAQSRGAYADYALVPRLMRDTSARDTATTLFGQTYAAPFGIGPLGGAAFIAYRGDLVLAEAARRMNLPMCLSASSLIRLEDVHAQNPQAWFQGYLPGDQNRIDRLLDRVEATGYRTFVVTADTPTLGNREHNIRSGFSMPIKVTPKVAWQSATHPRWLLGTVARTFLKHGAPHFENTEAERGPPMMSQGAVRNTIARDQLSWKNLEAIRKRWSGNLLVKGLLAPEDVDIARECGADGVILSTHGGRQLDYAVAPLDVLPEIAARKGGLKIIVDSGIRRGTDVMKALALGADFVLLGRPFMFAAALGGAAGVEHAMRILKEELNRDMALIGVNRLSELNPDFLRRVPRRA

SEQ ID NO: 31 - protein, 397 aa, Methylobacterium sp.
MAPIITTVEDLRRVAKRRVPRMFYDYCDSGSWTESTYRANEADFAGIRLRQRVAVDMTDRTLATTMAGQAVAMPVALAPTGLTGMQHADGEILAARAAEAAGVPFTLSTMSICSIEDVAENVSKPFWFQLYFMRDRSFNDRLIDRAKAAGCSALVLTLDLQILGQRHKDIRNGLSAPPRLTPGTVLDLLTKPRWCWSMLRTQRRTFRNIVGHVDGVRDTRSISAWTADQFDPRLDWDDVRRIRDRWQGPLILKGILDVEDAERATATGADALIVSNHGGRQLDGAPSSIAALPGIADAVGSRVEVLMDGGIRSGQDVLKAVALGAKGVFIGRAFLYGLGAYGQAGVARSLEIIRTELDMTMALCGHRDIRAVDRSILWTPSAQETREDAPPVRRIGP

SEQ ID NO: 32 - protein, 540 aa, Methylobacterium sp.
VEPTDIDAVAAGAFDYVIVGGGTAGCVLANRLTESGTHRVLLLEAGGRARSPWVAIPAGFSRLLQHPSYNWRFRTEPEAATGGRVIAVPRGKGLGGSTLINGMIYVRGQPQDYDAWAQAGCRGWGFSDVLPYFRRLEDYEGGREPLRARGGPLPLTEVAERPAIAEAFIAAAQAAGYPRNPDYNAESQDGFGYYQVNQRRGRRVSAADAYLRPALGRPNLAVVTDAHVLRLTFDADRASGVAVLVGGRERLFRCGGEVILAAGAAQTPQILELSGLGDPAILGALGVAVRRALPGVGANYMDHYCTRMNWRVRLPVTLNEQTRGLRLGLAAARYLATRQGILALGTGLAHGFVRTRPGLDGPDVQYFFMHASYANAAERKLDRLPGMTIGVTQLRPESRGTIHAVSPDPLAPPAIRPNFLATAEDRRAMVEGMKIARAIVAQAPMERFRGAELNPGPDCRTDADWLDFARRDGQTIYHICGTCRMGDDPDSVTDPSLRVRGVAGLRVADASIMPRIVSGNTQAAVFMIAEKAADLIRADV

SEQ ID NO: 33 - protein, 538 aa, Methylobacterium sp.
MSTSDALDRADFARRAGENQARLTADLKPAYDFVVCGAGASGSVVARRLAENPEVQVLLLEAGGSDDAEAVLDPALWPTNLGGARDWGFRAEPNAHLNGRTLSMAMGKGLGGGSSVNVMVWARGHRCDWDAFAAEAGDAAWGYESVLDIYRRIENWRGAPDPAHRGSGGPIWVQPASDPSPVAHALLDAARELGIPTFDNPNGRMMEGPGGAAITDMLVRDGRRVSLFRAYVHPWLDRPNLTVLTDALVRRVTFDGRRATGVEFVHAGAVRTVGARAETVLSMGAIHTPKVLMLSGIGDRDELGALGIPSVQHLPGVGQNLQDHVSFGCTWEYADPIAPRNSGSEATLYWTSRPGLSAPDLLFCQVEFPVPSEQTAARGVPAHGWTMFAGLAQPASRGRLRLRSADMATPPVIEANFLSHPTDVTAAAACVDLCRALGNARAFRPYVRAEAMPGPLSGAAMADYIRDAAVTYWHQSCTARMGRDALAVVDGALRVYGIDGLRVADASILPRVTTGNTQAPCAVIGERAAEMLKRANGL

SEQ ID NO: 34 - protein, 441 aa, Methylobacterium sp.
MAATARRRSLRTRLLASALVLVLAALVVAGLAIGVILHRFVRGQLDGRLDAQIVALRAGLEAGILPQDLDAPPFDRPGPGWAWEVRRGAGTIRSGSLRGGDIRLSDPGPDDDPGRPHPAAGTGPRGEPLVARVLAVPGPEPATIVVAAPEGELRGPLREALTSLALALGILGLCLLAGLAFQVRLGLAPLTRLRADLASVRAGRRERVPADQPAEIAPMVAELNALLEQNAQNLERARGHVANLAHALKTPLATLSMALAEPARDPDGALRRQVDDMDRRVRHHLRRARAAALAGSARGRTALAPRLSDLRAALSRIHAEKGAAIDLDVPETLSVSCEGQDLDEMLGNLVDNACRWCRGRVRVSATARDGAVAVVVEDDGPGLDPAAASAVMARGRRLDEGVPGHGFGLPITLELAELYGGGLSLGRSDLGGLRAELRLPA

SEQ ID NO: 35 - protein, 215 aa, Methylobacterium sp.
VLNEMRAIENVVRAILREGGIKLGTPARAAFAGRVREMVGDDPLILPLVTPLLAILSTMLEQLDRLTRQVLVIARGEAACRRLMSVPGVGPITALAFRATIDQPERFRRSRDVGAHLGLTPSRYQSGETDIQGKVSRCGDELARTALYEAAHSLLTRSRKWSSLRAWGLQIAKHRGMARARVAVARKLAVVLHRMWSDKTEFRFGKKPVAALAAA

SEQ ID NO: 36 - protein, 392 aa, Methylobacterium sp.
MRLSALGALAALGGVPRARAGDGATLPFGNGERPLVAYPGKRPLLQMTARPPQLETPFAVFDGGAITPNDAFFVRYHLADIPTEIDPQAFRVAVTGQVERPLSLSLADLKAMPQTEIVAVNQCSGNSRGFFEPRIAGGQLANGAMGCARWTGVPLKTVLDRAGVKAGAVQVAFNGLDGPVLPETPDFAKALTLDHARDGAVLLAWGMNGQDLPWLNGFPLRLVVPGYYGTYWVKHLDSIAVLDHPFEGFWMKTAYRIPDNPCACTEPGKAPDRTVPIGRLNVRSFLTNLTDGAQVKAGPVALRGIAFDGGSGIRDVAVSADDGRTWSAARLGQDLGPYAFRTWTAEVDLAPGAHALRVRATGNDGATQPMEPRWNPAGYMRNVVETTRVRAA

SEQ ID NO: 37 - protein, 64 aa, Methylobacterium sp.
VREERASGERKYYLSNLLAEATLKQLATTIKARWICEQAHQQMKENSASITSRADPGPGCIGTR

SEQ ID NO: 38 - protein, 110 aa, Methylobacterium sp.
MFSTRPLRASVVAIAAALAATPALAAPETYALPEPTAQFRPAPDAAHAAGFQAAQENCLTCHSADYVAMQPPKKGQAFWDAEVAKMIKVYRAPITEDQARAIAGYLGAAY

SEQ ID NO: 39 - protein, 332 aa, Methylobacterium sp.
MQMLAIDLAKQSFHVHGVDADGQVISRRVGRTKLPALVASLAPKVIAMEACATAHHWARAFLAAGHEVRLINPRFVKPFVRGSKNDAVDAEAIFDAASRPTMRFVPVKSTEQQDLQSLHRVRDRLVSQRTNLINHTRGLLAEYGLVYPKGAARFPARVRAELSEAELSPMARATFAALLDELDALETRLERLDDQLRAICREDVVCRRLMTVPGVGPVVATALKASVGDARQFRSGRELAAWIGLVPRQYSTGGKPQLGGVGRRANHYLRRQLVHGARAVALRLATKTDPRSRWFQAVIDRRGFNKGIVAMANKTARIAWAILRREEDYARA

SEQ ID NO: 40 - protein, 408 aa, Methylobacterium sp.
MVDRLRIAILTHSTDPRGGVVHALALGEALGRLGHEAVVHAPDPTGGGFFRAAQCPVISVAAKPVAGPAAALVGARIADYLAHFSTPAACDFDVFHAQCRISGNALATLTRRRLIPGFVRTVHRIDTFTDPRLAQWEERAILDAGRLLCVSQTWAATLAAEYGARADVVGTGVDGAAFTPDPGPEDDALRRRLGLGGGPVFLSVGGFEARRNTLAIIEAFATLRRTCPDAQLVVAGGALPLDQAGYEARCCAALEREGLKVGPGRPVIRTGAVAQADMPGLYRLADTLVSPSLAESYGQCVLEAMACGTPVIVSGRPPFTEYIGPGEALSVNPDDTDAIAAAMRASLEPSRRARLRNAGREVARAHVWDACAARHLPTYAELAPGDAPLIAAATGAAAWNTLRVPRDA

SEQ ID NO: 41 - protein, 393 aa, Methylobacterium sp.
VKPLRVALLTHSTNPRGGVAHCLALAEALCELGHEAVVHAPDPSGRGFFRDASCATVAVAAEPVAGGTTDLVRARIHDYLRHFASPAARDFDVFHAHDGIGGNALATLKHRRLIPGFVRTVHHVDSFADPVLAGWQDRAIREAGRLLCVSRLWADWIRDAIGTEAGIVGNGVDLSVYRAAVAEGDAALRARWGLGAGPIVLSVGGLEERKNSLGIIAGFARLRARHPHAQLVVAGGASLLDHAGYRERCRAALVAAGLDVGRGAAVIETGPVPQADLPALYRAADLLAFPSWTEGFGLCVLEAMACGTPAIVSDRPPFTEYLTPADALFVDPADPDSIAAAMAATLEPRTRARLRAAGFARAAAHSWRACAARHRDAYAACTRGAAAFTELQP

SEQ ID NO: 42 - protein, 161 aa, Methylobacterium sp.
MPFAFCRSLPLATLAFAAATVPGYALEVTRSADIAAPPAKVWQTIGEFCGIGDWHPAIEKCALSDKDGMKVRTLSLKGGGTIKEEQVSRDDKVMSYTYTILESPLPVSDYKSTLSVAPEGSGSKVTWTGTFNAKGAPDTVATDAIQGIYDSGLKALADKAK

SEQ ID NO: 43 - protein, 119 aa, Methylobacterium sp.
MRFPPSERALAACEDIIDNADAAQRFVAGMTFEAFVADLRTNYAVVRCLEIVSEASRRLTDAMHERHPDVPWRDIASIGSVFRHGYHGVKLDIVWRTVHERLPVLVAACRAEIARASDS

SEQ ID NO: 44 - protein, 214 aa, Methylobacterium sp.
LQADGYAGFNGLYEGRRPGGALIEAACWAHTRRKFFDVHARTGSAVAFEALERIGAIYEVERSVSGKPPDERLRQRQARSKPLAAALKAWAATILPQLSGGSDLAKAFRYMLVRWTALTRVFDDGRIALDNNPAERALRSVAIGRKNYLFAGSERGAERAAAFYTLIETAKLNGLDPEAYLRDVLTRLADHPAKRLAELLPWNWSPVTAGAQAA

SEQ ID NO: 45 - protein, 282 aa, Methylobacterium sp.
LETLKRSGKLFADETTAPVLDPGCGRTKTGQLWAYTRDDRPWGGTDPPGVAYIYAPDRTAGRPIAHLCGFAGVLQVDGYAAYETLAKGGAVRLAYCWSHVRRQFYDLAAASPIATETLSRIAALYRIEAEIRGRSAEERRAARQERSRPVVEALEAWLREKLGLLSRKSNLAEAIRYALSRWAGLSLYLDDGRVEIDSNTVERAIRPLALNRKNALFAGSDGGSEHWAVIASLIETCKLVGVEPQAYLADVITRIVDGHPHRRLDELLPWAYPSTPTLRAVA

SEQ ID NO: 46 - protein, 220 aa, Methylobacterium sp.
VGAPASPSSDDPETLKALLAEERAENERLRQIILAMQRHRFGRRAESLPEDQLLLGLEEAEQVEAAGFAAEESEPAKEARRAKRRANRGALPAHLPRVECLVDIDSLVCPCCSGALHRIGEDVSERLDVVPAQFRVLVIRRPRYACRGCGDAIVQAPAPARLIEGGLPTDALVAQVLVSKYADHLPLYRQAQIFARQGVSLDRSTLADWVGRAGDRGRER

SEQ ID NO: 47 - protein, 501 aa, Methylobacterium sp.
MILAERAARLASEIAVERLKLEVARLRRERFGTSSERSARIDQLELVLEDLEETLAETQAQAAAEPEALSGAASSRRKPARRPLPEHLPRERVVHPGPTTCACCGGARLRHLGEDVTETLERIPARWVVIQHVRERFSCSDCETIAQTPAPFHPIPRGRAGPNLLAEVMMAKFGLHLPLHRQSQRFAHEGVPIDVSTLAGWVGAVTTALSPLVTRIEAHVRGAERLHLDDTPVPVLAKGKTRTGRLWTVVRDDRPFGGSEPPAAAYFYSPDRSGAHAETWLGDFHGIVQAHAFSGFGRLYEPGRKPGPLREAACWAHARRKFFELAELRKAPIAIEAVARIDAIFATERATNGLAADERRAHRRTRSATLVAELEVWLRENRAKLSAKAPVAQAIDYMLKRWSAFILFLDDGRACLSNNAAERAIRPIAVGRRNWTFAGSDAGGHRAAALYTLIETAKLNGIDAQAWLADVLSRLPDHPARHIDDLLPWNWTQHQPRPIAA

SEQ ID NO: 48 - protein, 303 aa, Methylobacterium sp.
MIVGMARDAVHANTLIEKLRGELARLKRAQFGVSSEKLQARVEQLELAIEALEVDEAERLAAAPVVAEAVEAASRGPGRRPLPDHLPRETVAHPGPCACPACGGRLRRIGEDVTESLDYVPGRFKVVRHVREAFSCRACETVVQAPAPYHAIARGRAGPGLLAHIAVAKFDDHLPLYRQAEIYARDGVTLQTSTLSGWMGATAAALAPLADLLRTEVIAGSDVLHGDDTTVPILAPGAGKTRTGRLWAYVRDERPFGGVRPPAAVFFASPDRKGERPLTHLAAFSGVLQADGYAGFNGLYEGR

SEQ ID NO: 49 - protein, 423 aa, Methylobacterium sp.
MTGSAGPAIGTRVVDTLATLRPLAPFFCLYVTFGATLGFLSGGAPLILRARGVELAEVGLLQLINLPVGLTFLWAPLLDRIRLPILGHRIGWIAAAQAASVLLLVVLSLGEAWPLPALLGLAIAACTCVATMDIALEALVVETVPAERRAFVASAKLCGASLGGILGVGVLVGSYDSLGWRGAVLACAALDALCLLPILGYRESRLRESGSAGAGTAAGAGPERWSGSLARLRRLGGRVLVLGAYFAASYLVGGPNTLALLDLGVPLGQVGTLTGTVLPAVNLVMALAAGWLAARFGTVRLIAVGALGVLASGGLMVVACAGRMPDLGIAAAVLGFVAGGFLGVPVFNMIYRWAQGPKPATDYALLFGAAFFAAMPLRVAAPALAGWIGWPGYFAAPLPLYAAAVAWLAVAVDRTLRDDGAAR

SEQ ID NO: 50 - protein, 98 aa, Methylobacterium sp.
MDKLAALDILRANEAELRRRGVLHAALFGSVARGDAQADSDLDVMIEIDRERVRDLFTYAGLCRFIDDLFPVPVDVADRESLKPRVRQRAEHDAVSAF

SEQ ID NO: 51 - protein, 107 aa, Methylobacterium sp.
MILGIGTEREALPMGETISITLAPDTLRAVRESVEAGEYASVDALLDEAVHALQRQRREDAERLDDIRARIRRSLDDPRPPRSLEEIRTHIDALHAETVKAHRDAAL

SEQ ID NO: 52 - protein, 470 aa, Methylobacterium sp.
MRRHRHAKIVATVGPASAAPDQLRALFLAGVDTFRLNFSHGLQADHAKVHAAIRALEKEVGRPIGILQDLQGPKIRIGTLQGGRLDLQAGETVRFVLDGADGDKQAIPLHHPEIFDAVVPGQELLIDDGRIRVRVTGPERTSITAEVVTGGPISNRKGVNLPGTLLDLSPLTEKDRADLAFGLDLGVDWVALSFVQKPSDVIEARGIIGDRAGIMSKIEKPQALERIADIIRLSDAVMVARGDLGVEIPHEDVPGRQKELIRACRLAVKPVVVATQMLDSMVNAPAPTRAEASDVATAIYDGADAVMLSAESATGRYPVEAVAMMDRIIRSVEGHKLYHSIVAASEPGEEETPPHAVATATADLAEAVRAAAIVAYTASGTTAARVARKRPAASILALTPNVATSRRLSLLWGAHSVLTEDVDSYEEMTSKACHHAQDEGFARPNDVIVVTAGIPFHTAGNTNNIRLMQV

SEQ ID NO: 53 - protein, 515 aa, Methylobacterium sp.
MNLAGMRSYRADEAVDAVVVGTGAGGAPLLARLAAAGLKVVALEAGPNFTPERFAFDETLADEIYWTEERLSGGSTPEAFGANNSGTGVGGSTLHWGAFVPRADARDLRLHTESGEGVDWPLSYEDLLPFYERVERFLGVSGAQSYPWDAGRRYPLPPVPRNGPAQIMARACEARGIRWADAPAAVVSRDFQSEDGPRRNACINCGFCHQGCRTGAKASMDVTYLPYAVAHGAEIRAEAFVHGLERGADGRITGVVYRQDGAERRQRCGAVFLCAGAVETPRLLLHLGLANSSGQIGRNYMGHVATQVWGTFDHEVRMNRGYPSSLITEDFIRAGADFAGGYLIQSLGVVPVTFGNSAARGRGLWGQPLLDYLDRYNHFAGIGINGETLPCDANVLTLADETDAHGMRKAHISFGYSTNENRLNAHATKVMRDLWEEAGADDVWVLERVAHTLGTCRMGRDGTSAVVDPHGRSFDIDNLWICDGSTFPSSLAANPALTIMALSLRSAEAFLAGGP

SEQ ID NO: 54 - protein, 522 aa, Methylobacterium sp.
MSAPYDLSDGSVFVIVGSGAGGGTLGTQLALKGIDTVILEAGDRHETFDFVNDEWDSFAQLAWKDKRHATGPWPIAKTFPNLPAWIVKAVGGSTVHWAGASLRFQEHEFRTRTHYGAVKGANLLDWPVDLPEMDPWYAMAENRMGVTRTNGIPGLPGNNNFKVLEAGARKIGYTEVHTGRMAINSEPRDDRAACMQLGFCFQGCKSGAKWSTLIAEIPKGEATGRLEVRSGCQVLRIEHDPGGKVTGVVYADKDGVEHRQRARAVAVAGNSIESPRLLLNSHSAKFPDGLANASGQVGRNYMRHTTGSVYAIFEKPVHMYRGTTMAGIVRDEARHDPSRGFVGGYELETLSLGLPFMAAFLDPQTWGRDFTGALDKYRNMAGLWIVGEDMPCSDNRITLSDDTDAYGMPVASVHFADHPNDEAMREHAYRQGSALYEAVGAVRTIRTPPYPSTHNLGTNRMSEKPRDGVVNRFGQAHDVENLFVSDGSQFTTGAAENPTLTIVALALRQADHIAKRMSRGEI

SEQ ID NO: 55 - protein, 422 aa, Methylobacterium sp.
MTTTTRHVPVAVVGGGQAGLSVSYHLKQRGIAHLVFEKHTAAHTWATQRWDTFCLVTPNWQCDLPGHRYDGPDPDGFMKKDEIVAYLKAFVAKVRPPIRENVAVTRVARRDDGVFAVRTSNGDYTADEIVVASGGYHTPIVPRMAEKLPPAITQIHSNQYRNPAQLPDGAVLVVGSGQSGAQIAEDLHLAGRQVHLAVGDAPRCARFYRGRDVVAWLADMGYYEKTVDDHPLRDGVRDNTNHYVTGRDGGRDIDLRRFALEGMALYGVLEDYAAGALRFRDNLRPALDQADRTYNGINAAIDAHIDAAGIAAPVQAPYAPVWEPGEPVTALPLEGSGIAGVVWCIGFAPDFRWLDASVFNGAGQPKHRRGVTAEAGISFIGLPWLNTWGSGRFGAVGRDAEYIVQVIAARLGAGAVGLKRAV

SEQ ID NO: 56 - protein, 111 aa, Methylobacterium sp.
MRRFEVLFSAEAETNLLQIYRWIYDASRDPNVAGRFLDRLISRCERIGDAPLGGRPRGDLEPGLRTVPFERSAVIAYRVEAELVTITNVFYGGRDFDALYRTASPGDEPAP

SEQ ID NO: 57 - protein, 101 aa, Methylobacterium sp.
VARSVQFHPLARADLFDLYDYIERRSGSERAGAYLDRIQRLCTSLADFPERTVPRDDLLPGLRTVALDRRVLIALTVTEPVVTILRVLYAGRDLSAQDVLF

SEQ ID NO: 58 - protein, 185 aa, Methylobacterium sp.
MALEQELATLMAAAQGGDAPAYRALLKACLPVVSAIARAQGVRGEAVDDVVQDALMTVHRARASYDPARPFLPWLRAITQRRAIDRLRRAGRRPREVNDPLAYETEVDPGPAPGHGLEARDRAAALARAVAALPDGQRQAVEHLGLRELSLDETAALTGRSKGALKVNLHRALKALRASLTQERE

SEQ ID NO: 59 - protein, 280 aa, Methylobacterium sp.
MSQHPAISPGRSAVVTGAASGIGLAAAQAFARAGMNVWLADLPGPALDAARAAVAELAAVEVRAVPTDVSDRGAVEALAAAVAKGGPPALVMLNAGIEAGGKLFSDADTWARILGTNLGGVVNGIHAFAPGMIEGGKPGAIVVTGSKQGITTPPGNAPYNVSKAGVKAVTEALAHELRNREGCHTTAHLLIPGFVYTGLTKARGVAEKPAGAWTPDETVAFLLERLAAGDFYILCPDNETTRAQDAKRIAWASGDIVENRPALSRWHPDYAEAFKRYMEG

SEQ ID NO: 60 - protein, 138 aa, Methylobacterium sp.
MSAPSPEPCTCSALRRATRALTASYDAALKPTGLRVTQFAILRLLDRLGSVPVSRLATEAALERTTMGRNLDPLKRRGLVSVTPGAADPRERCVSLTAAGREALTAATPYWREAQSRISARVDPATVSALAESLISAA

SEQ ID NO: 61 - protein, 221 aa, Methylobacterium sp.
VKILLVEDDAALAAEVAKVLRAENFVLDHTDTGEDAQHLGETEGYDAVVLDLGLPKGDGVSVLRAWRGAGRTLPVLVLTARDGWSDKVAAFKAGADDYLVKPVRVEELVIRLRALVRRSQGGGASRITCGPLSFDPGLGAFEHEGLPLKLTGLEWRVLSCLMLNRETVVPRPHLIERVYEGDADVDSNSVEVIITRLRRKIAPARIESVRGHGYRLHAEPA

SEQ ID NO: 62 - protein, 228 aa, Methylobacterium sp.
MSDDKTIDGTAREVRETEAAGPASRAIPRRTWVVGAVALPLALGAVGLSLAQGTPFQPTPVAPVAIQALAPSGATAIKGEVAEIFGNKFVVQDGTGRALVETGREGEGGGLVAKGETVTVQGRFETGFLHARVLTHGDGRTLLLGPAGGPPTGSLDWAKDRLGLGPKPDMAALTASLQAAGYGDVRVTGRGPRHFEVAAKDRDGREHRLHVGFDGQVRERPAPGLPPL

SEQ ID NO: 63 - protein, 89 aa, Methylobacterium sp.
MRFHIRWPDGTREACYSPSLVIKDHLAVGQDYPLDEFVALTRLALGIASERIRARYGFPCGRAQAQLARIEEGARRQEPGTVHVEAFED

SEQ ID NO: 64 - protein, 126 aa, Methylobacterium sp.
MPEADDETPPVVPPVVPPGVPSGGPVVAAAGVRADVGGMPYPEHRPEPRPEHRRAAPRPTERYAPGAAPAALRVIPIAGGPTLDAQTRVRLGHQMRAMYDPVIDEALDPRLAELLQQLDADRGGST

SEQ ID NO: 65 - protein, 223 aa, Methylobacterium sp.
MTHDHARHALGHDDHHHDHHHGSDLLPVEARVRALESLLTEKGYVDPAALDALVELYETKVGPHAGARVVARAWTDPAFRARLLADATPAIAELDIGGRGGEHMVVVENTPEVHNLVVCTLCSCYPWPVLGLPPVWYKAPPYRARAVIDPRGVLAEFGVTLPETTRITVWDSTAETRYMVLPMRPAETDGFSEEALAALVTRDSMIGTGLPKAIPVAPAEMPV

SEQ ID NO: 66 - protein, 300 aa, Methylobacterium sp.
MELRHLRYFAAVAEHLSFTAAAQSLGVSQPPLSQQIRDLELEIGVNLFERSSRRVVLTAAGEDFLGNARAVLAQVADAVDRARTIGTGTAGILNIGMTSSVLAGPAGCLIRAFEQRFRAVDVRIHEMAPADQIAALKANRTDLSFLRSPPEDPDLVAHLAWPERLCVAVPREHALAAGRSVAIDVFRSEPLISLGLESSRFAADIYQACIARGFTPSISQQVREASSLINLVAAGFGLAIIPEFVGRPRHPDVVVLPIKPPFLSADVYALHHQRRNPVIDNFLGLIREEAPGLIARFQKR

SEQ ID NO: 67 - protein, 303 aa, Methylobacterium sp.
MELRHLRYFVAVAKHLSFTAAADSLGVAQPPLSQQIRDLEAEIGTALFERTTRRVALTRAGHDFHIQAIGLLERAAEAVERARAIGAGTAGIINVGLTGSMLAGPLGHAIRDFAQVYPAVDLRIHEMSPDRQIAMLKAGQTDVSFLRAPPQDGDLVRVRAWSETVQVVLPRGHRLARGRLRLADLRDERFVFLRMSDSLFAKYLWDCCVEAGFVPTITHQAVEAASLTSLVASGLGIAIIPEYVARLAHADVVYRPLEGPRIRADVFALWSPAKAALVGNFVDLVRDGRKTPADQAEDPGSAP

SEQ ID NO: 68 - protein, 538 aa, Methylobacterium sp.
MERVIGGTDRPSATGGRAPARTEPSPSGTLSRTRTIVVRLDRRSLRGWHIRLLDQLGQRPDHRIRVAWVEHAEGLPPNAELLFRLEAAIHGLPRPGLATAAEPVALAPYEASPDDAEPGGSAADLVLDLSDSPADPGPAPAWRLDYDGMPGEAGLLAALFAHGAPVAALRGPDGAPVAVGRLGTESHTVMLTAFEGYLARTITLILAALDGAASTALPDGAGAPLRPAAAYDLGGLGARRRAAGGLARQIARRLYDLCFHGPHWRVGWRRIVGPDLIDLRRHPEGGWQVLPDDGRRFYADPFAIARDGAVTLFVEEFDYRRGKGVIAAVDFGENGPRGRPEPVLELETHLSYPFVFEADGQVWMIPESHASGTIDLYRATDFPRGWVHEAVLLDGVVAGDATLLQHGGRWWMFATVRAGGGSYSDTLHLWHAPHFRGPWTPHRHNPVLIDIGSARAAGPIVARDGGLIRPVQDCRQGYGAALGLARILRLDEEAYAQRVETRLCPGAAWPGTRLHMLSAAGGFEFIDGSHRARTRLLG

SEQ ID NO: 69 - protein, 328 aa, Methylobacterium sp.
GAGAAAPARPARILASRPARLVARSLVGRLYRLCYHAPHWRTGWRTLRGPDLVALGRHPAEGWQVLPDDGRRFYADPFPLAVDGTTHVFVEEFPHATGKAIISAVRFGPAGPEGPPVPVLEEPHHLSYPFVFARAGSVWMVPESSAAGTVDLYRATRYPGGWVKEATLLSGVVASDATLLEHGGRWWMFATVRDAPVGAPPGSGCHHDALYLWSAPDFRGPYAPHPANPVLVDPSFARPAGRIVARDGVLIRPVQDCAHGYGRALSLARIDRLDPEGFAQTILDRIEPGPAWPGSCLHTLNTGGGIECIDGSGRASRLRAYLNARSGA

SEQ ID NO: 70 - protein, 142 aa, Methylobacterium sp.
MKFHALLAAVLLGSSPVMAQAPEAVPGTPATLNDTLKARFVAQAPDDVVASKLVGLSIRNGADETVGSVADVVFDDKRGIKSYVVSVGGVLGLNAKYVAVAPETLQLNRQDGGKLDAVIDTDKDQLRAAPEYVYLGSEPTKK

SEQ ID NO: 71 - protein, 166 aa, Methylobacterium sp.
MRTPLLASALLLAGLATASAQTDGAKPDGGAATPVPGQPATMADSLRPTFVAQAPDDMVASKLIGSSVVNGANETIGQIADFVLDQKGAVKAWIIGVGGFLGIGSKYVAVDPSVLKLDRTDGKTLQARIDTTKDQLRAAPEYVYLGKEPPKGAAPASPAGEPASKP

SEQ ID NO: 72 - protein, 279 aa, Methylobacterium sp.
MYARSFGATRVSVPVIGQGTWHIDSSDRTDAVRALRAGIDAGMTHIDTAEMYGDAEAIVAAAVADCREEVFLVSKVVPGNATRRGVARACEASLRRLRTDRLDCYLLHWPGQHPLEETIAGFEDLRRAGKILSWGVSNFDVEDLDRVRAIAGPDRIACNQVLYHLNERAIEHAVLPWCEKHGVAMVGYSPFGSGDFPDPASAGGRVLAGIAQNHGTTPYAVALAYLTRLPGTFTIPKTGRPDRAVENAGAADLHLGAAEIALIDAHFPRGPRPRMLPML

SEQ ID NO: 73 - protein, 309 aa, Methylobacterium sp.
LPILSVRHRTVYRYRRPVAFGEHRIMFRPRDSYDQRLIAATLDIAPEPASLRWLFDVFGNCVAVATFDTRAETLTFDCGITLDHTPEHAPVFPLAPHATHYPFGYGAEDMPDLARSIERQWPDPRHEVDAWARSFLPPQGRIPTQELLAAMTRSVRANFTYLARSEKGVQDPLTTLRTKLGSCRDFAVLMMEGVRALGMAARFVSGYLYNPRNDRARHVGGGSTHAWLQVYLPGAGWVEFDPTNGIVGNRDLIRVAVTRDPAQAVPLHGSFFGLASDDLGMRVDVDVVELPADGPAARTVQGPETSLAR

SEQ ID NO: 74 - protein, 358 aa, Methylobacterium sp.
MSETRIVRAAAIQIAPDLDRPDGTLERVLNAVDEAAAKGARFMVFPETFVPYYPYFSFVLPPALQGPEHLRLYERAVAVPGPVTQAVSAAARRHGAVIVLGVNERDHGSLYNAQLIFDADGALKLKRRKITPTYHERMIWGQGDGAGLAVVETAVGRVGALACWEHYNPLARYALMAGHEEIHAAQFPGSLVGQIFADQMEVTIRHHALEAACFVVNATGWLTDAQVAQVCPDERLRGACRGGNCTAIVSPEGKHLADPLGPGEGILIADMDLALVTKRKRMMDSVGHYARPELLSLLHDDRPAASVQRPARSQTAPRSPDHEQQPASDAPSRVPAGPDGPDRDADGAPDQRVAILRR

SEQ ID NO: 75 - protein, 335 aa, Methylobacterium sp.
MSVRERLRGALSHLVPQRPARRVIVAGLVFAPLAIAGPAREARADPVFPGAGALGLTPPAGMSVSRRFAGFEHPAGASIILVEMPPEAWDQINGRFTPEALAATGFRVKGGAEPLPVAGGEGFVLRGTQPANGLTYAKWVAVVRGAPGTGLVTVQVPEKAARQVPAASVEAALRTIAFRAKASLTDQVAALPYTVGDMAGYRPAAVFAGNSLLLTEGPKDVDPEREQPVIVVAPSLGQAPVPAGAEVAVARRLFAAQKDFADVNVTDEARSSRGEAVVVRLRGTGTDTKSGRALGVTQTMVFDGKRYLRVLGFADAGRPDALDRADRVAASVAMR

SEQ ID NO: 76 - protein, 79 aa, Methylobacterium sp.
MPLNIRSEEVNQLAEKLASRAGVSKTEAVRLALTNELARRDAERETFLERVTQIQERLASYPSTGLQADKAFYDSLNDE

SEQ ID NO: 77 - protein, 743 aa, Methylobacterium sp.
MSFRSAPSGLLLATTALSTVALVPAAAAQGAAVQLDEISVEAARPAAAAPTGGVGGGGNVNRGDGGGAATSGGGGGPSGVTGYVARVSPAATKTNTPLLETPQSVSVVTREQLNDRNVQDLAQAIAYTPGVSSSVFGFDPRYDAFYIRGFSATYNGIFRDGLRLNAVGLTIPRSEPYGLDAVTILRGPASGLYGLGSPGGIVDSTSKRPVFVPFGEVQFQAGNYDRFQGNFDIGGPVAGTDGTMAYRVTGVKRQSNTYLPGGDDDRTFIAPSFTWRPDSDTSFTFLSEYFESRLPGTSFFYNDPGFRVTNFYSGDPALNQYKQQQYRVGYAFEHRFSPDLIFRQNFRYYDVRADYDYTSITGLNPARTLGARTAGAYLDTLGQISLDNQLEGRFATGPIQHTLIGGVDYAHYDYTRAFGFGAAPDLNLLTLNYGQQVIARPRYTNFQSQAQDQIGAYLQDQAKLGRFVLTLTGRHDWVFQNTSDRTADTVADQTDRAFSGRIGLNYLLTDFLVPYASYATTFTPQVGIDVNGNPFKAATGDQIEAGVKAAIPNTNITTSFSGFDIVQSSLLRQDPNNIANQVATGSAESKGFEAELTANFAPGTNLTLSYTHLNLRYLRQTSLVTGRPIDGNALSGIPGDSFTAFGTYQFAPGSPLAGLQLGGGIRYAGTSFADDENTVRNPTVTLFDALVAYDFAALDPKYRGFRAQINASNIFDRSYTTCQAGFCYRGAPATVIGSLIYRW

SEQ ID NO: 78 - protein, 628 aa, Methylobacterium sp.
VLNARPVTRPGEVLEAVPGLIVTQHSGEGKANQYFLRGFNLDHGTDIAISVDGMPVNMRTHAHGQGYADLNFLIPELVGAVEYHKGPYFVRDGDFASAGSVRIDYLDTVRENLALTSIGSFGYKRALSIASAPLGEGTLLVAGEAQVYDGPWAVPDALRKLNGVARYSQGTALDGFAVTGMAYASRWTATNQIPERAVGAGLIGRYGTLNPTDGGDTGRFSLSGRFSATDDTGITRASAYVIRYQMNLFNDFTYFLNDPVGGDQFHQLDQRVLGGGEVLHIFQGDLFGRPLEVEVGAQTRTDSIRVGLFNTAFRQYRSTVLDDRVLESSGALYLDTRVRWTEWLRTSVGVRADGYYADVRADTPANSGRATDGIVNPKLGLVLGPWSDTELYVNYGGGFHSNDARGVTATVDPASPLFNITRSPFLVPSTGYELGLRNRSIAGLETSLALFRLDFASENIFQGDTGTTEPSRSTRRFGVEWTNRYAVTPWLSLDGDLTITNTRFSSYDPAGNRVPEAPTTIASAGVTFGEPLGWFGSLRVRYFGPRPLIEDNAIRSRATALLNGRIGYLFDTGVSVSLDVLNLTNSKADQITYAYVSRLPGEPAEGLIDRVFHPVEPTAVRLTIAGRF

SEQ ID NO: 79 - protein, 159 aa, Methylobacterium sp.
MSKGYPSMTALLGLLAVAGYQNRDKIADWLGAPSRDSYDATLTPASRTTPVANSSMPSNLEHVLGGVGSAGVGGLIASGLAELVEHFTKGGHGETASSWVNQGDNRSIAEADLERAIGPETLDHLTQQTGLSRPALLSRLSRELPSAIDRYATEGRRFA

SEQ ID NO: 80 - protein, 151 aa, Methylobacterium sp.
MTALLGLLAVAGYQNRDRIAEWLGGHAKDASRSPAPQVPPATGSTIPANLDRLLGGASAGGVGGLIAGGLTELVDHFTKGGHAETAQSWINHGPNRDIPTADLERAIGPDTLAALEQRTGLSKSELLARLSRDLPSAIDRYSPDGRLPAFS

SEQ ID NO: 81 - protein, 358 aa, Methylobacterium sp.
MGRILLITDDPARSQGLAQDLSDGLSCELHDLRAAELPLGGATAIVTDVHDLGTASVERLRRRLAEVRHGAPLTVLLHTDSPRTRLLGVALGATHTLCAPFDTDRLRETLGAPRAPARLATFADEPLPACAVRTAAAVRGFYASVFVPDQPITPGVIDNGTQAIDLAIRDTGIRDWVRAVRQFDDATHQHCLLVAGLAAAFAASLGLGEQERHRLTKAALLHDVGKIHIPAAILNKPGRLDDAELAVMRLHPEKGYTMLVDQGFEQQMLHVVRSHHEMLDGSGYPDRLKGEEIPDLVRLVTVCDIHAALIEQRPYKQPMASEAAYAILEGMAGRLDPAIVGAFRPVVAAFAPHTLNAA

SEQ ID NO: 82 - protein, 354 aa, Methylobacterium sp.
LGQTLILTDDVERAERLARNLGGVTPVVLHDLYGDAVPPRGAGLIISDVSALTSESVRRLRQALSTARGPGIPFLALIHGNLGRGEIQATALGATRAMPAAAVSAMLLNAVATLIGTAKAPPQTGNWQEQVNEARSAFVSLFRADQAPPAALVENGADLVNQAIREAKVREWLRVVASFDDVTHRHCLSVAGIAAEFARVLGLNEADSRYLVKGALLHDIGKAKISLAILNKPAPLTPTERAEMARHPALGHEMLLTGDYDALTLSVVRSHHEYLDGSGYPDGLRGQQIPDLVRLITIADIFAALIEARPYKAPKAPREAYAILESMRAKLDADLVRAFGAVAVACETPRRASA

SEQ ID NO: 83 - protein, 240 aa, Methylobacterium sp.
MLEVTGLSAGYGQVEVLHGLDFQVPKGQVVALIGSNGAGKTTTMRALSGMIRPRAGSIRLNGQEIGGLESHDVARFGLAHSPEGRRVFPTLSVEDNLTLGAFPRLTGSRPKGDVAADRERAFEMFPRLKERRAQLAGTLSGGEQQMLAMGRALMLRPEILLLDEPSMGLAPKLVEEVFRIIRLLKSEQVTMLLVEQFAMAALGVADHAYVLENGRIRFQGPAQQMRNDPAVRAAYLGGSH

SEQ ID NO: 84 - protein, 234 aa, Methylobacterium sp.
MLEIRDLVCGYGHVTALKGLTIDVREGQLVALVGANGAGKSTTLRAISGLVPPRSGAIRFAGRDIAGAEPRRILAAGIAHCPEGRRVFPQMTVAENLAMGAYLRRDRAAVAADLARIYGEFPRLAERRDQAAGTLSGGEQQMLAIGRALMGRPKLVLFDEPSLGLAPNIVERMFAVIGAIRDAGTTVLLVEQNAFAALELCDYAYLLETGRIVLEGRGQDLIADPHVRDAYLGG

SEQ ID NO: 85 - protein, 129 aa, Methylobacterium sp.
MPFINVKVAGAPLAPEQITALQAGITRLMATVLHKVAPLVGVLVEEVSAAGWSVGAEPIARAAQVDAVISADTNTPDEKSRFIYEVNQLLKTVLGAELAEVSYIVIHEVPKDSWGYDGLTQAERGRGRA

SEQ ID NO: 86 - protein, 890 aa, Methylobacterium sp.
MTKPDSVPPHLFETAEGRRLVEARSDPAWRRWGPYLSDRQWGTVREDYSPKGDAWDYLPHDHARSRAYRWGEDGIGGFGDRHLNWCLSLALWNGRDPILKERLFGLTNQEGNHGEDVKELYYYLDGVPTHAFMRMLYKYPQAAFPYGRLVEENARRGLDDPEFELLDTGLFDAGRYFDVEIAYAKAAPDDILMRVTATNRGPDAADLTLLPHLWARNTWSWKQGTPKPELMAGSEGSVWARHPEMPTFRFFAEGAGDLLFTENETNTHRLFGSGPAEGFYKDGIDRCVVGGDRAAVNALSGTKCAARYDLHLGPGETRTVRLRLRAETAPGAPFADFDAVFAAREGEADDFYGALQAPIADPEMRLVQRQALAGMLWSKQLYHYDVREWLAGDPAQPAPAPERRHGRNSDWSHLRANDIISMPDAWEYPWFASWDLALQAIVFGLIDPDFAKNQLLLLVDEAYTHPNAALPAYEWGFGDANPPVHALAAWRVFELDRALTGKPDHAFLKRIFNKLTLNFTWWVNRKDADDRNLFQGGFLGLDNIGIFDRSKPVGDGATLTQSDATAWMATYALNLMRIAIELALEDPTFEDMAEKFFEHFLLIAGATGAGVWDEPDGFFYDVIETRDGQRLPIRARTMVGLIPIFAVAVINECDLARLPSLRNRMVFFLKNRPDLATLVSRWNEPGEGQTALLSLLRGHRLKALLHRALDPNEFLSDYGLRAVSRVYADEPFCFAWDRRDLGLAYEPAESRSRLFGGNSNWRGPVWMPVNYLLIAGLNRFHDYYGPDFRVEAPTGSGRTYALREIAAHLSRRLISLSTRRPDGRRPVYGDSRIEQEDPHFRDLVLFYEYYHGDSGRGVGASHQTGWSGLVALLIQEVATAAAEAQNPGWP

SEQ ID NO: 87 - protein, 881 aa, Methylobacterium sp.
VDWAERRRIAEQGRGDRAWSLWGPYLSERQWGTVREDYSPCGNAWAALTHEDARSRAYRWGEDGLAGICDERGNLCLALALWNGRDRILKERLFGLTNQEGNHGEDVKEVYHYLDAVPSHAYLKMLYRYPQAAFPYADLVGENGRRGREQPEYEIEETGVFDGDRFFDVTVEYAKADADDVHAVITALNRGPEPADLHLVPQLWFRNTWSWEAGQARPRIARAPDGGAICTHERLGPYRLAFDGAPDLLFCENDTNLRLHGGQPDAAGPFKDGLHAAIVDGDPASVRRDAGTKLGLHYALRLAPGETARIRLRLSAGLRARAVDDGSLVRRRVAEADAFYEELQDGIASPESRAIFRQAAAGLIWSKQLYSYDVRRWLEGDPLQPPPPRGRAGGRNGQWRHFAAADVLSMPDTWEYPWFAAWDLAFHCLPLALLDPDFAKKQLLLLTREWYMHPNGQLPAYEWEFGDANPPVHAWATYRVFEIDRDRRGGGGDLAFLEGVFHKLLINFSWWVNRKDAQGRNVFQGGFLGLDNVGVFDRSRPPPGFGVVHQADGTAWMAMYALNMMRIALELALHNDVYESTASKFFEHFLLIAEAMTDMGGSGGDGQGYGLWDETDAFYYDEVDIPGGGMLPLRVRSMVGLVPLFAVEVIEPSVLHRLPDFARRLNWVLENRPHLARLVSRWTEGGVKDRKLLSLLRGHRMKALLRRMLDEAEFLSPYGVRSLSKVHRDAPYVLNELGASFTVRYDPADSTSNMFGGNSNWRGPVWMPMNFLIVEALRRFHTYYGDDFRVEYPTGSGAMLTLSAIADALEDRLIALFAKDETGRRPAFGTRPPIAPAPGAEEALLFHEFFDGDTGRGLGAAHQTGWTALIINLLRDRARAR

SEQ ID NO: 88 - protein, 329 aa, Methylobacterium sp.
MTIAGRTVMVPVHTEAAFDSPFLVRPPDPDGIAVIEHAGVVIGHVTFPGRPRFYALSTFDGVPYAKIAVLHGRDVLATTVLQTCIRYQSRAKTCQFCSIGQSLAAGRTVARKTPEQLAEVARAAVLLDGVKHMVMTTGTPNATDRGAAILCESAFAVKAAVDLPIQAQCEPPDDDRWFERMKASGIDALGMHLEAVTPEVRARIMPGKASVPLERYYDAFAAAVPVFGRGQVSTYILAGLGDAPEAILAMADRLIGMGVYPFVVPFVPISGTPLESHPAPGPDFMHAVLKPLAEMLGRANLRSTDIKAGCGRCGACSALSTYERAGEAA

SEQ ID NO: 89 - protein, 257 aa, Methylobacterium sp.
MNRADVVRAAAGTSVIVHAVNPPGYRGWDRLVLPMLDNTLAAARDAGARIVLPGTIYNYDPALASVIDETTPEKPRGRKGAIRVEMEKRLAEAAPEVRSLVVRAGDFFGPGVGQSWFAQALAKPPLARIVNPGKPGVGHAWAYLPDLAEAILRLLELPPDRLRPCERLQFPGHDDADGGKMVAAVRRASGRPDLPERRFPWTLMRALAPFGGFPREVMEVRPFWAYPVRLDGRRLSTLIGDPPLTPLDRAVAASLRG

SEQ ID NO: 90 - protein, 156 aa, Methylobacterium sp.
MTALLGLLALAGYQNRDKLAELLGGAGQTAPAGPGGQADGSNSGSNGASGAGLGGLLGGLLGDRRGEAPGGFLHSGLGEMLDRFQQAGHGTAAQSWVNQGPNQKIAPHHLEQAIGPDVLAALTQRTGLSRDELLSRLSRELPRAVDRYTPDGRIPA

SEQ ID NO: 91 - protein, 425 aa, Methylobacterium sp.
MATDETADTVVVGGGMVGLASAIALRDRGLDVVLLDPGEARARTSYGNAGVVSRGSILPMSSPALWGKLPAYLRNADRGLRLHYGHLPRIVPYTAHFLAAARASRWRRAAAALLPLTSAAYPAHERLAARAGTGDRLQRTGWIKAYRTEAAFASAALEREILAGHGVAFDILDTAALRALEPALVRPYARAMLLTETGSVREPGRLIEACEALFTGLGGRRLRGSVARLEPEVDGWRVDHDGGAVRGRQVVLAAGAASGAIARTLGYRFAVAAERGYHRHYALHPDSPPLTRPILDTGAGSILSPMGEHRVRVLSGVELNARAAAPDHTQIDAASREAASTLRLGGPLDNAPWLGSRPSTPDGMPVIGRAPRHDGLLFAFGHGHIGLSTGPITGEIVADLATGREPAVPVAAFAPERLLRWPRLL

SEQ ID NO: 92 - protein, 229 aa, Methylobacterium sp.
MPGEGSNWAGGDLSRHERLVEELAGGLEPVRPLPAPEARAALWLGVTLVLGVVLAAWVGTGGFMLRMHVPDLALAAVGAVLTAITAAYAAFATSVPGRSGRWALLPLPPLALWIGASGLGCLRDWIAPGAEMHGEHPITGCFSFLICVSVPLSVLIVVMLRRACPLRPNLTAALGGLAVAAAAAALLMPVHPHDATATDLLFHAAAVAIVIAANGLAGGRLLGQHAGAG

SEQ ID NO: 93 - protein, 69 aa, Methylobacterium sp.
MGDDVAAILLTLVTENSELREQLASAQDMLMETAIDAGQLHARIQGLEAERDAWRAEAGHRQARAALTA

SEQ ID NO: 94 - protein, 479 aa, Methylobacterium sp.
MKAGGRGGRSVDRSDAAGIWTPDLRRWGKPHYLAIADALADDIRTGHLLPGTRLPTQRALAATLDLNFTTVSRGYVEAHRRGLIEGRVGRGTFVVDPADAARTAEPALPRRPGPVDFTMNLPPEPDLPGLQARMRSSFAELSGNLADLLRYQGFGGTEADKEAALRWLAGRGIAAARERLLICPGAHSALSSILGQVAQAGDTICAERITYPGIRTLAAHRGLRLVGLPMDRHGLDPDAFAAACTRGAPKALYLNPLLQNPTTATLSRARREAVIATARRYAVTIIEDDAYARICPAPPPSFAELAPEITYYVAGVAKCLGAGLRLAFLVAPNARAALPLGDALRAATVMASPISTALTTRWITDGTADAIVDFVRAESAARQSLAAALLPAEAYVADPHAFHVWITLPAGWTRSAFASQGRAAGLGVVGSDPFCVAGTPPEAVRLCLGGPSTRQQIAHGLERLAHALEGSPTLASTYI

SEQ ID NO: 95 - protein, 93 aa, Methylobacterium sp.
MTKRSTPFSPEVRERAVRMVFDHQGEHGSQYGAIRSIAAKIGCSGETLRNWVRQAERDQGQRPGPTTDERERIKALERENRELRQANEILRKA

SEQ ID NO: 96 - protein, 456 aa, Methylobacterium sp.
MNEIAPFDTRVDPSVLAARLSDERAPDIVEALNDEAPEVAAAILLGLPMERAIEVLDQPELDCAADIIEMLPRDRVAGYLSGMSADRVTDVFREIEEPGRSDLRARLDAETRGAVDRLSAYGEETVGSLMTTEFVTVPGTWTVGQTLEHIRHVEKTRETIYAIFVLDPRTRALTKAVPLRRLISGDPSDNVLSVAPGRRPLAVSPTASREEAARLISKYDLLALPVVDAVGHVIGIVTVDDMIDAMIEKQTQDVQRFGGMEALPEPYMDIGFFTMIRKRAGWLCALFLSEMLTASAMQGFEGELEKAIVLTLFIPLIMSSGGNSGSQATSLLIRALALHQIRLRDWWRVALRELPTGIFLGAILGVIAVIRIVAWQKLGLYDYGAHWPLVAATVGAALVGIVTFGSLAGSMLPFLLQRIGFDPATASAPFVATLVDVTGLVIYFSVALLILRGTLL

SEQ ID NO: 97 - protein, 357 aa, Methylobacterium sp.
MSTTVALRSLIKRYGSFTAVDDITLDVPEGQLVALLGPSGCGKTTTLRMIGGFVEADAGSILIGGRDVTRLPPAKRNIGFGFQSYALFPHMSIAQNVAFGLEMRRLPRAEIASRVARALDRVRLSAMADRLPKQLSGGQQQRVSLARALVIEPSVLLLDEPLSNLDAQLRGEMKLEIRQIQKAMGITTIFVTHDQDEALSIADRIVVMRAGRIEQDGSPEAVFGAPRSRFVAEFMGVTNLLPGTVEGPGTFRLADGNAIRVPVAGAGRGATVLAIRPERVRITPSGADTAPDTLDAEIEAATYRGLAVEYRLRTPSGLCLTARRATPATGGPAMLEPGARVHVAVPPDACHFVPVEL

SEQ ID NO: 98 - protein, 294 aa, Methylobacterium sp.
VSAGTTLILDGITQRYGSALAVDTVTLDIRGGELVALLGPSGCGKTTLLRAVAGFLKPTEGRVIIGGQAVDHLPPNRRTVGIVFQNYALFPHMSVADNVAYGLAARGVGRAEQRARVAEMLALVRLEHLAGRFPREMSGGQQQRVALARALAVRPSILLLDEPFAALDKNLRLDMQIEIKRIQRSAGTTTLIVTHDQEEALSMADRVAVLNAGRLEQFAPPTDVYDRPETLFVNTFVGTANVLHGRLATEPGGARVVALKAGGLLPAATSLPDGTRVAACLRPEHVAFAEEGPG

SEQ ID NO: 99 - protein, 361 aa, Methylobacterium sp.
VDPPRDRPVVGPADPSAASEAAVEAASEAAAARALQRAILRQQAGLLARQERALAAAGMGLWSCRLRDGALDWSGGVHDLFGVPRGAALHRPRILDLYEPASRRLLETVRHRAIAGSGAFVLDAEILAGGRRRWIRIRAAVETEDGRPARLFGTKQDVTEEIVRLAELSRRAERDPLTGLANRRGFEARFEARFEAGTDGAGPDSFGALLLIDLDGFKPVNDVHGHAAGDLCLRRSAARLAAVCRDAALVARIGGDEFAVLLRAPVDPLALVERGRRVVAALSRPIPYRGRELRIGASVGIAVGDAAGMSSGRGGRARLFDRADAALYAAKDAGGNAVRIVLGGGRSGAGAAQAAVALGPG

SEQ ID NO: 100 - protein, 160 aa, Methylobacterium sp.
MPAVNREPHKKGDVLVDYEEKVFEDVKAEPGQKALVTFHTVAFEGSIGLVNLLQATRLQRKGFETSILLYGPGITLGVQRGFPRLGDEAFPGHLNFNNQLEKFMAEGGKVYACRFSTQALYGHSEAAFIEGIRMINPLDVLDCILLHKRDNAVIIDTWTV

SEQ ID NO: 101 - protein, 180 aa, Methylobacterium sp.
MFDPVPPYRPSHFRVKFAVAPWERRACAALRRQVFCAEQGIFEADDRDAIDAHAIPVCALSTLGGDADAVVGTVRIHEDGACPGTWWGSRLAVARPFRSAAALGTGLIRVAVSSAHARGCTRFLAHVQEGNVALFEALHWESLDALDLHGRPHRLMEADLAAYPPMHDPEHGLLTFRRAA

SEQ ID NO: 102 - protein, 331 aa, Methylobacterium sp.
VTAGIDIRALARQIREARGVGHKRDIDAVVRRLGLGSRHAAVPVGDDCAAIPDGDGHLLLAIEGFLDSFVADDPYFAGYCGIMVNLSDVAAMGGRPLAVVDALWARDAGAADPILAGLSDAAALYGVPVVGGHTNTRAAAGNLAVAVLGRAGPRLLTSFDAAPGDDLVAAIDLRGRFRDPHPYWDASTGAPGARLRGDLALLPGLAEDGLAGAAKDISMAGVVGTALMLLECSGVGGVIDLDAIPRPDHVPLARWLTAFPSFGYLVSVRPDRTAAVTARFAERGIAAARIGGLDASRVARVRDSSGAEAVVWDFAAGPLIGCGRDGREATP

SEQ ID NO: 103 - protein, 117 aa, Methylobacterium sp.
VNKSIPQARNLRRTQTSAEAKLWRVLRNRALNGWKFRRQHPIDRFIIDFACIEAGLIVEVDGATHSTDVEIARDAARTEILESLGFALLRIPNADIHKHLEGVRETILAALERRETV

SEQ ID NO: 104 - protein, 124 aa, Methylobacterium sp.
MKQTSGPARKPAEAVIKDIRRATRRQFSAEEKIRIVLEGLRGEDSIAELCRREGIASSMYYGWSKEFLEAGKKRLAGDTARAATADEVQDLRREAGALKEVVADLVLENRLLKKSLTGAGGDEA

SEQ ID NO: 105 - protein, 110 aa, Methylobacterium sp.
VIKDIRRATRRQFSAEEKIRIVLEGLRGEDSIAELCRREGIASSMYYGWSKEFLEAGKKRLAGDTARAATTDEVKDLRREAGALKEVVADLVLENRLLKKSMSEAGGDEA

SEQ ID NO: 106 - protein, 325 aa, Methylobacterium sp.
MAERRMTFRHIEAFRAVVATGSMTEASRRLHTSQPQVSRLIAQLEAITGLPLFDRSGSRVVPSLDGTRFHAEVERAFVGLTSLESAAARIRAFGAERLRVAAMPRLAGGLLARAVVRFRAAHPDVIVAIHSGDDETVNHWLATGSCDAALTMLYGDAPEARAEHVETRACVAVLPRDHALAARESLAPADFQGVPFVAASLGSALRDRTEAVFEAAGIGLTITAEAGLGASICTLVSAGLGVSVMNPLAAHEEAKVSPIAIRPFAPALPVHFALLFPPDHARGRLMRAFGACARTVLLEELAQLPDAAIGRPAASAQAARFSAPA

SEQ ID NO: 107 - protein, 256 aa, Methylobacterium sp.
MSFTDTRALVTGADSGIGQATAELLARAGADVAITYHSDAEGIRETAARVEAAGRRALVLQLDVGDPAAVTAAFDRIGSEFGTLDILVANAGQAMSGMPVAEMDDAVLERILRVNLMGPLFCARPFIRMRRAQGGNGKIVFVSSVAQHLPTPESAPYGMSKAGLGSLCRSLSRELAEDRINVNTVAPGLIETPMTADRFEKPEVLDRSLERIPWHRAGQPEEIARAILYLASEDAAYVTGHTLVVDGGLTMQWGGA

SEQ ID NO: 108 - protein, 239 aa, Methylobacterium sp.
MRILLINPNTSAHVTDLVAGHVRTQLGGRAELRAVTGRFGARYIASRAAAAIAGHAALDALAEHGADCDAVYLACFGDPGLLALRELSRVPVIGMAEAACREAAASGRFGIVTGGAAWEPMLRELVAALGLADALAALRTVAPSGGTIARDPDAALEILAEACRACAASGAETVVLGGAGLAGLAGRIAPQVPVPVICSVEAGTRAVLAAGASGQAPSRPDPVESIGLTPALATRLMDP

SEQ ID NO: 109 - protein, 231 aa, Methylobacterium sp.
TDLLAGQVGTMAGAAATFVPATARFGAAYIASRAALAIAGHAALDAFAEHGRDCDAVFLACFGDPGLLALREVSPVPVVGMLEASCLEAQRVAGRYAIVTGGALWKPMLRECVASLGVGDGLAGIRTIARTGGEIAKDPEAALSDLAAACRACAEEDRAEAVILGGAALVGLAARLQPHVPVPVLCSVTSGVRAVVAAAAAPYRRPPAVAADNVGLGHALATLLAPREAIV

SEQ ID NO: 110 - protein, 310 aa, Methylobacterium sp.
MSSAQALSGAPLAGPGVAPRLPPLPPSGRPEIVRETGHAHGAAVVEKPLSITERLYNQAWLRKIVILVLLAGIWEAYGRYLDNDLLFPTFTATVEAFFRGIADGTLPARAWSSLKVLLMGYAAGVALATVLTGVAIASRIGTDLLETLTSMFNPLPAIALLPLALIWFGLGNGSLIFVLVHSVTWAIALNTHSGFLSVSRTLKMVGRNYGLSGPRLIGKILIPAAFPSILTGLKVGWAFAWRTLIAAELVFGVSSGAGGLGWFIFENKNMLDIPNVFAGLLTVILIGLVVENLIFQTIERRTVQRWGMQA

SEQ ID NO: 111 - protein, 386 aa, Methylobacterium sp.
FLTGLAYQMQAVAIGWYVYDLTHSALALGLVGLAGFLPAVLCALITGHVADAYDRRLVGAAAFALQSAASLGLLACALAGVHSVWPIYALVIVVGTARAFANPALQALLPTLVPGPLFGSAIAWNASLWQSASVMGPALGGFLYALGPAVVFGGAGGSFALASALTLLIRYRPAAVSERPPITWAALSAGIDYIRSQPVVLGAISLDLFTVLLGGATALLPIYAAEVLHVGPLGLGALRSMPAFGAVAMAVLLANYPLRRHAGVRMLRAAAVFGAATVAFGLSTSLPLSMACLFVTGAADMISVYVRQTFVQGEAPDAMRGRVSAVNTVFIGASNELGEFESGLLAAAIGAVPAVVVGGAATVGVALLWGRLFPALRARDRLMVQG

SEQ ID NO: 112 - protein, 99 aa, Methylobacterium sp.
MAGTQAHGSASGSGSESGSAPGPASGTDEAASQPSARSSDAITFEQIRERAYELWERNHRPEGFEIEFWLLAERELRKERDRRKANAAPAAPRSDPPPA

SEQ ID NO: 113 - protein, 529 aa, Methylobacterium sp.
MTVIDDRYSEFLAREATAVAEARRLNRLVIELNYWVYRIIAETDQDQMQAANRGFEAALPTVRALLPSLRSHAPTFAARIDEQAARIERYLRDVSEVRRLGTANQNEQAIALIHTAIDPTFSGLLSDGNRMAEDIDTYMQKGSGDLTDQTNETRRTLMIVSALGMLAGLLAAVFIATVGITRPLDRLVKVLQRMAQGEIEAEITEAARRDEVGAVGKAVEGIKVMVARKAAEEAEMKRRADEAAAAARRRTMVELADGFERAVGSIVGMVSSSATELQATAQIMTSSATETASQSTTVAAAAEQASANVQTVAAAAEELGTSVQEIGRQVLGSANLAQAAVGEADETQHLVQALSQAATRIGDMVGLIANIAGQTNLLALNATIEAARAGEAGRGFAVVAAEVKELAGQTARATEEISQQIGQIQGVTGQAVSAIDTIAARIREIDAVAATIAAAVEEQGAATQEIVRNVSQAAAGTDEVTSNIAGVARASEETGAAAAQVLGAAGELSRQSEHLGTEVSRFLGSVRAA

SEQ ID NO: 114 - protein, 441 aa, Methylobacterium sp.
MASADAAIGIPADGRQRGVAGRDVPDVLRVLLNGAVFVLLWNHVWLKDLSDRSMLAASEDGSLLTQILFLSAGAAMAAAIHRIGVRHLRPLVTRPLVLCALWLGATALLSVEPSLSLRRLALFAIAAMLSAGVLIVARSPRQLALTMAGSALVIVLASYLAVAFVPNLAIHSAFDVNSDPSHPGLWRGIFPQKNEAGAAMVILVIVGLYVAKVASRVLGWAIVLLAAGFLVASGSKTAILLLPVILAVTGLCQVLTGGFLRRLLLLGPVIGFSLISIGSVLAPPIQEAVGSLLTDATFTGRSEIWQFAIDNIMIRPWRGWGIGAFWMTERTMYAGSEALTWVNTVDHAHNAYLDTALIGGLPFLALTVVAFVFAPVRDLQRVAGGTRLDAETLLFLRLWFLGLVSASFETVLYNGNNATCCMFMMAVFGLRLRTRYAVVAG

SEQ ID NO: 115 - protein, 109 aa, Methylobacterium sp.
LRIELGSDTLLGPGKAALLSGIRDTGSIAAAGRRMGMSYKRAWYLIDTLNKAFQEPLVSASKGGRRGGGAVLTVTGDAILDSYLRMERLASEAVAGELDLLSSLMKADS

SEQ ID NO: 116 - protein, 92 aa, Methylobacterium sp.
VQLLEMIAEHGSIAGAGRALGMSYRRAWLLVEAMNTGFGRPVVEAQTGGRAGGGARLSAFGADVVRRYRAVEAAAEAAAAPFLRCLGQAGDA

SEQ ID NO: 117 - protein, 256 aa, Methylobacterium sp.
MDTGQPLLEVDGVTLRYKTPEHLVTATYRVSFRVWPGDRFVLLGPSGCGKSTLLKAVGGYMAPTEGEIRLKGRPVTEPGPDRMMVFQEFDQLLPWKTVRQNVVFALEASGRLRGREALDRANLYIDKVNLTKFADSYPHTLSGGMKQRVAIARGMAMEPDILLMDEPFAALDALTRRRMQDELLALWEGTRFTVLFVTHSIPEAIKVGSRILLLSPHPGEVKAELNSAESPEAALQLEGRIQHMLFSEEIQEAENV

SEQ ID NO: 118 - protein, 767 aa, Methylobacterium sp.
LGGDASADPDSLKAYATNRDAMVAGFASVQDLLRNRDLPSVTATLARLNAAQDAVNLLRPRVDDALRVAKPKRDPALLPAVLTAFQDLLDALTATTDAVDSAIPRSDAVLQRYLVLKRSAWATRVAIGNVALRVQTSLAAGTSWSLPETVAAAEERARVQSAWSSTSEAAAQSSDTVRAAFERAKRSNFEGEAAEAARAIFDALSQQRASPITFQDLRKRNTVEQMTIVDLADAALAEMVARAESLAAEADRVLLHSAAALLAVLLLVGLGLMALFGGVLRPLRIIATAMRALTGGETAVAVPVRAYRNEFAPIMVAVQAFRDNLIRTRDLEAGAERARLEADDQRRDSLRQMAQRFEEAVGGMIGSVASSATALQVTAQTMTATATQTAGQSTAVAAAAERASSNVNTVAAAAEELGTSVQEIGRQADGSAELAQRAASEADRTAARVQDLSSAVDQIGAVVGLISSIAEQTNLLALNATIEAARAGSAGRGFAVVASEVKALAAQTAKATDEISGQIAQVQASTGQAVEAIAAITARIREINGAATTIAAAVEEQGAATQEIVRNVGQAATGTGEVTTTMTGVAQAAEGTGLAASQVLAAASALSDQSDRLTAEVERFLASVRVSYAVSAAQVAIVQRSFATVQALGDTAAELFYGRLFDIAPQVRSLFPDDMTAQKRKLVAMLALAVANLDKPEALVATVRDLGDRHVGYGALQAHFEPVGAALLWTLEQGLGPDFTPEMREAWTETYRVIAGLMTMTGAAKAA

SEQ ID NO: 119 - protein, 687 aa, Methylobacterium sp.
MSLVLVVMATIMLGYATGTVREARQHAAEAERVIALVRASRALLQTLNVTRFERGATLQFLAAAEPVEAETRASLYADRQRAIAGLAAARPLLDGLELPAVAATLGRLQEASGRLDRLRPRVDAALDVPGARRDGAVTAEARAALQAMLDALIATSDAVDAAIPLSDGLLRRDLALKRAAWATRMANGAVALRVQTSLAAGASWSLDETVAAAEERGRLDAAWNAAIEASADTSETVRAAFRRARENNFEGAPLARRRAVAQALARGEPPGLTLAQARKLDTPEQVTLVDLAFVCLDEMIARAEALSGTARSTLWRDGTALVATLLLVALGLLALFRGVLRPIRRITAAMEALAAGDAAVAVPGLRRRNEIGAMARAVQVFKDNLIRTRRLEAGAEAARQDAERQRGLAMRQVADRFADAVGGIVAQVSTAAASLQATARGMTEIAAETAEQSTTVAAAAEEAASNVGTVAAAAEELGASVQEIGRQVDGSASLARAAVAEADRTGALVRDLSEAVARIGDVVGLISTIAGQTNLLALNATIEAARAGAAGRGFAVVATEVKALAAQTARATEEIAGQIGRVQASTGQAVAAIGTITARIRDIDGVATTIAAAVEQQGAATREIVRNVGQAAQGAAAVTGHVAGVAAASGTTEAAAGEVLGAAAALSAQAEHLTEEVGRFLDGVRAA

SEQ ID NO: 120 - protein, 686 aa, Methylobacterium sp.
LCLVIVIMACMALSNAVRTLVDARARAAGAARALTLTQASQGLLRTILPLRLERGSTLALGGEAPADAKTLSTIAGSRQAMTEHYAGARRSLGDLAEPAVGATLERLSTAQAAMADLRPRIDAALGLPLARRDPALRDAAMAAFQDLLEALTATLKAVDAAIPRSDPVLQRYLALKQAAWETRVASGNVAVRVQASLVAGTAWSLPETVAAAAERTELLSAWRRTTEAAADVSETVRAAYDQAKAANFEGDTEAIARAVFDALSAHAPPRHTFAELRDRNTVNQRSLVALSDAALDAMVARAEVLAEEARGDVARSGAALLAVILLVALGLWTLFGGVLRPLRALTATMGALADGDASVTVPARTYRNEIGAMARAVQVFKENLIRGRELESEAAEARQAAEARRRSDLRAMAERFERTVGGIIAQVSGAATALQGTAQTMTATATETASQSSTVAAAAEEAATNVSTVAAAAEEFGSSVEEIGRQVEGSTRLAQGAVAEAGQTGAMVRDLSGAVARIGDVIGLIAAIAGQTNLLALNATIEAARAGEAGHGFAVVAGEVKALAAQTARATEEIAGQIAGIQGATGGAVAAIGAMTGRIQEISGVASAIAAAVEEQGSATREIIRNVGEAAVGTGAVTRTILGVAGAAEETGRAANAVLAAASALSRQSETLTDEVARFLDTVRAA

SEQ ID NO: 121 - protein, 242 aa, Methylobacterium sp.
MDPEGSEPAPETAPRPDAGPLRVLALAVQKGGTGKTTLAASLAVAAAEAGEQVTALDLDPQSSLAGWGALRKNDGRSDRARDAVAVDRVQPWEMGQLSEILGILAEQGTTLAVLDTAGSASGLAPALKDADFVLMPVRPSRLDIVAARPTLQALVGLGLRERLALVLNQCPPPPSPRTSAYAAQLRALGVLAEPGIIHRVDHQDALATGLGVTEFAPGSQAAEEVRALWAWVDGKMRAAPAR

SEQ ID NO: 122 - protein, 392 aa, Methylobacterium sp.
MPPLPHRRSILAGAAALGLAGAARAAGPAGFGPLGRPSWSPDSLQAAAAAKGLTYGCEVPFHRFDATPAYRQAVARECGILVCGTEMKMEEVLPAPGKTDFARGDAILRFARANGQRMRGHTLVWHAALPPWVGPLLGRASAVQAEDFMRRWIETVAGHYRGQIVAWDVVNEILGNEADPDRGGGLRDSPWLASIGPGYVDLAFRILHETDPAAAGTWNEDAVEQGVPWMEAKRTKVLRRLEAMRSRGVPIRRFGLQSHLTSTIPIDQGQLRRFLREIGQMGLGIEITELDIDDRAFPSDVATRDRMVADYPRRYLDVVLDEPACLDVLTWDIYDPDTWLNDHPYRKRPDGLPQRALPLDAQFRRKPLWHAMKAAFEAAPDHRAAREKLRRA

SEQ ID NO: 123 - protein, 373 aa, Methylobacterium sp.
MRSILLAGLALGAMAAAAQAAEVKLGVAAPITGNSAAIGAQLKNGASQAVEDLNKAGTLKGTTLTVTVGDDASDPKQGVSVANKFASDGVKMVVGDYNSGVSIPASDVYLDAGIIQVTPASTNVKFTERGMWNTFRTCGRDDQQGAVAGNYLADHFKGKKVAFVHDKTPYGKGLADETLKAFKAKGGKEVMSEGINPGEKDYSALVSKLKSANVDVVYFGGYYTEAGLILRQMRDQGLKAPMMGGDGMVDRELVAIAGPAAEGTLTTFPPDARKNPNAKAALAAFKAKNIDPEGYTLYSYAAVQVLAKAMAETGSSDGKKLAEWLHQGKPVDTVVGPIAYDKKGDITRPDYVMYEWKKGPDGKIDYSGNELTK

SEQ ID NO: 124 - protein, 437 aa, Methylobacterium sp.
LPGFGDAAGTPGYSVAAMADHVAEAIRARAPARYAIAGHSMGAKVALALARRAEDGEAGLAGLTDLVLVSGSPPSPEPIPEDRRADMLAWIDADPETRRREAEAFVRANVGDGLDPETEARAVADVLRAEPAAWKAWLEEGANEDWCRRAGVLRTPALILAGSEDANLGPDAQRALTAPHLAHHRLVTVDGVGHLLPLERPAALADHLRAHLGDRPRPPVEAGPAVPPDYAALIASERVNSRLREALAERAAPDDPAYRPAALDPVELAILRAALARVVPVPHLDLAASLDRRLASGDGDGWRFSALPPDAEAYRAALRTLDAAARIARDRPFVTLDAAEQDGLLTLCARAALTVPESLGGRLDADRMRFWFEDLRADAVRLWLGQPAALARIGFSGIGAGGDRPGEIADGLPGFHAVGLDAPEPWEPRALRTEAGR

SEQ ID NO: 125 - protein, 292 aa, Methylobacterium sp.
MTQDPREAGPRPPFPGDQQQTRPGLTTKMTPRPDHGEESYVGKGLLTGQAALITGGDSGIGRAVAIAYAREGADVAISYLEVEQEDAEDTKAWVEKAGRRCLLLPGDIRDEAQCRDLVARTVAAYGRLDILVNNAAAQVVNEGLDDLAASDIEGSFRANVFAMYYLAQAAVPHMKPGGAIVNSTSVQAKVAGPNMLIYAATKGAIASLTIGLSNLLAPQGIRVNCVAPGPVWTPIQPIVKSPEQMEQLGAQTPLGRAGQPAELAPAYVLLASREGSYMSGALVPVTGGIPML

SEQ ID NO: 126 - protein, 276 aa, Methylobacterium sp.
MRLIAGLLLAALLLCGLACAALALGQRRFLYPGAFGPQSPWTIPPGLATITVATPDGETLHGLWRPPRPGCGVVVSFHGNGSRPEPHAARFAAEPWRARGWGVLTVAYRGYPGSTGSPSEDGLIRDGLAAVEAARARVPGAPILLHGHSLGAAVAVAVAEQVPAIGLYLEAPFDSMTHTVRLHVPLAPIWLLRDTYRSDLRIRDGTAPVLIVQGRDDTVVPAKLARNLAEAAGPRARIDVIPGDHVSILGSRDREAEALFGQGVGPACPQPVDQQG

SEQ ID NO: 127 - protein, 329 aa, Methylobacterium sp.
MPNLTLPEAEALAADALVRCGTAEAAARSVARALVGAEADGLKGHGLSRVAPYAAQVRAGKVVGDAVPLASRPRPGLLAIDAAHGFAYPAIDLALEALPGVARQQGVAAAGIRRSHHCGAAGRPVEALAEQGCVALLFANTPAAMAPWGGRQAVFGTNPLAFACPLPGRAPIVVDLALSKVARANIVGAAKRGEPIPEGWALDAEGRPTTDAEAALDGTMVPLGDAKGTALALMVELLAAGLVGARFAGEASSFLDAAGDPPGTGQLILALDAAALSPDAPERFAALAGAIEAQDGARLPGSRRLGLRRRAAEAGLDVAEALVAEIRAL

SEQ ID NO: 128 - protein, 141 aa, Methylobacterium sp.
MADLFWLSDEQWAVIEPFMPRDQPGPERKDDRQIISGILHVLTSGCRWRDCPAAYGPRTTVYNRFNRWSRRGFWKAMLTALAKAGWAGDAAALDSSYVRAHRSAHGGKGGQGRRPSAHRAVVKRPRSTHSPMSSAGPASSC

SEQ ID NO: 129 - protein, 144 aa, Methylobacterium sp.
MADLFWLSDEQWTVIEPFMPKDQPGPERKDDRQIISGILHVLTSGCRWRDCPATYGPRTTVYNRFNRFNRWSRRGFWKAMLAALATAGWAGDAAALDSSYVRAHRSAHGGKGGRRRRLSARRAAAKRPRSTRSPMSSVALASCY

SEQ ID NO: 130 - protein, 125 aa, Methylobacterium sp.
MSMLQGILYEEPSAWLFLLVTVVMGGWAGWMAARGIARGWRPFWQCALALLLVAAAVRFIHYALFSGTLLSLHYYAVDAVIVMIIGAAGFRYTRTRQMTSQYRWLYEKTSPLTWRARAPAAGEVR

SEQ ID NO: 131 - protein, 265 aa, Methylobacterium sp.
MSVAGINVLVEETRAIQAGQKPPLLAVRDVSTYYGSVAALRGVDLDVAEGEIVTLIGANGAGKSTLMMTIFGSPQARSGTITYDGRDITRLPTHAIARLGIAQSPEGRRVFPRMTVYENLQMGGALHDGRFFAEDLEKVCTLFPRVKERLNQRAGTMSGGEQQMLAIARALMSRPRLLLLDEPSLGLAPLVVKGIFDAIRELNRTDGMTIFLVEQNAYHALKLAHRGYVLVNGRVTMSGTGRALLDDPNVQAAYLEGGHSGPVGT

SEQ ID NO: 132 - protein, 287 aa, Methylobacterium sp.
VLTVEHLTMRFGGLTAVSDLSFEARRGDITALIGPNGAGKTTVFNCITGFYKPTEGMLTLAHADGTAHLLERLPNHKVNRTARVARTFQNIRLFQGMTVLENLLVAQHAPLMRASGYTILGLLGLKTYRDAQAAAIERAKAWLARIDLMKRADDPAGALPYGAQRRLEIARAMCTDPVLLCLDEPAAGLNPRESAELNGLLRHIRDEHDTSVLLIEHDMSVVMEISDHVVVLDYGVKIADGSPADVRADPKVIAAYLGVEDEEVEAVEAEVGITVPHGDAAHTGASA

SEQ ID NO: 133 - protein, 464 aa, Methylobacterium sp.
MAASQNALPGSAMAGILRDAALYALVTFGLCVPIIAYRTDPGPGSELVLVPRWGLVAALCAAIFVLRLVQRLVLLRRDARRALTPSPAQATEAVHGEPDAGQKTSKVGLWLFIFVALTLPMISALATGGLSSARYWIDLGILILTYVMLGWGLNIVVGLAGLLDLGYVAFYAVGAYSYALLSTTFGLSFWVCLPLAGLFAGLWGMILGFPVLRLRGDYLAIVTLAFGEIIRLVLINWTDVTGGGAGISSIPRATFFGIPFTAGEGGFAATFGIPYDSMHRLIFLYYLILGLALITNFVTLRLRRLPIGRAWEALREDEIACRSLGIDTTATKLTAFALGAAFGGFAGSFFAVRQGFISPESFNFLESAIILAIVVLGGMGSQVGVAIAAVAMVGGPEMLRNLGFLKAVFGEGFDPSEYRLLLFGLAMVAMMVWRPRGLISERMPSVSLGQRRAVSGAHVSEGHG

SEQ ID NO: 134 - protein, 305 aa, Methylobacterium sp.
MDVFVQQLINGLTLGSIYGLIAIGYTMVFGIIGMVNFAHGDVFMVSCFIALITFLLLTVWLGVSSIALAFLVVLVVAMVLTALWGWAIERVAYRPLRGSFRLAPLISAIGVSIFLSNFVQVVQGARNKPTPPMLSGGITLFERDGYAVFLAWKQVLIMAVTAVLLTGFWYLVQRTPFGRAQRACEQDRKMAALLGIDVDRTISLTFVLGAALAAVAGVLYLMYYGVVSFSDGFVPGVKAFTAAVLGGIGSLPGAVLGGLIIGLIETFWSAYFSIEYKDVAAFSILAIVLIFMPSGILGRPEVEKV

SEQ ID NO: 135 - protein, 185 aa, Methylobacterium sp.
MSGGHGAVEGSNKRVALLISVLALFLAFSETLGKASQTDSIGANVEAANQWAYFQARTIRATVLKTADEALALVPPGPNQEAIAAKRAEWSKTLARWDSEPSTGEGRKELSEKARASEGRRDLALLRYHHYELASAAFQIGIVLASAEVITGISLLVFAGGFLGLAGAALLGFGYLAPHALPFFH

SEQ ID NO: 136 - protein, 351 aa, Methylobacterium sp.
MLNGRARSMGLGSLNTLTLAEAREKATECRKLCLDGIDPIEAREKARAAARLDAANTITFDACAEAYIEAHKAGWRNAKHADQWSNTLANYASPVFGALPVQAVDTGLVMRVIEPIWGDKTETATRVRGRIESVLDWAATRGYRQGENPARWRGHLQNLLPKRSKIKRVEHHAALPFREIGEFVGRLQTQSGTSPLALEFTILTAARTGEVIGATWDEIDLAERTWTVPAERMKSGREHRVPLCDRAVDILEGFKVLGDRHVFPGGKRGRPLSNMAMLELLKRMDRPDLTVHGFRSTFRDWAAETTHFPNEMVEMALAHIIENRVEAAYRRGDLFQKRRELMNAWAVYCGR

SEQ ID NO: 137 - protein, 413 aa, Methylobacterium sp.
MTDSTEPALPSSAAVAPPPATSIPRLIVVLACAGFGSTFALRSVEPLVGVLARDLASDAHTVALLSTAFALPYAFIQPVLGPIGDALGKERVMSTCLAVLAVALTLCSVAPDIGSLFGLRMLAGAAAGGCIPLSLALLGDRVPMESRQVAIGRFLVAVILGQLSGSTFAGLIEAAIGWRGVFAVTAAVAALACAATVLGFDRAGRAPARRPAFGEAVTRYRTILGNPRARVLFAAVFIEAIAIFGVFPHLAPLIEARGEGGPREAGLVLAGFAVGGLLYSALVGLLVRLLGLPRMLIGGGLVCGASLTVVGLAGSWQVDCAALTAMGLGFYMLHNTYQTQVTEVAPKARASAVALHAFSFFCGQALGVAVIGQALLRFGQLGALLGCAVTILALGIATAIALRQKPGPVPFTG

SEQ ID NO: 138 - protein, 419 aa, Methylobacterium sp.
MHVLILGGGVVGVTSAYYLARAGHQVTVLERQPGSGLETSFANAGQVSPGYSAPWAAPGIPVKALKWLMMRHRPLVLWPRLEPRLYAWLTRMLANCTEEAYQRNKGRMVRLAEYSRDALRDLRTETGIAYDHREKGTLQLFRTRKQLDHVGDDTRVLDAYGVPYTVLDPAGCVSAEPALAAVRDVFVGGLRLPGDETGDAHLFTQRLAAICEGLGVTFRYRTAIARLHHAGDRVTAVETADGDLLRADAYVAALGSYTPALLRPLGIALPVYPVKGYSLTLPITDAAAAPVSTVMDETYKVAITRLGDRIRVGGTAELAGFSSALRLPRRETLARSVQDLFPAGGDLDRAAFWTGLRPMTPDGTPIVGGTRVGNLFTNTGHGTLGWTMACGSGRLLADLVSGRAPEIASDDLALDRYAA

SEQ ID NO: 139 - protein, 304 aa, Methylobacterium sp.
MDLDWVRDFLALAEHRTFSRAAEVRHVTQPAFSRRIRALEAWLGTPLFLRSAQGAHLTAAGTGFRSHAEELIRGLDRACREARAAGARADASLAIAATHALSFTFFPGWIRRHAPFETLGALNLISDSMAACEAILLAGEVQLLLCHHRADLPTPLDDGRCESVRVGADSLVPLCAPTSEGGPLWPLSGAVRYLAYGEASGLGRILAASGAAAGHEPAFTSHLAATLMTMAQGGDGVAWLPVTLAEAAIARGQLVRAGPEELDVPVEIRLFRMRESRGGAADALWRRLHAPEGARPDQAFAARA

SEQ ID NO: 140 - protein, 283 aa, Methylobacterium sp.
MELKWLEDFLSLARTGSFSRSAVERHVTQPAFGRRIRALEGWLGVALVDRSTYPTALTPEGRLFLETAEETVRRLHGSRDALRARIRPPPRTVSVAALHTLALTVFPGWFRDIEARTGPLGSRLLPDDFHACVQALAEGGYDLLLTYHHPLVPIPLDPAAFPHLTIGRDSLVPVHRPGPAADRPGLGYPRDSFLGRVAALAGDGAAAAHVNENAMAEALKFMVLAGHGRAWLPESLVARELADGSLVTAGPGTPLEIRLYRRAGRGGAVAAVWAAAAALAAGP

SEQ ID NO: 141 - protein, 428 aa, Methylobacterium sp.
MDRVSAISAAVRAQRGPVEVLFAELARCGRTEPGFTRPSYSPEETAAHAAVARCASDLGLAIARDAAANTAMTLPGRDRTLPPILIGSHLDTVAQGGNFDGAAGVVAGLAAVAAIRQLGLEPERDISVLGIRAEESVWFQVSYIGSRAALGALPDGALDAARIDTGLSLADHIAREGGDPDALARGPAAFDAAAIHAFLEVHIEQAPSLEEAGIPVGLCTGIPGNVRYPDVRIAGRYDHVGTPRRFRRDAAMAGAEIALALDRVWAEREATGCPMAVTFGRFHTDAAAHGLTTVPGEFRFSLDMRAYAAAVLAELEAAFLAAVAEVSDRRGVTVTLGPRAEAGVGAVAPRIRDGFAAAADALGIATRPLGSPASHDAAAFAKAGVPMAMLLVRNANGSHNPREAMAIGDLLDAVAILTAWLVAETCGG

SEQ ID NO: 142 - protein, 418 aa, Methylobacterium sp.
MTRLAIDPDLCAGLFAELLSFSQDAPGVTRAAYGVGEERAHALMRATGLALGLAAETDAAGNLFLTLAGRDPALAPWMVGSHVDTVPHGGNFDGAAGVIGGLAAVEALRRAGIVPARPVTVAVFRAEESVWFPASYVGSRAALGLLPPEVLDLPRADTGRSLRDHMAELGLRPGAVARGERLLDPARIHGFVEMHIEQGPALEAAGFPVGFVTAISGSFRYRKAACFGRYGHSGAVARGERSDAVFALADLITGLDALWGRLEAEGCPATITLGEVATDPVQHAFAKIPGEVRFCLDVRSTESDVLDRVEAALAAHIAAIEAARSVRFVLGERTGSTPARMSAALVQALSGHARRLGTPFRTMASGAGHDTATLAGQGVPSTMIFIRNQNGSHNPDEAMRIADLCAAATLVAHLVAEA

SEQ ID NO: 143 - protein, 534 aa, Methylobacterium sp.
MSEPVVRIRDLTIALPKGADRPHAVEGLNLDLEAGKILCVVGESGSGKSMSAYALTGLLPRALKPTAGTILFEGRDLLTLDEPAWRHLRGRRIAMVFQEPMTALNPVMRVGDQIAEMFEAHNLLTRSERWARAVALATEVGLPNPEEAVRAYPHQLSGGQRQRAMIAMALALEPSVLVADEPTTALDVTTQAQILRLIRDLQRKRGMSVLFITHDFGVVAEIADHVAVLQRGRLVESGTAEAVLRAPQAPYTKALLAAVPSLTPPPRPPLEAAPVALSVNRLSKTYSGRSGLFGKPRVVAAVKEVSFDVRRGETLGIVGESGSGKSTTARLAIRLIEPDGGTVRLGELDYTALKSRELRDKRSRIQMIFQDPFASLNPRRTVEQIITAGPIAHGVPAAEARERARSLLDLVGLDPRAAARYPNAFSGGQRQRIGIARALAMEPDVLVADEAVSALDVSVQRQVLDLLEDLKQRLSLAMLFITHDLRVAATICDRIAVMHRGAIVEMRGTADLFAAPEHAYTRTLLAAVPGARAS

SEQ ID NO: 144 - protein, 300 aa, Methylobacterium sp.
MIVWTRRAVGLGLLAAPLAAPLSASLALPARAAEAEPDWAAIERQLGGRLGIAAASADRVLAAYRADARFPMCSTFKVPAVAAVLARVDAGRETLDRIVSYGAGDLLSYAPVTRKALEAGAGTGRMSVADLCAATLIWSDNTAANLLLADLGGPDAMTAWLRTTGDPVTRLDRTEPTLNTALPGDPRDTTTPDAMRATLGRVLLGTILSPASRARLEAWMVACETGRKRLRAGLPPDWIAGDKTGSGDNGTVNDVAILRPPGRAPILAAVYVTDSTASPDTCAAAYAEIGRLIASRAHAT

SEQ ID NO: 145 - protein, 303 aa, Methylobacterium sp.
MRRGTLDDLAAFAAVARHRSFTRAAAEMGLSPSALSHTMRALEARHGVRLLARTTRSVALTPAGERLLRSVGPALEDVARGLDALADWRGAPSGRLRLTTFAYAARAILEPRLPAFLIDHPAVSVEVIVDDRLTDVVAAGFDAGIRFGETVERDMVAVRVGPDLRTVVVAIPDYFARHPRPESPADLEAHRCVNYRLVGGGGLLPWEFARDGRDIRVRAAGQLVVNDGRLAAAAIRAGAGLGYMLEDEAADDLAAGRLVQVLDAWCPPFPGCHLYYPDRQVTPALRSLIDALRWREAPSPSRP

SEQ ID NO: 146 - protein, 238 aa, Methylobacterium sp.
VSAVQVWIVDLALSPSQVDRCDAVLDAAERARADRFLRPADRARFRASHAALRLVLGDALGLAPADVELAAGAGGKPELAGTGRGAADFNLSHSGARALIGLTRGAAIGVDVEAVRPIADALRIAAAHFAADEVSALAGAPRSAVEKCFFGLWTRKEAVVKALGSGLSLPLDRFSVSVPPEAPRLLRADGDASWNLDGPWSLAEIDCGRDHVATVAVRSAEAEITCHRPPDDWPDHLG

SEQ ID NO: 147 - protein, 255 aa, Methylobacterium sp.
MTPRHRAPTRDRRALRAALLACSTLAAMPARAEPVRAVVELFTSQGCGACRSADPVLRDLAHKPGVIALTLPVTYWDYLGWKDTLALRPLTERQRAYARGRGARQVFTPQVVVDGNGFAVGSDRPALERLIRDACQHGGLPVPVRGETNGDRILVEVGAAPEAKTEIRGDVWLVPVLRSRAIAIQSGENGGRTATYVNVVRGMQRLGPWTGQPTRFEVPDTQARVADADSWVVLLQGAADGKPGRIFGAAKGPGL

SEQ ID NO: 148 - protein, 81 aa, Methylobacterium sp.
MDQEQRMTDLLEKAVAKARDLAPEMQDEIARLMLAFVGDEAPVYRFNPEEEAEQDAADAEEARGEYATEAEVRAIWAKYGL

SEQ ID NO: 149 - protein, 416 aa, Methylobacterium sp.
VVAKVLTMQSVERHKPQPAGRLEIPDAALPGFYLVVQPSGAKSWAVRYRFGGKTRKFTIGPYPLFDLAAARAAAREALQMAARGRDPILEKKAAVEAAQAAERDTVRAVAAEYVERHLKPNSKPRYAAEAEALLRNHVVARWGDRRMCEITRKDAIALTDALTDAGMGVGANRVFSAARALFNWALEREVIETTPFLRLKPPLAEASRERVLSDAEVRLVWLAAEKVGYPFGTLVQLLLLTAQRRDEVARMTWAEVDADGLWTLPAARTKNSREHLVPLPFSACEILATAPRIAGRAGFVLTTDGATASSNFAKNKAKLDAAMLEIAHQEAAEAGRDPDRVELISWRLHDLRRTASTGMARLRQPVHVTEAVLNHATGAVSGVAGIYNRYQYLDEKRAALEAWAAHVEAIVGKEAR

SEQ ID NO: 150 - protein, 414 aa, Methylobacterium sp.
VTRERACETQLPAQMLTDAQVRSLKADGASRLMIYDAKAQGLCLRVSATSKSWSFIYRPKGGAKQRRYTIGDYPSWSLAQAREKTFALRRTVQEGGDPVAAAQERVAALTVAGFIERYIERYAKKKLRSWRDYEGLLKRDVVPALGQRRAEELTRAEVANLLDKIAARAPVVSNRVLNTLSAVYSWGVSEGLVPSNPVTGLKRRHLEAPKERYLSDEEIVAFWNVTESAAPAYRDTFRLILLTGQRPGECAGIRAEEVDLAAEIWTLPPSRTKNGRQHKVPLVGRALEIVRRLRADRSAGALIVSPRGKLITPQNLAKAFENLRDGVFESNVTPHDLRRTAATLLGKLSVGRLTQGYVLNHVSTTKSSVTGSVYDQYDYVPEKRVALEVLDAKILSIINGHTMPTNVVLMARGS

SEQ ID NO: 151 - protein, 227 aa, Methylobacterium sp.
MPLEQLELAIALGEAVLAGRADLALLNRRSLAWRGKIALAPVPTALRDGDLTLRRWRPEDAAPFAALNADPAVMAHFPRTRTATESEAEAGLLDRRFVADGFGPWALEHAGRFVGFAGAMRILRPLPFPGGDRPGSTVELAWRLARDSWGRGLATRAARLARADLAGRCGIRSVVAFTAAGNGRSRAVMERLGMRVAGTFPHPAVPEGPLRDHVLYRLDCADREEAA

SEQ ID NO: 152 - protein, 40 aa, Methylobacterium sp.
LVGRRLPDAARPGWPVRLDHCFARILLDQACGGSWRDHVR

SEQ ID NO: 153 - protein, 523 aa, Methylobacterium sp.
MLRLLTFLYLLLCAPALAQASDPYAQLAGDGYAEIEAGVSGLAASGDPRADAILSALSDGRLLVSPDRTLLIRQGNAVVDARTGAPAADSPDLKPVRANNRVRRAIEAARGQLDLASPDPARRRAAADAVFKARDAAALPALDVALARETNPGVRQALTEARAAVLLARPGTAEPDRIAAIPAIQARGDGDAMGILRGLAADPSEAVRAAAARGIAAIETRLAILGALQNVWYGISLGSVLLLAAIGLAITFGVMGVINMAHGEMVMLGAYTTYLVQELIRTKAPFLFGWSLAISIPCAFLVAGLVGVLIERFIIRFLYGRPLETLLATFGVSLALQQGVRSIFGPTNREVGAPAFMSGAFDFYGLSVTWGRMWIIVFAFAVFLGLLFVLRKTSFGLKTRAVTQNRRMAAAMGIRTPYVDALTFGLGSGIAGIAGVALSQIDNVSPNLGQGYIIDSFLVVVFGGVGNLWGTLVAALTLGVVNKLAEPYIGAVLAKIGLLIFIILFIQKRPRGLFALKGRAVES

SEQ ID NO: 154 - protein, 384 aa, Methylobacterium sp.
MPSRTPLIDLKGWIFLAVLAAFCLAVPVLNLAVPEGSGLHLPTYLVSLLGKYLAYALLAVSLDLVWGYCGILSLGHGAFFALGGYAMGMYLMRQIGSRGVYGNPVLPDFMVFLNYKALPWYWYGFDHFAFAALMVLLVPGLLAFVFGWLAFRSRVTGVYLSIITQALTYALMLAFFRNDMGLGGNNGLTDFKDLLGFSVQSQNFRVGIFVATGIALALGYLIARVLTVSAYGKILIAVRDAESRTRFLGYRPEHFKTLAFTVSAMMAGVAGALYVPQVGIINPGEFAPTNSIETVIWVAVGGRGTLVGAALGAVLVNYAKTVLTGAMPDAWLFALGGLFVFVTLFLPRGLVGTAIERFGGRRAAAKLPPEPEIAPKRVEQGQGA

SEQ ID NO: 155 - protein, 431 aa, Methylobacterium sp.
MKAFGTWASAAALAAGLAMGTLGAGAARAQETIKVGILHSLSGTMAISETTLKDAMLMLIAEQNAKGGVLGKKLEPVVVDPASNWPLFAEKARELISKDKVAAVFGCWTSVSRKSVLPVFKELDNILFYPVQYEGEESERNVFYTGAAPNQQAIPAVDYLMSEDGGGAKRWVLEGTDYVYPRTTNKILEAYLKSKGVKDEDIMINYTPFGFSDWQTEVSKIKAFGSAGKKTAVVSTINGDANVPFYKELGNQGIKATDIPVVAFSVGEEELAGIDAKPLVGHLAAWNYFESIKTPENEAFIKKWQAFKKNPKAVTNDPMEAHYIGFNMWVKAVEKAGTTDPDKVIDALPGIEQKNLTGGTAKMLPNHHITKPVFIGEIESNGQFDVVWKTEGLIPGEAWSKQLEGSKDLEADWVKLKCGNYNTKTKSCGGA

SEQ ID NO: 156 - protein, 586 aa, Methylobacterium sp.
MPPRFRFPVPLPRSLPRSLPLSLTTRILLLVLLALAPALAIQGYNEVALRASRDAAVRADARATARDVAEDFAQISERMQQALDLISEDATVQVREPAACTAYLRRAAARLPHVLLIALTDPDGAVICDSAGAPAGSYSSRGRAYHRRALERGGYAVGGYAVGFQTKRPSIHFARAVHVGESAGAPAGVLLAAVDLDWLSDHLEQALHQPETAITVTDRDGLIIARRPDEAAWIGRPIPPDRAAMLEAQGSDVRVAAGLDGRKRIIATAMPDGPLAGVRVVVGRDHATAFADIDAATRRGLVLIALGAALALAAALLAGRVFIRRPVDRLLRTAAAWQAGDLAARTGLRGAAEFDRLGSKLDAMAGTLQRSTAELRAEIQRGRALQAQQGTMLHELNHRVKNTLATVQALARQSRGSAEVLEARILALSKTHDLLTREDWSGAPLREVLESELGPYRTGGDQIRLDGPDVSLSPREVLALGMTVHELTTNAAKYGALSVREGRVRVAWSLAAGAAGERRLRLSWEERGGPPVRAPTRVGFGTRLIAGGVRRELAGTVDLAFEAEGLRCCLDVPLDPGLGTMLAPTG

SEQ ID NO: 157 - protein, 244 aa, Methylobacterium sp.
MVHARSLLFAVYWAAWTTLFLAPLAIFLLSGSPQRPIRRATRLWARGILGGLRRIVGLRYVEEGRQHLPDEPCLIVANHQSTWETLAFLVLVPDVAIVAKQELLAIPVVGWFLRRSPMIVIDRAKGTQALRTMIDGGREAVAAGRSVLIFPEGTRGAIGEPLRFKRGVELLYGRLGLPVVPVALNSGLFWPGGAATRSGTVVVSYLAALAPGLPTAEFLHGTEGAIDRELNRWRPGGAAGLGAP

SEQ ID NO: 158 - protein, 328 aa, Methylobacterium sp.
VTLLVVLIVLALVFDFLNGLHDAANSIATIVSTRVLAPRYAVFWAAFFNFVAFLVFGLHVAGTVGSGIIDVATVDDRVIMGALGGAITWNLITWYAGIPSSSSHALIGGLLGAGIAKAGVGVIVWPGVIATSAAIVLSPALGFALGLLLMLAVSWIFVRSTPHAVDRVFRGLQFVSASLYSLGHGGNDAQKTMGIIAALLYAHGESGAFHVPLWVVLSCQTAMALGTLMGGWRIVHTMGSKITRLSPMQGFCAETGGAATLFAATAFGIPVSTTHTITGAIVGVGAARRVSAVRWNVAQGIVIAWVITMPAAALVAALTYAASGLVLP

SEQ ID NO: 159 - protein, 530 aa, Methylobacterium sp.
MTLSRRQILAGTAGAAAGLGLPHLVRAQPGGGSVLRFIPSTPLPSLDPIVATSYVIRNHGYLVYDTLFATDENFRIQPQMVKEWQTAPDGLRWTFHLRDGLTFHDGSPVEAKDCIASIARWSKRDAFGQTLAGFVEGYGQEDARTFTVALKKPFPLLPAALGKLSSNVPFIMPERVALQDASKPIADATGSGPWRFEAREWIPGQNAIYTRHAGYRPREEAPSWAAGGKVAKVDRIEWLAITEASAAVGAMIQGAVDWYEQPAIDLIPVLKGKPGIEIRNVPLGLILLMRFNHTQPPFNNPEIRRAVMMAMKQDDYMQAVVGSPEYYREAKTFFTPGSPMSTGAGGAAAMQADLAKAKAMLAKAGYKGERVVLLAPADQPIAYNQSLVTQDLLKQLGMNVDLVSTDWGSFIARRGNRGPVDAGGWSLFHTLWSGADVLNPALHPLIRANGQAAWFGWPDDPTLETLRSEWIATSDEAQQKALAARIEERAFEVVPYAPAGLVQQPMAVSAKLKGMVMAPVQFFWNIEKTG

SEQ ID NO: 160 - protein, 531 aa, Methylobacterium sp.
MLRRTFLGGAAAAAAAPFLPARPALAQGGRASVLRFVPQSDLTIVDPVTTTAYVTRNHALMVFDQLYGLDAQLTPQPQMVEGHAVEEDGRRWTFRLREGLRFHDGEPVRGRDCVASIRRWAQRDSLGQALMARADALEAPDDRTFVIRLKRPYGLMLETLAKLGPPVLVIMPERLAATDPAQQIPELIGSGPFRFNTEERLVGARVVYDRNPDYRPREDGPVSWVAGPKRVHFERVEWQVMPDPGTAAAALQNGEVDWWENPISDLVPTLQAHPQIATQLASPLGNLGTGVMNHLHPPFDKPAVRRVVLEALSQADFMAAAAGDDPKLWRKDVGLFTPGTAMATDAGLDVLTRPRDLAKAKRDLVAAGYKGERVVLMSTSENPVLGALGEIMHDLLQRLGMNVQYVVSDWGTLVTRRASKAPPDQGGWNIFTTTWTGLDMANPVVEQVLRCGGPKGFFGWPDLPELESLREAWIEAPDQAARQAIAARMQTLAMRDVPYLPTGQYFYRTAFRRDLRDVVDGQFVFWNARRA

SEQ ID NO: 161 - protein, 516 aa, Methylobacterium sp.
MALSGAALATPALAQGSAARTLKFIPQADLTVLDPIWTTAYVTRNHGLAVFDTLYGTDAAYAAQPQMVAGHTVEDDGKLWRLTLRPGLTFHDGSPVLARDCVASVARWGKRDAMGQTLMAYTDELSAPDDRTIQFRLKKPFALLPDALGKVGSSICAIMPERLAKTDPFTQVTEMVGSGPFRFKADERVVGARVVYERFAGYVPREGGEPQWTSGPKRVHVDRVEWNVIPDQATAASAMQTGEMDWWEQPPADLVPTLRGLTTRITDPTGLIGCLRMNQLQPPFDNPAIRQVLLKVVDQTDFMQAVTGTDPKLIHVPTGFFCPGLPMASDVGLDALTSKRDYAGAKAALAAAGYKGEKVVLMGASDFPSLKALADVAADMLTRAGFNVDYQVMDWGSVVQRRAKKEPVAQGGWSAFCTFWAGLDQANPAVSAFLRGTGQSAAIGWPTSARIEALRDQWLDAPDTAARKRLAGELQQQAFVDLPYLPLGQYFNQTSYKPSLTGVLDGVPVFWNVKKG

SEQ ID NO: 162 - protein, 300 aa, Methylobacterium sp.
MHQDVPFPRSTSSTGPRQQATLARPFERSGRSLHSGRHATVRVSPAPAGHGIVFRRHLKDGRAVDVPAHWHYRESQPLSSALRRDGVLVRTIEHLMASLSALRIDNVLAEIDADELPIFDGSATPWCEAIRIAGRREQSLPCRVIRLLRTVAVENGRRRLEIEPGPGLHVTGHVALAHFGSIDWSGAITPDSFEREIAPARSFGRYARAMAGRAYGYLMRNDFLQGVSPRSAALLVRGHVLGGMRVPGEPVRHRILDLVGDLALAGHPVEGRISAFHTGHELNHALVTALMRDGKAWELV

SEQ ID NO: 163 - protein, 382 aa, Methylobacterium sp.
VVLIDLPFVIADKDRHGNVRYYFRRRPEKKVRLRGKPGSAEFQTAYEAARDRAPMAPPAKGGRPAVGSFIDVSQRYIASTTFKKLDASTQGWQKRALNEIAASDKGAAPLAMMQPRHVRRLRDEKAETPAAANTMLKALRAMFQWAMEEDIVDSDPTRDVKRAQYVTKGHHTWTLDEVDLFERRHPLGSKPRLAFAILLYTACRREDATRLGPQHIRDGRLRYVQAKNEHRKPITVDVPVFPDLAEAIAALPSSHLTFLVTDYGKPFSVAGFGNRFREWCDQAGLPHCSAHGLRKATAARLAERGCTPHEIMAVTGHQTLEEVERYTREAQRAGLADSAWERFAAGRRGPTSGAGSGPTSSNPLTKLDKNAPVALPRGPRRA

SEQ ID NO: 164 - protein, 414 aa, Methylobacterium sp.
VSADRATANRFLLGLALMLVAFNLRPALSTVGPLLATIRDGTGLGAGGAAILTTLPVLCLGIACALAAPLIRRIGPDLAVLAGSTILVAGLTLRGLGGLVPLFAGTALAAIGIGIDNVLLPALVKRDFAGNGGLMTGLYTMTLCLGAAAGAGASVPVEHALGGGWPSALAIWSLPALVAAFVWIPFARRTAATAAPSAGRLLRNPLAWWVTGFMGLQSSLAYILFGWLPLLLQGRGLTPLNAGLYASLATLVQAPGALLVAMLAARARDQRAWIVVIPGLTAAAFVVLAFGADSLRIPAACALGFGIGGCFGLGLTLIVLRAADAASAAGLSAMAQGIGYTCAALGPLVFGLAHEATGGWAVPGALFVGITVAAILIGLAAGRDRKVSAAGPEPRDPAAQPLTELQPANPASGS

SEQ ID NO: 165 - protein, 406 aa, Methylobacterium sp.
VLAGALAAGAGIRPVQGSPAPVALRRGIALWPWFSLTTEYPPPRTDYAWPPFQAGRPVPTRDDLARIAGFGFDFVRLPLDPGPFVAFTGPRRAELLGTLSEAVDAALAAGLRVLVNVQANAATHHYTPDAFYGSDRAPLFASYRDLVGDLARLCARKGTDRVALEPVNEPPQACGAGAWNRVQDGLLAAARAAAPALTLVATGSCGSLVAGLTALDPAALARFAPLLYTFHFYEPYLFSHQGATWLTEEPFYRWLTAVPWPGSRGTLRETLAAVRARMDADRTVPQAEKARDRAVIEAKLHEYFEAVPGPAYIADAMAPVATWADLYGIPRGQVLMGEFGALRTDARFTASRAPDRAAYIRNVRLAAEANGFAWSFWNLFDGLGLMDDAHVADPALIAALGLRARP

SEQ ID NO: 166 - protein, 86 aa, Methylobacterium sp.
VNIPAERRVNQLTDAEVLSIRETIDRDYLVEGDLRREVSMNIKRLMDLGAYRGLRHRKQLPVRGQRTHTNARTRKGKAKPIAGKKK

SEQ ID NO: 167 - protein, 339 aa, Methylobacterium sp.
MTARSIIRLVGTVAVLWGALGAARAEVSTVRLAKQFGISYLPLTVMEEEGLLEKQAKQRGLDVKAEWLRFTGGSGMNEALLSGNLDLASGGVGPFLTIWGRTQGNLKVKGVAALNAMPLWLVTINPAVKAITDFGPQDKIALPTAKTSIQAITLQMAAEKAFGPGQQAKLDPLTVSMGHPDAQTAMMGGRSEITAHFGSPPFQEMELKDPRARKVLDSYDVMGGPHTFNLVWATSRFVTENPKVTAAFRAALEESLALIRDDPARAAALWIKAEGAKISPAEAVAIIRAPQNAWTTKPERMLAYLAYMNRAGLVSAKADSESELFFPDPNAGAPKEANR

SEQ ID NO: 168 - protein, 642 aa, Methylobacterium sp.
MSGPAPRPGAGLRRRLGERLGQRLGKRLGKRLGDRLGERVGALRYLPTLFREIAAASPRLLAASLSLRLVAACLPVLTLYLAKLILDGIVAEHARPAPEAGLAAWLADPGRARLAGLVAAEFGLALLSDLTGRLSSLVETLIGDLYANAASLRLMAHAAELDLAQFEDSAQQDRLERARRQVSGRTGLIGTVFGQLQGLLTLATLAVGVAAFTPWLVVLIAAALVPAVLNEWHFTKAGYRLAWIRSPERRRIDYLRYLGASVETAKEIKLFGLAGYVTGLYAAVAGRLLAENRGLAVARAGWGFAFASLGTLAYYAAYAVIVWRTVAGAFSVGDLAFLAGAFQRLRGGLEGLLLGLTQITGQAQYLEDFYAFFAIRPQIRSPARPLPVPSPIRAGLVFEGVGYRYPGTQVWALRDLSFAVRAGETVALVGGNGAGKTTIVKLMTRLYDPHEGRVLLDGVPLPAYDLDDLRARIGAIFQDFVRFDLTAGENVAVGRIAAADDADRIAAAAARGLAAPVIERLPAGYAQPLGKRFAGGLDLSGGEWQKVALSRAYMREAEILILDEPTAALDARAEHDVFARFRELSAGRTAVLISHRFSTVRMADRILVLEGGRVLEEGSHAALMARGGRYAELFALQAEGYR

SEQ ID NO: 169 - protein, 213 aa, Methylobacterium sp.
MLAWFRALMPREDRFFDLFERHARTLEDGAAALRGLLDGTQAVPAAYAAIAAHEDAADGITREALLAVRRTFITPFDRGDIQALVGSLDDAIDQMLKTAKAVQLFEVTTFEPAMREMGAVIQEAAQVTAEALPKLRALGENAAALNSLTERVIELEGRADDLHNDGLKALFKASGRDPMAFLVGSELYGHLEKVMDRFEDVANQISSIVVEHV

SEQ ID NO: 170 - protein, 373 aa, Methylobacterium sp.
MFSCRSGAALPLRGAVFALALASGFGAAPLVAREMPEAGTAAAAKKPNVVILATGGTIAGAGADAANSATYTAAKVPVDKLIAAVPQVNTIANVRGEQVFQIASESFTDAQLVQLGKRVSQLLKQDDVDGVVVTHGTDTLEETAFFLDLVVKSDKPIVVVGSMRPGTAISADGALNLLDAVTVAASKEAIGQGVTVTMNDYIQCGRDVNKRTNIVPSAFYSQWGPLGMVVEGKTYFFRSLTKRHNMSSEFDIDQIDSLPLVGIVYGSGNMIPGVYDAELQAGAKAIVNAGTGNGSVPGYLVDKLKEIRSKGAIVIRSSRVPDGFVLRNAEQPDDKYDWVVAHDLNPAKAKILAAVALTKTSDTKELQRIFWEY

SEQ ID NO: 171 - protein, 122 aa, Methylobacterium sp.
VQPFRAFRVLLSLAGQEVRAVEPMKPMEPMKPMEPMKPMKGAEPWWPKDLGEPATSGAQNGMKYAFFPDKRRLLVDRDGQVSTYDSGDHRIGGVAQADGAAQTLTFTGQDGEVDLGSLKKLD

SEQ ID NO: 172 - protein, 127 aa, Methylobacterium sp.
MHYACDHLHLRSRDAVAAASFYVETFGAREVKRVGADPVQRVVLDLGGLAVFIEQAPDEIAPATATPCLGIEHFGLRVADIEAAMADLTARGVRVRTGITERGPGLRIAFVEGPDGALIEILERKPA

SEQ ID NO: 173 - protein, 207 aa, Methylobacterium sp.
MQESMQEAMSGEEAGEPIEARLRRALGLRSIVLVGLMGAGKSTVGRRLASRLGLIFKDADIEIEAAAGLTIPDIFAIYGEPSFRDGEERVISRLLRAGPLVLATGGGAYLREATRARIAESAVSVWLKADLDVLMRRVRKRGNRPLLQTEDPEATMRDLMAVRHPVYAAADVMVISREVSHDRVVQDVLEALDAHLSGEGSIPVAAQ

SEQ ID NO: 174 - protein, 454 aa, Methylobacterium sp.
MMHTVASSARPTNRRVLALALPMTIANVTTPMLGFVGAAVIGRLGDAALLGAIALGAVIFDAIFWSFGALRMATAGLTAQAVGGRDDAEVDRILARALAAGALIGLVLVVLQGPLAQLAFAISGASAAVIAGLATYFHIRILSAPFVLASYGVLGSVLGRGRTDLGLLLQIAINLTNVALTLTLVLGFGLGLAGAALATLGAEALGLGLGLILLARLGSRPFRVPLRDLRDAAALRRTLSVNGDVILRTLALITGIVLFSALGARQGDVVLAANSVLWNLFLIGGFFLDGFATAAETLCGQAVGARDREAFDAAAALSLRWCLGFGLAVSLLSLAGGPAFIDAVTTNGPVREVARSYLVLAALAPLAAAAPFAYDGVYIGATWTRAMRNLMVCALAAYCAILALVESLGFGNTGLWLAFVSFLGARGIGQAIAFPRLARNTFRTPAAAALGTAA

SEQ ID NO: 175 - protein, 317 aa, Methylobacterium sp.
MLIKRRRGWEIPEHLATPEAVFLNRRALIGGAAGLAAGSLLGGRAALAAAGDQPLYPAPQNPAYTLDRPLTPERFSADYNNFYEFGTSKTVLPAANALKTQPWTLKIDGLVEKPFEIGVDDLIRKVGLEERLYRHRCVEAWSMAVPWTGFPLAKLVALAKPTSGAKYIRFETFMDKAMAPGQRAFFYPWPYTEGLTLAEAGNDLAFIVTGIYGKPLPNQFGAPIRVAVPWKYGFKSAKSLVKISFTADRPKTFWEGLQASEYGFWANVNPAVPHPRWSQATERVLGTDQRVPTLIYNGYGEQVAGLYKGLEGERLFV

SEQ ID NO: 176 - protein, 198 aa, Methylobacterium sp.
MTLMLQAAPAGSGSGPAPRGADAEMRDLLLGAIPALRAFAFSLTYDLDRSDDLVQDTLVRAWVNAASFRRGTNLTAWLFTILRNLFYSEQRKRKREVEDADGVHAGRLTALPEQEIRMEMAQFQSALNRLPPAQREALVLVGAQSFTYEEAAAICGVAVGTIKSRVSRARTRLIEVLGMTGTDDIGPDPQTRAALDGS

SEQ ID NO: 177 - protein, 63 aa, Methylobacterium sp.
VRDDDDRPRKAVAHEIGQPLDTLSLGDLDERVALLRAEIARLEAARAAKQAAQGAADAFFKRG

SEQ ID NO: 178 - protein, 370 aa, Methylobacterium sp.
MPMTADRDLFSPTKIGAIDVANRVAMAPLTRSRADMEGVHSQLAVAYYRQRASAGLIITEATNISRQGRGYAFTPGIYTEAQAEAWSRVTSAVHEAGGRIVCQLWHVGRMSHVSLQENGEAPVSASAIQAGELVFLESRTQAPPSMPRALRTDEIPDLIGDYRRAASLAKQAGFDGIEVHSANCYLLDQFIRDSTNRRTDRYGGSIENRTRLAVEVVSAVAEVWGADRVGLRLSPMTRAVGDTPLDSDPQATYGYLARKLGELGLAYLHCVEGQTRGPNGSSAFDYKALHAAFGGAYIANNGYDRQLAVEAIASGYADMIAFGRSFIGNPDLVERLRRNAHLAEADQATFYGGGAEGYTDYPNLDISGNA

SEQ ID NO: 179 - protein, 126 aa, Methylobacterium sp.
MAEAARRYQQAGGSDLVRRLMARPVRLEQQVRTRMPLRDPRRVDAFADAYEDEAADDAEARDEADAIARLETELQVMKAVLRAQRQEVESLRAQRQLLTESAPTDDVRATRERWAALVDSLLIRAR

SEQ ID NO: 180 - protein, 332 aa, Methylobacterium sp.
VARAFGAAPSSTAKLPFGPMIDRSAAALGIPLPWLDRAGRLSWLKLAVFACCVAPALYLAAAYRLDALGAKPITALIHATGEWAVRFLLFSLAISPLRRLADWPKVIVVRRMLGVTVMAYAVAHLTLYAVDQNLILTKVISEIALRLYLTIGFVALIGLIALGLTSTDAAIRNLGPNWNRLHRLTYTIAVAALVHYFLQSKIDVTDPVFSAGLFLLLMGWRVMRRFQWPERPWSLLLLAIVAGLATAGLEAAWYGLASGVPANLVLAANLDFSGPVRPAWWVLAVGLSLPLVALVRGPKARASGPAPGRRPAQAARREPIREPVREPLSPSA

SEQ ID NO: 181 - protein, 441 aa, Methylobacterium sp.
MASGSAGNPTLSALPPARVPAEGRADPGSDDEAVLRTMQAGGGLRLLGLRVVIVLVLLMAAQAYDGSLHALSHWFILGLYGLGTIWFGLRERGGGPAANAYSWAGTGLNAGLAVYVIIEHMLAGGGAGLGADAVSRLPAFLLLLQTGLSMRVAQTLLFCGLVTVCWSAAFLVGLIHPDLFPNADTFPTAQLTGLATFMAAGLLVVDGMVRLRAAVVRALRMEHERTQLARFVPDTVALDLAADDGDSGLGIHRRHACLMILDIRGFSRLSREHPPEAMVTALLGVRAAAQAAVAEQGGLVDKYIGDAVLVQFVVGHPDVQARAALACALSIRDRIAALNAARARETLFPLRVVVALHAGDLLVGVFDDGVRAEYTVLGPAMNALARIETQAKAAEIEIAASGDFLDLLGGVLPAGIRAVPVPDAALPEHLTLSAIAVAPGA

SEQ ID NO: 182 - protein, 118 aa, Methylobacterium sp.
MIGPSGAVRVMLATRPVDFRKGMDGLAALVRDAMGADPFSGTVYVFRSKRADRVKLLVWDGSGLVLATKRLEAGQFCWPKIEDGVVRLSAAQLAALVEGLDWKRVHAARAVGVPAVAG

SEQ ID NO: 183 - protein, 115 aa, Methylobacterium sp.
MIPLPANVRVWLATGHTDMRKGFSSLGLIVQETLKRDPHGGHLFVFRGRRGDLIKVIWHDGQGACLYTKRLDRGRFLWPSVADGAVTISTAQLGYLLSGIDWRMPQESWRPSALG

SEQ ID NO: 184 - protein, 115 aa, Methylobacterium sp.
MIPVPSGSRVWLATGHTDMRKGFDGLAALVQDHLHHDPFSGQAFVFRGRAGRLIKVLWWDGQGLCLFSKRLERGRFVWPGTAGAAAALSPAQLAMLLEGIDWRAPERTDRPRIAG

SEQ ID NO: 185 - protein, 105 aa, Methylobacterium sp.
MKAILAAAAVSLGILGVVGPVSAQPRPDYDDYGGRGYRDRGDYDYRDRGYRDRDDYRGRANYGFDEREYLRCNPDVRRAVANGQMESGAAHYRVFGRREGRRLSC

SEQ ID NO: 186 - protein, 772 aa, Methylobacterium sp.
MSETIDKTDTTSFHMAGQCPFGGDRIGGAHGNRPTLENWYPHRLRVEVLHQNGLAADPLGPDFDYAAEFAKIDFDALKRDIKQFLTSSVEWWPSDYGNYGPQMIRMAWHSAGTYRIADGRGGGGTGMQRFAPISSWWDNGNTDKSRRLLQPIKHKYGNALSWADLMVLTGNCALEIMGLPTYGFAAGRLDAWEADDATYWGPEVVEMGSVSSFDDMVNRDKRWRGKNGDADYDLENPLAASHQALIYVNPEGPYASGDPLASARDIRITFTRMAMNDEETVALIAGGHAFGKSHGMVPAKEIGPPPEMAPMEAMGLGWHNPKGTGSGKDTMTNGIEGSWTPDPTKWDNAYLENLFKFEWEQTKSPAGALQWTPKDPAAPKTPDAHVAGQMHPLMMMTSDIALKVDPDYRKVCEKFLNDFDAFTQAFSKAWYKLTHRDMGPKHRYLGPEAVIEDGLLWQDPLPERDYDLVGEAEIAALKQAISGTGLSVSDLAFTAFSAASTYRDSDKRGGANGGRLALAPQKDWAVNRRAAPVVEALRGVMATFNGGRSDGKKISLADLIVLGGCVAVEKAARDAGVETPVPFTPGRVDTTQALTDLEMFEWLKPVVDGFRNYVDDGFGQMTRSVSPEEMFLDKANLLTLTAPEWTVLTGGLRALNANHDGSNRGVLTDRVGALTTDFFRNLTDVDLVWEKADPDGMTFALKDRASGQTKFEATRSDLVFGSNAQLRSIADAYAGSDGQRRFVADFVKAWDKVMMLDRFDVKGHRRYGPMAA

SEQ ID NO: 187 - protein, 192 aa, Methylobacterium sp.
MAGQSGARVPRAALTLARAVGLSAALSAALSAALAALPAIAAGRAAAEEGLTARTRIELLTLNGFDPVSYFLEGGPHAGLARFELSWGGQVWRFSSGANRAAFRDDPPAYAPRLGGYDAAGILDGRLVDADPLVFAVIDERLYLFRDAGRRARFLAEPGLARQAEAAWPAVRRLQDVPPDGLPDVPAMDAPR

SEQ ID NO: 188 - protein, 308 aa, Methylobacterium sp.
MIDLNLDPSETRPDRMPSAKPGPSLNLKVVLFSVAGASALVGFGVAASTVMAGLAAPTPVKIVASRQAADWPELKDGLPAIKGSVQAAAAPAQPAKPETPALRMVSLPEAFAAITPAPTPPAPDAPRRAAPQPAKVAAAPVAPTQRIPVPTPVTPVAAAREVAPLAPVRTAALQTPRASETVRARELVEPAAPKPVAESTERAEKSERPEKKERAEKTERSGKPERTERAEKIERSEKPAPKAATRQTPAPMRTADKAKGAAATVAQAEPAEAEDTEVLGIKLPSLAPAGRKLKESVDALGDAVKNVF

SEQ ID NO: 189 - protein, 68 aa, Methylobacterium sp.
MDTPPNDLDARALGRAAPAKGLAREACPYAEGTEARALWLAGYDAALAEGETPVTGGLAKHPVDGSAR

SEQ ID NO: 190 - protein, 382 aa, Methylobacterium sp.
MLRRVLRRLTAAASLTVLTFAVPAFAEEPLRFEVDPAWPQRLPNDWIMGQAAGVAVDAQDNVWVIQRPRTLTDDEKAASLDPPRTRCCKPAPPVLVFDQAGRLVKSWGGPGEGYQWPQNEHGIHVDHKGFVWLAGNGDTDGQILKFTPDGKFVLQIGKQGPQTDSRDTSRLGKPAGMMVDPETNELYVADGYYNHRVIVFDAETGAFKRMWGAYGKPPTDDKLGPYDPAAAPSQQFANPVHCVQVARDGLVYVCDRTNDRIQVFRKDGTFVKEMFVEKNTRANGSVWELALWPDERQTYLLNADGANNEVRTLSRDTGEILGRFGRNGRMAGDFHWVHNLAIDSKGNVFTTEVDTGKRAQKFLFRGDMVLRKRAALPEGGAR

SEQ ID NO: 191 - protein, 361 aa, Methylobacterium sp.
LVERGWQVGVYCQRDVETVRDRIVRSTWNGVELITVEIGLRGPVATLAFDAICAHDAATRGGVCLVLGYNGAAFLPYLRARGGRILTNMDGIEWRRPKWSLPVRAFFYVSEWIAAWSSQRLVADHPVIADHLARRRPRGAIATIPYGGDPPAADVGPPPLGLEPDRYLVSIARIEPDNNILTLVEAFSRRARGVRLVVLGTLRVGNPYHRAVEAAASPEVLFPGAIYEPEQVQALRVHARAYLHGHTVGGTNPSLVEALWAGNAVVAHDNPFNRGTAGDAQLYFSGPDSCAAAIERVLSDGAAVAAARAAGRARAEQFRWDAVLASYEDALRRVGGYPPAPDRAAHATAAEPVAAPAGPRW

SEQ ID NO: 192 - protein, 153 aa, Methylobacterium sp.
MAGLKPILLVEDNPNDIELTLAALESSQLANEIVICRDGAEALDFIYRRGAHEKRQAQDPAVVLLDLKLPKVDGLEVLAKIKGDPVTRQVPVVMLTSSREETDLVRSYDLGVNAFVVKPVAFEEFFAAIKEIGVFWALLNEPPPYRGGWPSNA

SEQ ID NO: 193 - protein, 70 aa, Methylobacterium sp.
MRLYRVTFYKTVADDTGHEHRVRQREILVRAPSEVSAVWQAKALLCAGARVVDWRLRADSCEVAALPAAA

SEQ ID NO: 194 - protein, 207 aa, Methylobacterium sp.
MIIYGSSVSPYVRKVLAALYEKGVAFEHRPVGFQAADPGFRAASPMGKIPAMEDAGYRLADSSAIVDYLERLHPAPALIPEDARDAARARWFDKFGECELTRQVLVPFVERFLKPRLFKVEGDEALAQRTVDTALPPLFDYLESQIDGPYLVGGRFGIADIAVAAPFHNLRLAKVAVDGARWPKLADWVAATLERPSFTAAIAAAKS

SEQ ID NO: 195 - protein, 202 aa, Methylobacterium sp.
MKRPLSARSATSLALLPAALVLLPQAAFAHPGHGSATGAEAGFLHPLLGADHVLAMVAVGLLASLRGGRALWALPLSFLALMSVGAGLGMAGAVLPHVELGIALSIVVFGLATIVGLRAPVALLAALVGVFAVFHGYAHGAEMPETASGLSFGLGFLAATALLHAAGIGLGAAASRIGATRAAPALGAGLAAAGLALLALPA

SEQ ID NO: 196 - protein, 95 aa, Methylobacterium sp.
MITAAQIRAGRGLLKWTQGVLASRAAVSVVTLNMIESEQVQPRSRTLAAIRTVLEGAGIRFVGDARDGYGAILRPAPATGDAPAQKSPARRTAPG

SEQ ID NO: 197 - protein, 62 aa, Methylobacterium sp.
MPEKLDALLERLKAHQRTLILAMAEHDGMPAGSAIRQVAELENVIAAVEAVADEEADRKRRG

SEQ ID NO: 198 - protein, 121 aa, Methylobacterium sp.
MATVLAVDDSPSIRQMIKVVLGPAGHTVIEAGDGAEGLAKARSESVNLVITDLNMPVMNGLEMIKQLRTLPSCTGVPILFLSTESDEAIKQQAKAAGATGWITKPFKPEQLLAVVGKLVRA

SEQ ID NO: 199 - protein, 128 aa, Methylobacterium sp.
MNTILLVDDSPTILSSMSGILRSSGYETEQAADAETALAKVKAGLKPALVITDFHMPGMDGVQLIQALRKLAPTRFTPMLVLTTESQQEKRDGARQAGATGWLVKPVQADKLLQVLTQVAPAIQRRAA

SEQ ID NO: 200 - protein, 102 aa, Methylobacterium sp.
MATTVSARSAAAGPHGEIPLARGERLGMRMWRAEEPNADKPMTTSAHETVGYVVSGRAELVLEGETVALAPGDSYCVPAGAAHTYRILETFTAVEATAPPAG

SEQ ID NO: 201 - protein, 82 aa, Methylobacterium sp.
PGTAFAWGGGGGGGGGDSGSGLSPYAALSGNDRSAGVNNGNYRDPALDPYIRTYDPEAAARYAAPPAAQPRLRVRPYYGYPY

SEQ ID NO: 202 - protein, 47 aa, Methylobacterium sp.
MDLGSHGGFILAAYAFTAVVMVALVGNALRDRRAQRRALKGFGEDRR

SEQ ID NO: 203 - protein, 79 aa, Methylobacterium sp.
MRSASENQSPAFDPFGEPVADGVAGACPATSTGDRTARRVGGAVFWTLALAILAGRVYAYDLPAVQAVASHAAQVLALR

SEQ ID NO: 204 - protein, 575 aa, Methylobacterium sp.
VIGPSAGPLRILHLEDSDLDAELIEAELETLGHPVAIERVMTRDAFARAAVAGRHDLILADYVLPTFDGVSALGIARAQCPDTPFIFCSGTLGEDVAVEALKNGATDYVVKQRLDRMPRTIVRALAEARARADKREAEAALQALNETLEVRIAERTRELAAANEALQAQIVERERAEDALRLAQRLDAVGQLTSGVAHDFNNLLTVIAGNIEFLERVVSDNRSKRRLAMMRGAAERGARLTAQLLAFSRRQRLEPTPVSLNQTVASMRDLLQSSIGGAVRIETTLQPDLWPALVDATQIELVILNLAINARDAMAVGGRLAIETANVSVAGAPTRPEQPAPGAYVMVAVSDTGTGMTPDVLARVFEPFFTTKEVGKGSGLGLAQVYGFVKQSGGGIRIDTVAGEGTSIKVYLPRAADAEGAAPRLPAAAEAARPHPPGGGPRLLVVDDDAEVREVTTTRLIEAGYAVREAASGLQALAALEADPSVDLVVMDFAMPGMNGAETALEVRKRWPALPVLFVTGFADTSALTEAGAVGADAIVLKPFRVGELEGKVATALAARPPAQLRLISGRDRSA

SEQ ID NO: 205 - protein, 172 aa, Methylobacterium sp.
METERAVLAGGCFWGMQDLIRRQEGVVSTRVGYTGGDVPNATYRNHGTHAEAIEIVYDPARTSFRRMLEFFFQIHDPTTPNRQGNDRGPSYRSAIFYTDEGQRRVAEETIADVDASGLWPGKVVTEVAPAGPFWEAEPEHQDYLERRPDGYTCHFIRPNWVLPARVPAAQGA

SEQ ID NO: 206 - protein, 116 aa, Methylobacterium sp.
MTQDRTLSIDDPALDCPVAPDVVGRLIKADPEGAAFLLDGIPEATRARLAVWLYGRSHTYAIGVRVAATCEGATLRRTAGLVGNVLYDLSRRPVAAASHGPRGAGRISLGGSKRRA

SEQ ID NO: 207 - protein, 48 aa, Methylobacterium sp.
MDLERQREIASKGGRSVPAEKRSFSQDRELASSAGRKGGQSTGTGRAE

SEQ ID NO: 208 - protein, 78 aa, Methylobacterium sp.
MMTSQQLADELKRIATTQVSDITRAVKEGQKSIALNEVRDMARRLGLLADAFDPKSAAERSEADGASVADAVDDAQAA

SEQ ID NO: 209 - protein, 189 aa, Methylobacterium sp.
MDTTPLGPTAFRAPAVLLSGPVDYAMYKDFRRQLDAAGDRDLVVVELTTLGGDPEVARMMGEDIRFNSAMDPNRRFVFLGKAAIYSAGTTFMSFFARPNRYLTCGTRLMIHERKMNKQLQVEGPLTTCIASVKATLNEILCSIEIQNEGFANLIQGSDVALDEVLEKAPANWYIEAEEAKRRGLIEAVI

SEQ ID NO: 210 - protein, 201 aa, Methylobacterium sp.
VKSPVRRLFLAGLLAIAAIPAARAEPAIVRFRGTVVQADSERVEIRRTSGSTLAVRMGPRTRIYAVNGASLRAIKPESYVSVLGASDAEPRQASAVTLYSPSERGFEAGSQPWDTGQGARLTAGWVADLQRGAPMRLTLAYNGGQSSFAIPDDTPVTQLSPGEKAMLQPGAAVTIFARPGDDGGLMAGTIAVGRQGVVPGL

SEQ ID NO: 211 - protein, 293 aa, Methylobacterium sp.
MSEIRPRRSVLAMPGSNARALEKARSLPADVILIDLEDGTAPAAKAAARAQVAAAVAARGFGPREVVVRINPPETEDGEADLVALAPAAPDAILVPKVRTSDALIAVGSRLRRLGAPLATRVWAMIETPMAVVNAAEIAGAARDVDGRLGALVIGPNDLLKASRIRPPGRAALLPWLMNVLAAARAYEIEAIDGVFTDLKDAAGFEAECAQGRDLGFDGKMLIHPSQIGPANAAFGPDAEEIAQARRLMDVFDAPENRERGVIAVDGRMVERLHVEAARRTLAMAEAIARMTA

SEQ ID NO: 212 - protein, 292 aa, Methylobacterium sp.
MATDRPLDLEGVLAFVRVVDLGSFTRAAEALATSQAAISLRLKRLEDRLGTRLLDRTPRHVDLTRQGAQFLPAARRLLDAHDSAVADAATAVPARLSLGISDHVAGPDLPVLLRHLGLNRAGLITEVRIFPSRDLAAAFGSSGEGGYDAVIFRTEDEAGHGGAVLAEERLGWFAAPDFPAPRPGETLRLAGLAGPCTVRGAAMRVLDAAGLPWTEVFVGGGVLAVGAAVMAGLAVAALAPSTAPAGAVEVGGRFGLPELPRTFVVLRARRLAGRPAEALRALAAAYRGPGGR

SEQ ID NO: 213 - protein, 164 aa, Methylobacterium sp.
MDRPSLYDDDIVTWAEEQAAALRALAERPELSNAVDWENVAEEIESVGRSHLRAVEGLLIQTLAHLLKRASAPLAPASLHWREEIATFQITAWNTYEASMRQRLNWNRIWKSAVTAAEAGLGAYGNALLPGLPEACPIRPEDLLTETFDIERALRTIATSVARR

SEQ ID NO: 214 - protein, 89 aa, Methylobacterium sp.
LRILRSLLGAVLVLVSTATVALVSADRLAHLAPAPVVRAAQAEPSATGSIPLPAKAAPAPKPAVPSIPNGFDTERLHALMRGDPILPGR

SEQ ID NO: 215 - protein, 430 aa, Methylobacterium sp.
MIQAHPSSSKVATVLRVTSGNFLEMFDFFLFGFYATYISKTFFPVGNEFASLMLTFVTFGAGFLMRPLGAIFLGAYVDSIGRRKGLIVTLGIMAAGTILIAFVPGYGTIGLFAPFLVLVGRLLQGFSAGVELGGVSVYLSEMATPGNKGFYVSWQSGSQQVAVMFAAVIGYILNHALSLADMNDWGWRIPFFIGCAIVPFLFYIRRSLEETEEFLKRKHRPSMKEVFGSLASNWQIVLLGMLLVGMTTISFYTITVYTPTFGKAVLKLSDTDSLLVTFCTALSNLFWLPVMGALSDRIGRKPLLLVFSALTLLTAYPVLGWLVANPSFGNMLIALLWLSFLYGSYNGAMVVALTEVIPASVRTAGFSLAYSLATALLGGFTPLVSTWLIEATGNRAAPGLWMAFGGACGLVATLLIYRRATQPVALGAPA

SEQ ID NO: 216 - protein, 435 aa, Methylobacterium sp.
MAGDPGAVGATLKSRIGAILRSTSGNFLEMFDFFLFGFYATYIARAFFPSGNETTELLLTFGTFWLGALMRPLGAIVLGAYIDRIGRRKGLIITLAIMASGTVLIAFCPSYDTIGVAAPLIVLAGRLLQGFSAGVEIGGVSIYLFEIATPGRRGFYTSFQSASQQVAIMFAALIGYGLNAFLTKQQLGDFGWRIPFFIGCLIVPFIFFIRRSLQETQEFAKRTRHPTTREILSTVAANWRIVLLGMMLTTMTTVTFYMITVYTPTFGKNVLKLTETDSLIVTLFVAITNFVWLPVGGALSDAIGRKPVLLTISTLSLLTTYPALHWLVADPTFGKMLAVELWFSFFFGVYNGAMVVSLSEVVPAHVRASGFSLAYSLATALFGTATPMVSTFLIEKTGDRAAPSYWLMAAAACGIVATLALFRSRPGLERVPAHA

SEQ ID NO: 217 - protein, 95 aa, Methylobacterium sp.
MRVSADLCIVPMGVGPSVSPYVREIKGIIESSGLTATMHPNGTNIEGELSEICALAERCEAKLAELGVQRTFFTLIFSTRRDKDQSMADKLAAVS

SEQ ID NO: 218 - protein, 98 aa, Methylobacterium sp.
MEAKVIRWGDDLAVRLSSAEAEELGICEGATVEIVSKRPAQPESTQWVGRRYVDGLPVYTMEEMIAEARRLGSEAEPPTVDWGPDRGSEIIDDDNDPY

SEQ ID NO: 219 - protein, 251 aa, Methylobacterium sp.
MTTSSWRTLRNVQARKRLEKALPAIFPAPVLQHALARPLIPPTPRLAVESYWRNHILRADRLARALAARSGTPEGWAWQIGAEGRAGSFRTPPAPFRDPAFARGRGACCICGQPVYRFGWHRDLWARGAPNTNAGWHAACVAAWKFWIAPHAQVRALKLRQRHRCTTTGKRLLRTAEVDHLLPLYRVWREHRDAPWPELLGYWGAPNLQVVNRAAHLDKCRDEAAERSRTLQRARFRVVEDESGFSVVEEE

SEQ ID NO: 220 - protein, 203 aa, Methylobacterium sp.
MIVDDLAALEALYSAPLAPASTVKVAAAITPDYAALIAASPFAVLATAGPEGLDCSPRGDRPGFVRVADPRTLILPDRRGNNRIDSLRNVVRDPRVALLFLIPGSGTTLRVNGRAVISADPDLLASFRVDGHAPRTALVITVAEVYFQCARAIIRAGLWDPDARVDPGSLPTPGAILAALTAGEVGGQRYDAEWPERAAKTMW

SEQ ID NO: 221 - protein, 310 aa, Methylobacterium sp.
MRLCICICTCERPVGLARLLKALDQQRLGSLAETALRILIIDNGRSRAAVPVVEAYRATGRFPVTYAREETRGLAAVRNRSLAEASAAGADWVALIDDDEFPDRDWLHNLLETALAAGVAACVGPVVPFFDRVPPAWAAAGGFFAKRLPVRDGYVEDGYTANALLDLRVIRALGLAFDMRFNTMGGEDTFFFRALMLAGHRIAWAETAVVYDSIPTHRMRVRWLLARWYRSGSVEAYLGRLRPETVGGRLANAGRGFVRLGGGLLRLGIAGLSLRPATLIGGGYTLCRGAGLLAAVIGLSYREYHPSRYR

SEQ ID NO: 222 - protein, 320 aa, Methylobacterium sp.
VPLTLEGTREVPVIRLAEPVAPAAAADAILARAEALTAQDMQVLRIVVAADPATSGRLLDLGAARALGDGDGVEILPGLLWQCAARWLPRARPPFPELFTATAGRRHPLRPRTPAGTVYARAIPWLDRRLSFRTMTEPGDVALFSTWMNDPRIAAIWQETGTLEAHAAYIAGLQADPATLPLFGCLDGRPFGYFELYWARESRLGPLYEADPYDRGWHVAIGDASVRGRPALSAWLPSLMHYLFLDEPRTQRVVGEPRADHAQQIRNLHGSGFATIATVDFPHKRAALVALSREHFVRDRLWVPGAAAADAAPRPPAVPA

SEQ ID NO: 223 - protein, 230 aa, Methylobacterium sp.
VKRVVLLLLGGLALLAIGGFAGWRLHRPGADARAYAEMRLIAVQVSLDEAPPDYVFWAGDSQVELQPGSQRPCGLDFLNGGISGATAGSYADYLARLTFKVHPRLAVLTIGTNDILVKNNPQLHKPTEQFEAAAETIVKRLQTLSPRVVVTALPPVGREIGKLVDAGAVADYSRRLQNLCGRLGCVFTDPFAALRDGDTGYAKSGALRDGLHLAAFRPALKAVEPALCTP

SEQ ID NO: 224 - protein, 424 aa, Methylobacterium sp.
MTPISQPIPTRGLAAALAGLSLGLMGSGPVAAQETPATAAPPPSVQVDRGSALYGRPEGGAAAKLAPVAGPPLATAAAKLPLDKLKVPEGFKIEVYASGLANAREMTQAPDGTLYVGTRTVGKVYAVLPKPDGDGKRAVKTIATGLHRPNGVAYYDGALYVAELSKIWRYDDIANHLDGAAKPTLVYDDLPKDEAHGWKFIAIGPDNKLYVPVGAPGNIVMPPDTHAQIRRMDLDGKNAEVVARGVRNTVGFDWNPKTKQLWFTDNGRDWVSEDIPNDELNVLTEPGKQHFGYPYCHQGTFTDPEYGWGHACSEFTAPAALLGPHTASLGLRFYTGTQFPEAYRDAMFVARHGSWNRTTKLGGDVVVAKPGPDGKTAAVEPFLTGFLQDNKYVGRPVDVLVAKDGSLLVSDDYNGAIYRFSYGR

SEQ ID NO: 225 - protein, 751 aa, Methylobacterium sp.
LNLRSGAAQRLDLTACDREPIHIVGSVQPHGFLLGLEARSLTIVQASANAPAAASVGTVLDAALPDLAAVVRHHLEAAEPQDGALYLRTVTLETAGGRQAYEVAAHRVDDLVVLELEEIDAAAAEIGVDVLTPRLRAFVERLQTARTVEDLCQFVAEDIRQITGLDRALVYRFDRDWHGTVLAEAGNGVLPSYLDLRFPASDIPAQARELYRRNRLRIIPDAGYVPVPIRPATTPSGRPLDLSQSVLRSVSPVHVEYMRNMGTMASMSVSILVDGALWGLISCHNRAPRRVPLRARNACDVLTQIFALQLSARERGAQSEKRLALGAVQARLLAFMAEEDSFVDGLLNHPDDVLALVDATGAAVVTADRCRLLGATPTEREVRALYRWLSERGDAEEVFVSEALSEAFPAAAAFADRASGLLAISVSKKYASYILWFRPEVVRTVKWGGNPVKAVRPDPEGGPDRLHPRKSFEIWKETVQGRSLPWSDPEVEAAKDLRASVLGIVLRRAEELAAMSEELQRSNKELEAFSYSVSHDLRAPFRHIVGYANLLKTREGAQLSDKGRHYVETIIEAAFSAGTLVDSLLSFSQMGRHALNKVWGDMNALVEEVRRKVLRDVTPDRTLRWEIAPLGRAYADPVMLRLVIENLLSNAVKYTRGTPEAVIAMGSLPPREGEAVYFVRDNGAGFDMAYVDKLFGVFQRLHRVEEFEGTGIGLANVRRIVERHGGRTWAEGRLGEGATFYFTLPIREEAH

SEQ ID NO: 226 - protein, 497 aa, Methylobacterium sp.
MAWLHTWSGLVVGWVLFAIFVTGTASYYRTDISHWMRPELSATAPDPAAAATRAGAFLRRTMPDAAGWSIKLPNAEIPAVEVYWWPRPGGPFHHALLDPATGEPARIRDTRGGDFLYRFHFELSLPPIWGRWIVSACAMVLLIALISGIVTHRRIFADFFTFRRDRSAQRGWLDAHNVVGVLALPFHLMIVYTGLVTLSAMLMPWGMKAVYGDDVLRYYAEAGLAIPGAAPVGRPGTPLPLGEIVARATAAGGEVPEVMLVTRPGDAGATVTAYFEEPHGLAHLHPQIAYAADTGSEIARVGDAGAATRTGAVMVGLHEAHFAAAPLRLLFFLCGVMGAATVASGLVLWTVARAPKGADPEGFGLRLVRFLNLGTIAGLPVGLAAYFLANRLLPDGLGARADWEVRAFFAAWLVAALAASLYPRRRAWSLALAVPACAFLAIPLVDVILIGQQRFLAFDAAMAAVGLALGIAARLSTRRGVAAARPAKVTLSQTVEA

SEQ ID NO: 227 - protein, 407 aa, Methylobacterium sp.
MTANHGVFAFAHIGDLHLERASDPHAADLRAMLAEVAGLHGHGLLDFVYIPGDLAEDGRAEQYAVLHEALDRHPDLPVRLIAGDHDRQHGTMADFDALFAAVAGSPRGGGHAAQRHDLPRPRDPASVTHYYFAETWAGVRCLFLDMVSPGYGQKGFGLDFRLGPHQLAWLGEELARAEREGQPCAVFAHTYPDDLCVPDERAAFAGLIRHYGVRLVEMGHTHYNELAPDGRTLYAAARSVGQNEDGSVGYAVAAIDGPVTSWRFKPLDRALPFVMITSPADRRLATAPLDAPDGTITVRALVLSAKPQDAWRCHLRVDGGPAHPMVPDGPRTVHARIPWRDGARRLAVTVADGTGHTDTEVIEPVDRSFVPPPAHERPGSDAFRLPAWPEKGLRGDQLGPNRNGRHW

SEQ ID NO: 228 - protein, 219 aa, Methylobacterium sp.
MNGAQDLGGAHGFGPVLPEPDEPAFHAAWERRVFALAMAMGYTGAWNLDGSRANRESLPPAEYLASSYYEIWLRALEKQVVGTGLVTPAELASGRSAEPAKPVARVLARDGLEQRFRAGFPSSRAADGPARFAVGDAVLARNVHPTGHTRLPRYVRGKRGRIVRVDGVFVFPDTNAYGSGENPTWLYTVAFTAQELWGECGDPGGVVTVAAFEPYLDPA

SEQ ID NO: 229 - protein, 107 aa, Methylobacterium sp.
VTAPSPSPFAAPWEAQVFALVVSLRESGLFTWSEWADRLGRQIRPTEAPEQAADYGAWLATLEALLAERGVAGPESVAARTEAFLRAAEATPHGQPIRLENDPLYRP

SEQ ID NO: 230 - protein, 457 aa, Methylobacterium sp.
MTARAAPLCDVIGVGFGPSNLALAIALAETPAARGLRYRFLERQPHFRWHGGMLLPGSDMQISFLKDLVTLRNPTSPLTFVNYLHSQGRLHDFIDLGTFHPSRIEFNDYLRWVADHFADRCDYGETAVAVEPGLGPDGTVETLWVVTRDAAGREIRRQTRDLALAVGGAPHVPAAFAALARDPRLCHSSRYLDHVDRRGPGSPLDLSRPGARVAVIGGGQSAAEIGHDLHARFPQLQVDLVFRGHALRPSDATPFVNEIFHPDRTDFVYAQPSERRAAIVRSYRNTNYAVIDADLLKALHVIVYREKVSGPQRLHLRPRSEILSAVGDAGGIRLRTVDRYAEVEAERSYDGIVLATGYARDPNPAILEPLAPYRDGPDLARDYRVPTRPGFVPRIYVQGYSETSHGLSDTLLSVLPVRAQEIVDSLLDQDGHGGAVAPARAPAAGGIRAWERQGAHP

SEQ ID NO: 231 - protein, 343 aa, Methylobacterium sp.
MPKLREVTKGSRFSGDLRGTRILVTGGSGFIGSHIIDLLVEAGCDEIVAIDNMIRGRPENLGDALGSGRVRLVQGDIRDRALMDTLVKGTDVVFHQAALRITQCAAEPRHAFEVMAAATFNLLESCVEAGVAKVVMASSASVYGMAEVFPTTEKHHPYDNRTLYGAAKSFGEGLLRSFNDMHGLDYVALRYFNAYGPRMDLTGRYTEVMVRWMQRLAEGQSPIVFGDGLQTMDLVHVRDIARANILSAISPATDVVLNVGTGVETSLVDLAGHLTRIMGRDGTPLVHEAERAVNPVPRRLCDTSLAKELIGFEAKIGAAEGLADLVAWWQDESRSDHLRRALA

SEQ ID NO: 232 - protein, 368 aa, Methylobacterium sp.
VPESVLITGGAGFIGRHLSAELLRRGYRVRVLDSLIEQVHGGGAEALPPEVEFQAGDVRDGAAVARALSGIDRVVHLAAEVGVGQSMYAVERYVSVNDCGTAVLFQQLIDAPVRRVVVASSMSIYGEGLYRTSDGSTAEEVVRRPRRPGEPWDPLDGHGQPMRPIPTPETKRPALASVYALTKYMQERLTLTLAPAYGMEGVALRLWNAYGPGQALSNPYTGVLAIFAARLHNGQPPMIFEDGEQRRDFVHVEDVAQAFALALEHPAAAGQVYNVGSGQDRTVSEVARLLARAMGHEDIGPEVTGQARLGDIRHCIADIGKIQRELGYAPRRDFAEGLAELAAWVAEQQAVDRVAEARRELEARGLVA

SEQ ID NO: 233 - protein, 154 aa, Methylobacterium sp.
MSAGLDRIDQKILRLLQTDGRMANAEIAERVGTSAATCHRRIQRLFADGFVRAVRALIDPMRVGRGTLVFVGVVLDRSTPESFSEFEAAVRAIPALLDCHLVAGDFDYMLKIRVSDMADFNRLHSATLIGLPGVRQTRTFFVMKEVIDNAPLDL

SEQ ID NO: 234 - protein, 34 aa, Methylobacterium sp.
MLKRVILTGMVEFMAFGMLFVAVGAWAIALAPVR

SEQ ID NO: 235 - protein, 85 aa, Methylobacterium sp.
SWPRYALLAAMTLGGLATAPTEGADRHLERPKPRVAIQAAERWRLRPTEPVVAATTGSIRKRAETAIPEDRRNVRLVYPALIEAR

SEQ ID NO: 236 - protein, 495 aa, Methylobacterium sp.
  MOD_RES (390)..(391): Any amino acid
MRAGISIAAKLGLCLAALVLLIAATSGLSLAELGRIESAAAQLRDTRIPATDALGRIGINFMRQRVNAVRLITADTPALRAEVADQIAKRDALLAAQYARYEALPLTQPEREAYAAFRQHVATYAEQQREAVAKAEAGDVAGGQRIYNTTMSDSIRAIMADWEKLVALNGDGSQASGTLIVQTYDAAKRNVLALAGLALLVALGAFVLVTRGVSRPLRKIAAVTQRLAAGDAEVAISGQERRDEIGALAGSVVVFRDNLVRARALEAETALARADAETQRRAATRAMADAFEQAVGGIVGGVSAAATELEATARSLTGSAAEAAGQSGTVAGAASDAAANVNTVAAAAEELGSSVQEIGRQVSSSAELARVAVAEATNTVALVQDLSGAXXGRRRGGADLRDRRPDQPAGAQRHDRGRARRHRGPRLRGGGLGGQGARRADRPGHRGDHRPDRPDPVLHRAGGVGDRRDRPAHPRDRRRGLQHRGRRGAAGRGHP

SEQ ID NO: 237 - protein, 101 aa, Methylobacterium sp.
MRSRSRQVLPAILVLADLSGAVAPRTARAQGADSVMACETLIAARRIDAASGSGGPAPSEAGCRRMPRSAIGTVEQRALIGGAPYECLTVAGGGPCRWIVP

SEQ ID NO: 238 - protein, 490 aa, Methylobacterium sp.
LKIFIAGLATETNTFAPLPTGRSAFHADYARRDGSRNPPSLSNIGLKAWRALAEADGHTVVESLSTFAQPGGITLRAVYEELRDALLEDLEAAMPVDAVMLFMHGAMVAEGYDDCEGDTLEQVRAIVGPEATIGVELDLHCHLTETMRASADVIVIYKEYPHTDIVDRARDLYPLVVRTVTKDIRPVMAYADCRIVNMWRTSREPVAGFVRRMEALEGRNGILSVSFGHGFPWGDVADVGAKMLVVADGDAARAQALADELAGAVWAMREEAASHCDTIDAAIDRALASGDPRPMVLADFADNAGAGAPSDNTAILARLAERGIANVALGLIWDPGAVGICHEAGLGATFTLRIGGKCGVTSGNPVDLRVTVRGLSDDHSQTGLSGGRAHLGPAAWVEADGIHVVLTHKRQQAFAPDAFTRLGLSLDDKRIVVVKSMQHFYAAFAPIASEVRYVAAPGAVPPDYGAIPYTKRSGLYWPRVADPFAEENAR

SEQ ID NO: 239 - protein, 430 aa, Methylobacterium sp.
MALDPTLAAEIEASVAEGFADQVAHTQALVRFASLRGEEHACQDYVFDQFRARGYATERFAMDRAAIAAHPGGSKIDAALHSDAPIVVCHHRPGTETGRSLILQAHVDVVPPGPADLWTHRPFDPVIQGDWMYGRGAGDMKAGHAANLFALDALARLGLQPAAAVTVQSVVEEESTGNGALMTHLRGYRADAVLIPEPEDEKLVRANTGVLWFTVEVRGVPVHVREMGAGANAIDATYRVIGALRDVEARWNAEKAAHPHFETEDHPINLNIGKIEGGDWASSVPAWCRIHCRVALYPGVTAAQAADEIEATVAGFSRTDPFLANSPPRVVFNGFFAEGYVLEEGSEAEAVLGRAHERAIGSPLQSFMTAGYLDTRVHALYDRVPALCYGPTSQNIHGFDERVSLASVKRITTAMALFVAEWCGTERKAG

SEQ ID NO: 240 - protein, 532 aa, Methylobacterium sp.
MAGKRRAAPSGTLRFVLGDQLTRRVSSLVDLDAERDVVLIVEVRDEATYVRHHKQKIAFLFAAMRHFAAELEAEGIAVEYVRLTDAGNTGSFTGELERAVARHRPERVVVTEPGEWRVWEMMQDWRETLAIPVEIRADNRFLCPREDFARWAEGRHHLRMETFYRGMRRRTGLLMDDGEPAGGRWNYDSENRKRLPRGHRPPDRIGFQPDSVTRAVIALVEAEFGDHFGDLTGFYWPVTRADALAALRHFLADALPTFGDYQDAMKTGAPFLYHALLSPALNAGLLTAEEVCWAAERAYRDGAAPLHCVEGFIRQILGWREYVRGLYWARMPAYRDSNALGAGRDLPWFYWSGETALNCVAQVVAETRAHAYAHHIQRLMVTGNFALIAGLDPAQVEEWYLIVFADAYEWVELPNVHGMVLWADGGVMGSKPYAASGAYIDRMSDYCASCAYDVKVKAGPEACPFNYLYWNFLMENEDRLAGNQRMAMPYRTLRGLGDRRRAEIRRDAAAFLDTLEARPSADQRGDQTDRLR

SEQ ID NO: 241 - protein, 139 aa, Methylobacterium sp.
VSTGAAMAEDRSDGRLSVYYDGGCPLCRAEIDQYRRCAGADRLAFVDVGSGAPEPALGADLDRDRALRRFHVRTADGQLISGAAAFARLWRTLPSWRWLGRLVDLRVLGVRPILPLAELAYRLSLPLRPRLARLMARLR

SEQ ID NO: 242 - protein, 183 aa, Methylobacterium sp.
MIAEVAAQVPDTLAAYRDGVAEGPGGPDALPLGALRDGAVFDATLAAFGAGFGAEFRTADPRVRVSYWSQFYLAALATPALTALVRLGRPLPLAFDAVSLELDAAGRPRRFHLPADGSACAACPVPGLTGLVEAHLRPFVELCHARCGIAPRVLWGNAAVILDYVARELGDPLAGPAGDGAGG

SEQ ID NO: 243 - protein, 429 aa, Methylobacterium sp.
MASRARRGATKALRVLTRPVRRAQGHGGKGRGGLVVEPYRGYGSRDEVFLIGRVFRQSPGIPGEDPESLRAQWRDLRRRIARRTIAGAAVTARFGDDAVRVETDRDGYFRVHLHPRTPPAETGDWHAVELRLEADPPIPAEGAVFIPPDHCRCVVVSDIDDTVMRTGVANKLKMLWRLFVEDAEGRVAFPGVAALYRALHAGAGGDEGNPMLYVSRAPWGLYEMLSEFFQRHGIPAGPVLFLREWGLSWTHPLPRRATDHKHALIRHMLALYRDLPFVLIGDSGQHDPEVYAQIVEENPGRVLAVYIRNVSRGSARVEEIVRLAGAVARAGSSLVLAADSVAMAEHAAAIGLIAPGAVAGVADEHAAAAETGPRRETARITPEPSGVADAAEDPIGPEAIAEALAGDGPVPATLVVEPETPAALPRLGA

SEQ ID NO: 244 - protein, 162 aa, Methylobacterium sp.
MPARPAALDAASLRILACLQQDSEISIADLAERVGLSTSPCWRRVNDLKEAGVIRGCVAVVDPLSLGLAVNVFVHVSLEKQTQAALQAFDEAVRSRPEVMECYLMSGEADYMLRVVVEDLGQYQKLVLDHLTRIPGVANIRSSFALGQVKYTTALPLGHLTR

SEQ ID NO: 245 - protein, 119 aa, Methylobacterium sp.
MPRTRRHTGACSPGCAVEATLRLIDGKWKGVILYHLLEGTLRFNEIRRRLASVTQRMLTNQLREMESDGLITRTVYAEVPPKVEYSLTERGRSLDPVIRALKTWGDLHAEVADPAENAA

SEQ ID NO: 246 - protein, 108 aa, Methylobacterium sp.
MNPYLILGLAIGAEVTATLALKAADGLTRPGPTVIVALGYGTALWLMSTSMDMLPIGVVYAIWSGIGMIGAALGGAWLYGEALNPTMLVGIGVIALGVTVLAAGQGQQ

SEQ ID NO: 247 - protein, 682 aa, Methylobacterium sp.
VTLPGWRDWAFALKTYAAAMLALYLALWIDLPRPYWALGTVYITSQVLSGATRAKAAYRVCGTVLGAAVSVVLVPNLVNAPILLSLAVALWVALCLYVSLLDRTPASYLPMLAGYTAALIGFPAVDDPGAIFDTAVARAEEISLGIVCASLAATLILPQSAAPLIVGRLNDWSAEARAWIRSALAAARAPEAVGPSQGRRLRLASDAIGLDALGLALRNEATGAERAAEAFAPLRQHMLMVLPIVAAVTDRVAALERAGAVAARVRAFLSDLTTWLVDEVDDPDRAARLRDRIDGFEPALGRAPDWNTLLLASLAARLRDVIDLRQDLRALRGHLAAGTAPRAPLAFAYTARVRSIRHRDHGLAAFSAFGVFAGLLACCAIWIATGWPDGSAAPMMGAVACCLFAAQDDPAPQILSFANSAIVGALGAGLYLFAVLPLATSFEMLALALAPALILCGLMMTQPRTAPMGMGAALNGATLLALQNGYSGDFAPFANGVIASVVGMWVAAAVTRVIRSVGAGWSAGRLIGINRRSLAAAAAGRGTGHGLELAALMLDRVGLIAPRLASLPADTSASVGDLLADVRVGINLVEVRRVRRRLTGPVRSTVDRVLALAARQLRGRTGGPDAALLAALDEALDAVAGAAPSPERRAALIGLTGLRRGLFPDAPAYRAAPALDHRELAA

SEQ ID NO: 248 - protein, 680 aa, Methylobacterium sp.
MTLPGWRDWAFALKTFGAGMLALFLAFWIDLPNPYWALGTVYITSQVLAGATRSKALYRVLGTLLGAVVTVALVPNLVNAPELLTLAIATWVATCLYFSLLDRTPRSYLMMLGGYTAALIGFPAVGDPGTMFDVAVARAEEITLGILCASLVNTIVLPQSVAPVISGRLDLWLRDARGWVIDVLGRTRATTDTQATRLKLASDAVAFDALATPLRYDMTGAERSADAMATLRQHMLMFLPIASAVSDRIETLERASALPQRLRTLLDAMAAWLASGTTEQAEADRLKAEADALEPGLGERPSWDALVLASLLARLRDFIDLRQDARILQRHIADGTPVTEDLTFRYTAAARTIRHRDHGMALLSALGVFLTILVTCAIWIATGWPHGSAAPMMAAVGCCFFAAQDDPAPFIVSFANSAIVGALGAGAYLFAVLPLATTFEMLALALSPALLACGVFMAQPRTAPLAMGAAVNGSAMIALQGSYTGDFAAFTNASVAVIVGMWVAAIVTRLVRSVGAGWSARRLRAVNRRSLARAAGRQGAQNGLELAALMLDRVGLIAPRLAALPSDDAEWTADLLAEVRVGINVVELRRDRRQLSEPARAAVEALLVALSRHFAAEPGKPAPGLLEAVDGALDAVSRDARQAAGRAALMGLVGIRRGLFPDAPPYRSTLPTTTHPELAA

SEQ ID NO: 249 - protein, 905 aa, Methylobacterium sp.
MIAPTREAAPMNAIPPKATIARSAEVDHDPAETQDWLAALESVFRTEGAARARFILDRLERRSKEIGILDEALPYSPYRNTIALEKQPRYPGDLDIEERLTSIMRWNALAMVVRANMAYGELGGHVASYASAAELFEVGFNHFFKGGTDGDLVYFQPHSAPGVYARAFLEGRLSEEQLKHYRQEIAGDGLCSYPHPWLMPDFWQVPTGSMGIGPIHAVYQARFMRYLGDRGLADTTGRHVWGVFGDGEMDEPESIGGLALAARENLDNLTFVINCNLQRLDGPVRGNGQIIQELESLFRGAGWNVIKVLWGSEWDGIFARDTNHALLRRFAETVDGKYQTLGAKDGAYNLAHFFGEDPEVRELVAHMSDADVDRLKRGGHDFRKLYAAFAAAKTTKGRPTVILAKTKKGYGMGGAGESRMTAHQAKKLDVDALRAFRDRFALPLSDAQVEGLAFYKPAEDGAEMRYLRERREMLGGVLPARRRTAPTVPVPELSTYAGFALEAGGKEMSTTTAVVRLFGNLLKHKDLGPRIVPIVADEARTFGMANLFRQVGIYAPQGQLYEPEDAGSMLYYREARDGQLLEEGITEAGAISSWTAAATSYSVHGLSMLPFYIYYSMFGFQRVGDLIWAAADQRARGFLIGATAGRTTLGGEGLQHQDGSSHMQAAAIPNCRAYDPAFAYEMAVIVDRGARAMMEEGEDAFYYLTAMNENYAQPSMPQGAEAGILKGMYRLSGPQAGQGTGAAAVRLLGSGAILPEVIAAAALLAQDFGVAAEVFSVTSFSELARDAREAERQAMLNPEAEAPVSHVAALLPGTAPIVAASDYVRAYPQLIASYVGARFVALGTDGFGRSDTRNALRRFFEVDRQHVVIAALHALAEAGTVPRATVADAIRRYGIAADAPAPWTI

SEQ ID NO: 250 - protein, 444 aa, Methylobacterium sp.
MRPADYRTVADAIAADIAAGRLRPGARLPPQRDFAYARGIAVSTASRVYAELARRGLVTGEVGRGTYVRSEPGRAGLLRPEPPPAALDLQRTHSRLPEQEAVLAETLAALARDDGQIGFTQYGPAGTPSAQAIAAGFLARAGYAPDPADILFTGNGRQALAAALAALAAPGERIGCEPLTYPGVKGIAARLGITLIPLAMDAEGVCPEALLQAHRATPLSGVYLQPTLHNPLGATMGPARRAALAEALERTGLTAVEDAVYSFLAEAPPLAGLAPDRVIFVDSLSKRVMPALTVGLIAAPPALTDRLAASVRQGAWTVLGLSLAAGMHWMAGGSAAALAEAKRRDAAARQALARAALADLRVVGDPQAYHLWLELPETWRAEAYAAAALRQGIALLPASSFAVHPGHAPNAVRLALASPSREELDRALRGLRRLAFAGDDQVVE

SEQ ID NO: 251 - protein, 280 aa, Methylobacterium sp.
MALTASRYGKERVRVLRLARDGDHHSPRELTLSVMLTGRFEAAWTEGDNRASIATDSIRNIVNVTAARHLGLDAEGFVAAVARVLLETYPQVETVTIEAEEIRWLRHAIADAPHGHTFTRDGNGAGFAGLTADRTGSTLRSGLRGYTFMKTTQSGWTGFVADRYRTLPDTTDRIAATSMDATWTWASAPHDYAGTNARILATLLTVFGTTYSRGIQDSMYRMGEAALAAVPELAEIGFVMPNKHYLPIDLTPFGLDNPGAVFLPTDEPYGRIEATIGRTG

SEQ ID NO: 252 - protein, 170 aa, Methylobacterium sp.
MADSRRIVDALVRSRRGGLAAGAALGGLALIGGLAYRALRGAPPPEAGGPDFTKVDEDEARLMLRAMVAATTADGMVDAAERKRLDAAVAEAGLDPDGRAWLERELADSADVDAIADRVADPDAAARIFAAARLAIEPDTLQERQFLKMLAEALDLPAEAVERVERDIGA

SEQ ID NO: 253 - protein, 170 aa, Methylobacterium sp.
MIDLDRLNALERDAFVAYLGGVFEHAPWVARAAHGAAPFAGVADLHGAMMAAVRAAPPDVRLAFLNGHPELAGPEARARAMTADSAQEQGSAGLDRLTEADAAAFDRLNAAYRHRFGFPFIVAVRGRDLREIRALFEERLARAVVDEEATALEEIGAITRMRLDRLVRPA

SEQ ID NO: 254 - protein, 169 aa, Methylobacterium sp.
VITIAALNALARDAFVDLLAEVYEHSPWVPEAAFDRGPFAARADLHAAMEATVAGADWVRQLALLRAHPELAGRAAQRGELTAHSSREQAGSGLLGGPSPAVARLQDLNRAYAERFGFPFIIAVRGLDRDAILARLEQRLGNPPETERAEALRQVGRIAALRLEALVLA

SEQ ID NO: 255 - protein, 40 aa, Methylobacterium sp.
MAPAASQPLWKRLAWFAGLWASSIVGLGFVATVLRYWLKS

SEQ ID NO: 256 - protein, 440 aa, Methylobacterium sp.
METHIDLWFAASIVAISLLLSAFFAGAETAFTAASRARMHALEQAGDPRAAIVNRILAIRERFIGAMLIGYNIVAIGASAFTTSVLTALFGKSGVIYATVGMSVLVIVFAEVLPKTLAISKPDRAALLTARPVAFAVALMGPLAIAIEHVVRLMVKPFGVTIGEHQSILTAAEELRGQVALMHREGGVAKAERDMLGGLLDLSDLSVSDVMVHRTKMRAIDADQLSEDIVRAVLSSPYTRMPLWRGTPENIVGVLHAKDLLRALDAAGGDASGLKVEALALETWFVPGTTSLRAQLKAFLTKKTHFALVVDEYGEVMGLVTLEDILEEIVGDIADEHDVTVSGVRPQGDGSVNVDGGVPIRDLNRAMDWDLPDEEATTIAGLVIHEARTIPDQGTAFNFHGFRFQVLRKAKNRITTLRITPLTAAGLQAAALPDAPRDAV

SEQ ID NO: 257 - protein, 530 aa, Methylobacterium sp.
VAKPGFNRWLVPPAALAIHLCIGMAYGLSVFWLPLTRALSVGKPAPAACPDMGVMTALFTITCDWRVSDLVTVFSIGIVVLGLSAALFGGWLERAGPRKAGIAAALCWGGGFLIGAFGVYIHQLWLVWLGMGLIGGIGLGLGYISPVSTLIKWFPDRRGMATGMAIMGFGGGAMIGSPLADSLIKSFRTADSAGVWQTLAVMGVGYILFMLGGAFGYRVPPAGWRPDGWTSPTARNAMIASGHVHLRDAHKTVQFWMIWLVLFLNVSAGIGVLALASPMLQEIFGGELIGLPGTGFSALDAGQKAQVAAIAAGFVGLLSLFNILGRFFWASMSDRIGRKVTYAIFFALGGLLYAAAPWAAGIGSQALFVAIFCVILSMYGGGFATVPAYLADVFGTQFVGAIHGRLLTAWSMAGIVGPFVITKIREAQVAAGVQGADLYGRTMYVLASFLAVGFLCNLLVRPLAQRWFMSDSERASLDVRAGATASGPSGSFGIGRGGFSAGAALAWAVVGIPIVWGIGITLSKAFILFR

SEQ ID NO: 258 - protein, 254 aa, Methylobacterium sp.
MDNLTNRFKAALAEGRQQIGLWCSLASPISTEVVAGAGFDWLLLDMEHSANDLRDIYAQLQAMMEGDTHPMVRVPSDDPITIKRVLDAGAQSLMIPNIDDAEQAARVVAATRYAPRGIRGFSQAPRAARFGRIKDYHTRCEAEIFVAVQVESRRALDNLDAIAAVEGVDGVFIGPGDLSTSLGYVGQQGHPEVVATIEAAVARIVRAGKQAGILTPSEELARRYIAAGTRFTAVGSDMGLLARSSEALAARFRA

SEQ ID NO: 259 - protein, 92 aa, Methylobacterium sp.
MLTYDTTRNTRPDLSPEPAASLGRALSRSVRSHPSHERAALVSALDDGLMPDEVAQILAGRRVAEAFPIRWGESPEAYASRAVSEMFVAYLQ

SEQ ID NO: 260 - protein, 114 aa, Methylobacterium sp.
LAAATLSAKRRSLDRQLGAILATPSRCDLTRELQAKISRARDQLLVFLAYPGKVEPTNNGSERLLRPAVVQRKVTNGYRAMWAAEGEAAIRTVVDTARITGSSPFSTVLKTIGA

SEQ ID NO: 261 - protein, 322 aa, Methylobacterium sp.
MGRSDLERLSREELIELVLRLQRPEKTSRTSSKPPATDRKEQREHSKPGGAKPGHEGHSRVVSDDPDAVVEHRPEACACCGASLHAALPAEVVSVAEQIELPAVAPVVTQHQRLAVRCPRCGERVVAPVPEAARGTPFGPRLHAVATYLKTFQALSYERLQAALSDLFGLTLSQGGLMNLLRRAQGCFRPGRDAAIATLRRAEVVACDETGVRIEGSNAYHWLFHSAQAVVHTASPTRGAVVVREMMDGHRPAVWISDRYTAQQGHADEHQTCLAHLARDVAYVVEVSDDPVPWRLQLWLKSVFALAERVTHLAAATLSAKR

SEQ ID NO: 262 - protein, 446 aa, Methylobacterium sp.
MRGLFSAMLGGSRSLSAAGESLSTAPAPDDDRWYGDVGAMSFAGRRVTPDIAMQFSAVYAGVNLLAKTVASLPLRVYRKDPATGKSYEAPEHPLNDLLEHQPNRWQSDWDFKAMMQSHLVLRGNAYAEIISGPRGFADRLEPLHPDRVTCRRLSDGTLGYDIVDWKGNARRLLQDEILHLRSSTTLGGLVGIGPISYARQTVGLALATEEHGARLFSNGARPSGVITVPKSWSDEAFDRFKADWRSAYNGLSNAGGTPILEDGAKFEAIALTSEDAQFLATRQHQIEEICRWLDVPPVMMHHLTKTTSWGTGVEAIMLAFVRNNLRPWLRCWTQAIRRDLILAPQIYEVRFDIEDLIRGDSKAQAEFFTRLVLNGILTRNEARLELGYNPLEGLDTPLEPNTGATSDRLPGNGGGETRDASQIGHNGGPPLEETSEPEPQEEDIAE

SEQ ID NO: 263 - protein, 270 aa, Methylobacterium sp.
VGHTLCGDNNGVAIMKTSGNTILITGGGSGIGAALAHRFHDLGNTVIVAGRRAEALERVTAGRPGLHAMPLDIADAGDIAAFARRVTAEHPALNVVINNAGIMRFEALDQARDLSDAEATITTNLLGPIRLTDALVAHLVTRPDATLINVSSGLAFVPLTTTPTYSATKAAIHSYTVSLREVLKGRVEVIELVPPAVQTDLTPGQATRAGYLPLADFIDEVMALFQQQPTPAEILVQRVAFQRNAEAEHRFDAAVATLNEAARAARAAQE

SEQ ID NO: 264 - protein, 556 aa, Methylobacterium sp.
MKIGGKLLSFVGACSMTTLVVAGVSVATLKSFERSLTSVESASIRALDAANFNRLAAEVTMDSRGVYASADRAEAAKYTAGIRKGLAEMDALRADWAPRVTEAERPLFETMVRNADAFRTLRSALADAGDTTGPKAAAELGFNDANRANRKAFQASIDALVKQGRGEMAAIKADTQAMFETRTLLLLGLALIGTVICCALGLLIGQRQIARPLRAVSVSIQRLSRGDHTLPAVKPGRDEIGAIWTSMQVFSDTMREAESLRHEHQRLEADTATRKRAEMAGLAERFQGSIGGLVEHLAGAAAGLERAAATMAGNAEHAGTQSQAVTRAAETTAHNVEAVAAATEELAATASEIGVQVTQTSTAAESAVEATRRTRASVQALARSADGIGQVVSLISTIAGQTNLLALNATIEAARAGEAGRGFAVVATEVKDLATQTAKATEEIAGQIAAMRTATHDAVAAIEEIGGTIEQVHGIALGVAAAVEEQQLATQEIARSVSEAASGTRAVTDTMALVLGAARETGASAAEVLDAAADIARRSNGLGGEVAGFVTQVRAA

SEQ ID NO: 265 - protein, 148 aa, Methylobacterium sp.
MQRITITIDDALLTAVDDLCARRGYGSRSEAVRDIVRDALAPARAAETGGSAACYGALSYVYSHGTRDLARRLTGEGHEHGVSIASLHVHLTHDACLEVAVLRGPVARMQSYADAVVTQRGVRYGHLHLIPEGDDAHAHPGHGDDGAG

SEQ ID NO: 266 - protein, 300 aa, Methylobacterium sp.
MQSTGLRYFLAVARTGSIAAASSQLNVAASAISRQIANLEAELDCVLFERRPRGMVPSPAGELLAQHAHQVLIRSEQVVTEIRELEGLARGLIRVACSEGFSLDIVPNAIAAFHAAHPGIRFEVTVQPPAQVTQTVSVGDADLGITFALTPTAQVEVLYDGQVDMLALAAPDHPLARAPALRLVDLLDYPVALPTRDTTLRQVFDAACAHEGIAVEPVLTSNTLSALLPFVRRSRGIALMSALSVQTPLRLNELVSLPIQSRTSLARGVKIQAMRDRRLPKAVRAFLRQLLDALPPPRSP

SEQ ID NO: 267 - protein, 514 aa, Methylobacterium sp.
MPLRTLTRAATLAATLAASFATLIAAHPALAGKANDTLVYASDSEPENVSPYHNSAREGVILARNCWDTLLYRDPKDGTYKPFLATAWTWADDTTLDLTIREGVVFHNGDPLGPEDVAFTFNYVLTPEARTVTRQNVDWMKSVEVTGPHTVRIHLKAPFPAALEYLAGPTPIFPANYFKKVGLDGFAKAPVGSGPYRITKVDSGRGVSMERFDKYWAESPLGKPKIGKLQFRVIPDGESRMAELMTGGVDWIWRVPSDQAEQLRAAPNITVLNSETMRVGFLQFDTLGRAKENSPLKDVRVRQAISYAIDRKAMVDNLVRGASRVMNALCFVEQFGCTDQGVMRYPYDPAKAKALLKDAGYPNGFEIDLGAYRERDYAEAVIGYLGAVGIKARLNYLRYAAFRDALRAGKTSIGYQTWGSFSVLDVSAFDGVYFRGGEEDLTKDPQVIADLQEGDSSTDPEKRKAAYAKALQRIAAQAYALPMFSYSTNYAFTSDLNFTAQPDEVARFYAASWK

SEQ ID NO: 268 - protein, 305 aa, Methylobacterium sp.
MLAFTFRRVLVALAVAFTVSVASFLLLHLSGDLATAIAGPEATGPQIAQIRQDYGLDQPLLTQFLTWGWRALHLDFGNSFYFRESVIDLLAARLPITLYLGIIALAVALFVAIPLGVVAAVKRDTWIDRTALAVSVLGQAMPSFWFGLTLILIFSVNLRWLPVSGNATWKNFVLPAVALGYYAMPAVMRLTRNGMLEVLASDYVRTARAKGLPPRKILVRHALRNAVIPVIALSAVQFGFMLGGSIVIEAVFSLQGLGQLAWESIARNDFPVVQAIVLVLAMIYIGLTLAADLLNAFLDPRLRQS

SEQ ID NO: 269 - protein, 274 aa, Methylobacterium sp.
MIGAFVIAFREVIEAGLIISIVLAATRGIPGRMRWVLLGIAGGLAGAALVALFAEKISDAFEGSGQDILNAAVLIVAVLLLIWHNTWMSKHGKELAGELRAAGAAVRSGEREAAALSIVIGAAILREGAELVLFLYGLVASGTSGADIQFGAVAGIGAGALLSAVTYLGLASIPSRYVFSVTSVLIIFLAAGLAAQAAQFLANAGVVEVLGYTLWNSSGVIAENSWPGRVLHALVGYTDRPTALQGLVYVATIAVMVGLMQWSAADKRRAVRPA

SEQ ID NO: 270 - protein, 72 aa, Methylobacterium sp.
MPVFEAKNLDSEFEGQSLLAAILHPTRAAQTRALRHGRRRAERAAALADPMTIEPRFPIAPGELAPTGFTGR

SEQ ID NO: 271 - protein, 198 aa, Methylobacterium sp.
MAQEAILIIDDHALFRSGIVSMLSTAFDEIPVLDSPSLHEALAIVAVVPTIVLLDIQLPGIGGLEGMGLLQQRWPAARIVVVSGLDLPDTVSTALAQGACAFLSKTDRPERMMTVLREMLARSSAVPRIGGALCPTLTPRQAEVLTLVGRGLSNKMIGRNLGLSEHTVRGHVQGLLSVLGVTRRAEAVFKAQQFGLIR

SEQ ID NO: 272 - protein, 210 aa, Methylobacterium sp.
MNGSARETLIVADDHPLFREGMRHIAERLYPQALVREAATMEQVLAMARAGAPPRAFLLDLLFPGLDPHHSIGALRVEFERASIIVVSMIEDEGLIRTVMAEGADGFIGKALPAAEIAQAIAAIRDGEFVIRRSPVSSLAAPRGPLPPLTQRQRDVLRLVALGRTNKEIARELEISPFTVRIHVSALLRALDVTSRSAAAAKAATAGVGD

SEQ ID NO: 273 - protein, 473 aa, Methylobacterium sp.
MTRDAAIARATDSFDSGAFLALLREAVAMPTESQAPGQEAALRAYLDAFIAPLVARLGFETPKIFPNPDGVHGPFLIAERREGADLPTVLIYGHGDTVRGYPEQWREGLGPWEIVVEGDRWYGRGTADNKGQHVLNLAALEQVIAAREGRLGFNVKLLIEMGEESGSPGLRPFCREQAEALRSDVLIASDGPRLNGERPTLFLGSRGAYNFELSLNLREGPHHSGNWGGLLRNPGTVLASAIASMVDARGAILVDALRPPPIPEGVRAALADIRVGEDPTAPTIDSDWGEPGLSPAERVFAWNTLEVLAFKTGDPDGPLNAVPPHAKATLQLRFVVGTDWQNLIRNVRAHLDAHGFPMIEVRPARAAEVFQATRLPVEDPWVEWALESIEASTAKKPALLPNLGGSLPNDAFSEILGLPTLWVPHSYPACRQHGPDEHMLASGTREGLAIMAGLFWDLGRDGPDILRRREARA

SEQ ID NO: 274 - protein, 294 aa, Methylobacterium sp.
DAPVALAPVPSPTRLILRRGLRHTGFLIGAGILGLIVLAALAAPLIAPHDPYAQDVSRRLIPPVWQAKGTWEHVLGTDKLGRDYLSRLLYGGQISLLIGISAALISGLIGTTLGLCAGYFGGWVDSVVSYVVTTRLAMPVVLVALAMAALVGGSLKVVVLVLGFLLWDRFAVVTRAATQQIRNQDFISAARAAGLTDLRIIRQEILPNIMNALIVVATLEMAHAILLEAALSFLGLGVQPPLPSWGLMIAEGKQYMFFQPWVITIPGVALLLLVLAINLLGDGLRDITAPEARN

SEQ ID NO: 275 - protein, 156 aa, Methylobacterium sp.
MEAKLCFIGHALMENRSALIVDTCLTSADGHAERIAALAMIEPRADRPKAISVGADKAYDAEDFVNELRSMNVRAHVAQNTSGRRSSIDRRTTRHVGYGMSQKIRKRIEEGFGWIKTVGGQRKTRFRGRDRVGWAFAFTAAAYNLVRLPKLLGALA

SEQ ID NO: 276 - protein, 215 aa, Methylobacterium sp.
MRGSDQRSGRLFSYVDLEARVRPDHPLRTIRQLTDVALAALSGDFSVLYAARMGRPSIPPEMLLRAMLLQAFYSIRSERQLMERLEFDLLFRWFVGLGVDDPAWDHSSFSKNRDRLLAGEIAAKFLAAVLAQPRVKRLLSSDHFSVDGTLIEAWASMKSVKPKDQSGDQAPPPAGGRNAEVDFKGQKRSNEPTPKPGSTARARAWRPSSASSAMP

SEQ ID NO: 277 - protein, 259 aa, Methylobacterium sp.
MADWNPALYTRFEDERTRPAAELLARVPLDAPRLAVDLGCGPGNSTALIAARYPDAEVIGLDTSPAMLESARARLPGLSFVRADAATWIPDRAPDLIYTNAVLQWLPDHANLLPRLFGLLAPGGVLAVQMPDNLAEPTHRLMRAVAADGPWAAAIGDPAVAGRLGRMLEPAAYYDLLAPRAAEVDVWRTAYHHRMADAAAIVEWVSATGLRPFLNPLDPEERAGFRAAYTRAIDAAYPPRSDGRRLLAFPRVFIVARAR

SEQ ID NO: 278 - protein, 157 aa, Methylobacterium sp.
MASLSVAIAFGVRLLLVLLFLPFSALDKILNFRGAVGQARQAVHATAPAVALILIGLCVEIGMSLCILTGTADRAAAFVLAGYCGVTALLWKQFWVPGDFWAGGRGRELFWDFLKNFALAGGFLLITFGTGAGTVQDFLADPLGSTHPYAIADRARP

SEQ ID NO: 279 - protein, 460 aa, Methylobacterium sp.
MTSTVSPSPIPSPAEGRAEDGRAARFWPDVWWRLIDFKIGIIPLPIFVVLAILLAILVQEGEIKPDGPTMIAVLVMGGFTCAEIGKRIPILKNIGAGAIFATFIPSALVYYALVPPQMVKAITDFTKFTNFLYIYIATIIVGSILGMDREVLIKGFLKIFAPLALGSVAAALVGTLVGTLLGLGPYKTFFFIVVPIMAGGVGEGAIPLSIGYAAILGMQQGVVFAQVLPPVMLGSLTAIILSGTLNSVGKRYPHLTGEGRLQPDSDGIKSSDAQAKAEAAKGQIDPATIGAAGLTAITLYLLGVMAHHLVGLPAPVAMLFLAVLAKLASAVSPHLQAGGFVVYKFVQVSMTYPLLFAIGVALTPWHELMAAFTLVNLITIVSTVVTLMTVGFFVGRWLGMYPIETAIVNACHSGQGGTGDVAILTAANRMALMPFAQIATRIGGALTVTGTIVAMKWIGA

SEQ ID NO: 280 - protein, 217 aa, Methylobacterium sp.
MSPQMIERLWQAFLDTALMVGVSAGIAVVAGIPLALFLVTSGPGGIFAAPTAHRVVGTVVNGFRAVPFIVLLVALIPFTRLVAGTTIGVWAAIVPLSVSATPFFARIAEVSLREVDAGLIEAAQSIGCRRRHILAHVLLPEALPGIVAGFTITVVAMIGASAMAGAVGAGGLGDVAIRYGYQRFDTTVMVVVIAILIALVCAVQFAGDTAVRRLRAR

SEQ ID NO: 281 - protein, 396 aa, Methylobacterium sp.
MVGLIFDSLREPGTPAAAGRTSPGAATAARAPAAAPGREAGRETGRETGRETGTVRFESVSKTYRSAAGPVQALDRVDLAIPAGAIFGIIGRSGAGKSSLLRTVNRLEAPSSGRVLVDGAPIDALDTDGLVALRRRIGMIFQHFNLLAAKTVRQNVALPLTVAGVPRHAIGPRVAEALRLVGLEDKADTYPSRLSGGQKQRVGIARALVSDPEILLCDEATSALDPETTLAILDLLRDINRRLGITIILITHEMSVIREICSDVVVLEAGRVVETGPVWRVFGAPEHPTTRALLEPLTRGLPPDLAARLQPRPAPGGWAILRITCSGRAAPDLSGLAGAGAPVRLLQAGIERIQGHAVGRMLVAVPAEDPGAEARLRTLGGDVERVGYVPADPAEG

SEQ ID NO: 282 - protein, 307 aa, Methylobacterium sp.
VAVATETLPGPARPAREAGTGAEADPRIVPRRIVPLADDRTIAYAETGAGPDLVAIHGTLMCLEDVWLGPVPALAEHFHVVAVDRPGHGFSRRPRGGAADIWDQAACIREAVRRLGLERPVILGHSFGAAVALAYGMLHPDEVAGIVALAPICFPEPRLEQALFGPRALPFGGDALSALLGASSDRALLPLLWNAMFFPEAMPARFARDFPFALAGRPAQITAEGEDAGWLWPGLTRSVLGYPSLRRPTRILGGSADLVVNTDLHGRRAAGLIPGARFEYLPGAGHMLHHLQTDAVVRAALAVRSEA

SEQ ID NO: 283 - protein, 81 aa, Methylobacterium sp.
MSELLSVALVCAGTLLAQDCSRDTALDVIVAPAHTPMECLMHAQTMAAQAGLPGGSDRYLKVACEHRRSEADPRPVIRRAS

SEQ ID NO: 284 - protein, 391 aa, Methylobacterium sp.
VGEVFRAFLKLGLTAFGGPIAHLGYFRDELVTRRRWLDERGYADLVALCQFLPGPASSQVGFSLGVLRGGGLLGGLAAWAGFTLPSALLLLAFAYGAAALSGPVADGVIHGLKLVAVAVVAQAVWGMARSLAPDRPRAGIAVAALFLTVFVAGSVGQLGAIALGALAGLVLCRAAPQAQEGHLAVPVSRRAGAAALVAFALLLVVPHLLVAGLPSQGLALFDAFYRSGSLVFGGGHVVLPLLQAEVVAPGWVGSGTFLAGYGAAQAVPGPLFTFAAYLGAVAGPSPHGVVGAAIALVAIFLPGVLLVYGTLPYWDAFRTRPLAQAAMRGTNAAVVGILGSALYDPVWSSAVGNPRDFAVAVLAFVLLTVGRVAPWIVVALTALGGVALASL

SEQ ID NO: 285 - protein, 391 aa, Methylobacterium sp.; identical to SEQ ID NO: 284

SEQ ID NO: 286 - protein, 547 aa, Methylobacterium sp.
MPGEHYDVIIVGSGPGGGTMAWRLAQTGKRILLIERGDYLLREPRNWDSQAVIVDGYYQAKETWYSSDGKSFHPGLHYYVGGNSKFYGSILFRLRERDFSEIRHQDGVAPAWPVGYDVFEPYYQAAEELFHVHGLRGEDPTEPWSTKPYAHPPVAHEPRIQELFDNLKRTGHHPFHLPVGVRLVEKDGRAVPTSPCIKCESFDGFPCPTNGKSDAQTMVVDPALRDCPNLTLLTRTYIERLVTDASGRTVTGVVGNRDGAAFEASADIVVVACGALSSALLLLRSASDRHPNGLANGSDQVGRNYMRHNNSTVLAISKVPNPTRFQKTLGLNDFYFGDPDPKDGWDFPLGHIQMVGKSDGAQIHGEGLPGFLQWFPDKPFDWIAKHSVDFWLTSEDVPLPQNRIFYKDGKVHLDLTETNVEAHKRLRHKLREICSVTDIHPHLFDRSLYLGKNVPIGGTAHQAGTLRFGADPRTSVLDPNCKAHELDNLYVTDASFFPSVGAVNPTLTIIANALRVADHLVARMGARDAIAPPRLFDHTEPREPLPA

SEQ ID NO: 287 - protein, 418 aa, Methylobacterium sp.
MIFIGMLLGIAVGYACSITWPDPQTAKEIAGYIALVSDVFLRLIKMIIAPLVFSTLVVGIAHLGDTASVGRVGGKALLWFVGASFCSLMLGLIMVNLMQPGHNLNLPLPDAGAGTGLKAASLSLKEFVTHLVPKSAVEAMANNEILQIVVFSIFFGVGLAALGEKGRLLAQGIEGIADVMLKVTGYVMMFAPVAVFAAIAATITTQGIGVLVTYGKFLVEFYISLGVLWMLLMGVGFLLLGGGGIMRLFNLIKEPFVLAFSTASSEAAYPKMLSNLEKFGVPNRITSFVLPMGYSFNLDGSMMYCTFAVMFIAQAYNIPLSWGQQLTMLLLLMVTSKGMAGVPRASLVVISATLSHFNIPEAGLLLIIGIDQFLDMGRSATNVLGNSVATVAVAKWEGQLSTTDQRLDHVGTMASPAE

SEQ ID NO: 288 - protein, 449 aa, Methylobacterium sp.
MTHADTDPDSTTSRSGRLTLYTGLGLALGILVGAVLHGLAAGPDEAKAFAAHFTLATDIFLRLIKMIIAPLVFATIVAGIASFGDARSVGRVAALAMGWFVTASVVSLTLGLLTANLFQPGAGLGLPLPDAGAQTGLKAASLNLRDFLVHVFPTSIVSAMAGNEVLQILVFSIFFGFGLSTIDRRYSEPMVQLLDGLARVMFRVTDTVMRLAPIAVFAAIAAVVTVQGLGVLLDYGKFIASFYAGLSLLWLLLIGAGWAVLGRRVVELLRLLRAPMILAFSTASSEAAFPRTVEVLERFGVRPRVTGFVLPLGYSFNLDGSMMYQAMAALFIAQAFGIHMGFGEQLTMLLVMMVTSKGIAGVPRASLVVVAATVPMFGLPAAGILLIMGIDQILDMGRTVTNVLGNGLATAAVAKWRGEIAGGVREVSAEPAGPRLDLAARPATGAARA

SEQ ID NO: 289 - protein, 300 aa, Methylobacterium sp.
MFDLGHARSFVAVAEEMHFGRAAARMHLTQSPLSRQIQMLEQTLGVTLLERTTRAVRLTPAGRTFLAEAYRVLAAAENAARITRRAARGESGVLRLSFTAASAYRTLPQVVAHVRRTLPEVDLVLEEMVSDEQILALGENRTDLAILRPAPVLQDPKSAIATAPLARERLLLAVPRGHRLAAARAPTLRDLDGEAFVTWSPRGGRYFIDLLDRLFEAGGVQPRIVQRVNQVHAMLALVGAGIGVALVPGSARGNSMADIRLRPIALPAATGPELWLAWRSDNANPCLPSVRAAALETGEA

SEQ ID NO: 290 - protein, 296 aa, Methylobacterium sp.
MFDFSQLRCFAAVAEELHFGRAAARLNMTQPPLSRQIQVLERVLDVQLLERTSRTVRLTAAGRSFLPEAQRILRLAETATHVTRQVAAGRAGVLKFGFTAASAYDFLPRLVTAFRRALPDVTLALREMVSKDQIEELLAGRIDAALVRPPVTHPDLIAVRALAEPLVVALPAGNPLALRDGLTPADLGREPLIGYAPNEAHYFHDLVLGLLAEAEIRPPTVQQLTQIHSILALVRAALGVALVPAAAERLRFEGVVFRPLVLPAPRPVELLLAWRRDADDPLIAQLVSIVAEMPPA

SEQ ID NO: 291 - protein, 233 aa, Methylobacterium sp.
MTSPFLPLDRKVIAREAAKMFLEIEAVLFYKDEPFKFTSGWASPVYTDSRKIISFPRLRSTLMDFATATIVREIGYEKLTHIAGGETAGIPFAAWIADRMMLPMQYIRKKPKGFGRNAQIEGEIVEGARTLLVEDLATDGRSKVNFCKALRDSGAQVDHCFVLFYYDIFPDSAALMEEIGIKLHYLTTWWDVLAVAKEMGTFDPKTLAEVERFLNAPAEWSAAHGGISAFGQA

SEQ ID NO: 292 - protein, 77 aa, Methylobacterium sp.
MNQLTRRVIVCPITRNPHPWPTKVFLPVGLSVSGAVLVDQVRSIDRAARILRSLGNAPDDIVAEVRGKLRTLLGLTI

SEQ ID NO: 293 - protein, 728 aa, Methylobacterium sp.
LTAPSPTASPPGRVRRRLAAGRGSLSRPGGDLRRLPTGLDLRNVRLVEGVRAAFAFGVVILLNIWIQWSPLLTMALAANLACFCDNGGPMRARLRVLTAFSFLGGLLWAGLGLIQPLGLPVVVPVACALIFACSYARVWSVQAQSAGNVLVVVLCIALDRPLDVAQAAVTAAMFAAGGLWATFLALVIWRLHPYRPAHRAVAEVWHNLARLCGDLERLVALPEPDTAAFDGHARGHRRGVRASIETARTMILDLARSRERVSDRTAQALLRLESAEQIFAALIAVGELIDSRPDARRRALAKVFLRRLRPLLVTIARAIRDDVNLDLGRLEHSIARVAEGLSEDPTLARLADRIAGRVRLGAKLSTPEGYRPGGTITEGGSLDRWTRYVGPLAQNFTLASPNLRHALRASAVAAPALAATLTYAGAFTHWLVMTVVLTMQPFYAATWQRALERIGGTVLGGLVGAVLAYYATSPLAEAGLILVLSIVGFAARQISYGFFVTCLTPLVVLLVELLEPGHSSWEIVAMRGGFTVLGGVIAVASCLVLWPIWEPDQVRQELRRALKAQAGLAEAVLRAPPGEGREAAIAVQSREAGLALNDLEAALSRALQQPRAGSHPEVESALVADATLRRISARLIVLRHAPEAAAPEAEPWRAWITATLAALGADRPVPERPALDRGQSLVRLVSQVDLLVGTLRPGEIRAATVADGGAPASGQGTATRAGQPFLPS

SEQ ID NO: 294 - protein, 68 aa, Methylobacterium sp.
MGEIDLYGVFVPGLALWMAAAFALSLPLRRLLAATGFYRLVWHRPLFDLALYVVLLGGVVTLAHRTLQ

SEQ ID NO: 295 - protein, 69 aa, Methylobacterium sp.
MTGELDLYGVFVPSLAAWMLIAFALSLLLRRVLARTGFYRMVWHRPLFDLALYVVLLGLVVSVAVPLTS

SEQ ID NO: 296 - protein, 308 aa, Methylobacterium sp.
MTALFSALGRLLVTLGMVAAALIVGLGLWDYYMDAPWTRDGRVRADVVAVAPDVSGLVTEVLVEDNQVVRKGDVLFRIDPDRFRLGLRQAEAMVQGRKATAEQEAADYARYSKLSDAAVSQQRVEAAKAADLSARAAYEQGLADRDLAKLNLERSAVRAPVNGRITNMELRPGAYVTTGRGVMALIDSDTVRVEGYFEETKLPRIRVGAPVTVEIMGEDGALRGHVASIAGGIGETGRSDASNLLANVNPTFSWVRLAQRIPVRISLDGGTSDPRLVSGRTATVSIAPAAGGEALRWPWTAWREARAR

SEQ ID NO: 297 - protein, 315 aa, Methylobacterium sp.
MPRLLALSFRLLVTLGTVAAAIVVGLALWDYYMEAPWTRDGRVRADVVQVAPDVSGLVTEVLVADNQVVKRGDVLFRIDPERFDLALRQAEAVVEGKQATAERAAADYVRYQKLSDAAASQQRVEAARATDLEARAAYGQAVADRDLAKLNLERSAVKAAVNGRITNMELRPGTYVSTGRGVMALIDSDTLRVEGYFEETKLPRIHVGDKASVRLMGETSTLNGRVESFAGGIEDRERTAGSNLLASVNPTFAWVRLAQRIPVRIKLDDVPDETRLVAGRTATVAVASEGGTPHFSLFGSWRGAPEPAARETRTR

SEQ ID NO: 298 - protein, 165 aa, Methylobacterium sp.
MAAKTLRQLRLAYTHTLLLSGRQWRRLANAATEAHGISEAKALPLVLIARMGGEPRQTTLADAIGIEGPSLVRLLDQLEKADLVARREDPTDRRAKVLTLTPAGQVVVARIEADLERLRETVFATVSAADLEAGLRVFQALQDHLRGEAGLDGAEAGAHRGEAAE

SEQ ID NO: 299 - protein, 360 aa, Methylobacterium sp.
MAYARLDDPPPTAAGPSPRADVIDRRPVRAPTAPRIAALARLGGILLALLAPPTGAIAADAQDLVEALRKVAGSRPGVRPTFAKGQCVRGTYTPAAEVGQVTRSISFTRPWPLVGRFSVGGGNPSVPDATRTVLRGFSIKLLSDGGETHLLFENAPVHFARTVDQMLAFLQVRVPGPDGKPNPEAIAAFAKANPETTRQAAFVAGKPVPGSYVGLVYWGVHTFTGLNADGRAVPFKFKIVPRAGEITLSDEEAKGKPAQFLADALREQLSRGPAGFDVVALLAGPSDDLGSDITQRWTNEDDRKAVTLGTIAVTGIEPNETCDQGIFDPGQLADGIDAPKDEIFAARRTAYGISFGLRSQ

SEQ ID NO: 300 - protein, 139 aa, Methylobacterium sp.
MSEPSDTAEPYALVVDDDGLIRMDAMDILADAGFRTFEASDGDKAMTLLAREHALIVLLFTDVQMPGSRNGFAVARETATRWPHIAIVVASGHVRPGPGDMPEGACFIGKPFTADMVHDHLQEILPDGRKPAPLRDRER

SEQ ID NO: 301 - protein, 266 aa, Methylobacterium sp.
MKFLRLLAVAALSLGALPAGAETLRVGVVPGAYGDAVTVAAREAKAEGLDVKVVEFSDWTTPNVALDAGDIDVNFFQHRPFMENAAKQKGYAFDIVGLGILSNIGLYSLKHKSFDQIPAGGTVAIANDPVNQGRGLLLLQKAGLITLKDGVGFLGTLDDIVENPKKLRFTEVEGPQLARITGDVDLALGYPHFIVAAGSFDPTSGLIYSGIEDRRFAVSFVTKAARKEDPVIRKFVTLFQNSEAVKQQIRKSFANSDKLYLLAWQN

SEQ ID NO: 302 - protein, 463 aa, Methylobacterium sp.
MMESWSPTIAGETGPKYLAIVRALAKDIRAGRLAPGARLPPQRALAKHLSVDLTTVTRAFNEARRTGLIDATAGRGSFVRASRSPAAEMRRPDPTGSVDFSMNMPPQPEAAWLAERLEAGLSRLAGSSAFLARMQYQDSAGNLADRAAAAHWLGQRLGALPMQRVLVAGGAQVVLAAVLAAVLKPGDALCVPALTYPGLRMAAERRGVRLLPVAGDAEGLDPDALLERCRSDRPRALYLVPTLDNPTTATLPALRRRQIAEIARTHGVAIIEDDAYGALPHDAPAPIASQASDITWHIATLSKCASPGLRIAYVAVPGTNEAVRLAAELRAINMMASPLTAALASHWIAEGELDGIVAAIRQENELRQAVARETLRGLEVWAHPCGHHLWLRLPDPWRRGEFGAHARQLGVSVVLSDAFAVGAAPEAIRVSLGAAPDAETLRYGLSLLATLLAHPPGAISTVV

SEQ ID NO: 303 - protein, 168 aa, Methylobacterium sp.
MTAVAFDTLKFARALREKAKLSPEQAEGLADALVDVFDGNLATKADIRDVQAELQIVRGDIEALKIQTRGDIEALRLTTQAEIEGLRISTKADSDSLRQSTKSDIEALRLSTKADIDGLRLETKADIEAVKGAIASAKVETVRWLVGAIGFQTLAVLGAVIALTRTLH

SEQ ID NO: 304 - protein, 259 aa, Methylobacterium sp.
MMTRRTLTRTLAAGAATALLPGPATAQDLPRARNVVLVHGLFADGSCWSEVIPHLQAAGLSVTSVQNPLTTLAEAVASAQRVLARQEGPTVLVGHSFSGMIVTEAGIDPKVSALVYVAARAPDANEDYAALAKAYPTPPASAGIVFDGDEGRLSEAAFLRDFAGDLPVEKARVLFAVQQPFRKVLLTGRTTQAAWRSKPSFYAVSTEDRTIDPDLERFMAKRMNARTVELRASHLSLISRAPDIADLILEAAGQPRRRR

SEQ ID NO: 305 - protein, 477 aa, Methylobacterium sp.
MSASTTAPGSLALTDVTPRRSAVDARLARFGDALRRYGWIIRSVQWLIVAVYAVLVIVPALLPLPDNAAHIWTNLTLAAQFAFWGIWWPFVLVSMVLVGRAWCGVLCPEGALSEFASRWSRGYAVPRWITWQGWPFVAFAGTTVYGQMTSVYGYPKPVLAVLGGSTLAAIVVGLLYGRNKRVWCRYLCPVNGVFAVLSKLAPVSFQVDRAAWADSPKPVGGTASFNCAPLVPVKTMRGAGACHMCGRCSGHRGAVRLALRSPNHEIVHVAGAEPSLDQTMLILFGMLALAVGAFQWSSSPWFVDAKQWAATWLIERGTTWPLEHSAPWFVLTNYPDRNDVMTLLDGGLLLAYIGAATIVLGLALSGIVALATLSLGGWSLRRFHHLTQTLIPVAGCGVFLGLSALTVTFLRGDGIVIPYVAEIRAGLLAGASLWSVWLAWRVAGLAAGGLRRVAASACIAGAAALSVANWVLLFWIW

SEQ ID NO: 306 - protein, 122 aa, Methylobacterium sp.
VPELTVSRLPRCSLVRAIPLLLVAAASASAPARADDMPVIKVEMRDGVIIPTVIEVPANTRFKLEISNTGQTPVEFESTELRREKALAAGSTSAIVFRTLDAGTYQVFDDFHPEAKATLVAK

SEQ ID NO: 307 - protein, 187 aa, Methylobacterium sp.
MHASHILPVLRGLAAASLLAFAGAAAAKEVPIGPHVTRNGLEVAAVYLQPIEMDPPGMMREAAKSDIHLETDIRAAKDNRNGFAEGDWVPALDVRFEAVKLDGDKPTDQTVSGMLMPMVANDGPHYGDNVKLFGPGRYRLKVTVAPPGKDSHFGRHVDKETGVGPWFEPFEITQDFTFAGVGKKGAY

SEQ ID NO: 308 - protein, 243 aa, Methylobacterium sp.
MSGVRPDLFARLHDDLESGFREDLEEAVIDPARWPDLAERVVRASGSEGALLLRSDRTGLESLCTASLADASRRYFDEGWHRDDHRLRGIPLMRTRGIAVDQDFTTPEEIARLPFYQDLLASRGLRWFAGIGFSVKGRLWCLSLQRTVEQGPYEPHEQRRLATLSPLLQRAGLLTSMVERARLAGLTQAFELIDRAALILDADGRALRWNDAFGALLGRDLKLSGGRLTAEDPDAARQLEALA

SEQ ID NO: 309 - protein, 127 aa, Methylobacterium sp.
ALARPCGRPPISAVVAARRDGPPLVIHVVPLVGPSRGLFAGASTLLLGSVPGAPAAPATAILQAAYRLTPAEARLAQALSSGISLAEAASRFAITAATARSQLKAIFAKTGATRQSDLVRLVAGLAR

SEQ ID NO: 310 - protein, 470 aa, Methylobacterium sp.
MFGTLRVGLALLGAALPLQAFGQSAANLSALRGLVPVARLQTTPDGKAALDANLRVTGDIQTGALKQPTLLPFPEQQQLALRDCFITDGNAANLADGLGTTLARAYHAKATYSDYKTFTSIAPSVANLIGYTNNVTKSDSNSGKYFFANATTNGKHPVSEEAAAILSNGAVTDVFGKAYDRPAGSPGADRYGNSRPFQTLPRLLTYRGKDYFGDASDSLDWLRGPSQDLVNSPSYPSGHTTYGYTESMVLALLVPERYQQMVTRAAEYGNDRIIVGAHYAMDVLGGRATSLHALAHLLANDPAYVGQIRKNPAVLDKASAEADKTVGVTDYRALLTEARAAIGEALKAGCGDTVAACAAKDTGRFKDAAANAAFYAATQTYGLPVVHPDTAGRREDVGKVAPEAGHLLTAAFPALTLDEANAILTETQGPGGGFLDDGSEFGVYARLDLYTAGGKAAALAASRAGSSATR

SEQ ID NO: 311 - protein, 141 aa, Methylobacterium sp.
MPYWHVYTDAEGVSRQELFHLERFKFEGINPGTAPQWNDKMDPAPSVVTFTVLPVGWVGEWHENPRPQWIAVLSGRWFVETMDGHRVEMGPGELMMGEDQNTKARDGRKGHLSGTVGDEPCTMIVTGLQVEPTVNQPGRFK

SEQ ID NO: 312 - protein, 225 aa, Methylobacterium sp.
MSVAALQEWWLTLSDEVVTYGPGFLSATLVVLGVTVASILVSWVCGLLGALGKRSSFAPFRALASFYVWFIRGTPTLVQVFIVYFGMPQIGVKLSPVTAGIIALGVSSGAYVAETIRAGLAAIPRGQIESALALGMNPRIMMVRIVLPQVFRMILPSLTNEAISAVKNTSLLSTITVVELTLYAQLMIATTFRPFDFYIAAALIYLGLTSILSQLSAYFERRYAR

SEQ ID NO: 313 - protein, 129 aa, Methylobacterium sp.
MPNDTQRIEIITGRERRRRYTAHEKVRFVEETMQPGMTVSAVARIHGLSPSLLFGWRRRMAEGGQVAVQADDEVVAASRMRELEARVRDLERLLGRKTLEVEVLKEALAAARVKKAAWPLPSPPAGSSR

SEQ ID NO: 314 - protein, 144 aa, Methylobacterium sp.
MLATMTSLDAPVPANATLPAASSLIYVVDDDPAILHSTRFLLESAGHRVETFADGRALLAAFPGPNPTFVLLDHVMPGMDGLAVWGRLRHLAAGVPVILITGHPDPSIRSRARAAGIPLVEKPLAFDALMGMLAAGPIPASRAR

SEQ ID NO: 315 - protein, 135 aa, Methylobacterium sp.
MGDVLTFTPRSKPTTPEALPPLAGADLRASLEEAAQTALDAADRIIAVLDRMDGDADHEDGGDDEPSLAAPENTTGSQVVYMRGSDRDGEAEAAEAVLPVVQAEPQPVAEILPWRGRGNVIAAAGSFLVDLLERA

SEQ ID NO: 316 - protein, 83 aa, Methylobacterium sp.
MANVIPFRPRRKAVAVPDTRARIEGALALALDAVDHLVAALDEIDGDPDIEDSGDAEPSLGAPEGQASQIVWLRGGDRDLEGV

SEQ ID NO: 317 - protein, 78 aa, Methylobacterium sp.
MPRYFIDLHDGSQPIHDEVGFDLPDLPAARAKVTRIMSAIARDMLPEVERQDYVACVRDGVGKVVYRARLSLAAEMVE

SEQ ID NO: 318 - protein, 266 aa, Methylobacterium sp.
MLKEARGAAGRSTEAADYQDVPRPVAVMPKTYAAGMHLARHFHPRAQLLYATSGLMMAFAEDGTWVVPEGHALWIPPLLPHAVATHGAVAMCSAYLDPAAVRSFPASCRVIAVSRLLAAALTALAEEPVLYAEAGRGGHLAALVLDEIGRAPATPLALPLPRDARLRRVCLALIEDPASEADLDAWADRAGASRRTLTRGFRAETGLSFGDWRARARVIRALALAAEGRPPRAVAAAVGYRSAQALRTTVARVLGTDHPLRGAGSP

SEQ ID NO: 319 - protein, 696 aa, Methylobacterium sp.
MSTVTDPHPDPRPTLARPDDDPYLWLEEVDGPDALAWVEARNAETLARYGDAGFLRDRDIARALLDRPDRIPFVQRFGTWLYNFWTDGAHPRGLWRRVDAAGYRAAIPDWEILLDLDHLAATEGEDWVWAGATILRDALDRALVRLSRGGKDAAVIREFDLDTRTFVADGFVLPEGKGGATWLDRETVLLSSALGPGMATRSGYARTVRLWPRGTDPRDASVLFETAETSMAVWGASDRQTGTERITVVEQLGFFDAAVHIGDRGGLRARLDLPTHAGVQLHRDHLSVRLRRPWTVDGVAHDTDTVLAIALPDLVAGGRAFTVLWQPDARLALQRVFWSAGRLIVDVLEDLRPTYRVFEPGPGGWTERPLAGLPALGSVHLWPLDGDPERADGALLALAHDPVTPPALLAFPPALDAPAVLRRAPPAFDARGIRVTRHEAVSADGTRVPYVQVGPEAETGAAPVYLTAYGGFGLSRLPDYQPVLGKLWLERGGTCVTANIRGGGEFGTRWHHAGRREGKARAHDDFAAVAADLVARGVTRPGRIAAEGGSNGGLLIANMLTRYPERFGALACTIPLIDMRRYTKLLAGASWIGEYGDPDDPQDWAFLSGISAYHAAEAGRPYPPILLATSRGDDRVHPGHARKMAQKLRVLGCDVAFYEPATGGHGAGKDSEQTAAFRALGLTFLRRAIGWDDPVA

SEQ ID NO: 320 - protein, 257 aa, Methylobacterium sp.
MQAPEPTFETLRDAHVAALTGSLIDGVEHGPGGAGYVWSRSIPDPTVNFAFGVHRPDQFAWAGAAALGRARAPAFLARDDGEIALLRALFEPAILYPARWMVARELPAPAPAGSAITVQATPAPGPDFERVFAHLSDAPGVRTHLRRYYIPALRAARGRHGLVTLHLVLRDAAGPAACASLYLRGETAGLYNVSTRADRQRRGLGTAVTVAALREARARGVVQVFLQCPADGRTEALYARAGFRTACAPTLLCTTPP

SEQ ID NO: 321 - protein, 383 aa, Methylobacterium sp.
MIAHDTDALGWLDAQEGAMLALLEELVNIDSGSYDKPGVDAVGARIAAFLTGHGIPVTTIPVDGYGDALKASVAGSGGGNRPVVLMGHRDTVFPKGEPARRPFRVADGRAYGPGVADMKAGLVMNAFVLAAYHRAGGAPVPLVGLFTSDEEIGSPACRPIIEETARGARAVLNSEPGRPTGNVVTGRKGGVFMHLEVLGRAAHSGGNYADGRSAILELAHKTVALQALTDLDRGTTVNVGLVSGGQSVNTVAPRVTCEIDLRYVTLPEREAAMDRIAAIVAGSTVPDTTAHLTIKGEFLPLVQDEASRALFETYARVSAEGGNPVTGEFAGGCADSGFTASVGCPTLCAVGPVGGKAHSPEEYLEVGSLVPRARAMAETIAAL

SEQ ID NO: 322 - protein, 281 aa, Methylobacterium sp.
MSDTADTPREGASLHAPLARLLRPLVRLLVARGITFPALTDLLRELYVNVAEYDFALAGKEQTDSRVSLLTGIHRKEVRRLRGAGAPVSAVPAVVSRTSRIIARWIADPAFTDAQGQPLKLPRTAEGGAPSFESLVAGVTRDLRPRAVLDEWLDRGLAFTDPQDRIVLAEAAYVPRGDGAEGPQLYYFGRNLHDHIAAAVANIFGDAPRFLERAVHYDGLSKDLATRLEARAREIAMEALQQANREAHAACQTDPGGTHRWNFGLYVYTEAAPPARRADER

SEQ ID NO: 323 - protein, 283 aa, Methylobacterium sp.
MHPGYEPTTPFGRRPLSLGMMAAQAAAKACPDDAVGHKWRIFRDVTEAKDHLAVSDRALAVLSALLTFHPETALQPGSPLVVFPSNRELSLRSHGPSPATLRRALAQLVAAGLVIRRDSPNGKRYARRDGAGAIARAFGFDLTPLVARAGEFATLARAVRAAARRRLLLPEEIALHRRDLSKILALAAESGWPGPWAALADRFAACGGMPGRTAGEPHLYAAAEPLRALRREVDKWLPSLANATEMVGTASHGERHHQNSDPDPADDSERCPRRGPAGAARSD

SEQ ID NO: 324 - protein, 554 aa, Methylobacterium sp.
MSRDTQPGGLTRRSTMAGAAALGLVAGRAGAQEPAEATEATGIVSARDAAGGEPVPLPGVLVSNGREIARTDERGRYRLPMPGDGAVFVIKPPGYALPRDADNVPRHSYIHQPGGTPAELGLRYRGLAPTGPLPASIDFTLTRADEPDDFDVVLFTDPQPESRFELDHVRDTAVARAMAIPAAFGLTTGDVLFDDLSLYGRSNRIVGQIGLPWYSLPGNHDLNMQAPDARYSRETWKRVFGAPTYAFRHGRAWFVMLDNVEWLGPPVPVGANTYRGRIGDRGLAFLRNLLAEIPRNDLIVLAMHIPLHTETGPEEPRTHTTDRAALLDLLAGRKVLSLAGHTHTTEHHYLADGHHHHVLTAVSGSWWSGPDTRTGIPSADSRDGTPNGFHVLSIRGTDYTTRYVAAQGQPDETMRILFESELRAGAPEVVRWTRPVQGLRPPVPQDALADTTLVVNVFDGGPRTRLAFRVGDAPPRPMARTRRPDPFVTELYERYPETKKSWVKAVPSTHIWTARLPDDLAPGAHRVTVEGADEYGRPIRGRTVLEVTGERGRG

SEQ ID NO: 325 - protein, 498 aa, Methylobacterium sp.
MYAQVEAAGISTAVSDEREAVVIKPSYDPDLVNEDLAPLRKQTWGTYNIFAFWMSDVHSVGGYVTAGSLFSLGLVSWQVLIALLVGIVIVQIFCNLVAKPSQQTGTPYPVICRASFGVKGANIPAIIRGLIAVAWYGIQTYLASAALTVVALRFYPELAVYADVKQYGFAGLSGLGWAAFMTLWVLQALVFWRGMEAIRVFIDWAGPAVYVVMIALAAYLVAKAGIGEIGLTLGTVKYTGWDALPVMINAVALVVSYFSGPMLNFGDFSRYGASFDAVKKGNFWGLPVNFLGFSLLTVVTASATVPVFGHLITDPVETVSRIDSTFAVVLGAFTFMTATIGINIVANFVSPAFDFSNVSPRRISWRMGGMIAAVGSIFITPWNLYNNPAVIHYTLDVLGAFIGPLFGILIADFYFVKKQKVVLDDLYTMSPTGTYWYNGGYNRAAVTAMIPSALIPVLCVILPGLEGVANFTWFIGCALGFAIYTALMRRPAGAARPA

SEQ ID NO: 326 - protein, 91 aa, Methylobacterium sp.
VSWAIEEKGYSQRRACGLIGLEPKTYRYASTRGDDAVVRVCLRGRAGERRRFGYRRLLILLRREGLTLNHKKLFRLYRETRLSVRKRGGRK

SEQ ID NO: 327 - protein, 602 aa, Methylobacterium sp.
VSGPDTALDSPRPAGGIRGARPLRTGDALARLGFADIDPVPAAGGAGRAGGLRGAGPIRRGDPLSKRGFADVLAAGAPADELMKPGALRGAARGRDLDSLSHTLFLRIYPVIGALLLLTQLGIAWVTYTDQLRLYGDRAHLLARLTAAAIARPDWARDPDAYDGPLKALAAEPDFAHAVLRDAAGHVVGTAGAAPPARGWSTLSAQADLSVPGRAGPAGSLTVTVSTKALRDNAAWQVMLALGASVGLMIAFVITLHATVRRHVMAPLMRLLLAMREIEHKRWTTVELGGAYRPSNEIDVISQAFNRMVEGLRSGDAAKQLLVELEQAHDRLERANRQVVESIGYARRIQDSVLPDRSALAGAGVEVAVLWEPLHVVGGDYFWLEEIDGLCVIAVADCTGHGVPGAFLTLIVATALDRLLHERGLRAPAAILAGLDAMVRTQLRQDGRGAESDDGLDCGLCVWDRAAGTLHFAGAGLSLTVVRDGVAERVRGGRRGLGYPRPARDGQPEDVVADIAVPVAGATFYLMTDGITDQMGRAAPDRAPRLLGRRGVADSLLRHADLPLAAQTAALEADLDAYRGTEARRDDMTLVAFRLSMATAAG

SEQ ID NO: 328 - protein, 281 aa, Methylobacterium sp.
VSPHRAPAHDLLSEPADAFSLFDTEEAVLGRSEVMLVRLAEVGDGVRELAGAYRRSYHEQRRLVRLSDRMQLDLHRANQRMAEQQRALRHLNDALSAEIEHRARLEAELRRLADTDHLTDALSRRRFLQICEEVWARTQSGDTPSSVLMLDLDRFKLINDRYGHSAGDTVLKAFVETCRDSLRAVDVIGRMGGEEFAILVTGTVMAEAQTIAEALRRAVAQRPVRLEHGPLPISVSIGLAAFGPSESMSATLRRADAALYAAKHAGRDCVRCAAEPGASLT

SEQ ID NO: 329 - protein, 129 aa, Methylobacterium sp.
MDRITLPRTERSPEVDFDFASGRLVLRGESYPEDAAAFFGPLLQALRGHLAATEASPITFDVALAYFNSSSAKALMNLFMPLEDAAAEGRPVTIRWMFGADDDVIQEAGEDFAADFAHARFEMIASVPA

SEQ ID NO: 330 - protein, 184 aa, Methylobacterium sp.
LRASDFRSFHEASKRSGVILSFGGDLSENILFSLGEVLKLRMRHEETDAAVAKRVFSIFVEQAQNVIRYSADKVAPAEPPGPARVSAGMIAVGTEEGRFFVVCGNEVGRTEVPRLRERLDEIATLSSDELRKVYREKLRQPPDEGSLGGSIGLIEIARRSSAPVEYDFQDLGAERSLFCLKAFI

SEQ ID NO: 331 - protein, 205 aa, Methylobacterium sp.
MDRIMYALVTLAEAVLGIFGVRALYEQPAYTVVERLDRGVEIRSYAPRLAVETDARGQGDGDAFGRLFRYITGANRAGDRIAMTAPVESGGQRIAQQIAMTVPVERDGSGTMRFFLPRAVAAAGAPAPTEPGVRLVEVPAERIAALRFSGRLTPEARAAQAGILAAVLAAAGRAPAGAPFVMGYDPPFAIPFLRRNEVAVRLPPP

SEQ ID NO: 332 - protein, 107 aa, Methylobacterium sp.
MTQCLTETAALETRIGSQIRSRGGWLARMAGPVLTVAAEVRAGLSRAAMNRRVLQRLSTLSDRELKDIGLTPQDVADACVPGTGDAIHLLVGRRDERRHARAAARPW

SEQ ID NO: 333 - protein, 509 aa, Methylobacterium sp.
MSRAAARCCLVTVLLLASAGPGPRAAEAPQRTAAADAAFLDALTWGATPSTFAQLTAEGRARWLDAQLHPPAEPRLPPAAQAQVDALTPPGSLFERAQALDAQAKAAKDIADPEARKVAQQAFQAALNTAARNAASVWVLRALYSPDQLRERLTWFWFNRLNVHQGKSTLRAAVGDYVEMAIRPHVLGRFRDLLMASLRHPAMLRYLDNDANAAGRPNENYAREIMELHTMGVGSGYTQDDVEALARILSGVGIDLKPENPKLRPERAADFRRDGLFEFNPNRHDYGDKVFLGTRIRGRGWPEVEEAVDLIARNPATATNVSRALATYFLGQPPDDALVARLAAVFTRTDGDIAAVMEALVGEPAFTAERGGAFKDPVRYVFSALRMAYDARVIRNAGPVLGWLNRLGEGLFNRSTPDGYPLDAAAWTGPGQLATRFEIARQIGSGSAGLFKPALPDQAEEPAFPVLANGLYFSALSGTLSAATRAALAQAVSPQDWNTLYLASPEFMR

SEQ ID NO: 334 - protein, 395 aa, Methylobacterium sp.
MNRRDLIRASAALGLSTVAGRVWAAPKADARLLVVFLRGAYDAANVVIPTGSDFYYRSRPNLAIPKPDASDPKAALTLDADWSLHPALRDTLLPLYAKGQAAFVPFAGTDDLTRSHFETQDTIEMGQTVGAARDYNSGFMARLAAELTRVRPIAFTDQMPLIFRGGETVPNIAINGVGKPGIDDRQARLIAAMYSDTKLAAAVTEGFRVRDAVYHTISDHAGQADRGAVSPKGFELSARRIGRLMRENFNLGFVDVGGWDTHVNQGAGTGYLADRLGELGRGLSGFVEEIGPGWSDTVVVVLSEFGRTFRENGSRGTDHGHGSVYWILGGGVRGGRIAGPQVRADEAHLFQNRDYPVLTDYRGLLGGLFRRLYGLDQASLRRIFPSADPADLALL

SEQ ID NO: 335 - protein, 208 aa, Methylobacterium sp.
MYQPPHFRDDSRAAQHALIRANPLGLLVTAGAGGLTANPIPFLLDDDGPHGVLRAHLARANPQGEDLAAAEECLIVFQGPQGYVTPSWYASKREHGRVVPTWNYATVHAWGRPRLIEDADWLGRQIADLTALREASRAEPWAVADAPAPFVAAQVRGIIGIEIPITRIEGKWKMSQNRPEADRHGVIAGLRAEGEAGLAGLVAERSGL

SEQ ID NO: 336 - protein, 233 aa, Methylobacterium sp.
VTIRALVFDVFGTLVDWRSGVAREAARLLAPVAPDLDAGAFADAWRARYNPSMETVRSGARPFVDLDTLQAESLPDVLAQFGIADVSEAVRGELVQAWHRLDAWPEVPDALRRLREKHLLAPNSNGHVRLMADLARRNGLIFDAVLGAGYSRDYKPKPALYRDAVAAFGFAAGETMMVAAHSNDLAAAASHGLATAHIARPHEHGPAGGETAPTVPVTHAARDLADLADRLGC

SEQ ID NO: 337 - protein, 226 aa, Methylobacterium sp.
VPHWLDLMLQSLGPLLAAGLRFTVPLTLITFALGLALGLGTALVRLFAPRPLAALAWFYVWIFRGTPLLVQLFVIFYGLPSAGILIDAFPAAVIGFTLNVGAYTSEIVRAAIASIPKGQWEAAYATGMTPVQALRRTILPQAARVAVPSLANSFIALVKDTSLAAAITVPELFQAAQRIVAVTYEPLILYIEVALIYLVLSTLLSWLQTLLERRLGRYGGYLEARA

SEQ ID NO: 338 - protein, 305 aa, Methylobacterium sp.
MSRSLERLTSEVVSARAAEDQLRSGSVAVDLDPGLVDPSPAPDRLPVIDGPGEDAFVAVIRAQGQQTPILVRPHPTVSGRYQVAFGHRRLRAAAALGRPVRALVRTLTDAELVVAQGQENNARADLSFIERAAFALTLERLGHGRDVIMAALLVDKTELSRLIAARRALPDSVIAAIGPAPKAGRRRWMSLADRLASPEMRARVDEIVAADAFATLSSDQRFVRVYAAVAPVPAPAPPVVRAGPEVGLAEDGRHLARVERTPTTVGLIIDETLHPAFGDFLVARLPELFAAYEREQARGPERSGL

SEQ ID NO: 339 - protein, 514 aa, Methylobacterium sp.
MGKHRGKHWRWAALAFCAASITAGAGPAVAQVEATAPDGGPAPVNPGPKASPAQKARYRANRARRRVIREARSFSGASSAAASLDAQGSSATPPSLPPGTLDLGNGISMVLNYTGEFAANPSGGIRQGSAYAGQIAFGLDADLGRLAGIDGGSVHTVVTQRHGRSLAQDDIGFNGSVQEIYGGGQTAHLTLLSYQQKLLDNRLDIEVGRLLANPNFLASPLYCNFQNNATCGAPKSIFKLTNFTYWPIATWGGHAKAWVTDRVFLHAGIYEVNPRDQLPTRNGVDWSTSGATGYLVPVEVGYSTNFGNDPLPRNYSIGAVFDRSDYTDPVLDRRGAAQVFSGLDPLTRFGRSAVYARFDQMVWRPDPNGVQGLSVFGVAIGGTGGRQTQDYFLEGGAVLTGTFPGRPYDTLGLVFAMEKLSPLGTANIQAARVAGARHPERRVPADHPGAELRHPADPGGAADAEPAIRDRPGPDPLPVPPEADPGRLRDRREAVGGPVHPGRPREGPGQPVTP

SEQ ID NO: 340 - protein, 82 aa, Methylobacterium sp.
MTRAALLLPLIFLAGAARAGEAPTRARLCPENLPEGVRLPPQPGCDASARPPTPRRPGHFDLGDGTSIQIGGSASALYGVRR

SEQ ID NO: 341 - protein, 123 aa, Methylobacterium sp.
VPVGKKAVAVVDDDEAVLDATSSFLEALGYDARAFNSGEAFLAAMAGSDVSCLLTDVNMPGISGIELQDRVREQRPALPVIMMTALTDDALRRRALAGGARDLLRKPLVADELIRCLEETIGA

SEQ ID NO: 342 - protein, 291 aa, Methylobacterium sp.
MARRFTVIQGGLTERPDRAADPEAGAGAESGVESGTWRVDLRRPGAVDAATVAAWRAMLVRNAVTDPLRDPDHLLPLAQHRPAGRPVAVALAWSRDARDGHETLRGVVPLTMPHPVWGRRARPWQPAEPDAAALVERAAAEAVDRALRERLGALRRPLRLVGQSAPAPDPEPRRPVLAASRPARARPIPAGNLLGVRPEGWEPAETEMLAVTEPEAVRDAVETFLALDARTAARPIIADPAEASLVRVVTRLFARRGALRVEFRRRAGAVVAGTLHLCAGANAVPWRRARA

SEQ ID NO: 343 - protein, 81 aa, Methylobacterium sp.
MTENRRGTFRKNAFTFGAVLLDGGEVSCLVWDATDVGAQIEVEDDQAVPDRFALRVSTGTEPRPATVAWRRSRRIGIAFDG

SEQ ID NO: 344 - protein, 374 aa, Methylobacterium sp.
VTVPNSRQPFQSSSAASAPLASLRRGSGQLFESERRLNAVLDNASVSIFLMDDRQHCIYMNRAAEQLTGWTLREVLARDCPLHDIVHHTYPDGRPFPLEECAIDRAFPENNQERGEEVFVHRDGHFFPVAFTASPIRDDATNIIGTIIEVRDISEEKAAAERQRLLINELNHRVKNTLATVQSIAAQTFRGQTDQTTRAVFDARMAALSNAHNVLVEDNWESASLRGVIERALAPHLLAEVDAGRFRLQGPDARLHPKVAVTLAMALHELMTNAAKYGALSTPEGQVAVTWSLHDRDDGRQQLDLLWEERGGPPVTPPTQKGFGSRLIERQLPLEFDGSAAITFAPAGATCQMRIPLTRLGWIGQEAVEGPRAP

SEQ ID NO: 345 - protein, 152 aa, Methylobacterium sp.
MTPLAGRRVLLVEDESLVAMLAEDMLLDLGCEVVVAMRLDQALAHARTEAFDLAVLDVNLGEARSYPVADLLLARGTPFLFATGYGQHGLDAAYQAVPVLQKPYQAAPLEHLLLRLLSSEGPHRTGPTGLPPACRCRASEPAHGQFSADPIR

SEQ ID NO: 346 - protein, 310 aa, Methylobacterium sp.
MIDLAGVSRVFEGRTVVADVTLRVETGAILTVVGTSGSGKTTLLRMINRLIEPSAGTVRIAGRDVREVPPHLLRRGIGYAIQGHGLFPHRTVAENIAVVPKLVGWDRRRIAARVDELLGLFNLDPAIYRDRLPAALSGGEQQRIGVARALAAEPPILLMDEPFGALDPIIRGRAQADLLAIQARYGTTIVLVTHDMTEALHLGDRVAVMDGGRLVQEAAPADLVGAPATAFVGALLGSGDRAFQLMALRVVDDLVEPGPAPGPPIPAGTSVRAALAESLWSRRPALPVSRDGVVLGRVTREALEARGARP

SEQ ID NO: 347 - protein, 481 aa, Methylobacterium sp.
MQDARQDGITAMGAVDLAAAIRGRVVSCAEVMRAYLERIHRINPQVNALVGLADDAALLREAEAADVALARGDVVGPLHGFPLAVKDLDPVRGLPFTQGSPIFADRVADTDSIMVTRLRAAGAIFIGKTNIPEFGLGSHSFNPVYGATGNAYDPGKTGGGSSGGAAVAVALRMQPVADGSDHAGSLRNPPAFNNCYGLRPSWGRIPAEAKDVFSPNLGVLGAIGRTPGDIGLMLSVLAGYDPRCPNAIRQDPSAFASPLARDFRGTRIAWLGDCGGQIPFDPGVLDVGRSALATFAEIGCTVEEAMPRYDMETLWQDWLVLRALTVAANLRPFYDEPRHRALLKPEAAWEVERGLALGADRIIAALEGRTRWYETLRRFMESYDYVVMPSAQVFPFDKALRWPETVGGHAMDTYHRWMQITIPATMSGLPALAVPAGFGEAGLPTGIQIVGPNHGELACLQLGAAYDAASSWVRRYPPPVE

SEQ ID NO: 348 - protein, 738 aa, Methylobacterium sp.
MSDKAVTVIDPATDAGHHPLLICLVIVARHHGIQLSTKQIIHDNQLKPGSVSASDLARCARRAGLTAKRLTVGWRHLVKLQKVLPSILLLRTGTAMVLTRVESNDAVEQVVLRDPLAPEDAPLVLDRVQLEEVWDGAAILIKRDYSIRDEEQPFGFGFLASLILRERRILRDIVIAAVALSLLALVPILFYRLLTDRVMMHHAMNTFTALCIGLAVLVTFEVAFTALRRTLLLHLTSRIDVKMETYIFDRLLRLPVDFFEKHPVGFITHKLGEAYRIRDFLTNQLFGTVLDSVCLLFFIPVMLVFSVPLTLVVLASCGLICAWTAVMLPAYRRRLGALISAQAARGSFLVQTLHGIRTVKSLALEPRQAHGYDVHVARIARLRLREGNLATVIQAAIVPVERFMISGTLAIGVYLAVTSADPAAVGEIFVFLLLAQRVAAPLRQMSALVEQYDQARIAVASVADMLNRPGEEIRPGQGVRRQLVGEVSFSDVLFRYPGATTPALDRASFIVPAGTTLGIMGRSGSGKTTVTRLLQRLHAEYDGLIKIDGIDVREYALDHLRGSLGVVLQDSFLFAGTIRENITAAKTDATFDEVVRAARLAGAEEFIDRLPRGYETYLPEGTTNLSGGQRQRLAIARALITNPRILILDEATSALDPESEAIVSANLKRIAEGRTVLVISHRLSSLVESDAILVLERGRVHDRGTHAELLDRCDIYRDLWTQQNGAAGRQTSPLRLVG

SEQ ID NO: 349 - protein, 213 aa, Methylobacterium sp.
MGVSEQREQYGVPKPRSLGGQTCPKAFQSALDELDVIGQWEWDAATDCARSDAFVALLFDVDPQQAEAGVLLTHYVEAIHPEDRVRVLDLIRRSASEGSTFLTEYRVISVDRQTRWVLARGRFTADHQGRPIGGGGILVDITSLRMSEGTFAEVTRCPDETALDRAADHAIAAQEAIVELRDPELKAQADALLISLGRKLAQQEVQDRRRTMN

SEQ ID NO: 350 - protein, 165 aa, Methylobacterium sp.
VRADAFVALVYNVDPAEAEEGVPLGRYMSSIHADDRERIDDLIRRSAREGTPYLAEHRVTSADGRTRWVLVRGRFTGDHVGRPQGGSGILLDITRMRMFEDMADEAVPHAETSPLELAADHAIAAMYAISELQDAELKMQADALLMTLGRRLALQEIQDRHRHMN

SEQ ID NO: 351 - protein, 352 aa, Methylobacterium sp.
MIPAMTLLRRLEGPQTLGRGPAFWTAFALAVAAAVAYPWFADGYTVGNTAYFFCWVFMALGLCLIWGYGGALSFGQTAFFGLSGYAYGVLTLNVGAAYGFTLAAVVLAVALSAVMAALLGYFLFFGRIGGVFLGIITLSVTLALERFMAQTAGPEWKIGAARLNGYNGMSGMPPLTVPWLDGDVVLFPDVALYYGLLALLIVVYLALRILVNARFGNVLVAIRENPERAEMLGYDVRRYQLAAFVIGSALAGLSGTLYTAWGQYITPSSMGLTAAALPVIWVAVGGRGDLTATLVGTLVVLGGFQALTIYGSQYALVVMGLLLVVVVLAAPDGLVVAAMRGLGRLRGREAGR

SEQ ID NO: 352 - protein, 148 aa, Methylobacterium sp.
MRPAPARVGPDQENQMSDESELFGQGFENRKTVLGAAHVEKSWANADAFNRPVQRLVTEYCWGAVWGDETLPFKTRSMLNIAMLTAMNQHHELGVHVKGALNNGVTKDEIQAVLMQALVYCGAPAALAAFRTASAAIADWDREHASGR

SEQ ID NO: 353 - protein, 401 aa, Methylobacterium sp.
MNPALDATVSVLPGLATGRADVDAAVARWQRFAPLLARLFPEEGAGRIDSPLVPLEEHLFRKVLDGADGRVLVKADHALPVTGCIKARGGVYEVLAYAEDLATRAGLLAEGRSYAAFADPEFRALFARHVIAVGSTGNLGFSVGLMGRSLGFAVEVHMSHDAKAWKKQRLRELGARVVEHRGDYGAAVAAARGAFADRADAHFVDDEDSVDLFLGYAAAALDLQRQLAEAGIAVASAHPLFVYLPCGVGGAPGGVAFGLKLLFGDAVHPVFVEPVASPCMLVQLAAGLDRPVSVYDVGLDNRTAADGLACASASMLVARTLEKLVAAVVTVPDDALYRWLRVMWTEAGLRLEPSAAAGFAAAGRFAATLPAAVGAAATHVIWTTGGAHLPAEEFEAALARG

SEQ ID NO: 354 - protein, 277 aa, Methylobacterium sp.
VLGAGALLAALGTTAPRAADLGADLPRTTPTFAMVDPNTWIVTLSGSIQAVPRYPGASDYTAVGYPSIDIRRVGEPRRFSTPDDGFSFSLFDTESFRIGPTARFVPGRYYGDDRRHLYGFRDARFAVEPGVFAEFYPVSFIRTRVELRQGVYGHHGTVGSVAADYLIPAEKFLFSIGPRLNVGDASYARKYFGVSPIEAALNGRVTPYDPRSFYSAGVLGGVTYTQSETWAYTAYAGYTRILGASGNSPLVRRPFGNPNQYQFGLRIDYAFRMPALF

SEQ ID NO: 355 - protein, 398 aa, Methylobacterium sp.
MDSDTLSRRTLRFVNVAHALDHFVLLIYPTAVIAIAAQTGLGYGELIGLATGAFVAFGLCSLPMGSLADRFGRRNMLAVFFFGYGLSCLGVASASTPLGFALWLCVLGLASAIYHPVGSAMLVTHARRLGHDLGINGVWGNLGAASASGLTALLAATVSWRAAFIVPGLVCLACGAAFVALVPGDGDAAGRKTGGAAVIPVTRPWALMAMFALSIFAGGLTFNLTTISLPKVIDEGVGQALPLALTGSIATGVFLFGALMQLAMGRLIDRYSLPSLFVALSVLQPLGLGIAAVSTGLPLLAGLVLAMTAIYGQVVINDAMIARYVPPAYRARAYSVRYFVGFTASGFVVPAIALLHDRGGFALVLGVASACGAVIWLSALGFLRLTQGGARPALAAAE

SEQ ID NO: 356 - protein, 322 aa, Methylobacterium sp.
LGLSVFAVGLAVLAIITLAAGVKIVPQGHVYTVERFGRYARSLDAGLGLITPFVERIGRKVNVMEQVIDVPSQQAFTRDNAGVTIDAVVFYQVLDAARASYEVSSLDLAATTLTMTNIRTVVGSMDLDQLLAHRDEINERLLRVMDAAASPWGVKINRIEIKDIVLPADLAGAMARQMKAEREKRASILEAEGQRAAEILRAEGRKQSAILEAEGRREAAFRDAEARERSAEAEAAATGMVSRAIAEGDIAAANFLVAEKYVDAVRAIATAPNQRVVVVPIEAAALAGTLGGIGELTRTVFGDGAAAPRRTGTPPNVAAPRA

SEQ ID NO: 357 - protein, 444 aa, Methylobacterium sp.
MAKVFRAWDVDQGWLLPPSLHEFVPPGHMAHFVRDTVREALDLSAILDTYTEERGYPPYHPGMMVALLLYGYSRGLYSSRQLARACEERVDVMAVTGLNRPDFRTIADFRKRHLVALSDLFVQVLRLCRAAGLVEFAHVAVDGTKLKANASRHKAMSYGRMKTAEPALTAEVQAWLDRAGEADAAEDQAHGASRRGDETPDWMADKQRRLEAIRAAKAALEAEAADPPDPEDESGPGASSGMRWQGRPLRGEDGSPPDRAQRNFTDPDSRILPTRDGFVQGYNGQVAVDAAHQVIVAYRLVTNSADHRALVPLVDGLRAHLGRKPREVSGDAGFANEANLAALKERGITGYLAPGRARHGEADAAGRRRLTKMPLMSAMAARLKRAGRRSRYRLRKQVVEPVFGQIKQARGFRQFLMRGLDQVRGEWAMICTAHNLLKLAQSGR

SEQ ID NO: 358 - protein, 351 aa, Methylobacterium sp.
VRSGSRLSERWFTLALWLVALVFAWFLIGLGSLVVGDLPQVEHRYTLDQFLDTDQGTASAEALKQIRREQDDNRRTIEQDQLALEAAQSASEGARETFANWLKTRDATQRVDQDPGLIARTQQLDALKAAERAIEERLAALARTGLDLSEREAAQLRVDTDLRAAAQTRLDAAERGQELRVFGYRLALTLPLLALAGWLLLKRRRTRNWPFVWGFAFAAAFAFFVELVPYMPSYGGYVQYGVGVIVTLVAGRAAINALHAYRARQAVVEARPDAERRTEIATDQALARLAKKACPGCERPIALDDASTNFCPHCGLGIFAHCPSCAQRKSTFERFCRACGTRSPDLASEAP

SEQ ID NO: 359 - protein, 336 aa, Methylobacterium sp.
VRATLNRRFVLRLLAGAATVLPGTVRSQESPRDQGIGGTGMMRTDEPKSGPLGEGDRGIGGTGVIGTIRRFGSIVVNDLRIAYPPEVEVRIDGTAAKAADLKIGQVVHVVARPEGGGLATGRIDVTSEVVGPVESVAPGRLVVLGQRVSTAGLGGAWQPGARVAVSGLRRPDGVIVASLIEPRDTGPDRVAGPVRRVAGGLGIGGLRLAGADALPPGRRALVTGRAANGVLTVTNAAQVGLPFPPGLKQVSIEAYIGRGSGGLDVGAGYAVAGRPGAQVPRTGSVRAVLTAAFARDGDLTVERLRIENRIAPEPQRPDAPRFERERDRLDLRNLPD

SEQ ID NO: 360 - protein, 217 aa, Methylobacterium sp.
MNGIASASRLHPWPVRVMHWTNAVAMVVLIGSGWGIYDDSVIIHGVYFPKAIRLGSWAAESLLWHFAAMWLLVANGGAYLVYGVATGRLRERLLPIRPRDIVQTVRDTLRLKLAHEDLTTYNAVQKILYIVAILAGIGQIVSGLAIWKPVQFSGLVALLGGFQGARLVHFAGMAVLVGFLAIHVVLALLVPRTLWAMLTGGPVRRPILPAAAREATR

SEQ ID NO: 361 - protein, 257 aa, Methylobacterium sp.
MRSPFRPRTVPDPGILDDHRPLVRQIERRGLLRGGLTLGALTLLTGCDVTDTTAVGRALRVVSDFNDGVQAALFDPHKLAPEYPASQVLKPPRFNAYYDVEDVKPVDGEAWRLELAGLISDRRPWTRRQIAELPEREIIVRHVCVEGWDYIGQWSGVPLRAFLERVGADLTAKYVAFKTADDYPSSIDMASALHPQTLLATRYAGHDLPDPYGYPLRLRTAVKLGFKNPKWITAIEITNTYPGGYWESRGFSWFAGL

SEQ ID NO: 362 - protein, 283 aa, Methylobacterium sp.
VPAERRTEPSTLRVTEIGPDDRIVAFDAAGLWQYRDLLYVLILRDLKVLYRQTALGACWAIAQPLFTVLIFTVIFGHFAKIPTDGAPYALFAGSAVVLWTYFSEAVRRSANGLVAEAELIRKIYFPRLVIPLATVVSPMVDFAIALGVLLVLMAWYGAVPDWHLVLAVPTLIVTAMLALGVSLWLGPVNVRFRDIKHTLPFLIQIWMYASPIVYASSIVPASVRWIYALNPMVGLIEAFRFAILGGTPPDALALAVSVAAAVGLLVSGLIFFQRMERSFADVI

SEQ ID NO: 363 - protein, 461 aa, Methylobacterium sp.
LRGLVTDLIGGPSYAYASAFFRSVSAGEGRRIVVIGRDLRDSSPGIAATVADAAAAAGFTALDCGALPTPALALEAMRRGAYAVMVTGSHIPEDRNGLKFYRPEGEITKVDEAAILAALEESASGESQASTPATPEPDAIARYRQRYAAAFAPDILQGLRIAVYQQSSVARDLMADLLAGFGAQVTPLGRSQVFVPIDTEAHRPEDIAFIRDVMEPGSFDALVTTDGDADRPLVADGAGRILRGDVLGLITARFLAADTVVVPVTAGSALEQSGGFRKVVRTKVGSPFVIAGMEEATSAGARIVAGFEANGGFLLGSDVTFHGRTLAALPTRDAMLPILATLAAVRATGTALADLVASLDAGEMASDRLPNIPSETSAAFLDRLRDADFRAAFLASIGSSGSIDQQDGIRIELDGGRTIHFRASGNAPELRCYAEAKTAQEAHDLVRWGLASAATAMPAKA

SEQ ID NO: 364 - protein, 42 aa, Methylobacterium sp.
VSDGLFAALDIGLVFALALGVGVWQLVTVRRSIRRDRDGKAD

SEQ ID NO: 365 - protein, 382 aa, Methylobacterium sp.
MPSRFTLTTAILLALTATGARAEAIRIGVNEPLTGPFAASGTYVVNGAKIAADEINAKGGVLGKRIELVIEDNKSNPTEAAAVAEKLITSDKTPVMMGAWGSSLTLAVMPKLADYETPMLVETSSSGKITTSGNPYVFRISPPSSLEAETFAPMVGRLGLKKVDFLVLNNDFGRGAATDFGKMLKDKGVTVGLVETMDQGAQDMSAQLAKLKASDSDTIMITSSVDQLVLLFKQMAALGLKKRVITTGGSQNPDQIIAQAGAAADGTMHLTTFLPWSPDRTPDPKATEAFIAAWKTRGFDFAGVTESFRGYDGIRAIAHAIEKAGSADPAAITKAFWSVDFVGLNGPIRFAKAGPAGKESGQSKPDVYLIEIKDGKVMVPTL

SEQ ID NO: 366 - protein, 76 aa, Methylobacterium sp.
VVDWLMAAKFSQHVALTAPLARYVAEQVEKGEYATASEVIRAGLRLLIERDEDRALAKVGQGKQPAAAAAPSRGQA

SEQ ID NO: 367 - protein, 408 aa, Methylobacterium sp.
MTASLAIPDSPARARRGRRWGAIAAAGGAAIAGCAWTAAALINVPDPVTLTALAVIEPSSVGTWFPSRIVQAPARASDLPARPRPILDRVPWKGKTVPLMTVLEATHTNAFLVLQDGVLIHEWQRAGTGPETLFPSWSVAKSIVSLLIGAAVARGQLAETDRVSTLLPELRNGAVFGQITVRNLLDMASGIAVPENYDPRHPLTGTAGMYLTRDLTAFVRDNAHLAFKPGTKGRYRSIDTELLGLILARVEGKPLADILSERIWKPMGAQADATWNLDRPGGIEKAFCCINATARDFARLGLLVADQGRSGDHRIIPGRWIERIMTPARRDVDGWQYSAQWWHAPGGEDDDISAIGVYGQYIYVNRATGTVIVKLSDHGAEQDEVDTLAVMQAIAGDLAAGRPAARKD

SEQ ID NO: 368 - protein, 175 aa, Methylobacterium sp.
SAEAGVAAGAARAATDAATDAAAEARHWPLAERPGFLARRMHQIHVSLFAERCAAFRVTPLQYSLLSLLRDLGEADQTTLASAVALDRTTTTGALKRLAARGLVSRTTSPLDRRAQVCRLTDEGAALHGAMEPAARAAHALTVEALTPAEQDTLTRLLRRVIAGHEHRRGQPDIL

SEQ ID NO: 369 - protein, 440 aa, Methylobacterium sp.
MPPLWMLLVGRAAVRRHWHLIAATGLLWSSLGLLVVIDSLDGALHVPERWFGLILLAEGVSSLVVGASAIGAARRLRLAKGALLSVMAVLIMMATKHSTFLLAMIFGVAFVVDGLVRITIAGLLKFAGWRMSVALGGLSIAFGLFHLQPWPTWYAGTVGYCIGMFLILNGANLALVGLRTRRLGTAEPAVSVSGDEPGSLTVYVWTPTGQATTPAGQRLIRRYVASVDKAGRFSTGHAALQQGDDLYVSHYPAVEIDRSPANLRSSLRAGPENDVPGRFLPSHAAEVADWCPATVAVTLNGIDAARLRAFWAQYSRDTTYNFISRNCSTTVARALDIAVEGAFSRGGHPWRRLAAALTTPEFWAAAFLRNGARSMTWTPGLVLDYTRALSALVDPASPVPSIAWKRVGWRLLRNWRARDLAPLSPIARQPSVPGAGPTEA

SEQ ID NO: 370 - protein, 432 aa, Methylobacterium sp.
VRTLRQTGFARRHDPAARTGPVLRALLRAESVALSVWALLLVGVSGGLLWVLGLNYEGITGSAASKIHPATYLAVVLIGWTLMRAGNPVIPVAGALNRRPASVLLAACGVLLLALIAARGGAGLAGSIDTFVLAGLVPILLMDRDAETLGRLETIFHLVMLANALLGLFELASGQRFFPYRFDGVAFESDTRSAALQGHPLANATMTACYILALAKGGGRLAPMPRAAMIVLQLVALVTFGGRSATVTTLILGGAVGLVALNRTLRTGRVPLAAAACACFAVTLLPVLVAVLASAGFFDTLLDRFVSDGGSAQARVDMLTVFDAIPFRQLLLAPDFLQVNTLRRIYGLEWGIENSIISAVLYHGILVTGVLVIAVGLYLAEIARDCRRGVWLPILAFVILVNTFEGLAGKTTLLAKFALMLIVLFPPLPRRG

SEQ ID NO: 371 - protein, 409 aa, Methylobacterium sp.
MDIVRPRIDGAERRVETLEAENIRLRSLLSQATAQADWERQRSRRLGRIIETASRVEAGRMAAERVEAPLGPSPRGPAGLGLEARPRHSGRARAIGLPQAPNDYLELLDRDGRLITASEDGPALSAAGDEADAIGRPWIDAWTRPEDREAVAEALDRARIGRPSRFQAQSESGGALRWWDVAVTPIGAAPDRPERILAVSRDITDQKLSEARQTLLMQELAHRMKNTMAMVQAVATQTMRNAPSLEAAGEALAARLLALAKAHDVLLQGSFTRASLSGLVEGAVSLHGDGVAGRFRIAGPDLTLGPRHGMTLALMLHELGTNAAKYGALSVAAGWVCITWNVAEGGQTLRFRWEESGGPPVTPPTRTGFGTRLIARSLAHSFGGTAHMSYPREGAVLTFEAPLDAVMVA

SEQ ID NO: 372 - protein, 574 aa, Methylobacterium sp.
MARRSSAKPDGRPERRRDILRDRGGNVALLFAFLSVPMVMVGGAAIDYGFATRLETKLQSATDATALLLCQTPLTTTEAELNALAQTTMTGAMGAASLVVDRLAITSNPRKITLTAHKQSTTFFGGLTGTQRINPGAVSQCATPLPKTFEIALVLDNTGSMAASSGGQSKLQAVQTAATDFVNYVYTSPAFSSASKISIVPFAASVAVNPATYRYASWIDQAAQSSYHWLNVNGLQGTGITNRFDIFSKLQAANSGWAWAGCLETLPYPLNVQDGAPTASNKDSYYLPLFAPDEPGDGSSEYSEYSTKTSSNISFNSYIDDYTNSPDCPKPTRDTSFSTAEGRACKYLSPRDPSPTSRNRYTGIPNGPNSGCTTQPLQRLTSDTTTLKSLINLMVASGSTNIHEGFMWGWRTLSPNSVFADGARYSSNSANSDLSTINKIMILMTDGENTWPVNSNPSYNKSMYFPFGYFTNADGSNPNSRLPPSNQNISNARTARDALDKLTALACSNAKTNNISIYTIGFSVPADPIDSAGQTLLRNCASSPDQFYLANSSDDLIKAFKSIQASIGALRLTQ

SEQ ID NO: 373 - protein, 549 aa, Methylobacterium sp.
VSAVAGQGSAAAPGRRPGAGKAASGKAPGGHNPWLIAGVVALATFMEVLDTTIANVALRYISGGLAVGPDEAAWVVTSYLVANAITLTASSFLAKRYGRKAFFMWSVALFTVSSILCGFAWSLESLLLFRVMQGLGGGGMAPLAQSILADSFPPEKRGQAFALYGVAIVVAPVIGPTLGGWLSDNASWHWCFLINGPVGVIALGLMYWLIEDSDAAKKERRALVRKGIRFDIVGFVLVALFLGSLEVILDEGQRKDWFGTSTLMNVSGVLMVVSFIAMIPWLLTRENPAVDLRLIGNRQFGSCFLVMMFTGAILIATTQFIPQITQEYYGYTATLSGLVLGPGGIVTVVMMFLTGRISSYVQPKWLIATGMTIVALGMYDLTRIDGSTTFAFFAWSRVYIGIGLPMVFLSITSASYEGIRKDQTDQASALINVARNVGGSMGVSLAQNILAYRSQFHQSRLVESVNPASPAYQETMRQATQYFSEHGYAGIEAQNQATAWIGSVLSTQVAYWAYIDVFWVLGLVAACAVPLALSLKSVKLGGGAPAGGH

SEQ ID NO: 374 - protein, 551 aa, Methylobacterium sp.
MLAVTLTAGAIWITVSRQTWSEMEARQRTNGERNLRTLALVLAARVEGAAADLDGARVARVSTPSLSGFADARVVDDAVAYSGGLATVFSYESASDSFVRRQTTVRREDGTRAVGTALAADSPAQAAIRAGRTYEGPAALFGRRYHTVYQPTVDAAGKVNGILFVGLPIEMYFDAHARTMTSLSVAALVIAVLACALVGLAAARLFRPFATIAARIEALAAGDLDTAIPHAERGDEIGTVARGLEVLRVSGLRTRELESLQSAGAADETRRRAALDRAIEAFRGQIVRLKDALTASTGAMRARAGEMAASSAEAEAAVAETERGSHETSASVQTVASAAEELSASIAEIGTQLDHAEALVATAAAESDAMNAEIGELAEAAGRIGAVVGLIRQIAEQTNLLALNATIESARAGAAGKGFAVVAAEVKALASQTARATEEIGSQIAGVQASTSAAVAAIGRMGERMRAVSATTGGIASAVSAQGAATAEISRNVADTAGATEAIAGGLTTVAGAARRSARMAATVTEAAQTVDTVAADLEGEIERFLGQVAA

SEQ ID NO: 375 - protein, 150 aa, Methylobacterium sp.
MLDSLAGTLGALGAAWSWVIAGLVLAGAEILLPGVFLIWLGLAAVATGLAAAALPMPWQGQTLLFAGLAVALVALAARLQHRGRRAGPDLNRADRGLIGREGVLDEPIVQGAGRIRFDDTLWRVEGPDLPAGRRVRVTGIGGTVLRVEAA

SEQ ID NO: 376 - protein, 259 aa, Methylobacterium sp.
VSDTYETILTETRGRVLLITLNRPKALNALNAQLTREVIRAATEADADPGIGCIVLTGSAKAFAAGADIKEMQHATYAEMYAGDRFADWDRFVAVRKPIIAAVAGYALGGGCELAMMCDIILAADTAQFGQPEIKLGVMPGIGGSQRLTRFVGKAKAMEMCLTGRMMDAAEAERAGLVSRVIAADQLLDEALKAAETIASMSLPIAMMTKEAVNRSYETTLTEGIRFERRVFHAMFATKDQKEGMAAFVEKRPPRFENT

SEQ ID NO: 377 - protein, 445 aa, Methylobacterium sp.
MTDSMPRPGDRLPLPGAGRLRLPGPMRAVLSGRFAVILSGELTQSLFHFLLNILLVRELGAHDYGLFAIVFAVGAVGITYIRALVAVPATIHVARSLGRPAALGYDVMFGSGAVLVSGLMATAVGVVLIPVIGLGALAAGAFVGLYAFRSYLRIVLLARGRPWIAGLSDLVYAVCGGLLVARWLNGEGTALLDRAFTAIALAHAVAIAVAYAALRERIRFSLHARARARYRAIWRTLAWSLAGVTSLTVQGQGLTLLLALLAGPAAYAPIAATIVLYAPLRIPASALLNMILPEISRLLAAGRVDAARRLVIRNGILLGGACLAYGAVMAAALPLVEDILFKGRFAEHPMGWIGLGVWAVVTVSLLYAIPRAYLEASAAFRTITAGAVASAALGMAVMVPALLLLPPATALAGLLASEVATLVWSVSAFRTLARRPESGRPLGAP

SEQ ID NO: 378 - protein, 419 aa, Methylobacterium sp.
MVDNFGLRAARDSDRAAAPALRAIGNAAAELRITCVHQGFELYGSDRCFIETVRTIRAAHPGARIDVVLPRRGPILAALEPFASEIVIAPLWILRRKNLARLVTLGLMALPIAMIRAWRRIRASDLVYINTTVVADYLLAARLVPGRSIVHVHEIPEGTVLKVLRGLIRWSGANVVFNSRATERAYALPRGATARVVYNGIAGPAEPNRNTYDGSRPLRVLMLGRISRIKGQDVLVEALASLPEPVRRRIELRIVGSAFEDEARERALVGRIAEAGLAAQVTLEPFVADPAALYRWADVVTMPSQRPESLGRVAIEAMSYGVPPLVTAIGGLPEVVEAGKTGWIVPPGGPEPIAAVLKDLVADPARWRDFGRAARARYLSLFSEASAAEGIEAMVRTTLRRPTAADPSRAADAPARPAA

SEQ ID NO: 379 - protein, 271 aa, Methylobacterium sp.
MESRVRRLFALVLATLLSVGPAMADRLDDIRQAGVLRVAAFDSNPPFGFVDPATKRIAGLDVDYAQAIADALGVKLEIRPTNPANRIPLLTSGKVDLVLANFTITEERAKQLDFSIPYFASGQQFLAKKGTLSSPEQLNGLRIGADKGTTNEIVLRRDFPQAVVVAFDDTPFAFTALRNGNVQAITQDGPKLVGLLAKVPDRQNYEIPAFSISNDYIGVGIPKGEARLRDRVNETLRGLEASGRAAAIYDRWFGPATEQPLPRLFRIGDRP

SEQ ID NO: 380 - protein, 132 aa, Methylobacterium sp.
VVERDLPGRIRLGPVDLLGDRDLLPVTAGGRRLLLVRDGARIVAAERACPHEGADLALGRCVAGRLHCPRHQASFDLRDGAVSPGWSFRALRLSAVEAVPDGLWLRTGSGLLAPDTAPPGGRGSPAGPEIRR

SEQ ID NO: 381 - protein, 272 aa, Methylobacterium sp.
MSAILSVEHVGVRFGGLVAIADLHFDVHAGEIVSLIGPNGAGKTTAFNVMTGFLKPSQGAVRFRGTSLKGLPPHAITRLGLARTFQRTSVFPDDTVFDNVMIGLHQMGAAAGRAPVLDALLGRAGAGERQLRARTAALLDWVGLAGRAQEKAGALAYGEQRLVGVALALATEPAMLLLDEPVSGMNASETRVFVRLIRQVRERGVTILLVEHDMPMVMEVSDRIVVLNYGRLIAEGPPDRIRSDPAVIEAYLGQGSAARQAAAAAAQEAVHA

SEQ ID NO: 382 - protein, 313 aa, Methylobacterium sp.
MLGYIGRRILATIPVMAVVGLFVFSLLYFAPGDPAAIIAGDQATPDDVARIRATLGLDRPFLVRFWEWSWQILHGDLGTSIFTNLPVTTMIGQRVQPTVSLMLVTLVFAIVVAVPLGVVAAWKAGSLIDRLVMGLAVTGFSVPVFVVGYVLAYVFALELGWLPVQGYTPIEQGVWPWLSNLILPAVTLGLVYIALIARVTRATMLDVLQQDYVRTARAKGLAQGPVLFVHALKNAAVPIVTVIGIGIALLIGGAVVTETVFAIPGLGRLTVDAILRRDYPVIQGVVLLFSFVYVLVNLAIDLFYTVLDPRIRY

SEQ ID NO: 383 - protein, 181 aa, Methylobacterium sp.
MADTGTSNTPRTHKTRNNTDSNAKKVSIEALNARLADGIDLALAIKQAHWNLKGPQFIGVHEMLDGFRTQLDELNDSVAERAVQLGATAFGSTQAVAERTKLPAYPTGIYAIADHIAALIDSYAAYANAVRQNIDETDEAGDPDTADLFTEISRAVDKHLWFLEAHVQEPTGTLRDGNAGR

SEQ ID NO: 384 - protein, 391 aa, Methylobacterium sp.
MAMHDLIAGDAQALSAKLQSHRQRLFPPEARKQLRRFSSGEAAKLIGVDDGYLRRLSLDGKGPAPEIGPSGRRSYSSADIQALRGMLDEGAKTGRRYRKERRAEEHLQIIAVVNFKGGSGKTTTAAHLAQHMALQGYRVLAVDLDPQASLSALHGIQPEFDVRDNETLYAAIRYDAARRPLTDVIQKTYFPGLDLVPGNLELMEFEHETPRALLQRSSDGDSLFFTRFAQALAPVADRYDVVVVDCPPQLGYLTLSALCAATSVLVTVHPQMLDVMSMCQFLLMTSEMLGVVAKAGGDMNYDWMRYLVTRYEPTDGPQTQMVAFMRTLFGERVLTNAMLKSTAVSDAGITKQTLFEVSRDQFTRATYDRAMESLDAVNGEIEALIRTAWGR

SEQ ID NO: 385 - protein, 168 aa, Methylobacterium sp.
MPPSDPAAREPFAAACRRLGPRLMRDLGLSDVQAAGLLGNLGHETGGFRHLQEVAPAVPGSRGGWGLAQWTGPRRVAMEAWCRARGRDPADPEAGYGYLCAELRGPEAPALAALRATTTLAAATEAVWRRYERPGVVAPARRLAWAHRALAALRDGPAAMPAQPPGRP

SEQ ID NO: 386 - protein, 71 aa, Methylobacterium sp.
MLGARALIQLGARTRPLVVSGQYDRAAIMAAACKAATGIQERCGVSRAEAISSALKATWQVAKAAHRAAAH

SEQ ID NO: 387 - protein, 414 aa, Methylobacterium sp.
MTIKLRLVSLLGGLGLVLVATAALGNLSLHWSHQSLKTVFDDRVVCLRQFSIIRDAYDDLLDASRQLRGRQIEPAEAKDKIERDLSKLHKELSAYLATYLTPEEEALVKDLQMRVDRNDAIAAEILKRVAAGAASDFEATHADLLKSMQATNATLSKLSALQVREAEAEFRRSEATAGWSRLALLAALALAALSIAYGVYVIVVQVTRPLGSLVAVLQRMAKGAVDAEIREAARGDEIGAVGQAVEGIRTMVARKAAEEAEVRRRADAAAAAERKRTMVELADGFERAVGGIVGLVSSSATELQATAQQMTATAQETASQSTTVAAAAEEASTNVNTVAAAAEELGSSVQEIGRQVTGSAHLAQAAVGEADQTAHLVQALSQNAARIGDMVGMISGIAGQTNLLALNATIEAAR

SEQ ID NO: 388 - protein, 274 aa, Methylobacterium sp.
MKALARTTTAVDTARLGIMLGELRLLTIKTVWPRFAEQADKEGWPAARFLAALAEHELAERDRRRIERHLAEARLPPGKTLDGFDFAAVPMPSKAQVMAVAAGDAWLAQGANLLLFGPPGGGKSHLAAAIGLALVEAGFKVLFTRTTDLVQKLQVARRELGLEAAIGRLDRFDLLILDDLAYVTKDQAETSVLFELISARYERRSLMITANQPFGEWGRIFPDPAMTLAAVDRLVHHATIFEMNVESYRRRTALDRKRGPGRPPTRATIKTADV

SEQ ID NO: 389 - protein, 83 aa, Methylobacterium sp.
VASMNVSLPEAMKAWVEAQADTGRYANASDYVRDLIRRDQERLAKLGDLQRLIDEGLASGVSDRSEQDIRQLGRTRLAARAEP

SEQ ID NO: 390 - protein, 89 aa, Methylobacterium sp.
MATMTISLPDPMKEWIEAQIRQGDYASTSDYVRDLVRRDRERRAQADLTLEDLRRIVDEARAGGPSRRKVPEILVRARKHAQSDQPLDE

SEQ ID NO: 391 - protein, 222 aa, Methylobacterium sp.
MPIVAIVNPKGGAGKSTAALVLGTTLARHGASVTAFDCDRNQPLVTWAAGDTRSALRVVSHLDPETIGRALRGEAARQQFVIADLEGTASMTVATAIVAADLVLIPTRGSITDAHQAQRAINMVEDQAAAVGARPYRLLFTCTRPGFQTRDERAIRDTFEQAGVSILPTDLGERAAYRAMFSYQLALDELDPGAVNGVDKAIENADAFANDVVSCIQARAAA

SEQ ID NO: 392 - protein, 227 aa, Methylobacterium sp.
MPVIAFANPKGGAGKTTTALLLATELAQRGAQVTIVDADPERWISQWSRLPGKPETITIISDVTEDTVVDVIEAAAEASQFVVVDLEGTASLMVANAIAMADLVVIPVQGSAMDAKGGAKTIRLIRTQEKTARRQIAHAVVLTRTGAAVTSRALRNVQEQLQAGGIEMFATTIVERAAFRDLFDYGGTLASLSPSSTSNLEKAQANAREFAGEVVAKLRAAARVEAA

SEQ ID NO: 393 - protein, 127 aa, Methylobacterium sp.
MARTKHYPPDATIADVLPDLADGEAYLRQVLSTMRMCQKHHGDAWVRIGVTGRSPTPSYRIDRPDETALGDGAVEAGKALFGAYGGRSHDRFTQVNAAETRWSSRALGMAEMLALHDGLRRPRGDAA

SEQ ID NO: 394 - protein, 416 aa, Methylobacterium sp.
MMPRTPRGSRLSALAAALLASASLAAPAARAADPIKLGVLEDQSGDFAVATIGKVHGIQLAADEINAAGGIAGRKLELVIYDTQSDNTRYQEFMRRVLQRDKVNAVFAGFSSASREAYRPIVDQLDGFAFYNNQYEGGVCDGHMVVTGAVPEQQFSTLIPWMMEKFGKRVYTIAADYNFGQISAEWVRNIVKENGGEMVGEEFIPLGVSQFSQTIQNIQKAKPDILMTLLVGTAQASYYEQAAAANLKVPMGSSVNIGQGYEHKRFQPPSLANMYVTTNYIEEVDSPSSKAFLAKWKAKFPNEPYVNQEAENSYLAVYLYKQMVERANGSTKRADLRKVIAAGDVCVDAPEGKVCIEPKSQHASHTIYLAKVDEKHAISFPKTWDNIQPYWLGKAGCDLTQKDPMAQYTPSNPPKP

SEQ ID NO: 395 - protein, 290 aa, Methylobacterium sp.
MDLLTHAFTFLYQIGDAFSFLVLSACGLAVVFGMMGVINLAHGELIMCGAYVTAASTRAGLPLPLGILAGALAAGAVGMVMERLVIRHLYGRPLDTIVATWGISLAATQGTLILLGSSMPGIGTPLGSFTVGGYSYSTYRVVLMVAAVAVLAGLYLAFNATRFGTLARATIQVPHMAETLGVDTRTVYALTFGLGAALAGLAGGLYAPTMTIVPTMGTTFIMEAFVTVVVGGADIFLGTAPAALVLGTVRALLTTWQGQLFGQIGLLVAVILVIRVLPRGISGLILRERA

SEQ ID NO: 396 - protein, 248 aa, Methylobacterium sp.
MNPLLETRDLSKHFGGLHVTNDVNFALAAGEIHCLIGPNGAGKSTFFRLLLGEYAPERGQILYAGEDITALKPFARIRRGMSVKFQVPGIFPSLSVAHNLEIALQHHLEGASLGAEIRRLLAFLNLTAAASDRAGNLSHGQKQWLEIGMAISLKPRLLLLDEPTAGMSPDETFATGAMVQALNRDGVAVLAIEHDMAFVRQIAQRVTVLHVGRIFAQGTTDAIIADERVAAIYLGEADAPPLRSVADA

SEQ ID NO: 397 - protein, 426 aa, Methylobacterium sp.
MFDDQRHPSEDEARPRPADGRAAARERDVLDLGRAAPAAGRDTRHETARKPGAEEADDTAPEAQDGEADDDSAGSDDDGDDARRPNVLRRHPLAFLLGGLAVVALCVGVFFYWLLYMHPYESTDDAFVDARSISIQPKVGGYLVDVPVTDNQHVEAGQILFQVFQRDYDIALDQAKAQVAADEAGIKNIDAQIQAQYANIEVSKAQVATAEAALKFAQEDAARYKDLAERGSGSVQQSQSATSTLQQRQAAVQSANASVVAAQKQVGSLQAQKASTQAQLGRDRAQVEQAELNLGYTTVRAVQGGRVVRLTGGVGQLAQAGQTLAMFVPDDIWVTANFKETQITDMRPGQPVDIEIDAYPGRKIRGTVASVQPGSGTAFSLLPAQNATGNYVKVTQRIPVKIVVKSWPTDVSIGPGMSIVPTVTVR

SEQ ID NO: 398 - protein, 177 aa, Methylobacterium sp.
LTAAILVTGALGLGLASAAVARDHGPEGFRGHGRWSALTPEDRAAFTDARIAALHAGLKLNADQEKLWPPVETAIRDMAKLRQQRREAMRDRPKFSDDAPAALRAMADAASARGDALRKLADASQPLYASLDQDQKRRAMILARPMGPMGGHGMRGGWHRDRGDDRGDDHGPRGDGR

SEQ ID NO: 399 - protein, 202 aa, Methylobacterium sp.
MTARTIIGADPAATETSPQIHIAEEIRRRRREQGLSLETLAARSGVSRSMISKIERSEAVPSTVVLSRLAEALGVTFSRLMAPATEREILLIPASRQPILRDEASGYLRRCISPVLPGRGIDWVLNTLPPGASTGEFTAHRRGVSEYIYVLRGRLRAVIGERAVIMETGDSLYFEADAGHAFTNVGTEACEYFLVIDPSRVR

SEQ ID NO: 400 - protein, 78 aa, Methylobacterium sp.
MPTHRCLDPQDPYAEREVRVAFEWSADHPRLIAALDEHEADILPDLVEVQRDDLRREIVAALPLPEPCIPGRTEIRLP

SEQ ID NO: 401 - protein, 118 aa, Methylobacterium sp.
MRTALILPVLVLAACALFLRSYTLPPAPDRRGGTTLLLTWPNRPAFGSPRADCLAGPPDEPVLPCLIASVARVRDDGYTLLQLPFCATCYDLSGRIAVMGRDAAATRARLEQIARFGW

SEQ ID NO: 402 - protein, 304 aa, Methylobacterium sp.
VSGTAPPGGVRALVGFGRTVADLAVTEAFYRDGLGFARVAPPEPVPAAQAEAMGLTDRRAVQLRMRLGRQTVTFLAVDPPGAPYPADPAATDPFFQHLAIPVRDMAAAAARLARLAPTPISRGGPQRLPASTGGVTAYKFRDPDGHPLELIFFPDGPAAARWRDARGLFLGIDHSAITVTDLDATVAFLTGPLGLAVAERGLNRGSEQARLDGVDDPQVDVIALTPPDPAPHVELLHYRTPATERRLAFGPADRASTRYVFSAADPQTLSRRLREGGQTPRNSTDGAAAYCAGPDGHGFLFVRG

SEQ ID NO: 403 - protein, 300 aa, Methylobacterium sp.
MDGFELTQPRFKAYILPNAPLQKLADGFRWTEGPVWFGDRDELLFSDLPNNRVMRWSESAGLSVYREASDFENGHTRDRQGRMLSCSHRGRRIHRTELDGRVTGLVERYRGRRLNSPNDIVCKSDGTIWFSDPPYGIQTDYEGGKQESELPAAVYRFDPRDGSLRVVADDFQGPNGLCFSPDERRLYIVETGLQFDTDPLQHVRVFDVAEDGSLSGGDVFCRIAPGNADGIRCDEHGNVWSSAGDGVHCIDPGGELVGKIRVPATVANLTFGGRNDSRLFLCASQALYAIYVNVRGAPLL

SEQ ID NO: 404 - protein, 534 aa, Methylobacterium sp.
MTKLAQMFRLRATPQTEPIPNTVPNAAGGHAFAVGDWARLDRFLVLGSEGGSYYASPRALTAENAASVQRCIAQDGARAVAAIVAVSEGGRAPKQDPAIFALALAAASADLATRRAALAALPRVCRTGTHLFQFAASVEAMRGWGRGLRRAVGDWYCAKPVEALAFQAVKYRTRQGWSHRDLLRLAHPETEEPARKALFDWICRGTVTEAAPGIVHAFARVQAEGLDGAVAAALVRSHGLPWEALPTGLMGSRAVNEALIERMPVGALVRQLGRLTAAGVLAPFSEGTEHVRAVLSDRERILRARLHPMALLLALKTYASGHGQRGKLAWEPVAAIVEALNAAFYTAFGAVEPTGRRLVLALDVSGSMGASTVAGSTLTAREAAAAMALVTAATEEHWQVLGFTAEAGRAWSQGAALTPLPIGPSMRLDQAVRATADLPFGATDCGLPMRWALERGVKADAFVVYTDSETWAGPVHPVQALRAYREKTGIPAKLVVVGLVSNGFSIADPEDPGMLDVVGFDTAAPAVIADFIRA

SEQ ID NO: 405 - protein, 344 aa, Methylobacterium sp.
MNRLLPLALLAGLVALPLGLGANPYLLNALIVTGILTIGAMSLNLLLGFTGQLSLGHIAFFGIGAYVSALTSLGFDVDLGFGIRAVHEPWPAVAGLLLATVAAGGCGYLIGRLSFRVRGAYFVIVTISFAEVVRLVALNWVELTQGPLALTNIPAITLGLPSLGMWTLKTKLQNYYLVLAVGTLCYAVIARLVGGRFGRAMRGLKENEPLALSVGINATRTLTVAAVISAAMAGAAGSLYAHYLRIIDPDVFLFATTVTMVIMVVAGGKGTLLGPVVGGLIFGLLPVALRPVMAPEAQWIVYGLVLIVILFVMPRGIVPGLAALLGRRPAPAAPVLEANPAVQR

SEQ ID NO: 406 - protein, 290 aa, Methylobacterium sp.
VNELIQHLVNALILGGTYALLGIGLTLIFGIMNVVNFTHGALYTVGAYVMYLAVAALGLNFFLALPVAILGGLLLGAAIELLLLRPFRGSDIDTTMLVMIGAGIVLQSGTLWTFGGVAKAIPAPFPEAPLQVGPVSVSWLRLFVLGAALTLIALTYALINRTKLGLAMRAAFQDSDTAALMGVDVRRIYTATFALGSSLAAAAGALLGPVYVVFPQMGGLAELKAFAIVILGGLGNVTGAAIGGFILALAEELGAGYVSSGYRDAMGFLIIIAVLLCRPTGLFAKAERVG

SEQ ID NO: 407 - protein, 427 aa, Methylobacterium sp.
MDNRRYDLVLRGGRVICPASGIDGIRDVAVRDGRIAAVAETILPSAAAEVVDVAGKLVLPGMIDTHAHVYQYVTGRFGLNPDMVGVRSGVTTVVDQGGPSCMTLPGFRHFIAERSETQVLAFLSAYLVGGLEGHFYPNLYSPDGVDIDATVKSATENRDLVRGIKGHAEIGGFARWGIKVMEMAAEISRRADLPLYVHFGQLWGLPESGANGEDADTIVERVIPLLRPGDVLAHPFTRHPGGFINEQGEVHHIIRRAMEAGLKVDVGHGSHFSYRVARASLPAGVVPYTLGADMHGYNTEVPEVKKPAGTPDEHHDDENHPFLGQARFSLTQAMSSMMALGIPLEEVVPMVTSHPAEMLCMGDRIGALKVGYAADVSVLHDDRGRFLLRDNEDTRVIADRLLRPAFCLRAGKRFEADSPILPQAIAA

SEQ ID NO: 408 - protein, 293 aa, Methylobacterium sp.
MKRVRAGVLEVAYLESGPADGPTAVLLHGFPYDVHACAAAAAQLDADGVRCLVPYLRGYGPTRFLEPATPRSGEQAALGADLLAFLDALGVGNAVLAGYDWGGRAACVVAALWPDRARGLVSCGVGYNIQNIPAAGQPVAPETEHRLWYQYYLHGERGRAGLAENRDAFCRLLWQLWSPTWAFDAETFARTAHAFDNPDFVDVVVHSYRHRFGLVPSDPALVAIEARLAAQPAIAVPSIVLLGGDDGVGPPPATDTDARHFTGPYRREIVAGVGHNFPQEAPDAFAAAIRALL

SEQ ID NO: 409 - protein, 301 aa, Methylobacterium sp.
PGAMPGVLKQVEAGVLDVGYVEAGPADGPAVILLHGWPYDIHAFAEVVPILTAAGHRVIVPYLRGYGTTRFLASDTVRNGEQAALAVDVIALMDALKIPQAVLGGFDWGARTADIVAALWPERCRALVAVSGYLIGNQEAGKKPLPPRAELSWWYQFYFATSRGRAGYEAYRADFAKLIWQTASPRWRFDDATFARSAPALDNPDHVSIVIHNYRWRMGLAEGERRYDALESRLAQAPTIGVPTITLEGDANGAPHPEPASYAAKFTGRYAHRLITGGIGHNLPQEAPRAFAQAVIDAAAA

SEQ ID NO: 410 - protein, 271 aa, Methylobacterium sp.
MRTHDLPRAARARLGRSGLLLAVGLALALVAPARANPLTEVPGARSSQPDEAPPPRDPAAERAETEEARAANPGATAIIRSLAPFADGNPGAPARPLAISPDDGGPAVRVVPARSIDLTVFFAYDSARLTPEARIQLEPLGEALRAEPLAGHGFLIAGHTDAAGGRAYNRRLSLARARAVKAHLVETYGIAPERLRVHGWGPARPKDPDAPLSRVNRRVEVSLIAPARSGALRFVLPVADRTCTDLADPRLRTDLDLDDFGAAPTPRPCAE

SEQ ID NO: 411 - protein, 176 aa, Methylobacterium sp.
MMSEHSEDQGRLTKVASAIFLHTEHAIYAALGILLALTALVALIEAAGMTWEAMRALGGAQQILEVIDRLLFLLMLIEILHTVRVSMRSGTLTCEPFLIVGLIASIRRVLVITLQSSEIMHAKDWSPEKQALFQASMIELGVLAGLILTMVFAIFLLHRARDDGRPAGEEKPEHVS

SEQ ID NO: 412 - protein, 159 aa, Methylobacterium sp.
MTKIAQLPARDDLYTTDLCLWTEEQAALLRAGRWPDIDSANVAEEIESLGGSQKSEIRSRLAILLLHLLKWEFQPEKRKYGWRATILEQRIRIDDLIDVSPSLQSWPDAVLAKAYSVAVLGAASETGLSGSVFPKSCPYTIEQIRELGFYPGAPETDVV

SEQ ID NO: 413 - protein, 129 aa, Methylobacterium sp.
MTKHTIRTEKAAPAVGPYAQGIRAGGLVFASGQLPIDPATGAFPDGIEAQTRRSLANLAAVLEAGGASLASVVKTTVFLKDMAEFAAMNAVYAEHFPGEAPARSTVEVARLPRDARVEIEAIALATEAA

SEQ ID NO: 414 - protein, 197 aa, Methylobacterium sp.
MTTEATSTMTGETAPRMVEAFAHAAGSAAVRVPGGAAGWVGSLTHIHIAPAASYEMEEVSEAVCVAGRGIEGDRYFLGTGTYSPKPDVREVTLIEQEALDALNRNDPPLQEGPLRLLPGDHRRNLTVRGVPLNHLVGRRFRVGAVILRGGRLNFPCRYLEELLGMPVYLPLYNRSGLNCGIESGGVIRPGDAIALLD

SEQ ID NO: 415 - protein, 187 aa, Methylobacterium sp.
VSTNAKETILAAARKTAQAHGYGGLSYRDLAAEVGIKAASIYHHFASKADLGAAVARRYWKDIAVELDAMLEETGDPMECLRLYPGTFRRSLEDGNRLCLCSFMSAEYANLPEAVQREAQGFADVNVAWLAKVLVMAKAVKPGEAEARARAIFAAVSGAQLYARSRSDVSQFDDLIENYRASGLLPA

SEQ ID NO: 416 - protein, 306 aa, Methylobacterium sp.
PEGIAPKAPPPPGLAVAAPLPDVIPARKRRGRVWTYVRRNPTIVVGGVLLLVVFLMAVLAPWLGTVDPTALAPAKRTRAPSAQYWFGTDMLGRDVYSRVVYGARVSLLVGFSVAFLASVAGLAVGLVSGMVRWLDGIVMRVVDGMMSIPPILLAVALMALTRGSVQNVIIAITIAEIPRVARLVRGVVLSLREQPYVEAAVTTGTRMPAIIWRHILPNTLAPMTVQATYICASAMITEAILSFIGAGVPPSTPSWGNIMAEGRALWQVKFYIILFPAIFLSMTVLAVNLVGDGLRDALDPRMAKDV

SEQ ID NO: 417 - protein, 316 aa, Methylobacterium sp.
MNWTDWVRGRSIGRSFRTGPLVLALAAWALPASATTIAFLTPAGVARRLHDGLDEQARARGVATHFAYAPDGAADEQIAQARRLIAEKADALVVVPVDSSAREEITRLAVEADVPLVLIGHGARTDWFAGRVTQVAPSDLVAGRLQMRKLAQMSGETGRVAILAGSATDPVSALRSRGAREVLAESPGLRLVAEAATDASRATARATVAGWLARGIGIDAIAATSDEMALGAAEAVEAAGIPAGRIRIGGVDATAEGMQAMQELRLAVTIFQDASVQSRRAVDDALALIRREPVPPYDWLPSELITDRMSTTHFSR

SEQ ID NO: 418 - protein, 287 aa, Methylobacterium sp.
MTAPFPPPTPVVTDADFVRFRDFFYRKTGIMFADNKRYFVDKRLQERMLASALPVFRDYFNTLRFQASGQEFQTLVNLMTVNETYFYREEYQFRCLVRSILPEVTRRKRPGEPVRIWSVPCSTGEEPYSIAFQLLDTWPEVDRYDIEIVASDIDTAVLDQAKRGLYGDRAVQHVPRATLERYTRRAQGAHEVIRDIRDSIAFAQVNLSDPLSTRQFRGFDVVFCRNLLIYFDDASRRGAAQTLYEALDPGGFVCLGHSESMSRISALFDLRKFAEAIVYQKPLNAEA

SEQ ID NO: 419 - protein, 93 aa, Methylobacterium sp.
LTVAALVFALASPAIVAQAQQDIPIQQDLKRMDRLDQRLGREDTELKVDPNVTPDNPDGVVGFDGPPFNYGDPGVMGDGPLPPGSPADDDDWY

SEQ ID NO: 420 - protein, 95 aa, Methylobacterium sp.
MRQPAVYIMASRRNGTLYTGVTANLARRVYEHREALLQGFTSRYDCKRLVWYEPYPTMAEAITREKQIKAGSRKKKLALIEAMNPDWNDLYPDLA

SEQ ID NO: 421 - protein, 758 aa, Methylobacterium sp.
MDAGALETDDHLGRSHPRVEGPDKVTGRALYSSDLTGPDRGTAHAALVTSTIARGRITGFDLEAAERVPGMLGIFTHRDFAGAVRPVKHLMAGGYANSSHRPLDSDTVAYAGQIVALVVAETLGAAEAAAHAVKVAYAEEPAAGGFDAPGAETVRLADLKPHHADIARGDAEAGFRDAALRVEARYATPVQHHNPIELFTTRAAWDGERLTVHEPTRYVGAVQHGLAAQLGLDPAQVRVVAGLIGGHFGSKFALSQHTALVALAARHLGRPVSLVPSRRQCFTIANYRPESRHRIRLGADRTGRFTALVHEAETVTSRFDPFVMEGAEVTASLYACPNIRTEERAMRVDRNTPGPMRAPPEVPFLFALESAVDEMAVALGMDPIALRRLNDTAVDPVSGKPFSTRPLMACFDAGAKAFNWSRRVPRPGAMRDGPWRVGLGCATSVRPTKIAAATLRVRLGPDGAAEVACAHHEIGNGITTLLAMGAADGLGVPVERVTVRLGDTDLPAAGISGGSSTTTSLMSALALGCRQIRESLAQAATGQGGRLAGRDPGSLRLAGDRLAAPDEAGIALGEVVGPEGVETVAEFVPEGGDREKTLAGLRQGHIGLALGGGGKAVSWGFGAQFAEVHVHAETGEIRVARLTGAFAAGRILNPLTARSQLTGGMIWGLGSALLEETVVDGAAYRNPDLAEYLVPTAADAPEVEALLVPDPDEQVDALGLKGLGELGIIGVNAAIANAIHHATGRRMRSLPIRLEDVA

SEQ ID NO: 422 - protein, 96 aa, Methylobacterium sp.
MTFRTTPRADEDIAEAYVTGALRFGVTQAERYQDGLFDAFRMLAATPQMARERREFTPPVRLHPYRAHVIVYVVDGFAILILRVLHGRQDWERALT

SEQ ID NO: 423 - protein, 96 aa, Methylobacterium sp.
MSDYTLTARAEADLFDIAVCGYRQFGIRQAEAYADGLERVFQLLAENPRMGRTAAAIRPGVHRHEYAAHVILYEPVEGGVLILAIVHGRSVRGLDL

SEQ ID NO: 424 - protein, 73 aa, Methylobacterium sp.
VLIALALWIQALAPAVALRTAQADRGALPGQILCGHAPGQADDAAVGPGAPAPGACALCGLCRAGAVPPLLPQ

SEQ ID NO: 425 - protein, 249 aa, Methylobacterium sp.
MIATIQAWFQQLYETTGFNFTVFYDPYDWGRYVAGLRMTLLLGISTILASLVIGAVGALLQSGPSRVLRALVNGFVVVFRNTPPLVQIFFFYFGLGTLLPDIGSADGLRAPILNNVQWAIISLSLFAGAFNVEIFRSGIEAVPRTTVEAAEALGYTRFKAYRYVVLPLALRVCLPALNNNLINLLKTTTLAYAIAVPETLYAVKQIWSESQNVLEMMLVLLATYAVLVGVLVWIMHRWERALRIPGYGR

SEQ ID NO: 426 - protein, 283 aa, Methylobacterium sp.
MSAADPRGGRPGDLPVLLPFALPKDRAAARLRPAHLWLLTGLALVAVPAWAQGGAAALSPLEVVIKWAPLLLTGFAFNVAISLMAMAIGTVAGIGLGLAMLAEGRVLPRLAWCATQVFRNVPWLVLLFFVMFLVPFQVTVFGVRVPLPDWVKATFGFSLPVMANVAEIVRGAVRSVPNTQWEAAESLAFTRRQTMWRIILPQCAKRMLPPWMNVYSLIAMATVQASIVGVTEMLTLTAQVHAAEGGRPELFAPLYGFALLCFFLYCYPIDRFTAALERRFETR

SEQ ID NO: 427 - protein, 259 aa, Methylobacterium sp.
MTRATLAATPSPSWTPDQPIVRVVDVHKSFGTFEVLKGISFDVRKGEVVCIIGPSGSGKSTLIRCVNALVPVSAGSIQVEGIEVTDPRLDKLALRRKVGMVFQQYNLFPHKTALQNVMMAPIHVLGQEKREVEARARALLAKVRLAGKENAYPGELSGGQQQRVAIARSLAMRPDVMLFDEVTAALDPETVKEVLVTIRELAEEGMTCMLVTHEMNFARDVADHIYFTDRGVIVEHGPPATFFASAQDERTRRFLSQVL

SEQ ID NO: 428 - protein, 373 aa, Methylobacterium sp.
MIVKDEAHVIRRCLDSVRPIIDHWIVVDTGSTDGTQDVVRAALADIPGALVERPWVDFAFNRNEALKLARRHAQYALIIDADDELIIPPDFTMPKLRAPGYRFEIIDAHTRYWRNQLVSTRENWRYRGVLHEFLSCPGVTETPILPLAMRRGDDGARHRDATADARDIAVLEKALAVETDPFMIARYTMYLGTTYDAAGEYRKALACFLKRADLGGWDEEVYFNLLMAAVNAERLDEPEDRVLQLYERATAIRPARAEARHGASRFCRLRKRFAEGYRYAEAGLTLELPSEGISLNPWVYEYGLLDEFALNAYHSGQFSACGHACLKILERAHVPREVALRAGALARDVMAQMIDPVWGCRHTPYALPFVPTW

SEQ ID NO: 429 - protein, 350 aa, Methylobacterium sp.
VSAALLGPTTSARADDGPSYGDDRRGIFLPFLNAPRPGDAITKSPRLGLSFGGEARPVLVDTGSTGIVVSAARIPGNESLPSEPGRLTYSSSGRIMVGRWVRVPVAVVGRGGESVVTQPIRVLAVDRIDCTARARNCTPEVAPAHVAMMGIGFGREDDSQTQSTPDTNPLLNAEPPGPGAVHRGYVLTPRGVHVGLTRANTRGRYRFVKLDPHPNVPGDWLGVPVCITVDGREPAACGRALLDTGVTGMFLTLPPSQVADSLRADAGDHAVLRPGTRLGFQFGDAAGYAIDVGDRAAPLAPERIVLNTVRPQPFVNTGLHVLNGFDVLYDADRGYYGFRARDAQSASDDP

SEQ ID NO: 430 - protein, 177 aa, Methylobacterium sp.
MPLYALDEHVPDLADPARVWIAPDAQVIGRVHLGLDVGIWFGAALRGDNEPIRIGDRTNVQEGVIMHVDPGFPLVIGTDVTIGHGAIVHGCTIGDGSLVGMGATVLNGARIGRGCLVGANALVTEGKEFPDHSLIVGAPAKAVRTLDEAAIEGLRQAALRYVENARRYRAGLRRIDG

SEQ ID NO: 431 - protein, 138 aa, Methylobacterium sp.
MRDDRSAARRRPALPAIAKLGLAAACALGLAACVTPQERHALDQNQCYAFGFEPGTDGFAECMMGLHQQRAVAQSNSNLYWQAQLAEQNRRREAQQDLYKVMSLQRAGDARFPVCGASSDGGMDRRTMTWYGPNCRAR

SEQ ID NO: 432 - protein, 144 aa, Methylobacterium sp.
MLRPHVLHATVFAVALMTPSLCRADTVQADAQSAASQWDAAYNGGDMDALAKLYTPDAIVVTKGSPQTSDGIQKFFAGLKAKGWDEHKTTVKSALPKDNLLIVSGRWEMTGPGDGGAKKKFEGNWVNVLEKRDGAWRTVLHTWN

SEQ ID NO: 433 - protein, 315 aa, Methylobacterium sp.
MTARLIMKLRVADAVATTPEVLHLGLVHPARPELPAWTAGAHVDLRLPDGRVRQYSLCGDPADRSRYEIAIKREAAGRGGSAWAHETLAPGAFAHVSAPRNNFPLDPEARRHLLVAGGIGVTPLLAMARALAASGAEFAFHLCAPSPEAAPLLAAVRAVCGPRLRCWFGSEGRRFDPDALGPAETGTHAYACGPRRLMDAVQEGLVARGWPAERVHSEHFEPLRDEGFVPEPFEARIASTGQVLHVPADRSLLDVLRGAGLDLPSSCELGVCGACECGYRDGAVLHRDAVLPLAKRRSRMMPCVSRARDAVTLEL

SEQ ID NO: 434 - protein, 92 aa, Methylobacterium sp.
LVQADGAMAKWIPGAAVFGLLCLMIIPAPGIWGVLIGAACVLAIVGSLCMLVLDRVASAILVWRQRVRVRRPSSGRSRSRVVHAGSRVTRKV

SEQ ID NO: 435 - protein, 408 aa, Methylobacterium sp.
MTEISRRAVIAAAGGAMAASSAAAQTAGPAPRLPERGGKGADILGPQNRPRAAEEPFTLAPPATDHGTMPNLKWSFADSHMRLEEGGWARQTTIRELPVSKAMAGVNMRLKAGAVREMHWHKESEWAYMIKGNARITAVDQDGRTFADDVGAGDLWYFPGGIPHSIQGLAADGIDGCEFLLVFDDGGFSEDSTFLLTDWLAHTPTDVLAKNFGLPESAFAKVPQKELYIFPGPKPGPLAADKMGGSGPVPKTFSHRMLAQEPVRTRGGSVRITDSTVFPASVTIAAALVEVEPGGLRELHWHPNSDEWQYYLSGQGRMTVFGSESKARTFDYRAGDVGYVPFAMGHYIENTGDTTLTFLEMFKSPRYADISLTQWLALTPHPLVQAHTGLDPERVEALPETKSPVVPG

SEQ ID NO: 436 - protein, 74 aa, Methylobacterium sp.
MKRAPFRILIRIEGDRRVLRATSEREAALKAESVLRRYDVLPGGAGLIIEASDTRASARIAAYLADVALEMEIA

SEQ ID NO: 437 - protein, 493 aa, Methylobacterium sp.
VKTYQLYIDGQSVDPVEGSWFESIDPYRGAPWARIPRAGRVDVDRAVAAAKRAMWDGPWGTMTASARGKVLRRIGDLVEREAKALAEVEVRDNGKLFAEMYGQTRYQPEWWWYYAGLADKVEGAQVPIDKPETFAFTRHEPVGVVGALTAWNSPLLFVAWKCAPALAAGCAVVVKPSEFASASTLEFARLTKEAGLPDGMFNVVTGFGGEAGTAIVEHPDVAKITFTGSDVTGAKVYEAAARQIKRVSLELGGKSPNIVFADADLKAAAAGAISGIFAATGQTCIAGSRLLVQNSIRQEFTERLVELARTAKLGDPMQADTNIGPITTPPQYTKVLDYIALAKSEGARCVFGGNPASGPGVLGGQFVEPTIFTGVTNDMRIAQEEVFGPVLSIIGFEDEAEALRVGNDVIYGLAAGVWTQDIGRAMRMSKGLRAGTVWVNTYRAVSYMMPFGGMKRSGIGRESGIESIREYLETKSVWISTSRDAPENPFVMR

SEQ ID NO: 438 - protein, 178 aa, Methylobacterium sp.
MTTVDQAKTMAKRLRAALAARDLAVPHAAALELVAAGLGYDDWNTACAVLDRDADDGPRFLEAVPVLRIFDEAKARAFYCGFLGFTPGFEHRFEPGLPLYMEVARAGLRLHLTEHHGDATPGSTVFVPMRGIRAYHRALTDQRYGYARPGIEQAPWGEVLEVADPFGNRLRFCERRTA

SEQ ID NO: 439 - protein, 359 aa, Methylobacterium sp.
MTKTYTIAAIPADGIGVEVIAAGIEVLDVLAEKTGSFAFRFDHFDWGSDYYKRHGAMMPADGREQIRNHDAIFFGAVGAPDVPDHITLWGLRLAICQPFDQYANVRPTRILPGITSPLRNVSGPELDWVIVRENSEGEYAGVGGRVHQGHPNEVATDVSMMTRSGVDRIIRYAFELARSRPRKLLTVVTKSNAQRHAMVMWDEIAAAVAKDFPDVTWDKMLVDAMTMRMVTKPETLDTIVATNLHADILSDLAAALAGSLGIAPTANINPERTYPSMFEPIHGSAFDIAGKGIANPVATFWTACQMLEHLGEKPAADRLMRAVERVTADPSLHTPDLGGTATTRQVTDAVIAAIRGDNA

SEQ ID NO: 440 - protein, 110 aa, Methylobacterium sp.
MAERRKATGSGEDSLSRHILPNAGTMVGVCTTLIGLVKIAEGWIGPSHVDEAAALTAILFLVSAIASYLSIRLDDGGDLSVTLERCADICFVIGLIGLTLISVLFAYETI

SEQ ID NO: 441 - protein, 77 aa, Methylobacterium sp.
MAFDREDTLFYVVVNHEEQYSIWPSYRDIPDGWRAVGDPRAKADCLAHIDEVWTDMRPLSLRRHMEAQERDAGGARA

SEQ ID NO: 442 - protein, 642 aa, Methylobacterium sp.
MALVKKAALSGSHAQVRKGEQASLSHLGRLNEESRRKARTFAKQQKAAERIAAATTQLASGVAEASSAAEELRKAMEQIAAGAEEAAGASEQSQRAVTTVSEAIGTARTEAETSRQKSESLQGLIAGVSQQIRLSVGSIATAAERQAASVTLIVELERQAANIGDIVRAVARIADQTNLLALNAAIEAARAGQHGKGFAVVADEVRTLAETSERSAQEIQALIGRIQEDVKVIAEGINRAAEGARQEVARGETITAQLEAVRQAMVEIMRGAETIARVAVESERAAVEAQKGSELIAAAAEAQSSACQQSLKTIEQQTTALGESEQAATELATLADELKNATDVGKSAEEVASAAEELSSAVEEINRAAAQITTALDQIDRGAQQQTAAAQQSAAAIAQIEKGALLAQDSARDALEKGGLITSQLQENRAAVDGLVAGVGNALAETDRSREQINALEQVSRKIDKIVDAITTVAIQTNMLAVNGSIEAARAGEFGKGFMVVSTDIRNLARDSSENAEQIKDLVKAIQDQIVVVRRDLEAISAAAAAEVEKNRAITRDLETTADDMGAVLDGNRQILQGADLIIRNVEEARRGVDQIATAARQGGQAVNEAQQAAREQANGAEELAAAIEEVASLADELQNQD

SEQ ID NO: 443 - protein, 170 aa, Methylobacterium sp.
MRVLLSPSPATAPHVLMSADAVGGVWQYSLDLAAGLVRRGLAVTVAVLGPAPADARISAAERDTGARIVATGLPLDWTAGTPDAVLDAARALADLARACGADRVHLHSPALALAAFPVPVAAVCHSCVATWWDAVETGPLPADLAWRHDLTVRGCRAADALLAPTRAHAL

SEQ ID NO: 444 - protein, 215 aa, Methylobacterium sp.
PQTRAHALATARVCGLARPPVVVRNGRDPSGLPPRAAAPVAFTAGRLWDRAKNAAALDRLAARLSVHLRAAGSVDGPNGARVETRHLQRLGRLDDAGIAAELAGRPVFVSLARYEPFGLAVLEAAAAGCALVLSDIPSFRELWDGAAAFVDADDDEAAAGAVRVLLDDPVRREAAGQAAATRAARYGVAPMVEGVLGVLRGLGARAPVRLGGAAA

SEQ ID NO: 445 - protein, 477 aa, Methylobacterium sp.
APPALAGLANLRGSVLPVASLRRLFDLPDRVHDDATRVVVVGQGAGQGGGPGGTSGFVVDRMASVITVEPGEIEGTDGLTATAATELLAGVIKRPAGMVLIIDLGRLLQRSGSGRAGAEGGSGGSAGRNAVGPVEAGGAASARPEGEVGLSDEIQLVSFELAGQEYALPIEQVQEIVQVPDRVSELPKAERHVIGVINLRDRLLPLVSLRALFGLPGVPLGEQNRIVVVASRESAGSVGIVTDTVKEVLRVPRAVVDPLPDLLAQGDALREVEAICRLGGGKRLVSILSAVRLFATTGIAGGLAGLGAAEEGPVQERQIATAPTRADEEEQFVVFRLADEEYGVPIDAVHEIVRVPEQLTHVPRTPGFIEGIVNLRGAVLPVVDQRRRFRLPEAARNDRQRIMVFAIAGVRTGFIVDSVSEVLKIPRSAIVPAPDLAQDDDSAVERVANLAAAKRIILMVNVDRLLSRHEVADLRAA

SEQ ID NO: 446 - protein, 96 aa, Methylobacterium sp.
LAEAPGRIRRLSADKGYDADWLRTDLRRNGITPVIPGKRGRKRRIRHDRSRYRERWRIEAMFNRLKDFRRIATRYDKLARNYASAIALVAVVAFWC

SEQ ID NO: 447 - protein, 63 aa, Methylobacterium sp.
LAEAPGRIQRLAADKGYDADWLRADLRKSGITPVIPGKRGRKRKIRHDRPRYRERWRIEATFN

SEQ ID NO: 448 - protein, 202 aa, Methylobacterium sp.
APPPVFTPVPVFTWTGFYFGVNAGYGFDANSRNTTNYALPGGSLINSPGTAGVVSVNNRSNNDGFSGGAQIGYNYQFTPGSGVVIGFEADAQYVDFARRANGTQNYAFGGAPGIAFAAPRAFVATSGNGLDYFGTVRGRLGYAFDRTLVYGTGGFAYGSGSADRSFGGFAGNDSFRTGWAAGGGVEYALPTDSFLNFFRSSA

SEQ ID NO: 449 - protein, 554 aa, Methylobacterium sp.
MNFVHRYLGESRAVSDADATRLGFVPDTLREPTYFAGTVARHLPFREAISALHHVVVSDLRFKPKDRTAYFAWLQAHEQELLAEALAEKDSLRAEIEALRAESRDIAARSDAVMRSFYDARKRYFDYLYRENLDAWIVLDPVITVHPDEIFFEAFSLDESSYGRLSCDHDTFARIGDMACGTTNIDYSHALYDEFQKIRSYRDTELAIDPTGFAVQTSGEAAYREDKIDLPDSWMRGFLQVSSAMAQPAHVVDLHPVDMHAILTRLAARRERHGPRSLRFLLEPGRPVSVLIEPWNERLTFRRSIYRGGETAEIRLWGRRRLAILARTLPLARSVRLHLLGTGLPAFAVVDFGGLRFTLGLSGWTANDWSRAGQFDLLAPRADVDADTAARVFAALRRHHAADTGQLAAETGLDRSTVEAALGGYVQAGRAMFDLDKRVYRLRELTREPLAPGALRFASEQEAKADRFLAAGLVTLGPVEQAGDRRRLSGTVLDDGRSLTPAVELDSDDRMVGGSCQCGFYTHNRLTRGPCEHMLAVRRLVHAQVEGKPVRWQA

SEQ ID NO: 450 - protein, 373 aa, Methylobacterium sp.
MRNNIPATVGMPVEEVDTPCLLVDLDALERNVDTLGRFMKAHGLRHRAHAKTHKSSDITVLQIERGGACGVCCQKVSEAEALVSAGIRDVLVSNQVVAPKKIERLAALATRARVLVCVDDLGNVDDLSAAAVRYGVTLECLVEIDVGAGRCGVAPGEPAVAIAKKIATAPGLRFAGLQAYQGKAQHVRDFGERKALIQTAIDETKRTVDLLKTEGLDCAIVAGAGTGSFAMEGGSGVYNELQCGSYVFMDADYQRVKDADGRPIAEFENSLFIYTAIMSKAKADVAICDAGLKAQSIDSGLPVVFGRDDVEYVKCSDEHGVISDPGNVLKLNERLKLIPGHCDPTVNVYDWYVGVRNGRVEAIWPVTARGMTL

SEQ ID NO: 451 - protein, 390 aa, Methylobacterium sp.
MNARHMNARTADLEVGFDVPALPGMREDEIQTPCLIVDLDALEGNIRKMGDYAKAHGMRHRAHGKMHKSVDILKLQQSLGGACGVCCQKVSEAEVFARAGIKDILVSNQVRDPGKIDRLARLPLHGARIIVCLDDVANVADLSAAAQRYGTRLDCFVEIDCGAGRCGVRTAPEVVAIAQAVAAAPNLRFAGLQAYQGAMQHIDGYEERRAKLDAAIAQVREAVEALIREGLEPELVSGGGTGSYYFEAGSGVYNELQCGSYAFMDADYGRIRDRDGNRIDAGEWKNALFILTSVMSHAKADKAICDAGLKVQSVDSGLPFVFGRDDVKYIKCSDEHGVIEDPEGRLKVNDRLRLVPGHCDPTCNVHDWYVGVRNGRVETLWPVSARGKAY

SEQ ID NO: 452 - protein, 231 aa, Methylobacterium sp.
MTQGPALSEIGALVGDPSRANILSTLIDGRALTATELAWTAGVAPATASEHLTKLVAGGLLTVSRQGRHRYFRLASVEVARMLEAMMVIANRAEPEGASRRATPRIDPALREARTCYDHLAGRLGVGIADALVSRGPIVLGEEAGEVTASGSAWLAAFGVEVEPAGRTRRLLCRPCLDWSERRPHLAGRLGAALCRRCEDLGWIERQRDGRAIRVTETGRLGFESEFGLVA

SEQ ID NO: 453 - protein, 130 aa, Methylobacterium sp.
MPLTRISLRAGTTETYRAALVAGVYDAMRETFAVPEGDLFALVHQHDASDFAYGPDYLGIRRSDRLVIVQITANATRGTAQKRALYAAVTRNLARDPGVAPGDVFINLVEVNPENWSFGEGLMQYGPPEP

SEQ ID NO: 454 - protein, 349 aa, Methylobacterium sp.
VSPLALGTMTFGAARWGSDATVSAAIFDRYVEAGGNFLDTADVYAGGASETMLGDLITARGLRDRLVVATKSGFPRAQGTPLAGGNSARNIRSGLESSLRRLKTDWIDLYWTHVWDRTTPPEEVLRALTDAVARGDILYYGFSNAPAWYAAQIAALARAHGLPEPIGLQYAYSLLDRGVELDVLPAGRALGLGLMPWSPLAAGLLTGKYGREKLAQAGPAGSLPDRAGDAAEGGSDSRLNGDNPFGGMLFTEANFAVVDVLRAVAADVGRPMAQVALAWVARRPGVASVLVGASRPEQLAQNIAALEVVLTSEQQARLDEAAAPPQLNPYFIFELPTSRIFGGERVEAW

SEQ ID NO: 455 - protein, 74 aa, Methylobacterium sp.
MRMLSMRGAALIFGTLLVIATFVWFMYFVPLGCVMNTTGCRETFSVWSGLGLVHFWSPLLVAGAAMLFGLSGSR

SEQ ID NO: 456 - protein, 80 aa, Methylobacterium sp.
MTRGAIIGLVAPFICIHAALAAAFTGTGGGPETTINAPYRSSVGQTVPPGAGAAPLHDPRERTRRQKDLDAVLGSVCDKC

SEQ ID NO: 457 - protein, 149 aa, Methylobacterium sp.
MRRAAPDPAIEAKRRGPPPQDVDPAIEALVNDIIGQVADKWTMLILEALEEHGTLRFTQLGRAVGRISQKMLTQTVRQMERDGLVRRTVHPVIPPRVDYTLTPLGRSLGAAFCGVWIWAETHHAEIERARRAFAAAAEAPDPPADAEAP

SEQ ID NO: 458 - protein, 117 aa, Methylobacterium sp.
MAGITTHVLDTDRGRPAAGVRIDFSVLENGQWRLVKSVVTNADGRTDAPILPADRAETGQYQLEFFVDAYFQGRAGTAEADIFIDNPVVRFAVFDAKQHYHVPMLCAPSSFTTYRGS

SEQ ID NO: 459 - protein, 188 aa, Methylobacterium sp.
LEHGPDRHALTRRGLVATGLGAAAAVSAGPTLAQGTPAPAAAPANAPAAAPAGAPTKPGTLNTAPVSQAGLSPRLTLHAIDNFHGTPGAGMVCDLAMHDGTGYRPIRTVTTAPNGRTAEPLLVDEAFKAGRYELVLHLEAYFANLGVKLPTPNFLGLVPIRFRIRDASQRHHLPVLFTPWGYSYYRGS

SEQ ID NO: 460 - protein, 697 aa, Methylobacterium sp.
LPRANPVSALRRAARTALILLGMTCLAPLAPARAAPDPAAFADNADAVAVVIGNRSYKQTVPVDYAHNDADAIRAYLIERLGYRESNVFLLKDATLNEFNQVFGTERNPQSGRLWRSVREGRSNVFVYYSGHGVPDLATKQPFLLPEDGNPNQGESGYALETLYRNLELVKRKIGADHQLVVMVDACFTGETGRKGESLLAVSAPGFAPARPKTEGGIVRLVATSGATPANWDEANKLGLLTSRFLMGVSGLADARDHQGDGDGLVQWTELKRYLRREVEDAARRASGREQVPEIDEAPIVLKASLPVAAVAKGVEAIRDEAAWRRAEALGTREGFEAYIGACGETCLYRPQAMDRLLAGRRRDAAVIDQENWAKFGTQRQYQAYLDSCGEVCAYRSLAEGYLGGKNPSADPRVKRCDELAAGTDDPDRPSGVAGVKLGRIEPAAAIDACRGAAAAYPDLRRLSYQLGRAYDRADRYKEAFAAYDRAAKAGSISALNNLAALYENGQGVKRQQAEAFRLYRQAGEGGNVVALANAARMLEYGNGIPKDEAQAVALYRRAVAGGDVASISKLVPHYATGAYGFPKDLRQGFDLFRQAADRGDPVAMATMATLIDNGFGRYFPGVRSADMVLRALKHGELGAASVSATDTAAQKLKPETIRSVQRAIKDADYYTGALDGRFNPVFVRALDQYARANETE

SEQ ID NO: 461 - protein, 105 aa, Methylobacterium sp.
MAIRTMARPSPSRRRLRVILILLLITWLPVVPFALGLALTSLTGCTVNEAGTHPCPVAGHDIGGLLYTLTMTGWLLIPFLPFMALTLLLTVVQGLLMILRAWLRR

SEQ ID NO: 462 - protein, 120 aa, Methylobacterium sp.
MFETETIMAGSASPTAFDIEEQRARIERAHEETRKFVAEQHKLIAEQSNLAAEQTKLAAEQFKMTAEASKTAVEQTKLAAEAAEIGRDRSLAPWQVALSGMTAGAALFGAGAAFVKLLGR

SEQ ID NO: 463 - protein, 299 aa, Methylobacterium sp.
MHDQSDLEIFARVVRTGSLTQAGSELGLSVAVVSKRLKRLEERLAVRLLHRTTRRVAPTDVGAAFFERIAPIVDAIAEAESLVSQTATRARGTLRVTAPSSFGRLHIVPHLRAFFALHPGIVLNLELSDDFESIVERGYDLAIRVGALESSGLTAVRLAPVQRVLCARPSYLDAAGRPQSLDDLRGHVCLATENQNPWRLVGPEGPCTVSASGPLRTHSNEVVREAVIGGLGIALRSTWDVHAELRDGLLEVVLPAYAAAASAGIFAVYPSRAFVPAKTRAFIAFLKQTYRSSGAWADG

SEQ ID NO: 464 - protein, 387 aa, Methylobacterium sp.
MRIVDVREVTKPIASPIRNAYIDFSKMTTSLVAVVTDVVRDGRRVVGYGFNSNGRYGQGGLIRERFRDRILEADRDSLLVDAGDNLDPHRVWAAMMRNEKPGGHGERSVAVGTLDMAIWDAAAKIAGKPLFRMLAERKGVAADPRVFVYAAGGYYYPGKDDSALRAEMRGYLDRGYTVVKMKIGGAPIDEDRRRIEAVLAEIEGRGRLAVDANGRFDLETAIAYARMLRQYPLFWYEEAGDPLDYALQAALAPYYPGPMATGENLFSHQDARNLLRYGNMRPDRDWLQFDCALSYGLVEYLRTLDVLAEFGWSPARCIPHGGHQMSLNIAAGLGLGGNESYPDLFQPYGGFPDGVRVEDGHITMPDLPGIGFEGKSDLIAEMRALAA

SEQ ID NO: 465 - protein, 325 aa, Methylobacterium sp.
MAEGSELKADGWTLANFTGAIHRGGVGLWAWSPSRRVAQLDALCREFWGVSEPEVDIDALFARVHAEDRPGMVESWAASERDPDAYSFDFRIGEGPDARWISARGVGGDAGRVGEWVQAIFMDVTERKRAEEAERLLTAELAHRVSNMFTVARALTSIVARDAKSAPSFAEDLSRRFGVLHEATALATRAHHGDHGHVPLGTLAERILAPYRNGANVEVDIEDAVVAPPGHVNDYAMIFHELATNSAKYGALSGGGTLSVRGSATGDATRITWVEGPAPSGAAKAAGTGFGSRLLKQTIERSLGGRFERSIDADGLRFEMVVGAG

SEQ ID NO: 466 - protein, 84 aa, Methylobacterium sp.
VLATALVLLAGSARAEDFTGFYAGINAGYGWGHARDGRAAGPAPGAAAAFSKTDPGADLPPSARDAAVAIRRAGRVGTSGTAGP

SEQ ID NO: 467 - protein, 516 aa, Methylobacterium sp.
MNQDEPREIRLALDAIPLGGKAEGKAGDDAVLFVRDADGVRAFQAKCPHLGAPLAKGEICGGRLYCPWHKAAFAVADGGLEEPPALEALTRYPVRIEGGEAVATLSPEPAPAKRAETPVAHVLIVGTGAAAVACVTTLRREGFAGAITLVGREGHPPYDRTKLSKQFLAKPTPAEKTLLESDFAAAHRVERIEAEATRIDPAGRSVALADGRTLTGDALLIATGSRAVVPDFEGRDLDGVMTLRSLDDAVRLSAAAERAARVVVIGAGFIGLEAAAFLTKRGLSVTVLSREEVPFAKRFGEAVGAALKRYHAGNGVTFVTGTVARIAGTGSVEAVETEGGARLPADLVLIGAGAAPETGIVAGVEPDESGGLPVGADLRLADNVWVAGDIAAFPERGSGVTARIEHWRLAQQHGTHVARAILGATGAFAGAPFFWSNQGDKRLDYGGYAPDFERIILQGDPAALDFIAYYVRDNRAVAACSVGRNPAFTAFLHLLGEGRVPAPDRIEAGADLAALV

SEQ ID NO: 468 - protein, 303 aa, Methylobacterium sp.
MIDSVMLWNEPNNKSHWDPEIDPDWLLFAEMAKEAGHAVRAANPNLIRVLGGISPIDPVFIRNMAGRGVLDAVDAVAVHGFPLDWNLWSIHDWPAKLDEIRAVTDLPVWVSEVGVSTFGAEEVQDWGLRRTLELLSGRAPRIHWYSLYDLPREWEATTRHKEAEGSSYYRHFHMGLLRQDGTPKIALESFARHTPEIGLCQWFHFEDHRLDEAVAWMKRLGVRYLRTGLSWADSFRPGALDWFDRQMAALQDFDVTVTFCFTPEHRGISPHHTSAPLVRAEFAEFCAAMVRRYAPGPLPGTTW

SEQ ID NO: 469 - protein, 262 aa, Methylobacterium sp.
MTDRILTASDLRRQADALGPWFHNIDLGDGVWTAPDHFLGDYPGVKWRRFADALPADLTGKSVLDIGCNGGFYAIAMKQRGAARVLGLDSDERYLAQARFAAASLGHDIEFRNLSVYDVGTLGERFDVVLFMGVLYHLRHPLLALDLIREHVAGDLLVFQSMLRGSRMVEPVAEDYDFWDMDQFERPGYPRMHFVERAYAHDWTNWWIPNRAGIEAMLRASGFAIAAQPEAEVYLCRTAPVPYGLGAEYPARAQAHGRGGTR

SEQ ID NO: 470 - protein, 200 aa, Methylobacterium sp.
MRQVFLVRHGSHDRLGRVLCGRMPGVSLSEAGRAEARALADALARRLAGRGAGTLLASPRDRTAETAAPIAAALRLTVATEPDLDEIETGAWTGRSFDALAADPLWATWNAERATARPPGGESMGEAQGRVGRVLARFAVDGAPVVLVSHGDVIRAALLGLLGLGLDAYDRIVVDPASCSELALWPGGGRVVSINERTAP

SEQ ID NO: 471 - protein, 360 aa, Methylobacterium sp.
MAAAPIRVGLVGVGNCASSFVQGLHHYRDSAPGEPVPGLMSPDLGGYRVRDIAVVAAFDVAAAKVGRDLAAAILAAPNNTQVFAAVPETGVTVRRGPTHDGIGRYLEGVVAESPEPAADVVAELRRTGTQVLVSYLPVGSQAATEFYADCALQAGCAFVNCIPVFIASNPEWAERFAAKGLPIVGDDIKSQVGATIVHRVLANLMRERGVRLDRTYQLNFGGNADFLNMLERERLESKKLSKTRAVTSQLDGALAPGDVHVGPSDHVPWLTDRKWAHIRLEGTAFGGVPLNIELKLEVWDSPNSAGIVIDAVRCARLALDRGLGGALEGPSSYFMKSPPRQFTDAEARDRTLRFAAGEGV

SEQ ID NO: 472 - protein, 860 aa, Methylobacterium sp.
VTNALLAQFIPEARELLERAGSGMLALEKSPGAEALDDVFRAVHTLKGTSGLFEIAPLTHLVHAAEDLLVEVRAGKLVLEPAIVDGLLDSLDLVGHWIDVLESRAVLPDDADVVMAGRVTTLRAWLPAAIDTTVARADHGPPDWLADLPEADRQAAWRRAAASGEPLTAWHYEPDEACFFRGDDPAHLVAQAPGLVALRVRPRAATPSPETCDPVLSWLRFEVLCVADAEAVADHLRYVADQVRVGAIRPDDLIVLTGTEDEAEMFGDFAARAGTLLAGDERADLAASADALLGIIGAGTRQACALRWIAALAATAETETLRRLAADLGGPRPASGSPPTDRPPADAPAAGGTLRQQAEAILAAQAEMLAVPADPAVAEGRFESVRTVVRRCLPHLAPVRAAAVEAALGRSRAGATEALGAVLRGAASGAPAAPPMPPLAGEPAPRPSAAPPPATEPRDAPEGAGPDAKGPARMLRVEQGKVDALMNFAAELTVAKNGLAYLAGRVEQVSGSRQLGREIKEQYAVIDRIAQSLQVGVMAIRMMPVSQVFQRFPRLVRDITRKLGKEVELVILGEETEADKNVLESLADPLIHMVRNALDHGIETPAIRIAAGKPARGTLRLAARQENDNVIIEVADDGRGIDPEAVRAKALRSGLIGPDQAAQMTAEDLVNLVFAPGFSTRDQVSDLSGRGVGMDVVRSAVRRAGGDVWLASQPGAGTCVTVQLPLTMAVTRIVTVVARGQQYGVAMDAVAETVKVPRDQIHRIKRRETFVLRDAMIPLIRLADSLGLPAAADAPPEEEAVMVARVGRERVGIVVDGFRERMEVIVRPLDGLLAGLAGFSGTALLGDGRVLLVLNLSDLL

SEQ ID NO: 473 - protein, 296 aa, Methylobacterium sp.
VHQRLPNAPRSAATARPRRRAGAGVLAPGSALCLQLCISLCLALPARAEVENKTARPGQRIFLQGFTYYFATQGCRSRAATIELVRPPRGGRIEQRREFRILSGKVDETGAQIRQPDGCEDAKKDSMSLYYTARPDFSGLDTLSIDVTFGDGSTVPYTFRITVPPGEPRRAPAVSQAPVPRAGGAGQAAPAARATPAPAPREAGTSTGDFLRDTVRDTVRGSVARRAAADRASAAARDGAGAAPPASGHAAALRPRGWPVRPGLAHPTNPRLTGPPAAQVRQVTDRATGRATSRAK

SEQ ID NO: 474 - protein, 354 aa, Methylobacterium sp.
VSGRPILVTGGAGFIGANLSDSLAADGHAVIVYDILSRPGVEANLAWLRQRHGNRIVPVVADIRDIQELGRAVAEAGAVFHFAAQVAVTTSLVAPRADMEINLLGTVNLLEALRAQARPVPLLYASTNKVYGDLPDIALEAVGDAYLPADPDLRRRGIGETRPLDFHTPYGCSKGAADQYVLDYARSFGIPAAVMRMSCIYGPRQMGNEDQGWVAHFLIRALAGEAVTLYGDGRQVRDILHVRDVVAVYRAALARIDDAAGHAFNVGGGPGNAVSLLQLLDHVGTLLGHPVSRSFQAWRPGDQRYYVSDTRRAVARLSLAPFTGWHDGVADLAGWLAAARASSDGAAPIAGAAA

SEQ ID NO: 475 - protein, 435 aa, Methylobacterium sp.
MRVALVNPPWDYRNSIYFGCREPHLPLELGYAAALLVAAGHETLLVDAHLEGLTAEAAADRVAAFTPAMTVVATAPTYLFWRCAPPELRVPRLFLDTLAGRGGTTVAVGPHGSATPRPVLDKLGCAVVVRGECEEVVARLAGLPDQRPDTLRTVPGLAVRDGEAAIVTGPPQAGRFTDLPALRWPEGWVARHRHHHHRFDAAPDGPGAEVEASRGCPYTCSFCAKIDFRDAYRRRELPIVLDEIDGLIAQGVTYVYFVDEIFLPQKPLLEALVARDLRFGIQTRIDLWKPDMLDLLGAAGCVSIEAGIESLTEAGRAALDKRCRASTDDLAERLIHARRTVPFVQANLIAVAGDDPDLVAAWRDRLRGQGVWANDPVPLYPYPSSPDYRRLWGAPDDQAWERAHAHYLGQFTQFSDIQDERPLPLSELEAACGCC

SEQ ID NO: 476 - protein, 370 aa, Methylobacterium sp.
MRIAYFTHSLASCWNHGNAHFLRGVLRDLMARGHAVTAYEPENAWSLANLLRDHGEAGLDAYRAAYPELASTRYADVDAVVERAADSDLVLVHEWNEPALVAALGAARRRGARYTLLFHDTHHRAVSAPEEMGRFDLSGYDGVLAFGETLAAVYRAKGWGRRVFVWHEAADTRLFRPPAREGTRAGLIWIGNWGDDERSAELESYLFRPAAQVGLPLDIYGVRYPAAALATLERYGARYHGWAPNAAAPGLFARHLATVHVPRRFYVERLPGIPTIRVFEALACGIPLVCAPWDDAEGLFRPGLDYLVARTGAEMESHLRALRSDPGLRQALAIAGLATIRARHTCAHRAEELLSIAASLRAPATLEATA

SEQ ID NO: 477 - protein, 228 aa, Methylobacterium sp.
VKIAFYGSSLLSSYWNGAATYYRGMLAALARHGHTITFYEPDAFDRQQHRDIEPPPYAAVTVYPATIEAARAVIAEAATADVVVKASGVGVFDDELLEGIIAASRPEALRIFWDVDAPATLAEMRADPDHALRRALPDLDLVLTYGGGPPVVAAYEGFGARACIPIYNALDPETHFPVPPEPRFAADLAFLGNRLPDREARVEKFFLAAAARLPERSFLIGGNGWENR

SEQ ID NO: 478 - protein, 234 aa, Methylobacterium sp.
MPKLLIVDDSALMRKHLRLIFEETGQFEVRTARNGRDALDQIDTFEPDVVTLDINMPEMDGLTCLGEIMAARPRPVVMVSSLTRESAAVTLEAMQLGAVDYVEKPGGTVSLNIGEVRDEMVAKVRVAARAKPRRARGLLDRVRRGRGEIATRRPAPRAAARVEGCVLIGVSTGGPRTLEEILPELPADLPWPVVIAQHMPGSFTGAFAQRLDRLCALEVVEVTAPAPLAAGRVY

SEQ ID NO: 479 - protein, 193 aa, Methylobacterium sp.
PIYNKIEAAKPDLIVTGISHVGVQPTVQWQNQKVPLAMTGMNSQATSSTFWSNTNGATQGVIFQSIAVPGAAITDKSLAFSAAFKKRFGSDPSYAGYMAYDQVYYAADAVKRAGTTEADKLVDALEKTDWVGTVGRTQFYGKDDPFTHSIKYGPGFVTGLMAQWQDGKQVAVWPKSLAQGAIVLPAAVKAAAR

SEQ ID NO: 480 - protein, 193 aa, Methylobacterium sp.
PIYNKIEAAKPDLIVTGIAHVGVQPTVQWQNQQVPIAMTGISGQATSSTFWANTNGGTQGVLFDSVAVPGVALTEKTIPFAEAFTKRFGGAPSYAGYMAYDATHYAAEAVKRAGSTEADKLVDALEKTDYVGTVGRLKFYGKDEPFTHSIQYGPGLMTSVLGQWQNGKQVAIWPATTANGTMILPPAVKAAGR

SEQ ID NO: 481 - protein, 176 aa, Methylobacterium sp.
GGVDGRQIQVVTYDDKSSASDAVRAFQRAVSEDKVNLVIASYISEVVLALMPWAARLKTPMITPGAASNEISAAVHKDYARNKYTFHGYLTSAALAQSICDSTKDMLIDLMKVKTAAIMSEDAAWTRPLDVGYEKCLPEIGVKVVDHIRFSPDTGDFTPIYNKIEAAKPDLIVTGI

SEQ ID NO: 482 - protein, 350 aa, Methylobacterium sp.
AEAMGIGLGELRFLAYDRALSAVSHYRRFTIPKKAGGLRRISAPMPRLKRAQYWILDALLAHVPVHAAAHGFVPGRSIVTNAAAHVGRDVVVNLDLKDFFPSLDYRRIKGKFRGLGYAEPVATVLALLCTEPDVDAVEIDGARLYAARGPRRLPQGAPTSPALTNLVCTRLDARLAGLAGSLGFTYTRYADDLTFSASGEAAGKVGALLKYVHAIVAGEGFTVHPDKTRVMRRGRHQEVTGLTVNERVGVPRETLRRFRALLHGLERHGPAGRRWGAAGEAGVLRAAVGFAQFVRMVRPETGAPLVAQARALADRHSAPATAPRQPDFRARSARGEVPLARWWVPAPRPA

SEQ ID NO: 483 - protein, 1040 aa, Methylobacterium sp.
MRVVRAARLHLRDATSDKVYDVDLIENEALGTPERYFVNTRYGRRGATLREGSKTPQPVTAEAAARVFDSVVVSKINGGYRRVDGPETAAPEATPDGREGVLRARLSACLRESWAERDRDRLLWRIGELRLAAAAPDLIALARGLGPARASYALVWALARAAGAQAGPALAAIAAEAPGSVVRDLARFALAAPLTGPYRPPEAEPDLPGMVARPAEAGDVDGLCGALDGLARHDPGRVGPALVALGRRAQAAPGLHATLCAALLRLPARPPYLIGLRRLFKHAEMADDAALFGATAQRFETAQAMYQAGRSHAYVPDLRRYVAVDAARQGPEARLGLSTATRAYMKRRIWRALRKRGAVGDPAFAALAAGFLLALGPEDLDPPTRWTAWGRQPDGTWGRQARARGPLARNWTASQLLYRHAPEARPRTGSLTFLETGAVDPDRRDEAFPDLWSARPDLALRLAAEGRIEPVARLGLRVLRADPRACAALTASEIGRLLAAPHDAVRTFAFRTAQARLAAGIAEPAELAALVAALLASPEPEARVLALRRLEAGTPIVWSDPDLAAALLTSPEPDVQAALPGLAGARALPTGLAAPLVARLVAWLRAMPPEPDAAATAAIRGLRAALPLLWPDHDLPVASETAAALIAHPSAAVRSAGLALLAQSEAGAAGLPPESWDALIGAESEDIRIAALVLLARLDDARLGPYADRIVAFASGPDSAVRRAARPLVARLAAADPGLAPRLARELIGSLFLAAPDDAYAADTVALLREALPGECAALDDGTLWRLLQARADGARRLGAALLPDRRPEALSVRQIARLGGHPYRAVRDWATAAFAVDPARFQAAAAEAILLVESDWPDTLAFARSLFDAWPETAWTPEALAVVTDSVKPEVLALARHLLRSRLRPEDAEAQVLRLLEHPAPSMHLLLTELLTEQAVASEAAFARLIPLARIVMLQVLRGRVAKDRMAAFLRAEALRSRTRAEALLPLFADLTLSGTARDRSAAILALRDVADAHPDLAVPLVRRPPEARGPVSVSEEAR

SEQ ID NO: 484 - protein, 245 aa, Methylobacterium sp.
MNARTSAALAGAACGCLALAAQAADLPRRAPPPPLPSLPVFTWTGFYAGVNAGYAFPTGSGGFTDPTYGTVTGGGRSGGFAGGGQIGYNHQFTPGSGVVVGVETDIQGAAFAKADAAYLGTTPYYSVRPSLDYFGTVRARLGYAFDRVLVYGTGGFAYGGGARATYAGAYPYTLPSTDRTGYAAGGGIEYAFTEKLSAKVEALYLHLGRGTTAATYYNASVPAFYGAGKQDSGFAVVRAGVNYRF

SEQ ID NO: 485 - protein, 233 aa, Methylobacterium sp.
VVLKAPSDASPGIAAMPQIAAPADEAERRINAALKRLDARALKAEQACKDQGGKNSSWERTVEAPMRGPRFLSFVIFDSGFCGGAHPNSGTMSIVYDLTTGAPVDWTTLLPLSLTGKLALAEGPGGTKMVTLASKKLHALYLAGYRPKTGDPKADDADKECREAVAETYDGQPPAMMAWLDAKAGGLAVQFDLAHVVQACADPVVIPVATLRREGAQPLLAVALEAAHAQAGK

SEQ ID NO: 486 - protein, 85 aa, Methylobacterium sp.
MTKTKILVLAASLLCAAGPALAQEAAPQHGNQEFLGVDLDNGGVYYNGRNSGRYCVYRTVEVYNRYTGYFEARRARRCGRGLYLP

SEQ ID NO: 487 - protein, 170 aa, Methylobacterium sp.
VSDAARLLAEIHAARALVRDAAATARPDHAGLWAHATRAPDGPVDLATVRAIRGDPATARRYRTMLGALALAHAPLAAAASDGAILRRRVGAFALEILEAADGAPPLLVLRGESGQMPRVIEAWLGDETVRLDLGPAIEGAAVLALDPAVPEAALMGRMLRDPACAVFLL

SEQ ID NO: 488 - protein, 376 aa, Methylobacterium sp.
MTRPAILVVVPTTRGPLVLRGLRPRPGLPAPAAFADGDYRPLPWSADYARLCGAAGPLARWAGRTPEPHELRLSGSFDAGRSWEVPVCLAHGLAEGGHPLAAAPEEADLILWATGAVDLDLAVLPGDYALLDKVERSTAMIAEAPDAALAVLLPDGPERAQAEAVFRGMGRNVRILPSHSVPEALAALTALRDPERAETPPARRWQRLALPAGAVAAAGLAGVLALGATRPDPISEPRPEAPAGPAGPHPGAEARIAPPIHVSELRAPAGSSCRRVAFGADPPERRPVPAESGDHLAASRLTPDLCGLAIGVEPGLRAQVGPELRDAALPAVRLADGALGYFLREGARQNLVYTVQAVPEAGTGAVAGRLVHTLVR

SEQ ID NO: 489 - protein, 326 aa, Methylobacterium sp.
MISMRRRGPLLLGTACALIVLGRGDAARAQSVGFDPADYGRAQLPLRQTTGDAAAYVDQNKGAFEPVSELDPKDGLAALARPIGRVDIVLQNGRTGQQVGASCTGTLLPGDYVLTNHHCLPQSGDLRPVKASILMDYLTLDGKGSRRFEIDPKPVEFDARLDFALARVAGNPTATYGAARLSGEPVTANRSMLVIHHPLGRPKVMSRFRCFAMKDQAEGPDLRHRCDTLGGSSGSLMFDASVAGIALHKEGGLDPKDPTSFNSATRLSAILGRSPTLARIAAAQGRPVAAADPGTRPVAPSPTPQPKPATDGPLDPAGMNAILRGR

SEQ ID NO: 490 - protein, 317 aa, Methylobacterium sp.
MPLVRTTAFRAACLAVLALGSAYAAPARAQTKPNVVVMGEDADEDAVPRGNRIFQRVIHELSETMNLRGYNVYDETAVAMGFTQANRVRRRDAELIEVARAVQNPPLDVVAVFQIYASASKSAYSDIVRPEIRIPGRLLNVRTGQSLGSFEVAGLQLPPLPQGCDRECLLERVGAEAKTVAADLAAALTAKLDGVIAPRRGADAGAAPPDAAPVGGAVAAAPGGESCGGLPSAYVVRLSGFSAQEVQAAEEYMAAFRCYEHHRPVRASGASTEYWYETRSDSARLGRNLRLMLEHMSAPGQVQFSGNTFVISRVATR

SEQ ID NO: 491 - protein, 374 aa, Methylobacterium sp.
VRAAPIRLVVLGLSLSSSWGNGHATTYRALLKAFADRGHDVLFLERDVPWYAQHRDLPEPGFCDLALYADLDGLDAHRAAIAGADAVIIGSYVPEGIAAGDRVLDWARGVTAFYDIDTPVTLAALEAGTCAYLAAGQIRNYDLYLSFTGGPTLRRLERDYGSSAARALYCSVDPDSYPALDRPARYDLSYLGTYSPDRQPTLERLLIEPARRAPDLRFAVAGPQYPAGIDWPANVERIEHLPPDRHPDFYAASRYTLNVTRADMVRAGWSPSVRLFEAGACGTPVISDRWDGLDSLLVPEREILLPDGPDAVLVILRGRAELDRRSLGAAARAAILARHTAAARAEELERFLGESGARSGSARSGAPDLAIIGH

SEQ ID NO: 492 - protein, 265 aa, Methylobacterium sp.
MTEPGTGRILAVANRKGGTAKTTTAVNLAATLAERGRRVLLVDLDSQGHAGLGFGVRARPGEPTVHDLFRGAGVTDLGRAVRRTAVPNVDLLPADRGFSGPDGAVAPLGLAATLKPVAADYAVILIDTAPTADALLISALASAHHVLVPTQLSHLAVDGVGQFARAFFRVATSLNPGLRGLSIVPVQVDLRITMQREALEQLASRFGRERLLPGIRTDIALAEAFGCGRPVRHVKPRARAVQDFELLCDHVMEKCVAGQIGTIKT

SEQ ID NO: 493 - protein, 651 aa, Methylobacterium sp.
MERLDKHPVALFAVIVLGATGLLVALRPDVLGSLAATPSALLRNGLILGGLVGGLLAASYIPARIEATRRALDRARASRKIRPIRFVDDGAAAEKKDLLATALATLDGMVGLDPVKLEVKGVIARMQVEQQRRAQNLPVAAMSQHMVFTGPPGVGKTEVARVLGSVFKALKVLRKGHLVEVDRAGLVAGYAGQTAIKTLERCKEALDGILFIDEAYALAPGGGSGGEFGKEAIDTLLKFMEDNRDRIIVIVAGYTNDMRRFIDANPGLASRFTKTVEFPPYSPPELAEILKRMAAGQGFVMPEGFEKDLAAYVGARSKAEDWANAREMRTVLEKARQAQALRLAASPGGDINRLEPADIAAALGRQAGGAVDMDAARKVMARLDAMVGLAPVKEQVKTVAARVLVDARRRAEGIEVGAVSQHMVFTGPPGVGKTEVARIMGDIFRTLGVLRKGHVVEVDRAGLVAGYVGQTAAKTLERCREALDGILFIDEAYTLAEGGGGGSDFGKEAIDTLLKFMEDNRDRIIVIVAGYTGDMARFIDTNPGLAGRFTKTVEFPAYDPYDLVEILRLMASRQSFRLPPRFETLLIPWVEQRAQRHDWANAREMRTLLERLREAQAMRLASDPLGDYGQFELVDVERALGGGAPRPAALS

SEQ ID NO: 494 - protein, 464 aa, Methylobacterium sp.
AGASPLWRGAGLLALALAVSAALLHANLAAVLPPGQWWAALLHPTDSDMPQLVLRDSLLPRLAMAVLAGGGLGLAGVLFQQVLDNPLAEPGTLGVFAGAKLALALATLWWPALLIYGYEPVAGAGAALCTGLVLLLSGRSGYAPSTVILAGLVVGLSAEAANRMLVLAHFDALSDLYAWQAGALNQNNWDGVRGLVPRLALAALAAGLLARPLTLIELGDAGARGLGVSTAGTRLAALALGVAVGASVTGYLGVIGFVGLAGPALARYGGARRLRDRLLWGPVAGAVLLVLTDQLVQRLIGRSGVPTGAVTALVGAPLLVGLILGLRTAREAPPAPGPVPVRLARPWPAIGALAILALAGVGLSLTLGRDAQGWLWSPDPGALLAWRAPRALAALGAGAMLAYAGGLLQRLTGNPLASPELFGVSAGAALVVVLVLFLAPGLGPAAMLAASAAGALATLLAVLA

SEQ ID NO: 495 - protein, 164 aa, Methylobacterium sp.
VPTIFDAHTFALTAHAGQLDKGGEPCMRHLERVANAAQTRAGHARLIDGLDIDPMRVMQAALLHDVLEDTSRTAADLRAAGFEADIVETVTLLTKPQSRIAYSERITALIAAGNLAALLIKMSDTEDNLCPTRIPPNAAFLRERYATAFERLKAAAAARGYTGR

SEQ ID NO: 496 - protein, 355 aa, Methylobacterium sp.
VDERLKDLTAKGDALQRLSGIVDFELFRDDLARAVPRSDGSKGGRPPFDLVFMFKVLILQASHSLSDERTEFLIKDRLSFMRFLGLGLSDPVPDANTIWTFREALTRAEIAGKPAIAVLFSAYEAALRHAGFLAMGGQIIDATVVAAPKQRNTEAEKTDLKAGRVPDAWKARPAKLAQKDRDARWTIKWSKAKPAEDGSKRIDLAVPAFGYKNHVGIDRRHGLIRTWTATDAARHDGAQLPRLLSKANTGSDVWADTAYRSKANEAHLASNGFRSRIHRKKPPGKPMARNVARANGEKSKVRAAVEHVFARQKGPMGLVVRTIGLARARMKIGLANLAYNMNRAVWLAGSRARTA

SEQ ID NO: 497 - protein, 92 aa, Methylobacterium sp.
MKHVRIPDFSQPVPVRIAANGKPVRVPVDRRYRNLPDEQQPGTIEPWQAVTPIRPDTAHSRSLRFLDATGELLAAVAIIGGGMILTGLASLL

SEQ ID NO: 498 - protein, 91 aa, Methylobacterium sp.
MLFMATRHSTAPARAGERSRSPAALYNRTKPAFESDEFAPGTVEAWEAVAPIRPDTAHVRAPRFLDLAGELATAALIIAGGVFAYGFMPIA

SEQ ID NO: 499 - protein, 226 aa, Methylobacterium sp.
VSTPHTLVRFLKANAFFAELGPEAIETIAGLCTTRSLARHEILFQKGDPGDALYAVRRGQIRIGAGSDDGRAVTLNLLGPGDVFGEIAFLDGHPRTAEAVALEPADLFVVEGRAFLKLLHGDPALAVRIIGLLCQRLRWMSARMEEATLLPLDMRLARRLIMLSEDYGAEIQVTQQELAAFVGAARESVNRVLQDWQRSGLIDLGRARVTVRASHRLVALGARAQT

SEQ ID NO: 500 - protein, 259 aa, Methylobacterium sp.
MAAALVLTTILGGTAYAAEQAVQTNGTQISASQAAVDKDVGKLSKDGAQGFRDLQLTRLAIFEANPGQAKDMIAKAQAAFAKAKTDDAVFTKAEADLKSPADMAAHKANAPSDKADTKADTKTASKEQVAWVPVDAQLTLGDDFVATPAKASAVTEANKNLAQGDQKGALEKLKLAHVDVNFTMAVLPLNQTITDVDQAATLINQGKYYEANAALKSAQDNMRFDVIDAIAVPQKATAATADKGAPQATGTTAGAKTSK

SEQ ID NO: 501 - protein, 309 aa, Methylobacterium sp.
MRLFVIGSFVIACSVKVARLPQAGESLDGLAFLAEPGGKGFNLALASHQLGVGVDGLFAVGTDVFSPMVRATFARVGFAEDMLVPHAGSTGAGVAFVDAAGENCLAVCLGANLALGAEDIRAAAARLERAELVAATFESPDASIRAAFALARTAGIPTLLNPSPMRPIDPAILADTAILVVNAVEAADLGLGTPDAIADATAATPAIAALLSGGLELLVVTLGERGAVAFRSGLPALRQPAFAVAAVDTVGAGDAFTAGLIAGLLEGQPLDATLRQAAACGALTTCQFGAFEAFPTAQVLAAFLRDADM

SEQ ID NO: 502 - protein, 68 aa, Methylobacterium sp.
MTNRNMVKDAAPGAQATQPNTPPLPPMPAPEDSATPTTREEPTDSPHLNASLKRDAPPPGGRGLSTKR

SEQ ID NO: 503 - protein, 444 aa, Methylobacterium sp.
MRRLLLAALLLAPAAARADPATQALTPFLDAVAACTGRPDLTLAVVGVEPGQTALSREQSEEVRLAVETRLQATGRVRLAAAADVVRIKALHEGTTGLSGAEAEAQIRSAFAGDAAVFLVEPRRAGETASVRLQAVTQSAACKATSDPLVVPIHVGAGVADVDAVMDGAVKAFAQAAPNAGAVEVCPFVAEGGHSTCAGALTDRLVIALDAEARSANRMLRGARLDVRRRPPGTACAGTVTARGRFRTDHDRQSWMEVEFQREGAVLAPTGRRRIATEGLGCDPVPRPFLDHLAATARTDAGRLSVAAAATPFAAGQRLEMRIESRVAQNLYCWVVAADETAFVALPVRDNAASQLALKPGDSRRYPRGYGLDEIVAGEPFENLFACFGVPGGLPPELAARWLAAAPGADGEARLLQPPDVLDLLDRIRATPGVTEAAARVVVR

SEQ ID NO: 504 - protein, 463 aa, Methylobacterium sp.
MTGGYDERCAADLANVGDGRDLSRADRAWLARVVTGAVRPNRDKPLWDLAHALAALAGAAGARDGRDLITLALDPGLARPAALSARFSGGPAVDDRGPVLGTAWSTGWAGLARLLALAEFVLTAEDLAQFATVAGWLDELAAAPDAESAAILAKRLARHLAAYRNAHLPLAPLERRFRALLTFLGGRRSVADDDILDFWRAEMATGERPGFRIVAEHFVTFEAAGRLLEGLDALSAPAALDAHAGWEERLDAALGDLAAAEPAAALATVLADWPEGPKILTGAEREDLADFLRLEPYHRTRPLTTLRAVSFGRVQSGIANRLRRGGGGAAIAERATCLEAESYAELRTRAGLLAAHLGRMLRIAAALRIADRDALPEAVRAALEAAEADLRRVRRAGFDDREGLSAGFAAAEPALLRLAEAAADLERSLDGLARHRPLDALFPADRDVFAVAFAAAYAGEAAA

SEQ ID NO: 505 - protein, 186 aa, Methylobacterium sp.
MSIDVGARLRFVRARHGLSQRTLAKRAGVTNSAISLIEANRVNPSVGALKRILDGVPIGMAEFFALEPEPERKAFFAAEELTEIGRRAAKGAISYRQVGDSLFGRKLQILKERYEPGADTGRVPLSHEGEEGGIVLSGRLEVTVDAERRILGPGDAYSFDSRRPHRFRCVGPNPCEVVSACTPPSF

SEQ ID NO: 506 - protein, 637 aa, Methylobacterium sp.
MDVPSPHALAEAGPTDGRWSAADRIAELRDLAILDSEPEPLYDDLVQVAAYVCRAPVALVSLVDAERQWFKSEVGLGKRELPINCSVCAHTIEAGDLLVIPDLTTDPRTTENPLVTGAPAFRFYAGAVIRGSRGIPLGALCVLDRVPRLDGLDSEQTATLLALARQISSLLEHRRTLAQVAAREAEIAASERRFRVMTSAMPQMVWTTRPDGFHDYYNDRWYEFTGVPYGSTDGEGWNGVFHAEDQDRAWARWRHCLATGEPYEIEYRLRHHSGDYRWTLGRAMPIRDAEGRIERWFGTCTDIDDLKRAEAEARKLAAIVETSKDFIGLSTLEGAITHLNEAAMALVGLPDLAAARTKKVPDFFTDDSRRILAETVMPAVRRDGFWEGELAFRHFVTGEPLAVLYNIFPVRDPTGAEIGYATVTRDLREAKRAEEARDLLIRELSHRIKNIFAVVGGLAALTARTDPAAKPFVAAFRERLGALARAHEYVRPHSPDSAPPVAGQTVLGLMRLIMAAYEENGRARVVISGDDAEIGERTATALALIMHEQATNAVKYGGLSTREGGVSLSGTREAGRYTLTWREEGGPQIAGAPSRKGFGTVLAERSVAGQLDGVLEHDWAPGGLLMRLSVPLENLRT

SEQ ID NO: 507 - protein, 419 aa, Methylobacterium sp.
VALILPAIAAAFDLDVAAAAWVAETYSVAFMSTLLIAGALADRYGRRRVLLAGNMAFAVMSLGCAFAGGSATLCAARALQGASAAFVITGALASLSLAYPRPTERARAFGLLGMTTGAAMVLGPSFGGFLAAAFGWRAVFLVNLPICLAVARTVPLRVSETFDPEGRPLDIPGVALLSGSLLACVLALLDGSASVLTRAMLLSGALGLGFLFVRRQFRQTRPMLDPALVTRREPLGIACVLVALSIGYWSVLVYLPLALKAVYAISTEAIGLAMLALTMPMLGLPPLGARLAVLWGWPRLFAFGLLVLAAGTTALALMLHWHRPLAETLTAMLVAASGAGLINAQVSSALIASGPAAQAGMTSSFSSTLRQIGFALGIALLGAVESTGTEGGSFALAFAVAASAAVLGAFAIMAARQAG

SEQ ID NO: 508 - protein, 264 aa, Methylobacterium sp.
VDWVIVQRFHSLEQAMTWMASPERQARIQGATPMLVGRDDVHIVKDDAGAARTSPVSAVISTRVKPGMEAAYLRWEQKIAAAQSRAPGMQGYRFEPAVPGVQEDYVAILRFDSEANLRTWMDSPERRALVAEAAPMTAEFHTRTVQSGFEQWFRNVAPPGEGAPAAWKMNMIVVLTLYPTVFLWGVLVGAPILAGMLKVDFPVALFIGNVFSVLLTSLMVPWTAKRLGWWLTPDPARRTRVNLQGAALLIAAYALMILVFWKLF

SEQ ID NO: 509 - protein, 152 aa, Methylobacterium sp.
MIVLGVALLAACTLIGVYLGDLLGLALGVKANVGGVGIAMILLITARLWLSRRGRLTKGVQFGVEFWAGMYIPIVVAMAAQQNVVAAVSGGPIVLIAATGSLVLCFGAVALLSRIGRRDPGGGAVAHGGSVIGGDAEPDAAAPAAVPVARKV

SEQ ID NO: 510 - protein, 143 aa, Methylobacterium sp.
ADRSVSEAILGALGRIGTPAAAERLFDLLGSDDVWLRNAAIETLQEMDAAVLGALERALADPDSDRRIFAVNVLVSLRHPAAATYARRVLAEDGHVNVCAAALDVLAEIGTPEMVPEIEAAAARFPDAPFLRFAARAACRRIT

SEQ ID NO: 511 - protein, 123 aa, Methylobacterium sp.
MARILVVDDATTVRLYYRDVLEEAGFAVEEAVNGYEGLEKAVAEAFDLVFVDVNMPKMDGYAFLRQGRTMPELQAVPAVMISTESAGADRARAFAAGANLYLVKPVRPDALVAVATVMAGAAP

SEQ ID NO: 512 - protein, 291 aa, Methylobacterium sp.
MSGVTIGTDRVRAHATLWYADARYRLAWLVLPQAAVALLAGLALALLKPAGEWGKPADSKENEKLYLDLLDKAGKDGDRAAFEKLRTAAEAGDVSARSFMGALYNPEWAAVYAKNPVKPDAAKALTYYQKPADLGFPGAQRGMTELLLDPARGQHDLKRGCRYGLAFQANPVAARNNYLDSWSTLYWIAGCYTDAGSGVPRDPQKAADLYMNTVAAKLPRAVTTFTDELGRQPPDLVAAIQRDLAKRGFYTGPADGTATPQTRAAVQALAGRGAGPQGSAGAGNAGAGNPG

SEQ ID NO: 513 - protein, 455 aa, Methylobacterium sp.
MGPRRKDPARFPAPRAGNRIGHRIGHRTARRAAAPMAALMAALLAGLLMPAAAQAQIKVRKADCFFAADGRTVIDGVCEFLTDARSYGVGGFRLATYTNGYLRDGVVVSVTAPGQGTATWNREPGGKPEDGPADSVTAEGACWTGSRSRICAWKVGEGRPGFGGAPAAAPEAGAPRAADCYLEVAGDVRLDGACQFRSETGQTGARGFEIRSYAAGKLDVVAQLVRDPQNPLKATAFWNGSSGGLRAAEALGALSPSGPCWDNDGARLCVWQPGQPRGGWDRRAEARAPAPPETPPSPPPSQAPSQAPPPPRDGAEGRDPPPGTFLKLSFKGRCESLMMDGEDLTATCAPEAVNTSVVGSPKAGFIFGTTDGKAMAFMASAKGFVEGGTLHQPVDELMYAERDQSTFKVKGTCEMPNPMGGPVVITCNAQSANSTYAVRFRTDGGKPVLTRGDAK

SEQ ID NO: 514 - protein, 178 aa, Methylobacterium sp.
SRAPPSAPPAAKPGLSPSLIAIVGGLVAAGAVAGVLLSGSGETAGTAARPALTLVKAGEIDKAAETLPSDEKDKIVAEAKACRAPLGQMRLSKMAADAGGVVRIRAGNYLSPAFNVADGPINIAVPFPAPYETGKGEITIEGAAKDVFVELTPGLKIDTTGGVQRIPVIWNTSKPCGG

SEQ ID NO: 515 - protein, 295 aa, Methylobacterium sp.
VRRADLPALSLFAAVAARRSFRGAARDLGLSVSAVSHAINGLEASLGVRLLARTTRSVAPTEAGQRLLDGLEPALAAIADAVEVATAAERRLTGTLRISVPRSAAEMLLVPLAVAFTRAHPGVEIEIRAQDGFRDIVAEGFDAGVRFAESLDQDMIAVPLGPPQRGAIVAAPDYLARHGTPADPQDLHRHVCVRRRFPSGGLYLWELEKDGIAQSIPVTGTLVLDDDGLVAEAARGGAGLAYLFEAQVAADIAAGRLIRVLDAWCPPFPGFFLYYPSRRQMRPVLRSFVDHVRGR

SEQ ID NO: 516 - protein, 308 aa, Methylobacterium sp.
TGQDGAYLAQLLLQKGYAVTGIVRRSSHAGVFDHRLKWLGITDDVELVDGNLLDQSALLRIVQATKPDEIYNLAAQSFVTSSWQQPLLTGQVTGLGAVHMLECLRSAAPQARYYQASTSEMFGLIQEAKQSESTPFYPRSPYGVAKLYAHWMTINYRESFGLHASNGILFNHESPLRGVEFVTRKVTDAVARIKLGKQKELRLGNIDAKRDWGHARDYVKAMWLMLQQDRPDDYVIATGRTTTVRDMCEIAFKHVGLKVDDHLIVDPALFRPAEVEVLLGNPAKAKATFGWEAETSLEALITEMVDAD

SEQ ID NO: 517 - protein, 210 aa, Methylobacterium sp.
MSALSILDISAVRAAPVSREPYAYTLGSNVLNPEAIDDIRRDFPDIAKPGYLTVDEVALKGRFKALIDELESDAFSKILGEKFGIDLVSCPRLTTIMRRSQLKYGSIHTDGPSKVLTLLVYMNDAWDAPAAGRLRVLYDGRNYEPFAVEVPPTMGTMFAFLRADNSWHGHEPFEGERRVVQVAWLKDASELDRKRKRNRTAQFLKGIFGR

SEQ ID NO: 518 - protein, 294 aa, Methylobacterium sp.
MLKRLALDVIFANVDQPRKEFELKKIAELADSIAESGLIQPITVRTMGNGQFEIVAGERRYRAHKLLAEQGRLETPTILAHVRKLDEDQRDVQAIVENMQRADVTPVEEARAFARMLAKGWTMEELGKAIGRKAFRIEERTRLLDLEPTLLKLLETGNLSQEAALEISRVKDHAAQTRLVQLISSGRLVGFRAIRTAVQTQLGEIAQNDMFGAAAPKVTDEEAETLSAMERKVAAVGDLVARGWKDGECVIAAKVDPNRAKMMADRLKLMQAAIRAMESELRAVSAQAELAVAA

SEQ ID NO: 519 - protein, 269 aa, Methylobacterium sp.
VRPKNRTIKGDVEADLAEGERPSVLSLLRLRADTAMPLYRQIEGQLRELILSGSLPPGVTLPAERQLADSLGVSRVTVQRAYAELSDNELLVPRGRCGFLVRRPPEPVRPGMDRLKGFTEEMRELGKIPSSRILDRSVVEDRSIASIFGLPSTAPFLRLTRVRSGDGVPMSREVAWYNIRAVPALETGDLSGSVYAFLSAHPGGRLVRCEQTVEATMPTADECEIFAFEQPLPCLLIKRHSYNQDSVMIEYVEGLFRGDAYRYRLNLRA

SEQ ID NO: 520 - protein, 409 aa, Methylobacterium sp.
MTTRFPRLRAFLNAQMWALDPVWHAFMVEIVENRAEGIVLTPEQIRERAAQHSQLAEGLVVAGVDVPNGSLALFEVSSGGRIYAARGGGSSRVAGEAEPGSLIAVINVMGVIAHHASQVDNISGPGGTSTARVGQAFDAAMDDPAVKAIVLHVDSPGGGVPGVQELADKIFAARGRKPIVAQVNSTAASAAYWIISQADEIVVTPSGQVGSIGVYGSHRDLSAAAEKQGLKVTFFAWPPQKVDGNQFGPPSAEFTDKAMADVKMVYGDFRNSVARGRGVKPADVEAGFGKGGVELARNALKQGMVDRIATMEDTLRRVAKMKPAPAQARAHVGEVTVDEARAEAGLPPLDAAPDAPQPGEAEEGSEEAVKAAAEEEERQRAEAADAERQAAAERDAFRRRRHAHRMRLA

SEQ ID NO: 521 - protein, 380 aa, Methylobacterium sp.
MIPDLSFDAREILATLQPWVLCESPTHDAAAVNRMMGVAARDLALLGAAVETIPGRMGLSDCVRARFPHRDRDAPGILVLGHLDTVHPVGTLGSLPWRIEGDRAYGPGILDMKGGNVIALAAIRALAAAGIETPLPVTVLFTGDEEVGSPSTRDLIEAEAARHAFVLVPEPGQPENGVVTGRYAIARFDLEALGRPSHAGASPHEGRSAIRAMARKILAIDALSDADCTVSTGIVSGGQWVNCVPTVCRGQALSMAKRQADLDRGVERMLALSGEEDGVRFTVTRGVTRPVWEPDAGCMALYEQARALSEALGQPLPHRSAGGGSDGNFTGANGIPTLDGLGPLGHGYHTLEEHVLIETLPQRARLFAALLANLGAAGRP

SEQ ID NO: 522 - protein, 215 aa, Methylobacterium sp.
MSAITRNPPPPAVDPAVLAAFRDVSTATISDCLARMPVLAGLRPFHRGGTLVGTAFTVRVRSGDNLAIHQALEEVRPGDVIVVDGAGDTGRALVGDIMKAIAESRGVAGFVIDGAVRDTAAFAGSDFPCYARDATPRGPFKTGPGAINVPVCVGGWTVSPGDVVVGDADGVVSFPPCDAAALLDAVRAQAAREAEVLEQIRAGRYDGRYARAAKA

SEQ ID NO: 523 - protein, 204 aa, Methylobacterium sp.
MSGSPLTAGKAPTALPATYVTASGLPRYHPVSQALHWLNAALVLAVLPLAWVAISLPPTPAKGSMFVLHKSVGLTILAIVVVRIVWRMIRPAPPDPQAPRLLTLIGRVNHFLLYAIFLIMPISGYLLSALSGRDTPYFWLFTIPGLPKDEATQKIFESIHVFGQWLVYALVLLHIAATAWHLVIRRDGLLERMLPVQDGRGSSR

SEQ ID NO: 524 - protein, 101 aa, Methylobacterium sp.
LPPVRLSERFIDTRNSIAMPVRLITTALLLSVGATAALAAPMSADDKAALQQQCMGDFTTFCGGMPPDDGPETQACFEKNMAKLSPGCQGAIQSYKQGKKG

SEQ ID NO: 525 - protein, 325 aa, Methylobacterium sp.
MNTADLAPHAHQVLRDATLPELPRHYRGKVRDNYDLPDGRRILITSDRISAFDRALAAIPFKGQVLTQTARYWFEQTADLCPNHVLAYPDPNVVVGRRLEILPVEVVVRGYLAGTTSTSILTRYRAGERDMYGHTFPDGMRPNQRLPEAIITPTTKAFDGGHDEPLTEAEILERGLLTRAQWETVSGAALALFARGTALAAERGLILADTKYEFGTDPEGRIVLADEIHTPDSSRYWFAQSYPERFAAGSAPESFDKDFVRNWVVARCDPYKDPIPEIPAEVVLETAAVYIRAYETITGARFVLPDPAEEPLERIRRNIAAYLAA

SEQ ID NO: 526 - protein, 210 aa, Methylobacterium sp.
MQTILYARVSTADQTIAHQRKQAEAVGFKIDQVVADEGVSGVSTVLADRPQGRRLFDMLRAGDVLVVRWVDRLGRNYADVTKTIREFMGRGVVVRTVINSMTFDGSTTDPVQMAVRDALIGFMAATAQAQAEATKEAQRAGIEHAKERDDAYLGRKPSYTREQLDDVVARLSHGEPVLSIAKVTGISRGTVYRIRDNRAEAEAALARWAA

SEQ ID NO: 527 - protein, 420 aa, Methylobacterium sp.
MTVPAMQIAARPSAKTELRTLLLSAAAGGAIGGVPLILGIAQPAQLLFAAAAALCGGLVTRGLQPSCRAVEPDAPPMAVTLRAEPAAAPMPGAACAEAVARDLGDLDPYFAVTGEQLRSIAAQTEAAASAILASLQTLDAAQARSAACIGGAHDRIVGFAEQSDAALQSLAAALGAYLDRRLNETREERGTVEVAVGQMRGLDALILSLEKVGAATRMLALNANIEAARAGSHGSGFRVIARELQDLAQTAQTAMAEARLQVADAQQTISRVLVADRGDDATRTEQERLRALMAELGGIAETTTRVLLGMARTDLAEVKAQNAAVGDEVLSVFGQVQFQDVVRQQIEAVDAANAALQLCLDGLRKRLIGTEQERAIAPAAILETARARYVTQIQRRVDAQALDQVQGQALDPAAPDIELF

SEQ ID NO: 528 - protein, 453 aa, Methylobacterium sp.
MSIAREDWLRAHAALWYDDRRYRLAWLALPQAVTCAVAGLCMALAAQGVWGQPATASKARLAELSALRDWAGKDGDRKAFDALTAAATQGQIDAATKLGTLYDPLTAAYFPNKPVPNDFARAAALYGPGAAIGDLLAVTRLADVLLDPANPNRDLRRGCRLAQTWIDAPETLERTITGEERLTVKLATCYVEPESGLPQDPVRAGGLVTAVLWRRHRPTMDAFINNLGQQNPALVSGIQRHLAEQRRYIGPVDGRPNPGIITALQVEAGITNTVATPRPEPRRVTPKGPDPEVLALQAAARTGDRRKMAELKSRAEAGDADALTAYARLFNPVMNKGDVFAPDAQVAVAAYERAAAAGNGMAAGEAAVLYDSGYGNVAKDPRKAAALALRGVDLKDDQITFWLLFPEAGNWSDGFWGAIQAALTARGFYTLPVENKRNAAVITALRAYMKAKS

SEQ ID NO: 529 - protein, 167 aa, Methylobacterium sp.
MRGLLLLVFGLWAQAAMAQGFAVHDLTGLAEAARSALGPAATARAEAGQLDLHCAPCTGAPSIALRIGRLTDGTEARVRSGRTTLAALEAICVRRNPDCRLSALPAGPAIGWLSVYALDGGAGATAVILRDGDLLTIEARASDRGAAEDAARRLVQAVLSRIVGPET

SEQ ID NO: 530 - protein, 390 aa, Methylobacterium sp.
VSAVSRRYDVAVLGLGAMGSAALYQLAKRGAAVIGLDRFAPPHALGSSHGETRITRQAVGEGADYVPFVTASHRIWRELEAETGETLLNACGALVMAPGHGVSSHHGKPDFVGRSISAAEGAGIVHEVLTGAEVARRFPQFLNLAGDEKAYFEPGGGYVFPERCLAAQLGRAGAAGAEIRTNCTVVGLQQDGSGVRIETAEGTILADRAVVAAGAWTAPLLGSPFDRLLTVRRQLLHWYALADETAYGPHAPVFIWMYGTSDTEYLYGFPPLDGSIKVATEQYSTTTSADGVERRVDPSESDDMYRLRVANRLAGATPEVVQAAACVYTVTPDRGFIIDRHPAMERVLVVSACSGHGFKHSAGIGEAVAAELAGTGSTVDLKPFALARFS

SEQ ID NO: 531 - protein, 282 aa, Methylobacterium sp.
MLVIEDLTRQYGDRRAVDGVSLRIEPGSFVGVIGRSGAGKSTLLRLINRLADPSSGRILHDGREVTTLRGRPLREWRTRCAMIFQQFNLVGRLDVMTNVLMGRLSHVPTHRALLRQWSAEDRAMALAALESFDMGEFAGQRADGLSGGQQQRVAIARALVQEPEILLADEPVASLDPRNTRLVMDALADVNRRYGITVLCNLHSLDLARAYCDRLVGLAAGRVVFEGGPFDLTEDVARRLYGLEAGEVLDDSAQREAEQRAAMPGRPGLVPVRPVREAALGA

SEQ ID NO: 532 - protein, 785 aa, Methylobacterium sp.
VSGTAHALPGLDGPAEIRVDRWGLAHIRAGTKLDAFRAQGFNAARDRLWQLDLWRKRGLGLLAADFGPGYLAQDRAARLFLYRGDMAAEWAAYGPQDTRAIVTAFVAGINAYVALTEARPELRPPEFTLTDTRPALWQPEDVVRIRSHALIRNVLSEVARARVLARGRSPADGLATDDLRKRISPPHDPVIPDGLDAADWPDDLLDAFRLATAPVGFSPERRAASRAEAWDWSKVDAHGTVTRGPRGPAKEPAEGSNNWAVAPSRSATGRPILASDPHRVYLQPSLRYAVHLTAPGLDVIGAGEPALPGISIGHNGRAAFSLTIAPIDQEDLFVCETDPADPDRYRSGDGWAPITRVAERIPVRGGPDETVILGFTRHGPVLREGGGRAFALRTVWSEPGAAAYLGSLAYLGATTPEAFGEALRHWSAPSVNQLYADTAGRIAWFMAGKAPVRPGHDGLLPVPGDGPYDWAGFHDPAALPRSVDPEAGWLATANEMNLPPDYPAVDRRVGFEWAEPWRARRIRAVLGGQDRHSLADSRALQGDVVSEPARRLADLMRDLPAAGDPDAAAAQTVLAAFDGALHHGSAAAALIEVVWVRHLRPALLAALVPDAGTRRLLPPGDTQSLIERLETSLDPATRASLLTDALGAGLRTCRERMGTDPAGWSWGRLHHALFAHPLTALAPGSGWDVGPLPVGGAAASVMHAEYRTDTFRLTHGASFRMVVDVGDWDRSVFINVPGQSGDPGSPHYADLAPVWGRQDYVPMLYGRAAVDAATETVITLTPSPA

SEQ ID NO: 533 - protein, 148 aa, Methylobacterium sp.
VYLVDTNVLSAGAPTKAVPAVELIDWMDRNSTGLHLSVVTIAEIEDGIAKSRREGAARKAERLAAWLETLLHLYAAKVLPIDLAVARHIGGLSDLARGQGHAPGFADLAIAATARCNGWTVLTRNVRHFAPLGVPACDPFVALPADGR

SEQ ID NO: 534 - protein, 104 aa, Methylobacterium sp.
MIRTLVLPVALAAGVLLAGSSAEARDGCGPGFHRNVYGWCRPNLGYRPFVYVPVYPRVGYRWHYGYRWHRRFAWGGGFRHAGWHGGWHGGWHGGWHHGGWHHRW

SEQ ID NO: 535 - protein, 245 aa, Methylobacterium sp.
MGLTMASPGAAPDEALLRAETARSAMARLLAVAGHDLKQPLQVALMAIDRAVSDGVGPRAAARLGLASDALVRLGRELDDLARSSQAGSVAPRLGPVAVAPLLEAVATEWGPYADAVGVRVRVCATALTVTSEVAMLTTILRNLVGNAVKYAGPGGRVVVGCRRRQGRVAIEVHDGGPGIAPERMAGIFDAFDRAGRRDGAGLGLGLHIVRQTAAALDHPIAVRSRRDRGSVFGVTAPRHRPASA

SEQ ID NO: 536 - protein, 197 aa, Methylobacterium sp.
VAIGFGQAIPIAVLGLAVNLASVWLLHDDHDDHGHDDHAHHHGGHAHGGHGGHDTNFRAAYVHVLADTLTSVLAIVALLGGRYLGLAWLDPAMGLVGTAVILAWSWSLLRTAALVLLDARPSPAATREIRERLEIDGDRVSDLHLWQVGPGHRAAVIALVSDDPQPPAHYKARLAGLKGLSHVTVEVQPCGGHAAAA

SEQ ID NO: 537 - protein, 313 aa, Methylobacterium sp.
MGMSRPRGDRRALLAGLAAGVLGLVPGGWAASPAGASDDPRRAETGGAPAARVVALDGLFAETLLAIGLVPVAIANRPLYEKLIAQPPLPDSVLDLGPLQEPNLEFLSLIAPDLILAAPWQAQIQVALTRIAPVVALPIVAGAREPIDHLDALTRDLGDRVDRAAAARALVAGTDGALAEARAALAGRTGRPVYICRFRDDGRQLAVFGTRSTVGAVAQRLGLTNAWTGRQSGAGTVLAAVEDLAEVPDATLIHFDRGAETARALGRLDDSPLWRALPAVRAGRVIRMPVVHPNGGLPSAARFARQVAAALGK

SEQ ID NO: 538 - protein, 336 aa, Methylobacterium sp.
MMVGTRSGIRVLVAGGAGFIGSHLIDALLADGARVTCVDSLLTGRRANLAHLANEARFDFVEADVTEPLPALPRFDWVFNLACAASPPHYQADPVHTMMTSVLGTGRLLGIARDAGARFLQASTSEVYGDPERHPQQESYWGNVNPTGPRACYDEGKRSAETLTFDFERQHGLDIRVARIFNTYGPRMRADDGRVVSNVICQALAGDDITVYGNGEQTRSFCYVSDLVDGLLRLMAVETPLAGPVNLGNPRELTVGALVDLVVRMTETPSRIVRRPLPVDDPQRRRPDITRAETLLGWSPRVPLEEGLEATIAWFSREIAPRRARPVIEERAVVAG

SEQ ID NO: 539 - protein, 317 aa, Methylobacterium sp.
MAWNPTVWGYGTESLEAIELVTAQGERIRASETENPDFFWAARGAGPGFFGIVTKYFLKLHALPKAIHGSEYFYRLEDAPAVGTWLGEAAPTIAPSVELTQFLVKAPPALAEAAAARNGWVCMVTATAFEDTPEAARRALAPLDDAPVAPLSSARATPLDFEQLFDASGALFPEGVRSRVEAAFSNHSPGAVMAAILPLWQRAPSATSVFLSTIFCGPDVPGPQRNMARSMTAKVYGGPWTMWHAADDDKANAAWHQAVIAALKPLNVGYYIGETNTVEQPEIVAQAFTPEKWQRLCALRDEHDPDRVFFDYFDGLH

SEQ ID NO: 540 - protein, 233 aa, Methylobacterium sp.
MLPRAAVLAAICGRPADKEAETCRMKDGRTAEFWTAAMFSTETGSRFTGFVTMPAPGADAAAPDRLSVAAATYVLKDMRWRLEDVQVLSGRIGTGNRNGGAPEVDERLGAVFRPLSRGRLLMGLRLTVYGTAGSQGFSYLLLQFRDAPARWTLAGEVAAGADETAGCAEDPCRLGSSTGRLEILPEDPRDPAAWPPVRVALSGTVLGADGALRPATDRDARVYRFDPGAGTYR

SEQ ID NO: 541 - protein, 108 aa, Methylobacterium sp.
MAKTRREFTPEFKREAVALLESSGRPQMQVAAELGIQPSMLRQWRATLNGASPRPRPAGSTGSAPPSPVASPSDQAAEIARLRRELDRTRMERDVLKKAIGIFAEMPK

SEQ ID NO: 542 - protein, 90 aa, Methylobacterium sp.
MVRFEVGKTGRGGCAGFVIRAVQAVAPGARIEVDIEVDLATKRVTAAGFPAEPVLAAPRGGAAATGISRRRPRLGRGHGPAARTGVIPYP

SEQ ID NO: 543 - protein, 90 aa, Methylobacterium sp.; identical to SEQ ID NO: 542

SEQ ID NO: 544 - protein, 139 aa, Methylobacterium sp.
MTQALDRATLDRLVALGRDRGLLTADDLRAALPVERMDVDALVLVMLELEAAGVSVEPEAFGPPTDRPLPVSVTLPPPRPGTPPARAAEAGPGASFAPPVSAAPAAPEPVPDDGVDAGRAVLLAGLATVLILGALLLML

SEQ ID NO: 545 - protein, 555 aa, Methylobacterium sp.
MINDLWYKNAIIYCLSVGTFMDANGDGIGDFAGLERRLDYIQGLGATAVWLMPFQPSPKKDGGYDIADYYGVDPDYGSLGDFVAFTHAAKQRGLRVLIDLVVNHTSDQHPWFQSARSDPRSPYRDWYVWSKERPATADEGMVFPGVQETTWTYDTKAKAWYFHRFFNFQPDLNTANPEVLAEILKIMGFWIQLGVSGFRMDAVPFVIAEKGADVGGKPREQFEMLRDLREFLQWRQGDAIILAEANILPKQDLDYFGDDADRMHMMFNFQVNQATFYALAAHDARPLVKAIERTKPRPLSCQWGIFLRNHDELDLGRLTDKQRQSVFDAFGPEKGMQLYDRGIRRRFAPMLAGDPRRIRLAYSLMFTLPGTPVLRYGDEIGMGDELALPERDCARTPMQWTSEHQGGFSTAERTVLPLIDHGPYGYAHVNVADQRHEEGSLLNWMQSMIRQRKEAPEIGWGNVVAMETGRPSVLALRYAWRGNAILCVHNLAPEPVEVAMASGSEDRAHDILVDLLTGARSEVKDDGRHCLFLEGYGYHWFRVGGLDALLKRRPT

SEQ ID NO: 546 - protein, 628 aa, Methylobacterium sp.
LSEAGRPAAPTPDRTFRLARRLFLLAASLGALAWGAWLGHLHLAGRATPLDRLESALTDLRLRLAGPRTPPANLTVVAIDDATVRREGGFPVSRTTMARLVERVAEARPRVIAVDVLFLEAGRQPEADSALADALGKTTAILASAAVFDGSASEDGIPVATALHRPTPKLGEDVASGVVNVAEDASGVPRHLPLVVRTADGVAASFVLRAAALAARSDPVLSKGRVRIGDRALSLDLGYHLPLRPYGPRRTIATVSAAAVLDGTAPAAALSDGIVVIGVTALGGGDTFATAFDPVLPGVELLATGIAHLTTGDALVRDAGVRQLDAAASVLLAVGAALAIALLPPGPGLILVLLATAGWLAAGAVAFAHGIWLSAALPLAAVGLPALVCAVGRQTLERRQSARVARSEQVLRRMQPAALAERLARDPGYLAEPVARDIPVLFVDLTGFTRRSEQLGPARTRAMLKTFHDLVDEAVTLRGGVVVNFMGDGAMILFGALDPDPDQAAHAVQAAEELIVRTRAWIAQSPVLHGAGPALDLRIGAHCGPVILSRLGSDTNQHITATGDTVNVASRLLAVAADAHARLALSAELAQAAGIDRSEGAFESRTAAIRGRSQPLEVWLRHPRATTS

SEQ ID NO: 547 - protein, 362 aa, Methylobacterium sp.
MIYNLQILRAVASYLVFLTHFGLYIGPVLPRPDLFAFGASGVDVFFVLSGFIMFVSTSGRRESPGEFLLRRASRVVPVYWLVTLALALIALTGLKPIGIVEIRPDYVVQSLLFLPFARGGFVEPLNSVGWTLNYEMFFYVVFAGLLMVPRPAFRALGAAAIFLALILLGLLPASNLYWAYYTKPILIEFAAGIGLGYAYLRLGAPAAGFPVRRVACAAVAAALLLILGGQIVTDALGVSPELSGFARPLIWGSAAVLIVGAMLLLERGGIALKSRWLLSQGNASYSFYLVHNLLLHSAAKIAALVVAPGFARAALIFAIAFPAAVAAGELLFRYVETPVIAALRRRLDRRPSPDPVPVPAAS

SEQ ID NO: 548 - protein, 434 aa, Methylobacterium sp.
MTTRNDDPDFWTRARRHLVRYGGAFAPVIIERAEGSFVYDADGRKILDFTSGQMSAILGHGHPEIAAVVADHVGRLDHLFSGMLSRPVVDLATALAGLAPGGLERALLLTTGAEANEAALRMAKLATGGWEIVSFAQSWHGMTAGAASATYSAGRKGYGPAPVGSFAIPAPNAYRPTFARDGAADWQTELDYAFALVDRQSTGNLAAFLAEPILSSGGILELPPGYLAALKRKCAERGMLLILDEAQTGIGRTGLMFACERDGVVPDILTLSKTLGAGLPLAAVLTTPEIEDLCHARGFLFYTTHVSDPLPAAVGLKVLEIVRRDGLVGRAEAAGARLAARLRALQQRFACIGDVRGRGLLQGVEIVADRDTKVPAPELGDAITRRCLELGLSMNIVQLPGMGGVFRIAPPLTATDAEIDLGVDILERAIEGSV

SEQ ID NO: 549 - protein, 273 aa, Methylobacterium sp.
VIADCDPGRRVSLREIVLRFDPSAVIDEATSGQALCDILLRHRPTLAFVGMQLDDLSGPEAVAVARRAGAEPPCLVLVATRVLPQWQEIATSLGAYEVLKTPLDPSHIEPLLHADARRRAPTRALLACSTPAGRSAISRVVARSGFAIELDETDDGRHALKQLKLAAYDFAFIDVKLGGIDGLELACQIQPLGLPTRITLLTTSELEPVAQAGRYFGVDAVLRMPFYARDIDLALHNALGLRRPYLLNALTAPPAPSALLRIADLPNSRRKIA

SEQ ID NO: 550 - protein, 136 aa, Methylobacterium sp.
VLAEHIFQRSLFGFSVTAVENGAAALRAARLQSFDLAFLSFGVIDVPALEIACRINSQYPTTKIVMLGRKADAISPAQLALFGAHAFLALPFTASDVDRLVYEVFDLWQPYLVKALRDEEAKQAPAQQITINRVSA

SEQ ID NO: 551 - protein, 324 aa, Methylobacterium sp.
VPECDVRALKPVCILLALACAASGIGADPARAQDAAAAPKAFTLDSVPVSDAPLGRFPYFALPDGYQPVNPPETREFGHFLFWTGAALHEVEGKVFQSLIGPKDGKTYSAYELKKNIEAVLTQAGGRKIADGRIPNSVTETLPEDIRIGMYEGLGDVYNVPAQTWVIRRPDREVWVHFVPDSFTAAWTILETKPFVQTAALLPAERLKQDLDKTGKAVIQVNFATDRTEILPASAPQIDAVAALLRTDPGLRLAINGYTDGTGAAAHNQALSDGRARAVVARLVGAGIAKDRLKAKGFGAASPIAANDSEAGRAQNRRVELVKF

SEQ ID NO: 552 - protein, 151 aa, Methylobacterium sp.
VAAMLVLAFAAPPAQAGEGLVPTAIVGDAIPESLTGALGDAARGRAIVVDRARGLCLLCHTGPFPEERFQGNLAPDLAGVGGRLGSGQLRLRLVDGRVLNPETIMPPYYSLTGLTRVGRPWQGRPILSAAEIEDVVAFLATLREAGPEESR

SEQ ID NO: 553 - protein, 158 aa, Methylobacterium sp.
MRRPITAFALAGLCVLATAAGAETASTGLAPFKVVAVDGSDAIPEPLTDKPGDAAAGAKVVVNRRQGNCLGCHQVSSLSAESFHGEIGPSLDGVAGRWDAAHLRMIVVNPKHVFTEATVMPAFYRIEGLHRVRPEFQGKPILTAQQVEDVVAYLTTLK

SEQ ID NO: 554 - protein, 150 aa, Methylobacterium sp.
MDRRGVLAGAVGTALAVALRPAAAATLPRTETTESAIRRFAGDNPIRPGRVTLDLPPLVENGNTVPLTVAVESAMTPEDHVRRIGVFNERNPQPNVVTVHLRPGAGRAQFSTRIRLADTQRITAIAEMSDGTYWSASADAIVTLAACLEG

SEQ ID NO: 555 - protein, 148 aa, Methylobacterium sp.
LNRRQALAFGTGAVVATAFAFRAGPALAAKPATDEAIKAFTRGKEPVKGKVKLELPEIAENGNTVPMTVSVDGPMTAESYVEEVMIVAEGNPNPGVISFHFTPSSVAEANTRIRLAETQNVIAVARMNDGSVFSDVRQVKVTIGGCGG

SEQ ID NO: 556 - protein, 106 aa, Methylobacterium sp.
MARTLINLPKTAKPGDTITIKTLISHPMETGFRPGADGRILPRNIVTDFVCRFEDEEIFRAELFPASAANPYVTFTWVATRSGRFSFTWRGDGGFDQTESAAITVA

SEQ ID NO: 557 - protein, 109 aa, Methylobacterium sp.
MADVKPRIKLDKKEVAKGGIIEVKTLVSHTMESGQRKDKDGKTIPRKILNKFTCDLNGKTIFSADIESAVSANPYFQFKIKPEESGALTFTWVDDDGSKIQATEQIKVA

SEQ ID NO: 558 - protein, 263 aa, Methylobacterium sp.
VPRRSGSLPQTALVALLLSSPLARSEPVPPAERRSGFDQMSPEIQAMQRDDGANPGMLAVADGEDLWAKAPVSGGLACAGCHGEASSTMRGVAARYPAWDARTGRPIDLQSRVNACRREHQGSEVLAYESPDLLALTAFVAAQSRGLPIAPPDDPRLDPARAAGRALFEARQGQLGLSCAICHDDHRGHRLGAATIPQGHPTGYPLYRLEWQGLGSLQRRLRNCLTGMRAEPFGYGAPDYVALELYLATRAAPLPLETPAVRP

SEQ ID NO: 559 - protein, 288 aa, Methylobacterium sp.
MVRPTPIAFTALALVALAVAPHAQDMPSAPAAKEASERPAWQAHGLKPQNSGSPFEEVVSGLYFRSKETQDMQADDFNNPGFLAVEQGEELWSKVDGTAGKSCASCHNEASTSMKGVAAAYPKWNEKLGKPVNLEQRINICRSGALKAEPYAFGSPEFTAMTTYIRNQSRGMPVAVKVDGPMTPWFERGKSLYYQRNGQLDLACASCHEKNHGKYLRADFLSQGQSNGFPVYRLRDQRLVPLHERMEGCMQDVRATPFKPLSDEFLALETYVAWRGLGLPVETPAVRN

SEQ ID NO: 560 - protein, 448 aa, Methylobacterium sp.
MPHTPSPAGEDLAASTVRTVTLRLMPLLGLLYLIAYIDRQNVSYAKLEMVGSLGLSETAYGLGASLFFLGYFLFEVPANVFLERVGARIWFARIMITWGIVTVLLGFTQGTAMFYVLRFLLGAAEAGFFPGVLFALTLWFPQAHRARMIGWFMIASAIANAVGAAIGGALLGLDGLLGLQGWQWVFLATGAPAILMAAVVLFVLPDGPETAPWLSQAQRDWLARTLQAEREDGGHVDHGNPFAALLDRRVLMLAGVYVSLPLAAYGLGYWLPTVVKGFGVSNLTNGFLNIIPWLATAFALWWVPRHAARTGAQGNALTWHVVGPALVGAAGLALSVILPGNAVKFACLCVAAAGTFAAQPVFWSMPGTFLRGASAAAGIAAINSVGNLGGFVAQNAVPFIRDQTQSDLVPMLFLAACLAVGAGLMFVVLSALRRDAARRAVPTAARPA

SEQ ID NO: 561 - protein, 376 aa, Methylobacterium sp.
MAEDAVTGIRLRSVALPLKTPISDAKVLTGRQKPMTEIAILFCEVESREGHRGLGISYSKRAGGPAQFAHAREIAPALLGADPSDIAKAWDTLAWAGASAGRSGLAVQAIGAFDVALWDLKARRAGLSLAKLLGAQRDWVRCYNTSGGFLHTPLEELLVNTDRARAKGIGGIKLKVGQPDWAEDLRRVSRVREHLGDAFPLMVDANQQWDRPTAMRMGRTFERFNLIWIEEPLDCLDAAGHAALAAALDTPVATGEMLTSVAEHWDFIRQGGADFLMPDAPRVGGITPFLKVAALAEFAGLTIAPHFSMELHIHLAAALQREPWVEHFEWLEPLFNERLALEDGRMRVPTRPGLGLSLSEQALAWTRETAGFGSLG

SEQ ID NO: 562 - protein, 114 aa, Methylobacterium sp.
MRIRVRVARLAILVGGLSVAAAPAQAETIDVTFDCPNGRTLAVTFVNAAGPDKAIVRPDNGAAVTLPVQLSGSGFRYADATHELRGKGRSVTWTDGAGTPVTCTDRTPADAKPR

SEQ ID NO: 563 - protein, 187 aa, Methylobacterium sp.
VFQVIFVAKADGGVTYVSSEWTAFTGQAAEEAVEHGWFACMHPDDHETAVTFLRSARDQQSEYSLRTRLRRADGSYAWVMIGAVPSYGPPGHTFLGYLGSLTEIIPSGSEPLSAYGTLSRFVPPPMSPTTPPGSTLEAVADYLLIAHGLVEQDGAKEMLPVLRQALMVAGMLLARNMTSVQPSDRAH

SEQ ID NO: 564 - protein, 427 aa, Methylobacterium sp.
MSTKTAGTRATTGRAGLAACLLALSALPAAAEYRIGPGDTIEVTALSIPTFKQEATVSTDGTVMVPLLGDVPAAGLTVAELRQSLQKSLPAKAVRQRNSEGKESIAVLEPDEIGVRISKYQPVYLSGDVTKQGEHPFHPGMTVRQAIALAGGYNLLRFRMENPVVETANLRAEYDSTWASIQRESATIWRLKAIVAASRGDKSPPPADVAPGIRATPAQKLAEQQLRVQMTDIAKEKDHLQRSLNRTQTQFTSLSEQQVKEKEGVTADAEDYDTVRALFQRGAVVTTRLTDARRAVLLSSTRALQTTVQLTQLERDKSEVGRKLERVDDVQAMDALEKLQAAENNLATYRSRLNSINDKLVYTGALRAQLLSGSRAQAAIAVFRQSGPAKTQIDAAEDTELLPGDVVEIALKPDPAMRGVGDGAGQN

SEQ ID NO: 565 - protein, 149 aa, Methylobacterium sp.
MSPDRQILRLMAAMILAIIAYVAPSAAQAHEGHAHHGHRAAAAQPRAVAPVAASVPVTPAARSAAPAWSKVARATVAAARVEPTEDGCCRPGRETRCCGTMACCATGVLGEPPGLSPDLFGAVTLVPGDVAGRTGLGPEALPEPPRTRA

SEQ ID NO: 566 - protein, 149 aa, Methylobacterium sp.; identical to SEQ ID NO: 565

SEQ ID NO: 567 - protein, 173 aa, Methylobacterium sp.
MRTTARLAATAALTLAASSAAAQTRCTETTRFDPPLRILHCADGLTLETERAGSLRPVGPDGDGHLKGAEIGGNAVFVTIPASRRVRRDGFQILTPHAVASVRGTVYAVDVTRARTSVFVAQGRVDVARRTDPQVAVTLGPGEGVDVDDGRDPLEVRRWPQERVRSLLERFGR

SEQ ID NO: 568 - protein, 142 aa, Methylobacterium sp.
MPKMIFVNLPVADVEHAAGFYVALGAQRDPRFSQAGTVAAMVFSDAIVVMLLSHAQFANFAPRAIADARAANEVLVCLSEESRAAVDASVERAVAAGGRADLRPPQEMGTFMYGRNIEDPDGHVVEVIWMDPEAMTRGQAPA

SEQ ID NO: 569 - protein, 218 aa, Methylobacterium sp.
MFSVIFEVRPGDDRKDAYLEHARVLKPELEGIDGFIDNERFTSRTRPGWVLSHSTWRDEKSVIRWRTHAGHHSIQGKGRSEVFADYHLRVGEVTADTHPPAGHPVRDQRLDETEVGQAKACTLSEAMLADRPTPSDIDPMAMLGLDQRSEGLVSWDAFDSFTNPGKVLVLLSWRDAGAANAVSSVAGTRLRAVRIIRDYGMFDRRESPQYHPAVQAPG

SEQ ID NO: 570 - protein, 280 aa, Methylobacterium sp.
MRLTVRTLLTTGALAALAAFSTVALPGRATAADGVDAIKKRGTLIVGVKADYKPFGFRDPSGTIIGLEPDLAADLAKRLGVKLELVPVVSANRIEFLQQGKVDLLIATLSDKPERRRVVQAIDPNYYSDFVNVLLPKSSGITDWAQLKGKPVCATSGAWYNKDVARTYGAEIVAFDGSEKPLFALKQGNCIGYVYDQSMLQGKLLDDDWKANYALPLKGILDAPWMMAVAQGNTTLQAAVEDATKDWMKTGFIVNEEKKWGIEPTAYSKAMHEKYKNATN

SEQ ID NO: 571 - protein, 148 aa, Methylobacterium sp.
MNDKRPRRLQASAPVLAGLLACLAVPTTAGADQPSAKLCLTETSTPGTTACMTRALQEADAKLNAAYKKAMSVIDHDDRTQDPDARALWKTRLERAQRAWIAFRDADCGDLTDSEWANGSGANAALSACLYDKTVQRTADLLSRYPLH

SEQ ID NO: 572 - protein, 315 aa, Methylobacterium sp.
VLVPSLVETTSHVDPKQAFEFWRCTALAGFGDIGRQHPRERFAAKRLTVVSAGWSLTHTVSSPVEVEFRTRHVDRNARGMVVIGLALDGVGYQAQDGRGAQLTPGDIGFLSRNRPFVAGTQSAYSEIRLAVPREMFETWVGDADGFAGRSLTPHPSGAEFRARLRGVAGSVAWMSADEAQAAIEGLLHLLGHLVDGSARRGDPEAVSQAAVVSLARAHIARRMHHPDLNPQDIQRALGLSRTSLYRAFAETGGIAAAIRDARLDLACRRLEARRDDKVRIASIAYACGFTDVPTFNRGFRKRFGLAPGDLRPALP

SEQ ID NO: 573 - protein, 303 aa, Methylobacterium sp.
VETTDSVDQKRAFDYWRSTALARVDATPLAPDIPFAAGRRLAITRHGAILHTLSKPIGVERTAQHVRRDGRDDIAIVLLVQGSGYIEQGNSGAVLGAGDIAVHAMDQPFAIGSRDSYEEIRLQVPRAAFVSQVGSVHAFAGRGLRATPLSGLFATYLRSFSETVGGMSEAEAGIALEGVLHLLRALADRQGEAAGDDLSGDAVRALALAHIERRLHDPAFGPESLPAALRVSRSRLYAAFTGDEGVAAKIRDARLDRAYRRLRGGTRIGSVMTSCGFTDAATFSRAFRRRFGVAPRDVLERRP

SEQ ID NO: 574 - protein, 547 aa, Methylobacterium sp.
VTGGGGRLRRFGAARGGNVAILVALGSAMLMGAGAVGIDLGLVFQARRKAQGAVDIAAMLAAVDPSQADTVARRSLGDNGYGAATATVAPGSYDASTKGVAPGGRFSAGGSPANAVRVGLSTSVPVTFGRAIGLPAAVPLRVTGTAASAQFAAFTIGSGTLKLDGGIANALLGALLGAKLSLSVSDYDALASARVDGLRVLDALGASLNMQAANYTDIVQANASVGQMLMALRVAAADNGSAVSALSGILNALPNAGNLVAIGQVDGLGDAAALAPPRGFAGPSLNVLNLLGAAASLANGQNQVAIDLGATVPGLLSTRLTLAIGERKRSSGWVRPGSRNATVQTAQTRLLIETTVTALGLGTITLPVYAEVAPAQATLRSLSCAGSGGRKVTLDAQTGLATLAIAQVPRTAINGGSASPDLSQPAPLITLPLLGITVSGRALTTLGTASQTLVFSDADIANHTVRTVASGNLTQSLTGSLLRNLVLSVGDVGVPPLIQSTLTTALGTATPGVDLVLDTVLRSLGLRLGYADLDVDGTLCNQAVLVQ

SEQ ID NO: 575 - protein, 206 aa, Methylobacterium sp.
LKSILATGLLALLVAAPVATPALAQTPPTRDPAQIQAGTYAVDPGHTQVGWRVSHMGFSNYAGGFSDVSGTLELQPKNPAAAKLSVKIPVASVTTTSAKLTDELKGDQWLDAAKFPDMTFVSTKVAPAGKDHAKVTGDLTLHGVTKPVTLDVTLVGAGVNPLSKKYTVGFEATGTLKRSEFGVKTYVPLIGDELHLTIAGAFEKQD

SEQ ID NO: 576 - protein, 491 aa, Methylobacterium sp.
MFSALNVREAHAKLAALDRVQGVIEFDLAGRILSANRNFLDVVGYTLPEIVGQHHSMFMEPAQRDAPDYRAFWERLRSGTFESGQFQRVGRGGRSIWIQASYNPMLDVRGRPYKVVKFATDITQQRTEEADRAGQIAAIDKVQAVIAFDLDGTVIAVNDNFLAAMGYSRAEVLGQHHSLFVEPAYRESEAYRAFWAALRNGTYQAAQFRRIGKDGREVWIQASYNPILDAAGRPYKVVKFATDISDQVRLFANLRTLIDQNFGEIEQAVTHSTTAASLASSAADSTSGNVQTVAAAAEELAASVAEMSQSIVRSQSATDTAYACVQDADGHTKRLAETATAMTGIVGLIQDIAGQINLLALNATIEAARAGAAGRGFAVVASEVKALADQAARATGQINGEIASVQRVSQEVVQALSSIGSSVSVMRETVVATAAAIEEQSAVTRDLAESMQSAAGAVTAITGNIGAIVQSVANVSQAVDTTRDAAKVLAR

SEQ ID NO: 577 - protein, 149 aa, Methylobacterium sp.
VDAIDRRIIQALRGDGRISNADLAAAVGLSASACHRRVRLLEESGVIRGYTALIGGAVDGPGLVVLTQFTLDRQTEDYLNRFEAAVRRCPEVQDCYLMTGTADYLVKLKVIDAADYERLHKDVLSRLPGVARLQSSFAIRTVVAAGRPL

SEQ ID NO: 578 - protein, 80 aa, Methylobacterium sp.
MSAVRRVGNFLQVQDGDGCRHLLRVTSVQALSDTDLMRNETFITAAGRTIRVTQPLDEIVDLVAPGERTAPGPQEEPWPF

SEQ ID NO: 579 - protein, 105 aa, Methylobacterium sp.
MMRHALFAIFALVAASPGSAQTSTGPAPIRQPGPAQPVTPGTPAGTVVVPGGSQNSGPGSTAVVAPTGTGATTITTDSAAGGNAGQPERGVPQVGKGSGDGSGGS

SEQ ID NO: 580 - protein, 1614 aa, Methylobacterium sp.
MTLETATALSSSEQKTARTGLIEAAADLVTEQGGPGGFVRDLFGRVTPEDLAPYDPSVLADLAARARAFLSEPRRPGDPARMRLSDSQLVRDGRARETTVLEIINDNRPFLLDSTLAELTEQGLSPQLVAHPILGVERDGAGGLIRVVGETTADAQGSLARESFIHIHLDPVAAETGERLLNALATVYRDVALASDDHDAMLARLTDLAADLGRGPTPMPEPETEEARAFLEWLTDGQFLILGMQEHGIAGDAHPLVEGSSLGVLRDPGATPLRRGRTPVDYTPEILAFLEEPQPLIITKASVKSRVHRSAYLDYVGVKLFSGLGKLSGEVRIVGLFTASAYTSPAREVPVLRRKVEAVVQRAGLDPTSHAGRSLLAVLESYPRDELFQIDGERLYRFTLAIAALADRPRVRVLSRPDRFGRFVSLLVYVPKDRYDSAIRGRIGSYLAETYGGRLSASYPDYPEGSLARIHYIIGLPDQGSPEHDPASLEAGIVALVRTWGDALRAALAESQGGDRARQLAARYGDAFSAAYRDNFQPEVAVADVTILDSLGETQPRAVHLDRRPSDPAAQVRLKAFSRGTAIALSDRVPALENLGFRVINERTYQIAPAGMDEAARVWLHDMLIERATGAPIDLAALERPLEAAMLAIADGIAESDGYNRLVLEAALAWREAALLRALGRYLRQLRVRYGQDYLAGTLSRHAGIARAIVALFRARFDPALTGNRTAQEAEVRAEIETALAEVTSLDDDRILRRFVNLVEAAVRTNFYQTGADGQPRETISFKFACAKVTAMPLPRPFFEIFVYSPRVEGVHLRFGYVARGGLRWSDRPEDFRTEILGLVKAQQVKNAVIVPVGAKGGFFPKRLPPASDRAAWMQEGTESYRIFIRTLLELTDNIVDNAIVPPPDTVRHDPDDAYLVVAADKGTATFSDIANALSLEKGHWLGDAFASGGSQGYDHKGMGITARGAWEAVRRHFREIDVDVQTDPITTVGVGDMSGDVFGNGMLLSESIRLIAAFDHRDIFLDPNPDAARSFSQRRRLFDLGRSSWADYDRSLISEGGGVFPRSLKTVPLSEAIRSALGFDRSEATPTELMQAILKAPADLLWFGGIGTYVRATTETDEDAGDRANDALRITGPELRAKVVGEGANLGLTQRGRIEAARAGVRLNTDAIDNSAGVNTSDVEVNIKIALMTPERDGRLSYEARNTLLADMTDEVGRLVLRNNELQTLALSLAQRGGLGETGFAMRTMQALEAEGRLDRAVEFLPDDGTLAERMRRNEGLTRPEYAVLLAYAKLSLHDAILESAVPNDPYFDRELQRYFPKALRERFPDAVKGHRLRREIIATALANIIVNRGGPSLVTRLVDGTGADAATIAKAYAVTRDAFGLMELNLAIDGLAGRIPGQGQLDLYAEVQDLLTNRIVWFIRNLDLGGGLAPVVARYRDGIAAVEAALPNVLGDEAQATIGTRAAELTGHGMAAAQARRLASLSALVSAPDIVRVAEASGRPVEEVAATHFALEHAFRLDDLAAAARTVPVADTFDRVALERAGAGIAAAHRKLTAEVVADLGAGPEAVEAWIRARGASLARIREAVDAISASGLTVSKATVAASLLGDLVRAD

SEQ ID NO: 581 - protein, 78 aa, Methylobacterium sp.
MSTIAILIGTKAGARLLAAASEREAALSAEAFLLRLPVRALPAPLWVQCADPAVSGRLTGYLNGLQAEQVRERDPSRV

SEQ ID NO: 582 - protein, 113 aa, Methylobacterium sp.
MMKDWNQYGAELVSTLGRIGAVSPDLLKAHDQLAAAAPTERKLDAKTRELIALAVAVTTRCDGCIAVHSDAARKAGASKEEVVEALGVAVALNAGAALVYTARAFEAFTGESG

SEQ ID NO: 583 - protein, 115 aa, Methylobacterium sp.
MHMIDWNSYRQQVTAGVGHFAKLSPETVRGYGTLSTAGQKTGQLDAKTRELIAVAVAISLRCDGCITVHTDAARKLGATEAELAEALGVATSLNAGAAVVYATRALDAFAASAEA

SEQ ID NO: 584 - protein, 71 aa, Methylobacterium sp.
MGRAALGWTTQDLAREAGVGANTINRFEAGQDARISSVDKMRAALEAAGLEFIPENGGGAGIRFRERKAQA

SEQ ID NO: 585 - protein, 161 aa, Methylobacterium sp.
VSDGPERDPGGRLPEILRGRLALPVICAPMFIVSGPELVIAQCLSGVVGSFPALNARPAELLDEWLARITQTLAQARAADPSRRIAPFAVNQIVHASNDRLAQDVEACVRHRVPIIITSLRAPDAVIRPVHAYGGVVFHDVTNVRHAEKALEAGVDGLILV

SEQ ID NO: 586 - protein, 175 aa, Methylobacterium sp.
LSPFALVGEIRRFYDGPLILSGAITSGSAILAAQAMGADLAYMGTRFIATQEANAAAAYKDMIAGSAAADILYTPYFTGVPGNYLTPSIRAAGLDPEALPVRDKTAMNFGSASVKAWRDVWGAGQGVGTIADAPATADLVARLAREYAAARARTAGSSADYAEDYVADRDGGAVP

SEQ ID NO: 587 - protein, 525 aa, Methylobacterium sp.
VIYRFGSFTLDSARRELSRDGAEIAVEPQVFDLLRVLIERRDRVVSRDDLLEAVWNGRIVSEATLGSRINAARTAIGDTGTEQRWIRTLPRKGVRFVGAVREAASEVSPAIAPEDAAEAGVTWRTGPRLPAVAVLPFTNMSADPDQDYFADGITEEIITALSRVSGLFVIARNSTFTYRGAAIDVRRVGQELGVGYVVAGSVRRGGSRLRITGQLVDAGTGAHLWADSFDGGLDDVFALQERVAARAAAAIEPTLQLAEIGRLGRDAPAHPDAYDRLLRANARLADFTAAGMAAALDHLDEALALDPGYAPAMAAAAYCRAQCHFQGWIAQGEAERAAAVRLAWGAVERAPGDAQVLWMAAFAVWNMSETGRDRARDLFGRALLVNPNSALALTLAGWIETMCGRAEAGRVMVERALQLNPRDPRGWLMSGVMAVAAVSEADYPEAIRWAERALAQNRRFAVALRALAVAHVGLGQPGRARQAVDELLEIEPGLTVSGFLARIPFPVAALGRRYAEALAEAGLPA

SEQ ID NO: 588 - protein, 119 aa, Methylobacterium sp.
VATELAPGLIHHPGFLDAAARARLAAEIAAILAEAPPVTPRMPRTGKPFSVRMSNAGPLGWVSDVAGYRYQPDHPDTGRPWPALPPTARAAWETLAAYPAPPEACLINIYAPGTRMGLH

SEQ ID NO: 589 - protein, 533 aa, Methylobacterium sp.
VRDFSAPGRSPVYAANAAVATSHPLSTLAAIEVLRAGGNAVDAGIAAVAVQCVVDPLMTGIGGDCFALYAPAGATTPIALDGSGRAPAAATPHWYAEHDVGITPTSPHAVTVPGAVAAWELLVREHGTRSLGELLQPAIRYAEDGFVVQQRVGWDWLRGAERVAADPHAAATYLPGGEVPAIGSVVRLPKLAATLRGIAEAGARAFYEGPVAEDMVSRLNALGGLHTLDDFAAARPDVVVPVSTRYRGYDVYECPPAGQGLAALMMLNVLSHYDVGALSDLDRLHLFAEVCKQGYHHRDVLFGDAALANVPVEHLLSDAWKAAAHGAIDMGRAREPEIYPEIAREMAEGRAHKDTVYLCVVDRDGNALSLINSIFQGFGSGILAPESGVLLHNRGLSFRTEGGHPNSVGPGKRPMHTIIPGMLMKDGQAVAPFGVMGGHYQAMGHVELLTGLLDRGLDVQEALDAPRSFAYGGSLEVEGGVSDAVMTGLKERGHPAIRAPLPLGGGQVIWIDRKAGTLAAGSDPRKDGAALGY

SEQ ID NO: 590 - protein, 511 aa, Methylobacterium sp.
MVSFAPRRCGRATAWLAASLGLSACAVGPNFVAPEAPPVGRYTREPLQNPSAADNIRTRQGGSADQSFVSGADIPGEWWRLFHSKALNRVVEQALANNPTLEAAQASLRVAQQNVLAQKGTLYPSLTATPQVQGALAPGLDLQSPLNNQSRYLYSLSTPQAVVSYNPDVFGGNRRQIESLEATTENQRFQLEAAYLSLTANVVAAAIQEASLRAQIDATRKVIQAQTEVLQLYNKQLSLGQIAGADVVQQQAALALSQQLLPPLEKALAQQRNLLTALAGRLPSDEVSETFDLAALRLPTRLPVSLPSRLVQQRPDVKAAEALVQQASANVGVAVANRLPQFSLTATGGSSATRIAQIANPGAAFFTIIGQATAPIFDAGTLFRRQRAAEESLTEAQAQYKATVITAFQNVADALRALQADAKAVAAADAAVSATNQSLALIRKQYTAGAITSSQVLIAQQGYLSALVTSAAARATQYADTAALFVALGGGWWNRADVAPPPPEKDPLKFL

SEQ ID NO: 591 - protein, 148 aa, Methylobacterium sp.
MGMRRLRRRSAPNGWTCRRGSSAVEFALVAPVLFLLFAGIAVLGICLGAAHNLRQIAAEAARASVAGVTDAERANLAQSMVNRSLSAGAMFRPGSIVVQVGPDPSDATVYTVTVTLDANTLGINAFARLLPMLPTVLRSSVSVRKGGL

SEQ ID NO: 592 - protein, 65 aa, Methylobacterium sp.
MDSIAAAAVQMLGSSQSQQIGIAVAKQQLSADKAVAGLVADSAAQAASAGPPAPPGQGQSVDLRV

SEQ ID NO: 593 - protein, 94 aa, Methylobacterium sp.
MTPALALLAALAGGTGAGAAEMRPPPGASSCTGCHAAGSAMGVLAGRPEAEIVGALDAFRTGARPATLMNRIAKGFGAQESQAIAAWFAAQGSR

SEQ ID NO: 594 - protein, 419 aa, Methylobacterium sp.
MRAPSPTRRALIGGAAAAALARPALGGTAPRVVVVGAGFGGATAARCLAAGGVDVTLIEAAERYVACTGSNAVVVGLRGIEAQTFGYEALGRAGLRFVRGTADAVDPAGRRVTLGDGTVLSYDRLVLSPGIALRFDAVPGYDAKAAEAMPHAWKAGEQTVLLARQLEAMPEGGTVVLSAPANPYRCPPGPYERASLIAHFLKTRKPQAKLVLLDAKDTFSKQKLFEAAWAKLYPDVLEYVPLASGGAVTEVDAAAMVVRTDFAEYKADVACIIPPQRAGPIAAQAGCADRSGWCPIDPVTFESRLVPGIHVIGDAAIAGAMPKSAFSANAQAKVCAQAVIDLLAGREPESPRLINTCWSLVAPGNGISIAGVFRPTDGLLADVPGAGGISPLDAPDAVRAQEAAYGESWYRTITRDVFG

SEQ ID NO: 595 - protein, 166 aa, Methylobacterium sp.
MVGIAGAAVLVSGCLGITPGWAVDADAVVGTWRLATATRRIVDTGETIDAYGGPKPTGWIHYGRDGRMMVVCAHEGRERPVANDKMSDADRIKLHKTFFAYAGTYRLEGDRIVHDIDTSWNEAWTGTSQVRHVAQENGRLVLTTVPFKFNVDGRMSVITLTWEKYP

SEQ ID NO: 596 - protein, 61 aa, Methylobacterium sp.
MPTLSAPRLLTFLVSAVLIGLAVASLYTRIPMVGKAVVAHRQWFFIGAYALLALGVTTRSL

SEQ ID NO: 597 - protein, 76 aa, Methylobacterium sp.
LVLAADPDTSDHAAIHAWILDFMETGADDPDQDSIRSLIYHSLNFDIPFQATERVRQSLIATVRARLAAQASRRGL

SEQ ID NO: 598 - protein, 708 aa, Methylobacterium sp.
MGDGSGPARSVSAHGRMNVRARETAIRKPELQLSRGSRRTFVALALAAAIPVLLLSGWVATLMAQQQRDLARSAAVASATRVAERVASDIAAQIAVLEAEAASATLDRPDLAAFYAEAVRLRQAHPLWETVELARPDGAQIVNLLRSLEEELGPTSDRTSFDAVVRTRQPVIGGIGPAGSISGKRLVALRVPVIRDGTLRYVLSIRLATNAVSSILRDAGAPEGWVGTIVDAEGNTIARTRAEVEELGHPANPALQAAIRNAPNGFYTGPTLEGADVEVVYRTLQHTGGWSVHFGMPVATLNAPVSRSYAVLGGGSFVSIGLALALVGLVGRDMAQRRAGEQARFSLALRSSEEQGAVAAEAAELGTLRWDTVAHRVTGSPRAADLLGWTAAAEGRDSAVDADTVLQAVDPEDRGRLSEALRRSLAEGTPLDVEFRVTQDGRDPRWVRVAGRVPQLHEHTPAGLIYGVVSDIEPRKRAEAERFALLRRLGEAQENEQRRIARELHDQVGQTVTGLSLGLKSMERLLARGATAEAGRQVEWLQSLAGEIGRDIHRAAVDLRPTALDDLGLREALATLLRDWSQRHGIRADLEFLSEATRLPAAIETAVYRIVQEALTNVLKHARAASVSVSVEKRAGEMRVIIEDDGTGFNAEEQRERASGEAPAKLRLGLSGIRERLSLLSGNLTLETSPGIGTTLFVTIPIPEHPET

SEQ ID NO: 599 - protein, 90 aa, Methylobacterium sp.
LRLTRTVARQLDQVLGDLTRHSPSGADGVLQRIGVCLELLLRHPYAGQTTDRRGIRRIVVSPYLYIMTYRVGADEVIVRTIRHAARRPLA

SEQ ID NO: 600 - protein, 405 aa, Methylobacterium sp.
MLGRIARPVTLAALAGALMMGTAAAQTNVKIGILGDRSGAYSDISGEGSVVAAKLAVEDFKPEQHGLKVEIVSADHQNKPDVGAAIARQWYDRDAVDMITDGVTSSVALAISQVTKEKNKVFIDTGAGTADLTGPQCTPNTIHWVYDTVALANGTGGAMVKRGGNTWFFLTADYVFGQTLQRDTSTVITKNGGKVVGSVKTPFPTSDFSSFLLQAQGSGAKVIGLANAGTDTINAIKQAGEFGITEGGQALAGLLVFSSDVHSLGTKVAQGLVLTEPFYWDLNDQTRAFSDRFAKQMKNGSKPTANHAGVYSDVLHYLKAVAETKSTADGAATVAKMKAMPTDDPLFGKGVIRADGRKIHDMYLFEVKKPAESKGEWDLYKKLETIPGEQVFRPLNEGNCPLVKG

SEQ ID NO: 601 - protein, 382 aa, Methylobacterium sp.
MPLIGQIKAAGGTPIDLANAIGVALKQVADLAEKPAASVEVATYRPFYIIGAVQQPGKYEYQPGLTVLQAVSTAQGLMRGTDPRSIQRDAVTTRGELRNLAAERVALAAKLARLEAEVGGAETIAFGGDLKGTVDRTYAEHAVRGEQLLFDTRRNALKAEIKSIEQSIASFQNEMSTLDSKSKTLDRQIELSRGELGLINDLVSKGLTIAPRKLAAEQSQASFESSRLDVQVAMLRAQQSLTRAERDIIDLKARFRREALSEAADARQKLASIDEKARTAERLAADAESQMVGSTDDAAEAVSARYEITRKQGVKAGTWLASEEAVVEPGDVVRVTLVRQPADKSGETRPSPSPRPGSAGAPVSRGPAASDVPLRPTESANR

SEQ ID NO: 602 - protein, 554 aa, Methylobacterium sp.
MNIHNTNRIPPDQSQSVSHFPETTSIGVQDGPLAVISAALKAARRHKMAVAVWVVFCIGCAALYTVTATPFYTATAVLLLEPRRPVGSGSSDGAAMPSLDVGRAESELQVLRSERLLANVFNSLQLANNPEFGPAEAESPKEPGPGASELSGLRTAPPSMAAILQQRKFENFAERFTVRRVGQSYVVEVSYTSRDPNLARRVANAAVSAYLLQSIAAKADAAKNGAEFLQGRVNALASQARSAAAAVTEGTLPDAPTPDADARVIGAALQPLKPSAPRKTLILGLGAMIGLVGGFLAVALLQAFDRRIRTPQDLVQRAGIPCLAVMPEVLRKTADGRRETVDLRNVNAPWFLNVRFSTGVRDLRTSIQLALSARGHDSDCVIALVGCTPRTGTTLIGLSLARLLQEGGRTARLIDTNIHGAGTFFLTPDSKAGVGASLADLIINPSHLALAKFVDFGGVSVLPSRSPYTAVGTGISLSSSVFQSVIDQMRRGGYVILDLPPLSVSAESRVAARRADVVVIVAEAGRTTVDELSDAVNGLIGAGANVIGAVLNRA

SEQ ID NO: 603 - protein, 147 aa, Methylobacterium sp.
MRQVFCTDCGTEAELVDGATIGRVDPDRAGRRFWRCPECPDSWSCHIDALEGPGEPPSGPATKAARVLLQERRIEPLIQQALRGNQNERALAQGRTVNWLFQQLGLPTAGAGLGLLGLEQLRQAYALLGRTDYAAIRQWAANHRRVA

SEQ ID NO: 604 - protein, 170 aa, Methylobacterium sp.
MRPLTDRERIELAVPCVLWHGLVTAGCFGRDPNVSEEEAKAEIAVLVPKLTALLGAACKEPLDDLPPKKRRQLSARITRESAACSRELDQQPAVKVALTFYHFTKALLEEGVLELWEGSAMGEAMNLLFPCFEHGFSEAALDASAQKQARRVLGHLQRAGFYQSAAAMAA

SEQ ID NO: 605 - protein, 210 aa, Methylobacterium sp.
MSGSWPFGALTPLSYDVIMADPPWDYANWSEGGNAKNAKAQYACMPLAEIAALPVGHLARGDSWLWLWLWGTYPMLPQCIQTMSAWGFTYVTAGPWVKRGVSGKLAMGTGYVLRSCSEIFLLGKHGSPRTFSRSIRNVIEAPRREHSRKPDEAYAMAEELFGPARRADLFSRQARPGWEPWGNQTDHFPPGPPVQRPQSSTLDLCQEVAA

SEQ ID NO: 606 - protein, 319 aa, Methylobacterium sp.
MLSTLLVVLPIFALIFAGWLARRVGVLGAAATTELNRFVVFLALPALLFDVTAHAHWSAIWKPGFIGAFGLSSLAIFALAVLIRGGAGRPLADAAVDGLNAGYANTGFMGFPLALVAFGPEALAPTTVAAILTVCGVFAVAIVLIETGLRREAAASGRGGGARRPVWWTVGRSLVRNPLLVAPALGALVPSAGLTVPDAVATFLKLLGGAAAPCALVALGLFLAQPRRAGGGQGRIAALLVGLKLVLHPLLAYGLGRYVFDLPPLLLHTAVLMAALPTGTGPFMLAEFYRREADLTATVVLVSTVLAVVTVSAYLAAIA

SEQ ID NO: 607 - protein, 106 aa, Methylobacterium sp.
MIIVTTENIPNYHVREVRGPCFGAVVHSRGAVGNFTAGLRSIMGGEISEYSQLIEQARSQAIDRMAQNAAHFGANAVVMMRFDTADTDQSMMGVVAYGTAVIVEAR

SEQ ID NO: 608 - protein, 409 aa, Methylobacterium sp.
MIRTIGGAVMAAALAGTALGSAPAAAQGSFSDNAIRIGVLNDQSGLYAEYGGQGSVEAARMAVEDMGGKIGSVPIEILTADHQNKPDIASAIARQWYDRDNVDAIMELTTSSVALAVQGLSKEKKKITITTGAATSDLTGKACSPYGYHWAFDTRALAVGTGGALTRAGGNTWFFLTADYAFGSALEADTSKVVLANGGKVLGSVRHPLSNQDFSSFLLQAQGSKAKVIGLANAGLDTSNAIKQAAEYGIVDGGQKLAALLFTLSEVHGLGLKVAQGLTLTEGWYWDANDETRAFGQRYMKRTGRMPNMIQAGTYSAVLSYLKAVKAAGTDETDAVNAKLKELPVDDVFAHGGIVQPNGRMVHDMYLFEVKKPAESKGPWDLYKLISTIPGKEAFASAAESGCPLTAAK

SEQ ID NO: 609 - protein, 605 aa, Methylobacterium sp.
MIGGTGSGSEDGRPSRRALGDFSADRRVLTLAGMAVVTGTAASGTAWILLTLIGLVTNLAWYGRLDSDLTSLAGAAPSPWMVAIPVIGALIVGAMARYGSEKIRGHGIPEAMEAILIGGSRMSPKVAVLKPLSSAVAIGTGGPFGAEGPIIVTGGAVGSLFAQFFHLSAAERKTLLVAGAAAGMTAIFGTPVAAVLLAVEVLLFEWRPRSLVPVTVGAVTAACWRPALFGAGPLFPFADNPALPWWGLPACALLGVACGLISGALTRALYALEDGFGRLPLHWMWWPALGAVVVGLGGLVEPRALGVGYDVIHDLLSGHMLASAVVLILVVKAVIWLAALSSGTSGGVLAPLLILGGAVGWLIGLLLPGAHGFWALIGMAAMLGGTLPAPLTGVVFAVEVTGDVAALAPLLAATMAAYAVTVLLLKRSILTEKIARRGQHVTREYGIDPYELARVEAVMTRTVETLDADLPLADALAAIETGAHHAYPVVDGAGRPVGLVSRSDALRWTLEESDGEAEAGTLGERVSDADLAVVHPGDVVSHALDVMLSAGQGRLPVTDPRTEGLVGLLTRKDLLQVRATVVRAEAERRAFYRTARGQRRARADA

SEQ ID NO: 610 - protein, 377 aa, Methylobacterium sp.
VTENRTTAALLAERLHAFRSLGDNCEFGFVQRYGGVEPSGLLRFSYTPMEDLIRGLRCGFADFGVPGDLRLSVSSGGTYYCHSVAYNIWANTGHPAGSIEPEVLLEREYGRLAHLKRKLLEELADGSKILVRKVGRDEPEADFARLAEAVRAHGPSTLLRVTEAGPDWVPEPARRVADRLIEGRVRRFAPVEQAWEVDLEPWMHLVDSVYALERGAAPTRLDAAAFPEALALPGRLRRHVGRHRATALSAYTRAVDPAGFRADTVHVFSSWVWIPEDFAGDRVFAAAGYARLGWRDADLSRRRCWQRVWAAGRLRPDATREPVGLGMIGTRRDGFWSAGARFAEGPIPGDEPAPALRMPPVRFPGRDLLGRLLPRVL

SEQ ID NO: 611 - protein, 172 aa, Methylobacterium sp.
MNFLIDKLAGSFLLRRDLDYHLLRAAMVVIFAWFGYDKWFEAEIRGLLPLITHGPFTFWTIPVLGIRGTAIFLGASEWTFGTLLLLGFWNKKLGVLGALGSTATFVSTLTILPFVPDAWDAGAGGFPAMAMNAAFLLKDLVLLVVSVYLLRQDVARVVAARDAIVGRVAFTR

SEQ ID NO: 612 - protein, 207 aa, Methylobacterium sp.
MNTQVRRVLGLVSGPGSNRLGLQAMRVAIAVIFLWIGALKFVPYEADSITPFVANSPVMAFFYAHPDQYAQHLTHEGELNLAARAWQTANHTYAFSRGLGTVELLIGLLVLVGLASRRLGLAGAVLAFLTPVVTLSFLVTTPEAWVAALGDAEHGFPYLSGAGRLVLKDVTLMAGAWLVLADSARAVLVRQARAPGAPARLDLAASR

SEQ ID NO: 613 - protein, 811 aa, Methylobacterium sp.
MARIRSADDRAPEVRFGPWRLAATPPGACAGPGDLDGITDWIAAEVPGTAAAALRAAGLWSEAAPEPIHDRDIWYRTRITGSGPFRLRFGGLATLAEVWLDGVPVLCARAMFEEHAVDVDLGGTCELALCFRALRAELDRPAKRGRWRPRMITPGSLRHVRTSVLGFMPGWCPAIDLVGPYRPITVEPVRPRASAADVRTTLDGDVGRVAVRLRVDGPVGTVLLRCGGGEATLAEVEPGLFAGALALPGIAPWWPHTHGNPNLHPVEVRVDGARVDLGRVGFRTLSLTRPFEEGLALAVNGVPVFCRGAVWTPPDLVGLGSDGTRTLLELAREAGMNMLRVPGTTLYPAQDFFDLCDELGILVWQDLMLANFDYPHAEPAFAAALDRELTGLLDRTQTAPSLCVVCGGSEVWQQAAMLGAPRAVWADAYCAETLAERVAERRPDLVVVPNSPSGGDLPFSPRGGCTHYFGVGAYRRPLEDARRAEVGFASECLAFANPPEPGTPGPTGPADPLWQAGIPKDRGADWDFETVRDHYVGALYGVDPATLRAEDPDRYLELGRAAVAEVMEATIAEWRRPRSPTAGGLVLMLRDLASGAGWGVIDWTQRPKSAWYALRRAFRSVQVLLTDEGLDGLHVHVLNETATVQALTLSLTFCDVAGRVAAHAVRDLVVGPRAALTFTSATLLGRFFDATDSYRFGPRIHDLAHARLTDADGRAIAESFHVPGAGPLDRSAVGLRAEPVATEAGPGLRISTERFARGVQVLAPGARPADSSFHLAPGSSRIITFAEAARLPRGRVRAINSDEIVEFGHDG

SEQ ID NO: 614 - protein, 72 aa, Methylobacterium sp.
VSARDRASGDAATEVTFRGRGLALRTGSRLILLVCPLCSQRNARRGAERGICEWCAYVPSPDQAEPVDRGCS

SEQ ID NO: 615 - protein, 232 aa, Methylobacterium sp.
MLVHEGETRTPEADRALALSLAGVAGALNTAGFYAVGLYASNMTGNVSAISDRTGTGDLLLALQAGLLVVLFVLGAATATLLIRRRRRGHRPGAYAYGVCAEAILLVAVGLLVLPLHEPARSHALVLGLSFVLGLQNAAVTKISESRVRTTHVTGMITDIGIELARWLDRGPSAADPLKPHDPERLRLYLLTVGAFLTGGVVGVVAYRLVGVALLFAAAAILAGLALPALRR

SEQ ID NO: 616 - protein, 552 aa, Methylobacterium sp.
MLLIEEMLQESSSLSRTFDATDLSRRTVLALPLGLAVATSSARAAEPKRGGTMVMIVHPEPSTLAHYAVSAGNIPPIATQVYEGLCTYDWDQNPQPNLAKSWEVAPDGKTITFKLQDGVTFHNGKPFTSADVQYSFMEILKKYNPIAPVMLAELVAVDTPDPMTAVLRLANPAPYIMKALSGRDLPILCRSVFEGTDVLQNPSANKPIGTGPFKFTSWERGQFVRLDRNEKYWKPGLPYLNRIVARFIPDAATRSAAMEAGEAHFAGYSAVNYADLARMKTNPILDLTTKGYEMTPAQSVLELNGRHPHLQKKDVRQAIAYAIDRKVILKDVMFGYGLPATGPLSRKFKTAGLYTDDVRQYDVPDRLDIANKLLDEAGALRGADGTRFALHLEVNSFGEQWLRQAEYLKQALAVVGIAVTLRSEDTATWLRRVYTNYDYDLNEPFLSQGVDPVYGLNKQFLTSQIRKGVTFVNDTFYSNPEVDRMLGEGAREPDPEKRAALYKKVQQILAEDSPMIWLIDVQYVSVFNRRLKDHTTGPLGTQQAFERAWMDT

SEQ ID NO: 617 - protein, 405 aa, Methylobacterium sp.
MRPPGSASPSAPASARFVWDDPFLLEDQLTEDERAIRDVAQSFAQEQLLPGIVEAYASEKTDPGLFRKMGELGLLGVTLPEEYGCAGASYVAYGLVARAVEAVDSGYRSMMSVQSSLVMYPIHAYGSEEQREKFLPKLASGEWIGCFGLTEPDAGSDPAGMKTKAEKIDGGYRISGAKMWISNAPFADVFVVWAKSDAHEGAIRGFVLEKGMKGLSAPTLKGKLSLRASTTGEIVMEGVEVGEDALLPNVSGLKGPFGCLNRARYGISWGAMGAAEDCWHRARTYTLERKQFGRPLAQTQLVQKKLADMQTEIALGLQASLRVGRLMDEGRMAPEMISLVKRNNCGKALDIARTARDMHGGNGIMGEYHVMRHAQNLETVNTYEGTHDVHALILGRAQTGLQAFF

SEQ ID NO: 618 - protein, 195 aa, Methylobacterium sp.
MRINVIDGYAENADRLRAALEASCVVGAWEWDHVRGVVVYDAGAARLLTGNPDLADRPINGPMALAAVHPEDMTWLMDHMLRAVRSSGLVLAEYRVFKADGTVRWLLSRGRTHRNEDGEPQRSHGILMDITEIRDGGDRYVVGRPMAGGDPLERAADLAVALKETLTDDMPAEVRAAADLMLLGLGRALARRMTH

SEQ ID NO: 619 - protein, 308 aa, Methylobacterium sp.
MSGDALIVQEVATRDGFQIEPVFVPTAEKIRLIDALAEAGFGRIEVSSFVSPKAVPALADAAEVFSGIRRRPGTVYVALVPNPKGAERALAARVDEINLVASVSETHNRANMGMSPADSIAGFARIMDSVRGAPVSTNATVATAFGCPFEGDQPADTVVAQVERYLSLGVDGVTLADTTGMANPRQVSRLVARVLPLVGPGRLTLHFHNTRGLGLANVLAAYDAGARRFDAALGGLGGCPFAPGATGNICTEDLVSMAHEMGVPTGLDLPALIGLSRDLPRLVGHDVPGQVAKAGRPCDLHPAPARAA

SEQ ID NO: 620 - protein, 95 aa, Methylobacterium sp.
MDRPRRVGLPWYTPEQYPALRTSLADGAKLPPDYETWRVATEQMEREVQRSGVEVVRVPVEPEIFAAWCERAGLPRDAAARARYAAAALAADWAV

SEQ ID NO: 621 - protein, 689 aa, Methylobacterium sp.
VVRQEVDGGVAVLTLANPPVNALGAALRAALDEALTNAIADASVRAVVLAAEGKVFVGGADIGEFGKAQRPPSLPDILDRLDASPKPVVAAIGGAALGGGLELAMACHGRVAAPSARIGLPEIKLGIIPGAGGTQRLPRLIGPDAAFAMMLTGEPVSAEKAAALGIVDAVVLGDLVAEARKRALELADSGALPRVRDRSETLTPGARENFEAQAAEAVKRDPDATNVHALARAVRAGLEQDFDAAVAVERSEFRALVEDPRSKALRYAFFAEREAGRVPGLPKDTPRRPVRTAAVIGAGTMGGGIAMCFANAGIPVTVIETEEGALARGLDRVRGLYAGSAKRGSITEAQRDERVGRITGVLGLENAGEADIVVEAAFEDMGVKREIFSKLDQVAKPGAILATNTSYLDVNAIAAVTNRPQDVLGLHFFSPANVMRLVEVVRAERTAPDVLATALDLGKRLNKLPVTVGVCFGFVGNRMLERRSRAGERLLLEGALPHEVDAAVTGFGFRMGPFAMSDLAGLDIGWRSRKDFGGRAPVADSLAEQGRFGQKTGRGFYLYPDGARAGTRDPEVEALIARVAAEHGVARRSFTADEIVARLMYPMVNEGARILEEGIAARPGDIDTIWINGYNWPAWRGGPMHWADTVGLKTVAEALSRFAAETGDDSQEPAPLLKRLAAEGGSFAGLKNS

SEQ ID NO: 622 - protein, 402 aa, Methylobacterium sp.
MDAVADLPLAGIRVLDLSRVLAGPWCAQVLGDLGADVIKVEHPERGDDTRDWGVPTSPGNTSYFDSVNRNKRSIGVDLATSEGLAIVKALARESDVLVQNFKTGGAEKLGLGYTDLSAENSGLIYCSIAGYSSDGSEAGRPGYDLVVQGESGVMALNGEAGGPPLKFGVAAVDLFTGQFAAQAVLAALYQRERTGRGRTVDLALFDCGVALTSYYGLEALARGIDPPRYGNAHPSIVPYGVFEAGDGPVVITVGNNGQYRRFCEQVLERPDWVADPRFATNLDRSRNRAAFIPVLEAELAKWERAPLIARLRAAGIPCGEVMGLREALTCDRAREAGLVVAAPEATPANAHVIAPPYRLDGRRLPVRRMPPGLGDSSAEILAEHLDYPEAARDALRAKGVVR

SEQ ID NO: 623 - protein, 601 aa, Methylobacterium sp.
MSDKRRITPADLRSKAWFDNPHNPGMTALYLERYLNYGLTPEELRSGKPLIGIAQTGSDLSPCNRHHVELAKRVRDGITAAGGVAFEFPCHPIQETGKRPTASLDRNLAYLSLVEVLYGYPLDGVVLLTGCDKTMPACLMAAATVNIPAISLNVGPMLNGYFQKELTGSGTIVWKTRERHAAGDIDFQQFMDIVGSSAPSTGHCNTMGTASTMNALAEALGLALPGSAAIPAPYRERGQAAYATGQRIVEMVWEDLKPSDILTREAFENAIVANAAIGGSTNAPIHINAIAKHIGVPLSCDDWERVGFEIPLLVDMQPAGRWLGEEYFRAGGLPAVFAELIEAGKVHEGALTCNGRTVGENYRGRHSWNRDVIRAYGEPLMERAGFLNLKGSLFDSAIMKTCVISEEFAARYLRNPNDPMAFEGRVIVFDGPEDYHTRIDDPALDIDENTILIMRGAGPIGYPGAAEVVNMQPPGALIRRGVTSLPCIGDGRQSGTSGTPAILNASPEAAAGGGLALLQSGDRIRIDLNRRSADILLPAEEIARRRADLAARGGYPYPATQTPWQEIYRDQVDQLDQGMVLRGAVKFQKVAQASGVPRDNH

SEQ ID NO: 624 - protein, 599 aa, Methylobacterium sp.
MTDRPIARPLRSRAWFDNPDNIDMTALYLERYLNFGLSLEELRSGKPIIGIAQTGSDLSPCNRHHLVLAERIREGIREAGGIVLEFPVHPIQETGKRPTAGLDRNLAYLGLVELLYGYPLDGVVLTTGCDKTTPACLMAAATVNIPAIALSVGPMLNGWFKGQRTGSGTIVWKAREMLAAGEIDHDGFIKLVTSSAPSTGFCNTMGTATTMNTLAEALGMMLPGSAAIPAPYRDRQEAAYLTGKRVVAMVAEDLKPSDILTRDAFLNAIAVNSAIGGSTNAPIHLAAIARHMGVELDIADWQTHGLDVPLLVNLQPAGAYLGEDYYRAGSLPAVVAQLMRRGLIREGALTVNGRTLGENCRGAAIEDGDVIRPIDRPLKEAAGFLVLRGNLFDAAVMKTSVIGAEFRSRYLSNPEDPDAFEGPVVVFDGPEDYHARIDDPSLGITEETLLVMRGAGPVGYPGAAEVVNMRPPAQLIRAGVHALPCLGDGRQSGTSGSPSILNASPEAAAGGGLALLRTGDRVRIDLRRGTADMLVDTDELARRRAALEAAGGYAYPASQTPWQAMQRAAVGQMHTGAILEGAEAFQRIAQTRGVPRDNH

SEQ ID NO: 625 - protein, 290 aa, Methylobacterium sp.
MDLDIREFEEVCRDLYVRALKILPPDIKAGFADLQRAETSATGRAILDTMVENVAVAERTKNILCQDTGIPIYNVVIGADVRFDGAALKAAIRRGCERATKEFSLRSSVVHPITRKNEQTSCGIRVPIIHVDFDDRPETVAVEMIPKGSGSENGSFLQMLLPSDGIGAAKRFVIDRVIELGGRVCPPTIVGVGLGGTSDLCMHLAKVAATRPLRSVCSDPEGARIEAELSRAVNELGIGPQGLGGRSTSFAVHVELAATHITQNPVAVNIQCHSARRARATLTPGGIAFD

SEQ ID NO: 626 - protein, 129 aa, Methylobacterium sp.
MRQTPDGTLALLIAALREGTAHVEALLTLARTEVDGNFRAIVSLIAIVGTIPVLLIVTFFLGLDAVVKLLAVPFGAEAPAALIVAAPFLAIALGLGWMGARRMALSNLEPWRTWRQVKRDVREVTRAGA

SEQ ID NO: 627 - protein, 243 aa, Methylobacterium sp.
VRARGPDILPGSFRESAVIRFFYNLSPNPMKVALCLEEMGLPYEPVPVDTRRGEQFDPAYTAVNPNGKVPAIVDGDVTVFDSNAILMYLAGKTGRFLPEGEPVRGEMLSWLMFVATGIGPFSGQCVHFRHFAQDGGAYATERYAFEARRHWGILDQRLADRTYVLGDTYTIVDMAVWGWARMVPFVLGEGAFGDLPSVKRHLDALNARPAAQAAEALKGRHAFKAEMDAEARGFMFRAVKGAA

SEQ ID NO: 628 - protein, 301 aa, Methylobacterium sp.
MTMRLVAVLALALAATPASAVEVLTGTLRSVAERGEIVLGYRESSVPFSFVEGKQSDGSPRPIGYAIDLCGEIADDIQAAIGRPVRIRYAPVTAESRIEAVTSGKIDLECGSTTANAERRKQVAFSPVDYISATQLLVKRGSGIASYRDLGGKTVVVTAGTTNEKAVRDLLARLKIDAQVVTAPDHAASYAMVKAGKADAFATDDVLLYGLIATDAKDGANYTVLPDKLSYEPYGIMFRKDDPELAGLVQQTFTRLAESRALRWTYERWFLKRLPNGERLDIPMSNDLRVSFQLMGLDGGE

SEQ ID NO: 629 - protein, 325 aa, Methylobacterium sp.
MHALILGAAGMIGRRLVDALVRDGRVGGQPLTALTLLDVVPPAAPEGFSGPVRAEAADLTAPGAAEAAIAERPGVIFHLAAVVSGEAEANLELGYRVNLDGTRLLLDAIRAASAADGYRPKLVFTSSLAVFGPPFPKVIPDDHILRPASSYGVQKAMGELMLADYARRGFLDGIGLRLPTICVRPGKPNKAASGFFSGIIREPLAGQQAILPVPDTVRHWFASPAAAVGFLTHAAGLDLAAIGPRISLTMPGVSATVAEEIEALRRAAGDKAVALIRREPDATIARIVGSWPEAFEPEAALALGFRADASFDAIVAQHVAEFHGG

SEQ ID NO: 630 - protein, 427 aa, Methylobacterium sp.
MRSLLLAALFAGVAMPAAVLPALAQGAAPAETKAKTDDLEKLQGFHSTDTQAAAEIPQTGRRADAIRKNLSKVKLPDGFKIDLYAVVPDARAIAVGPNAGVLFVGTRKSKIYTVTDRDKDRVADEVRPFAPGITFKIPNGVCFSKDGVLTVVEQNRVLAFPAAEFFYENPDVAAGVLVKQGQLIPASEESFNHTARVCRVGPDGKTYIALGQPYNVPPAEKADLYKKTGIGGIIRIDADGKNREVYATGIRNSVGMDFNTDKSLWFTDNQVDGMGDDKPPGELNRATKAGENFGFPWFGGGSVRTVEYKDQTPPADAVAPQAELPPHAADLGMTFYNGKQFPAAYKGGIFIAEHGSWNRTEPVGARVMFAKLGADGKVESVKPFAEGWLTGDGEYLGRPVDVAVMLDGSLLVSDDSAGAIYRISYEK

SEQ ID NO: 631 - protein, 105 aa, Methylobacterium sp.
MIRPLLLLAATLVPLSAQAGDAAAGKKRATACQTCHGMDGLSKLPEAPNLAGQVEPYLVKALTEYRDGKRQNEIMNVVAKELSDADIANLAAYYAGIQIDVLPPG

SEQ ID NO: 632 - protein, 1158 aa, Methylobacterium sp.
MRLIRLALERYGAFTDRTVAFRPDARLHVVLGANEAGKSTALAAVTDLLFGFGKTTPYAFLHDMPQLRLGAEIAAADGRRLSFRRRKGNSRTLIDAADAPLADDALAPFLGGLSRTVFCRAFGLDAASLRAGGREMVDVEGEVGASLFAAGSGLRGLTELQTTLDAEADAIFAPRQAKHRTFYQALERHETARRAIRERGLRAGDWRALNDEIAAAAAQLEALRSEQKAGAVARARLERFKRVRPIIAEIDTLERRIAAETDLVDADPAWIARLGAALDACRAADAEAERAETARDRARGEAESVPVEPGLTHRADEILAAFSGTREFEKGGTDLPRIEGDAHKVGLDLERLRARIGVPDLAALEARQPPDAARARTERLIRDGRTLAAAEEQIARDLAAARAERERLAREVEAADAARDPTPLREALKPLARLHEWIAARDTLDGAIRREAALLRNQAERLSPPVPDLAALVRTPLPAPDTVARYRQGLEAKTREHERAADRCDAARRQVAVTRARLREREAGRPVATRERLDALRATRDAAFAPLRDALAAGRAAAVAEVAAFERALLEADRVADERASDAARVAAQADDLERLAAEEAEAARADDVLAGLAAEIAAGEAAWREAWRPAGLVPGPPTEMAAWLAEVESLIEAEQRLAAQRIEADRLLARIEAARGPLADLRSRAGLDAAPDLEIAAALDGLEARIAALASRWEANLQTAGLLRAAGLSVDRLEASLAETAARRAAWRAEWEAALLPLGLDGTAGPEEAEGALEAWRSVPDRLAERAALQRRSAGIRRDMEAFRATAAALVEALAPDLAEVSPAGAVRSLHGRLVAAQAREARRAELDRRRDEAEAAHRGACESRDAARATLARQVAEVMPDLAAAPTPEIDRLFGRLSAREALRAERLRLRGTLAGAADGLPEAELRAGLETVSPEAIEAELARLSLEADEQAERGQVIFADRDRAERRRAELEGGTGAELALAERKAAEADLQAASRSWAVLRLAGLMLGQAVARHRAGQQDPLVTRAGALFQALTGGAFSGLAQIYDEADTPKLAGQRAGGGTVTIEGMSEGTRDQLYLALRLAYLEDYAGRAEPAPFIGDDLFSTFDETRTGYGLDALAAIGTRVQPILFTHHRHVADIARDRLGDSVDVVTL

SEQ ID NO: 633 - protein, 412 aa, Methylobacterium sp.
MTAFSFIHAADLHLGSPLSGLAARDAELARRLAAASRQAFEDLVSRAIERSVAFVVVAGDVYDGDWADTTIGLFFARQVARLDRAGIRTILVRGNHDAESVITRSITLPASVHVFPTARAGTLRLDALRVAVHGRSFQGRAVEENLSLTYPAAVPGWFNLGVLHTSCTGHAAHETYAPCSVADLAARGYEYWALGHIHEYAELSRDPWIVFPGNLQGRSVRECGEKGAVVVDVADGRVTGVSRLPLDRARFEQITVDLAAVTDARGAVEAVEAALRPLAGIAARRLLLVRVHLAGTTRAHDALAADRESLTAEIQAAAHRLHEDIWLERLKIETRRPRAAAEPSGAAIDPAALLADLDRDPEFRARAKAALAEIVGRMPGTAAAEADLDAEFDALCAEAEALVLGRLGGRHC

SEQ ID NO: 634 - protein, 284 aa, Methylobacterium sp.
MAQSLDIDLLRSFATVAETGALSRAAERVGRSQAALSMQMKRLEDLVAQPLLRRTGRGVVLTVQGERLLVHARRILASHDDAVAELSGGRLNGTLRFGCPDDYAQAFLPTLLRGFAHLHPDAAIEVVCGATPRLEDRFARGGLDLALVSVPLAVGREILRREDLVWVAPRGAAAPWPDPLPLALGDPDTLDHRAARAALDASGRAYRIAYASGSLSGLLAVARSAQAVAVLTRAAVPPDLRVLSRGSGLPALPRIGLTIRLDEVHAAPLTRAFAAHLRAVLPTL

SEQ ID NO: 635 - protein, 221 aa, Methylobacterium sp.
VSIADAFRQTAAQIGANPLDLATVASYESGGKLNPAVMGGAGGRYAGIFQFGPWEQQHYGVSNRSTAEQQVEAAGRFLKDRGFKPGMGLLDMYSAINAGRVGRYNASDAGNGGAPGTVRDKVEKQMGGHVEKARALLGALGGAPASDAPAAGQTPQAGTDLAAALGPGVTLPTLAPAVPVVLPAEPDPTIQAQQAQQLQEQRAQQEQQRKQALLSVSAFYR

SEQ ID NO: 636 - protein, 241 aa, Methylobacterium sp.
MRPPLLAPLLLLSALALLASPARAEENECRRSPSLASGAPPTFGRITAPGRTAFVKDGLARAGCPDPSAACRERAYLVTADPVILGERRGAYVCAHYRGAGDDMGRTGWLPGEAVAVEPPGAVAPADWLGTWTRAEARIRITQADKPGMLTFGGDATWGAGDPERARRGGVHIGEFAGTVAPQGAAASFAVGENGALPVEAGDASDCKVWLRRVGPWLVVDDNLACGGVNVTFRGLYRRQP

SEQ ID NO: 637 - protein, 720 aa, Methylobacterium sp.
MSKLVVAEDLRTFLSEEALPGTGLSADQFWSGFAAIVRDLAPHNRTLLDRRDGLQADIDSWHRDHRGAPHDPAAYAAYLTRIGYLQPEPETVRVTTENVDAEIAAIAGPQLVVPISNARYALNAANARWGSLYDALYGTDAIPQDGELAPGAGFDPARGAAVVARTKAFLDATAPLSVGSWADAVGFSVTDGRLAADLGAGRSAGLTGSSAFAGYTGDAAAPTALLLRHNGLHIEVVIDRTSPIGRTDPAGIADVVLEAALSTIMDMEDSVAAVDSADKVAVYRSWLGLMRGDLTATLSKGGRTVERRLAADRTFTAPDGGRLTLPGRSLMLVRHVGHHMYTDAVTLDGAEIPETILDAAVTALIALHDLKGTGPVRNSRTGSVYMVKPKLHGPEEVAFAVELFGRVEALVGLAPRTLKIGVMDEERRTTLNLKAAIAAASDRLFFINTGFLDRTGDEIHTSLEAGPVVRKDAMKATAWIKAYEDGNVDAGLACGLPGHAQIGKGMWAAPDRMAAMLDAKGAHPEAGANTAWVPSPTAATLHALHYHQVDVRARQAALAGRAPATRAAMLTLPLAEGAFAPEAVREELDNNCQGILGYVVRWVDQGVGCSKVPDIHEVGLMEDRATLRISSQHIANWLRHGIVDRDEVAAALRRMAEVVDRQNAGDRAYRPMAPGFDGPAFRAAEALVFEGASQPNGYTEFVLHRFRREAKRLEAHVRAA

SEQ ID NO: 638 - protein, 304 aa, Methylobacterium sp.
VRAFCAVVDLGTVTAAAATLQETKGSVSRRISRLERALGVRLMARTSRAVSPTAEGLAFYAKAQESLTLLDEATETARDARTVPAGHLRITTSIDFGIEVMPEIVASFRAAYPQITVEMLNTDARLDLAANRIDLALRLGGAEETGYRAMVLATLALALYAAPAYLERRPAPADLADLRDHDLILARERIGTAGLTLSDGQGRTEPLSLSPAIRVSDFATALRLTLAGAGIGHLPSLVAARAVEAGQIVRVLSPWATRSSTLRAVTLAGRELPARVQVFREHVRTVLASRGCPGDSAKSEGEYR

SEQ ID NO: 639 - protein, 249 aa, Methylobacterium sp.
MRLNGKIALVTGAGSGFGAGIAQRFAAEGARVACVDIDGAAAERVAAALGDNAIAIAADVGLAADVAASVAETRQRFGVPNVLVNNAGTTHRNKPLMEVTEEDFDRVFRVNVKSIFHYVREVAPLMRDAGGGAILNVSSTAALRPRPGLTWYNASKGAASLASKSLALELAPWKIRVNALCPVMGATGLLEHFMGVLDTPENRDRFIATIPLGRLSEASDIAAAALFLASDEAAFITGVDLPVDGGRTA

SEQ ID NO: 640 - protein, 379 aa, Methylobacterium sp.
MPSSPAYLDPATGATYPIETPRWRSETGGPLMITDLPGIGRAQIDTGRRSLWRYAAALPVAVADPVTLGEGCTPLVRRPWRGGHAHFKLEWFAPSGSFKDRGASVMLSILRQQGIDAVLEDSSGNGGAAVATYAAAAGMRAKILVPASTSPAKTVQMRAAGAEVELIPGSRQDTADAAVRQADSIFYASHNWQAHFLQGTKTLAYELWEDLGFRAPDNVIIPCGAGSNILGCDIGFSELLRRGAIARLPRLYAVQPAHCAPLHAGFEAGAEDFVPVTPRPTLAEGASIAQPVRGREVLAALRRSGGGTVAVSEDAIEAALMELARSGLYVEPTCAMAAAALTDLTARGAIRPEETTVVVLTGTGIKATPRIAELLGLAP

SEQ ID NO: 641 - protein, 377 aa, Methylobacterium sp.
MSMIDRELRPDAGPAGTASALLTIDLAAIAENYRLLAARAGTATCAAVVKADAYGLGADRVAPVLAAAGCRHFFVAQVGEGVALRSILGPGAVIAVLNGAAPGSEVACADHDLVPVLNDLSQLDGWQGLARRRARRLPAILQVDTGMARFGLAPDEVGALLDRPDALAGLDLRLVMSHLACAGEPDSPVNAAQLSVFRAVRQRLPTVPASLAASSGIFLGADFHFDLVRPGAALYGIAPQEGAPNPMRPVIGLRARVMQTRRVPAGTPVGYGHAARVDRDSRLATVAIGYADGFFRSTAGGAAWFGGARLPVVGRVSMDSLVLDVTDVAPGTLGPGTLVDIVGPERDVDAVAAAAGTIGYEVLTSLGHRFHRIYLGA

SEQ ID NO: 642 - protein, 302 aa, Methylobacterium sp.
MTNATPRAAVIGLGSMGSGMAGSLLRVGFAVSACDVNPDAVARFATAGGRAAANPAEAARDADVVVSVVVNAAQTEAVLFGEDGAAAAMPEGAVFVSSATMDPAVARALAARLEATGRHYLDAPMSGGAARAAEGGLTFLASGSAAAFAKARPALDAMAGTLYELGDAAGQGAAFKMINQLLAGVHIAAASEAMAFAAKQGLDLRRVYEVITKSAGNSWMFENRVPHILDADYSPKSAVDIFVKDLGIVQDMARAEKYPVPVAAAALQMFLMASGAGMGRDDDASVARLYAQVSGAKLPEKA

SEQ ID NO: 643 - protein, 192 aa, Methylobacterium sp.
VPAEDAPIGRFPIPRLETLPDDIRARIEAVQEKSGFVPNVFLVLAHRPDEFRAFFAYHDALMDRPGNLTKAEREMIVVATSAMNQCQYCVIAHGAILRIRAKDPLIADQVAINYRKADITDRQKAMLDFAMLVSQSAHQVGEPAFAALRAHGFDDADAWDIAAIAAFFGLSNRLANVSNMRPNPEFYALGRG

SEQ ID NO: 644 - protein, 84 aa, Methylobacterium sp.
LNIAQDIREILGANEAFAGKADQLSEDDSLFDLGLDSFGSVQLMLGLEERFSIEFPDELLNRKSFSSIRAIREAVSTLIQQEAA

SEQ ID NO: 645 - protein, 323 aa, Methylobacterium sp.
VTAALRLPEGLGAAGPYVPHPLHGSGRDWPETNCYVDLWIELLHGRGLVPEAMLGFTLRQDFEGDQFTFFKPPTGDIERLYGLEVLELAVYGGLENHAVIQAAAGRPVLVEVDAIYLPDTQGTTYGREHGKTTIGILALDPVAQELDYLHNAGRFRLAGKDYAGIFGPATLPPYAEFVKTVAPPLGPADLPAVARELLVRHRARAPRRNPVLAFRDTLAATAAELVVRPLSVFHAYAFNTTRQLGGNFEMLASHLTWLEAREAGGFAPAAAAAADLSREAKAFQFQLARAFHRRSAEGLAPRLDRLAATYDRVFADLDRALDR

SEQ ID NO: 646 - protein, 594 aa, Methylobacterium sp.
MTGEVGSEAAVPVPATFDGLFGWLHPAAGTRGVVLCGAYGFEQMAAHRPWRSLAEGLAAAGCPTLRFDYPGEGDSADLDEARVAACVAAVRKAIAYLRATTGVAEIVVVGLRLGATFAALAGEAEAVDRLVLLAPVTTGRAYLREMRLRAQTIGRLPDGSAPAQEPDSLTVGGFRMEAAFLTDLADLNLAGLARAPARHALLLAPETKALAARLGALGCDVTTGAFPGLAALVADPIFSDVPTADFARVIGFATDGMAAAGPRPGGIATDAHRNGLTGPGWAEAPVRFGRGLIGIRCRPDRAESAAPTILFVSTGMSVHSGWGRQTTDLARRLAAEGIASVRFDLRGIGDSDERPDGRKPLFAADGFADVTAAVDLIAGAGGPILLVGGCSGAYAAFHALCRDRRIDGALLLNLYCFDWDPDQDLDQVIRQTFGSASTYAALLKRGATWRRLIRGEIRIAAIASVLARRGIEAGIRRLRRALRPGPLGGSPARRVATLRRRGAEIRLLYSAGDPGLAAVRRHLGRSPGPADRRIGAPVTVVPGVDHNFGSREAQAWVAAALQDLLRAVRRAHATRTVAAKAAATGSGLTLAGRT

SEQ ID NO: 647 - protein, 394 aa, Methylobacterium sp.
VAAVRPLDGAAPWVPAWRALGRASLVRNPFYEAGYALAARDAFGAGVRLLLVADRPPEAAGARLVAVWPFRPSRRRWGVPLPLLMGWTHGYAPFGAPLLDGAAPEAALAGLLAAPGALGLPPRLLLPNAPTDGLLPELLTGHGGRRAAYWPHDRGLLDLTGLGPEARAAYLGHLSGQRRRKLRRARARLEAAGPVTFEILAAPESLGPALDAHVALEAAGWKGQAGTSLAQRPAEIAFLRAALADLSADRGADRGAADGVRIARLRRGDRLLASLILPVTGREAWVLKIANDETRPETAPGVQLVHRLTEAVAAGDWPIDRIDSCAPPDFALGTTFWTARRPIAHLLVEAGRDPLFPVARTLERARERVARARLTIRSGRSAPAAPASPPRRGP

SEQ ID NO: 648 - protein, 397 aa, Methylobacterium sp.
MILCGGFGTRLGALTSAMPKPLLPVVGEPFLDVLLFELGRHGFTDIVLLASFHSEKIRAYATDNPVARRFGMTLRVSVEPEQAGTGGAVVHALPEADETFLLLNGDSWFDVNLLSLPAMAARHPEAAIVLSLRRVPDAARYGVALLDGVRITAFLERPPEPGPGLVNAGVYLVRRDALIGLPPACSLERDVLPALVAEGRVVGEAHDGYFLDIGVPESYARAQEEIPARRRRPAAFLDRDGVLNHDHGYVGSVDRFQWMAGARDAVRALNDAGYFVFVVTNQAGVARGFYTEADVARLTAWMRDDLREAGAHIDDLRYCPYHPDGTVEAYRAVHGWRKPEPGMILDLTVYWDIDRARSFLVGDQETDLAAGRAAGLAVHHFRSDDLLAFLREVALTG

SEQ ID NO: 649 - protein, 397 aa, Methylobacterium sp.
VSGPLSGIRVLELGQLIAAPFATRLMAEFGAEVIKVEAPGEGDPLRKWRKMHEGTSLWWYLQSRNKKSIAVNLKSPEGLDIVKQLAASADVVVENFRPGGLEKLGLGWDVLSALNPNLVMVRISGYGQTGPYRDRPGFGAIGESMGGIRFTTGGPEAPPARVGVSIGDTLASLHGVIGALMALLRVKTGQGAGQVIDVSLVESVFNVMESLVPEYDLLGEVRTRTGGALPGITPSNTYPTRDGGYVVIAGNSDPIFRRLMTAIGRPDLADDPALRNNEGRSRQSAMLDGTIADWSKTKTVEEALAALDAADVPAGRIYSVADIVADPHYQARDMILQAELPGGTAVKMPGIVPKLSDTPGEVRWQGPALGAHTDSVLAELGLDPARIATLREKGAVA

SEQ ID NO: 650 - protein, 550 aa, Methylobacterium sp.
MPKGSDLLVAALENEGVDRIFGIPGEENLDVVESLRNSKIELVLTRHEQAASFMAATHGRLTGRPGVCLSTLGPGALNFSTGAAYAHLGAMPMIIITGQKGILSSRQAKFQIVDVISSMKPITKMARQIVSASSIPTIVRDAFRVATEERPGPVLLELPEDIASEEAEADLVPSHPIDIPVAHPTAIARAAEMILKAKRPLIMLGAAASRPRATGELGGFVQRTGIPFFTTQMGKGTVAGGTDLYMGTAALSERDYVHEAIDRADLIIAIGHDTIEKPPFFMGQADQKVVHISYMPANVEQVYYPDAEVVGDLGPTLKLLADKLDGKLPNAGALLHLREHILGHIADRAGEDRFPVTPQRLVRDVRRVIPEDGIVCLDNGMYKIWFARNYRTYVANTLLLDNALATMGAGLPSAMMAAMLYPKRRVMAVCGDGGFMMNSQEMETAVRLKLNLVVLVLDDSAYGMIRWKQAVDKFADYGMTFSNPDFVLYAKSYGATGHRVESVNDLVPTLDRAFAAGGVHLVAVPIDYSENTRVLVDELRAKVKDFEPAE

SEQ ID NO: 651 - protein, 438 aa, Methylobacterium sp.
MKILIAATPLTGHVNPLLAIGRTVAARGDDVLVLTDPAFRPKVEAAGLRFTPYADNHAAEFRETELPAGPERYRREFERRFVDPMPVQAAALRALIAAEAPDVILAGSMFLGALPLLLDTAPRPPIVTVNVSILFLDRPDHAPVGLGLPPARDRDDLVRYATLKAGMDAAFVNPVRAYTDAKLAALGLPPLPASLPHSIVVLPDLFLQPTVPGFEYDYGTLPPGLRFIGLLEPPTPPAPLPDWWPDLEAANAAGQPVVLVTQGTLANADFGELVEPTLTALADRDDLLVLATTGGRPVDALKVPVPANARVSCFLPFRELLPRVSVLVTNGGYGSVSQALAAGVPIVSAGLTEDKAEVNARIGWSGVGINLRTNAPSSEAVGAAVARVLGEPSFRARAGALRDAFAARDAMASILTALDDLARAGTDAGTARRLARSA

SEQ ID NO: 652 - protein, 325 aa, Methylobacterium sp.
MQGSTLGSKAGPKAGSKPGSTPGSRRGPGWLGRLALGALAALATTAGPARAQERPAAKALPPLVFTGIPDQDESRLVERFGKVAAYLEAELGVPVRYIPVKSYPAAVTAFTNGQVQLAWFGGFTGVQARKAVPGSQAIAQGAEDAAFKTYVIANAATGLKPEKDFPKAVAGRTFTFGARASTSGRLMPEYFVRQAFPGKTPEQVFARVGFSGDHTRTIQLVQSGAFAVGAVDYSVWDLDSKAGKVDPKAVSVIWESPTFPDYQWTVRGDVEQTYGAGFTDRLQAALTGIADPAILEPFGRSKFIPVTNAAYEPLVEVGRSTGLLD

SEQ ID NO: 653 - protein, 577 aa, Methylobacterium sp.
VSAPEIPFLAGLDAPAVAAVRARMVPVAVPGGRTLFEQGETGDALYTLVSGAVGVSARDHAGRPTRIARLRPPETFGEMALLSDAPRAATVMALRDSHLLQLTRDAFEAVIAEHPHTLLYFARMLADRLRAIYDGHSVHHAPRIFTILAVTEGPDPARVARQLATAFDALLPGKTGCLTDWPEGADEAWFQAFEGAHARTIFGAHDIDCPWCRQSQRRGDHVLLLAEPGAPPRPGAAAYLDRVRSDWIRMDLVVRQDPAARRPRALHPEVAALPAAMRIQVRDGDRGDLHRLARLASGSARGLVLGGGGARGLAHLGVLKALDEVSCAPDFVGGTSMGAIIAASLAMGWSVAEIQAQIEAFFATSNPINDYTLPLHALTRGAKVDAGLAARYGGVRIEDLWLPFFCVSSNLTTGNTMVHRSGDLPKALRASIAIPGLLPPVLCDDGVLVDGGMMNNLPADVAAGLERGPVLAVDVGTDRAFQDMPRRGWSGRLMRKLIGSPLAMPGLAPLLLRAATVSSDAQSLMAAAHATAVLKPQLSGIDLRAWSRFRESAELGYRETRAGIATGTLARWLDPMR

SEQ ID NO: 654 - protein, 593 aa, Methylobacterium sp.
MSTERLDICGLEPVPAALTPGRPEIPFLADLDGEAADAVRARMTSVAVAGGRTLFEEGDEADALYTLVSGAVGLSTRDPRDGGVRRLIRLAPPDTVGELALLTGEPRSITATALRDTHLLRLSRDAFADLIAAHPGTLLYFARILAARLRIAHTGVTLRHAPRSFAVLAVTEGRTATAFGERLARALDAALPGRTGCLSEWPPEADEAWFHRYEQGHDRTVFVAHQIDCPWCQLCLRHADHVLLLAEPGAPPRPGAAAYLAAIRSPWIRMDLAVAQTAEARLPRPLHPDVAALPFSLRLQVRANHDGDFARLARIASGHARALVLGGGGARGLAHLGVLRALGEAGLDIDLVGGTSMGSILAASVALDWSLDAIETHTVASFVGRNPLDDYTLPFHALTRGAKVDAGLAARFGDARVEDLWRPFFCVSSNLTTGTAMVHWAGPLDRAIRASIAIPGLLPPVASADGILVDGGMMNNLPADVMADLDRGPVLAVDVGSDAAFQVMPRQGRGAQAFRHVLGISEQLPGIAHLLLRSAMVSSDAQTMAAVTRAAVLLKPALAGVDLRAWSSFETTAELGYRCAREALDSGRLRAWT

SEQ ID NO: 655 - protein, 619 aa, Methylobacterium sp.
VKPVTDPILSVSDLTVSFRSDGRWREVVHGVSFDVGPRETVALVGESGSGKSVSALSILRLLPRDASRIGGRVRFEGRELLAAPEAEMRRVRGDSIAMIFQEPMTSLNPVLTIGFQIAEALIRHRGLSRSAAEAEALRLLDKVRIPAARSRLHEYPHRFSGGMRQRVMIAMALACRPKLLIADEPTTALDVTIQAQILDLIKSLQDEEGMSVLFITHDMGVVAEIADRTVVMYRGRAVEAGPTARIFSEPTEPYTRALLAAVPRLGTMAGRARPMRFPVVDRATGLAAPTPETPDTVRAAERPVLEVRDLTTRFDIRSGLLGRVTGRVHAVERVSFSLAAGETLALVGESGCGKSTTGRSILRLVEPLSGSVLLDGEDITGLDAGTLRARRQRMQMIFQDPFASLDPRLSVGAAVAEPLLINRLAAPREARRRAEDLLARVGLPPETAGRFPHEFSGGQRQRICIARALALNPRLIVADEAVSALDVSVKAQVVNLMLDLQAELGLAYLFISHDMAVVERVSHRVAVMYLGEIVEIGPRAAIFGDPQHPYTKKLLAAVPVPDPARRGERHALPDDEIRSPIRTPDYVPPERLYREVAPGHVVQDWGTEWDAGARQGAAA

SEQ ID NO: 656 - protein, 255 aa, Methylobacterium sp.
MERSGEGQAGSGRADSGRAGAVGFRPLYRQVYDTLLKRLADAVWQPGQILPSEGQLAAELGVSQGTVRKALDALTADSLLVRRQGRGTFVADHDDKQSVFRFLKLRPDGDGTGMPTSRVTGIAEAAASADERGRLDLVRSARVVRIERVRAVDAKLCVVETISVPAGLFPGIAQIELPNTLYSLYATRYGITIATANERLKAVAIGPREAELLQVPAGTPSLEIDRVAIDLEERPVEWRLSTCLTQDIHYLSVLR

SEQ ID NO: 657 - protein, 125 aa, Methylobacterium sp.
MSTRPLLPASSGRASDALEEAQFRARMARVGPDGAHRTPRRNRAPERRRGFRLGWKGWLVVDCLVVLLVVAGVVAWPPVQSCRSQDQTVGFYAGDSVGKCIRRGIADRLDTADQRLKSLIRRSGH

SEQ ID NO: 658 - protein, 1027 aa, Methylobacterium sp.
MIPVLTRHTEAVPLYAAACAELRLRGFEGDLTLSDADRTVFSTDNSIYQVAPGAVAFPRTRDDLVRVAKLLADPRFAEIVIRPRGGATGTNGQSLGHGLVVDTSRHMNRILEIDVANRVVRVEPGVVKDQLNRELAKHGLFFAPELSTSNRATIGGMISTDACGQGSCLYGKTRDHVLALTCVLTDGTVWTAEPLDPAGLAAAKGRDDRVGAIHRTVDAVVTENAALIAERFPKLNRCLTGYDLAHLRDAGGRFDLKSVICGSEGTLALIAEAGLNVLPIPKAAVLVALSYIDFDAALRDAQALLPFGAASVETIDSTVLALARKDPIWAEVRAFFPDDPAGRPVDGINLVEFVGDDAATVEAALARLTGMLEAERGTDTKRLGFTIARGDAIERLWTMRKKAVGLLGAAKGDARPIPFVEDTAVPPERLADYIAEFRALLDGKGLRYGMFGHVDAGVLHVRPAIDLKDPAQNGLIREVTEGVVALTAKYGGLLWGEHGKGFRSEFVPATFGPLMPALEAVKRAFDPDDRMNPGKIASARGAGLTRIDGVPRRGERDRAIPAPVREDFDEALHCNGNGACFSFDADEAMCPSWKATRERRHSPKGRASLMREWLRRAAEAGVDPAAELARQRAGWLSDVAATLRSRLRGRSEADDFSHAVKEAMDGCLACKSCTGSCPIKVDVPTFRAKFLALYHTRYARPLKDHLVAALEPLLPLAARAPRLFNAVLANPLARLILARAGLVAIPALSPVALAAQLAERGVAVATPDALARLDPQERARSVLVVQDAFTSHFDAEVVTDSCDLLAALGFRPWLVPYRPNGKPLHVHGFLARFAAVARSNAAMLRDLAGHGVPLVGIDPSMTLTYRSEYAQALGGDLPKVHLLQEWLAARLDRIAPGQGGRTMRLLPHCTERTNAPGAVRDWQAVFAHLGLRLEVLAAGCCGMAGTYGHEARHRATSEAIYGLSWARHVAEAPGCTLLADGYSCRSQAKLVDGVRLRHPAQALLEHVRASAAGAAPFHPERAAAVAP

SEQ ID NO: 659 - protein, 381 aa, Methylobacterium sp.
MRVAIVHYWLIGMRGGEKVVEALCDLYPEADIFTHAYAPQSMSPTIRAHRVRTSFIGRLPFATSRYKSYLPLMPMALEQLDLRGYDLIISSESGPAKGIIPPSDALHICYCHSPMRYVWNMYHDYRERTGLLTRLLMPPVAHYVRNWDAVSAGRVHEFIANSDTVARRIETYYRRQAKVIHPPVDTAAFEIAPDGQRGDYHLMVGEMVRYKRPELAIQAFNRLEQPLVVIGGGEMLRELRSMAGPHIKILGPQPFEVLKHHYARCQALIFPGEEDFGIVPVEAMASGRPVVAFGKGGVTETVIDGVTGTFFHEQSVDALIDAVQRCRAIGVEPERLVRRAADFGVGRFADEISCFVDGVLARERLAAPRPPREPSRAYLVQ

SEQ ID NO: 660 - protein, 151 aa, Methylobacterium sp.
MPDLPARFAELILAFAPLFVHRSWRHAQLLLIGAILTPGRRTVASALRIMGRAQDRRFVDVHRILNRAAWSPRAGGRILLGLLIAAFAPRGPVVLALDDTIERRRGKRIAAKGIYRDPVRSSDSHFVKASGLRWMSLMVLAPIPWAGRVWA

SEQ ID NO: 661 - protein, 307 aa, Methylobacterium sp.
WMSLMVLAPIPWAGRVWALPFLTALVPSERACRERGRRHKPLLDVGRQVALQARRWLRARDLVVVGDSGFSALLFLDAMRRARITTITRLRLDASLYEPAPPRPPGTIGRPRTKGARLPTLAAILAAKDTRWHAVVVLGWYEAGERTLEIASGTAVWRHGGLPVVPIRWVLVRDPESRFAPQALLCTEPMREPAQIVGWFVRRWTVEVTFQEARAHLSVETQRQWSDKAIARTTPCLLALFSIVTLLAARLPVRQRQRIAAAAWYPKPRPTFADALAAARYAIWRERTLAISPRRRARTKPRFRLPA

SEQ ID NO: 662 - protein, 276 aa, Methylobacterium sp.
VLATATPGGGFPAFGEAFAGAVAAVDPALTVGRRATGGSSENVGLLRAGRVDLGLVQGEYAYPALAEGAGLTVLAPMYPTPGLFVVPAGSAIRSVADLRGRRVVLGTHKSGLTVMGRSVLGASGLDPERDISPILLDRAGDGPALVREGRADALWGGGLDWPGFRALAADPGGARFFGPSEAGIARLAQPGAATRRLTVPAGSFAGQAEPIATVGSWSFVIARPGLDEEAAYRIVRALARTDLTEAQPKNLVGLVPADRVNPGTARVLREAGVTLR

SEQ ID NO: 663 - protein, 124 aa, Methylobacterium sp.
MTGLADWIARFSEMDPERAPPVPAISYATWPTVHANALAFLRERGDDAVAAGFTCLELLGVHWGAGLMRPDATGILMMTRPVTISSVAPKLAVFSNGLVWRGNFNARESVPIWEFSASAGPPRK

SEQ ID NO: 664 - protein, 312 aa, Methylobacterium sp.
VTAGTAAPAPGPEATPRLDDLSRADVPFRTGHFQAYAPHDFHRIAYVEWGDPDSPHVVVCVHGLSRQGRDFDALGYRLAKLGYRVICPDLPGRGLSGWLKDPELYGLPQYAADMAALIAHLRVPGKIDWVGTSLGGLTGMVLAAAARSPIRRMVINDIGPFLPWAPIREIGSRLRDAPRLHHNLASGESRLRTVLGAFGPLTDEQWRHIAKHSFFQELNGGWRPHYDPGIGDAFRPGRVYSVSMWRDWDAITCPVLLLRGEHSELLLASTADEMTRRGPPTRRVEIPDCGHAPALLDDEQLRIVTDWLGPAA

SEQ ID NO: 665 - protein, 271 aa, Methylobacterium sp.
LSSPAPYATWRCGLGALLALCLVLSAEPATARLVQADLARVAVAPPPGARAPLDLAATDAGTDRPTTLGQALGGRAALLLPVDYTCGNVCDPMLSLSVDALAATGLPIDDYALVLVGIDPRDDAAAARRMLAETLGDRAGSVRPRALIVSDAALARLTGALGYEAVYDAGTDSFAHPAAALLLTADGRVARVLSPLALTGRDLRLALTEAGEGRVGSIADRLTLLCYGYDAARGVYTPLIQRILTVAGIVTILAIALLVAGLTRLAHRRRT

SEQ ID NO: 666 - protein, 47 aa, Methylobacterium sp.
MRTKILLILTLLVYVTTGRAPGIREPRNPDAEHGGGRLVVATKRAWI

SEQ ID NO: 667 - protein, 594 aa, Methylobacterium sp.
MPAPALPLSRPRGRIEARTLLWILAALCIATMNAPNAVWETVQHLRVPDTDDAMRLVEVRDLVAGQGWYDNVQYRFLPPGGVPSHWSRLVDAPIAGLILALTPLTGPALAEGLTAALWPVLLFGLYGWLLYRGVRHSFGSRAALLALIAATQTFGVTIQFQAGRVDHHNLQILSILGLAFCMIRGGLRPGLIGGILAAVSLAIGLEGLPFVALAALFLTGDWCLRGRPALASLAGFGLGLGLAAPALFAVQTAPSLWGVSYCDALSPPWLWLTLGGLALGAIAAAAGERLATVPARLALAGVSGSVLLAGFAAAFPSCLGGPFPDMPPLVRIHWLLTVNEMAPLAKFVARGQWEALVFYPVVILASLTATGMAWRGPERRAWSVAALFLWPGLILGVAQFRGLYIVSGFVPLVAGVVLDRALARAALPAGARRWPVALLGAALVSSLWMIPALLAETVAPGLRTAPDAAETNACLDDAAVRPLTHLPEGTVLAPIFMGPSILLRTRHRIVAAPYHRAIPGLTAAIEGLGGTEADLDRVLTTFDVRYLVACPARPAENLQAETAFATRLAAGAARSARLVPLDVPGPLKVWRVAP

SEQ ID NO: 668 - protein, 500 aa, Methylobacterium sp.
MSHHTETLVIGAGPAGLTAAYLLSKKGRSVTVLERDPAQVGGISRTVSHNGYLFDIGGHRFFSKSQAVVDLWDEILPDDFIERPRLSRIYYRGRYYAYPLKAFEALRNLGILTSAACVASYLYARLRPVPEPKTFHAWVRNQFGERLFSIFFKTYTEKVWGMSCDAISADWAAQRIKGLDLGAAIRDGIKRSLGLRKAPKAGGPVIKTLIESFRYPRRGPGMMWEAAAAKIRAQGGQLKLDRGVDSLSYDAGTGIWTVAARRSDGSRETFTARNVVSSAPVRELVDAIRPRPLSTFNARALKYRDFLTVALIAKSDKNFPDNWIYIHDPSVKVGRVQNFRSWSPEMVPDADHTCLGLEYFCFEGDGLWNADDSELVELAKREIGQIGLIDPADVVDACVVRQPKAYPVYDEEYAGHVVTVRRELERDFPSLHLVGRNGMHKYNNQDHAMMTAMLTVENILCGRRRHDVWRVNEDAEYTESGVSGADVALGSERLVPRKVA

SEQ ID NO: 669 - protein, 318 aa, Methylobacterium sp.
MRTGLILDDYQQAALALADWARLSDRVSVSAISQHIPNPDDLVARIAQAEILVIMRERTPFPAALLERLPRLELLVTSGMRNLAIDLAAARARNVVVCGTDSSPTPPTELTWALILGLARHVAPESLTLRAGGPWQSTIGTDLAGATLGVLGLGKIGTRVAEIGRAFGMRVIAWSPNLDDGRAAAAGVERAASKEALLEASDVVTIHLVLGDRTRGLLGAAELRRMRRDAFLVNTSRAPIVDQAALVQALEEGWIAGAGLDVFETEPLPADSPFRRLPNVLALPHLGYVSRNNYRTFFTQAVEDIEAWLAGAPIRQLG

SEQ ID NO: 670 - protein, 116 aa, Methylobacterium sp.
MIIWSGWGMLTALIAAAGLIGSVLLDPALARLGVPTPTGVILVWVVAAGFNWWLGTRLNGRPGRELLDPRTGQTVILRPRHTLFWIPMQYYSVLMVLLGLLAVIGAMHAGSPGRPV

SEQ ID NO: 671 - protein, 386 aa, Methylobacterium sp.
VPERRAPLPLLVAVTMTGTVALHIFVPALAAAAVDLGTNAAGAQLTITVYLIGLAGGQLLYGPLSDRYGRRPILIGGLGLYLAGLLLAIPAPNIGVLLVARVLQSLGACGSLVIGRAMVRDVSTREDAARKLAILTTAMTLTPALAPAIGGVVNEAFGWRAVFVVLAGLVAVLGALVVFTLPETNRHKVALPGFVAVLSGYLRLVRVPVFRAYLVAGACGGTSLYAFLAVAPFLLVDRLGRSSQEVGFDCLIVVFGMVGGAVLASRLAARVPIRKAARSGNLLCIGAALSLLIVDRTGMLGVVSLIVPLFVYAVGVGLLSPNAVAGLMNVDPHAAGSASSLYGFTQMTFGALFTAAASAWPATSATPVALALLAAGLIAALALRRA

SEQ ID NO: 672 - protein, 382 aa, Methylobacterium sp.
MEAYTEIREAVAKLCAGFPGPYWRGLDREMAYPTEFVNALTESGYLSVLIPEAYGGSGLPLSAAAAILEEVQRAGCNGGACHAQMYTMGTLLRHGSEAQKAEYLPAIAEGRLRLQAFGVTEPTSGTDTGSLKTTARLEGDHYVVNGQKIWTSRAEHSDLMLLLARTTPRAEGMKRTDGLSVLLVDMRAAKGNGLTIRPIRTMMNHATTEVFFDNLRVPAQNLIGEEGRGFRYILSGMNAERILIAAECVGDAKWFIDKARAYAGERSVFGRPIGANQGVQFPIAKAYANMRAAELMVREALTLYEGGANPGAEANMAKMLAADASFEAANACIQTHGGFGFAEEYDVERKFRETRLYQVAPISTNLILAYLSEHVLGLPRSY

SEQ ID NO: 673 - protein, 472 aa, Methylobacterium sp.
MTDLLRSTTLRWAVGIALWSVLLALTMFAFIYWQTAAYLREELAETLRLEVRAAAADPAATALRVDTWTAMDPHARHYGGDFAPDGVRRAGNLDAMPKGLPRDGDAYRVNATVEVGGRSLADEIWAAALALPGGGTVVIAHDTDDIDRVRVTTLRALGLGLLPMLALSGIGGLVLARRGRRRFAATEVALAEVMRGNLGKRLPVGGRGDEFDRLAANVNRMLDEIEQLMGEVRSVGDAVAHDLRTPLTRLRARLERSRAQARTVAELHEAIDQGLAWIDQTLAMVTAVLRIGAMEEGRRTAFAPVDLGEVAAAAVDFFEPEAEERGVRLVLSAVGPFTVHGDRDLCFEALSNLIDNAVKFAPPRGTVRVEVAWTGQAIEVAVEDTGPGLPASEHEKVFRRFYRAEMSRQTPGNGLGLSLVAAIAKIHAASVSVRTSEKGGCRFAMTFPNLTIEDRTSSSYWMDSRRYKIGNT

SEQ ID NO: 674 - protein, 381 aa, Methylobacterium sp.
MSFGLDEDRTAIREMALGFAAEHIAPHALDWDRDKTFPVETLREAAALGMAGIYVREDVGGSGLSRLDATLIFEALSTGCPTVAAFLSIHNMCAWMIDAYGDDDQRRRWLPSLMGMERIASYCLTEPGSGSDAAALRTRAERDGDHYVLSGEKQFISGAGASDLYVCMVRTGEAGPAGISAIVVEKGTPGLSFGADERKMGWNAQPTRAVRFDGVRVPVGNRLGAEGQGFRIAMSGLDGGRLNIAACSLGGAQAALDKALAYMGDRRAFGAKLTDFQALQFRLADMATSLEVSRTFLRHAAAALDAKDPAATQLCAMAKRHVTDAAFEVANQALQLHGGYGYLAEYGVEKIVRDLRVHQILEGTNEIMRLIIARGLTGARR

SEQ ID NO: 675 - protein, 490 aa, Methylobacterium sp.
MPEFETPSLKDRALLVDACLIGGEWSKAGSGSIDVTNPATGALIAKVPNAGADETRRAIKAAHEAYPAWRAKTANERAVLLRKLAALVTEHQEDLAQILTAEQGKSLTEARGEVGMSAAYVLWFAEEARRVYGDVVPSPWGDRKILVTKEPVGVVAAITPWNFPSSMIARKIAPALAAGCPIVIKPASQTPLSGLAWGVLCERAGFPAGTVSILTGSARAIGAEMTGNPLVKKITFTGSTEVGKVLLEQAAHTVKKVSMELGGNAPFIVFDDADLDKAVAGAMLAKYRNSGQTCICTNRFLVQDGIYDAFAEKMAEAANRLKVGNGVEDGVAQGPLIDMAAVEKTEAHIRDAVEKGGRVVAGGHRHALGGQFFEPTVITGATPAMAVAREETFGPLAPLFRFRDEAEAIRMANDTEYGLACYFYTRDLGRTFRVAEALEYGMVGINEGIITTEVAPFGGVKESGLGREGSYQGIEDYLNTKYLCVGGLGA

SEQ ID NO: 676 - protein, 311 aa, Methylobacterium sp.
MPLTSDIGGVVPIAPTPFHPDGRIDEVSLDRMTDFFGSAGVDGLTILGQLGEAGKLDHAEGIAVARRVLGRTRLPVIVGVTAPGFAAMRSLAREVMELGAAGVMIAPPNTLRTDDQVVGYFRNAAEAVGPDVPFVLQDYPLTFSVQMTPGVIRRIVSENPSCVMLKHEDWPGLEKISTLRGFEADGSMRHISILVGNGGLFLDFETERGADGANTGYAFPEMLVDVVRLGRAGERDAAHDLFDAHLPYLRYEQQQGPLGLAVRKYVFMRRGIFASDAQRKPSQALTAQAKAEVEYLLTRLARTDARARLAA

SEQ ID NO: 677 - protein, 611 aa, Methylobacterium sp.
VAWEHHTGDLRGDSRTDAKEFTFEATPIKVNGLLYLCTPHNIVQALEPETGRLVWAFDPKMARDGQYQHQTCRGVSYNDSAGYAPPAETDADRAAAVAAAVAECPRRIIAASVDARLYALNAETGAPCRTFGADGFVDLKAQMPNLRRAAYQQTSAPLVTRNLIVLGSAIADNYYADNPSGVIRAFDVRTGAIVWKFDAGKPDATAPLRPGESYEPNSAVAWTQFSADEALGLVYVPFGNRSPDQVGVARSKADEALIDALAALDLETGALRWAFRTAYHDLWDRDNPSQPVLLTLPQGDGTVPAILIPTKVGNVWVLDRRTGAPIRPVSAVPVSTRTDIPGETPSPVQPMSSLRFTPAPLTEAGMWGVTPFDQIQCRLAFRSNRYDGNPFTPPQASEGAIVWPGNIGVFNWGSVAVDPVHHWMIATPQYLPYIYRLLPRPPGEPERRLLGADPEASPVNENLGGRYAASIAHMRSALGIPCSAPPWGVRVGVNLADGTVTWKRRNGTVAGQKVGGLAVPLPLEMGMLAHGGTLTTAGGVAFTAATLDDRIRGYDMQTGEVLWSTTLPAGGQATPMTYRGRDGRQYVVIAAGGHGALGTTPGDSVIAFRLE

SEQ ID NO: 678 - protein, 751 aa, Methylobacterium sp.
MTTTDLTSAGTASPAGGRAAILRGARIGAAAAVTVMVLLLDLISYSQLIFSGPLVESRAAGLSALLAAYVLGSLVFIALRRTARISLSFIGAAAIVQAAIAAAVAGQLEAAGVTDPETVGQLVLVACGVSTFATGVIFALLGTLRASLLVQLLPYPVLAGFLGGVGLLFLRSGVQIGGHVDDPLAALLHAVDPANLDPGRIDAGALARIALTLVIGFCAFYLPRIVRHWGTYPTVILSSLAVVHLGLAWTGTSVAAGQASGWLIEPLPTGTLLRPPAIGSLTAFDPHLLLPIWPKIATLVVVAVIIQILYVVSVELEIRRDLDIDRMFVASGATNVVGSVFGSSAMGFGRTSTLLLHNIGGGHWLGWWLTLAVMAALLIVGASPLALLPRPLAGGALIAIGIGLLFNLGVASRTLPGWEIAIALVVCTATAYFGATTGFLVGVLLAILIFGVQYGQIGAIRRSLSGADRRSSVIRGPDAAARLEAAGGRTRIYTLQGYLFFLNAQAIFRRAAAEAGDLRVLILDFRETVGLDSSALIAFRKVGQLAEQRRFEVLLVHVDPVARLLITRNGLTADPRVRILDTLDEALRAAEATLLAEAGGAGPGEVAVFARHMADRLGSTFGPDDFAPYLTVRELAAGAALMRQGEAADALYFLEQGLVSIEMEVPGRGNLRLRTTTAGTVIGEIALVQGGRRTATAVAESPCRVVVIDRAALARMERERPDLALAFQRFLILELAGKVSDTNRLLEAEMQ

SEQ ID NO: 679 - protein, 283 aa, Methylobacterium sp.
MKLCRYGEVGSERPALVDAAGVLRDLSSMCRDLGPSELAPDGLARIAQTDPTRLPRVEGSPRLGVPFTGLSKFICIGLNYSDHAAEAGMAIPSEPIIFLKAPSAVCGPNDDTIQPRDSTKLDWEVELGVVIGSTAQYVTEEHALDHVAGYCVVNDVSERAFQLQSSQWDKGKGCDTFGPIGPWLVTKDEIHDPQQLDMWLDVNGTRRQTGNSRTMIFGVREIIAYCSRYMTLLPGDIIATGTPPGVGMGIKPKPVWLQPGDTVSLGIEGLGQQSQRIRRTDHG

SEQ ID NO: 680 - protein, 428 aa, Methylobacterium sp.
MHIHLDALGGVAGDMFAAALLDAFPEHRTGVSASVRAVDARIACAVSAHNDGILSGARFTVSAPGAEPGPAPHRHAHTGQHDHPHAHDHSHDHGHDHARDHGHRPWLEIRAALEAADLAPAVRAHALGIFGHLAEAEARVHGIAVDAVAFHEVGAADSIADIVAAAHLIAALEARSWSVSALPLGSGRVRTQHGPLPVPAPATTLLLAGFATLDDGIPGERVTPTGAAILRHLCGDDPGRGRTRGILGRTGIGFGTKVLPGLSNCLRALVLEDGAASRPGRRDLAVIAFEVDDQSGEDLATGLDRLRAEFGIVDVVQMPVIGKKGRMMARIQVLVRPESLEAAVAACFRETTTIGLRYHPVEGAVLARAARTVEHDGRSVRVKIVARPGGRTAKAEADDARDRAGHAARAALRREAERLALEQEQEER

SEQ ID NO: 681 - protein, 253 aa, Methylobacterium sp.
VTRQHLESVLAGLGPVAVAVSGGVDSLTLATLAHRLAPGAALMVHAVSPAVPEEATARVRAEGAREGWSLRVIEAGEFADPAYRANPVNRCFFCKTNLYGAVRRVTDRQILSGANRDDLGEYRPGLDAAREHGVRHPYVEAGFDKASVRALARDLGLGAVAELPAAPCLSSRVETGIAIEPETLTFIHAVERLVGGALATDGAGRAVRCRVRAEGVVVELDPASLAALDAEGRETLGAGIRDMAPARLAGPVR

SEQ ID NO: 682 - protein, 302 aa, Methylobacterium sp.
MSLALGCVADDYTGASDLANTLTKAGLRTIQTIGVPEDSRSLPEADAVVVALKSRSIPADQAVARSREAEAWLRARGAAHVMFKVCSTFDSTDAGNIGPVMDALRAEAGETVALVTPAFPETGRSVYQGNLFVGSVPLNESPLKDHPLNPMRDANLVRVLGRQSGSPVGLIDTATVAKGAEAVAARLDALAQEGKGAAIADAIFDSDLEVLGRAIVGRKFSVGASGLGLGLARALAADGRGTKDAAGAAVGEPVGGASACLAGSCSQATLQQVAAAEAIMPVLRVDPARLLAGDDVVAEALA

SEQ ID NO: 683 - protein, 335 aa, Methylobacterium sp.
MDDIQPSGRLVTLTDVAREAGVGESTVSRVLRNHGSYSKRAGERVAEAVARLGYVPNRLAGSLAGQGASARLVGVVIPSLANVVFPDLLRGLTAALDADGIPCVIGVSDYDPDREEALAAALLSWRPAALLLTGLEHNPGTVALAKAGGVRVVEMIDTDGEGIDAVVGFSNRAVGAASARHLVARGYRRIAYLGHDLAVDLRAGKRLAGFEAALGQAGLALHGKEIRTGPSSPASGRAGLEALLARVPDLDAVYFSNDDMALGGYFACLSAGLAVPGRIALFGFNGLDFAAAMPQPLSTVRTPRLEIGRQAAACLTGAGPRRIDLGFELIEGATA

SEQ ID NO: 684 - protein, 226 aa, Methylobacterium sp.
MSDESRLREEICRYGRSLFERGLTPGSSGNISLRLPDGGWLVTPTNASLGFLDPARIARLDDAGRLVSGDKPTKEIPLHSALYESRSEAKAIVHLHSTHAVAVSMLPEIDPRQVLPPLTPYYLMRTGGTALVPYYRPGDPAVADAIRGLAGKYSSVLLANHGPVVAGDSLEGAVFATEELEETAKLYLLLRNLNPRQLSPGQVADLVSHFGLTLPEPDDHAGHDHG

SEQ ID NO: 685 - protein, 391 aa, Methylobacterium sp.
VTTRGDRAGDVAGDLAGDLAGDDAGGARAAPARRRIYLDQTHLRAHVTGIERVTLDLFAPDRLAPHAVRPVTAGSLPGMIAAQQLGLPARALMDRDALFLFPGFPPGPLCAVAASRCLLYVHDTFLLTRTEDLSLRSRLYMSPSFALALRWCPNLFVNSRTTGADVRALCAKRARVALLRPPVRDAFGLAHLPGPAAYAPDRPLRILAIGTIEPRKNYPATLALTAALIRAGIPAELHLVGRVGWGQHAFLEAPPPFLHRHGYLADAELRALAGSCHLLVSTSKAEGLGLPLLEVQHGGLPVVAPDDAVFREVLGASALLIRPEEPDAAAAALAGWIRDGALARAAGMSRANVARWNAIAAEDGARFRRFLAGDPAAYDALESIVAHAGAA

SEQ ID NO: 686 - protein, 244 aa, Methylobacterium sp.
MHEGTTIAIVEDDPDIRALLAGYLEGEGFRAVALDGGAALDRLIAAGPAPDLVVLDWMLPGEDGLSICRRLRDANGPPVVMLTAKDEDIDRVLGLEMGADDYVSKPFNPRVLLARIRAVLRRAHGAGGQPAAAASERLSVADLVVDLAARTVITGDPAAEIPLTSAEYDLLHCFVTRPQRVLSRDQLLDWTRGRTADAFDRTIDVQVSRLRHKLDASGSQAASLLKTVRNAGYILAAPVRSGTP

SEQ ID NO: 687 - protein, 76 aa, Methylobacterium sp.
VTAVHNEQTKLLATALNNIAVAYVVIGFVTPMMAASFGVPSAPALRVENAIFTLVWLGTGCALHYGARRALRSLKP

SEQ ID NO: 688 - protein, 338 aa, Methylobacterium sp.
MQATMHDTQHGESGAAAGGLPTFADVARAAERIAGAAHRTPVLTSRTADAMTGGRLFFKAENLQRAGAFKFRGAYNAISALPEAARTRGVITYSSGNHAQAIALASRLLGAPATIIMPGDAPAAKIAATRGYGAEVVLYDRYTQDREALGHEIAEARSLTLIPPFNHPDVIAGQGTLAQELIETVGPLDVLVACLGGGGQLAGCALAAAELSPGCRVIGVEPEAGNDGQLSFREGRIVTIPVPRTIADGAQSTALGDLTFAIIRARVSDILTVTDAQLVETMRFFASRMKLVVEPTGCLAAAAVLSGLVDVKDKRVGVVISGGNVDLGAFARLAGEAA

SEQ ID NO: 689 - protein, 162 aa, Methylobacterium sp.
MSADGPTGLIPAILAGLTLRGSGLLNGRPPRPAANTQRHPDDPGHETRDVNVRNTVLVMAGLALTALAVVGTMVWLMGTFAASQRRALPVLTPQQTTRLAPPPPNLQADPYADLDRERAETAARLSGYGYRDEAHTRARIPIGRAMDLTVGRSLEPAEPAAR

SEQ ID NO: 690 - protein, 103 aa, Methylobacterium sp.
MRNPLATLSADDRALLRKRLRTPVLTFLALLALLAVNVTLGATLPFAQVWILELAVVAVMVALILLVSMEVIHEPPLIRLFSGLGFFWVAIMVGMTLTDYLAR

SEQ ID NO: 691 - protein, 91 aa, Methylobacterium sp.
MTTTKDIHSADAAMIEPNQTAFILKVTRPDDAELSGRLVMFYAAITTSEDEALAIVRRAVKADAEVEPTGVRLSQQTASALDLEAGLARAL

SEQ ID NO: 692 - protein, 138 aa, Methylobacterium sp.
MGGLLAGLDAAAEALTTLIFDGVPLAVIAHYREHVVANTERLRLQNPVMTNIDAHSPDAALIMTNQTAFILKVTRPDDAELSGQLVLFYAAITTSEDEALAIVRRAVKADAAVEPTGVRLSQQTASALVLEAGLAWAL

SEQ ID NO: 693 - protein, 112 aa, Methylobacterium sp.
MVPNALNMLLGAVLLLAPWYLDLGYETAAARNAFVTGGAITVVALLALGETCAWEEYLTVALGLWAAVAPWVLGFADATAPVWVHGLTGLAVAALAAYALWRLYVSPRARSV

SEQ ID NO: 694 - protein, 295 aa, Methylobacterium sp.
MNIGFIGLGIMGAPMAGHLIAAGHSLFLKSRRSVPEALLAAGGTACATAAEVAERADTIILMLPDTPDVEQVLFGAGGVAEGLSPGKTVIDMSSIAPLATKDFAARIVERGGAYLDAPVSGGEVGAKNAALSIMVGGEAGTFARAEPLFAAMGKTVTHVGPVGSGQVAKVANQIIVALTIEAVAEGLLFASKAGADPAKVRQAITGGLATSRILELHGARMIERTFDPGFRIGLHQKDLNLALDNARTLGLSLPATALAQQLFSACVAQGGAAWDHSAMVKALEALANHAVGDAA

SEQ ID NO: 695 - protein, 296 aa, Methylobacterium sp.
MDQPRGRAFYLLAAVFALYVLFLYGPTLTILALSFQGPSGGLTFPMNGVSTHWFAKLWEGVGVIDIWAALRRSLALGLVVMALTVGIAFYAGLAFRKGFRGAGLVFALAVSSLIVPSIVVSLGIGLEFRLLDDAVKAMAAATGWGFLQDHGTLMGLYSSALGAHLTWTLPFGLLIMFAVFNRFDPAYEEAARDLGASGPQTLRHVVVPILAPALVGVALFGFTLSFDELARTSQAIGGRNTLPLELQGLTTTVTTPEIYALGTVTTAVSALVIGTALGLTLWLQKRRARRALAGLP

SEQ ID NO: 696 - protein, 311 aa, Methylobacterium sp.
MTDLALPAAATAERTAAPAVAARPRGRALAYLQAAPLALVFLVFLVVPLVLTGIVSLWEYNEYEIIPALTLQNYADVFDGCLSADLCTTVRTYLSTVKFVVLTLAITLPLGFAIAYFLAFHIRSGTVRMGLFLLCTIPFWTSNVIRMISWIPLLGRNGLVNDTLRTLGLIREPIEGLLYSDFAVVLAFVHLDTVFMIVPIFNSLARIDRRLVEAARDGGASGAQILWNVILPLAKPGIAIGTIFVTTLVMGDFVTVGVMGGQQIASVGKVIQVQMSYLQFPAAAANAVVLLAAVLLMILGLTRMIDLRREL

SEQ ID NO: 697 - protein, 418 aa, Methylobacterium sp.
MDLSPSRRTLLKGAAALVATPVTGFPAVHAAEPVTLRYLGTAVNQSADIARKVKEDLGLTIEYIPVVTDEVTKRAVTQPNSFDLIDTEYFSLKKILPSSNLQGMDAKRIKLADKISSVFTKGEVAGKKIGDQGTAPKKVFYLEGIDSKKFAGEQTQWISLIPTVYNADTLGIRPDLIKIPVTSWKELLNPAFKGKASILNIPSIGIMDAAMVVEATGDYTYGDKGNMTKPEIDRTIKVLIEAKRAGQFRAFWQDFNESVNLMASGETVIQSMWSPAVTKVRAQGVPCTYQPLKEGYRAWASGFGIPKTLSGRKLDAAYDFINWFLSGWAGAYLNRQGYYSAVLETAQANMQPYEWAFWMEGKPAEKDILGPDGTLIEKAGATRDGGSFDARMGAVACWNAVMDENTYMVRKWNEFIAA

SEQ ID NO: 698 - protein, 331 aa, Methylobacterium sp.
MDVELIGLTKRYGAAIAVDGIDLKVPSGAYCCLLGPSGCGKTTTLRMIGGHERASAGDVVIGPKAVGDAAPAARGTAMMFQSYALFPHLDARDNVAFSLKMRGVGRAERRAKAMAMLDLVQMGHLAGRLPAQLSGGQQQRVALARALVTGPKVLLLDEPLSALDPFLRVRMRVELKRIQTELGLTFIHVTHSQEEAMALSDLVVVMNAGRIEQAADPRTVFERPATAFVARFIGGHNVIRLPDGLVAVRADRMRLGAEAGPGALPARVVAVEYQGTSVHVGLDADGLERTPESPAALTAILSDADFASRPLRLGDTIPVGWDAAAAHHLDA

SEQ ID NO: 699 - protein, 475 aa, Methylobacterium sp.
MPEFDLAIRGGTVVTASDTVRADIGVRGGRIVAVAEGIADAARVIDASGLLVLPGGIDSHVHIAQDSGPGIVMADDFASATRAAAAGGTTCVMPFALQPRGASLRGAVDAYRARAEGQCHVDVAIHMIISDPTEAVLGQELPALVADGYTSFKVFMTYDDLVLNDRQLLDVFHVARRQGARVMVHAEGYDAIRYLSERLERAGETKPYGHALSRPEVVEREAAHRAISHAELIDLPIVIVHVSGREATEQIAWAQARGLKIRAETCPQYLTLTAEDMKGLGQEDLMAGAKYVCSPPTRDVESQEAVWSGIRRGIFDVVSSDHCPFRYDDPQGKLNPRGKTSFRWIPNGIPGIETRLPVFFSEGVSKGRISLNQFAALTATNHAKLYGLYPRKGSIAPGFDADLTLWDPNRRETIRQANLHHGSDYTPWEGFDVTGWPVMTIAGGQVIAEDGRVLSEPGRGRVLDRAVDPAERRDA

SEQ ID NO: 700 - protein, 376 aa, Methylobacterium sp.
MADQEKPKGPAAPLNLTPAALLAEVGTLGRRISEGAKLFADVSDADVEIATTPKDLVWSQDKVSLYRYRPLAESKGLPPVLIVYGLIGRYTMADLQEDRSLVRNLLNLGLDLYVVDWGNPGRADRYVTIDDYVDGYLAECVAFIQEAAGRERISLLGICEGGVFTTCYAALYPETVNAMVLTITPIDFHADTRENRAGHGFINVWTRSLTPEDVDRLIEAQGSLPGAFMGSVFSMMTPMRTMTKYNLDLLDALDDKKKFLNFLRMEKWIADRPDHPGEAAKQWLKDLYQDNKLVESAFELSGRRVDLKAITCPVLNVFAQDDHIIPPATSQALKDRIGTTDYTELGLPGGHVGVFVGGKAQKLLGSGIADWLGQRG

SEQ ID NO: 701 - protein, 400 aa, Methylobacterium sp.
MTAIDTRAFLADLYELREIGRFRTGVHRPTFSADDMESRRWLMARLEACGLEASIDGIGNVLGRHRGPGPHLLVGSHIETQNEAGWLDGALGVVAGVALARAGLPVDVVAFADEEGHFSGGFLGSRSAIGDLTEAEIDEARNRTDGTPLRAALASAGLAGLPRTRLDPDRYRGFLEMHIEQGTQLESAGLHLGVVSGIVAIWQFRIDFAGNQDHAGGTTMAERRDAGLSAVRLLAAIDREFPKVCGPRSTWTTGRITLDPGGFSIIPGRAEVYFQFRDVAMPVLERMEACLEALVRDSNRRERCPATLTALAKAIPAPCDPALMRALSEAAESVCPGGWQVMPSGAGHDAQNVARILPAAMLFVPSIGGISHHWAEDTSDADLALGVRALGDAAARVLAG

SEQ ID NO: 702 - protein, 363 aa, Methylobacterium sp.
MERRSFLQGAVLGAGLAGAGSAGAAVNASALPGNRPQDPADLPFVTDPGERRGEMLYRPFGKSSEKISAIGMGGFHLGKSAVTDDEATRLIHAGIDRGITFMDNCWDYNEGRSELRMGAALAQGGYRDKVFLMSKMDGRTKEEALKQIDQSLLRLRTDRIDLVQHHEILRYDDPDRVFAEGGAMEGFLEAKKQGKLRYIGFTGHKDPRIHLQMLEVAAERGFHFDAVQMPVNVMDAHFRSFSHLVLPYLVQNGIAPLAMKTFGDGVILKADAPIKPLEYLHFSLNLPVSVVITGIQNQRDLDQAFEAVKTFKPMDKATVAELLSRSKPYALEGKYELFKTSATFDGTAKNAAWLGEGVASVKK

SEQ ID NO: 703 - protein, 226 aa, Methylobacterium sp.
VSISEEFTLDFARPERIGLEEAIFCAGKSPEQIDAILDAARARGASLLLTRLDPEKRDRLRDAARLDYCPVSRTAVFGEAPRITGPARVAVVAAGTSDVPVAREALRVLAYAGRAASLFADVGVAGLWRLTSRIEEIRAHPVVIVAAGMDAALPSVVGGLVAGAVIAVPTSVGYGVAAGGRAALDAVLASCAPGITVVNIDNGYGAACAALRLLHAAGRLAAGTER

SEQ ID NO: 704 - protein, 69 aa, Methylobacterium sp.
MPDAANSNVEPQIFDMREDPEGWTVYDTRTDEPARVKGVPQTGLEMEKADDLVDLLNRLAHRTGERFSL

SEQ ID NO: 705 - protein, 331 aa, Methylobacterium sp.
MDHRRLGTELTVSALGLGCMGMSYAYGGQPEGEATATLRRAVDLGITLFDTAEMYGPFENEKLVGKALAPVRDRVIIATKFGFKISETGQGPDRIIGVDSRPEHVRAVCDASLRRLGVDVIDLFYQHRVDPAVPIEDTVGAMADLVRAGKVRALGLSEAGAATIRRAHAVHPIAAVQSEYSLWSRDPEAEVLPTCRELGIGFVPYSPLGRGLLTGAIRDRDSLAADDYRRTMPRFAAENLAANQRLLDTLAALARDKGVTPAQLAIAWVLNQGDFIVPIPGARKIRNLEENAAAAGLVLAEADLRAIADAMPAEAVTGDRYGAAGLAMVGL

SEQ ID NO: 706 - protein, 556 aa, Methylobacterium sp.
MMMITIKGRLLALLAALGTLLIGSAALSNYALYKNYRGLESIYADRVMPLSQFGTMRDAFDAILTAARDFEIHAIQAADAAPILERQLTRAKNAWAAYLTTYLTPEEAELVAKLTPQLDRDAAIVADLVRALTTGENATVSAARNDLLRALAPTTAAIGQLSDLQVREARAEFEHADAMARRLRIWFIGTLLGAALAVGYGIRVILVQVTRPIARTTATMTRLAAGDLDAQIDGAHRRDEIGAMLRAVQVFKDALVAKRAADAAADAEAAAKARRVETLDSATAAFRARMDRLTEALSASASSMEAAAATMDRSAGETATQLLQVSSAAEQTSVNVQTVAAAGEELATSIGSINGQIARSSDMAQRAAAEATETNALVMSLADGAERIGTVVSLIAGIAAQTNLLALNATIEAARAGEAGRGFAVVATEVKALAAQTVRATETISEQVATIQKETHRAVDVIQAITAAVLDLRTIAASVAAAMEEQEAVTQEIVRNVGQAADGTQAVTVTIGRITQAAGETGRTAAAALDAATALSRQSETLNAAVAEYLAAVRAA

SEQ ID NO: 707 - protein, 579 aa, Methylobacterium sp.
MTPTQTSRPPADRAAPWQRLADLRLRHKLAAVMALVLLAIGALSALSFHDMRGSALEDRALMTKRLTEVAQSLLVHYEAQARTGQMPVADAQKAALAAITALRFGSEDYFFVLDDRGHLIANAFNAKNVGKQVVDQTDVPGGKRYFAEMVETAKRDGSGFVDYMKPRPGGAVPVEKVASVQMFKPWGWIVATGLYRDDVHAAVRDRAVTIGLWSAGLALPILALLLLVGNRLSRPITRLTAAMRGLADGDLAVTVADQRRGDEVGAMARAVQVFKDALIAKRAADAAAVAENDAKMRRAQMLDTVTARFDAQVSALTQGLSAAAVEMEATAREMTRTAARTTDQSVRVAATSEQTSSNVQTVAAASEELAASINEIASRVAQSSAMADRAGTDVAQTNALMQVLARGTDQISEVMGLIAGIAGQTNLLALNATIEAARAGEAGKGFAVVAGEVKALASQTARATETIATQIAAIQNETRQAVESMRTIGGTIDEMRTVALSVAAAMEEQGAATSEIVRNVTQAAQGTQAVSTDIADVRQAARETGAASDQVLSAAQELARYSTSLGQEVTTFLAAVKAA

SEQ ID NO: 708 - protein, 85 aa, Methylobacterium sp.
VPRSHQEATAVLPASRIEVSPRRGLRREESARYVGVSPSKFDEMVRDGRMPKPKRIDGCVVWDLRRLDLAWDALGGDDAASNPWD

SEQ ID NO: 709 - protein, 262 aa, Methylobacterium sp.
MAHAVTAPETPPARSNEPLNADSVRRARVDLAACLRWAARNGLEEGICNHFSAVLPERPDLFLVNPYGLAFAEVTASSLLLCDFHGNVLEGDGQPEATAFHIHAELHRLKPRARAAFHTHMPYATALAMLEGEPLMWAGQTALRFYGRIAVDEAYNGLALDSSEGRRIAESAGEADVVFLKNHGVMVLGETIAEAWDDLYYLERAAQAQVLAMSTGRALKAVPEAIVKRVAAQEAAGRAESARLHLESVKRVLARDEPAFLA

SEQ ID NO: 710 - protein, 164 aa, Methylobacterium sp.
MHPASLTAIGAAVLAAGPASALEVTRSRDIPAPPAAVWALVGDFCAIQNWHPQVQRCILSGEDEDDGIRAQIRGLVVKGGKGTIAEVETARDETGMSYSYSFIQGPLPVRAYNATLAVRRDGAGSTVIWSATFDAEGMSDADAVADITGVFDAGLAGIAREAAR

SEQ ID NO: 711 - protein, 265 aa, Methylobacterium sp.
MPQITVGGLGLRYHLEGPEDAPVVAFSNSLGATLEMWDALMPALAGRYRTLRYDTRGHGGSETRDRPVAIADLAGDLAGLLDALGIGRAHLVGLSLGGMTVQALASADPGRALSATLMATAAFLPSLQSWDERAATVRAQGTAAVVEATLGRWFTPGFAERAPEAVRAVRERFLACDPAGYAVCCGAIGRMDLRPALGAITAPTLVIAGRDDPSTPPAMAEEICGGIVQAELVVLPRAAHLLAVERAEAVGGYLRAFLDRAVPGA

SEQ ID NO: 712 - protein, 250 aa, Methylobacterium sp.
MADLEQAWRVEEACLNAWPSPRELLVHRYLLRAAGGRSKRQNSVNPMRGSGAPGPAIAAARAIYGRLGQRPIFRVPAIAPQMEPLLAGGDYDVVDETCTLIRGLDDLPVAPDPAVAVAAAPGPDWLALRDAVNRADEAAARVFRDTVAALALPRAFAAAAAEGGIGAIAFGVLDRELMVIEAVATPEPLRGRGHARRAVGALLRWGRGEGARAACLQVVAANTPARALYRALGFEHELYRYHYRVGPEPG

SEQ ID NO: 713 - protein, 463 aa, Methylobacterium sp.
VLPDRATADASARAAVGSGALIAARLERLPMTAFQRNIFLIIATAWFFDSIDLGSLTFLLGSIKTEFGLTTAQAGLLSSMSFIGMFAGAALSGMLADRFGRKVVFQISMVFWGLGSLWCAYAPDATMLGYARLLLGFGMGMEFPVALAIVSEFLPTAKRGRYLAIMEGFWPLGFIAAGCLSYVLLSYFDWRAVFLAQAVPALFLFVIRFLVPESPRWLADRGRHAEADRVMAQIERQVALRLDGRPLPEPTVLPEPARGERRFSFLELWSPGYASRTVMIWLTWFFALLGFYGLTTWLGALLQEAGYSVAKSVTYTILISLAGVPGFIASAILVERWGRKPTAVLMLLGSAVAAYLYGHSPSFGWLIAYGLMMQFFLFGMWSVLYAYTPELYPTRARATGAGCASAIGRVGSLIGPFAIGLILPVLGHGGVFALGAGSFVIAAASVGFLGIETKGKSLEAISH

SEQ ID NO: 714 - protein, 203 aa, Methylobacterium sp.
MGSPPPKPGSLRARKRQETLERIAETGLRLFSRHGYEATTLDAISEAAGISRRTFFYYFKSKEEILLDWQMRGFGAALRKAVLAQPEGKVPVEAVRDALLALSTGFRTQEFISIDRVMRSSETLKARKQAAYGLHEQALHAALIERWPDPVRSAPLRLVAMASLGAMRLAIEAWIQAGGDRPVDAFLRAAFAGLTAEFCTPSR

SEQ ID NO: 715 - protein, 451 aa, Methylobacterium sp.
MSASSTGAPSTLLAAADAGRRTRVRLLIVAMLFAATTINYADRATISIAGPDMAKELGLSPVQMGYVFSAFAWSYVLAQIPGGWLLDRYSVKWVYAAAVALWSAFTLVQGAVGFFTGLTAVVLLFALRLAVGLTEAPVFPANARIVAAWFPTRERGMASAFFNSAQYFATVLFTPLMAWIVHNFGWHHVFTSMGLLGIAFAVLWLRVVDSPKNHPSMNQAERDYIEAGGALLDMDGQSRTKQGDAGRTLRQLLANRMLLGIYVGQYCITVLTYFFLTWFPVYLVKERGLSILQAGFAAVLPALCGFIGGILGGVISDLLLRRGFSLTAARKIPIVGGMLLSMSIIGCNYVQADALVVGLMALAFFGKGIGALGWAVVADTSPRESGGLSGGLFNTFGNTAGITTPIAIGYIVQSTGSFNGALVFVGLNALVACFCYLVVVGEIRRVELKAH

SEQ ID NO: 716 - protein, 381 aa, Methylobacterium sp.
MSHNLPLRGLTVLALEQAVAAPYCTSRLADAGARVIKIERPEGDFARGYDAAVNGLASYFVWLNRGKESLVADIKDPADARLLHAILAQADVFVQNLAPGAAARAGFGSAELRARYPRLITVDISGYGAGNAYSDMKAYDLLVQAESGLAGITGHPAGPGRVGVSVCDVACGMDAHAAVLEALIARGITGQGCALEVSLFSGAADWMNVPLLYFEGTGQAPQRVGLAHPSICPYGAFPTADGSLVLISIQNEREWASFCAGVLGEPELARAEGFASNNARVANRAAVDLRIGAELVRLGREAAAARLKAAGTAYGFVNTLADLATHPALIRAEVRTPSGPARIVAPPVLIDGAVRALGPVPAIDEHGARIREEFAPRARGQ

SEQ ID NO: 717 - protein, 277 aa, Methylobacterium sp.
MTDLSAWIGRTREASDLVTPRLLAEFRATFAPHLAPVTDGIAPPALHWCLAPETPPAESLGPDGHAAKGGFLPPVPLPRRMWAGGQIETVSDLRAGDTVTRTETVRDVAFKEGRSGRLCFVTVDHAVSTGRGVAIRERQDIVYREAAGAQSGMNAAPERDDPDAYASAWAVPATPTLLFRYSAMTFNGHRFHYDQPYATRVEGYADLVVHGPMQATLLINLAATLLGRVPRTFTYRGLAPMTANQVFRVCGRVAGTAFEGVTLNAGGQVCMRARADG

SEQ ID NO: 718 - protein, 565 aa, Methylobacterium sp.
MTDEPHGFDRGLTNYGDRDFARYLRRSFARSMGISVGLLNKPVVGIAMTPSGFNNCHRGMPELVEAVSRGVLAAGALPRPFPTVSLGEVFLNPTSMMYRNLMAMDTEEMIGAQPMDAVVLIGGCDKTVPAQLMGAASADLPAIQLVTGPMSTGRHRGQRLGACTDCRGFWAKYRAGTVDAEEIAEVEGRLSVTAGTCAVMGTASTMACIAEALGMSLPGTAAIPAVHSDRLVAAEETGRAAVRLIETRIRPSQVITQKSVENAIRVLMAVSGSTNAIVHLTAIAGRLGIRISPERFNQISDETPVLVDLKPVGQGYMEDFHAAGGMGALLRELRPLLHLDTMDVEGRTLAERLDEPEAWVDRAVIRTAEDPVSPVGGLVALSGSLAPDGAIFKRAAATPDLFESEGRAVVFTGLEDLSARIDDPALDVAPGDILVLQNAGPHAAGMPEAGYLPIPKKLAQAGVKDMVRISDARMSGTAFGSIVLHVAPEAAVGGPLAAVRDGDRIRLSIKDKRVDLLVAQDEIARRLADHRPPPVPARGYKALYRRSVTQAPEGCDFDFLAKAEG

SEQ ID NO: 719 - protein, 225 aa, Methylobacterium sp.
VARLLLIEDDGDTAGDVRDDLRGRGHEVAWAATGPDGARSARQGGWDAIILDRMLPGQDGLGVLQDLRRDGDRTPALVLSALGDVDERIRGLRAGGDDYLAKPFALGELAARIEALLRRPVDTRETLLRVGSLEIDLIAGTGRRGARDLDLLPRELKLLAYLMRAPGRIVTRAMLFEEVWNYRFTPKSNLIDVHLGRLRRKLEAAGEAPLIQNVRGVGFTLTPDD

SEQ ID NO: 720 - protein, 404 aa, Methylobacterium sp.
VLLILAALAAVAFAGWTCRGPLLAGLGLAPPTVREAKADRSDDAPANPDLVTLDGAGQTRIGLAFGTAETRRIVLPVRAPGTVAFDERRVTHLKPRTQGRVLSLAVQPGDRVTAAQTLATLDAAGLLDARNGLQAAEAALGEARASEAVAALQVKRGLEQLKFGGVAQAEVERRQVDLAKAQAAVKSAQANAEMYRAQYQRLAPAEGAAPGTSAVVTPIAGVVTSVGITLGEVVDTGRDAFTVADPTRVVVLANLYGPDISRVKAGDAVSVESPVPGHPPFEGHVRSVNAALDPATNTAPARIELDNPQDLLRANLFVSVTVAADLGRDGVTIPAAAVQQTDTGPIAFVRTDPDRFERRALTLGIQRTDWVEVRRGVAAGESVATAGSFGLKAILLRSLLGSTD

SEQ ID NO: 721 - protein, 297 aa, Methylobacterium sp.
MAQTIGFIGLGNMGGPMAANLAKAGHTVRGFDLVPASLEAARAAGVAVTGSALDAAQGVDVVITMLPAGRHVVEVWTQLAEALPAGTLLIDSSTVDVESARKAHALAEARGCLSVDAPVSGGTGGAKAGTLTFMAGGAAAAFAKAEPLLKAMGKNVFHCGDAGAGQAAKICNNMILGISMIGVSEAFALGEKLGLSHQALYDVASVSSGQCWSLTTYCPVPGPVPTSPANNSYKPGFAAALMLKDLRLAQAAAIAAGAATPLGAEAAQIYGLFEGAGHGGEDFSAIIRMLRGQGGES

SEQ ID NO: 722 - protein, 558 aa, Methylobacterium sp.
VKIGLGAKLHTITATALIGIVAVSGIGLVSLKSQVEQDRMAKTRNLTDVAYGVAAYFEGEERAGRLSRADAQGAAIRALKALRYDDKEYFWVNDMQPRMVAHPIKPELEGKDLAAVQDPTGKRLFVDFVETVKRQGQGFVDYYWPKPGADAPVPKLSYVRGFAPWGWVIGTGIYADDTAAILRDAAWKAAAGMLVVVALIGLLAALIGRRLTRPLRALNGAMHRLAAGENAVPVPARERRDEIGAMAGAVQVFKDALIAKVESDARAAASADGDARRAAALDRLTRSFETRAGTLSRGLATAAADLEATARTLTVTAAHTTERTGAVAAQAAGTSADVQTAAAATEEMSASVQEIAGQVNRASEIAGQAAISTRQGEATVRALAAGTEKIGDVVGLIASIAGQTNLLALNATIEAARAGAAGRGFAVVASEVKALAEQTAKATEEISGQIGRIQGETRDAVAAIGAVGRTIEEMRGIAVGVAAAMEEQNAAIQEIVRGVASAAIGAQGVSENVVDLRRGADETGSASEQVLAAARDLTRGSDELDHAVKAFLAEVQAA

SEQ ID NO: 723 - protein, 195 aa, Methylobacterium sp.
MASGQTSAERMPEIPAGSLSPAQEEAAAAFRAERGVPVFGPFVPLLRSPELMLCASRMGQYLRYGSVLPLRISEFAILVVAREWSQPVEWAIHHPIALEAGVAPETARALAEGRRPDTMSADEALAYAFSTELMRNRAVSDATYAALVARFGEQGAIDLTGINGYYALLAMTMNVARTALPEGGPAAPPLPPLVG

SEQ ID NO: 724 - protein, 304 aa, Methylobacterium sp.
VSAAVSPAMTVAVVGAGAVGCYYGFLLARAGHAVTLIGRPALVEAVEKAGLVLESAAGTASVPVRATDTGAGVSGADLVLVCVKSGDTEAAGAMIAPHLDPAATVLSLQNGVDNAERLAAVLGRPVVPVAVYVATAMAGPGHVRHNGRGDLILGASETSARVAAAFAAAGIPTTVSEKAVDALWAKLIINCAYNALSALTQLPYGRLVQGEGVVAVIADVVQECARVAEAEGVSVSPGILDDVMALSAAMAGQRSSTAQDLARGRPSEIDHLNGTIVRRGAAHGIPTPANRLLHTLVKLAERRD

SEQ ID NO: 725 - protein, 101 aa, Methylobacterium sp.
MASIREIADTLRKIAAPGMKPKAIRSAIRERHPEASKKEIVRAAFYAVTEGATAAEGATAELHDFALAERIAEDNADVVLKASKRKRKKRSSDASDRSLAH

SEQ ID NO: 726 - protein, 196 aa, Methylobacterium sp.
MRRPIRAARGLVPALGGLLLAGAALAAPDAAMQERLAPCIGCHGAGTSATEGVPSLGGQLPDYVVTQLFQFREKQREAPPMNEVAAGFSDDDLRAYADAVATLPPPGRSGPAADAALTERAQALVAKHQCNSCHGPDLAGRDAIPRIRAQREEYLAKALAGYKSNARPGYDPAMNEVAQGLSEADIKDLAAYVSRL

SEQ ID NO: 727 - protein, 337 aa, Methylobacterium sp.
MVPDTRVGTTFGHEFTGVVEEVGSGVRNLAVGDHVLVPFNIACGRCHFCKQGLFGNCHEANAQATAVGGIYGYSHTAGGYDGGQAEYVRVPYADVGPCKIPETMDLDDAVLLTDVVPTGYQAAEMGGIQRGDTVVVFGAGPVGIMAARCAWLFGAGRVIVIDHVEYRLDFARRYCPAEVYNFRSIGDPVVFLKKTTDSLGADVCIDAVGGDAAGSALHTLMGTKLKLEGGSAVALHWAINSVKKGGIVSIVGVYGPTGNLIPIGNVLNKGITIRANQASVKRLLPKLIAHIEAGRLNPKDLITHKVPLEEAADAYHLFSAKLDGCIKPVLVPPTARA

SEQ ID NO: 728 - protein, 164 aa, Methylobacterium sp.
MRNRPIDPSTVPGWGVDADPQNDPTYPMRDIARDDSRGMNWTRPPQQRARVEVLTSIEYNARPAVVGTSTPPRGVSGVIRRQAFRYSESQWAHWLMLMAADRVNVVEGVVDDLARGRVPNVPAEMGARAELAHNRSGLAGKLALTGAAIGLGILVSRLARAERL

SEQ ID NO: 729 - protein, 197 aa, Methylobacterium sp.
MAEAAVRQATYADLEAVPEHRVAEIIDGVLETHPRPRPRHGIAAARLSGELDRPFARGRGGPGGWVFIIEPELHLGSQVVVPDLAGWRRERMPTEPEDAFIETPPDWVCEILSPSTTRLDRGPKRRIYAGSGVGHLWLLDPAAGVLEGFALADGRWVLLATIQRGETVALPPFDAVPFPFDDLFPFDDPAAPALPET

SEQ ID NO: 730 - protein, 393 aa, Methylobacterium sp.
MPDTGVGTQVPSAEPDGASGPLQTPCLLLDGARLRANLAGLRAHLDRLGVAFRPHLKTAKSIDVARLAMTGPAGPAIVSTLREAEYFAEGGVRDMIYGVGIAPQKLDRVGAVRRRWGADLAVVLDSIEQADAVAAWAARTGDRLPVLIEVDADGHRSGVKPADAALLVAIGRALGAGADLRGVLLHAGDSYGLSDPEDLAAAAEGERAAAVTAATLLREAGLPCPVVSVGSTPTARYARNLDGITEVRAGVFMFGDLFQAGVGSVAVDDIAVSVLATVIGHRRDKGWIITDAGWMALSRDRGTARQAVDQGYGVVCDRAGRPYPDLIVADANQEHGILALRPGSRAALPDLAIGDRVRVLPNHACATGAQYDRYHVLDADGRVAAVWPRINGW

SEQ ID NO: 731 - protein, 114 aa, Methylobacterium sp.
VCRHNTGTGCGIYSERPEACARWYCLWRKIDVLPDALRPDRSGVMFSLDIRSPAADVADAACIVGRAVEGVHAFDRPDVIEAFAMFVREGSWPVWQATEHATTLVHPGPQISPP

SEQ ID NO: 732 - protein, 405 aa, Methylobacterium sp.
MDLHRTFAEVVVWEDGRLRHAGRVDMTRSGLEGFARTLRADDEVVIEATGNAMAVSHLLNPHVARVVIANPLQVKAIAHAHVKTDKIDAGVLANLYAAGFLPEVWTPDAATERLRRLVARRNQVVRHRTRLKNETHAILHAHLVPPCPHADLFSRVGRAWLERQALPDDEQAAIRRHLRELDTLSEDLAVLDQAIGEATLDSPVVRRLLTVTGINVTVAAGLAAAIGDVRRFSSPQKLVSYFGLNPRVRQSGLGLAQHGRISKAGRSHARAMLVEAAWTAAKAPGPLHAFFVRVRARRGHQIAAVATARKLAVLCWHLLTKEADYLWARPGLVANKIRGLELQAGQPQKKGNQRGPAYAYNIKALRDQEMEIARRAETAYERVVAHWTPRPSKTVRGRLKSARLE

SEQ ID NO: 733 - protein, 527 aa, Methylobacterium sp.
MQAEIEAPTRPHPAGAGAAGDVPRTIRLSDSDNVAIVVNAFGLPAGTVFPDGLELVEFVPQGHKVALTDIPEAGEVRRYGEVVGIATQPIPRGAWVEESRVATPVAPALDALEMATRVPAPLPPLEGYTFAGYRNPDGSVGTKNILAISISVQCVAGTLDVAIRRIKQELLPRYPNVDDVVGLTHAYGCGVAINAPEAVVPIRTLQSLAQNPNFGGEVMVVGLGCEKLVSERLLPDNGAAGDGVVRLQDERHRGFSAMIDSILTMAEARLEVLNRRTRETCPASELVVGLQCGGSDAFSGITANPALGFAADLLVRCGATVMFSEVTEVRDAIHLLTPRAKSPEVAAALVREMAWYDAYLAKGEADRRANPSPGNKKGGLNNIVEKALGSVAKSGTSAISGVLAPGERVREKGLIFAATPASDFVCGTLQLASGITLQVFSTGRGTPYGLAQAPVIKVATRTELAERWSDLIDLDAGRIATGAATIEEVGWELFHLILDVASGRKRPWSDQWGLFNDLTLFNPAPIT

SEQ ID NO: 734 - protein, 306 aa, Methylobacterium sp.
MSADLPAAATLSRLDLKTLRLFAAICAEGTLNGAARRAAIAPSAVSKRLAELEHALGCTLLTREPRGMRLTPAGETLLHHTRRMLASAEQIALELAEHARGVRGFVRVLANLSAIVEFLPEDLQAFLAAQDGIRVDLEERPSGGVVAGVEDGFADLGLCAGNTDTRSLTAYPYRSDRLVLVMPAGHPLSGRGAVALADTLDYDHVGLHAESSIYAALRDEARRLGRPLRLRMHVPSFDAICRMAQVGLGLGTVPERVYALLGPPMRLAAVPLTDPWAARTLRLVVRPGALSPAAALLLEHLRAAGR

SEQ ID NO: 735 - protein, 224 aa, Methylobacterium sp.
VVVADIAREAGARVAADLGAQARFAETDVTREADGAAAVRTALDAFGHLHGLVNCAGIAPGEKVVGRDGPHRLETFARAVSVNLVGTFNMIRLAADAIAREAPDATGARGVIVNTASIAAFDGQIGQAAYAASKGGVVSMTLPIARELARHGIRVVTIAPGIFETPMMAGLPQDVQETLGQSVPFPARLGRPSEYADLVRHICENPMLNGETIRLDGALRMPPR

SEQ ID NO: 736 - protein, 105 aa, Methylobacterium sp.
MSSHAASGAGRRKPHLLAHSPQDNVAVAVIEGLSASTDAFGVVTENDSTFEVHVRHDIPIGHKVALTDLKAGDTAIKYGQDIGKVIKDVAKGEHVHVHNVKTKRW

SEQ ID NO: 737 - protein, 428 aa, Methylobacterium sp.
VTMFKEAAQLEHEIATPFVGGAPDQFATKALATERASENYTSATFMGWRRENGRVGVRNHVVLLPLDDLSNAACEAVANNVKGTMALPHAYGRLQFGEDLDLHFRTLIGIGSNPNVAAVVVIGIEDQWTNRVVEGIAKTGKPVIGFGIEGHGDIAIVAKASYQAKRFVQWATELQREECPIADLWVSTKCGESDTTTGLASCPTVGNMYDKLIPHGIYGVFGETSEITGAEHLCRERAISPEVSDKWYTMWKAYQDDVIEAHKTDDLSDSQPTKGNIAGGLTTIEEKALGNLEKIGHECRFIDALQPAEAPAKGPGLYFMDTSSAAAECVTLMAAAGYVVHTFPTGQGNVIGNPIVPVIKITGNPRTVRTMGEHIDVDVSGVLTREMTIPQAGDALIDMVVRTANGRLTAAESLGHREFVMTKLYRSA

SEQ ID NO: 738 - protein, 313 aa, Methylobacterium sp.
MPKVVISEFMDEAAIAAELAGLDVQYDPGLVDRPGDLAAAVARADALIVRNRTQVRGALLDAARDLKVVGRLGVGLDNIDVPACQARGIAVYPATGANDGAVAEYVVATAMLLLRGAYGATARVAAGTWPRNALMGREIAGKRLGLVGFGSIARETARRAAALGMIVAAHDPFVAAGDPAWNPASGPVRPLALDALIAQSDVLSLHVPLTDQTRGLIDATALARMPKGAILINAARGGVVDEAAVAQALRSGHLGGAALDVFDREPLDAASGAVFADVPNLILTPHIAGVTQESNVRVSAVTAAAVRRHLTER

SEQ ID NO: 739 - protein, 82 aa, Methylobacterium sp.
MDEPGGDGAGRRAMRSRAAVALTDRIPVAAARFARDVRGSTATEYALLGGLIFLVAVGSIRYYVSRVSAVYGDITAAVTQGQ

SEQ ID NO: 740 - protein, 457 aa, Methylobacterium sp.
MGRVGLLGRIMLLLLGALSLLVLATVALDHWQRREERLPAGSRFPRVDQAASIMTLLRDADPAQRPAILKAVSGEVLRAEIVDAPPDTVDLIREPRLETRIRRMTAEPADRVQAYTDAALLRRGVDPANIAQAERAGPVGRLALATYRLPDGRYAVISATEHHRSLMPWLFGQPLSLWVAVLGAAAAGLVLVGTRHELAPLRRLTDAVSRFDGRAPERVSAPRGAPEIRRLAQAVQGMQERIAGLMAERSLLIGAISHDLKTYLTRLRLRAEVVAEPLLRDKLVADLDAMTELIEASLGFARGTAVEATRAPVDLADLVAVEVAEHAAQGATISLTGEEVRDATVAGDAVALRRVVANLIGNAVKFGRSSVAVAVSRAGTVCRIVVEDDGPGIPEAERTAVFSPYYRVERSRSRQTGGTGLGLAISRQIAEAHGGTVVAEAGAGGGARLVVTLPSLS

SEQ ID NO: 741 - protein, 491 aa, Methylobacterium sp.
MSFEPIGAIAVVIGLFCLLFGRESVVIAFVVFCNLGSAAALLLGGANVQPAHLFLVFLMIATLFHRNMSTRVLSSFRLPEPGFWLLCLTLYGVASSYILPRLFAGQTYIVPLGTSSHLITSDGVVPLGPVSSNFTQPIYLIGDLVCFSIITAFGSTKNGIETLAKALILYAAANICFGIIDVLTAATGTQEALQFIRNAQYTFHDEESVGSMRRIIGAWPEASAFAGMTLGGCGFTGMLWLCGRKPLVTGPLALISLLFVILSTSSTGLVGAAVLIPMLYAIALLRCSTRRQDRFSAWLVVAGPLVACVLVLLAFSVGGVAERVYDYVDTLVLSKAETSSGVQRSAWNAYAWRNFIDSSGLGVGLGTNRTSSFPLAVLSNVGIPGAVFYVLFLASVFGFRRGAPRTYASDIRAAGRVACLCLLPGSLIAGPTVDQGLIFYIFAATACAYPARHPVGHIGVSATPIEPAAVAIRSGLAEPARHSAQNVSLDT

SEQ ID NO: 742 - protein, 145 aa, Methylobacterium sp.
MLALIGSFLVKLLGSGIAEPVLAYFKQKDTSARDIAVAGIDADRQRDLAALQGVVEANKLKAASQAAYPWIVYLIAVPPALHAASIYFDSMPFWTPWGAHVVGSWGVPTPPPPYGDWQGKILLSFFVVAPVVQAIRTGAAAVARR

SEQ ID NO: 743 - protein, 233 aa, Methylobacterium sp.
MPNERPETRLKCALVVRGAFDAHVVPAFEAAGGRTAIHWAPTTVIMKTLAEGETADAVLVLSDAMDRLVAEDRVEPESRVDVVRSRYGIAVKAGAPHPDIATVEALKRTLVEARSVAYSRTGASGIYFAGLLPRLGLADAVNARATIIPQGFTAEKLVSGEADIAVQQISELMVVPGIEVVGPLPDPVQEMTTFAAAILRGAADRDGAARFLAGLRTPQAAEAYRTSGLEPAY

SEQ ID NO: 744 - protein, 328 aa, Methylobacterium sp.
MADTAALDAAPIAAAVPTSRDDKALHRLIFVGIAVLLVVAPLVLYPVYLMKVLCFALFALAFNLLLGYGGLLSFGHAAYFGMASYLCAYTAKSLGFTPELAILAGTVTAALLGLVFGALAIRRQGIYFSMITLALAQMVFFFSLQAKFTGGEDGIQAVPRGNLFGAISLADDRVMYAVVAVVFMAGMLLIYRIIHSPFGQVLKAIRDNEPRAISLGYRASQYKLAVFVLSATLAGLAGSTKAIVFQLASLTDVHWSMSGEVVLMTLVGGMGTVFGPIVGALVIVTMETYLAQFGAWVTIIQGCVFVLCVLLFREGIVGLIARLIRRPL

SEQ ID NO: 745 - protein, 463 aa, Methylobacterium sp.
MNGGTQPTRRGVGRLRLPSAGAKLLTPLLVGLLVGLLAALRPLPAAALTEIQFWHALDGPNGELVTRLAETFNASQPDYRVVPVYKGSYAETISSGITAYRTGAAPHLLQVFEVGNGTMAAAVGAVRSVATVMREAGLSVTPEDFLPVVATNYRDADGGMLSLPFNVSSTVMWINRDRFRLAGLDAKQPPATWPEVFEAARRLKAADGKRCALSSAWPTWVHIEQLSVWHDRPLATRSNGLDGYDAELVFNGPLQVRHLQNLVDLKRAGVFEYNDRVNRGESRFVSGDCAIFLTSSSLYGKVATAARFDWTVVPMPFYPDVVPEPQNAILGGGSLYVMQGKTPDEYRGVARFLAFLMDGRQQAAMYRNTGYIPTTRAAYDDAVAEGFFERHPQLHVAVQELTRRPPTRNTAGLRLGNMLQIRDIWAEELEAALDGAKAPQQALDDAVARGNQVLRVFQQRTKK

SEQ ID NO: 746 - protein, 207 aa, Methylobacterium sp.
MRLRIGVALAVVVIAAVALLAGPLSRGDSLSDILTGRTPLLAGSARAPGGSADLTGTATLASDQRPATLHVACDPGGTGLSAALTVPRFAELAPRFDFAGLEGADSEKPLTGLLVSSAGSVRSVRMPVRGAATGADAGFTLTVAGARRGEDPLRGVALALVQPGTKLTWTQASPRGDDPTLTATFTVTEADAAALKGALSGCLAAPF

SEQ ID NO: 747 - protein, 87 aa, Methylobacterium sp.
VLAVASVSAALPEAEMARSAREGPAQERPDRERRLADAVFVRPLYGAYRHCGGSCLKSGDLSWFCFARQSCYLSCATAPPQMKCAVP

SEQ ID NO: 748 - protein, 539 aa, Methylobacterium sp.
MNPIKPTRRSLMAGGVALAALGAACRAGAQGAAPGTLTYGISMTDLPLTTGQPDRGAGGYQFTGLTLYDPLVAWELDVADRPGKMVPGLATAWEADPADPKVWTFHLREGVAFHDGSAFDADAVIWNFDKVLNKEAPHFDQRQASQVRPRLPGVASYRKVDAKTVQVVTKTPDSLFPYQMLWFLISSPAQYEKVGKDWAKFAFEPSGTGPFRMGQLVPRVRLELLPNTGYWNPKRVPKLAKLTLACVPEDLARVNALLSGSVDLIETPAPDAVPRLKAAGMRVVGNETPHVWNYHLSMVEGSPWRDLRLRKAANLAIDRAGVVELMGGLAQPAVGQVQESSPWFGKPGFKIRTDVEAARKLVEEAGYSVKNPVKATVLIPTGGTGQMLSLPINEFVQQSWAEIGIQVAFKTVELEVAYTAWRQGAADPSLKGVSAGNIAYVTSDPFYAILRFYDSRQIAPNGVNWSHYRNPEVYALCDKVKASLDVAEQNRLLARIHEIVVDDAVQVWVVHDTNPHALSSRVKNYVQAQHWFQDLATLA

SEQ ID NO: 749 - protein, 75 aa, Methylobacterium sp.
LAAASLTLLAGSAYAQGNSPYNASGAQAGGPRGGLERAGEAAAMEQGAAPAARPTMRKRMKHKRMKHHRRMRHHM

SEQ ID NO: 750 - protein, 243 aa, Methylobacterium sp.
MTSPFLGEFLGTMTLIVLGDGVVAGALLKHSKGENAGWIAITAGWAFAVLAGVFVANATGSADAHINPAVTVAGAVSSGDFSKIPVYIPAQMLGAFVGAVLVWLHYLPHWGATQDPGLKLACFCTGPAIRDAKANWISEIIATFFLILTISALVTTTLGSAGAIPRAVAPYMVGMLVWGIGLSLGGTTGYAINPARDLGPRVAHAVLPIAGKGSSDWGYALIPVAAPLVGAVLAGLFVRALGI

SEQ ID NO: 751 - protein, 539 aa, Methylobacterium sp.
MKPFDWVTGYPSLRMPMFGRNCVATSHALAAQAGIQMLQAGGNAVDAAIATAAAKTVTEPCSNGLGSDAFCILWDGKALHGLNASGGASAAWSRDYFLKKYGAAERPPMRGWDSVTVPGAVAAWAALSERFGRLPFADLMQPAIRIAERGYLAPVVVQQKWAAAARIEAITRQPGFSEFFLPRGRAPDVGELVTFPGAEKTLRLIGETKGEAFYRGEIAEAIAAHARANGGAMTAADLAAFRPEWVTPTAKDYHGYTLHEIPPNGQGIAAQIALGLLEQFDLGGLPVDGPESQHLQIEAMKLAFSDTYRYVADPRGMEVTPEAILDPAYLAERAKLIDRNRAQVFGPGKPPAGGTIYLTAADESGMMVSFIQSNFMGFGSGVVVPDWGISLQNRGYGFVLDPESPNAVAPGKRPFHTIIPGFLTKDGAPVMSFGVMGGNMQPQGHVQTLVRMIDHGQNPQAACDAPRWRVNEGLDINVEAAMPGATLERLKALGHELEVIEDSYQDFGAGQFIWRMGDPAVEGYVAASDPRRDGQAVVW

SEQ ID NO: 752 - protein, 173 aa, Methylobacterium sp.
MKTAAKTHSKTHSKTAAKTTRATLALDKAGIRYSLHVYAYDPDAPRIGLQAAEALGVDPGRVLKTLMASVDGRTVCLLVASDREVSMKRVAAAFSGKAASMLKPADAERLTGYHVGGISPLGQKRSFPTAIDAGSLTEPAAEIHVNGGGRGLQIRLTEGDLAAVLGALVVPLT

SEQ ID NO: 753 - protein, 535 aa, Methylobacterium sp.
MTTARALSIGFVGNVVTNPFGKVAGRLADLATVSCEHLPIGQIEQVLAGPAAADVLIVHLDHRWFFDVAPDEAAVDRARGLAELVSARLARAPGTIILNTVPFVPVSSVESDLHDQLQALARVNAVLFDLARAQERVSVVDAAGALALLGFANAFRERNRYMYQMPYGPAAVDALSERYADAVAARLRSRRKVVVVDADNTLWGGVVGEDGVENLEVDSDYPGIVHTQLQRQLLRLKGLGILLCAVTKNNEEDFRAVFAQRAMPLRLDDFVAYRSNWTEKSENIRDLAAALNLGLDSFIFLDDNPFEIEEVRARLPGVECHLFDRTRPEQALTLLDGIASLRARNITAEDLAKTEQYRGEAKRQELQRSAASMDEYLASLEIRVHVARNNPGSLRRVTQLINKTNQFNLTTRRYTEDEVATAMREGGVYAARVVDRFGDMGIVGVAIVRGGELETFLMSCRALGRRIEAQILRHVCQQEGDRDLRAQYRPSAKNRMVESFLDDNGFEPLSAGPEGKTYRLTRGPDDTPYIHIVAE

SEQ ID NO: 754 - protein, 423 aa, Methylobacterium sp.
VDAVEIRDASLTAFYRSMTPPERHTFWACAAGWCLDGMDFMIYPLVIGTIMALWHVDAGTAGLAATVTLLASALGGWLAGFVADRIGRVLTLQITILWFSLFSLLCAFVQNFEQLLVARALLGLGFGGEWAAGAVLIGETIRAEYRGRAVGSVQSGWAIGWGLAVLSQAVLFSVLPPETAWRWMFAVGALPALLVFYLRRYVKEPEVAAESRARAAATGDRPQIWEIFSGPILKTTLLASLAAAGCQGGYYAITTWVPRFLTTERHLSIVSSTGYLAALIIGSFTGYLVGAWLADRLGRRPLFLIFSLGAIAVIVAYTQIPLSNGVLWVLGFPLGFFASGYFSGMGAFLTELYPTRLRGSGQGFCYNFGRGIGALFPALVGYLAERAGLASAIAIFAAVAYGIFFLAAFALPETRGKVLHADS

SEQ ID NO: 755 - protein, 417 aa, Methylobacterium sp.
MTVHIARAQFVAKDADQLGTALVSPEPRHALNALEVGRIARHLVIFTPTPDDLARLIAAARADLPDLAPLRTVQRVMSINPDSVLAIAQRHRFDAADPRGEGFVACLMLNADGMAALKAGTLDASDPPAAMLAGQHERPAGIYVWAVYARRRLSGGVGLVFDRLSSPTYRGVDFYARAATPEGADLLTTLGFTAQTSARGPLYHFARGPKAEPAPPYDTHRSGGTGISVAVARNMEDLSRVIALRAAVYMAEQACPYEEEFDGNDLSATHLIGYVGDEPAGCLRIRFFADFAKIERLAVRAEFRNTRLSFALVRAGIELARVKGYRRLYGHAQKRLVGFWSRFGFRVFEGAQELVFSDFDYVEMLMEAEPHPQAIGLGADPYVIIRPEGRWHRAGALDRSRSRAVTRPSVDRAVAAR

SEQ ID NO: 756 - protein, 426 aa, Methylobacterium sp.
VAIDPRNLAQTATLTYSQDFDTLPLWDGTSGLDTSGGPQWSIHVTSTGTRPFNREQQWYVRADQPDGSALPNPFRVHDGILTITAAPSNPSLLQDLGDQPYTSGMVNTFHSFSQTYGYFEMRAELPAGQGFWPAFWLLPADGSWPPEIDVMEMLGHDPDTLYTTVHSLAPGQTPGNHTMSQGISAVADMSGGYHTYGVDWQPDTLTFYFDGQEIYRTPTPAGLDKPMYMIANLAVGGSWPGDADASTPFPAQMNIDYMRAYQASPGAAALEPVFHFYDAASGRHFYTASAAERAQLESTPSGYAYQGVGWAAPVSSPATADVFRFTNPTTGDHFYTTSTAERDGLLSGGSGYNYDGVAFDAYASSTAAGSHALTVERFVNTESGRHYYASSADEISYIEQGHAGSGWIDEGHAFTLHAPTANMFGM

SEQ ID NO: 757 - protein, 87 aa, Methylobacterium sp.
MADDLNGLSDKALSILAFAAYHRLVSGETVTSVIRRDGAGHEADPEGVKELEGRGLVTAGESAIDLGETAQAAVETMVAALRREVGR

SEQ ID NO: 758 - protein, 380 aa, Methylobacterium sp.
MATIRKRTLPSGKVRWLAGYSDGGGKRRFRQFETKKEADAFLVQARTQVATGVHTPDSVSPTVAEAAELWLKRCERDKLERTTLLQYRGHLTHHIGPRLGAVKLSRLTVPLINEFADQLLTAGRSRVLVSRVMVSLSSIVTEAQRRGLVTANNVRSAKPVRRSSREDKRPEMPSRDELKAIIAATPDQWRPLILTAIFTGLRGSELRGLTWGDVDLRRGVLSVRQRVDRFNTFGPPKSKAGTRDIPLPPNLLTTLKAWKLACPNGPLGLVFPTVDGTVQGHANILHRCFWPLQVKAGVTVLKDGQNEQGRAIKVPEAKFSLHALRHAAAALWIEQGLSPKRIQTLMGHASIAQTFDQYGYLFEARDDEAAMMAGVEKGLL

SEQ ID NO: 759 - protein, 523 aa, Methylobacterium sp.
MPIETSRAWGRGELYETLCLLVIGVGIWFVGVTLGTFAYLNSVVATYNLTDLLLLAACMGVAQWGASIRKSIILRRLMLERAAAAAQAEAIARHDGLTGLANRRRFIDAVERAHAPGAADAAVLLIDLDRFKPVNDLYGHAAGNAVLCAVAERLQQLVPSGGLAARLGGDEFAMLVPLRYESEALRRLAQAVLARIAEPVTWNQNDLKVGATVGVAAVSAEQGDADAILHAADLAMYQGKKDGRGNVRFFRSAMDAELRARARMETELRLAIETGAIEPFYQPVVSLPEKEIVGVEVLARWRHPTRGVVGPSEFIPVAEETGMIADLSYSLIRRACLDARAWPPHLILAVNIAPQQFQDAWLAQRILGILTETGFPPQRLEVEITESALIQDLEATRTTLLSLRELGVRIALDDFGTGYSSLYHLRELKFDKLKIDRSYVDAITMSDERAKLVDAIIKLGASLGLSTTAEGIETDASLDWLSEQGCHFGQGYLFGHAMPKAEMDGVLAAARSPAPFQDLARAS

SEQ ID NO: 760 - protein, 523 aa, Methylobacterium sp.
MYTSRRQILLSGGAGLVGLATGLGRPGLSRAADRPLLTHGLQSGDVGTDSAVVWARSDRPARAIVEWATTESFADIRGGVFADALPETDGTVKVALTGLPAGQDVFYRVRLEDVAAPTIVGPAQVGRFRTAPADRRSVSFCWSGDTAGQGWGIDEARGGMTIYSAILKNRPDFFIHSGDTIYADGPIQSEVKLPDGSLWRNRVTEEVAKPAETLAEFRGRHKYNLTDRNVLAMNAAVPILAQWDDHEVTNNWWPGEPLTRAEHLKKKYADPNVLALQLRAAKAFHEYMPMRFEPSEPGRVYRKIGYGPLVDVFMLDMRSYRGPNGENRQTEYGPESYFLGPQQIAWLKRALLESRATWKVIAADMPLGLVVTYDTDRNFGSEAVAQGDGPPLGRELEIADLLRFIKSAGIRNTVWLTADVHYTAAHYYDPDKAQFQDFEPFWEFVSGPLHAGTFGPNALDNTFGPQLRYVKAPDKGQVNLSPAAGYQFFGHVAVDGATEQMTVTLKDAADTDLWHVTLDPAKA

SEQ ID NO: 761 - protein, 275 aa, Methylobacterium sp.
MRTALARFARNRLALAGAAVLFGLVVLVALTPLLYPGDPFALVGPALQPPGGQFLLGTDTLGRDVAAEIAYGARTSLIIGLSATGAAILLGTLIGGLAGYYRGGVEIALMRLTEFFQTIPAFVLAILIVAILSPSLFSEVVAIVAVSWPGIARLVRGEFVALGGREFVLACDGLGAGDTRIIFRHMLPNCTAAIIAVGTLLIGTAVLIEAGLAFLSLSDPNVMSWGLIISSGRAVLRSAWWICTFPGLAILLTVLAINLVGDGLNEVLNPRLRER

SEQ ID NO: 762 - protein, 302 aa, Methylobacterium sp.
MAIDTIEHTLRAMGNAARGLAAIGAALRLRQDAMEHAREDAREDAPEVDPEVARRVLDVVAAVIPGGLGDLEPERVSALLASVTHALEEARDLLDHPERPPVWQVRDPAMLQAQGQASRSVVRRLAALSTERPSLAAALTGRFLDVGTGVGGIALEAAALWPSLRVVGLDIWEPALALARANVAASPFHGRIELRLQDVTRFDDSAGYSLTWLPAPFLSRDAARTALDRLTAALEPRGYLVVGLYAPPADPAAAALAALRLARSGGHLWECAAMEAELRARAFTAVETCAGQPVTLVMGQRA

SEQ ID NO: 763 - protein, 323 aa, Methylobacterium sp.
VTDETPRAMNGAESLVRTLVEGGVEVCFTNPGTSEMHFVAALDRVESMRCVLFLFEGGATGAADGYARMADKPASTLLHLGPGLANGLANLHNAKKARTPVVNIVGEHATYHREYNAPLTSDIEGLAHPMSSWVRTGMSATEIGSDGAAAIAAARTAPGQVATLILPANTAWDPGAGPAPVPPIPERARAGDDAIAAAVQALQSGEPVLLHLGDRAVQGEGRVIADRIARKTGARLMAMTSNARIDRGAGTVPIERLPYPIDQGIDALKGFRHIILIGATPPVGFFAYPGKPSLLAPEGSTTITLATPEEDQIDALERLAQAV

SEQ ID NO: 764 - protein, 463 aa, Methylobacterium sp.
MPDIDPVHASAAELGRAIQARTLSPVDAVDALLGRIDRLEPKLRAFTEVFAADARLAAEGADRAIRSGHAVGPLHGVPVVLKDLIDLEGRITMGGSAAHRARRAARTATIARRLIGQGMIVLGKTHTVEFAYGGWGTNQHLGTPWNPWDAETPRTPGGSSSGTGVSVAARMAPWGIGTDTGGSVRLPASFCGLTGLKVTVGRVSTWGIVPLSMTLDTPGPLARTVEDAALLYEAISGPDPRDPTTRGVAPDAPWPALNRGVRGLRLGRMPASERDGVAPDMLAAYDAALDLLAGQGAEIVDVVLPFRFSDCVAMSQITNAEAYFVNGDLAEDPSAQLGDAVRARILAGANVSAQEYLGTLHRRAAMKQQYDAALAGIDALLTPTTESAAVALDAVDEAHLPSRFTRFGNLLDLCALALPNGFTASGLPLSLQIVCRGYEETTALRIGQAYQRATDWHLRRPPV

SEQ ID NO: 765 - protein, 391 aa, Methylobacterium sp.
MNPFTFQTTPNVLFEAGAAKKLPEIVGSFGAKRVLLVTDKGVRSAGLTQAAEAALAEAGVTLDVYEDVVADPPSTVIEAAAKRARELGTDLVLSIGGGSALDTAKLVAYLAKSDEPLDSIYGVGLAKGDRLPLILVPTTAGTGSEVTPISIVTTPTTEKKGVVAPKLLPDWAVLDPELTLGLPSHVTAATGIDAMVHAIEAFTSKNKKNPISDQLAKQALALLSANIRTACTDGKNLEARSGMLLGSMLAGMAFANAPVAAVHALAYPVGAIFHVPHGLSNALVLMGVMRFNLSHAEALYAELAPILDPAAADLPRPEAAKRFVESLDAICRDCKVPASLAEVGVARQDLERMATDAMKQTRLLVNNPREVTYDDAFAIYAEALGEARPAA

SEQ ID NO: 766 - protein, 395 aa, Methylobacterium sp.
MTDAVIVSTARTPIGKAHRGALNLTRGADLAAHAIRGALDRARLEPAAVEEVVLGCGYPENATGGNVARHAALVAGIPVESAGVTVSRFCASGLEAIASAARRIVLDGVPVAVAGGVESISLVQPKVQRELTRNAWLEAHLPAIYMPMIETADIVAERYRISREAQDQFALESQRRTAAAQERGLFDDEIVPMSAVMAVTDKATGETREVETRLAKDEGNRPDTNLEGLAKLKPVRGEGAYITAGNASQLSDGASASVLMSAGEAARRGLEPLGTFRGFASAGCGPDEMGIGPVFAVPRLLERQGLRVSDIDLWELNEAFASQSVYCRDKLGIDPEKVNVNGGAIAVGHPFGMSGARLVGHALLEGRRRGARYAVVTMCVAGGQGCAGLFEIARS

SEQ ID NO: 767 - protein, 398 aa, Methylobacterium sp.
MDLRFTDEEIAFRDEVRTFCRTEIPAEIRKKVSEGRSLSKEDYVTSQRILNAKGWAVPHWPQEWGGRDWTPIQRYIYTEELFQAAVPLPQQFNCYMFGPVLATFGRQDQKERFLPRAANLDDWWCQGFSEPGAGSDLASLKTRAVRDGDHYVVDGQKTWTTLGQHADWIFCLVRTDFEAKKQRGISFLLIDMKTPGITVRPILTLEGRHEVNEVFFDSVRVPVENLVGEENKGWDYAKFLLANERTGIARIGLTKERIARIKRLAREMPAGPGTMWDDPAFRGRVAEVEVELKALEITQMRVAAKQGRADSVEPDPASSLLKIRGSQLQQAATELLVELAGPFALAAPARGAGANNLPGGFDWVDAAAPSYFNNRKVSIYGGSNEIQHNVIAKGILGL

SEQ ID NO: 768 - protein, 384 aa, Methylobacterium sp.
MDFDLNEDQSLLRHSVERLAADLYPSLESRQARLKAPLGFPEDGWAAFAELGVAGLPFSEDEGGLGGGPVETMLVMEAVGRNLVVEPLLASLVLGSTALRLGGSAAQRERLVPGLVAGDLRLTLAHTERQSRYDLADVATTARRSGDGYVLSGAKSVVPNADAAGLMVVSARVSGERRAPSGIGLFLVPTDTAGVAIEAYPTQDGGRAAEVSFSDVTLPADAALGDPEGGLPLLERVVEHGIAALAAEAVGSMDALHKLTVEYLKTRKQFGVSVGSFQALQHRAVDMLIQLEQARSMALYAAMMVDTPEPRARAAALSAVKVQINKACRYVGQEAVQLHGGIGMTLEYIGAHHFKRLAMIEYQLGDTAHHLRRITQDENGLLAA

SEQ ID NO: 769 - protein, 285 aa, Methylobacterium sp.
MEVEAGPRAGFDIGLDTAEPDVAEPDVAGAGAKEDRHFVTALARGLSVLACFGPGRTSLANHDIAEACGLPRSTVSRLTYTLTKLGYLQHMPELGRYRLGTATIALSSAALGGLDIRAIARPVLRAVAEAANASVGLGVRDRLSMRYVDCQRGPAAISLNLDTGSRISLARSAMGRAYVAVCPDRERAGIYEDLKALDPVAWPVLRAGLDRAVEEHRELGCCTSFGEWQETVCAIAVGFHPGGGLPPMSVNCGAPTVITDARFLLEVARPRLIDAVRSLDGVMGA

SEQ ID NO: 770 - protein, 48 aa, Methylobacterium sp.
MSAARSVLSRVRAYLRYRDTVTQLSRLSDRDLADLGINRSEIRGVARV

SEQ ID NO: 771 - protein, 112 aa, Methylobacterium sp.
MTYVVTENCIRCKYTDCVEVCPVDCFYVGETMLVINPDECIDCGVCEPECPADAIRADTEPEMAGWKTFNAKYADLWPNITEKTEPADDAATWDGRDGKLLDLFGTADPASA

SEQ ID NO: 772 - protein, 231 aa, Methylobacterium sp.
MDVVVGHKGKSAARLTFRGKASHSALAPQGVNAVEYAARFIEHVRLSAEAIARDGARDALYDVPHTTGLSSVVRGGSALNIVPDSCSVEFEYRAIGADDAAALAASAIAYATGTLAPLMRAGDPACGVAVEPLIDYPGLDTDPEAAIVTLAKRLAGRNGHAKVSYGTEGGLFERLGGVPAVVIGPGSIARAHRADEYVTRDELAACAGFVRQLIGACVTGSAAASQGALPG

SEQ ID NO: 773 - protein, 129 aa, Methylobacterium sp.
MTQAGIELVRAERRRRWTRAEKERLVAASFEPGVSTSDVARRAGLHVSQLFRWRKLLCERVGAPTPALVPVVITPTSAAMTVEPGRAHNRGRRSGGVIEIDLGRGRRVRVGSDVDAAALRRVLDALEGR

SEQ ID NO: 774 - protein, 79 aa, Methylobacterium sp.
VLRAAHRHSARHADEVRSSVLCGCFFCLEVFAPDEIAGWIADEGTALCPRCGIDAVIGDLSGYPAGSAAFLRAMRDEWF

SEQ ID NO: 775 - protein, 109 aa, Methylobacterium sp.
MHRRDRDIDAAAYQADRYGWEPDDRDWDDDRDTRRPRRGVFGRFFSPTKLALLAVPAGLFLYGSFADCSARPAAGWLGLVGAGACARTEMLGNVLSIQDNLALLKRLID

SEQ ID NO: 776 - protein, 561 aa, Methylobacterium sp.
LLTPRWTPPGQPAGGAFTVSEIRLSRSALKTLARGVAASTVATFALAALPAQAANVFRFAFQGDLKSLDPYSLKESFTEGMQQAAYESLVTLDKNLKFAPGLAESWETPEPTRWRFHLRKNVKFHDGTPFTADDVIFSAQRVRAPGSNFTTNVPADAEFVKVDDFTVDMVLKKPNPIAIAQFPTWVIMSKAWSEKNGVVQPTPPSATSPSYATLHENGTGPFVITEHQPGVKTVFKKFDGYWGKVESNLDEAILTTIANPATRVAALLSGEVDWIDPVPLQDQQRVNASGTATVMAGPELRTIFLGMDQDRDELKDSSVKGKNPFKDIKVREAFYLAIDEDTIAKRVMRGQAVPSALMIAPALYDRGAEFKRPATDLKKAKELMAQAGYPDGFSLTMDCPNDRYVNDEAICQAVVSMLARINVKVNLNAQPKAKYFAKVLAPAYDTSFYLLGWTPSSLDSHNILYEIVGCRKPGDKSGRGSWNLAGYCDPKIDAIADKVEGETDKTKRDALIKEGFDVLNADWGYIPLHQQALAWGVSKKVHLTQRADNLLLLYWVSKDPQ

SEQ ID NO: 777 - protein, 326 aa, Methylobacterium sp.
VLAFLLRRVIQAAAVLAVVGLIAFAMFRFAGDPVNQIVGPDTTVAERAQIRTDLGLDDPVLVQFVRYAGNVVRGRFGISYQFRQPVSQLLAERMPATLELAFCATIFALVVGILMGVYCALRRESWLAGLFQAVSLIGISLPTFLIGILLIYLFSVTLGWLPSYGRGDTVRLGWWTTGFLTASGLKALILPSVTLGLFQMTLIMRLVRAEMLEVLRTDYVRFARARGLTTRAVHLRHALKNTLVPVITIAGLQLGSVIAFSIITETVFQWPGMGLLFVQAVQNVDIPIMSAYLLLVALIFVTINLVVDILYTVVDPRLRLPAGRTA

SEQ ID NO: 778 - protein, 672 aa, Methylobacterium sp.
MTAVGSFGINGRFLTQPMTGVQRYAMNVTRAMSAALAARGESAPLLSVPDAEDPRLAGTPLRTVGPAGGHAWEQFVLPRAWPGRLLNLCNTAPALKADQVVCIHDANVFNAPESYSASFRTFYRTLQPLLARRAARIATVSSFSAGQIANHLSVRASDIVVLPNGHEHVRAWDPRQAVRAPAALDRDADGLERPFVLALGSRARHKNLDLLLKLAPALDELGLDLVVAGGQATIYAAEDLRRGENVRHLGFVTDHDLAYLMERALCLAFPSLTEGFGLPALEAMARGCPVVSTDRASLPEICGSAALLAPPDRPERWLDQIRALAASPDLRSDLIGRGRDQAALFSWEASAQGYLDLMRAPKVRTAAQPSARSATPPSPPSIAVAIATLGRPEVVTGTLRRILDRQTLKPAAILISCVTPDDAGEAAAWPGVTVVTGRPGLATQRNAALAALPEAIDIVVFFDDDFVPEASWLAAAAQRFEDEPDIVGLTGDVVADGIKGPGLRFTEVDRMLAALGPVEPAAPIEAFSPYGCNMAFRRSAIGTLRFDERLVLYGWLEDRDFGAALAARGGRLVKCMEARGVHMGVKGGRISGDRLGYSQIVNPLYMLRKGTMTLSQVFGQITRNVLSNVTRFAAPEPFIDRRGRLRGNLRGAADVLLGRLEPERALKIRRKA

SEQ ID NO: 779 - protein, 216 aa, Methylobacterium sp.
MAIDPTLRDALSAVTPASLARALARAGVKACTPHGLSARGSGTVVGPAYTMRMIPARDDAAGDLAAAIDAVPEGAVVVIDAAASALALPFGAILAARLAQRGAVGLITDAALPEEIGLPAWCRPAAATGALALVGTQERVACGGAAIHPGDILVGDASGLVAVPASLAERVALEAVEQQRLDLWIQREVERGADLASLLPPDAAALARFEAETKPA

SEQ ID NO: 780 - protein, 159 aa, Methylobacterium sp.
VSAVVVIDPDAFLETERGRVWTPERNAEAWRLALAALRAALAADSVERLVVVCGLQGAGKSTWIARQRPPLGRVCFDAALPGRRHRAPILAIARACGVAAEAVWIRAPLAVALEGNRRRAADRQVPEESIRSVDRLFEPPSRAEGFAAVRIVDATFRAG

SEQ ID NO: 781 - protein, 420 aa, Methylobacterium sp.
VDLLSSDDRLFAFGRRAAWVLVPFGLAMVLLVYGTGPDPRRNWYGDPLGNDFVQVWVAGRSALEGRGADPYDLPVHLANLKAACGQACRFAWHYPPVFLLPAAAMALLDLQPAYLLWTALSLALFALAMRVAAGRRDAALVALAHPLVLCNLVYGQNGLFTASLLTLGAVLVDRRPWLAGLCFGLLAYKPHFAALAPLLLLVTGRRACLAACASTVLALCLASLALFGTAPWTGFLGTLGDTNRIILQNAAASLNLNASAFGAVRLLGGSMAAAWTAQGLVAVLALGLAFRAWSRPTDPTLRAAALLVSAPLLSPYLPVYDLAPLVPAVLLLALAAHRAGGLRPRERALLCAVPLFAIVREAAALTGFPLGLVLSMATFACIAARIVPRSVRPSRRRSGTGGTEAGVLTEPAAAGSGRAA

SEQ ID NO: 782 - protein, 221 aa, Methylobacterium sp.
VPVLTVLTRRAAQLRYDRRGGAAVEFAVILPILLAIWAGMTEVTHAIDEWRKLTQLGRTVADLTAQGDTQNPISTTVMNDILASATAVMRPFDTSKVKIVVSAMGTDAKDPSGPPLVCSSVANANGTARSPGPAPSLTVPDGYRMPGMRYVLAEVSISYTPMIGSALVKLAKGVSNTITFTSSAPWPTRGGQAYGTSTYTEVVLPDDKQSNCDGTKIVRKT

SEQ ID NO: 783 - protein, 222 aa, Methylobacterium sp.
MAITQTGGSSESIRAAVAAALSPERRRLVVTAAAREAQARAEAAYREEFGRLPKTEISVDGRAGGNLDQLNPDQGEVAFRFARATEALAWIYEQIVAHSPVLSGEYKGAHIMLADDQKADPANPPPAERYVFMNLTAYGKKIEEGESSQAPGGVYQAVAVLADRRFGNSVRVGFGYESPVLDYVAGEAGRGARARLRQQPTRVAAMKLERATRVPVITVTLA

SEQ ID NO: 784 - protein, 251 aa, Methylobacterium sp.
MSSAENRVAIVTGGSRGIGRAVALLLAERGYAVCLSYVSDAAAAQGVVDAIAAKGGRALAVKGDVGNEADVIALFKAADGLGRLAALVNNAGVVDVKSDVADMSVARLQRMMTTNVVGSFLCAREAVRRMSIKRGGAGGAIVNLSSVAARLGGPGQFVDYAASKGAIDSLTIGLSREVAADGIRVNAVAPGIIATEIHASGGEPDRVERLGPGVPMKRAGTAEEVAAPIVWLLSDEASYTTGAILDIGGGR

SEQ ID NO: 785 - protein, 289 aa, Methylobacterium sp.
MPEIRDCPAPDPHPEGPTRYAVPEGAVDTHAHVIGLPPDYPLVADRSYTPPAAPAERYLAMLDGTGMANGVLIQVSVHGTDNRLMVETLRAHRRRLCGVAVIPLGLPDAELAALKEAGIVGLRLNVLFGGGVGLDAVESYGALAREMGWHLQFLLDARELPPIAGRLSRLPVPLVFDHMGHMPTSAGLDHPGFEALLGLVADGNWVKLSGAFRDSVTGPPYADTIPFARALNDAAPERCLWGSDWPHVAAWDGPPRTRELLDLMADWVPDADRRRMVFVDNPRRLYGFG

SEQ ID NO: 786 - protein, 337 aa, Methylobacterium sp.
MEQAEAIRDPMPDWQSIRVFLALQRSGSFRSAATKLGLSVNSVRRRIDDLEALIGAPLLTRHVDGIRLTAEGHAILEAAGRMEAAAFSLVRTGEGAPFAETGEVRIAVTEGLGAFWLAPRLVEFQRANPRLTVDLRCAMESADVLRLEADVAIQLTRPTSPDLRIVKLGRIHMVPYAARSYEETYGLPGRPEDLERHRIVVQDGGQTVALEDYVRTVPGFPAKVPITLKVNVSSAYYWAIAKGAGIGLLPTYASAIGAQVVPVDNLGRFSVDIWLTYHPDAERITRVRRTIDWLRASFDPKRYPWFRDEFIHPRDLPGAVKGAALPDLFAGFIAMTP

SEQ ID NO: 787 - protein, 142 aa, Methylobacterium sp.
MEADAPGTAALSREQYAALADFRFRLRRFLAFSEAAAAREGLPPQQHQALLTLAGHVGRAPATVGLLAEQLLIAPHSAAELVSRMVEAGLLTKTRAVEDRRRSELSLTPRAEALLRTLTDAHLAELRDLAPALTEALGPVTR

SEQ ID NO: 788 - protein, 109 aa, Methylobacterium sp.
LEKILDGDAESILRKAVQLARDGDPVALRLCLDRLIPPRKDRPITFALPPIETTDDLPKATGAIVAAVATGELTPSEAAEISKTLDVHVRAIEATELHRRMAALEARGR

SEQ ID NO: 789 - protein, 224 aa, Methylobacterium sp.
MDALTLIRESLAPLAGKRVVDIGCGPGTLARRLVDAGARVTGIDPGAAALARARDAVPEARFEAATGEALPFPDASFDGAVMLNSLHHVPDPAAALAEAARVLAPGGLLVVVEPLAEGSFFDALRPIEDETAIRAAAQDAIAAALARGALTCRRDATIARRERFDTLDAFLARVSAVDPAREATIRDRRPVVEEAFLKAAAREADGQFGLVQPLRIHVLEPAAA

SEQ ID NO: 790 - protein, 176 aa, Methylobacterium sp.
MAGCLVLVVGPSGAGKDTLIRLARAALAGDPRYVFPRRLVTRPPSADEDNDEIDEADFAEGCAAGRFTLSWRAHGLGYALPETVGGRVADGHVVVCNVSRRVVARARAAGPRVSVVEITAPPEILARRIAARGRAQDGDLSARLAREGGVTADLTILNTGAADEAAARLVAHLRAC

SEQ ID NO: 791 - protein, 378 aa, Methylobacterium sp.
MDDFILENATLVLPDRVQRGWLAVSDGAIAEIGEGRPPARGLDLGGDHLIPGLIELHTDHLESHFAPRPKVRWHPLGAVLAYDAQITASGITTVFDSLRAGSDPDGSGLGSELEQLAGAIATARAADLFRAEHFTHLRCELPSLDVLDTVAAFTARYPVGLISLMDHTPGQRQFRDMEKYYTYATRGGRPMDEIRANTERKVRDGRALNAKNRPAIVQFAREMGIPLASHDDTTLADVDLAVGEGVRLAEFPTTLEAAEAAHRQGFTVMMGAPNLIRGGSHSGNVAALALAEAGHLDILSSDYVPASLLMAAFLLPEQAPGITLPAALATVTSNPARATGLTDRGALAPGLRADLVRVQRAEGVPVVREVWRAGRRVA

SEQ ID NO: 792 - protein, 533 aa, Methylobacterium sp.
MTFRRLIAAALAGTVALTGSASAESVLRIAMTASDIPTTTGMPNNGFEGMRFLGYPIFEGLVQWDLKSTTKLAGIIPALAERWEQDPNDKAVWTFHLRQGVKFHDGTPFNADAVIWNLDRYFKNDSPQFEPQGAGISRARAPLVGSYRKVDDSTVQITTTQVASYFPYMVVYLLFTSPASFEKAGRDWSKVAALPAAGTGPFRITRVAPREAVDLAKFDGYWDPNRMAKVDKVRLLPIPEANARVAALRAGQVDWIEVPAPDAIPSMKQAGFTITTGSYPHVWPYFFNMGAKDSPLKDVRVRQGLNYCIDRAGIVELLNGTAEPASGWLNDRDPNFGSPKNRYTFDAAKGKALLAEAGYTDKKPLSLKVMISSSGSGQMLPMPMNEYLQENLKQACNVDLTFNVVEWQVLLNAGRALPDAPTLQGAMALNVSSPSSDPAVMARYFAGDRFPPNGFNFPTWKDDPFDAALKALAETTDAKVIDAQTKVAHERLVDNPPWLFVVHDLNPRGMSKKVQGFVSPQSWFVDLTLVSVQ

SEQ ID NO: 793 - protein, 545 aa, Methylobacterium sp.
MSAAGAPRGGVAPCSRRVMNLAHFLRRAARRFPDAVGLAWGQRRWTWGELDARVDAMAAALAARGVTKGDRVLVQARNSNQLFESMFVCFRLGAVWVPANFRQTPAEIAYLARASGASTLICGAGFPEHAAAVREACPDLDRVVAIGDAAFGADYDALVADHLGAAAPVADVEHDDPCWFFFTSGTTGRPKAAVLTHGQMAFVITNHLCDLMPGTTEADASLVVAPLSHGAGIHQLAQVAAGTKTVLTAGERLDPEEVWALVEAWRVTNLFTVPTIVKLLTEHPAVSTHDHSSLRHVIYAGAPMYRADQQHALRVLGPVLVQYFGLGEVTGNITVLPPRLHAAEDGPDVKVGTCGFERTGMQVQIQDTQGRECPPGATGEICVCGPAVFAGYYDNPEANAAAFRDGWFRTGDLGHLDSEGFLFITGRASDMYISGGSNVYPREIEEKLLTHPAITEAAILGVPDTAWGEVGVAVCVARPGAAVQEGELIAWLSATVARYKLPRRVFFWEALPRSGYGKVTKRAIREGLEARGDLPLDGQARPQTR

SEQ ID NO: 794 - protein, 689 aa, Methylobacterium sp.
MNRHSTSASFLPIGATRPGGTGAWRGQPFSPETESQVSILTIARQNWRSILAFAAVGLVCAGIYVATAPAIFTARARVYIESRSSPVTARDTPNAGTPLEIAEVESQVEYIRSEKIALAAVHRLDESALKDLAAPTHPLVAKVREFVKAAKALPLRLIGAERPVQEHAPVSPELRQARTLRENVEASRIGAAYVIEVGYSADNPATAAAVANAVAGAYVSTELENRAQVWKVAGEWMLPRLKELQQRASQASREAQTYKAEHTIIDLGKRGLVGEQQVEELNTAVAAARSKTVDARAVRDQIRGLLDSDIADPGITEAFKDSVIIQLRRQYVDLVQRADDLKRRLGPDHEAVQAIQRDILAAKQSLRTELERLAVSLDHDYEVAKAREDSMTAAFDALISKTLIMSNARVKARELDRTAETYDQIYTNLLQRYIDAVNQQSYPQPSAHVITPATVPESPSAPRGSLIMLLGLLVGTGFGVSGAFARHWFDRTIRTPRQLTGHGLTCLAALPELRREPGFRAALALAQAHANQAQRPASIEAFRASAVRFMPQSVFVERLHSLKAHVLGSDRRGPVFAIGVTSVGAGAGKTLFASNLGQLLARARASSGRVLMIDADVRQGTLSRLSQATEQRGLLDVLAGRCGATEAVRPQPGEVRLLACGNRHPNDPHFSDLMTPEGVAAVLGDGRPA

SEQ ID NO: 795 - protein, 94 aa, Methylobacterium sp.
MKRRSARPFMVEVKQTRSARTTLTATEARPRPDKILWPELAQAALAPPAPAPAPQAAPAPRPERKVPDAPVRRVLPSLMPMFEVPAAPVLEANP

SEQ ID NO: 796 - protein, 388 aa, Methylobacterium sp.
MVSAPARAADPIKIGLTGPYTGGSSSMGVSMRDGAKLAAAEINKAGGVLGRPIQLIERDDEAKNEVGAQVAQELINKEKVVASVGFINTGVALAAQRFYQEAEIPVFNNVATGTIITNQFKEPDYDANYVFRNSAYDVLQAGLMVDEALAQGHKKIAVLADSTNYGQLGREDIEKYLATKNVKPVAVEKFNIKDVDMTAQLLKAQQAGAEVILAYGIGPELAQIANGMAKLGWKVPMITSWPSSMQSFIDIAGTNGNGVIMPQTFIEDQTLPKRKAFLENYYKTYGVTKIPTPVAGAQGYDSIYLLAAAIKQAGGTDGAKIRAALENLNEKVEGVVTTYDKPFTAKDHNAISRNMVVFGKVQDGKIVYAKDEDAKNAGVVRLKEKSSN

SEQ ID NO: 797 - protein, 290 aa, Methylobacterium sp.
MEILLQLIASGVAVGMIYAAIAFGYQLTFATSKTLNFGQGEALALGALFGLTLVPFVGYWLMIPLVLVFGFALGAVVERLGVRPAVKIKSEYGWIMATIALGIIFKNVAENVWGRDDLKFPSPLPETALQVGGVRVLPMELLIVAGALLMMLAVEIFNRKSIWGKAVVATSNDIDAAGLMGINTQKVITLSYSISAMTAAFAGVLVAPVTLTGATMGSVLALKAFAVAIIGGLESGLGVIVGGLILGVAETLTGFYISTGYKDVPGLILLLVVLSIRPVGLFGKAVIKKV

SEQ ID NO: 798 - protein, 406 aa, Methylobacterium sp.
MSRNAAAGALALLCLATASPSGAAEPGAAEPAAADGPFRPTQPAGYFFVGGRYATAAGKTTASGQMFVEYRVPERVTQPYPIVLVHGTAQTGTNFLGTPDGRPGWADRFAAQGFAVYVVDQVGRGRSGGDSDTYGPYARLPAEDLETVFTGQERSALYPQARLHTQWPGGAGIRGNAAFDQFYLSQVPYIASALRSEELVDPALIALLEKIGPAILLTHSQAGVFGWAVSDQRPDLVKAHVAVEPNGPTFYDIRFKGGADWYERVGEARARPYGITRVPLHFEPPVSGPADLTVVQTESAAAPDRIRCWLQAEPARRLPNLARVPAVIVTAEASFRATMDDCTAAFLTQAGAKPDRLALAEHGIRGNGHMMMLESNSDAVADAIAGWIQSRVQGRIQGQVEAPARP

SEQ ID NO: 799 - protein, 307 aa, Methylobacterium sp.
MAENTAIAWTTHTFSPWWGCTKVGPGCDNCYADALDRRWGGAHWGAGVPRRLVKDWSKPRKWNRDAALSGERPWVFCASMADVFDNEVDPLWRARLWDLVRECRNLRWQFVTKRIGNVRKMLPHDWNENFGHCGLLISVVNQEEANRDIPKLLATPAAWRGLSMEPLLGRVDLTHLETAGDGELNALTGLWATCPIVQAGRRIVMTTANLPPLDWVIVGGESGHNARALSPNWVRALRDQCAAHGVPFFFKQWGEFAPVHETRAGEPGIAGRLWVNFDPDTAVCRIGTKAAGRRLDGVEHDAMPRAA

SEQ ID NO: 800 - protein, 326 aa, Methylobacterium sp.
MTETILSVRDLTVAFDTRRGPLTAIDRVSFDIGRGEILGVVGESGAGKSVTGSAVIGLIDRPGRIAGGEIRLRGERIDNLSPEAMRRVRGKRIGMIFQDPLTSLDPLFRVGDQIVETLRTHTDLSAKAARSRAIDLLAEVGIPAPERRIDGYPHEFSGGMRQRVVIALALAAEPELIIADEPTTALDVSVQAQIITLLKRLCREHGTAVMLVTHDMGVIAEAADRVAVMYAGRVAEIGPVASVIAKPHHPYAVGLMGAIPTLSQEAERLSQIPGSMPRLTAIPKGCAFNPRCPKVFARCRVERPEPIPVDASRVACHLYDAAERAA

SEQ ID NO: 801 - protein, 326 aa, Methylobacterium sp.
VSAYVEVTDLRRQFDVSKPWLNRVIEREPRKFLTAVDRVGFAIEKGETFAIVGESGSGKSTVARMVVGLLPPTAGEVRITGVSMTDPRQAAARRRLRARIQMIFQDPYASMNPRWRVGKIIAEPIRAFDLIQGEGAIRARVGELLGLVGLHADDARKYPHEFSGGQRQRVAIARALASQAEFLVGDEPTSALDVSVQAQILNLMRDLQDRLGLTYLFISHNLAVVRHMATRVGVMYLGRLVEVASARDLFATPRHPYTRMLLDAVPDLAHVGRARVPVSGEIPNPIDPPPGCTFNPRCPLANDRCRAEVPALLDGVACHAVQEGRA

SEQ ID NO: 802 - protein, 135 aa, Methylobacterium sp.
MQTTSPSVELAAKILSAYVTRNSVPAGTLPDLLSEVHRSITALDQPAEPQVRRPTEAQIRASIRPDTLISFEDGKPYKALRRHLTMRGLTPEAYKAKWGLPVDYPLVSAVYSARRSTISRQIGEGQRLRMQQAAE

SEQ ID NO: 803 - protein, 466 aa, Methylobacterium sp.
MATILIVDDDRALRDGLAETVTDLGHTALPVASGSEALARLGEGPVAAVLLDLRMPGDLDGMATLERIRSLPEPPPVTVLTAFASPANTIEAMRLGAHDHLTKPIGRADLAAVLDAMLRDARSDPVGAAPPPDHPVLIGSSAGMRKVQKTIGLVADNASTILVQGETGTGKEEVARALHAFSRRRARPFVPVNCAAIPAEALESELFGHVRGARAGATADRAGAFHEAEGGTLFLDEIGDMPAAMQAKILRVIQDGVVTPLGGRPARVDVRLVAATHRDLPALVAAGGFRADLYYRLNVVPITLPPLRERLADIVPLAEHFLVPSGKRLSGGAASRLLAYEWPGNVRELRNVVERAAMLVRGGVIAAEAIDLPAARPDRRGEDGAADWLAGDLPGAVARLERTMIAAALREADGNRARAARRLGIQRQLLYAKIERYGLGAPGTDLSEETTDTVGNPDASAGTDTA

SEQ ID NO: 804 - protein, 146 aa, Methylobacterium sp.
MANPTPKPKQTTAIDHGVGSRIAFLRAANGLSQSALASALGVSFQQVQKYETGKNRVGAGRLQAIAERLGVPVSSFFEPEPEAATDSGPALLRVAGAVELLRAYNQIADDQMRRDVLSLVKSAARIGQTKSSDDAAPQAGGAPRKS

SEQ ID NO: 805 - protein, 179 aa, Methylobacterium sp.
VGNDNLPAISGETGRAAAEGGVARAREAYERFAEAGEMALNAFEASMAQSFEGWRAVMGSSRETAHQLTDSNVAGARRMREQWDAAGARLYNAFEDNAVHAMAAMREIGHRMLVASDTNVRASLDFAERVAKAADAREVAALNIAFLQEQARRLTDQMVDLHQTTGRLAREAAARTETP

SEQ ID NO: 806 - protein, 255 aa, Methylobacterium sp.
MAAPFDLAGRHVLVTGASSGLGRHFAGTLARAGARLSLGARRADALAETVDRVAAAGGEAHAVVMDVTDAASIERALDAAEASFGPVAVLVNNAGVTATKPALDLAESDWDAVLDTNLKGVWQVAQATGRRMVRHGAGGSIVNIASILGLRVTGGLAPYATSKAAVVQLTKSLALEWARYGIRVNALAPGYIKTELNDAFFESDAGRALIKRIPQRRLGEAAELDGPLLLLASEAGAYMTGSVLAVDGGHLVSGL

SEQ ID NO: 807 - protein, 430 aa, Methylobacterium sp.
VTRSSADLRFGLLGRPSLGRRSVRYGVFFATYFYQGLVAGFSLTALANHLAARGVPATEVGLHFALAGLPWTLQPLLWGPWVDRAGDTRMGRRRPFAVAALVGCHATLALLLVAGGDAVGALGLVFLVHSLFASLLDTACDRMIMDHVPAREFGRVSACTRAGFVAGTSLSAAVFGWTLASWGFAASARWLLAAAIVASLPMLLVREAPADPIWSLERRGPAPRRLPFRRFLRRTVIALRRPRALRLLALCFGLDAALGLFELPFSIDLLQRQGWEAASLSRLQAVLTLVSGTAGAVAVGFWSDRAGAASPLRALLLGSAATFVLAGILIGAGLVGAAAPAILALTSVLPGLLIVALMPALLAASRGRPGAATQFEVYMAAMNLGSVAGTAVAGWLAPVLPLQAVAALVAATFFAAFRMAGRGDLLGARR

SEQ ID NO: 808 - protein, 66 aa, Methylobacterium sp.
MTTEITRSHTVEIVPCVDDPRCFRWIIRSRGGAVVEHSPYAFVTQNGARISGECWMREHFADGQVA

SEQ ID NO: 809 - protein, 144 aa, Methylobacterium sp.
LLASACSDDGRERRRALGETPTFDDVMRVADAERGGRLFGQCAACHTISPGAGDRNGPELYDVLGKPVASNSRRYGYTGALRALGGVWTPERMDLWLAAPAKLAPGTSMTFRGLPDPLDRGDLIAYLRPRSPGDGDAAARPSRP

SEQ ID NO: 810 - protein, 545 aa, Methylobacterium sp.
VRPAAAYRAGQRALAAGFISALLLGHGPASARTFVFCSEGSPESFDPARATTTTTMNAAWQVYNTLVEFTPGTTTIRPALAESWTVSEDGRTYVFALRDGVRFHANARFTPTRALNADDVVFSFARQRRSEPDGAAQGFTYFHDLGLADLIEAVDAPDPRHVRFRLREADTTFLANIAQAFGAILSAEYAAALAAGNASDDLARAPIGTGPFVFEGYRPDQVLRYRAFPDYWRGGADGSEPGERPDGLVFAITPNAAVRLNKLRAGECHAMAFPATGDLDAIRAEPGLTLLALAELNVAYLALNTTRAPFGDVRVRRAVNLAIDRRAIVAGVYGDAGILAQGPLPPGIWAHDADLPDTPFDRGEALRLLAEAGLADGFDVDLWYPPVSRPYNPNGRRVADMIQADLAQVGIRARPVTRPWNAYRAALYGGEPTLMLYGWTSDNGDPDNFLNVLLGCKAAQTGGANLARWCDPAYDRLVEAARRTGDREARQALYRQAQAIARRAMPWVPLAHTKVHLALRNDVLGLTMDPLGRHLFETVRFRDPR

SEQ ID NO: 811 - protein, 156 aa, Methylobacterium sp.
MRLAVPALLAALVSGPACAQSFVPTERAAIDLVRDRRTAGFTTVARTLAYAERATGGAFRLGGYRVDYRPDVPFARVRICYRLGIDPPTCGLAYRVAVNPAHVEPADRYNGLTRDLEHGPQAFLRALAREADLQRQPDVLRKVEAALEPYNPYDWR

SEQ ID NO: 812 - protein, 125 aa, Methylobacterium sp.
MVRAHFTIRLGNASLPASAAQWVEDVEAARSTARTIVQGLMRQHGGDSRLMEAAMVITDDDGAVLLEMSFFDTLYLPVEPVPDADRRRPRAPRRAAPLGLTAALGPVRRLAGALGMRAQQPLSGR

SEQ ID NO: 813 - protein, 130 aa, Methylobacterium sp.
MGLLDGAKTLIGDVAAAADRALEETGSGKLALSLAKFYPGGLPAFLDRLRETGHGEAVASWLGSGARQTVPESAVAACLPEGVTERLAYDLGVPEARVPTVLAEFLPAAVADQSENGTLKPQPNFSTQVR

SEQ ID NO: 814 - protein, 372 aa, Methylobacterium sp.
MYVAVKGGEAAIDNAHRLLAEARRGDPAVPELSVAQIRAQMALLVDRVMTEGSLYDPDLAALALKQARGDVVEAVFLVRAYRTTLPRFGASVPVDTGAMAVERRISATFKDLPGGQVLGPTFDYTHRLVDFALAAETAVEAGMEPAAEAEPRADAGACPRVTDLLARDGLIEPSPPDDGAPAGDLTREPVDYPADRALRLQALARGDEGFVLGLAYSTQRGYGRTHPFVGEIRVGEVAVECVPEELGFAVPLGRVRLTECQMVNQFKGSGATPPQFTRGYGLSFGQSERKAMAMALVDRALRAEELGEPVASPAQDQEFVLAHCDSLQATGFVEHLKLPHYVDFQAELELVRRLRAEFEQKSDAVEMQEAAE

SEQ ID NO: 815 - protein, 195 aa, Methylobacterium sp.
MLAPGFADPVHDAQDTFRAVMDALARPGRVRPLAPGLMPPAPLTPELAAVALTLTDADTPVWLDPALAAAPEVAEYLRFHTGAPLTGDPAAAAFALVSDPARCPPLARFAAGTPAYPDTATTLVLALDALAEGEGLHLSGPGIRGTARIAPAPLPDGFAAQLAENRVGFPLGVDLILTAPGRVAGLPRSTTVTEA

SEQ ID NO: 816 - protein, 136 aa, Methylobacterium sp.
MALCAEASRADLEAAVSVLDAPAAADLRPPETGLVMASGRIGGDGRPFNFGEVSVTRAAIRLADGPAGFAYHLGRDRAKARLAAILDALWQDPVRRARVEAALEPAARRLAASRDRAARRTAATRVDFLTLARGED

SEQ ID NO: 817 - protein, 247 aa, Methylobacterium sp.
MDAQEQAAGLVRGEGLTAWRQIADALTAEIAAGRYVPGQQLPAEAALAARFAVNRHTVRRALAALAEGGLVRASQGRGTFVEEAPLAYPIGPRTRFSEIVAGAGREAWGDLVAATTVPAGTEQAASLALAPGAPILELLTVHRADGAPLSTALTWLPLPRFAGFAEAYAARGSITRAFATCGVHDYTRLSTRIRARPADSAEAQRLDIAPGRVVLVVSSVNIDPAGVPIQANRTLFAADRVELVIGG

SEQ ID NO: 818 - protein, 288 aa, Methylobacterium sp.
MSARPEALRAAARADLARLRARYPAQFRTDWLGRARLAALLAVLVGLAALGYWRLDFSVARILHGLGRLGTFAVLMLPPSPEGQFWTFLHALGETLGIAFLGTLAAAILAFPVAFLAARNVVPNPFARFAVRRGLDVMRSVDVLIWALIWINVVGLGPFAGALAIACSDFGALGKLFSEAIETCDKRAGEGVVASGGSALHRIRFGLIPGVLPVLASQVLYFFESNTRSATIIGIVGAGGIGQYLTELIRVLELQQVAFLVLMILVTVAAIDWVSTRLRRAIIGPAAR

SEQ ID NO: 819 - protein, 293 aa, Methylobacterium sp.
LRGLTPLSPERAAALSGLYAAATGEARRRTLAGFALVAALAVVAGLIAEVRPLVFAENIGKFTAYIQQILPPISLEHPLEDVRAWYWGLPKWLGLLGETLLMAYLGTLLGGLAGFALSFVAAANLVRSRVLRVGAKRLLELCRTVPEVVFALIFVIAFGLGPMVGVLAIAIHTTGALGKLFSEVVENIDMRPVEGLSASGATWVQTVRFAVLPQVLSNFASYALLRFEINVRGAGVMGFVGAGGIGQEFLVAIRNFYYADVSAILVLIILTVFCIDLVTERVRHRLIGAEHAR

SEQ ID NO: 820 - protein, 311 aa, Methylobacterium sp.
MITRRTLAAAAAATALALLGLPAAAQDWKAQFPELTLGVIPAENASGTADRWAPLTAYLTKTLGVPVKLRVASDYAAVIEGQRAGNIQIAWYGPASFARAVMTGVKIEPIVNQKHETGASGYYSVVYVLASSPYKTVEDLKGKNLALVDPNSTSGNQAPRFFLKRAGYDVEKFFGKTFYAGSHENAVLALTQGTADAAANLWNSETDTMVTRMAAKGMLKKPDGTPMQQSDFRVVFKSDFLPEGPFAMLASLPDDLKAKIRDAFVALPKADKAAFDRLSDGKDQDLTPVTLKDYQPIIDMLRFNDEQRRKS

SEQ ID NO: 821 - protein, 228 aa, Methylobacterium sp.
VSRRYALYWLPAPDSRLEAFGRAILGTDNVSGLPVPYPEGLGDLAPVTAGARVYGFHATLKAPLRLAPGTGEADLVAAARALAAAHPPVAVGPLRVAALGPFLALVPEAPPPELGLLAAECVAALDPFRAPLTEAERAKRRPERLDPRGRALLDRWGYPYVFEAFRFHMTLTDALPEAERDLWHRRLSAAYAAAGPEPLRIDAVSLLTQDGSEPFRLLARLPFGEARG

SEQ ID NO: 822 - protein, 159 aa, Methylobacterium sp.
MTPSDHAAMRRVADVCGDEADILALSVARFVAAGYMTSDVACWNAAFDGAEQLLGPTEGCRFVACVVAIIRALRAERDGDWSFMPASCCRVTGHECALVKLINRGRQRLWADLEAAAAEITGQDAAPRLVAAVRAAVGPLDAAAERLAPASCPAGTVLH

SEQ ID NO: 823 - protein, 105 aa, Methylobacterium sp.
MNDDTEYDLDEVNATRDAEAEAKTRAENRAERAERAERMAREGAQAMAEHHAAIKAMDERTVRLRSLRLAKEAADAQAKAAEKEAKAAAKGSAKKAAPKKTTAKG

SEQ ID NO: 824 - protein, 261 aa, Methylobacterium sp.
MNPAARPARSTPAPSAVTPIRPAERPHQPFKIVSWNLLRRTGAAVDDVAALVAQEKPDLLLMQEATRAIGFLLDRIGGHYAWAPLPGRIHGLAMWSPKPWAAPPRVIALPSGALVHRVCQILDLGEFGVANVHLSHGQMLNRRQLRRIVSELPPRAAVLGDYNIVGPALIPGFRDVGPRQSTHAMVEVLPLRLDRCLARGLVCHAHAVLPRGRSDHRPIVVHLGPAPEAHAPARFKGMAAAVARLRRADGSAGRARRDPPG

SEQ ID NO: 825 - protein, 106 aa, Methylobacterium sp.
MSTIDLLGLTLSFYGTMPPPRPPRPNRNGATWAAAVIFGSVCLATIGPMITIWSFHRPYAEAKARCIASGGRVLYGALDGSGPYRCERPAAAAAAAPIAHPAKPAD

SEQ ID NO: 826 - protein, 156 aa, Methylobacterium sp.
MYGVHHPAASIPLPARDADRRARPGAQGAASAERRGAPAVPVAAICPHRVSRWAWGEGLRAGQAVALLVQDLGQVEAMRLGLTRLGLRVVCLDCAGRDAALAGSLSQSGAVLVVVDTALADAYAGVMGRLTAYPAVWWNGPGADFASLDLALAEHA

SEQ ID NO: 827 - protein, 89 aa, Methylobacterium sp.
MTRTCLAALLALATVAPASAQVEARPVAPAPGAPGVVSQQIDATGNEAAVSYSPTGRPADTISNNSAAAGNANQPSRVAPQGGGGGGSR

SEQ ID NO: 828 - protein, 307 aa, Methylobacterium sp.
MTESVAIVGAGLIGRAWAMIFARAGWDVRLFDPAAGVAEAAIPLCAEGLRTLAANDLCADPAGAAGRIRAAGTLAAALDGVAFVQENGPERLEVKRSLFADLDAAAPREAVIASSSSAIRCSLFTEDLPGRARCLVGHPVNPPHLIPLVEISGAPWTAPEALVRARQVYEQIGQVPITVLKEIEGFILNRLQGALLAEAFRLASEGYVTPQDLDKTVADGLGLRWSFMGPFETIELNAPGGIADYCARYTGFYKNLAADPAPPSVYEAPATEAILANWQPPTDLPARMNRRDARLAALRAHKASRKD

SEQ ID NO: 829 - protein, 273 aa, Methylobacterium sp.
MSRPLDRRSDDRIEATGVEGRRSAIVASVRQRGFVTIEALAAQFGVTVQTIRRDLNELSAEGRLERYRGGGGLPSSVENIDYADRRVTLLPEKSRIGRLAASRIPSHCSVFINIGTTPEAVARELTRHDDLSIITNNLNVAISLAETTEFRIVVAGGTVRNRDGAVLGQLTCDTLSQFRVDVAVIGISGIDGDGALLDYDYEEVRATQTILAHARKTFLVADHTKFTRRPMVQVGRLEQVDTFFTDRAPPAEIVALMERQGVALAVADSADEP

SEQ ID NO: 830 - protein, 449 aa, Methylobacterium sp.
MLNDSRHAARNTPTVTAMKVVPVAGHDSMLLNLSGAHGPYFTRNLVILTDSTGATGLGEVPGGEGIRKTLEDARDLVVGQPLGAWNAVLNAMRTRFADRDVGGRGLQTFDLRITIHAVTAVESAFLDLLGQYLDVPVAALLGEGQQRDAVEMLGYLFYVGDRTRTDLDYRAPTARDGWFRLRDEEALTPEAVARLAEAAYDQYGFNDFKLKGGVLRGEDEIAAVTAIHERFPKARVTLDPNGAWSLAEAIRLCKGQGHVLAYAEDPCGAEGGFSGREIMAEFRRATGLPTATNMIATDWRQMNHAIQLGAVDIPLADPHFWTLAGSVRVAQLCRDHGLTWGSHSNNHFDVSLAMFTHVAAAAPGNVTAIDTHWIWQDGERLTKEPLAIRGGLVRVPERPGLGIELDMSAVEEAHALYRDHGLGARDDAAAMQFLIPGWTFDNRKPCLVR

SEQ ID NO: 831 - protein, 164 aa, Methylobacterium sp.
METGGTATSHVPDDLKAEAHRGDPFAAAVRATRMPMIITDPAQHDNPIVFVNDAFLKLTGYTRMEVVGRNCRFLQGPDTEAAAVDSLRAAIRREEDIRVDLLNYRRDGSTFQNALYVGPVRDEAGRVVYFFASQLDVSEHYALTAEIERLKAALAEAEAKLAAR

SEQ ID NO: 832 - protein, 66 aa, Methylobacterium sp.
MLDHHRDAAVQAERRLERSVAAALRVIAAAHDERQAPPVSAARRRLSEVYGATRLARRLEQERRTA

SEQ ID NO: 833 - protein, 81 aa, Methylobacterium sp.
MPRRVYYRISDRPDGRFDAVVTIEPDTVVRRDGFDSLAELEEWIDGLRALMAALGAPVSQADAAGAPAETAGAPGRLRTAR

SEQ ID NO: 834 - protein, 35 aa, Methylobacterium sp.
MSPEMRESRAALILLAASVGAVLIFGAFTLLSQLG

SEQ ID NO: 835 - protein, 100 aa, Methylobacterium sp.
MERLFIILAILVFAVAIVAVAAMAARGRREPLRMGSELDIEDEDLVLGSVGPRKSPIDRSAQVLDPRVLDLDAIELEPIRALDRTQRDAALRGDPPGAGR

SEQ ID NO: 836 - protein, 387 aa, Methylobacterium sp.
MVASIALPRLMRVGAGASRLLPEVLGQLGLSRPFVVTDPYLAGSGRTDTLLERLTKAGAQATIFSETVPDPTVASVEAALAALQAGDFDCVVGFGGGSPMDTAKAVAVLARHGGHMRDYKAPRQQDEPGLPIVAIPTTAGTGSEATRFTIVTDEASDEKMLCIGLAYLPVAALVDYELTLTKPKRLTADTGIDALTHAIEAYVSRKSNLFSDGLALQAMRLIAPNLRRVWTDPGDRAAREAMMLGATQAGIAFSNASVALVHGMSRPIGAHFHVAHGLSNAMLLPAVTAFSAPAAIDRYAACARAMKIAGPDTDDRSAVSALVTELEALNDDLDVPGPREYGIDPARWEALLPTMAAQALASGSPANNPVEPSTDEIVALYRRVWAG

SEQ ID NO: 837 - protein, 108 aa, Methylobacterium sp.
MRAASRALLALALALPAGSAWAQVQQNDPNAANASFALQGQIRSLNQQRVSDFNTLNQTFQRNVQAESFGPYLPYRGVRGDVYRGRHIGRNGIVRRGGGLNTSVCTGC

SEQ ID NO: 838 - protein, 242 aa, Methylobacterium sp.
MGAHWIENAARHWRHGRIVGHRFAERRPGIRAALRAAAPGSVLLAGNSHAELVGAPDLGGRPCINVAVGGSTAADCGRQLAALCVPVRCAAAVLIIGTNDIQRWRHPERARVVDRFEADVRDILRRLEAWAAQVFVAAIPPIGAGATGRDPAAVAVFSDRLAALCAAGGRTFFDPFAPWRSGTGGLAGPGLHRDGVHLADYAPLAAALASAVVLDALPLAPVRRPVPAAPLRILRAAWIGRP

SEQ ID NO: 839 - protein, 328 aa, Methylobacterium sp.
MKADRPDGARLRRVLFLGATGTIGRATVRALVSRGHEVVCLVRRPAETAIPAGATARIVDLTDTVSLARDGVRGERFDALVSCLASRTGLPDDAWAIDYGAQVEALHAGRTAGVTHVVLLSAICVQKPILAFQHAKRAFEAELIASGLDYTIVRPTAFFKSLSGQIDRVKRGKPFLVFGDGTLTACKPISDDDLGRYLADCLDDGDRRNRVLPIGGPGEAITPRAQGERLFALLGREPRFTHIPVVLLDVIVAVLATMGRWVPALAAKAELARIGRYYATESMLVLDPATGRYDAQATPSTGSETLFDYYARVVRGEAVAERGDHAVF

SEQ ID NO: 840 - protein, 63 aa, Methylobacterium sp.
MSSTTDKIKGVANEALGKAKQGIGDVTGNDKLKAEGAAQELKGKAQSTVGDAKSAVKSATDKL

SEQ ID NO: 841 - protein, 85 aa, Methylobacterium sp.
VQTYTLAIADGVLFACLPDEADISAAITDATATNYGFGLSLDIVRGATLTDAARPEDEVVWQEGPDSELLDAQGRRYRYAVRRPC

SEQ ID NO: 842 - protein, 355 aa, Methylobacterium sp.
MQDPVSAAGAPLVTIAMPALNEAAHIADAIASVLPDRDAIACELLVLDGGSRDDTCAIVAALSARDPRIRLVHNERRIQAAAINLAARLAHPASAYLVRADCHAVYPEGFVQNLVGTMRLRQAVSVVVPLRTVGVTPLQRAIAAAQNSRLGNGGSAHRQGGISGYVAHGHHAAFDRREFLRVGGYDETFTHNEDAELDRRLCAAGGRIYLAAELAITYFPRACLRSLARQYLHYGRGCARTLEKHASLPRARQILPALVLLYAVAALPLAALMPALLIPLLLYAGGCVLSGLALALKAREPVLVMSGPAAVTMHLSWAAGFLSYPGYRRTLLRAALRKKRRLLGLPPGSDAARVN

SEQ ID NO: 843 - protein, 72 aa, Methylobacterium sp.
AADLRGLGALGRFRATCEDLGTFCFADACGGDQIAAAEGCRARCPSASIVEVVPAACPLPDGRSVPILRRRG

SEQ ID NO: 844 - protein, 112 aa, Methylobacterium sp.
MKHIDAIIAWTPVRWAELKPETAGQVVVLPAPDAAGEAKRYMMRAGASSSALATLSEEARVARLFIDFQTLVVRDGIDPQVAHRAFLAIDEYRFRIAPDTEGAEFEDPPEED

SEQ ID NO: 845 - protein, 39 aa, Methylobacterium sp.
MLLLAFEVLVAGFTQAMIQPVRQPGITIEMSVTPHHVVT

SEQ ID NO: 846 - protein, 235 aa, Methylobacterium sp.
MTALLTFQDVAKSFTLHLRGGVVLPVVGGVSLSVEPGECVVLGGPSGAGKSSLLKMAYGNYRCDGGAILVRDGDTVVDVVRADPRAVLALRARVIAYVSQFLRVIPRVSALDVVEAAGREGGLSEAAARGRAETLLARLNLPERLWGLPPATFSGGEQQRVNIARGLIADRPLLLLDEPTASLDAENRAVVAELVREKLRAGAGVLGIFHDSEMRDAVATRVVDVTRFAPRARAA

SEQ ID NO: 847 - protein, 257 aa, Methylobacterium sp.
MSETLLQVRGLTKRYGARLACADVSFDLVPGEVLAIVGESGSGKSTLLSLIATELAPDSGTVAYRNRDGALRDLATLSEAGRRALMRTEWGFVRQDAAQGLRMAVSAGGNVGERLMGLGDRHYGRIRAQALDWLGRVEIAADRIDDPPTRFSGGMRQRLQIARNLVTGPRLVLMDEPTSGLDVSVQARLLDLIRRLSAELGLAVIIVTHDLAVARLLSHRIMVMRAGRVIETGLTDRVLDDPEHAYTQLLVASVLAA

SEQ ID NO: 848 - protein, 269 aa, Methylobacterium sp.
MIRRAILKAIAVPGYQVPFASREMPMPYGWGTGGVQVTAAILGRSDVLKVIDQGADDTTNAVSIRRFFAKTSGVATTTRTAEATVIQTRHRIPETPLTEGQTLVYQVPIPEPLRFLEPRETETRQLHALAEYGAMHVKLYEDISRHGHIATTYAYPVEVAGRYVMDPSPTPKFDNPKMDDCPALQLFGAGRERRIYAVPPYTRVRSLDFEDHPFRIQAFEHPCALCGAEGVYLDEVLLDDAGRRMFVCSDTDHCEGRRADGHVGTGDAL

SEQ ID NO: 849 - protein, 401 aa, Methylobacterium sp.
VDFTISPRVEDYRARIAAFVDAHILPLEADPAAYDGHGNISLAELARLRGLARAEGLWCLQLRPETGGAGLDKVGMAVCYEAMNRSIFGPVVFNSAAPDDGNMMVLEKVATPDQKARWLAPIVDGRVRSAFAMTEPHPGGGSDPGMIQTRAERRGDGYVVTGRKWYITGAEEAEHFILMARTSDDARKGLTALLFHRDQPGWRILRRIPIMGPEEHGGHCELLFEGLEIPAENVLMNEGDGLKLTQIRLGPARLTHCMRWLGLSKRCVEIARAYAAERHGFGIRLADRESIQLMLGDLAMRIEIGRLLVMKAAWALDQGSFARKEVSMAKVHVANLLHAAADTAIQINGARGYSTDTPLEWIYRYARQARLVDGADEVHKMVLNRNLEAEGDAFWSWGVGA

SEQ ID NO: 850 - protein, 94 aa, Methylobacterium sp.
MSKRFYFDVENGLETIWDEEGVRADSLEQALLDARSVIKEMAEDLADDVLSGELMLVVRDEAGSLVAHLPIEKSQHRFSSSKFENMQKLIRPHR

SEQ ID NO: 851 - protein, 73 aa, Methylobacterium sp.
VSERFYFDLESGEETIRDEDGVEVRNLAEAMAEARSVIAEMADEVCAADPDRSWSLVVRDAAGYARHRLPIRR

SEQ ID NO: 852 - protein, 123 aa, Methylobacterium sp.
MTFGVRHRRPAGARGWWALAARALALVLALTVAAPGVGLAADLAFHAGGHHDRGQGPALDAPAAPATVDPGLSEHLHCGCHQAARLEAAEIAPPAAPGRALPGALAQGRPSVSPDRLPRPPRA

SEQ ID NO: 853 - protein, 132 aa, Methylobacterium sp.
MRRLVLAAFAAAALAGPALAANEAPQTVAPKFETVPQDAVLSYNLIGLNVTDAQNNTVGEIKDLVIDHGKLSGYIVSVGGFLGLGERYVAVSPSSIALGYDADAKKWKAIIGASKDQLKAAPEFKYEGKFKR

SEQ ID NO: 854 - protein, 45 aa, Methylobacterium sp.
MNDIAQRAEPAAATPDLWQSIPLECILSAVAVLLAAGLKLAGVMS

SEQ ID NO: 855 - protein, 261 aa, Methylobacterium sp.
MRIRAALLLLLLPAAVHAETKPMAPDPTVLHDLAPTGTLRAAINLGNPVLAQGGADSPAGVSVDLARALAARLGVPVAFVTFPGAGAVSGSAASGTWDICFLAIDPKRAEGIAFTAPYVLIAGSYLVPAASPIRSPEAVDRDGVRVSVGRGSAYDLFLSRALQHATLVRAPTSAEAVTAFARDGLDVAAGVHQPLAAYAAAHPEVRLLPGHFMEIPQAMGLPVGHPAGAAYLADFVARAKRDGLVRRGLEASGQDPDLAAP

SEQ ID NO: 856 - protein, 276 aa, Methylobacterium sp.
MDQFDAFRAMSEFWTRAGAGFFTPGSGQSAPGFGWPTFPGSDLADLAAAQAKLTEAWTAASALSQTLTRSLQGGPGAPDPTAGAVLARIFDPQAWLGGSAEFDAALTRMAEGPQLADLWQTERRYAALFTAWASLRRAQSEHQAVMLQAWTRAAGTFAQEANTRAEKGESFASARDMMSRWIETANAVLLEVQRSDAFLASQRAVLRASTDLRLAQQDVAAFLSEFYGQPTRAELDDVHKSLTELRREVRALRRERRQAGKTARAGGSRVGEEAHG

SEQ ID NO: 857 - protein, 85 aa, Methylobacterium sp.
MQPAIQQVIRALAEDGRAGAINIAEHAVDSYLADAPSEGDRALSRDILVRDLASLRGVAPHLAAFIGRVEAYVASLAQPSLSRAA

SEQ ID NO: 858 - protein, 63 aa, Methylobacterium sp.
VQTALGPRAQSNFNSSLFNDVTLLKRIEAFEAKLGEPEKPKTADYTGNMFSRIANRRAAAGAK

SEQ ID NO: 859 - protein, 71 aa, Methylobacterium sp.
MSYSILVRDLTRETGGTPKLLAYDIRDRSAAETLVSVIATSYQDHGFNPATRVHWFRHADGLREIFTWPRS

SEQ ID NO: 860 - protein, 336 aa, Methylobacterium sp.
MQYRTLGRSGLKVSPICLGTMMFGGPTDEATAGRVVASAREAGINFIDTANVYTEGRSEEITGRAIKAERDAWVLATKVANPTGPGINDRGLSRVHVMKAAEDSLRRLGTDFIDIYYLHKEDHDTPLAETVRAIADLVRAGKIRHFGVSNHRSWRVAEICRLCDEAGIDRPVVSQPYYNAFNRMPETEHLPACAHFGLGVVPYSPLARGVLTGKYDPDAPPPAESRAGRQDARMMQTEWRPESLRIARTLREHAEARGITAGQFATAWVLNNRLVTGVIAGPRTEAQWQEYLGALDYAFTPEDEALVDGFVAAGHPTTPGYNDPAYPLEGRVPRSG

SEQ ID NO: 861 - protein, 294 aa, Methylobacterium sp.
VAGIGRGRSPRLPDGVTYAAIDLLDEAALGGFVARFRPTAILHLAGLASVADSASGPGQTWRVNVNGLMNLVAAVEAVPGCTFFFVSSGEVYGSAFLAGHALSEAVEPLPRNTYARSKWVGEQLLRDLLPRIGVKLVVLRPFNHIGPGQDERFVVASFAGQIARIEAGLVPPCLEVGNLSSYRDFLDVADVANAYADLIGRADSLADGSVFNISSGQPRTIANVLEDLRARARVPFEIRIAPERVRPTEIPLAAGDAGRLHAATGWQPRVSWDAALTRVLDDARARLADARETR

SEQ ID NO: 862 - protein, 360 aa, Methylobacterium sp.
VTRAGYFYIGGRYQKLGDKTVMVGQMFVQSRTPARVTQPYPVVMVHGLAQTGVNYLASADGRPGWVQRFVEKGYQVYVVDQVGRGRSGTNPEVYGPYDRLGTRSLERTHTAPEVYDLYPQAKLHTRWPGGAGVQGNAAFDQFFASQVPFLANSQQTEEWVDPALVALLDRIGPAILLTHGQAALFGWAASDARPDLVKAHVAVEPNGPPFFDVQFRGGKEFWEKTGDGRARAYGLTRMPLTFDPPVRAPEDLTVAQAAKGSDSKSDRAADGRIRCWLQGEPVRSLPNLAKVPAVVVTAEASFHATYDDCTVAFLTQAGARPDVVRLADRGLHGNGHMMMLETNSDAVADVLAGWLADRVK

SEQ ID NO: 863 - protein, 395 aa, Methylobacterium sp.
ARAAPTPAFAASATPRGRRVAFFGHDRAEPTVRKRVDAIRDAGWSVIVYAFERDRPGAVPAEAPVADDIVPLGLTVDRNYARRLPRLAVGIARALRRRRDLRAADVIYVRNLDMALVAWTAARLAGSRARLVYEVLDIQRLMVRPDAPGRIARAVERWILGRSDLLVVSAPDFIDRYFRPVQGFAGAWHLLENKVMGHRLGEVTTRLDRTRTAEPPWVIGWFGTLRCRRSLTILAAIADALGDSVRIVLAGRLSEEDIAPRTLADTLDGRPNMSFRGPYANPRDLPEIYSGIHFSWAVDYLDDGLNSDWLLPNRLYEGGLCGALTLARAATATGRYAVSEGLGWAFPEPLADSVTAFLRTLTPEAYAERHAGLLGRDLSTFVDVGGMRDLLVRLD

SEQ ID NO: 864 - protein, 570 aa, Methylobacterium sp.
MDWSTACPDWAERIVQRRSLVPFPPLFPGEAEAALAVFKSLRIVDLPGKPTFGEASEPWVFDFVRAIFGAYDAAAARRLIREFFLLISKKNGKSTIAAAIMLTALIRNWRSSAELLILAPTLEIAKNSYGPAADMVREDEELDALLHIQDNFRQITHRITRATLKVVAADTDSVGGKKAAFVLVDELWIFGKRTHADAMLREATGGLVSRPEGFVIYLSTQSDEPPAGVFKDKLDYFRDVRDGKVQDRKSLGVLYEFPPDMVEREAYLDPAWWFVTNPNIDKSVSAEWLQDKLTEAQRGDGSALRTHLAKHLNVEIGMTLRANRWPGAEFWIPRAAAASTLTFDTLLERSEVVTVGLDGGGLDDLYGLCVLGRERRADREADVLKQRWFAWAHAYCHRSVLKRRPNIASKLLDFAKAGELTIVDDDLGDIEDIIAKIEAIKLAGILGNVDVDPAGLGEMVSALGTIGVTQEADLLIAVPQGYGLMNAIKTTERKLARGTLIHSGAALMNWAVSNLKIEPTATAIRATKQNAGDAKIDPVMALFDAVVGMSQNPEPVRTRSVYEERGLRVA

SEQ ID NO: 865 - protein, 113 aa, Methylobacterium sp.
MKRPLTTNFSAPPPERAHPPEPAPAAATWRDVAPFAAALIATLEAIEAGQKAGPAMRAHRSAMRRQGEAAAALGGSEALEAVLNQVADADAARAERRLALVREAWAGLPGGGA

SEQ ID NO: 866 - protein, 487 aa, Methylobacterium sp.
VTAYSLRARLLALWVLLVASAAATAYLMLGVYDQSTGVQVAQADLAVGRACRDIIDRYAALVRARGKGVGEADLVGTVSAALARFPGLEGGIWSAARGSVAYAYPTYEGSGPKTDFPAAERDVIAALNAQALRVDHAASERRPSRTQVLMLQACPLHGPEAGLTAWSMTRAHVNDGPTYTRFLAGLGFLAATVLGSAAFLSWFLYGFSGRIARLEAALAAPRPDGQDLPHLDRTGERELDRLVDALNAAGGRLREAQARIVATERLAAVGRLAASIAHEIRNPIAAMRLKAENALVSGDPNRAAVALETVLGQIARVDTLLRDLLNLTQARPLSRVPTPVAPLLAECAGLHEDLARARAVRIAVEADGLPAADHPHLDRAQVARAVDNLLLNALQHAPPGGRVRLGAERVTVDGALRLRLSVADTGTGVDPAIRASLFEPFVTGRPDGTGLGLAIVREIAVAHRGEARLVEGAPETTFVLDLPWQPS

SEQ ID NO: 867 - protein, 313 aa, Methylobacterium sp.
MAEAIALVGCKGPDQEAEYLRILSAAMPEERLIPFRSMDDAARAAARVAVVANPDPAEVAALPGLVWVQSLWAGVEKLVGAFDRPLPIVRLVDREMARTMAEAVLAWTYYLQRDMPAYARQQRDRVWRPHAYRKPSDTTVGLLGLGALGTAAAERLTGAGFRVVGWSRSPKAVPGLDTVHGADGLPAMLGRCDILVCLVPLTPETRGLVNAERLAALKPGAALINFARGPIVVTEDLIAALDKGHLAHAVLDVFAVEPLPAESPLWSHPGVTVLPHVSGPTDMDSAAATVAANLRAYRRTGQVPDGVDAARGY

SEQ ID NO: 868 - protein, 348 aa, Methylobacterium sp.
MTAMLIYGATGYTGQLLAAHAVGQGLRPILAGRDPDKLRPLAARLNLEMRAARLDDAAGLQSALAGVAAVIHAAGPFSRTARPMAEACLAAGAHYVDITGEIAVLEALAARDAAAKAAGIVLLPAAGFDVVPSDCLAAHVAGRVPGATHLRISIGGFGGFSRGTARTMVEGIAWGTRVRRNGRIVELPSPPRATADFGTGPRRTVGLGWGDVSSAWYSTGVPNIDVYFEAFPAMAAAAGLPAGIRRIIAGGTAQRLINRGIDRLPEGPSAAAREKARSTFLAEAWDGAGRRAASRMETPEGYTLTAATALEVARRLASGAVPAGFQTPVTAFGPDFILEFAGVVRTDL

SEQ ID NO: 869 - protein, 975 aa, Methylobacterium sp.
MSHAPAGSPSETGQATDAGPRRSAGRLDEAGVAKQKLVEAIESSSEGFALFDPDDRLVLCNGHFQDFHPGLSAIIVPGVTFEAIANAVAETCVVRPDGMSIQAWVAERVAHYRAPRGPLLQQRVDGRWVQVNERKTNDGGVVAVYTDVTEIKRAEQVLQATQGRLTYLLTASPSMICSFEVGGRNAPTFISENVRDLLGYEPGDYLAGPEFWLERLHPDDRDRVLAEFPHLLADGHNVIEYRFLHANGTYRWVRDEQRLLRDATGQPVEVVESWSDITERKEAELALQKQTAFVELLQAAAAAANEAPTVEDALRFCLERVAQHAGWPIGHAHILARDGTRTLLPTGIWHCDPGADVARFQAATAATSLAAGSGLAGRVLVSGAPEWSVGDPSLAADPRAPAAVEHGIRAGFGFPVTVGRDVVAVLEFFARDASPPDASLLRVMSNIGAQLGRVIERKQAEESLRQAKEAAEEASRAKSSFLANMSHELRTPLNAIIGFTRLVMRRAKDVLPVKQFENLEKILASSEHLLSLINSILDLAKVEAGRMEVKPSDFALEPVLDLCLRTVEPLVKNEGVRLVRDVRDPPPMLRTDEEKLRQILINLLSNAIKFTEAGSVTLRVRSVDEGIEFAVMDTGIGIPAGALSAIFEEFHQVDNSATRSHSGTGLGLAISHRLARLLGGRIGVESREGEGSTFTLTIPPRIAGGAEVPPPPKPAPAAVTAPRSGAKVVLAIDDDPNVVYLLKENLADAGYTVVGAASGQEGLVKARELQPRAITLDIMMPGTDGWQVLHALKTDPLTRDIPVVLISIVDQKELGFRLGATDYIVKPFEREALIGALARIAPDNERVLVIDDDPNVPDLVRQLLDSEHCTVDWVADGAAGLERIAQARPSVILLDLLMPRMDGLAFLDALQADPAARSIPVVVLTAASLDSAERGMLRERVLGLIDKGGLDRAALVREVRRVLPVLETETADGDR

SEQ ID NO: 870 - protein, 137 aa, Methylobacterium sp.
MGLAAVDAAVSKRLAALWARCPVRTINGTDGDVPRSPAAFLSVEYPVMSSAQISIGAPGSNVYRDEGAIRFVLSAVAGKGIKTPLQWIDELAALFRGQIFDGVRTFAPSPPVIDDQNDNGGYFLLTFAVPFEHDYLG

SEQ ID NO: 871 - protein, 118 aa, Methylobacterium sp.
VNPRQAIAQLDRQLARNGQDVKLVRIVADGDDVISPVVRAFVRGYRPNELTGGIQQGDSLVVLSPTGLPAPFSGAGDPGAFLRRGDRLEIAGRSPRIEYVDPVLIDGVRVRINLLVRG

SEQ ID NO: 872 - protein, 153 aa, Methylobacterium sp.
MDAVDRKILDLLQQDATLPVAELAEQVGISAAPCWRRVKKLEASGVIRRRVALVDRRKVNVPTTVFVAVKAPRHAADWSDAFRRVVAGFPEIVEAWRLTGEIDYLLRIVVPDIEAYDAVYQRLIAKLDFSNLSSSIAMEEMKYTTAVPTIYVA

SEQ ID NO: 873 - protein, 173 aa, Methylobacterium sp.
MPQTTTPTDVEAMLANLARSASRSPEAYLASARATLMRLLARPDLLDPSRLVGRGPGLSRNLLFGTEAISVWAMVWAPGTVTPVHDHHCSCCFGLLRGSLRETWYRPISETHAVATMDAVREPGFVACMMPTGPNLHRIANDGPEAAVSIHVYGYDHRAQDSSIHRTYAVAAG

SEQ ID NO: 874 - protein, 212 aa, Methylobacterium sp.
MLTLDHLVVVAPDLAEGVAHVRDCLGIAMPEGGRHREMGTRNHLLRLGDALFLEVIAVDPEAPPPSGARWFGLGDAARVRADWDSGRRLRGFVARADDLDGLLAAHGALLGAAATMTRGDLSWRFAVPPGGAWPADGAAPCAMGWGPRGNPAATMPDLGAGLEALVLTHPDPDAVAGLHAALGLAAPPQVVAGPGPRWTARISTPSGPRSLT

SEQ ID NO: 875 - protein, 153 aa, Methylobacterium sp.
MARLNVNGVVREVDAEADTPLLWVIREQIGLTGTKYGCGIAQCGACTVHIDGAAVRSCSVPLSAIEAGQKIVTIEGLAPDARHPVQQAWAELDVPQCGFCQPGMIMASAALLAQNARPSEEQIRQEITNICRCGTYNRVLAGIKIAAERGQSG

SEQ ID NO: 876 - protein, 731 aa, Methylobacterium sp.
MSLESKASPKAARPSRRTLLAGAGLFTLGFHIPFPARAATLDAAPTAPEVNAWVVVKPDETVVIRIARSEMGQGTLTGLAQLVAEELDCDWARVTTEYPSPGQNLARKRIWGDYSTGGSRGVRDSHEYVRRGGAAARTMLVAAAAKGWGVPAAECRVERGVITHGPSGRSITYGAVAAEAARIEPPKDVVLKDPKDWTIAGKPLKRLDTLPKLDGSQVYGIDLRLPGLLNAAIRDCPVTGGSVRSFDAAAVSGMPGVRRVLQVGDSAVAVVADTFWRAKTALDALPVAWDEGPNARVSSETIAATLREGLDAEQAFVGNKAGDVAGALKGAAKVVEAVYGVPFQNHATMEPMNATALWTPERCEVWTPTQNGEAALAATADAAGLPATSCEVYKIHLGGGFGRRGATHDWVRQAVLIAREMPGTPVKLIWTREEDMTHGRYHPVTQCRMRAALDGDGNLTGLHMRISGQSILASVAPQRMVEGRDPVTFQGLNPGGPEAAIGYTIPNILVDHAMRNPHILPGFWRGVNLNPNAIYLECFMDELAHAAGQDPLAFRLKLMDNHPKHRAVLQAVAERIGWAGKPPEGVYRGICQTMGFGSYVAGAAEVSVSDQGELKIHRIVAATDPGHAVNPQQIDAQVAGSFVYGLSAALYGACTVKDGRIEQTNFDSYPVMRMDAMPAVEAILMPSGGFWGGVGEPTIAVAAPAVLNAIFAATGKRVRQLPLKDTDLRRA

SEQ ID NO: 877 - protein, 89 aa, Methylobacterium sp.
MYRCTLALLLGLAAGPALAQSTGYVTGFPGKDPAGDEEIGWGPAYRPETSFAQPGTPPTPGAIAGRAYRARTGHGVYDQMQGDGLYRGR

SEQ ID NO: 878 - protein, 341 aa, Methylobacterium sp.
MRIVHTPDSSRHDPERYMRRGAPIPHPEQAARYAILRDAAVRGGHDLAEPADHGLDPIRAVHDPDYVAFLAEAWARRDAIPGIGDEILTGAFARPQMHRKPAGLLGRLGLYTADTSTPIRAGTWAAVYGSAQCAVAAADATLAAGHAYALCRPPGHHAYADSAGGFCFLNNSAIAAERLRAATGGPVAILDIDVHHGNGTQGIFYARADVLTVSVHADPSDYFPFFAGYADETGAGAGAGFNRNLPLPPGSGDAPWLEAVEAGLAAIAAHRPRALVVALGLDAAADDPIGALAVSRAGFVGAAERIARAGLPTALVQEGGYLCAALPDNLAAFLAAFDAAR

SEQ ID NO: 879 - protein, 344 aa, Methylobacterium sp.
MADQLLSDARGTFVDVSFIMAAHDAAPWIETAVRSALAQTGVAVEVVAVDDGSRDGTASVLARLAEADPRVRVIPLADAGPGTPRGPSSARNAALNAARGRWIAILDADDLILPDRTRTLLDLALAADADIVADNPIPFTDMFDPQGPGMLEGGREPYLFEIDLAKYIASNQLLSRVTKLGYLKPMMRAEILRRHGIRYDEGVRIGEDFLLCLEALAAGARFVVTTYAGYGYRRGPTSLSHRLRQADIARLDAAFAARAEHGRLAEARSRSAEIRHGSRAYRDGLAVTRLIAQVIEAAQAGRWRAGATLALRHPRIWRFLAATLLAAAGKRLRPRPHAHPIGQR

SEQ ID NO: 880 - protein, 189 aa, Methylobacterium sp.
MPSTHDTLPDDLPVPVDDGAADHLRGMRLPDVALTATDGRTVSLARLPGRTVAYAYPRTGEPGRPGLTPDWDAIPGARGCTPQACDFRDHHAALTARGVAQVFGLSTQTSAYQREAAERLRLPFPLLADPHRAFAMAARLPTFEAGGQVLLRRLTLVIDDGVVSELFYPVFPPDRSARQVRDWLDGGGA

SEQ ID NO: 881 - protein, 342 aa, Methylobacterium sp.
VTSHLAITMGDPAGIGPEIIVKAAARLKDRIDAGDLKLVVIGSAPSLRRAERALGLLPDPVPEVTEDGDWPALCCLQADAEGAPIEPGRLSADGGRFAYKAIEAGVRLALAGRIGGIVTAPLNKEALNRAGYHYAGHTEMLAELTGVRGSVMMLAHGNMRVSHVTTHVALEDVPKRLTPERLRLVIDLTDRALKGLGLARPKIAVAALNPHAGEGGLFGRQDIDVSAPVIEKANADGLDVHGPVPGDTVFVKLRAGQYDAVVAMYHDQGHIPVKLLGFEIDPATGKWMDLSGVNITLGLPIIRTSVDHGTAFDIAGTGVANERSLIEAIEFAEKLAANRQPG

SEQ ID NO: 882 - protein, 71 aa, Methylobacterium sp.
MLANARDARRRTKLTSDLRPPEAGANADPVLYGVAAGLAALFPPVMLGSEASPETHRASETSRAPDATGTR

SEQ ID NO: 883 - protein, 240 aa, Methylobacterium sp.
MSSTLQDRSVVVFGGTSGIGLAAARQAEAAGASVIVVGRDAAGAERVAAENGFAGWRAADVTRPETVAAALADIPRVDHLALMAGTFVAGKVREAEVDHLKRAFDERIWAAAYALRALGDRLAGDGSVTLISGALADRPNAQGTAVLAAASAAMEAFARGLALELAPVRVNALSPGTTDTPLLARTLGAHRDAYVAGLTERLPQRRLGTAEEAGAAVVFLMGNGFMNGETLHIDGGGRLI

SEQ ID NO: 884 - protein, 588 aa, Methylobacterium sp.
LSWFWGLGFFYAIHVTLTYGWLGFLAFALPNATGLGLFGWMLGAPRRNLDAIVAAVQGPYALLFMGAQFFAVAITIFGFAAYAWLPLFGHDAAVGVIALVLVACSLGHAVPLRGIRIVHCGALAVGLAASVILLGGLSAHRDGWQVPLQAFDERFYGLVVPSLVGFLLGPWMDIQHWQRAVEIRRSGGSVRAAYVTGALLFLGLLTINALMAARAGLGMPVVSSDGLSGAYAAVAQAIGREPATGVAVAFVIWTAIAAATTIDSFYSATRWLGISVTARSNSPLLAFVPAGLVASPVWILGAALATAAAAIWANLSLLYLMMPFATLLVGAAACLVCESLGATRRYDPVLTSMIGATACLIFVTGYLAPSWALLAIAPLIGLIGALPMIAEVLGWRAAPPVAELIPAAERAPRAAPVPVAVDQTDAVASHGFDGHWFVLRLIPTYDDTNSVGNVYFANYVRWVGKARELFFNICMPDFDLKSTDFYILTKSFQHDFRREAMEFEPVTVRISIASHNRKFVTLAHEIHSEVNGLLGRGEQSLMFVDTVHYRPLDIPRAIIEGFLPYWPKTSPHAVADGSGPTGVAPLGV

SEQ ID NO: 885 - protein, 243 aa, Methylobacterium sp.
MQTPTNIVRFRQPEDIDDPLTDVLRAGARRLLAQAVELEAEAFLSAMQDLRLPDGRARLVRHGHGPERAIQTGIGPVPVARVRVRDRGASGSEDRIRFTSALLPKWARRTRSLDALLPVLYLRGVSTGDFQDALAALLGRDAPNLSPAVIARLTTTWADEYARWQGRDLSARRYVYVWADGVYLQARMEEQAECMLVLIGATPEGRKELVGFQVGVRESAQSWRELLVDVKRRGLSIAPEIAV

SEQ ID NO: 886 - protein, 234 aa, Methylobacterium sp.
METPTNLVRLRHPEDLDDPLTEVLRSGARRLLAQAVEMEADAFLSAMQDLRLQDGRARLVRHGHGPERAIQTGIGPVPVARVRVRDRGASGSEDRVRFTSTILPKWTRRTPSLDALLPVPYLRGISTGDFQDALAALLGRDAPNLSPAVIARLTATWADEYARWQGRDLSARRYAYIWADGVYLQARMAEQADCMLVLIGATREGKKELVGFQVGARESAQSWRELLVDVKRRG

SEQ ID NO: 887 - protein, 80 aa, Methylobacterium sp.
LVDVKRRGLSIAPEIAVGDGALGFWRALDEVFPGTAHQRCWVHKTANVLDKVPKSVQPAMKADLREIHGAPTRAAAEAAL

SEQ ID NO: 888 - protein, 73 aa, Methylobacterium sp.
DLREIHGAPTRAAAEAALAVFVEKYGAKYPRAAACLTKDRDRLLAFYDFPAEHWDHLRSSNPIESVFATVRHR

SEQ ID NO: 889 - protein, 186 aa, Methylobacterium sp.
VDTQTIPDELRTFFEKSHIAVALAAAGDDNVLLLVNERFHQLTGYTGAEVVGRNCRLLQRDADNREARAKIHAFLENDRQDTVRTPILNFRKDGKPFVNLLYMSKLKALSGEVRFLFASQFDVSRSQPELLSAYDAELGRTLSRLTPTLAESGLVIEGSLMTIANTVATVAQAKLTLADLDAPGFP

SEQ ID NO: 890 - protein, 271 aa, Methylobacterium sp.
VSVALASAPAGPHRWQRFPLWKRLARLAFTLCAVAAFVASLRTIEVIPEFLYDAPDQLADLFGRMWPMDAGYVGPTLRALVETLHIATLGTLIAIAIAVPIGLMAARNVTPNRALNLFAKFVFVTSRSVNSLVWALLFVAVFGPGPLAGTLAIALRSVGFTGKLFAEALEEANRGSIEALQAAGAGRMSTLLLGYWPQVKPAFWSIALFRWDINIRESAVLGLVGAGGIGVALDTALNLLYWDQVAVVLAAIFGVVILAEIVVTALRARTL

SEQ ID NO: 891 - protein, 137 aa, Methylobacterium sp.
MAMSEPIRRLELFTGAGRRRTWSDEEKASIVAESDGPGTSISAVARRHGLSAPQLFTWRRLMRQAERPDDQRPLQFVPAVLSVAPHEPTSAELSPELGERCGWHSIEVEIAGATVRIAQGASAAQIAAVIQALKACP

SEQ ID NO: 892 - protein, 76 aa, Methylobacterium sp.
MLVDEERIDEAVLALLWLTLHDGRRAWKGFDWAVLGRLHAKGLIADPVGRAKSVVLTDEGLRQSEALFRTLFTRSD

SEQ ID NO: 893 - protein, 76 aa, Methylobacterium sp.
MAVDEERIDEAVLALLWLTLHDERRAWKGFDWAMLGRLHAKGLIADPVERAKSVVLTDEGLRRSEALFRTLFTRPD

SEQ ID NO: 894 - protein, 431 aa, Methylobacterium sp.
VPSLKLSNPFRRAAERPSLRQRAAELKASLGQHVDAVQPEATPAKAPAEAVGDAELLRLGAQFEFARQREIAACEACNAADREADRHMPARPACLIYRASDERLNVHRTSMMPEALEGREIRSADVERLRRMMPMTHEVLRPIRHGERAHIDHPGLKLEIVPYPEAQARAEEIVVAYDTWLAERMRIHGEYLTEALDDAANDAGDAAAALAERIAGLPALTAEGFRVKLRALSHYNPKVLSSEITDEPDPDQLLSHSLWRDVQGEIPAPPPADTLTAAILDLWRDWAVKENAEEYDEALQGRRFALIDAAEALPATMENVAPKALALAWLEYVDHWRPKSVRGSYTTDGRLALDIHAAAAARSPTAVPAVPAAPREPSLVGMLDLASASLDDLQALHDIADLVGGVAYAVCWQSRAHGDGSYAGSWVTTEV

SEQ ID NO: 895 - protein, 65 aa, Methylobacterium sp.
LGDALTDVETAANNEARRRAPTNNADRETRLEMLALPVIQNGDPDETEAFARELLAHVAAERQGR

SEQ ID NO: 896 - protein, 730 aa, Methylobacterium sp.
MRFSIKAKLGVGFGAILVLLGTASGVGYQRLTAADATMKYVLSRAEIQKQVLEGKAHAIRSAFNVRGALISPDEAQMTEFAKRSANNHGDAMASLAKVKPLLMTDEGRRLYEDLSAKYEKQNALGNRALELTRDNSNGKTWAEINAAGRPALAALRTDLDALINTATDAQSPAGERLARVAAVFKSRVERAWGQLTSATGTTSVDALQQRVALAKQSREEINRSVDELASAAQAAGIAVTAVRERFGTWASSFQRAIALVEIGSSVKAAEVASGEYATVSTTAINAFETLADRQKRFMDDAAAQANAESAQGQTILLSVAAAALLMGLGIATWLALSISRGLGRAVSLADAVSMGDLSQTANVTTNDELGDLVGAMGRMTENLNATAALANAIAQGDLTVEARPLSDKDTMGLALQTMLSKLRTVVAEATAAAGNVSAGSQELSASAEQLSQGSTEQASSTEEASASMEEMAANVKQNAENASQTETIARQSAQDAEASGIAVGRAVEAMQTIAQKITIVQEIARQTDLLALNAAVEAARAGEHGRGFAVVASEVRKLAERSQAAAAEIGTLSSDTVKAAQQAGDMLGKLVPDIKKTASLVEEITAACREQDVGSGQINQAIQQLDKVTQQNASASEQVSATSEELATQAEKLQATIAYFRISETAAPVAGVDQAVTRLRATAARMGTPSAAIRSPSAKRAGARGPAGGGGFALDMGEGDAQDAAFTRVA

SEQ ID NO: 897 - protein, 192 aa, Methylobacterium sp.
MVLASTTASALQAAGFIGIWDTDVRAGRSMLDSGAASLMAGDPGLAGTPLPLDAALGRIHPADRDWVFGRIRHVRQTGGPVSLEFRVVTGTGEIRWILNRGCLTPDSDGLLRGRGAYIDVTDLHRHGIQSGDMNGAINGVTHGAADGSDLNAAADHGIQIHAALERHGDPYLRSVSGMLLHGIGRALARRDP

SEQ ID NO: 898 - protein, 550 aa, Methylobacterium sp.
MTDTRPTQTEVRETGSHPFEAGLARRPANYVPLTPVSLLARAAAAAGGRIAVIDGDRRLTYADLYARCRRLAAGLAARGIGPLDTVAILAPNVPEMIEAHFAVPMLGAVLNPLNTRLDAATIAFSLRHGGARALLVEAEYAALAARALAELAEPILVVAIGASGIDKALPYEDLLAEGDPDYPWRGPEDEWQSLCLLYTSGTTGDPKGAVYSHRGGYLQALGNAVTFGLTSESVYLWTLPMFHCSGWSYPWASVAACATQVCLRKVEPAAIFRLIAEHGVTHLCGAPIVLSMIAHAPAQDRVPFPQRVRCAVGGAAPSSTIIRTMEELGFQVTHLYGATESYGPATVCLAQPDWTDLPDTERHARMARQGVPLATLEAVSVADTVTDAPVPRDGATVGEIRLRGNTVMKGYLGNPSATEEALAGGWYRTGDLAVWHPDGSVEIKDRAKDIIISGGENISSLEVEEVLMRHPAVMLAAVVARPDPTWGESPCAFLEVKPGAAVPSDQELIAFCREHMARFKVPKTVVFGPLPKTSTGKIQKFVLREQARTL

SEQ ID NO: 899 - protein, 64 aa, Methylobacterium sp.
MQAVTLSSSPAVTRPTARPSLLRTWLQRIRTRRALAALHPDQARDAGLEPWDLRAEVAKPFWRA

SEQ ID NO: 900 - protein, 203 aa, Methylobacterium sp.
VTPGCLLKRLGRDTGGAAAVEFALVALPFLALCGAIIQIVFQMWATQNFDRALQNAVRTIFTGQFQLDTAGQTNPATVLATLKARMCGSPVSPVPTVFNCQNVKIDVATSSSFASATATKPIDTATGTWSTSFGSNYKCASPGTIVIVTAAVPFPTFFNLMGLNTKQFTSGSAEGSSLLTSTAVFRTEPYQIVGASPCPSSPS

SEQ ID NO: 901 - protein, 196 aa, Methylobacterium sp.
MQNRGARAIYRLADLEDGATAVEFALVAFPFLGMLAVILQTSLLVWAGRNLDDALQRAGRTIYTGQFQKANTGQTDTSALLAAMKNTMCGASSSRVATVFDCNALKLNVALSSSFANGSVPTPVDGKTGDWAKGFGTNYSCAQPGAIVVVTAAVKYRVVFSFLYAGIPGFSDGSRLLQSTAVFRTEPYDTSSGQGC

SEQ ID NO: 902 - protein, 59 aa, Methylobacterium sp.
LISHPRGRVELRRYVTRGGRVPRACNDNRRAGSHHAWYWVLAAGAMPTLGLLAMLSTLL

SEQ ID NO: 903 - protein, 584 aa, Methylobacterium sp.
VTGFPAALLPLPVAIPLVVCAAMLATAHVLPGRLPDILATLAALTVAVLCAVIATRAADGPLVYWFGGWEPRDGVHLGIGFSVDEASGWVAAFIGLLYALTFVFAWGFFDRTHGHFHILMLLFLAAMVGFCFTRDMFNLFVWFEVMSVAAFALTAYHLAESALAGAINFTVVNSLAGFLMLGGIGLIYAQTGTLDFEGIAAAVARGGRDPVVAGAFCLVAAALMIKGAIVPFQFWLADAHAVAPSPVSVIFSGSMVSLGLFGLAKVSAVVFGGSDQVQHALPGLLIGLGSFTALLGGWMALLQRHLKRLLAFSTISHAGIMLTGLGALSVDGTGGMLVYVVGHGLVKGALFMIAGILLATQASIDEIALRGLGRGIWPAGIAMALAGLLLCGLPLGVLDQGTRLVQGALWQQGHGVALAAGAIGAALTGAAVLRAAGRIFLGLGPDPGDEAGAPSEDEREKANRPLWLMLAPCCLLLALDIGLPAALIEHALPRAASAFMHRPAVHALAEGPGWLPWASVAAALAGAGYGLFRRHLPAFVVRPVSATQSAPTRALEMLHSGLIGDYAAWLAVGVAAIAAVLAMA

SEQ ID NO: 904 - protein, 139 aa, Methylobacterium sp.
VSAATSVLPYAVAAWLFGIGLYGIATSRNFIHLVGCLGVCQSATYVLLLGLGYRWGSIAPIFYDHPPGTPAVDPVMQALVLTDIVVGATLTALLLVLTVQAYKRGGSLDPEKLRPMRAGGKSGRDAGSSRVRDAERHAP

SEQ ID NO: 905 - protein, 258 aa, Methylobacterium sp.
VSPRARVALLALAGLVLLPGAAAVIAGLPPFGSTIAQYGARINAIVPEARHVANMVSAINFDLRGLDTLGEEFMLLAAITGTVVLLRGRRGEGMTGRAMRRPGRAVIPRSEAVVLACRVAGPLTALFGLYVVLHATVTPGGGFQGGVILASGTLLIYLGEGYAGWRDAIRSHWLDALEGGGALLFALCGLVPMLTGAAFMQNVLPLGTFRDLFSGGLMLVENLGVAMAVAGGFTQLFLEFMEETREADAPEEPGEESA

SEQ ID NO: 906 - protein, 83 aa, Methylobacterium sp.
MTVILPLLFVLTAVSGTAVVLVRDPARQIFAIAVNGLVLAILFDALQAPDVALSELAVGSAAVPLLFLVALMAVRTQPPEEKS

SEQ ID NO: 907 - protein, 148 aa, Methylobacterium sp.
MSVDRILAPSDALVGLRAAGKGALLEELARRAAGALGLAAETILPALIRRESLGSTGVGDGIALPHARLEGIARPYGILARLRDPIDFDAVDDRPVDLVVLLLLPAAAEGETLNALACVARRLRDPGAAAAMRGARDAAALYAAATGR

SEQ ID NO: 908 - protein, 139 aa, Methylobacterium sp.
VTDEVGNDPLAAARNARDRPMKRILIVEDVALNRDLLTQLLEDEYEILIAVDGAAGVDMAIAHRPDLILMDLSLPLVDGWEATRRIKADATTAAIPVMAITANAMTGDEDRARAAGCDDFMTKPVDEDLLFAKLQHWLG

SEQ ID NO: 909 - protein, 351 aa, Methylobacterium sp.
VEPARILIVDDEPFNLDLLEQELELLGHASVRAANGRAALDRLSEQPFDLVLLDVMMPALDGYAVLERMKAHEAWRHTPVVMISALMEIGSIVRCIELGAFDYLPKPFEPVILEARIRSCLERKRAHDREVAHLRTIERERKRADELLHAILPVSAVAELMETGQVKPRLFGDVAVLFIDLVGFTTWCHDQSPDVVVAEIQRLAEAFEVVAQARGLENIKTIGDAFMATANLLRPHEDPVSAAIRCAADMVAIAAEGEPGWRIRGGIHIGPVVGGIVGRTKFTFDLWGDTVNVAARLAGLGDGCALHLSREAFARLPDPRDVRPIGAVTLKGKGAVDVYCHALAAGDATPA

SEQ ID NO: 910 - protein, 245 aa, Methylobacterium sp.
MRPALLIAAGLLCGRLYPADAAERPVVVELFTSQSCSSCPPAEALIGRLAHEPAGAQGDVLPLAFHVTYWNHLDWRDRYALPAATARQEAYAARLGGPTYTPQAVIDGQVGLVGSDEAGLRAAIARARQAGSGIPVTLARDGEQVVAQIGAGAGGAAGRVLLIGYDPSHTTRVLRGENAGRTIEQANIVRSVRELGHWSGSAAAFASARPEGETAALLLQSEDGRILGAARLTASPAATVREAVR

SEQ ID NO: 911 - protein, 284 aa, Methylobacterium sp.
VHGSTYPSSTAFDLPLGGMSAMDYLAGLGFDVYCVDLPGYGLSGRPAAMDAPPDDNPPLMRTPDAAKVVGQVVDFIKKRRGVEKIDLMGWSWGTSTMGLYTSTHNDSVNRLVLYAPQWLARTPGLIGGGGKVGAYRTVSRDSARARWLTGVPEDKKADLIPAGWFDQWADATFATDAAGAKRSPPVLRAPNGTVADKDAYWAAGKPLYDPGEIRVPVLIIHAEWDADLPSYQAQEYFAKLTRAPYKRFVELGEGTHTVMMEKNRMQFLHAVGAFLTEADPQALN

SEQ ID NO: 912 - protein, 444 aa, Methylobacterium sp.
MAGPIATAGTAAPRTGAEAARDRGGYRPALSLLASLFFMWGFITVINNTLLPHLRSVFDLDYTQTTLIESVWFIAYFVASIPAAKLIERVGYQRALVTGLGIMALGTLGMILAAHRVSYAITLTALFVIASGITLLQVAANPYVAVVGPAESAPARLNLVQAFNSLGTTLAPLFGGYLILGRSASGNAAAGAALTPAERLADAQSVQLPYLIVAVVLVVLAVIIARFPLPAMGGSGGSGGATARAARAERAGLSLWRHRNLVLGVPAIFIYLIAEIGVSNLFINFVSQPEIGDLTHAQASRYLFLLWGGMMVGRFVGSYLMQRRPAETVLAGAAIGACAVMLVATFATGHLALWALISVGLFHAIMFPTIFTLGIRGLGPLTEEGAGLLIMAIAGGSLVVVQGWAADRYGLQHSFLITAGCELYVLFYALWGCRTGAAARPAGA

SEQ ID NO: 913 - protein, 349 aa, Methylobacterium sp.
VAKNILILGASYGSLLGTKLLMAGHNVTLVCRRKTADLINREGTEVRIKLRDEKEHRAIHSRDLPGKVDAMPPEDVDVSRYDLVGLAMQEPQYNNHTIRVLMIKIAAAKLPCLSIMNMPPLPYLKRIPALAAMDLEDAYTNAGVWDRFEPGLVSLCSPDPQAFRPPEEEANVLHVGLPTNFKAATFADETHNRLLRELEADIDAVRLDGHDVPVKLKVFDSLFVPLAKWSMLLTGNYRCITPGEPQSIHDAVHGDLARSRAIYDHVDGIARKLGADPADQVPFEKYAKAAESLLKPSSAARAVANGAPYIERVDLLVKLISHQLGEPNAEIDRTVETVDRKLDERIIEG

SEQ ID NO: 914 - protein, 658 aa, Methylobacterium sp.
VTDAADMSPPAHGVAGWPFGRSAGAPARPPSLPDGRPWPRIRVVTVAGADAALAETVASVLRQGYPELRHDLLDPAAGRAAVARILSAPDPEHLFWLRAGDLLAPCALTALALEAALTGADAVAGLRVLFDDAVRGLDGPGTADGGILWRRDALAHAILDADGRLDAASAWSAIPESRRRLIGRPVLLHRLDAPPPPPTAGLSIVSLTGTGTRGGAGVAQRRLAEALTLAGHRVAEVTLSGRPEAAEWSDDFPQAEAAIAAAAPDLVLAGNLHGATRSLDVVGRLARRGPVGLVLHDLFPLTGRCAHPRDCGRAASGCDAACPGPDEYPELAPGRIAGMHERKRAVLAGAAPGSPTRPSAPWLLANSDWTLARARELAPPGSVIEPVRLAFPTAVFRPGDRAALRGTLGLPPDDVLILVSSVIVDGPDKGFADLRAALQAVAGPGVGVVAIGRLDDPARLGVANLYAPGLIADEALLAAWYGACDLHVTASRHETLGQTPIEAGLCGVPTLAYRTSGLTSAVIDGVSGRLVPVRPGALAEALAALVGDREARARLGAFARIALESRYSPAASALSLDAVFRRHGLPSAPTGPHFAPGMLGHFPFAAALRAGAAGTVPAVSRPLVRRLRRAKQMVFGRRMPLLVRRCLYLAGALRRSRP

SEQ ID NO: 915 - protein, 854 aa, Methylobacterium sp.
MNVNSAGKRPIMPAWERRCLDASPEEIARWGTLYPESTNTGLLCGHLVGVDIDVLQPALTDAIADRARRILGPTPLERIGREPKLLLGYRLAVPADKIQTAALHFTDDPQEKPTKVEVLLRGQQFVAFGIHPETAAPYRWPDASPLTVDFADLPETTEEALRLFVAEAEVILREAGAATKRERRQTERARETKGRRAAGFGLNEKPNRETIADALRSIPNDFDYDGWIRIGFALYDGLGEAGRDLWEDWSATSPNDDAAFTSRKWSSFAGGRSVKIATLFWHAAENGWRRPGAGRSGAPKRDRAERRASADPEAEISGEDDGRPVVRFVAGKVPEAVDRMEALLLASPVEIYSRAGALVRPVIDAVPAAKGRMTTVARMCPLTTVSLADMAARTMRFQRYDGRAEDWLDINPPVEMTATLLAREGQWRVPAVAGIITTPTLRPDGSLLTVAGYDLATRLYLALDPGFTMPKLTERPDKREAAEALGFIETLLAGFPFVGPVDRAVALSGVLTALVRGVLPTAPLHAIRAFTPGSGKSYLVDLAAVIATGRRCPVIAAGKTEEETEKRLGALLRDAVPVVSIDNVNGELGGDMLCQLTERPLVRVRILGKSEAPELECRSTTFATGNNLVLTGDMTRRALVCSLDAEVDRPELRDFDFDPIATVLADRGAYVAAALTVIRAYRVAGSPSVCGAIGSYEDWSDMVRSPLVWLGHADPVASMETAREEDPELSAIRELFEHWRSHLRLSSGYTTNTIIRTACDRDAGSHFAGPGDFKLAEFRDLLLRQAGDGGAVNSRRLGKWLSRIKGRVVDGHRIEMKADASNGNRFSLCQVSVPEYPAGSPVAADYRASSAPEF

SEQ ID NO: 916 - protein, 471 aa, Methylobacterium sp.
MIARHSLIYVGSRGFAAALNMASVAVFTRLAPVESYGTYLYVLSWALVLYGATCQWPKFAFFALYDEAREPAQVGTVVRILGGTLLLAGLGSALAAALGLMPARMAAAILALAFGTTLFEGSTEIARTRLRAGAVAASVMSRAVLILALGSLALHLSQDPLHLAFAVAAANALASLPAAATIAPMMPGRGSRAEALRLFAYGWPLVLSFGTAALAQSLDRLIIAKTVGPAGLGAYGALADFLKQSFIVFGEAIALSLISIAKREARVGGMAAASGVLRDAARAMTLIAAFGAVFFLCFDDLVVAVLLGPDYRAEARELAPVLILASILMMFRAYYFGQVIYFARSSGLEAAAAFATLATVAALSLLLIPRFGAAGAALAFAGGQSAACLVLVLGARRTGTTMPLPLADMAGIAGIALACGAVNAGIALVPGGLLPPGQALRLVLLTAAAGVTAWRYDVLGFAGAIRHRLAA

SEQ ID NO: 917 - protein, 323 aa, Methylobacterium sp.
VRLARFLGYRLLLAIPVVLGIVVLNFFLIHLAPGDAASVLAGESGAASPEYMEQLRHKFGLDQPLATQFGVYLLNMLHLDLGYSFRNDSPVGSLIVDRLWPTGLLMLTAFAAALLIGTLLGLVAATGRNSWRDAVISLVSLVAYATPGFWLGLMMIVVFAIRLGWLPTSGYDTIGADNDGWDEVWDVGRHLVMPAVALALFYLAVYARVMRASVLEQVGMDYVTTARAKGQTEARVMTGHVLRNALLPVVTMAGVQAGNLIGGSIVVETVFGWPGVGTLAFNALQSRDLNLLLGIFFVSACLVVVINLAVDLVYVCLDPRLEL

SEQ ID NO: 918 - protein, 114 aa, Methylobacterium sp.
MKTLRTEARQSAPPQDAEGAGVALGGRPRTIRFPPVWHAWFARQSEPRLAALDEMVDAHLERRALRRYLRRLKHATVLAFVAAAAAAHWFSDQVAWLAAHIPALRALWKLLTGA

SEQ ID NO: 919 - protein, 109 aa, Methylobacterium sp.
MSESFPDAPAGAALLSVARQSLLDEVAPALSGRQRYVLLMAANAMGVVMREIAQAGAAAGAWERALGAAGSPTELVAAIRAGRRDGDAALHAALVETTRIAAGIWKAPG

SEQ ID NO: 920 - protein, 346 aa, Methylobacterium sp.
MLDADQRTALCAWIGRTLEAGSVALDDARPLTGGSIQENWMLSCRVDGAPRSFVLRKDAAATIASSRSRAEEFRILRAAFAAGVRVPEPVGFCADPGVVGAPFALMGLVAGIGLGPRVVKDTSLGGDRAALAEQLGRELARTHGILPAAGPGTAPADDLAFLGAPEPEPALAEIRALRASLDGIGAARPALEWGLRWAELHAPPCPQPVLVHRDFRTGNYMVDAEGLTAILDWEFAGWGDPVQDIGWFCAACWRFGRPDLEAGGIAPRAAFYRGYEAESARAIDPEAVRYWEVMAHLRWAVIALEQGHRHVSGQETSLELALTGRMVPELEAAILRETAPERWGAR

SEQ ID NO: 921 - protein, 392 aa, Methylobacterium sp.
MTEVVITGAVRTAIGTFGGALAGTPPSVLAASCVAEALRRAGTAPETVGHVVLGNVIPTEPRDAYIARVAAMEGGIPEAVPALTVNRLCGSGLQAIVSAAQSILLGDTETAVAGGAESMSRAPHLLTTGRTGSRMGDAVLVDYMLGALTDPFGNGHMGVTAENVAARYAVPRDAQDAFAAESQARAARAIREGRFREQILPIEVQRKRETVAFDTDEHPKATSAEDLAKLRPAFSKTGSVTAGNASGLNDGAAALVLSSAARAARDGATPLARIVGYAHAGVDPSEMGMGPVPAVRRLLERTGLRAADFEVIESNEAFAAQACAVSRELDLDPDRVNPNGGAIALGHPIGATGAIITVKALYELARTGGRYGLVTMCIGGGQGIAMALERVP

SEQ ID NO: 922 - protein, 337 aa, Methylobacterium sp.
MRTGSMSGTPLLSIENLQVHFRTPDGVNRAVDGVSFAIQSGETLAIVGESGCGKSVTSMSILRLLPEPPARIAGAIRFEGKNLLDLPNSAMRKIRGNDISVIFQEPMTSLNPVLTVGRQIGETLRLHQGLGRREAEERAVEMLTLVGIPEPRRRVREYPHQLSGGMRQRVMIAIALACSPKLLIADEPTTALDVTIQAQILDLMRDLKARVGAAIMLITHDLGVVAEVADRVVVMYAGRKVEEAPVRDLFRSPRHPYTRGLMGAVPKLGAVEHGADARLAEIPGMVPSLKGRIEGCVFAGRCPDVTDLCRAYAPALEPKAPGHLAACHYAPKDALAA

SEQ ID NO: 923 - protein, 77 aa, Methylobacterium sp.
MSAPTLIATVTKNNVEEVRVSLTTFNGLDLIDIRTFARLIGAHGEPVPTKRGICLCRDRLPDLIQALIQAQEGGASC

SEQ ID NO: 924 - protein, 80 aa, Methylobacterium sp.
MTSGTLEKPLDVGGPLSRRAAALANVRWFRALAWRALRDGGPRAELRASNARAAARIVLRQAKREALVARLARQALDASV

SEQ ID NO: 925 - protein, 80 aa, Methylobacterium sp.
MPLYVKDPQVDALAAQLMTLLGTSKTDAVRRALQNEIARQTNRPDLVARTADFVRALHERAGPDRKPADAAFIDGLYERT

SEQ ID NO: 926 - protein, 176 aa, Methylobacterium sp.
VTDVIRPAAEADLPAIAAIYGDAVASSTASFETEPPTLAEMTRRFEVLRAGGFPYLVAERDGAVAGYAYAGPYHQRAAYRSTLEDSIYVARTARGGGVGRRLLTALIAASEQIDCRTLVAIIAESGSPASIALHASLGFTPVGTLAGVGHKHGRWLDVTLMQRSLGPGRSLPPTRI

SEQ ID NO: 927 - protein, 239 aa, Methylobacterium sp.
MISVNEDMKQEMLRRGISVLHPAPFGLPEDCVFEPPCSIKWMGVDYCLTMGAFSYAVSGYYFGADIARYCSIGESVQVGRGSHPVQCGSTSPLFYTHHSAVFDRIDPRAEDYEISGPYLWPKRVRIGNDVYIGHGAFLMPDITIGDGAVIGAMAVVTKDVPPYAIVAGSPARIVKMRFPDALIERYLKVQWWRYAFWDLRQCSITDPETFIDAVEERIAGGMQEYRPEPIPIRSLLPGA

SEQ ID NO: 928 - protein, 224 aa, Methylobacterium sp.
MAKYKAGIVAVAKDEHPYLLEWLAFHFAIGFDHIWVYDNESAPPLSRLISHRAAREHVTVVRWPNSANGRLQIEAYNHFLRTFGRDVTWAAIIDVDEMICLKQDQTIGTFLNRFDGASGIALNWRYFGSSGHQTHEPGLMIERFRMAAAPDNEHNAGVKSLHRVEDVAFMLPHYSLYHGQAVVVSASGTPVPNDWRIPLDTNNFAVAQVNHYFVKSAEGNYPGL

SEQ ID NO: 929 - protein, 231 aa, Methylobacterium sp.
PETPATGGFVETVWAPIRDLLARLGPLALPVLALVAGFRMPGYVSNAMAIPLFKTLGYTNTDIATVTKLFGFWIALGGTFLASAIIPRIGMMASLLIGTVTASASHLALAYLAWHGGHGGAAFWTFALTVGIDGFAYAFASIVLITYMSRLSATAHAASQYALLTSLCALPGSLLAGFSGFVIEWTGFAWFFVGTSLIGVPVALLCLLVARRHGPMEPAADAAGDTPNRAT

SEQ ID NO: 930 - protein, 451 aa, Methylobacterium sp.
VEQGALFYEFSLDTHVPADHLLRAIDRFVDLSGLRAHLQPFYSSTGRPSVDPELMIRMLLIGYCFGIRFERRLCDEVHLNLAYRWFCRLGLDGRVPDHSTFSKNRHGRFRDSDLLRRLFETVLARCIAEGLVGGEGFAVDASLIKADANRQKGVEGTNGLPPESVSRAAREYLAVLDDAAFGAATPVVPKLVSPADPAARWTGADGGLAYFAYAANYLIDLDHAVIVDVEPTTAIRQAEVTAVKRMIVRSRERFDLYPARLAGDSGYGSAAMLGWLVHEQGIEPHIPVFDKSERRDGTFSRSAFTYDPDADAYTCPAGKQLRQRQKVYRSPPPLVDADGMLRYRASKHDCDACALKPRCCPNASARKIPRSIHEGARQMARDICASEAGRTSRRERKKVEMLFAHLKRILKLDRLRLRGPDGARDEFHLAAAAQNLRKLAKLIPLGQPSLA

SEQ ID NO: 931 - protein, 76 aa, Methylobacterium sp.
MKGMMLNALLGVMLGRFGSVWRLLVFVPIVAAEVGYGLLVYNLSAGACLRRGTALLVCGQLAFLLGALLRPIANER

SEQ ID NO: 932 - protein, 268 aa, Methylobacterium sp.
MSRAGIRRTYGAISGAVLVFIVLPLVVIVWVSFFANRILAFPASGYTLDWYARALDTDAFRDGFVTSVETALFATAASLTLGVPASLGLVRGRFPGRDAVQALLLAPMVVPGIVGGAALFIAFIEVEALLDIQVAGTLGGLLVAHTLIALPWTIRLVSASLASADRAIEEAAASLGADPLTVLRRVTLPAIRPAIVAAALFSFVISFIDLEKSIFLVGPGRTTLQIALVNYLEWNLDGTVAAVAAVQILIVGTALLVSDRYARLAQAF

SEQ ID NO: 933 - protein, 274 aa, Methylobacterium sp.
MSDGGYGGLPSLAGGDLGLSPSIQDWLLQQARAQAQNGVGQDAPSATPPGFTGYNPPTPPTGAPTDVVQPQAQSLAAAAMNALGPSSAQAATPDQGDIRSRFISTLQQGGLTNPNGLGAVAAYAQHESRYSPSNITGSWSDPSESGQAGTSGGILSWRADRLANMRAFTRGAADPVVAQANFLLQENPQLTQALQNAQSPQEANRLMADAWKFAGYNRPGGENAARLATTQAYANSFGGGGALPALTASRNGGSMGLILPRCRGHREIISRSSR

SEQ ID NO: 934 - protein, 296 aa, Methylobacterium sp.
MSDTDFSWDDQRAFLTVLDTGSLSAAARALGLTQPTVRHRVEALERAIGQPLFVRGVNGLAPTPEALGLAGHVRRMAHASEAFRREAEGGAFEVAGPVRLSVSDFVGIEVVPPMLATLRERHPRLAVELLLTNANTDLPSQEADVAVRMARPSQNALVARHVGSIPLGFFASPAYLDRNGVPETVADLTRHAMVGPDRMPAYVAILDALSREAGGPLNVALRSDSHPAQLAAVRAGLGIGVVQVPVGERDLVRILTDRVVFDLETWIVAHEDVRRSARIDAVFNHLVESFRAYCAQ

SEQ ID NO: 935 - protein, 596 aa, Methylobacterium sp.
MDERDLRGLIGQVKDGRLSRRAFVQRMVAVGLTAPMAGLMLAGNGVAMAADIRAGYKPTKAGGGGALKLLWWQAPTLINPHFAVGTKDQDASRIFYEPLAAWDADGNLVPVLAASIPSKENGALAADGRSVVWTLKPGVKWHDGKPLTADDLVFTWEYARDPATAAVTAGSYKDCKVEKVDDLSVRVLFDKPTPYWCDAFVGIVGMVLPKHLFGPYSGAKSRDAPQNLAPVGTGPYRFVEFRPGDIVRGALNPDYHLPNRPYFDTVEMKGGGDAVSAARAVLQTGEYDYAWNMLIEDEVLKRLETGGKGRVDVVYGGKLEFLLLNAADPNVEVDGERASITTKHPAFSDPKVCQAMNLLVDRKSIQTYIYGRTGKPTANTVNGPERFVSKNTSFAFDPAKANALLDEAGWKKGSDGIRAKDGKKLKLLFQTSINAPRQKTQAIIKQAAAKAGIEIELKSVTGSVFFSSDPANPDTCTHFYADMEMYAYSMTQADPAIWLLMYASWEVAQKANKWQGRNVVRWRNAAYDEAYNAAQSELDPVKRAALLIKCNDLAVSENVLPLIHRAEVSAVGATLTAPRSGWDNDLSFLPDWYREA

SEQ ID NO: 936 - protein, 404 aa, Methylobacterium sp.
MAFQVAHDILRQVPARFRRPEMRPEVGSEAGSDDRRGSGAAIPAAPLPEAAASSSEPPPAAQAADLLQAWLGLSAQQRTLLDALVAELGIVSTDVEANVHGLSNRFQSIAATTCEQSEIVRGLVASVQTVRIDGRTLQLGDVAAGLGETLTALIERITLMSSRGSTLAQGLAGVLEGLSSVEGSVAQIERINRQTNLLALNAKIEAARAGASGAAFAVVADEVRGLATTINALSDVIKQQIGTMAAGLRGSHALLGDIAAIDMSEESRTAETRVRMVMRALVEQNAQVAGILQQTAETTQAITQDVSAAIVAMQFQDRAKQRIQNVEGLLRSAGAELGRLADHSVDRVAAPGAVADPAWIAAAIAGCTLGEVRARLTERLLGGAPACETPAADAADDLDGIDLF

SEQ ID NO: 937 - protein, 139 aa, Methylobacterium sp.
MVATETRPRDVLVEPRTDPIGLIAHDSAKPGRPAGSRLTVHATPAWSRGHLEAPRDAVIAALLGAAENVLGAALRPSHAEAHRWRYAQVETALEQPCLYDPDLRLGAGGDWCLGARIEAAYDSGQALARCLLADLGRPA

SEQ ID NO: 938 - protein, 253 aa, Methylobacterium sp.
PQRHRPPRDFAGQPARIRAANTDPTHDERDSVALTPGGSAPIFALTRRRGRSFRRGRGVNEHGIVAVLGAGMAGAAAARRLAEAGLRVRVFDKGRGVGGRMATRRVGEMQFDHGAQFMRARGPAFAAELDRWTQQGIVAPWAGSDRHVGVPGMTEPVRALLSDLPVSSATTIVRLRRQGARWHLEDAAGTLHGPFDAVAITFPAPQVTALLEHRASRCPVSGEPPTRRAGRSWWRRRRDRGMSSSSPAPTRSA

SEQ ID NO: 939 - protein, 320 aa, Methylobacterium sp.
MDRRRIGRSDLTVAPFCLGGNVFGWTADEATSFAILDRFVESGFDFIDTADVYSRWAPGHVGGESETVIGKWLVARPGARDRIVLATKVGMDMGEAGTGLSAAHIERACEASLRRLGVDRIDLYQSHLDDATVPLEETLRAHERLIAAGKVRAIGASNYDAARLAEALAVSASAGLPRYECLQPDYSLAQRGYEAELEPLCRAEQIGVIGYFSLAAGFLTGKYRSADDAAGRPRENRVAKYLNPRGLALLDVLDSVAQAHGASSAQVALAWIIARPGITAPIASATSVAQLDELLGAVRLTLAPGAIDRLDAASAGGIEG

SEQ ID NO: 940 - protein, 430 aa, Methylobacterium sp.
VKVEALQPRPRLNGDRIIVPGAPTARGSEPPDTLPRPTIAGNVALGVTQIVLWGGTFFLTAVVSDPIVAETGWPQAMVVGALSLAIFVSGLPAPFVGRMIRRHGGRPVLIAGATIIAAGLVLMALAQTLPVFLLAWVVAGLGMAAALYDPLFAAIGQAYGANARGAMTQIAISSGFAVSLCWPATRFLVDQVGWRGACLTYAILSVALVVPLFAWALPARSQAAVEPAAAPRPYAPAGSTEAARLPAERLLAVTFTMAAMIMTAVSVQLLNLLQTLGVGGTAAVALTGLIGPAQVGVRVVELAFGRRAHPAWSLLLSSASVGLGLLLLATAPSLVWLAMVLYGAGNGMRTVVRGTLPLALYGQREYAAAMGRLARLPLLGQAITPLACGYIAERFGLLPLLEVMLAVAAINLGLSLWVFGFAMRRPSAQA

SEQ ID NO: 941 - protein, 252 aa, Methylobacterium sp.
MIGADLSGRRVLVTGASSGIGLATVAIFARNGATVALNHLPDDPRGPEEAARLAGAGFSVIALPGDVSRAGEAEAMVAAGIDRLGGLDVLVNNAGTSGTTTPIAFEDLDAMTEDFWATILATNLLGPFRCAKAAAATLTASRGAIVNTASVAGLGRRGSSVAYSASKAGLINLTRSLARALAPDVRVNAVAPGLVATPWTEPWSEERKASTVGRTMLGRMARPEDIAETIFFLGAGAAYITGETITVDGGAI

SEQ ID NO: 942 - protein, 67 aa, Methylobacterium sp.
MAVASTARANTLIAVKMALRFGLPLIGLAVFGRAVVLSVGGDIEHGQFALGVLLILAGFTSKLVPRP

SEQ ID NO: 943 - protein, 94 aa, Methylobacterium sp.
MSVAIGSVLALAVASAWLAALAVWRLPWALDRMHAVSFLNVAAAILVTGAAFLADGVSGRSLKILVMMVVFLAWSAVLSHVSGRAVLMREGRSA

SEQ ID NO: 944 - protein, 362 aa, Methylobacterium sp.
VSDLTFEIQSHPAPRTAEERAALMANPGFGKVFTDHMVVARYTAGRGWHDARIQAREAIPLDPAAAVLHYAQEIFEGLKAYRTADGGAALFRPEANALRFRRSAERMAMAPFPEDAFVEAMRRLVEIDRAWIPDTPDGSLYLRPFMIASEAFLGVKPASEYLFVTIASAVGSYFKDPTGTVTVWVSEHFTRAAPGGTGAAKCGGNYAASLAAQSEAASQGCEQVVFLDAAERRYVEELGGMNVFFVFEDGTLVTPPLSDSILPGITRDSVITLAREAGLTVKEEPYTIDAWRADVREGRLTEAFACGTAAVITPIGTVKGREESFTIGNGKAGPVAQRLRSLLVDIQRGNSNDAHGWFQKIF

SEQ ID NO: 945 - protein, 458 aa, Methylobacterium sp.
MSAALQIALPDIGDYRDVPVIELLVKPGDRLAVDDLILSIESDKATMEVPSPVAGVVRELLVSVGSKVSEGTPILTLEPAEGGGAETAAAPPAAAAAPSASGQSAGPLSRAGEGQGEGSGLSGNGPPLTPALARTGEGAGRASPEPMRAAAIQATSGDVHASPSVRQLARELGVGLDRVAATGPKGRILREDVHAFVKAALNAPAQAPAAASGIGAGLPPWPEVDFAKYGPVRREPLSRIQSLSGANLSRNWLTIPHVTNFDRADVTEIESFRVGLNTETRTPPARVTMVAFLIKAAASALRAFPRFNSSLEGGDLVLKDYVHVGFAVDTPKGLMVPVVRDCDRKGLIEIATEMAAMAEKARSGTLPGSDMQGGCFSVSSLGGIGGDGFTPIINAPEVAILGAARSRTEAVWDGKAFQPRLILPLSLSWDHRVVDGVAAARFLGHVASVLSDLRRALL

SEQ ID NO: 946 - protein, 309 aa, Methylobacterium sp.
MASQRKVIITCAVTGAIHTPSMSPHLPVTPEEIADAAIGAAEAGAAIVHLHARNPENGQPDQTPEAFAKFLPVIKQRSNCVVNITTGGAPTMSIEERVRPAATFQPEVASLNLGSMNFGLFGMLDRFKDLKHQWERDYLGNKDIIFRNTFGQIEHILTTCGPNGTKFEFECYDTAHLYNLKYFFDRGLVQAPLFIQTVFGLQGGIGAHPDDVMHMKRTADRLFGDQYRWSVLGAGRNQMNIAAMAAAMGGNVRVGLEDSLWDGPGKLAETNAAQVRRVRSIIEGLGLAVASPDEAREILALKGGDKVAF

SEQ ID NO: 947 - protein, 616 aa, Methylobacterium sp.
LTRPAPSLRSHQRTLMALVAAMASGQAAHVRRILAAVTPGGGKSLLPVIAAHRLIEAGLVERVVWVVPRDSLRLQAEEAFADPLWRAAFGHALSVRAADNERDPARGLAGYVTTYQAVAAAPALHLAEARAHRTLLVVDEVHHLPVPGRPGADETSAEDSEAGAWSRAMLPVMEAATVRLYLSGTLERADGRRILGLPYQAAAPGRGPEVDLYAPGLAVIGYSRAQALAERAVLPVTFGALDGEASWLEGGRIAGDSPRVGPHRLGAGAVRITTRPALFTALRTGFARDLLSEAFFATKRLRARRRAERDLPPGEPARGLGKLLVVAPDQASARAYLATLRDWMPTGQGARDVRLATSGQGDAHAALAAFRLTPEPAVLVTVAMAYEGLDAPEVAVVAALTHIRSRPWLEQMLARATRVDPHAGPYDGQQALIFHPDDPLFARFRLELETEQGSSVRPPRERPASAVVPERTRWRDDEPGGITPLESNAIGMRYALLRPRLPEPVPAAPAPEPPSVSERTLRQRLAAAVAAQAVEDETSLRVPRGGNLAHRYNAVLKRVLGKGRATMTLPELEAALSWLERNRLSDHLDRLDGDARYAWSARQRRGRWQPERAAGR

SEQ ID NO: 948 - protein, 453 aa, Methylobacterium sp.
MSLSAKLQRRADEGRPVRVGLIGAGKFGSMYLSQAPRTPGIHLVAVADLSPDRARESLRRVGWDDSRFAARGLEEAARGGTTLVTEDADAMIASPFVDIVIDATGSPAAGIRHALKAFAHGKHIVMVNVEADVLAGPLLARRAAEAGVIYSMASGDQPALIAELVDWARTIGLEVICAGKGTKYLPAYHASTPDTVWGHYGFSESQVAGGDFNPQMFNSFLDGTKSALEMAAVANACGLTPPRDGLAFPPCGVDDLPSVLKPAADGGLLTERGTVEVVSSVERDGRPVFRDLRWGVYAVFEAPSAYVRDCFAQYGLKTDSSGRFAATYKPYHLIGLELGISVASIAVRGEATGATGDWRGDVAATAKRALRAGERLDGEGGFTVYGKLMPAADSLAQDALPIGLAHNMVLRNDVPAGRTVRWSDVAFDADQEAIRVRREMEDLFRGAAGRAAG

SEQ ID NO: 949 - protein, 106 aa, Methylobacterium sp.
MAFACTIPATPTIQQDDGAVRITRWDFPPGGVTGWHEHGWPYFVVMLVDGILRVHDGAAVSETALAAGQSYMRPAGIRHDVMNGSDHPIAFVEIEVKRPDALVTLP

SEQ ID NO: 950 - protein, 296 aa, Methylobacterium sp.
MNSTDLMFFAAVAETGGIGRAATRLNTVQSNVTGRIRALEQALRVPLFHRGSRGVTLTRAGEQLLPYALQVGQLLAEARHALLAEGEPRGPLRIGAMETTAALRLPGPLADFAACHPEVDIELETGPTEQLIARVLDRSLEGAFVAGPVAQADLVGIPVFTEELVLVAHPAVGDLAALLDRLAGARDAKVLVFRAGCSYRRRLEAFLARQGLVHVRRMEFGTLDGILGCVAAGLGVTLVPRAVAEPAHRAGRVSVHPVPDGDGHVPTLLVHRADDRPSAAFARFAEQIRTALPDVT

SEQ ID NO: 951 - protein, 103 aa, Methylobacterium sp.
MHRATSRRTMKARRDSHHGWSIETLSYSPTRIVRLGAEKVAILFPPVEPGAAWQLYPHPDTFPGLNFEGLPEPLRPEFLAFPDLPEVERFLGIRDAEPAALAA

SEQ ID NO: 952 - protein, 380 aa, Methylobacterium sp.
MAFTESVAAALPCQRHLFEMPADVSYLDAAAWSPLPRAVRAAGEAGILVKSRPWDHPRTAVPPWAERARAAAARLIGAGADDIAIVGAVSHAMAVAARNLTLRPGRRLLRVADEFPSLRFAFDRLADREGLVVEEVPRPPGGDWTAAAAAAIDRPGAPPLALATLTPLHWTDGSLIDLDRLAPSVHAAGAALVIDATQAVGAVPVDVARWRPDFLAFPTYKWALGPYGLAFLYAAPHRQDGAAIEENIGNRPPAAGARRYDRGELNDPVALFMAVTGLEQIAEWGVPAVAARLRGLTDRLADGAAGLGLAPLPASLRAPHILGLRPPAGLPTGLVDRLQQDRVYVSERSGALRISPHVWADEDDLARCLAALSGAFRAIT

SEQ ID NO: 953 - protein, 717 aa, Methylobacterium sp.
VRAALIMPYAFHRALVALGVVLTTLPGARAEEAGQAGRPEPAIGLDTLSVTATKTAVPAVDALAGTSVVPRAALDRLQPGRLSEVLRDVPGVITQENRNDPAQAINIRGLQDFGRVNVLVDGARQDFQISGHGANGVFYLDPELVGGVDVTRGPTATVYGSGAIGGVAAFRTRSIDDILAPDESAGFVQKQGFGTNGQRFVNSSALGARIGTAADVFGQFVFRDTAPYRDGAGLPVPDTGSELNAGLAKLTLRPAEGHALHATALLQRFAFVNGGDTGAGARFANAVQADTVTFGYRFARPDVPLVDLSLDGYATTTRDALTFLQDSPRGLYGRLGTRAGDRLTYDLATAGFDAHNTARFETGPVAHALTLGGDGVANRVRTADRAGGFGAAFTPSGQRELAGAFLQDEIRAAPWLRIVGALRHDSYQLDGGAYRARGARVSPKITVGVAPVGGLELYGTYAEGYRAPTITETLMAGIHPFPAFAILPNPALRPEVARTVEGGANLRADGVVGPEDALRAKLALFDTAVDGFIDIQAVGPAYYVPAIPGVPASICAARPGRFPCVIPARSYQYRNVARADLSGAELEGTYDWGRGFVSLAATHVDGRDRATRESLLTVPPDRIGTTLGLRFLADRLVVGTRLTLVEARTDLPAAARSRATKAYGLVDLFATCAVTDRITADVAVQNVLDRRYRAYNDALASPGLVAKASLSIAFATR

SEQ ID NO: 954 - protein, 118 aa, Methylobacterium sp.
MAVLTSDGATLRAFADSVLRAAEETLEEVMPVTLAVIGGVLAEAEPGSVALQDADGGPPLLWATFAGRRMVFRYNAMTAMIELRVGTAEGYPFRLFGHRSLPMDIVNFFGSLRMEGRI

SEQ ID NO: 955 - protein, 87 aa, Methylobacterium sp.
MLKVLAPAALLVSLAVPASALPLVQDAVSDGADGARIIQVYGGCGPYGHRGPYGGCRTGGQWGGYIRGRSCPAGFHIGPYGRRCWPN

SEQ ID NO: 956 - protein, 51 aa, Methylobacterium sp.
MARELKTGKAQHVTAEDFNERMKRVFADKPDPRKAEPRTKGFKNSKPPTND

SEQ ID NO: 957 - protein, 51 aa, Methylobacterium sp.
MARELKTGKAQGVTPEDFNERVKRLLADKPDPRKAEPARKNFKVNKPLVRN

SEQ ID NO: 958 - protein, 122 aa, Methylobacterium sp.
MNIINRLISKIIQFFLGSEYERRSSAMAKEKEAGVYVGETATKARNFEDDYHAATNMLRMRMDRSFPDNFHARLGSGKNSPYDYGEDRALAVDTTSTAIAMALRNGATVKQAAEAGAESVGI

SEQ ID NO: 959 - protein, 122 aa, Methylobacterium sp.
MTIVRWLISRTVQFFLGSAQERRSDAIAKRKEAGTFEGASASKGRDFEANYAAAAQLLRTRIDREFPDAYYARLSSGRNSSYDYGQDRALAIDTMSIAIAMALRNGATVPQEAAAGAASIGI

SEQ ID NO: 960 - protein, 148 aa, Methylobacterium sp.
MRVQAMTIPSAAGPATRGAPRARLLLVALTILALPLAFVAAARVPAAPVDPDLVRVIRFMALLKGGFALAALAGCFWRLGRPAGWRSAVYVAGPPLMVLGAAGLWSLRDPGLAALGMHLGLFAVLAAALTDREALPDRLRAARRQIVS

SEQ ID NO: 961 - protein, 334 aa, Methylobacterium sp.
MQIPIKRSLERVPGGLMVVPLFLGAILHTLFPDTATFFGSFTGALFNGALPILAVFFVCMGAGIDFRAAPAIARKGGVLLAAKVGVAAIMGVVFGQILGEAPVVGGAFAGLSTLAIVAAMNDTNGGLYLALMGQFGRPKDAGAYAIMSLESGPFLTMVTLGLAGLSAFPWPTLVGSILPLLIGMILGNLDRDMRAFLSGAAPVMIPFFAFALGFGLDLAKIWQAGLLGIGLGVAVVAITGAALFVADRLTGGNGVAGVAAASTAGNAAAVPAIIAAANPAYKEAAGPATVLVAASVVVTALLVPLLTAFVAGRVRPDAAEEDPAPVPSPAPTAP

SEQ ID NO: 962 - protein, 438 aa, Methylobacterium sp.
MTSLRVRLFTILLLATGLIWLSAVAWIYLGSKREVEQVLDTRLQEAARMVGSLVGAVGASAPDGTPATIPAPTAYERQLSCQIWSLDGRMVARSSGAPERRLTDAPAGFSEREVDGETWRVFTVEDAEKGVRVMVGDRLGLRERLVTDLIMGLVTPALLVVPFLGMLIWASLGRGLRPLRLMARDLAGRDADDMSAIDAGRAPAEVRPLANALNGLFLKVEAARRHEREVTAFAAHELRTPLAGLKTQAQVAMATTDPDVAKAALRQILAAVDRTTRLVRQLLDAARLDAAGATPTLAEVDLGALVAETVDGMRMPAGVRTLIDPGLRGYTLRADPESLRLALRNLHENAVQHMEAGTVEWLVRPDGEGVLVRDEGPGIPAEELPHVTTRFFRGRHKSATGSGLGLAIAEMASRRSGLSLRLRNRPDRPGLEAAIVRA

SEQ ID NO: 963 - protein, 613 aa, Methylobacterium sp.
MSPSQEERIAAEQLRLVLDGVTQSVAVGFLVSTLMLAVLWSLVPHAVLLSWYGAFLVERFGAAAYAHRVRAAIGEPDRARRVERVIFLSKIVEGAILGSLIWIALPLQVPAVSILTMSLLGATCSNGVSLLAPRRHLYLALVVPVAVLAAGTLWSLGGAPYRALAICSILFVVGQYGQVVLASRRVRESIELRFENAALVEQLRAETAAAHRARRDAEHANTAKSQFLAAASHDLRQPVHAQGLFLQALSQTDLAAPQRRILQNAQTANVASTDMLNTLLDFSRLEAGVITPRPRAFELQPLLDKIENELAPLADAKRLIYRTPQTDLAIVSDAALLELVLRNLVLNAIRYTERGGVLIGCRRRRAGVSIEVYDTGIGIPADKREDIFREFYQLGNPERDRHKGLGLGLAIARGIAASLDHPLSLSSKVGSGSVFRILVPRTLDAGRDAGLDDAPAAAIAESGGLVGARILIVDDDAIVRDAMVALLSGWGCLCRAFEDPTDVTDLPPQGPPPDALICDYRLRRGQTGAEAIATLRQHWGRPIPAILITGDTAPVRMREALDSGVPLIHKPVRPDLLQKALAALIPPGRPPVGPVGAEVRRGPETTDLVRAEG

SEQ ID NO: 964 - protein, 240 aa, Methylobacterium sp.
VTVPGRIRLFCLPYAGASAAVFAQWRRGLPDAVDVRPVELPGRGSRIGEAPCTDPRALTRRLADEVAGSVTGSYALFGHSLGALLAFELAHELRARGIAAPRALFASGCAGPAVCDGAYFRRPRSDADLRDALSAYGATPPEALADPALMALVLPVLRADFRLRGAYTYAARPALDCPIQALGGTRDDVARADLEAWGRETRGPFDLALFEGDHFFIHARRGPVLDLVGRRIGARAEAAA

SEQ ID NO: 965 - protein, 268 aa, Methylobacterium sp.
MAHIETAAPPLLKIRKLHKSYGTNEVLKGISLDIHEGEVVSIIGASGSGKSTFLRCLNLMETPTSGFMDFERFAFDYEQGARRQPTPQQLCELRARIGMVFQSYNLWPHMTVLENVIEAPIRVRRMPRRQAVAEAEALLQRIGLYEKRHAYPSKLSGGQQQRVAIVRALAMAPKVMLFDEVTSALDPELVGEVLALMGSLAADGMTMLLVTHEMAFARDVGTRTLFFDGGVIAEDGPPDAIIGAPRSERLRQFLRRVLHQPAAPGQTA

SEQ ID NO: 966 - protein, 338 aa, Methylobacterium sp.
MSATPAPAGRTLLEVNDLKKHFSLGGGLLGRESRVLKAVDGLSFTVARGETLSLVGESGCGKSTVAKALMRLYAPTAGQVVLDGKRIDDLSAGALRPLRRHIQMVFQDPFSSLNPRMRVRAILAEPIRNFGLARNSADLESRLASLMERVGLPREALGRFPHEFSGGQRQRIGIARALAAEPDLIICDEAVSALDVSVKAQIVNLLRDLQRELDLAMLFISHDLAIVEHMTHRVAVMYLGKIVEIGPRRDLFLAPKHPYTQALLSAVPIPEPGAGRTRIVLKGDVPSPINPPSGCRFHTRCPHAFDRCRTEVPGLDAVGAGHLAACHLNDTAAPARAA

SEQ ID NO: 967 - protein, 126 aa, Methylobacterium sp.
VTSSTGQRPAVLLIEDEAIQMMVLSDLIEEAGCDVVEATTTTKAIQILENRPDIRIVFADLDMRGSVMGLRLAALIRERWPPIELILTGAVKPDLSSIPARGVFHDKPFQQRKLVQCIREFASVSQ

SEQ ID NO: 968 - protein, 442 aa, Methylobacterium sp.
MTAALSGSPAAAEAGAVTETGVVRKVAWRLMPLIMICYMFAFFDRINISFAKFQLQSDLGFSNVAYGFGASMFVVGYVIFEVPSNLFLYRVGARRWIARIMISWGIATALMIFIRSEWHFYALRFLIGAMEAGFAPGILYYLTIWFPASHRGRITSFMFVASAFSGIFGAPVAGLILGGLNGVGGLAGWQWLFLAGGLPCLVLGMLVLTRLDDRIADARWLSEPEKALLSSRIAHHNRDIGDHSLIGAIKQPGFLMIALIYFLLQIGSYGLNFWGPDLIKTASGGQAASVGFLTAIPYICGAISMVVIGRLSDASGERPKFVAGLAIAAALGFFGAGLFDKHIVPLMFALALLGAGIVASIPTFWTLPAKLVTGVGAAGGIALINTLGQFGGIVSPVMVGWVKDLTGSTTPALYGIGVLCLVAAGLALFAMPASLRRSDRAA

SEQ ID NO: 969 - protein, 137 aa, Methylobacterium sp.
VPELNAILETALYVADLDRAEAFYRDTMGLRCLFTDFRMRAFDVGGRGVLLLFPEGGSLQPIETPGGLIPPHDGRGPAHIAFSIDADALAPWEDHLAAAGVAVEGRTRWPRGGVSVYFRDPDGHLLELATPGLWKGY

SEQ ID NO: 970 - protein, 40 aa, Methylobacterium sp.
HIVLERGDARVDVKCADDDTTRACADVTLQMLEKLGTLRP

SEQ ID NO: 971 - protein, 267 aa, Methylobacterium sp.
MSTDLLEPPDAAARGPANRKRETDALLYLDDLRVTFDGYKALRGLSLTLARGELRAIIGPNGAGKTTMMDCITGKTRPDSGIALFDGTHDLLRSDEPAIADLGIGRKFQKPTVFESHTVADNILLALKGPRAAFASLFGWRNRVEAARIDALLETVGLLPHRGRPAADLSHGQKQWLEIGMLLAQDPKLLLVDEPVAGMTDAETAETARLLRRIAGEHAVLVVEHDMHFVRDLGCRVTCLHEGAVLAEGSIDAVSADPRVVEVYLGR

SEQ ID NO: 972 - protein, 233 aa, Methylobacterium sp.
MTMLAVDGIDLYYGAAQALRGVSLTAEAGQVTTVLGRNGVGKTSLLRAIVGQQPVRSGAIRLDGRPIQGLAPYDRARAGIAFVPQGREIFPLLTVKENLETGFAPLKRRDRHIPGEIYDLFPVLKDMLHRRGGDLSGGQQQQLAIGRALVTRPKLLVLDEPTEGIQPSIIKDIGRAITYLRGKGEMGIVLVEQYFEWARDLCDSYAVMDRGQVVLAGPRAGMVEADVLRWMSV

SEQ ID NO: 973 - protein, 86 aa, Methylobacterium sp.
MEQAMTAHEPEPLDEFTRLHAKLSALEIVLGVLIGRLSEENPEIREDVKRDVAAILSDLPIDGPSEEMIAAEVRRAAEVLTSVSIG

SEQ ID NO: 974 - protein, 238 aa, Methylobacterium sp.
VLAVPDATRKGNQAYDLMRREIVACRLLPGTRFTEAEVMERFEIGKASCRIALQRLAQEGFVSSMPRHGYRVSPVTVKDVDEVFALRMELEPLAARGAAGRVNRAHLERLEQACRRKITVEMGNQIDFFLEANRGFHLAIAAASGNGRLYRTLSGLLDEMTRLVALGFGVQGVRPNIENDHTAMIEHLVAGDADSAALVARRHVETFRDMTLEKVIASLRDTAVVAPVRPARVDGGEP

SEQ ID NO: 975 - protein, 399 aa, Methylobacterium sp.
MARRKAPRIPDAILDQLLAGADPKTAFEADGLLDELKKALAERALNAEMDHHLAGEDAGNTRNGYGRKTVTTETGRIELAIPRDRQATFDPQLIAWYQRRFPGFDDKIVSMYARGMSTREIVAHLRELYGIEVSPDLISAVTDAVLEEVAAWQARPLEPVYPIVFFDALRIKVRDEGVVRNKAVHIALGVRADGSKEILGLWLEQNEGAKFWLRVMNELRNRGVEDVLLAVVDGLKGFPDAIRAVFPEALVQTCIVHLLRHSLDFVSYKDRKLVAGALKDIYRALDAAAGEAALAAFEASEWGRRYPAIAQSWRRAWGEVIPFYAFPGEVRRILYTTDEMDKTHRAFRGSFLRARATSWRSAGPRLQAPPGRLHSSLADLRRPRTVFDGRGVQCATTRS

SEQ ID NO: 976 - protein, 406 aa, Methylobacterium sp.
MARRKAPRIPDAILDQLLAGADPKTAFEADGLLDELKKALAERALNAEMDHHLAGEEAGNTRNGYGRKTVTTETGRIELSIPRDRQATFDPQLIARYQRRFPGFDDKIVSMYARGMSTREIVAHLRELYGIEVSPDLISAVTDAVLEEVAAWQARPLEPVYPIVFFDALRIKVRDEGVVRNKAVHIALGVRADGSKEILGLWLEQNEGAKFWLRVMNELKNRGVEDVLLAVVDGLKGFPDAIRAVFPEALVQTCIVHLLRHSLDFVSYKDRKLVAGALKDIYRALDAAAGEAALAAFETSEWGRRYPAIAQSWRRAWGEVIPFYAFPGEVRRILYTTNAIEALNATLRRAVRARGHFPTDEAALKLLYLVLNRSEKAWKMGPREWVMAKAQFAVIFGERFTRAMAA

SEQ ID NO: 977 - protein, 406 aa, Methylobacterium sp.; identical to SEQ ID NO: 976

SEQ ID NO: 978 - protein, 406 aa, Methylobacterium sp.; identical to SEQ ID NO: 976

SEQ ID NO: 979 - protein, 216 aa, Methylobacterium sp.
VSVIVLTPATATALTTVANVRSDLGLAEGMPPDAQITRFIKQASSRVATYCRRAFGRQTVRQRFSGCRGVVDVGGGLLLDRSPVVQILGVTADGVELAPDAFEADDRFLYALHSGDRTPWTARSVVVDYEAGWLLPSETRGDPAATAAADLPDDVERAVIQLVGVAVSIAGRDAMVKSESTEGVGSVDWYVQGSTASLPHPEAEAALRDYRRVLFA

SEQ ID NO: 980 - protein, 75 aa, Methylobacterium sp.
MTPSDLDRRAELTIWPKGAPARAAEGRPFATLREALAVAIAAMESGEAQPWIITEAGDILSPRWIQANSRPRAPH

SEQ ID NO: 981 - protein, 131 aa, Methylobacterium sp.
MSAATRRAALGAILAAPLTGGAVMALPSNRMPAAPPTNLAKACDWAVAHVAWVNQNDEPVDAWPDERLEAELARFDDVLHRVADEPATGLSDLAAKARILRCDWEAALGGHDLHPGERALLTFLKEVSACA

SEQ ID NO: 982 - protein, 204 aa, Methylobacterium sp.
MSFRASLKHLIRRHPASSLRDRADELRGALPSRRAVVAGSMAAVVPLSGGAAAQTRETTEYADHRDRLLAAYAEDRACRSIDGEARVGSLEDVACTLVVRRCWAIADEIGALPPPRTLDGLAVIALAATIPWEVSHPETMSERAAVALIRSILAMTGTELPPRFSGFGDEPDAAERDAALYTASGTLPAWAIAEAKADYDFDDA

SEQ ID NO: 983 - protein, 187 aa, Methylobacterium sp.
MRFDACWDPACGEGHMFEVLLEYFGGGGWGSDIFDYGRGYRVEDFLDEGTVIGSPEDGMAPEFIITNPPFRPATAFTLRALTLAPVVAMLLRTVWVEGVQRYETLFRDRPPTLLAPFVERVPMTKGRWDPDAGTATSYAWFVWVRGRDPHAPFWIPPGCRQRLTKPTDRTRFAVQTATPLFDLAAAE

SEQ ID NO: 984 - protein, 1763 aa, Methylobacterium sp.
MVAVNQIAVNETRFVYTTEGVDRVRAQNEQVASSLDKVTSASGKATDAEGKAASSSDKAAQARAKLAAVQERFQRQMQAEAQILGMAQSQQDALTAATERFADAQSQAARSASALQSAANDNTGALERQGEAFKAAGKFALEHPIIVAAASVAAARALSGFAATAAGSLATASAVTARYAATSTEMGTTVAAGAALASRGLSGLSTGAAAAAVGLETFATKAAGLTTTTSLLSRALSLVPAYFLPIAAAFAVFELASAAIKKAYADLNQLVQLGEKAQSLDIGAPFLKSFEAIAPKIQATKDQIDAAIGKASSFLKDSWGSGNGLSKLFNDISSTGVAGAGGLQATALSDTATSIQERIQAALAGMKELDELGLHLASIQVGEKVFGPEFVERLRVSNTSAEQLSAALQAAAEKEVLKQEQVDRALALNRQISDTKQAISEAWAVTVDFSAAALLLNEAWLKILQAVQWVVETINSAISAVGNFASAVASGIGGAFDAVSNKVSGLLTQMGVLSAQQKVVASETPKIDGTYGPQQPTITARQFPYVFGPEAPKAAAAAAKQSKQAAQEAVSSYDNLIQRTKDRIEELDLETQSVGKSSEAVIKLKLAHDLERAAKKDGITVTAEMRAETDRLGTSLAASTENLANAKRQLELTREAQRELGDTFGTFAEDVILGGQKMSEAFAGLAKTLASSSLKALLTGQGGLAGLFGTAGEKSSDLGGLLGGKISFGSLFGGGSSNDAGSPLPGAQGPSLPSSSLFGGLFDGEKITKALGLGAESGIGNALSNALKPKGNGGILSSPLGGAIASVGAGAAIGYSSQSPLMGALGGGLAGLASGNPLLAVAGAGAGLLGGLFGQSEAKKQAKRQLQQELQARREALDQARPQIEQLALTFEGGSIGNIGKTISDALSQAKQAIKTASDGGDQALADKLMKDYQSYVARLTAVFAEGFNGVAAEMQAGFGAGGPFSQAISSVQQLGEVLKGFVTDAGRLSPAAVAAAQTAAVTGALAALQPPPNLSATQTELARINGTATGLNQVLKDLGLSADQAAAAIKDGTNKALDALRTKFSDDLGRKINDALNKGYLNDAADLVKEVASLSQDASAIGGDLGQVDTYFTAAAQKIVDGSQLAGSAFDELITKFPELAGKVHEFSETASMSADQAAKAAQEALSAIQDRMRGYEDRYVAATFETESLPGKLLAFDRAAEWERWQEGAKGNQAIVELERAQGAERLKIINDFAKAATEALNARLKGYADRLFNAGNDTSTLGGQLAAYDRQAQQEREDEAKAGGQALVQLEMTQAAERAKIVADYAKQAADALKQQMSAAQTAFETFVKNIKTYLDNLRSGGSSPLSPKDRLAAAQSQYDAQLALAQGGDRTALDNITQYSDALLAASKGYNASGEGYQATYQKILDDLAKLPTQVSAEQFIVDAINDSRDAIVSATDAMKLELKEGLIANSPQLIAAALLQYFNMLDTSVNGLLDYSEFTAGLGPLATEAEQQQARAIFNAIDANGDGQLSKLELQNASSYRLEQYTASTDANTDQANNIGNAQKATMDNQAAYLNSINNLTNAAYATQQQLVSLNASINSQNAFIQQNTGFTNSYLATQGQYFGDTYLLQGQILNNLRSANAKNGAPVYATGGWVSGPGTGTSDSISARLSNGEFVVNAASARLNGPLLEALNDNRPFAMPTIGVPAGGGRDDAALIAELRALRAEVARLTQLADEGNSIAAEGHSGTRAAVGRNTAALETGNTVASRKSLERPVKAA

SEQ ID NO: 985 - protein, 421 aa, Methylobacterium sp.
MTPGAPSAKILVVDDEPDLEALITQKFRRQIRQGLVTFLFAHDGQEALDRLAESRDVDLVVSDINMPRMDGLTLLAKLQELAERPSIIIVSAYGDMANIRTAMNRGAFDFLTKPIDFADLETTIERTLRHVEDLREGRRRQSLAERAHASLARYFSPNLAERLAGDASGLELGGHRRDVASLFTDIAGFTGLVESLDPAQLAEILNGYFAEMTDVVFAHEGTVAKIVGDALHVLFGAPGDQPDHAARAVACALALDEAAEGFRGRWRERGIEIGVTRIGVHAGPAIVGNFGGGRYFDYTAYGDTINTAARLENANKAFGTRICVSDAVVIRAGQFRGRPLGDLLLRGKQTALRAYEPLTEAAYGDALLAQYQDAYAKLDAGEAGALAAFAALVGLRPDDGVAAFHLKRLLNGGSGSRVEVR

SEQ ID NO: 986 - protein, 391 aa, Methylobacterium sp.
MPACDATDPAALRGSDDRTATQQRLSTRLLFLIVGLANATWAPLVPLVKDRAGLDAAGLGLLLLTFGIGSILTMPSAGAAAARLGFRPVLLAGTLALGLALPVLAVASGLVTLTLGLLLFGAGMGAVDCVMNLQAVAVERRSGHPMMSGFHGLYSLGCILGALIASGLLAAGLGAGWSVLILVAGIAALFAAAWPGILPTDRGGTRGPAFALPRGPVLVLGLLCFVVFLTEGSALDWSAVFLIQQRGLDPAWAALGYAAFSVTMTAGRLAGDRVVARLGRRSVVVLGGLLAAVGLTLSVLVPAWEAALAGYALVGAGCANIVPVLFTAAGRQRAMPESVAVPAVTTLGYAGVLAGPALIGFAAQALGLPAALLIVAALLVGVAAAGRSLRV

SEQ ID NO: 987 - protein, 563 aa, Methylobacterium sp.
MSALLVTLSATTVAAVLALPRAAERLQLSRAKHRSLTGHARMARRVAGLIPNYAYSERAFFRSDDPDEAVARRREAGFARLSDLFRARFARTRAETEAVRDGLSDLQFTGLYRVPFQYARHVRAHLGTGAFAAAAAGVTVTDLDSNVFYDLAGSYGVNLFGVDFYRACLEEGAARVSALGPVLGPLHPVVTGNVARLKAISGLDEVSFHMSGTEAVMQAVRLARYHTGRRRIVRLCGAYHGWWGEVQPGIGNPVPTRDTLTLADMSERTLRVLASRRDVACVLVNPLQAMHPNAGAPADSALVDSGRRASFDRAAYTKWLHDLRAVCSARGIVLILDEVFLGFRLARGGAQAYFGLRADMVTYGKTLGGGLPVGVLCGRADLMRRYREDRPVDICFARGTFNAHPYVMGAMGAFLDRLDSPAVAALYADLDATWDARARHLNARLAEAGLPVRVANMSTVWTVLYTEPSRYNWMLQFYLRAEGLALSWVGTGRMIFSLAYDDAAFEAVATRFEAAARAMRADGWWDGGAPSDRAIRRSILREVAAIRLGGLGARLGLRAPDQG

SEQ ID NO: 988 - protein, 301 aa, Methylobacterium sp.
MAARLALLGLGAMGHPIARNLAAKRGSDAETLVAIDTDPARLAGLAAPGLVATTDPGQAAGADVLFLCLPNGDAVEAALLGDGALAERLAPGAVVVDLSTIAHAKALTVGRAVAATGRAFVDAPVSGAPAGAEAGTLTVMCGGAAGAVARVRPLLERIGTTILHMGPAGSGQLTKTINNVLYDINIAALAEVLPMAVAMGLDPDQVAQVVTTGTSRSYAAQYFVPRILRGQFDEGYPMGAAYKDLVAAAAVAAENGFPMPVTAAATATYQTALRRGHGDRDKGAMVLPFEDLLGVRVRSRR

SEQ ID NO: 989 - protein, 295 aa, Methylobacterium sp.
MASTTVITCALTGSFDTPRKNPAVPVSPEAIAQSALEAAAAGAAVVHIHVRDPETAAPSMELAHYREVVERIREKNDAVILNLTTGAGGRFVPGDPDPSVAGPGTTFVGPEARTRHVGALRPEICTLDIATMNFGEHLFLNTPGHLRAMAGHIRDAGVKPEIEVFDLGQIELARHLIAEGHLARPPLFQICLGIPWGAPATPEALVAMRARLPEDAVWSAFGIGREEFPILAVAAGMGGNVRVGLEDNLYLSRGTLAPSNAALVEKAVSLLAHIDREPATPDQARAIFGLTPRGG

SEQ ID NO: 990 - protein, 316 aa, Methylobacterium sp.
MGEIAIVGGGVMGHGIALVLALAGHGVRITDTRPETRARIPGLMESALATLREAGAAPEGWDAARLARAVRVEAALDAAVSGAGLVIEAITENPEAKRALFSELDRLCPADTILASNTSYLDVFPLIPEARQARALILHWYTPPYIVDLVDVVPGPGTDPAVVAAMAEFVRGLGQVPIVLKRFIPGYVANRIQQAISAEVFRLLDEDVAAPKDIDDAIVHGLALRIPILGHLAKADFTGLELTQRALANGSYAPPPPRTRSETLDALCAAGRTGVMAGRGYFDWGGRAPEELFRERDRKLLALKAAMAGIGRMEGS

SEQ ID NO: 991 - protein, 389 aa, Methylobacterium sp.
MTRACIVGWAHTPFGKLEEPDVEGLIARVSGEALAHAGVEESQVDGIYVGSMNTGFSKQGFEGSLVAVNRPGLAHAPATHLENACATGSAALYAALDFVDSGRGRVALVIGAEKMTAKTVAETGDILLGASYRKEEADIEGGFAGVFGRIAAGYFQRYGDRSEELARIAAKNHRNGVGNPYAQLRKDLGFDFCNRVSEKNPYVAAPLRRTDCSLISDGAAALVVADAETAEGLERAIGFRARAHVNDILPLSRRDPAEFKGARLAWEKARAQAGIANEDLSFVETHDCFTIAELIEYEAMGLAAPGEGYRVVREGFAEKGGRLPINPSGGLKAKGHPVGATGVSMHVMACLQLMGEAGEMQVPGAELAGIFNMGGAAVANYVSILERRR

SEQ ID NO: 992 - protein, 255 aa, Methylobacterium sp.
MDLGIAGLRVLVTAGAAGIGREIVDAFLDEGARVFACDIDAEALAALPDTVGRSRTDVADRDAVTAMMDQAVEFLGGLDVLVNNAGIAGPTGRVEEIAPEEWDRCLTVCLTSQFNCARLAVPHLRQSANASIVNLSSAAGKFGFALRSPYAAAKWGVIGFTKSLAIELGNAGIRVNAILPGLVAGDRQRRVLESKAQQQGTSFADMEARAFSFVSVKEYVTARQLADQILLLCSPRGRTISGQAISIDGDTRMLS

SEQ ID NO: 993 - protein, 233 aa, Methylobacterium sp.
LALADLPQLERRTLSDTVYEALSDLLASGRLAPGDRLSLRQSAAALGVSVMPVREAVSRLAADGVLEVAPNRVIRVPVMGAAAFRALVETRIAVEGIAVARAAERRTGAELAAIRSAEAAFRAEAEAAEPDRARAVQLNRDLHFAIYGACGLGPLQEIIARLWLKAGPVINLDLRAHPERLLQGFALRRHAEAVAAIEIRDGAAAAAAIAADIREAAEFILTRGGLRDVQGED

SEQ ID NO: 994 - protein, 458 aa, Methylobacterium sp.
MMPMTDTAFLDRLAAIVGPSGLVTGAELRGRSANWTRPTEPCAALALVRPRSTEETSAVMAACRAAGVAVVPRGGATGLVDGTLCQPDEITLSTERMTGIEPVDPLGMTVVVGTGATLESVQDAASAAGLFFPLDLGARGSATIGGAISTNAGGLRVLRYGMMREMVLGLEAVLADGTVVSSMRPLIKNNTGLDLKQLFLGTEGTMGIVTRAVIRLRPEPAGYATALIACPGVDDGARVLRAAQSAFQGRVSSFEGLWPDFYRLMTAPGRATAPLGPDYPFYAIIEVECVPEESDRFLSLLEGLMGDGTILDAVVAASEEQRRGMWRIRDRVEHLNADGIDRAFDVSVPLARMDGYVRGALDRLAAIPGCRAVVYGHIGDNNLHWNTTRLDAAGNAAIDAAIYEPLAELNGSVSAEHGIGLEKRAKLKLSRSPEEIAVMRLLKRALDPDNRLNPGKIF

SEQ ID NO: 995 - protein, 397 aa, Methylobacterium sp.
MSLSGLTARKILPADGCRGALVGRVWRPDVAGPSVVAIRADADGTARIVDVTAAFPTVSDLCEARDPAAALRGAQGEDLGSLDAVLANTPPDARDATKPWLLAPVDLQALKAAGVTFATSMLERVIEERARGDLAAAAAIRAEVERLVGHDLRRLKPGSPEAMALKEVLVAQGAWSQYLEVGIGPDAEIFTKAQPLSAVGCGADAGLHPDSHWNNPEPEVALAVASDQRIVGATLANDVNLRDFEGRSALLLGKAKDNNASCAVGPFLRLFDDTFGLDDVRRTTVTLEVTGTDGFRLEGTSPLSEISRDPEELAEALMGRTHDYPDGALLLLGTMFAPIQDRHGPGLGFTHADGDRVVVASPELGSLVNRMRPCDACEPWTFGARALMRNLAARGIL

SEQ ID NO: 996 - protein, 353 aa, Methylobacterium sp.
MASVGIREVRKAFGSTNVLHGVSVDIRDGEFVILVGPSGCGKSTLLRMIAGLENISGGEIRIGERVVNDVPPKERDIAMVFQNYALYPHLTVRENMAFSMRIRKAPASEIDLRVNKAAQILGLAPLLDRYPRQLSGGQRQRVAMGRAIVRDPQVFLFDEPLSNLDAKLRVAMRTEIKELHQRLKTTTIYVTHDQIEAMTMADRIVVMHDGVVEQIGPPLELYDRPDNLFVAGFIGSPAMNFMPGKVRANGRLTFTTETGLSIPLADAPSGVDGRPLILGVRPEHFDLAPEGIAAEVVVVEPTGSETMLAVRAGGQDLTCVLRERVRERPGETISLRPNRVHFFDAETGRRLPN

SEQ ID NO: 997 - protein, 436 aa, Methylobacterium sp.
MSVLDRRSLLAGAAATGLAAGGDLFGFAKAWAQNAEWKPEPGASLSLLRWKRFVPAEDEAFMKLVDAFTKATGVKVTVTNESFDDIQPKASVAANTGQGPDMVWGLFSFPALFPDKCLPLEDVAESLGKKYGPWFPSAEAYGKVKGKWIAIPVAFNGGYPNYRISAMKKAGFDKFPTDTAGFLELCRGLKKNNTPAGFALGHATGDGNTWCHWALWSHGGNLVDANEKIVINSPETAKALEYVKSLYETFVPGTVSWNDSSNNKAFLAGDLYLTNNGISIYAAAKKDNPKLAEDMDHAVWPIGPVGKPTEFQLAFPILAFKYSKAPNACKAFIAFMMEASNYNPWLEAAQGYLCEPLSNYPKNPIWTSDPKNAVFAEAGRRSLAAGGLAPVSERIAAVLADFVIVDMFASHCTGREDVKGAIKNAERAATRIFRNT

SEQ ID NO: 998 - protein, 318 aa, Methylobacterium sp.
MANTALTQPAPAAIPTRSAWQRVRASRGWAGFWFMLPTALILGLFLAYPLLKGIWLSFTNARIGREGVFVGLENYEWLWDDDVFWLSVFNTCLYTAVASVVKFGVGLYLALLLNKNMPFKSIIRSIVLIPFVVPTVLSAIAFWWIFDSQFSIISWSLRHLGMINGNIDFLGEPAMARACVIFANIWRGVPFIAITLLAGLQTVSPSLYEAATLDGASNWQIFSRITLPLLTPIIAVVMTFSVLFTFTDFQLIWAMTRGGPVNATHLMATLSYQRGILSGTLGEGAAIATAMVPFLLAAIGISWFGLQRRAWQSGGNDR

SEQ ID NO: 999 - protein, 295 aa, Methylobacterium sp.
LEARPAGLTDNSEGMAYLERLPRRLVTTYLPLLLILAVLLFPFYWMALTAIKPDEQLIDMERFNPFWVVDPTLKHINKLLFETQYPRWLWNTMYVSVAATVLSLFASVLAAYACVRVRYRGAGWVGAAIFLAYLVPPSILFIPLATIIQAYGLFDSPIALILAYPTILIPFSTWLLMGYFKTIPYELEECALMDGASRWQILTKIILPLAFPGLISAGIFSLTLCWNEFIYALTFLSSTQNKTVPIAVVSEFVDGDVYKWGSLMAGALLGSLPLVILYSFFVEYYVSALTGAVKE

SEQ ID NO: 1000 - protein, 500 aa, Methylobacterium sp.
MSGNRGASGGPGRENAMSMNRRSLIGAAGLALTAPALQGAQAAEAAKPAAKAAPPHVTKILAQWILGSSYDTLPEPVRREGVRSFLNWVGVAIGGSHHETVDVAVSALQPFSGPPQAGLFGRTERFDIMNAAFLNGVSSHIFDFDDTHLKTIIHPAGPVASAILAYAAMKPVSGKDFLDALVVGIEAECRIGNAVYPNHYDAGWHITGTAGVFGSAAAAGKLMGLTEQQMVYALGLAASQPVGLRESFGSMNKSFNPGRAASNGLFAAILAAKGFTSSDGMIEAKRGWANTISTKQDWSQITDGLGTRYEAQLNTYKPFACGIVMHPTIDAAIQIRDQDRVKPEDIQRVDLKVHPLVLELTGKTAPKTGLEGKFSIYHAAAVAFVEGAGGEKQFSDRAVNDPRVVALRQKVVPVITPGVDPAQVDMTVTLNDGRTFHRHIEHAIGSVEKPMSDAQLEAKFTDLAAGILPDAQAKRVMQLCWSLPELKDAGDVARAGVAGA

SEQ ID NO: 1001 - protein, 274 aa, Methylobacterium sp.
MTEPISAAAHARTILAAHEHRRPIAPLTDWDPALDLPAAYRVAEAVRVLRGERGERPVGYKIGFTNTTLWERYGVRAPIWGHVYDTTLRDRAALSGPVPLAAFVEPRIEPEIVFGLARAPEPGMDAEALIACLDWAASGFEIVQSLYPGWRFAAPDTVAAFGLHGLLVVGERVRIAADARSVWLGELAGFTVELLRDGAVADRGGGGCVLGTGPLAALAHLVDALANDPVAPPLAAGTVVTTGTLTDALPVASGQRWRTSLDGLRLPGIDLALI

SEQ ID NO: 1002 - protein, 313 aa, Methylobacterium sp.
MAKDGFARAYARVRVYEGGNVDDPRDPGGRTSRGVTQRVYTAWLRRQGLPSADVWTATDAQIQAIYRALYWDKAACDELPAGVDFVVFDAAINSGVGQSVRWLQRSLNGYPGAVDGAIGDVTLHAVGQDEDNDALIARICAARLGTLRGLKTWRTYGKGWSARIANAQKIGQGWASGSVGPAPVAVDQVGGHRKAVVSPETITRPLLSTASTTVVTSASAVAAPVSEIGQQLEVMRDWFSWMPYVLGGLAVVAGVAGIIVKYGHAVADKVQAGSATQAVDVSADEDLPAVAVDDAVAPEAPAAAPPAAAAEAA

SEQ ID NO: 1003 - protein, 400 aa, Methylobacterium sp.
RIDPALPDRKPLPRPDLRLRRIAVGPVAVFGASNFPLAFSVAGGDTASALAAGCPVVVKAHPAHPGTSELVGRAVQKAVAACGLPEGTFSLLFDAGQSIGQGLVADPRIAAVGFTGSRRGGTALMAIAAGRPSPIPVYAEMSSINPVLLFPGALAARGAAIGKAFAASLTLGAGQFCTNPGLILALPGPGLDAFLEAAGAALRESPAATMLTPGIQRAYREAVARVAGHAAVTRIAEGAEGAATQGRATLFAADSDVFLADPELQEEMFGASGLVVRCADFAAMRAVLERLEGQLTASLHLAPEDHAAARDLLPLLERRVGRILVDGFGTGVEVAHAMVHGGPYPATSDGRTTSVGSLAIDRFLRPVSYQDVPDALLPAALQAANPLGLPRRIDGTPERR

SEQ ID NO: 1004 - protein, 1039 aa, Methylobacterium sp.
VFVVGSSEKAGLAGAAQSLARPLTRRLKGRRRAEPRQADLVRAVKESGLFDPAWYARRYPDVVGEGIDPAVHYAVHGGREGRWPHPLFHGDLYLDSVPGLRAEGTNPLLHYLDRGAAAGIRPNPLFDPDWYATRYLGGAEHRARAFADFLSRGDTDPSPQFDTAWYLSRYPDARAAGGNALSHFFETGRKQGYLRNPEEFAGLSRHVDLIRRSGLFDAAFYRERCPEAETSGLEPLEHYVMAGGYRRYAPHPLFDPDWYAAQSAAVRADSLNPLVHYLEHGAAEGLDPGPWFATRWYTETFLAGDAAGQNPLAHFLADGGRTTSPSPRFDAPWYRARYPKVATLGLNPLIDYVTTGLEAGRLTRRVPGAAVPEASDARLSCLKREPRRHGRTALFITHCPEGRIRGHVEPYLRAFAENGTDLVLIIAADQHKNAVPQAILDLCASVYLRENSGFDFAAWAHVLLEDTDLLDSETLYLANDSLVGPLDRDDFAGLLAKIDAFPEAVIGLADNFYYSHHLQSFFLALKRRCLSSYAFNHFLLSVANWPDKNAVITEYELTFSQRMRAAGLGMRSLFSAQNKHMSLVNDPRNNRTLFDWENMLSQGFPFVKRSLLGEHAAIGGAAVREAIAERGFDLDRLDVTYTYPGARIWADLRRPRAPERPLRVAYVSPMNYANGLGVAARSYARALHRTPFALNVHPMERPFHVHARVAPAWQARTFSGPADVALVHFNGDSWHSLMSDRQRAIAAQARLKIGLFVWETSHVPGGWLPTVDGLDAIWAPTEFCAAIFRQITDIPVDVVPYVVENEAGEPVSAAAKANLRKAFAIDPSRRVILYAFDGSSYLARKNPHALIRAFRAAGLGQAGWQLVLKTKHVFDLPEEGKKLLDLVGTSGDVVVIDQPLSQNELGALFDLCAVYASSHSSEGFGLTIAEAMEMGKVVVATDYGGCRDFLDATCGFPVKAEVTALDQTYGPYLRGAEWGQVDEADLTRALNDAARAVTGGDAARIGAAARARIRERLSIGAVARAMEASLTRLLAAERS

SEQ ID NO: 1005 - protein, 266 aa, Methylobacterium sp.
MSAATQSTVADRDAAPADHAAIRAMRVDLAAAYRLIHRLGLDDSIYTHISARLPGAGHRFLINPYGMRFEEVTPENLVTVDIDGKVLEDPMGLGINPAGFTIHSAIHAARHDAICVLHTHTVAGVAVSCQEEGLLPLNQWSMQFTGRVAYHAYEGIALDLDERQRLVADLGDKPVMVLRNHGLLTCGRTVGEAFRLMHNMERSCRAQLAIQAAGAPVIRPSSAIATKTAGQYAAGYDRVVVQGAPDNEWAAFKRMLARTDPDFARA

SEQ ID NO: 1006 - protein, 259 aa, Methylobacterium sp.
MDLGLSGRRALVCAASKGLGKGCALALAREGVAVTITARTAETLERTAEEIRAATGVTVTAVAGDIATEAGRAAALAACPEPDILVNNAGGPPPGDFREWDRDAWIRALDANMLAPIALIKATVDGMIDRGFGRIVNITSGAVKAPIEHLGLSNGARSGLTGFVAGLARKTVRHGVTINNLLPGPFDTDRIRSNAAAGAAKAGTSVEAFLEARARDNPAGRFGHPDEFGAACAFLCSQQAGFITGQNLLMDGGAYPGTF

SEQ ID NO: 1007 - protein, 406 aa, Methylobacterium sp.
MADTLVSAAPVDLAAALSARIRGIGTSQIGLVADRGRDDPEVVKLWIGEGDLPTPPFIVEAAHRAMLAGHTRYTTSLGLPALRAALGAYHARHWGVEIPPDRFGVTAGGMNAIMQAAQVLLEPGDEMIIPSPAWPNLGEAVRIAGGVPVTVPYRRLPDGRFALPLADIAAAITPRTRVIMVNSPSNPTGWTMPRAEMTALRDLARERGLWILSDEVYAHFTYGNRIAPSFLQICTEDDRLIVTNTFSKNWAMTGWRAGWVIYPRGLAPTFAKLGQYSTTSIPTFVQHACIAALEEGDGFIRTMVDRCAEARAILVEGLSRLPGVTVAPPDGAFYLMARMGGDEPSLDLALRLLREAKVGVAPGTAFGPEGEGLVRMCFAISPDLAREAVRRLAGVLGTRLPAAAAH

SEQ ID NO: 1008 - protein, 218 aa, Methylobacterium sp.
LRHKTVAAAVADSLREQILNGELPPGVQLRQDALAEEFGISRIPVREALLQLEASKLVRIVPHRGAVVTGLSLQEVEDIFQLRVQLEPELLLLSAPHLTPDDIRDLDALSKEYGAALETGQVLRWGDLNSRFHLDLIRHAGRPRSLAIVSALLQDCERPTRLQIATSEDATRAVSEHAQILALCEDRAFEAAAACLRRHIEHVGASLIALYRGALAEA

SEQ ID NO: 1009 - protein, 201 aa, Methylobacterium sp.
MANGVSARRYSAVAILLHWTSALGVLVLIGLGLTMTHAALAPLRQFQLYQWHKSVGITVLALTALRVLWRLTHRPPPHPAGMPVRERRAAAAAHHLLYLLLVGLPLTGWAVVSLSPFNIPTVLYGIVPWPHLPLAALVPDPAVAEAVLKRVHALGAWFLAALLTVHVAAALRHHLLLRDDVLRRMLPGHRPSPTPTVEPTR

SEQ ID NO: 1010 - protein, 367 aa, Methylobacterium sp.
MPAVAESPQNARRNAAMTPAPTFTPDIAARFAAVALGHVGREYPNKPGHVLAGPADARTPAALHPAFHGSYDWHSCVHGTWLLARVLRLFPDGPQAPAIRARLDAQLTPATVAGECAYFAAPTARGFERPYGWGWLLKLADALAALPERRWSEALAPLAAVIVRRFAEFLPVASYPVRVGTHFNTAFALRLAADYAEGAGDAGLTTLLHDTAVGWYGEDADCPAWGEPGGDDFLSSALIEAECMRRLLPPARFAPWFDRFLPGLAASRPATLFRPAGVTDRSDGKIAHLDGLNLSRAWCFRALAASLGPDDPRRPPLRAAAEAHLAAGLPHVTGDYMGEHWLATFALLALEAGAETGAAGDAQDGGK

SEQ ID NO: 1011 - protein, 408 aa, Methylobacterium sp.
MRAIMLGLGLLLGAGPALAGEAAQLGPRPFYLVDQLKPGPLKDRLAACGVDRTYTPRTFSISHRGAPLMFPEHTREGLLAAYRMGAGIIECDVAFTKDRQLVCRHSQCDLHTTTDILARPELAAKCTQGFTPADPATGRKASAKCCTSDLTLDEFKSLNGKMDASDPDATTVAAYMNATPRWRTDLYAGTGTLMSHKEYIALVKGMGRKFTPELKAPQVPMPFQGTYTQDMYAQQLVDEYKEAGIPASDVYPQSFQLRDILYWLEKDPEFGRQAVFLDDRDETAQGFDPEKPATWQPGMAELARKGVKILAPPLWMLVRPGPDGTIEPSTYAREAKAAGLGLIAWSLERSGPLKGGGGYYYQSIKPVVTGDGDILRLLDVLHGQVGVLGVFSDWPATTTFYANCVGAP

SEQ ID NO: 1012 - protein, 417 aa, Methylobacterium sp.
MLSEDVHDRDGSRADETVTDRRHGDARRAATKPAKKRSGAAGLILLLLAVAGGGAYGYTRLNQPAVKSRAAAPLPVPVTLGTVEQGPFALVSNGLGTVQAYNTVQVRTRVDGEIQQVAFREGQTVRKGDVLVQIDPRPYQAALDQAKAKKEQDTANLGNAKADLVRYTGLGAFASRQQTETQTALVAQLTAQVASDQAAIDNASTQLGYATIRAPIDGVTGFRQVDIGNIVNAAGQTPIVTITQVEPIFVVFTAPEDQLPAITAALKAGDVPVEAWTSDGQTKLADGKLALFNNQVDTATGTIRLKAVYENRNHALWPGLSVSTKMRVGTVAVATTVPDDAIQHGPDGLFAFVVDDASRAHQRALKAGRSDSGRTRVLSGDLRPGERVIVAGQYKVQDGSLVADPHAAHTAQAEAVQ

SEQ ID NO: 1013 - protein, 79 aa, Methylobacterium sp.
MKTFFVQIKCEIGKTYAVSDALVAMEIASEIYSTAGRFDIMAKFHVDNGVDIGLFVNDFLLRLDGVKDSETIIAFKAFH

SEQ ID NO: 1014 - protein, 412 aa, Methylobacterium sp.
MDARRSDSFKSADPVAGAPVTAPTIAAVTPPVSAPIPATVSASAPRRRRARIVLPLLGLLALGGAGTYGWHWWSVGRFLEVTDDAYLQSDKVTVAPRIAGTVAEVLVGDNQPVKAGDVIARLDDRSYRVQLKQAEAEVEKDRAQILGVASAIVQQRAQVASSRADLANAEAALTFAQQEYTRYQNLLQTGSGTVQRQQQAESDLRQRHAARDKAAASLDAAQKQIDSLQALEASTRASLEGAQAKVEGVRLDLSYTTILAPIDGVAGDRALRIGQVVSAGTGLLTLVPMGRDIYLVANFKETQTGRMVEGQRVTFTVDAFGDHTFRGRIESFSPGTGSQFALLPPENATGNFTKVVQRVPVRVALDPSDPLIARLRPGLSVEATVHTQDPVEPVRPARPRPAPALVSEALPR

SEQ ID NO: 1015 - protein, 319 aa, Methylobacterium sp.
MGAYILRRLLIAIPSLLGISLILFTVLALAPGDPFGELASNPNVPPEVRAALRVKFGLDDPILTRYLHWLTAMLQGDWGFSFASRVNVDTLILQRLPTTLFVVGSSQVLALLIAIPMGLYAARRPYSLADQVANTLAFVGFSLPTFFTGLLFILLFSIKLGWLPFVYQADLPGSGLPWVWANVRQAIMPVAVLGFFQAASYTRYVRASALDVARLDYVTTARAKGLPEGTVTRRHIARNALIPVVTLVALQIPAVFGGAIVTEQIFRIPGIGSLLIDAMLANDTPVVMAVTFVFAGLVILFNLVADLLYGWLDPRIALR

SEQ ID NO: 1016 - protein, 310 aa, Methylobacterium sp.
MAGSTLASPSDEAPALARAPASPGRETWRRFRRHRLALASVGVLALLVAGVVFGGLLWPVAIDDIDFAAQLQGPSWDHPFGTDDLGQDLLARMIYGGRVSLAVGFAAMAVASLIGVLVGALAGMSRRFLDPVLMWLTDLFLSLPQLPLLLLVIYLFRDSLKAVFGSQGGVFLMIVAVIGGLRWMPVARLVRAQFLSLREKEFVEAARSQGATTGHLVRRHILPNALGPVIVAASIEVSSAIIAESTLSFLGLGFPPDIPTWGRLLFDAKDHLDVAPHWALFPGGAIFLTVLSINFIGDGLRDALDPRRVL

SEQ ID NO: 1017 - protein, 292 aa, Methylobacterium sp.
MSAPGLLSRRALLAAVAAGALAPRAAAAQAATRIAALGGAVTEILYRLGAGGRIVAVDTTSLYPPEALREKPSVGYLRALSAEGLLAQQPDLIIAAEGAGPPAVLAQLREAGLRVETVTEPPNPEGVLDKIETVGRLAGLEREAEALETDVRARFADLATRRARIARAARALVVLSIQGGRTVVGGTGSSADGILALAGIANAAAGLEGFKPMTDEAIVAAAPDAVVMMQNGPEPPKPESIFAPGTALGQTPAGARGRLVAMDGLYLLGFGPRTPEAATDLMRALYPDLPRD

SEQ ID NO: 1018 - protein, 274 aa, Methylobacterium sp.
MYDPTLLTARDLTVTVAGRDLVRDVSLAVEGGTLQVVVGPNGAGKSTLVRLLSGALRPTRGTVAYGGAPVETIPPWRLAATRAVLPQAARLAFPFAAAEVARIGLDGIGRGLGARDRAAILARALARADVAHLADRAYPTLSGGEQARVQFARVLCQLEAGRTVADRQVLFLDEPTASLDLRHQGALLDAAAGLAATGVAVVAILHDLNLAAAYADRLLVLDGGRLVAGGRPVEVLTDDLIAGVFGVRWPVGRVPAGGQPFLLPHRGAAGRARD

SEQ ID NO: 1019 - protein, 249 aa, Methylobacterium sp.
VDAVRQERGSENVTLPLASGSRRIHGSVARDLGAAILGGRYAPGDVLPGEIEFSEKLNVSRTAYREAIRILSAKGLVESRPRTGTRVSQRSRWNLLDPDILAWAFESEPSESFIRDLFELRMIVEPAAAALAAERRSGLDIARMGHALEEMGRHGLATEAGRAADQAFHNTILEAARNGALIALSSSIAAAVTWTTIFKHRRQGLPRDPMPDHRALYDAIVAGDPDAARATMTELVRLALADTELAMRP

SEQ ID NO: 1020 - protein, 302 aa, Methylobacterium sp.
VNDRALRYLLAVVRAGSVRAAAEVLNVAASAVSRQIIELEAQVGETLLERLPRGVVPTEAGRLVAEHAQRQADEAALLEDQLKRLRGVQRGTVSLRCGAGFLIDLLDNALAGFAQDHPGIAYQVEIGTTDGILAAIARGDADIGLVYNPPAHPDVRGIVSARQPLLAVLPNGHPLAGGSAPVPLRSFATEPAALLPPDHGVRQLIGRVEADGGFRLVPRLETASFELHRRFVMAAMGVAFLPRFVVAAELRDGLLAALPLREAILSEASAHLVVRAGRRLPEGAARLLGWLADHMVAFRPPT

SEQ ID NO: 1021 - protein, 452 aa, Methylobacterium sp.
MATPTTPHAADAAAFESRTMRKVGLRLIPFLVLCYFIAYVDRVNVGFAALTMNHDLGLSAAAFGLGGGLFFVAYVLFEVPSNLAMERVGARIWIARIMITWGLVGIGSAFVTGPLSFATARFLLGAAEAGFFPGVILYLTYWFPKAYRARIVAMFMVAIPLSSFFGSPLSAALLTLDGAASLRGWQWLLIMEAIPAVLLGVAALALLPSRPAEATFLSPAERGWLTDRLETEQRAAEASAGHHAHGLAAVWAVLASRQVWLLAVVYAGSSATSNTLSLWMPQILKGFGLSNLQTGLLNMIPFGIASVFMIVWGLRADRSGERIWSTALPLALTSASFALTLLTGSLWVTLVLLSLVLLGNYAIKGPFFALATETLPPAQTAAGIAAINTLAHLGTGAITSLIGVLREQTGSFPVALLPLCALTGVGCALVFWIGRHQPRAATVGATPSAARV

SEQ ID NO: 1022 - protein, 1060 aa, Methylobacterium sp.
VGAALSASWAIGGSGGKGGNGGEARIESSSTVTTAGLGADGLAVLSIGGGGGVGGLASATAITTPLATPSGQSLPSFAFSTAIGGSGGGGGNGGGATVAGSQANKGLTLNLTVGGSGGTGARGGSVWVDNRGSVTTTGAEAHAVVAQSIGGGGGSFSAPSAEAAADTPDADTPAAAAERTESSKEPAASQVQSQTKSETKGGTKSDAQALADALLAALDIERIAPPEDPAGVSEKSGSLTLGGSGRVAGDGGGVTIAQSGTVATTGFGAVGILAQSIGGGGGLASVAAGPGGHRYTFGIGGAGGASGSGGPVAVSLTAGAQVSTVGDAAPALLLQSIGGGGGYGGAHQAMGYAVPYALRDGSGGNGGTIQVTLEEGSAIRTSGTQSHGLLAQSLGGGGGLLLDLTGPAAGASGQSRLNATGKGGDISVASSGSIIASGLDANAIFVQSGVQRTDGSLEPDPERGGRINLQVNGLVTGGSGTGAAIRIDGGRSNTIVIGGRAVVSAASGRAIVGAFSAGEINNYGTVIGDVDLAAGPAGGVTFVNGGFQNTGGTSAILRTGPEGVIALGPNGRLHNSATLDIGGVGKVARATVTGNFEQSEYGRMLVDVAPLAPEGALRADLLTVTGTASLKGLVEPHLIDGLLPGRYTFLRAGQVAESGAMAVGGSIHSGAVPISWSIVASGDTLSLVPRARFTEPVGVTLTPDQRSVAQGLQDAWDGNTRQLGTLYGRFLSVDSQKAYAAALDELKPESNQDILTDRTLDTRKGLQRAMSCPAFSGTGTLLREGECVWGRITSARTTFSATAEDGGYRQTALSYQTGLQTEFAPDWFFGLTGAYTRAVQSDPDRITGTTSDAGDVSAALKHQIGPWLLAASANLGYSWADNKRLIDFGGATATARSKSGILTAGGRLRASYQVLFGDWYLKPYADLDLLYSYSPAYSETGAPGFNLDMRPVAKTLVAFSPMLEIGGRIDLDAGRWIRPYGILGVTLLSDDHFTGRASFQGTGALGLFATESSIPDRLGEMGLGFQISLGGGIEVTGEYQGQVGDHFLSHAGTARMQLRF

SEQ ID NO: 1023 - protein, 367 aa, Methylobacterium sp.
MGYRPGQLCVPRRDRQIRDGGRLVVAATTGLVLVLDLPARAAERPRPEVVTATSGRDGKANVIASNVVATPGADGPDLSLIDVDAAAAGNDPAATIRTGSVGGAGGRGDAIVGLASVPGASGGRGGAVAVTLGEDVSGEGDQVGYTTRARVSRLQFRPIPRFWVFSRGGNGGDAQKDVGAGGDAGPATLTLSSRIATEGQAFLGVRVSAVGGDAGRGGTDADQTASRRGGAGGAAALTVTRSGQVTTDGVGATAVIVESIGGAGSIRGSGTFYSNPFVTSGGAGGTARLDMAGTIRTSGDYALGGLVQSIGGNGGIQPDAGGRPGGRGGDGGTVTVTQSGTIVTEGDYALGLVAQSVGGPGGQGGGG

SEQ ID NO: 1024 - protein, 472 aa, Methylobacterium sp.
ATSTLGGTGGGGGNGGIVTAANSGAVRTSGDGAIGIQAQSIGGGGGNGGGATATSNSLSLKQNVTVSRSVGGTAGVAGIGGAVTVTQSGSVTTGGAGAVGILAQSIGGGGGNGGNASSLAAPGFSFDKTLNGLVGKLPIADTLSVTETIGGGRGKGNVGGSVTVTNQGAITTGGSNAHGIEAQSIGGGGGNGGTVSGSAVGKLTVGLTLGGQGGSGGSGGDVTVTNAAAGVIATSGDGSHGIVAQSIGGGGGMGGSVAARDVSDPDTVGTIWTQIKKTIGVAAYQEWAKDKENKDDLDRFLKDIKSSDTYKSLADQLKNSDFGKALKSYSGSVSSYLDAQKKGATKLPDAAFTLSLGGSGAQGGNGGTVSVENGGTVRTMGIGAHGILAQSIGGGGGQGGLAYAEATNRTTVTATLGGTGGSGNIGGTAKIVNTGSVATADDAAYGLYAQSIGGGGGNGGGATVAGSQANRA

SEQ ID NO: 1025 - protein, 141 aa, Methylobacterium sp.
VDQQADQQSEPGTVFGATIPFVDHCGIEALDVRAGRTRLRLALRPEHANNLGIAHGGALCTLLDVALGTAARLRAGRPVVTLDMQTRFLAPGRGVLTAEGRVTRAGRSVIFCEAEIRDEAGELVATATGLLKPVGERPAPA

SEQ ID NO: 1026 - protein, 432 aa, Methylobacterium sp.
MTPTRRSLLAAPLLAMPALRTRAGGGSVVVVGAGAAGLAAATLLRSAGQSFTLVEARDRIGGRAFTDRALGAACRFDAGAEYIHWAERNPWAPIARAAGAHVAREDGWARRLVVDGRPATAAEAAQRRAGFSGLDALLAPKGGDPSLAEAARAGGPDAALAAAGLSRLSLGEDPERVSAVDYDRLWSGSDLWIDGYGDLVARHFADLPVSLGCPVRAIDWSGRGVRVETARGTIAAAAAIVTVPVGVLKAGAVAFAPDLPDAARTALDGLSMGAYTKIGLRLDPARLDGADLGDAVSVATGGPTIYFEMQPFGRSLAVANLGGDLARDLCRAGEAEAVALATERLVAVLGGGARSAVEAGRLAGWWTDPHARGSYSIAAPGHAEARDRLRAPVGGRVFFAGEALAGGGAMTVGGATLDGERAARAVLKALGA

SEQ ID NO: 1027 - protein, 354 aa, Methylobacterium sp.
MRFGPRWFLLVAPCLGALAGLLYGVIFGIAPLTGTAIRGAIIGTPILLYERQLLAPRLRDRIRGLATPLFLLATVALYIALIVVGNAVASTVLNQLFRFMYSERNAMLMSQSGLLYALGISALVVFVFRVRDLIGPGVFANLLIGRYHRPISEERIFLFLDVTGSTRFADRHGDRAAQAYLGQVFNALALPVARARGSIDDYVGDLALVTWTMERGLRDAACLRCVFAFQERLAAEAESWRDRFGQVPEFRAALHCGPVVTAEIGLERHKIAYFGDVVNTTARLEALSKTLGVDVLVSADLLARLGPLPDDLVAEDLGAHALRGRAEPLAVAAIRRRLAVAAPARPLPRRAATA

SEQ ID NO: 1028 - protein, 348 aa, Methylobacterium sp.
MSDAPRLTSLAHGGGCGCKLDPATLRQLLAQQPAAGPFERLLVGNETADDAAVWELEDGTCVIATTDFFTPMVDDPVDFGRIAATNAISDVYAMGGRPLFALAILGMPLGKIDPDVVARILRGGAEQCAQAGIPVAGGHSIDAPEPIYGLALIGTCRREAVRRNADAVAGDAVLLTKALGVGVYSAAIKRATLDEAGYRDFIATTTLLNRIGTDLAAEPAVHALTDVTGFGILGHGLEIARGAGLTLALEADALPLLPQAEALARAGAVTGASHRNWTAFGEAVDLPADFPEWRRHLLTDPQTSGGLLVTCSADRADAILARIRAAGYPAAARIGRIEAGPARIRVAA

SEQ ID NO: 1029 - protein, 437 aa, Methylobacterium sp.
MALAATPRVRRIQTISLALLVTAGVVNYVDRATLAVANPLIREDLGLSIPDMGLLLSAFLWAYAFAQLPAGALADRLGPRLTLTLGLTCWSFGQMLGGAVTSFWQFVSARIVLGIGEAPHFPTCARVSRDWFNIRQRGTATGIWNCASSLGTFLALPLLTFLMVSFGWRAMFVIMGAAGLVLAAIVYLVFRNPRETDLTPGERAFLEEGDVPNASRAVTWSAWRRLFGFRTSWGMIVGYFGCIYMTWLYTAWLPSYLEIERHFTLQKTGLVGSIPFAFGVLGGILGGRVVDVLVRRGVDPIRSRKIPMVGSLVATAAFTVVAALTPSDTLAIACISASLFLVYMSSSSAWAMASVAAPASCTASLGAMQNFGGYIGGALAPTVTGFIVGGTGHFSMAFITGAVIALVAALGYWTLIQDPIADEGPASAAVGALGAAR

SEQ ID NO: 1030 - protein, 410 aa, Methylobacterium sp.
MAAGKSMGAVQEREPATRRAATDFYDSLPRFTAFSSLMDPGLYRPLPADWWLGVADVVGSRKQIGLGRYKAVNAAGAAIITAVSNALGRREFPFVFGGDGASFAVAPDDVDAARDALAATASWVREALQLELRTALVPVSAVRDRALDVRVARYAPSAHVSYAMFSGGGLPWAEAAMKAGEHALAPAASGTQPDLTGLSCRWQEIRPRHELMLSLMLVPQHSGDAPAFRQLVQEILQTVEISAEVARPMQDAGPEMRGPWAGLDLELRAMPGSRRSRFWAKLRLAARSIPEYLIYRTGVRIGAFDPAVLRREIVGNTDFRKYDDALRMTLDCTRAFADRLEAQLASAEAQGICHFGLQRQSAAQLTCISPPVPGSGHMHFIDGAGGGYAAAAANLKGRAADGGASAQTRP

SEQ ID NO: 1031 - protein, 277 aa, Methylobacterium sp.
VLGRVDHRSRLVVERRVNGAGSHPRQAYPCNELIVMLGGRAVVRRTGDGQDEKCLAGAGTAWTGPVGFMEKAELSEAISCLHVCLPRALIEHSALADYGIDASLVELAFVGGLADPLLVSFARAFEGMLGRPQSPTDRLFVDGLTTALAAHLIANYTVDRWKPSTAPRKLDERRLKRVTDYIEAHYAEPIPLERLAAEACLSPFHFARLFREATGLTPHRYVTDRRVRAAREALALGRATLMEIAVEQGFGTQDNFTRVFRRSTGLTPGQYRATVRR

SEQ ID NO: 1032 - protein, 314 aa, Methylobacterium sp.
YNPFDGTLAGSFSGHPHRDPLTGETHAVAYDGRVWDSVRHVVLAPSGRVVRDVPVAVAHGPCIHDCALTARFVIVLDLPVTFSFRALLAGYRFPFRWNPGHGARVGLLPRQGDGADILWCAVEPCFVFHTANAYDDADGRVILDVVAYGTVFASPGGGLDAPGRLERWTIEPSTGRVERRVIDAAAQEFPRIDERRLGQRHRYVYTVSVPADGNTQLAGATQLYKHDLATGARHVHDFGPGHVPGEFVFVPARTGADEDEGWLVGLVIDTAGDVTDFTVLDARAFDAPPLARIRIGHRIPPGFHGNWFPARAPA

SEQ ID NO: 1033 - protein, 341 aa, Methylobacterium sp.
MTLRWTRRPEGSTWGDFGPDDELGRLNLLTPEKVLQGVAEVREGVTFCLSLPLDLPGGNVLNPRRHPPQITPTRRANGRPNMNFPVCEEVDGATDVICDDRALIHLQYSTQWDSLAHVGSLFDADGAGAAPTFYNGFRGGRDIVGPSAPEAADEPSRAKRLGIERLAETGMQGRAVMIDLRAHLGDAKTRVGYDQLARILEADGVVVEPGDMVCLHTGFAERLIAMGGEPDPKLVHNLCAGLDGRDPRLLDWITRTGLCALIADNYAVEAYPAGPGPACCATLPLHEHCLFKLGVNLGELWHLTPLADWLRARGRYRFLLTAPPLRLPGAVGSPTTPIATV

SEQ ID NO: 1034 - protein, 137 aa, Methylobacterium sp.
MLTPFHLAYHVTDLDAARRFYGGVLGCQEGRSTETWVDFDFFGHQLSLHLGEPFATTRSGKVGDHTVMMPHLGVVLPLDAWEALAGRVEAAGIAFDIPPVVRFAGEPGEQRTMFFFDPSGNPIEVKGFRDLAGVFAH

SEQ ID NO: 1035 - protein, 270 aa, Methylobacterium sp.
MTGPAPGAPADGALDHVVINVLRRMDEAADLFAALGFRLTPRGHHSLGSVNHLMMTAGPYLELVGVPETGPQRQDVLDSPFGLNGLVVASRDADAAHARLAALGLAAGPPVAFSRPVTVDGREAVARFRTVRVPADRFPAGRLYHCEHLTPDLVWRPEWLDHPNGFSGIDALTIESPALEADAALYAAASGAPAEASGGVRTLRLGETRVAIVPGPVARFAALALRFRGLDALEARAAGLPEAGWLRHGPGAATLTLPDFDLNLPCRAAP

SEQ ID NO: 1036 - protein, 357 aa, Methylobacterium sp.
VSASRPIRVLIVDDSASVRQTLCSILGTAPDIEILGTAADPFIAARRIQEEIPDVIILDLEMPRMDGLTFLRKIMAQKPLPVIVCSTLTEAGSRILFEVLEAGAVDVLPKPRVDTRQFLLESTVRVCDAVRAAARAKLRGSRPSRPLVEAKLSADVVLPPPVPGRVVAGSDRIICIGASTGGTEALRDVLEVLPAESPGLVIVQHMPEHFTAAFAKRLNGLCAIAVKEAEDGDPVVRGRALIAPGGRHLMVERRGGSYAVSVKDGPLVARHRPSVDVLFRSAARAAAANALGILLTGMGDDGAAALAALRAAGGRTIAQDEASCVVFGMPAELIRLGGATLTLPARSIPAQLVGWLS

SEQ ID NO: 1037 - protein, 282 aa, Methylobacterium sp.
MEADPGHLSDRHFRSVADLVQQHAGIQLPPAKRTMVEGRLRKRMRALDLPTLEAYGRHLFEAGHLADEFPHLVDCVTTNKTDFFREPAHFDLLRQTIVPRLAARGDRPLLKVWSAAASTGAEAYTLAMVLHDMAADRFRYAILGTDISSEVLDRARTAIYPAEMLDAVPPDLRRRYVMVARDPARREGRIVPELRARVRFQRLNLMDETYPIDRDVDLVFCRNVLIYFDKPTQKAVVARLAGHLRPGGYLIVGHSESMAGVGVAGLDQISSTVFSKLRESGR

SEQ ID NO: 1038 - protein, 157 aa, Methylobacterium sp.
MSSVWQYLTLGLGAETFGIDVEHVHEILDYRVPAALPQAPAFLLGMIDVRGQSYPVVDLRTKLGLPPVARTPATRIILLNVPMPDRALRVGFVADRVIEVTELDRAEMEAAPEVGGRWNARYIAGIGRRGEAFVVVFDLVALMDGDGPALVATPQAA

SEQ ID NO: 1039 - protein, 173 aa, Methylobacterium sp.
MSGGVARGVVEPGPQAAADGGQRDGRQGGQRGGQQVVMFRIGSESFALEAGMVREIIDPIPATRVAGARPHIDRIVNVRGNVVPLADIRERFGMPAASASPDTRFLVLEVAVAGDPVVVALVADKVFAVTEVDPAQCEAVPPVGTTWRPEYIRSIVKAGDEFIIVPELEKILN

SEQ ID NO: 1040 - protein, 699 aa, Methylobacterium sp.
MTALDPAEIFRAEAAELLARLETTLLDLGDRPEDRALIDTAFRALHTIKGSGAMFGFEQVAAFTHDFETAFDRVRRGEVPVGRDLVNVSLSAKDYIRGLIEEPEASAPIIGEAILAELEQLLGSASRPAAPSALLPEPAADPAAAGEGGWQIGIAFAPEILRNGTNPLALLDELRDLGACTIVPRLDALPELTALDPESLAIGWDVTLRAAVPREAIEDVFLFVRDEMALTLVPVSAAPPDVAPEPAEAAPPPSGPPSGPPSGPPSGAAPAAGLAAPASGETGPAGPGPVEPAARAAERVPARRAEERPASSVRVEAERLDELMDRVGELVIAQARLSQLAGLHADPGLKAIAEEIERLSARLRDTTMSIRMVAIGALFGRFRRLVHDLSRDLGKPVEFVTAGEETELDKTVIERLADPLVHLIRNAIDHGIEAPERRAAGGKAATGRITLTAEHVGAQVLVSVRDDGAGLDAARIRAKAEEKGLCAPGAVLTDQQIYQFLFAPGFSTAQEISALSGRGVGMDVVKKTIESLRGTIDIATEPGGGTCVALRLPLTLAIIEGLLIRVGEGRYVIPLAAVEECVELPASERGGRGRDFLNIRGALVPFLRLRSLFGAAGEPDLHQKVIVVAAGEARVGLVADQIIGNHQTVIKSLSKLHADVATFSGATILGDGTAALIIDVGRLVSGGRAEGVREYLEVA

SEQ ID NO: 1041 - protein, 93 aa, Methylobacterium sp.
MSEAPVLTLGPDCTIRTVRALQDTLAAALAGGARLTLDCAAVERADVTFVQIVLAADRTARGRAAGIALVNVPPAVESAFRRAAIEHPSAPLL

SEQ ID NO: 1042 - protein, 514 aa, Methylobacterium sp.
LAAPQLARPALAQGGKVLRFVPQANLANFDPIWGTQYVVRNAGTLVWDMLYGVDAQLKPQRQMVESEEVSGDKLTWTFRLRPGLKWHDGEPVLAKDVVASLTRWMARDPIGLMIRGIQDDLAATDDRTFQWRLKKPFPKLLYALGKTNAPMALMMPERIAKTDPFTQITEYVGSGPMKFVRNEWVPGARAVFETFADYKPRDEPNSWLAGGKRMLVDRVEWVIMPDPATASAALQNGEVDWWENPISDLVPLLRKNSSLNVDIADPLGNVGSFRMNHLHPPFDNPKIRQAVMTAMSQEDYMRSIVGDDDSLWKTLPGFFTPGTPLYSEAGGGNVGKGDIKLGQMLLKEAGYKGEPVVCIVAQDQGITKAQGDITADLLKKMGFNVDFVATDWGTTGTRRASKAPPSQGGWNMFHTWHAGADCINPAGYPAVRASGDKAWFGWPNIPPVETAIAEWFDAADPAAEKAAIDKVNAAACEGVVYVPTGFFLGYQAWRKNVSGIVKGPIPFTWGVSKA

SEQ ID NO: 1043 - protein, 311 aa, Methylobacterium sp.
MRVACIGECMVELSERPDGDLVRGFGGDTLNTALYLARLGVAVDYVTALGDDIWSDEMAAAWGREGIGLDRVRRLQGRMPGLYIIRTDADGERSFHYWRDRAAARDLFTEPGAAETEAELERYDLVYLSGISLSLYGETGRAALFETLSRLRERGGQVAFDTNYRPRGWPDRDEAWAAFRAALDLADVIFASAEDLDWLFGAAGEDEVLRHRGRAEIVLKTSDGSGPVARVLHGPADTAVPAGRAARVVDTTAAGDSFAAGYLAARIAGLAPEAAAAEAHRLAGAVIGHRGAVIPRDAMPVPAARPPGADA

SEQ ID NO: 1044 - protein, 97 aa, Methylobacterium sp.
MPHGARTSLAALMLVLGIGGASAETVATTWTDPPAHKAGSPKAPATDTKAAPPAPSAATPTGTPAAATETRPATARRKAVAVRRAPERKAARAAHRH

SEQ ID NO: 1045 - protein, 103 aa, Methylobacterium sp.
PRRARVAAAPPRSVRAAPQVVAAAPPPPEGYARYRAYNYGPGYGYGYAPGYAQGYTQGYTDDRLDRLSSAQAAGYVVVHRRTVQFPDGRTLRVYRPDDEGEPF

SEQ ID NO: 1046 - protein, 64 aa, Methylobacterium sp.
MIDLNTATAEELDSVPALKGHGFEIVRYREERGRFTSLRQLDEVPGLSGKTDGVADQVTVADSP

SEQ ID NO: 1047 - protein, 319 aa, Methylobacterium sp.
MESALITPTLDDVLAAHERIRPYIHETPVLTSRIIDEAAGAQLFFKCENLQKAGAFKARGASNAVFSLTDAQAARGVATHSSGNHGTCLSYAAGRRGIPCTVVMPRTAPQAKKDAVRGYGGRVVECEPSTSSREAVFAEVVAETGAEFVHPYNDPRVIAGQATCARELIAQVPDLDAVIAPIGGGGMVSGTCLTLAGLAPHIAVYAAEPEQADDAHRSLKAGRIIADDAPVTVADGLKVPLKDLTWHFVRHHVADILTVSEAEIVAAMQLIWKRLKIVMEPSSAVALAAVLKNRPVFANKRVGVIITGGNVDLDALPWQ

SEQ ID NO: 1048 - protein, 396 aa, Methylobacterium sp.
MFAQNPVFIPGPTNMPEVLRRAADMPTLDHRSPLFAQILHPALAGVKKVLKSEDAEVFIFPSTATGGWETALSNTLSAGDTVLAARHGMFSHRWIDMTRRHGLDVRMIEAPWGEGLPADRFAEALAADKAHRIRAVLVTHNETATGVRSDVAAVRRALDASNHPALLLVDGVSSIASMDFRMDEWGVDVAVTGSQKGFMLPAGLAIVAFSPKAMAATATATLPRTYFDIRDMAKGYPNGAYPYTPAVGLLNGLKLSTELLLAEGLETVFARHRRIADGIRAAVAAWGLELCAARPDLYSDTVSAIRTPEGFDATRIVTHAARHYDVAFGVGLGEVAGKVFRIGHLGSLTDVMALSGIAAAEMAMADLGLRIALGSGVAAAQAVYRRAPAAALRAAA

SEQ ID NO: 1049 - protein, 262 aa, Methylobacterium sp.
MTLPVPSLPDLLPTGPARFLGWSMIADPMLAGFLARAGFDAVLLDQQHGTYDYKTSCAAITEVALAGKSTLVRVPVGDFAMVSRMLDAGAAGVVAPMINTVADAEALAAAAKFPPVGQRSWGPDRAMWLSGLRNGADYLAGANDRALTIAMCETEAGIADLEAILAVPGIDGVLVGPADLSIALSKGAAIDPLGSAVTAALGEIARKTRAAGKIPCAFAPSPARAREMVGMGYQLVSVEYDALTIVNAFARVLCEADPARAG

SEQ ID NO: 1050 - protein, 531 aa, Methylobacterium sp.
MPAQLSLLNLAWTAPDGRAVLSGITASFGQERTGIVGRNGAGKSMLLNLLAGRLAPTGGSIHRDGTVALLRQFAGPTADETVADLFGATAGLALLRRAEAGAAEADELAVADWTLAERLTGALARMGVAVGPDTPLRRLSGGQRARAALAAAIFAAPDFLLLDEPTNDLDRDGRRAVQELLKAWRAGAIVVSHDRALLDAMDAIVDLAPGEATRYRGNLDAFRQAKATRLAAAEHDLAVAEKRATDLARRAQERVERQQRRDAAGHRRSAKGDLPRILAGARRDNAERNAGGSAHLAERQRAGAEADLAEARDRIAAVKPAAIALLPSGLHADRRVLALTDVTVGYRPGQPVLRDVSLAVTGPERVALCGRNGSGKSTLLALVAGRLSPWSGRVSVGVRAALLDQRLDLLDRDRTVAENFARLNPEEDANGCRAALARFQFRAAAADRPVAALSGGEQVRTALACVLGNRAPPPLLILDEPTNHLDLDAVEALEAGLAAYDGALLVVSHDSAFLDALGITRRVDLADRPRA

SEQ ID NO: 1051 - protein, 352 aa, Methylobacterium sp.
MSDADVFSGVKPVEPRHRIDEAKLAAWMEGHVRGYAGPLTVQQFRGGQSNPTYRLDTPGQAYVLRRKPFGPLLPSAHAVEREFRVIGALYGEGFPVPRPFALCEDPDIIGAAFYVMEAVDGAVHWDGALPGLDPHARHRHYAGMIATLARLHAIDPEAAGLSDYGRPGNYFARQVDRWPRQYRAAEDGRLEDVERLIAWLPRTVPEQQGACVVHGDYRLDNLIFSRDGGVSAVLDWELSTLGDPLADFSYLLMQWELPADGRSGLGGLDLPALGIPTRDEAVALYCRAADRTNLPDLDWYFAYNLFRLVGILQGVAARAKAGNAASEHAAAMAARVPKLAEAAWRFAERAGA

SEQ ID NO: 1052 - protein, 413 aa, Methylobacterium sp.
VDFTLSQSQTRWLTRVRAFIADAILPAAAAVASERAQSREPSPTMERLKETARAEGLWNLFLPPSSEHDTDDYRGAGLTNLDYALCAEEMGRVGIASEVFNCAAPDTGNMEVLHRYGTAAQKDRWLKPLMAGEIRSAFLMTEPEVASSDATNISTSIRRDGDHYVIDGRKWWSTGVGDPRCRIAILMGKTDPEAPRHRQQSQILVPMDTPGVRVERLLPVFGYEDAPKGHGEVVLENVRVPAENLILGEGRGFEIAQGRLGPGRIHHCMRTVGAAEVALEAMARRLVSRVAFGKRISEQSVWEQRVAEARIDIEMTRLLCLKAADMMDKVGNKGAKLEIAMIKVAAPRVALKVIDDAIQAHGGAGVSEDFGLAKMYAHIRTLRLADGPDEVHNRSIARLEFGRYTNRSEAERA

SEQ ID NO: 1053 - protein, 501 aa, Methylobacterium sp.
MTVAVVPPPAVSPVLAEPCLTVRGLTKRYGGLVAVKNIDLDLRPGEILGLIGPNGSGKSTVMKLIMGLERPSAGSIRLDGTEIGGMPAHRVARSGIGLVFQHARPLQRQTVLENISLALLPDSLIRLAADPHVARRAREIAERVGLGAVVDRRPGTLPFADLRRLELAKAIARDPRVVLVDEPFAGLTGGEVAAFSELIRGFRDEGKAVLLVDHNVKSVAAIVDRVFAMYLGERIAEGSAESVMADPTVRRVYLGGSIETAARPEAAFKPDSLLTVEGVDVLYGKAQALRSASIHVHEGEFVSVVGLNGAGKTTLFNAISGLVPHTGAIRFDGRDLSRMKPAAIARAGIVQVPETRELFGDLSVRENLDLGGQHFPKAESARQRDWLYELFPILKDREAQSARTLSGGEQQMLTIARALMMRPRLLILDEPTLGLAPVILELLSKALEKLRQTTPITVLLGEQNVTFALPHADRVYVLEQARIVWEGPPQRFASEMGSAYL

SEQ ID NO: 1054 - protein, 306 aa, Methylobacterium sp.
MKLLTTPGFWVAILAVLAAATLPWWVSGYILGLLTIAYYFGVFSMAWDLLFGFAGEVNFGPTFLIGLGAYGAGILNNRYELPIPYCLAAGTVLAVVGGLALALPALKVRGPYFGLITLVAVLLLQNMIVVFSGLTGGEIGLTVPDVISIDADTNYWLALGFMAVSGLILTAIARSPAGLILQAAGQDPVVTGALGFNVAKHKLAAFAVSAAFSGLAGGLVVFYMGTASVGTLINTSVGVQVIIAAVLGGRRTIVGAALGAVFLIAAGELLRPLGGLSTFVVSAVALLVILFVPSGLLGLGSLRRAR

SEQ ID NO: 1055 - protein, 291 aa, Methylobacterium sp.
MIGLQILVDGFAISSLYALGAMGFTLIFGVSGVLNLTHGALMVMAAVAAWAASALFGLGSYAGAVIGILCGLAGALVTYFAVVAPIERSRAIPREEKEIFVLTGTLLWGIMIQELVAYFFTDNPKTVLPIVEGVFEIAGVRTPRNQVFTAVICWVVIGLLWLFVNRARAGKVLLAASMNPRGVTLLGHDMGKIYVAVWAIYGLLAGTAGVLLGMFLGVSSYSVGPLTASAFSIVVLGGLGSVTGSLIAAYVVGYLETATAYLISPAYRVIPALLLLVAVMYLRPQGLLGRR

SEQ ID NO: 1056 - protein, 131 aa, Methylobacterium sp.
MTRFRAALLAPALILTACTTVCTTVCAATGASAANRFDGSWSVIATAETGSCTGPYSYPIVIRDGTVDDAGGNGVDASGRAGPDGRITGTIRKGLASVSVTGRLRGSAGTGRWTLSGLGACAGRWTARRTG

SEQ ID NO: 1057 - protein, 170 aa, Methylobacterium sp.
MRFLAVALPALLAAGLILDGSAVRAVDAGTAPAASPIYGVTVPDGYRDWQLVGVAQETGALDELRAVVGNARALDAYRSGTLPFPDGTVLVKRAWTRVPSAEFAPAFVPGGATTVQVMVKDSRRYAATGGWGFGRFVDGKPADAAQHETCFACHSANVRDHDFVFTRLAP

SEQ ID NO: 1058 - protein, 275 aa, Methylobacterium sp.
MASLGTRDALTLVERDTAESRRGFSGAHAGDNPVVVEQRDQSRGRASRIVIIDRRQLVGRCLAASLSEADRQTSFEVFADIESWKRQTPFVAASVVVLCRPDGNLTETEWTEITRELAFLQGEAGAPPVAVISDGENLDQIVRIIKLGVKGYIPTTTSVDIALQALQLVQAGGVYIPAECLLPLLANIKVDEPVEAGDDDIFSPRQLCVARALRKGTPNKIIAYELNMCESTVKVHVRNIMKKLKAKNRTEVAYLTNKYFLREDSSLASVKAPAA

SEQ ID NO: 1059 - protein, 256 aa, Methylobacterium sp.
MSLFDLTGKTALITGSSRGIGRAIALRMAEHGARVVISSRKREACAAVVAEIEAAHGAGRAVAIPASISVKAELEHLVAETETRLGPVDVLVCNAASNPYYGPLAGISDAQFRKILENNVLSNHWLIQMVAPGMVARRDGAIVIVSSIGALKGSPVIGAYNVSKAADLQLARNYAVEYGPANVRVNCLCPGLIRTDFARALWEDPEMLAATTDAAPLRRIGEPDEIAGAAVFLASAAGRFVTGQALVIDGGVTIAR

SEQ ID NO: 1060 - protein, 590 aa, Methylobacterium sp.
MSLDPRILAGWPALPFREAEARLTVSGGPFAITTIDIRGVPTRIWEKAPPTLGDLFRIARGHGDKTFVVYQDERVTFTGFARAATALARALVEAGVRKGDRVAVAMRNLPEWPVSYFGALLAGAIATPLNAWWTGPELAYGLQHSGARVLIADGERFDRLEPHLAECPALERIVTTRMEVDSRATPLADIVGRIHDWGALPDLPPPDIALDPEDDATLFYTSGTTGKPKGAVGTHRAAATTVMAYPYSAARSALRRGEAPPKPDPAAPQRAVLLVIPLFHVTGCHASLGAALYGGHRLVMMHRWDAAAALDLIEREGCTSAGGVPTIAWQLANAAREAGRPLPTLEGVTYGGAPAAGDLVRALGEALPRVVPGTGWGMTETSATFTHHQGEDYLAHPESCGPPLPVCEVRILDPLGQDLPPGSVGELCVKGPNVVRGYWDDPAATAEVLSEGWLRTGDLARADEEGFLTIVDRIKDMLIRGGENIYCCEVENALYAHPDVIDAVVLPVPHPTLGEEPGAIVVLAEGAETDPEAIRAFAAERLAAFKVPVRIEIWDGLLPRNPAGKILRAPLRAVFAAGSAQNGSPSSSGR

SEQ ID NO: 1061 - protein, 380 aa, Methylobacterium sp.
AEPRPVEAGGHGHGCGHNLLGSAALLAATALKDWLAETGTPGRVRYYGCPAEEGGAAKAFMVRAGAFADADIAISWHPGSFWEVAPPVALANTRADFVFTGRTAHAAAAPHLGRSALDAVELMSVGVNYMREHMPSDARVHYAYLDAGGIAPNVVQAGATVRYSIRARDLPGMLALVERVKKIAQGAALMTETAVEVRIVSAVSNLLGNDPLERALHGVMEELGPPHFDEADRDFAGRIRGTLTDGDIDAVFRAIGMPRTEAPLADFLVPLDAPRNPAVGSTDVGDVSWVVPTVQAHAPTVAIGTPFHTWQVVAQGKAPAAHKAMVQVAKAMAATGARAVTDAALRDAAKADLARRVGAAGYVSPLPPEVEPPLGMSLGR

SEQ ID NO: 1062 - protein, 222 aa, Methylobacterium sp.
MTSINISLDAAAAYIVSDGLRYDAHRGGATCCITKVIALPHLRAAVATRGSALLPQMMFGGLNALPSFEACIAALPVLFADLMSRLATVEVPLGPEHGSSEVFLVGWREAGLRPECWFIHAGGQPGEAFKAMPMNGVAPAMDGSSSRLQALAASAVDPFDPDPCYWPERDGPELIEGTRSLYGETIGGFCQLTTVARDEISMRILKRWPEHVTLPFNTAPVP

SEQ ID NO: 1063 - protein, 78 aa, Methylobacterium sp.
FALYAATNAVVRAYRPLLGELGLTYPQYLVMLALWQDGSAPVHALAERLQLGSNAVTPLVDKLEAAGFVTRARGADRR

SEQ ID NO: 1064 - protein, 250 aa, Methylobacterium sp.
VTAPVGHAAVDPGAGETLRVRVRRGETVADYAVPRRANQTVLDVVTEIQRDQDPTLAYRFACRVGMCGSCGMTVNGRPRWTCRTRVAAVAPDGVLTLEPLRNLPVVKDLAVDMEPFFEKWRRAHGFFEPGENPPEDFAVVEPESAARREVDAGIECINCGVCYAACDLVTWNPDYLGPAALNRAWTLVNDVRDRDRDRLAAVAGDAGCHSCHSHMSCTEHCPKGLSPTFSIAGLKRETGKAALRRFWRRG

SEQ ID NO: 1065 - protein, 109 aa, Methylobacterium sp.
MSALLYLAQRGTAAILAVTVAVHLGTILYAVRGGLTAGEILGRTQGNVAFLLFYAVFVLAAAIHAPIGLRSVLREWTGWRGRSLDVAMIALSALLAGLGLRAALAVYAA

SEQ ID NO: 1066 - protein, 125 aa, Methylobacterium sp.
MRTATSTAGRAGITRASLRRPGFAAALIHRLSGIALALFLPMHFIALGTALQGADRLESFLGLTHNGFVRTAEWGLVCALAVHMALGLRVLAIEWLRFRERNARVVAGCLAAAFAVGLLFLLSGA

SEQ ID NO: 1067 - protein, 203 aa, Methylobacterium sp.
VAHHVLDMPATEAEIRALRIGDTVTLRRWLFGIRDATLIHMFDRDRRTRLDLDGHAVIHTAPNVHRVPVSNEAPVGFAPFCIGTTTSMRMERFTDALMEREGVRLIVGKGGMGPATLDAFARRGGAYLAIVGGAAALETTWIETIVDVDLDDLHPESLWQFAIRDFGPLLVGMDSHGGSLFADVQRDVAARRDAVIASLEDAR

SEQ ID NO: 1068 - protein, 574 aa, Methylobacterium sp.
MSPEQVETDILILGSGGAGLFAALHAKKVAPDLDVTVAVKGLLGKCGCTRMVQGGYNVALAPGDSVERHFMDTIEGGKWLNDQALAWTLVTEAQMRIRELETELGCFFDRNPDGSVHQKAFAGQTFDRTVHKGDLTGIEIINRLSEQVWRRDVRRLEDHRALELIPARDGSGLAGVLMLDMRTGEPKLVRAKAVLLATGGGPTMYKYHTPSGDKSCDGLAMALRAGLPLRDMEMVQFHPTGLLAGAGTRMTGTVLEEGLRGAGGWLLDSTGQRFMEAYDPRAERATRDVVSRSIMRRLRDGFATPSGGVHIQMSHLGPEDVRRRFKGMVERCADCGFDLAGGLVEVIPTAHYMMGGLQFAVDCTTALPRLYAAGEDTGGVHGANRLGGNGVANSTVFGGLAGQSMARAVTREGRLAEPDPAAIEAGLARAYGPLGRPAESLPEIREALYETMWADVGILRDAAGLTRALATLDGLSDAVARAGAPDGDRRYALTWMDRLNLENLVLVSQAVARAALARTDSRGAHFREDFPEASDLATSHFTVVRQRGGALDLAMEPVHFTHVRPGGSLLDAAA

SEQ ID NO: 1069 - protein, 99 aa, Methylobacterium sp.
MAYFLLRLEPPRPSFPFDATEAEKALFSAHSGYWMEQAAAGTAIAVGPVFESGGTWGLALVEADDAARAEALGEADPVLMAQAGFRYTVSPVPSLILRR

SEQ ID NO: 1070 - protein, 210 aa, Methylobacterium sp.
MSRRADSRPFRRLAAGLVLGACWLPAGPAAAQALFWPSIGFAPLPSFAWPQMPEDAYGRWTGSYARLSTGYAVSTSRHLGSYSGPTIGFEGGRMWQEGPILYGISGGFDYLAGLGGNLTPGYGRLAYSNDFAGSLEVKVGTLVAPDVLVYAKTGALALHQTLRVGPTPGSLPFARQDIAVRPVAGVGVEWAVTDRLSLAVEAGVVGGGIR

SEQ ID NO: 1071 - protein, 184 aa, Methylobacterium sp.
YFLEHAIASANAQELDRPATIHFFVGIDPGIEIPAQLAAHPQVTFARGPQRGQIPALNAAIGAVDDSWDLVGFLEDDDHWLPPYLGFALRALESFDFVSSTQLETDEAGEVVRINDFATPSGWLMRRTTFAQVGAISPASKWHYDNEWLGRLAETGLRRAHLVEATAPVTLQDAIQVRPWLANV

SEQ ID NO: 1072 - protein, 624 aa, Methylobacterium sp.
MLDLTGYRLTYDDEFNARSISQNGVGTTYRDIRAEWRYDANSDIGFGRSSFLDSGSGYDPFSVQNGVLTITAAPPGTSASGYPGSWQSGLISTQGNFSQTYGYFEIRADFSNNPDAWDAFWLLPNQQSPQSSSANGHQELDVVEHYGNNDRGVYSTIHTTDPQPAGTTWQQTRQVYSEMPNPNGYHTYGMNWQADRISFYVDGQLVGSQATPSDLHSPMYLLANLAVQSTATTGTRFSSSIDYIRVYSNNPNAVAVPQDRVSSPDGRDPGLYGATAGLRSGAGAAGAQPGATGSNPGATAPASGANGSNGSSQPSSGTAQGTAAPGNAPCYCTGTSIRTDRGDVAVERLAVGDRVVTAAGLHRPIRWIGRRTYPGSSAPPTERPVRIRAGALDDGVPARDLLVSPDHAVWLDGLFVAAGHLVNGTSITRGERVVDLTYWHVELDSHDLLLAEGTPAESFLPAPGLRRLFDGRDPDDSAIGPQAYAPRTALGPQLAALRRRLIRRAGATSRPGAVRAWLDRCALRADGALRVAGWAHDAAQPDAPVCLDIVVDGTIVAVTVAAEYRADIAAAGVGDGRHGFDLGVEAPLAPGVPHVVEVRRSIDEAVICAMAADAAGVWRPLLAA

SEQ ID NO: 1073 - protein, 221 aa, Methylobacterium sp.
MAPSPLALIASAALVAVIATGTGAIVLQQGSGFSHSRKVGGPFTMADLDGRPVTQADLRGKPSVLFFGFTHCPDVCPTTLATLASALGRMGRDADRLNVVFVTLDPERDTPDTLRAYLASFDPRIRGFVGTPQQVARMADAYHVAYKRVPTKDGGYTMEHSATVALFDKTGRMVGEIGYGEDEANTFAKLITLALPGQCPPGGGANLWTTDGSTGSCGPRS

SEQ ID NO: 1074 - protein, 495 aa, Methylobacterium sp.
MLRYAACLLAGLALTGPAAAQTLRYGMMEDPDALDPTLARTFASRMVFAALCDKLVDIGPDLKPVPQLATSWELSPDEKALTMHLRPGVLFHDGEKLDAAAAKFSIERHMKMPGSQRRSEIAPIDSVDVVDDLTFRINLKQPFAPLLAQFTDRAGMMVSPKAAERLGDKFASAPVCAGPYKFVERVPQDRIVVERFPDYWNKDAIHIQRIEFRPIPDATVRLTNLRAGQLDLLERLAPTDVAQVKRDAKLKLDSTYELGFQEILFNPHKAGSPVSDPKVRAAFEAAIDRNAINQVVYNGEFLAGNQWVNPKNPNYVAEYPIPKRDVAKAKALLAEAGKPNPQITLTVYANSESPQVGQVIQAMTKEAGFDVKIQAVDFTTALDAADKGNYEAQLYSWSGRSDPDGNTFSFLACKAALNYPKYCSPEADAALQAERGTVDPAKRKAAWKALADQVLKDRPGIYILHRKLLWAYSQKITGFVPYPDGLVRFTGLKLN

SEQ ID NO: 1075 - protein, 309 aa, Methylobacterium sp.
MSTGSEIARAEAVGLEAAPSGAPAHAILREPGTLAAFWRRLRARRSAVVGLVIVGLLVLMAVFAPWIAPYDPTATDWGNVRGPPSLAHPFGGDEVGRDVLSRIIFGTRASLGAGLVSVALAVSLGLPLGLLAGYAGGWIDGAISRLTDALLAIPFLILAIALAAFLGPSLVNAMIAIGLSATSTFIRLTRAQVRAVAAEEFVEAARAMGNPPWRIARVHILPNIVPAILVQATLTIAAAIIAEASLSFLGLGQQPPDPSWGAMLNTAKNFMDEAPWMAIWPGLSIFLAVLAFNLFGDGLRDALDPRQRT

SEQ ID NO: 1076 - protein, 338 aa, Methylobacterium sp.
MIKPLLDVRDLAVAFDTDGGAVHAVNGVSYTLHEGETLGIVGESGSGKSVHVLAMLGLIPRPPGRITGGQVLFEGRDLLALKEQDLREIRGGAIGFVFQDPMSSLNPGMTVAAQIVEPLRIHLGLDARAARARARELLDLVRIPNAAARLDQYPHEFSGGQRQRVMIAIGLSCRPKLLIADEATTALDVTVQAEIVALVQELKRELGMAIIWITHDLGVVAGISDTVQVMYAGRILERGPVDDIFADPRNAYTLGLLRSLPDLSGGRAGRRRLHQIEGAPPDMRHLPPGDPFAPRNAYATPRCRAEMPPLAQAPGAAPGHLVAAWYDLPKLLDEEAAR

SEQ ID NO: 1077 - protein, 307 aa, Methylobacterium sp.
MNASQQPVVSVRDLSKHYPLRSWWGGKGAVFRAVEGVSFDIRPGETLGLVGESGSGKSTIGRAVTMLNPPTSGTIAFEGTDLAKLSAGAMRRMRARIQTVFQDPYAALNPRMSAGEYVAEAFKLHRRDMRGPERREAVAALFQRVGLDPRFMGRYPHQFSGGQRQRICIARAIALKPSFIVADEPIAALDVSIQAQVVNLLQDLQDEMGLSYLFISHDLRMVRYLCHRVAVLWRGRIVELAEADALYDDPRHPYTRRLLAAVPVPHPAEERARLAARDLAGHDQPPDGPLTEVAPGHWVALPRGQQA

SEQ ID NO: 1078 - protein, 131 aa, Methylobacterium sp.
LHQAAEIEALVNRAADMLEAEGARAFDAFRRKGSTWRYGDVYLFVVDLRGIVLFNAAHPNREGHDLLHERDADGKQFHHDFIDAVTRFGSGWVDYMFPKPGQSAPSVKWSYVCATRVAGVEALVGAGVYVE

SEQ ID NO: 1079 - protein, 310 aa, Methylobacterium sp.
MRIAFIGQQDFGKAVLEAFLKRGDEVAAVFCAPEKPGAKPDVLKTAAVEKGLTVFQFPSLKSPEAEDAMRGLNADIGIMAYVLQFAPQSFVNIPKHGTIQYHPSLLPRYRGPSSINWPIARGESQTGLTIFRPTDGLDEGPVILQKSCPIGADATLGDVYFDNLFPMGVEAMLEAADLVVAGQHVEIDQDEDAASYEGWFRAAEAEIHWSAHAEQIYNLIRAANPAPGAWTTHDGKKLQIFDCALHRIRKLADVVGKPGEVIAVDDEGFSVCAQGGRLDIRKVKAEGGKKVAAAEYAREAGLAVGQFLGR

SEQ ID NO: 1080 - protein, 186 aa, Methylobacterium sp.
MLITRYRHRLPADYDMDRIRARVAARAPVWDAVPGLVFKAFTVEDRARGAAANAYSSLYLWQDAGAAAEFLAGAGFGAVIASFGRPRIETWLAVAAAFGPGDAAGAVSEETRLVGPAEDLAALRDDERGRGRDIAAGRDVLATVAGLDPDGWRLTRFTLRAEAAAGLSGTAIAHLAAPGLAAARGR

SEQ ID NO: 1081 - protein, 84 aa, Methylobacterium sp.
MGDAMIRPAEFWDTVGGLVTAKVEPVIGRADRHRGPVIDYLRDLEALARRQCSSRETVQIIASGRRLLGDRSEIGPSDGPFTRA

SEQ ID NO: 1082 - protein, 206 aa, Methylobacterium sp.
VVDRPLGLEPALDPSARVVDSRLGRYTEVGARTRLTETTLDDYSYIGEDGEVIYTAIGKFCSIAASVRINPGNHPMERASQAHFTYRARAYWPEESDEPAFFDRRRASPVAIGHDVWIGHGAVVLPRRTIGTGAVVGAGAIVTRDVEPFTIVVGNPARPVRRRFPEVVADRLTRLAWWDWDHERLRRALPDFRGLPIEAFLERHED

SEQ ID NO: 1083 - protein, 259 aa, Methylobacterium sp.
VISFGTTFRTSRARRAVAGSALTLGFGLSGPAAAIDGGSAAGRDALAQATVAIGTITQPEEALKLTRCTGVLIAPDVVLTAAHCVNGDPLGALVVFFRGSEPARPVYGARVAARYSPDPGEMLPNEASGVSLSDLSLDLAVLRLTEPVRDRRPVPLAADPGRVPKSLRIAGAGLSGRTVGRLRTATLTPIAASSTGLTIARANGARVCFGDSGGPVVAQDRRGTYIWGVASAVISRAAPCGGYVVIAPAAQVFSATGTR

SEQ ID NO: 1084 - protein, 582 aa, Methylobacterium sp.
VTAAAMPETLDIRVPDLGDYADVPVIEIPVSPGQPVAKDQTLLVVESDKATLDIPSPAAGRLVEMLVGLGDTVSAGTLVARLAVEATDARGEPAPAPASAPAPESTPAAPPPKPPAGAGCDLLVIGGGPGGYSAAFRAADLGQRVILVERHATLGGVCLNVGCIPSKALLHVAAVTEEALRLAAHGISFGAPTVDLEKLRTFKAGTVRRLTDGLAQMARQRKVEVVRGTARFTGPKTVSVTLHDGGTRDVTFTGAVVAAGSAPVALPMLPDDPRIVNSTGALELPAVPRRLLVIGGGIIGLEMATVYSALGARVDVVERLPNLLEGVDRDLVSVWTKRNAHRFDRVLTGVEVVSAEAKPDGIAVTFSGEAEPGTYDLVLQAAGRRPNGATLGLDAAGVALDGGFVPVDAQMRTNVPHIFAIGDCVGQPMLAHKAVHQGHVAAEAAAGHKTGFDAAVIPSVAYTDPEIAWAGLTETAAKAAGRAVEVARFPWAASGRAIANGADYGLTKLLFDAQTRRVVGGAIVGPSAGDMIGEVALAIEMGADATDIGRTIHPHPTLGETIGLAAEAGLGLCTDLPPVARR

SEQ ID NO: 1085 - protein, 376 aa, Methylobacterium sp.
MRDFTVAWDTNRLEWVRERVRAYRMPRLPTGAGWRYGCDPDVLAALCAHWLDGFDEAAAAAELNRFPQILARVEDLDLHAVHVVGEAEGRRPLLLIHGWPGSIYEFWSVIEPLAFPSRHGGRPEDAFDLVIPAPPGFGFSGKPAAPIGARSTARLFDRLMRETLGYPRYRVQGGDWGAGVAAWLGLDHAASLEAIHLNYLLVQPDAEPESAAERAWQKQAGATQQALGAYAQLQGTKPLSLGYAMADEPVAQLAWLVERFHDWADLRERPFAQVFTNDQLLTNALLYILTDSFATATWFYAGAQQEGVRRMPPGRRVTVPTAFAAYPDPRTPAPPREWLERGYAVSRWQTMPRGGHFAAMEAPDLFVRDLRDWGRG

SEQ ID NO: 1086 - protein, 134 aa, Methylobacterium sp.
MLRNAFLAAVILVPTAGYAAEVDCGASANQMDANICTAQEFDRADAELNRRYATLRSKLDENGRRNLVAAERAWIAFRDSECNLRTGFNTLTPDDNGSIAPMLLGACKITLTRQRIQDLAAQIKCPGGDLSCSP

SEQ ID NO: 1087 - protein, 103 aa, Methylobacterium sp.
VSLRNGLAALALAVAGAAPVPAWAWGVPGCINLPEYNRALGALQGMTSACDMSVEEARRIVAARDGVAPGPPVAAAEPPAPPRVAPRHRRARTHRSARPRHHR

SEQ ID NO: 1088 - protein, 509 aa, Methylobacterium sp.
LKKKPVPAPSASWGTLPWPDAILPLPLDGQLRPLDERRLGQVAAGQFPGCRAIFVAPAASELRPDLAGHLTRALAERPDIGIFYGDDAVVDGAGQVRSVHCKPAFNPALLMADDYIGFPLLIRVSALAGLSPDFGLRHGSAAWFRFLLGAISAGIGIDRIPQTLIASPLERPKATRTARAHALDRWFETSGMPLRTAPGLTPDTLEIRRSFDARPAVTLVVPTNQSGPKDDQGRAVEGAKPHVINLLDSLGRSTYPADRIRVLIGDDVADDAIYRGRSDRFTVTRLLTTRAPGERFNYAAKMNTLWRAAETDLVILMNDDLVVRRPGWIEALLTFALDRGVGGAGGRLLFPTGKIQHAGMTGGIFDVFAHPWYNRDAAEPTYGDWALTQRDCSAVTGALFATRKAVLEAVNGFDEGFALDFNDVDLCLKMRQLGYRIVYTPFSELAHHESASRQTSFAPGSQIARFLRRWGDVVAEDPAYSPQLRIDTDVVAPRADATRWIAERRADAA

SEQ ID NO: 1089 - protein, 190 aa, Methylobacterium sp.
MNARHLCLLAALQAVALPAAAAEWAVDPARSAIRFSGVQVGVPFTGRFERFKADIDFDPAKPEAGHALVLVDLASARTGDIQRDEALPQKDWFDVKAGSEARFEATRFVDKGQGDYAAIGTLTIRGTSRPVTLPFHLTLEGGAAHAAGRVALVRTEFGVGQGAWASGQWVALEVGVEVDLVAAARPASGH

SEQ ID NO: 1090 - protein, 76 aa, Methylobacterium sp.
MTVRMLAAAALVAAVATPALAQGLDSKHSPYPASAYSGWVGNAPVLYRDAAGPARPAAYRYSGPHAGGPANALPRF

SEQ ID NO: 1091 - protein, 393 aa, Methylobacterium sp.
MIAAADPATPVAGAGCACCLPRRGFLGRLAGLGAAALTAGAARAEPSRYTGLVIDCHGHYTTEPAAMLDWRKRQIGALNDPGQSPKPSDLQVSDDAVRASVSGRQLKLQSERGISLALFSPRAGGMGHHIGTARTSLDWSIVSNDMIHRVTSLMPQNFVGVCQLPQSPGVSPKNCTAELERCVKELRFVGCNVNPDPSGGYWTDPPLSDRFWYPLWEKMVELDVPGMVHVSASANPNFHATGAHYINGDTTAFMQFVTSDLFKDFPTLRLIIPHGGGAVPYHWGRYRGLAQDMKRPPLSELMRNVFFDTCVYHQPGIDLLLKVVPRENVLFASEMVGAVNGVDPETGHAYDDTKRYVEAAAIPDADRAKIYAGNALRVYPRLAARLRSVGVTP

SEQ ID NO: 1092 - protein, 519 aa, Methylobacterium sp.
VAVPEAKASARDWLAVFGAILGAFTAILDIQITNASLADIQGALGASTEEGSWISTAYLMAEIIVIPLTGWLSSVIGLRRYLAVNTMLFTAFSLACALSTTLGQMILFRAGQGFTGGVLIPTAIVIVRTRLSKAQQPIGIALFGLTATFAPAIGPTVGGWLTDNLSWHYIFYLNLIFGPVAAAIQLGAFDSVPARWGELLKGDWIGIGLMATGLPALTYVLEEGQRKDWFGSQVIVNMSLLAAAGITGFIVRELTTERPFINLRVLANRSVGGACVLMTVLGAVSFGSIYIIPVYCAQIQGYNAQQIGYVVMWSGLPQLVLFPMMPLLMRTFDARVLVVTGTLFFIASCWINVGLTHDVGADQLILPQLMRAIGQPLFTIPLSQLSTVGLAPRDTADASALSNMMRNLGGSIGIAMLSTMIDRREHFHFSMLAEAITVNATRTQDRLAALAAGMHARIADPLAAKGVALGQLAAQVRREAYVMAYADGFWLVGVSLVASLAVVAILKKPQRAAGPVEAH

SEQ ID NO: 1093 - protein, 294 aa, Methylobacterium sp.
MIIATVGVVGLGNMGLGMAATLARKGFAVLGYDLSPARRPAAEAAGVTVLDALNDVLGRADALVFSLPLARDVEAVVTAEGGLLSRTDRKVVVIDTSTSDPGTTRRLAERLAAAGHALLDAPVSGGPSGAAEGILTMMIGGAAADYELARPVLEAMSARAPHVGPSGAGNIVKLVNNLLVAAHLVTAGEALRLSEAAGLSAEEAVKVVNTATGRSAISEVMVPRWVQSGTFDSGFSAGLMRKDVRLALELAEECGIDLPLSAEVKRIWQATQAAIPDTADFTRMADYRDPKGAH

SEQ ID NO: 1094 - protein, 246 aa, Methylobacterium sp.
MTVVTAPQPDLRLPLYQRLRDEIAFQIARNVWRSGEPIPTEAELAATHRVAIGTVRKAIDVLVADGLVERQQGRGTFVRRPRFDRSLFRFFRHLGPDGTQAVPEGRILSREACPAPATVREALGLDARGDAIRLIRTRHLQGRPILSETIWLPAARFAPILQAPLTEIGDLLYPAYERLCGEIVARAEETLTVGIADATDAGRLAIADGDPVVVIERLAFGFDARPIEWRVTRGAARDFRYHVDIR

SEQ ID NO: 1095 - protein, 220 aa, Methylobacterium sp.
MPRGEGRRGEREPEVGPGVDPGAASPDTRTRILAVSLALFNARGLGHVTTAEIAAAAGIREGNLQYHFPRKRGLVEALFAAFETEAVAVAGRMPADPTAPEALLAYQRAWFDLMWRYRCVYRDGIAMVEIAPALRARVHTLRAETQALARGVFEAAVRAGRLRVSPDALGRLIDNAWIVSGHWMSHRLQGGTDLTEADRDWGFAQVRDLFAPYLAPESPT

SEQ ID NO: 1096 - protein, 389 aa, Methylobacterium sp.
MPIGLQDFDFGLGETADALRAEVERFARAEIAPRAAAIDASNAFPADLWRKLGALGVLGVTVEETYGGAGMGYLEHAVAMEEISRASASVGLSYGAHSNLCVNQIRRNGTEAQKRRYLPKLIAGEHVGALAMSEPGSGSDVVSMRLRADRRGDRYVLNGTKMWITNGPDADVLVVYAKTDPEAGPRGITAFLVEKDFPGFSTAQKLDKLGMRGSNTCELLFQDCEIPEENVLGAVGRGVGVLMSGLDYERAVLAAGPLGIMRACLDVVLPYLHERRQFGRPIGEFQLMQGKIADMYTATNAARAYVYAVARACDRGRATRRDAAGAILFAAERATAVALDAIQALGGNGYINDYPTGRLLRDAKLYEIGAGTSEIRRMLIGRELFAETA

SEQ ID NO: 1097 - protein, 281 aa, Methylobacterium sp.
MVQANDPARPPIRVSCIQFEPEFGAVDANMARASDLVRAAAAEGGRLIVLPELASTGYVFESAAEAAALAEPVPDGPTTRAWAALAAELGVHIVAGIAESAGETLYNAAVIVGPEGYIGTYRKAHLWDQENVFFARGDLGFPVFETALGKIGVAICYDGWFPETFRQLALAGAEIVCIPTNWVPMPDQPAGEAAMANTLHRAAAHSNGIFIACADRVGVERGQPFEGQSLIIGPKGWPLAGPASRDRTETLSALVDLDAAGRKDLNRFNSLLRDRRSDIYG

SEQ ID NO: 1098 - protein, 310 aa, Methylobacterium sp.
MRELNTFSIAARCPRTGQLGVAVASAVPAVGGLCPFLRAGIGAVTTQSWVNPYLAARILDGLAGGQDPDAALAAALATDDRPDLRQLGLVDGQGRAAAWTGAGCTPAAGHRTGAGYAAQGNMLAGPGVIDAMAEAFAGSAAQDLDERLMRALEAGDAAGGDRRGKQSAALKIVAAEDYPLLDLRVDEHAEPVAELRRVLLVARRQLVPFVAGMPRKDGPAGALPDAVVAMLLRPPAERPGAAGDAAPDLLRDVVGLRQEPRRVAHLLAQFAPVLAEIARLRDLDLADIHPPVVFDPTLPYRRVPHDDRRD

SEQ ID NO: 1099 - protein, 76 aa, Methylobacterium sp.
MRTIILSGALFAALCGAASAEETTVIRRDGPAVVDHRDTVVEKREVTTGSVDCGSKTVHKEDGMGNSKTVHKEGCN

SEQ ID NO: 1100 - protein, 415 aa, Methylobacterium sp.
VTAAPVSAAGIVLARVDRLAGISAYPWTLTRRVFSPQQAEAEALVLGWMAEAGLSARRDPAGNLVGRIEGAVPGGPAVVVGGHVDTREDAGRYDGTLGVLIGIAAVERLIRQGPQPRHAVEVVAFVADAAGRFGPRQLGSRAVVGRLAPDALDWDDAYGVTLRRALEAHGLDPAHLASERRAPDAILAYLEVAAEAGPVLERSGAPIGIVPALSESTMLRVTLTGAAVDAAANPMPGRRDALAGAAECVLAAEGVGLARERVTVTVMRLDVAPVPTFVVAGSATLGVRVDYDGARRAAVAELAAALEAVAARRRLGITVERSVDPDATRCDPGLVRLFEEAVAASGHRAVRLAQGVTTDASHMALLGPIGLALIRCRGGVGWGAAGTVDPADVAVGLDVLTGVVGALAGGRLSPL

SEQ ID NO: 1101 - protein, 373 aa, Methylobacterium sp.
VRRAIVHIGMPRTGSTAFQEVLARLRPRLAAAGICYPNLAPPGAPGSDDVNHYRLGQALDRRRGAAERREALARLDTILAATPADTVLLSYEDFSVQRPLWRVPEILSDLFARRGFALEAALVVKPQAEQLASAYALRAQVVAEGRTFRGFLRSEGGSRRYDYADRLEPWRRAAAGRVTALPYRDRRSDAPLLARLVDGLGLGERLAPLLGPADLAYRTNRSSGPVAVEASRRLYRLGVHRQVTGHRRLLGHVLDDWAWARGLDAERFRGDAPEGLARVAARYAAGNARFAAACWGQSWDAVIAAAPAAPPNELAAGPVAPETEAAVEALVRAAAARAAFRSPPAWRRRTAHILEECRERLGEAVGYPVWRVP

SEQ ID NO: 1102 - protein, 109 aa, Methylobacterium sp.
MRFALPVLAALAVTAALSRPAAAETILQERFGCHTQEVTDRLFKLVMAGDESGFGQLLQGSLASGECRSFKPGEEVRLESRTMSYGCLALKDTQDRCYWTPLSAIEKAN

SEQ ID NO: 1103 - protein, 260 aa, Methylobacterium sp.
MSLIAAKIVVTPTLMWAVSAAARRWGSLVGGLLSGLPLTSAPISIYLAAEQGERFAAEAAIGSVEGLGAVTVSYLVYAVAAPRTGGLASALLALAGFVLGGALLHGVVQPGLWLATAIDLPAMALVVALCRPAAGTESPARRARPPRWDMPARLAAATALVLLVSGLAPHLGSGLSGVLAPIPIISWPLIVFARAQDGVGAALDVVRGSAQGAFGVLAFYVCVHLLLGRIDPVAAYAAAIAVSAACVLPWLVARRRPLSA

SEQ ID NO: 1104 - protein, 220 aa, Methylobacterium sp.
MRILVVEDDPILSDGLRAGLGLGGATIDCVGTCADAEAALATSAFSAIVLDLMLPDGSGLDVLRGLRRRKDRTPVILLTALDAVADRIAGLDGGADDYLGKPFDLDELSARIRAVVRRASGRAAALLEHGGIRLDPGSLAVTVHGVPVSVSRREVMVLAALMERPDVLRSKAELEERLYGWQEEVESNAVEVHVHNLRAKIGKHAIETVRGLGYRMRAPA

SEQ ID NO: 1105 - protein, 147 aa, Methylobacterium sp.
MLAVLLATLGIGTVRAGSEAPAGYYADQKVVYHNGGAGPDGAAYFKRLLANLRNHVEAVGKAHVEIRVVSLGDGVGLFQSAANDTELAGRIDALKGMGVRFLVCANTVRERKIDRTTLYGVGEDDLVPSGVAELARLQGMGFAYIHP

SEQ ID NO: 1106 - protein, 181 aa, Methylobacterium sp.
LPAAQRRFDPDRRARIIRATLDVVAEHGVAGTTHRRVAAAADVPLGSMTYHFDSLDALLTEAFTGLADTVSARFADRLAAAATVDEACEAVVDLIVSDLWASPRTMLLSYELYAFAARNPPLRRVMQDWMAKSRAALERHFAPETAKALDAMIEGLTIHRSVDPQPADRAQVRAIVERLVR

SEQ ID NO: 1107 - protein, 199 aa, Methylobacterium sp.
MDHADDVVSEAALVAALEASGGVGFWMWDILRDEARADRVSALLFNISPARSRVGVSLAELLKAVHPDDQPHISQVILDCVRTGGSYTAEYRVCSPEGRLRWLFTRGHFYLDQDGRPTTGRGVIVEISDSKAAGAAFAERDGDTIDDALSRTADLCLSLHNTVSVLGDTALVALTETLLLEIGKRLAERQRAERSGGLH

SEQ ID NO: 1108 - protein, 131 aa, Methylobacterium sp.
VARPDLGTKRICPTTGKKFYDLGKNPVISPYSGEVVPIAAATSYSRGSAPVVARKEAPSDEEDETEGPELVSLDEVEAEESEKDTDSNTEDDDALDIEDDGEQVDDDNLVVDEDDDDTSDLVEVNDDDDDQ

SEQ ID NO: 1109 - protein, 232 aa, Methylobacterium sp.
MATVDFLAKLVRATPAGRDQDHIPTLVCSAVDIPDRADAILGTGPDPLPALRAALARLEAGGATRIAIPCNTAHHWHAALQAATALPILHIVDAVAETLARSAIGTATGGRIGLLATDGTLRSGLYPERLARHGLACRAPDEAGQAAVAAAIRLVKAHRVAEATPLLEAQVRALAEAGCDRVVMACTEIPLALAGSDPSGLLVDATEALARACVAACRPDCRADAAALPRAA

SEQ ID NO: 1110 - protein, 141 aa, Methylobacterium sp.
VKLSALKVDPVAIEVGQWVGEIPGSGDLRLKVRGYQNAQFRRLQQRLIDAVPRDKRRGGRVDPDEMDKITSTCLGSTVLLDWSGLEDETGAAIPYSKEQATELLTKPEYRQFREAVIYAATVVGEAEAQTGRDDEGNSSGT

SEQ ID NO: 1111 - protein, 512 aa, Methylobacterium sp.
VQGGPMTRAATAPTNLGDLVDRSGPPDRPLIVGVGPDGEPAVMTRAGLDARADAFARGLLRGGIARGARVAILAANRPDTIAALLGAMRAGVIPVPVNHKFPPATIAAVLADCGARLVLCDGPRRALLADLGPDIRIAGFDDGGPEGFAAWLDPGPFVPVVPEPDEAALFLYTSGSTGRPKGVRLSHASHLWVARTRAAETDLRDDRLLVAAPLYHMNALALALLVCAAGATMVLLPQFEARAYIAAIDRYRCTWLTAVPPMIAMMLREPDLLAEADLTGVRTVRMGSAPVNDTLARQIRALLPNARILNAYGTTEGGPVVFGDHPDGRPTPVASVGAPHPQVAVRLVGPDAPETGILQMRSPAIMLGYHNRPDVPVPITADGFYDTGDVFRRDADGFFYFLGRTDDMFVSGGENIFPGEVELVLERHPAVLQACVVPVDDAIKGTKPVAFVVRRPGSAVDEAALKAHVLANAPAYQHPRRVWFVEALPLASTGKIDRAALRRRAEEAVRAP

SEQ ID NO: 1112 - protein, 139 aa, Methylobacterium sp.
MSDTPLTKEQVEALLLRGPFHQWLGLSVVAVGAGTIELKATWRPEWVVNAERGYVHGGILATLVDLTADWALVSKTGRGVPTVDLRVDYHRAAMQGDLTCRGTVVKFGNQLSVAEAQILDAEGRLLASGRGVYMTAPPK

SEQ ID NO: 1113 - protein, 334 aa, Methylobacterium sp.
MKALVLEAHGDIDTLKVVDDYPRPSPGPGEVLIRVGASSFNYHDVFTVKGMPGIKVPMPVVIGLDMAGQVVELGADVTEWRVGDRVLVNPLNKAKGLMGEMLDGGMAEYCRVSTGQLIAMPPDVSYADAASLPVAYGTAHRMLITHNTVKAGDKVLILGASGGVGTGCVMLAKQLGAEVIACAGSAEKMAALTALGADHVVNYRETDFSKWAIQQYGKPQRRTYEGGVDVVINFTGGDTWVPSLKCLKRGGTLLVCGATAGHDPKEDLRYIWSFELKVIGSNSFYDDNLSALMDMIQAGTLKPTIDKLLPLEEAAEGLRMIRDREVMGKIVVTP

SEQ ID NO: 1114 - protein, 326 aa, Methylobacterium sp.
LKRIRALAVAALCAVGLPGLARAETVRIGYWSSGISLGFGAVLEAGKFMEKEGLTAEYVKFPDVNAPTKAMAAGAIDFAIAASAGTALSVTADGLPMSIVLATQVADLDFVVPEDSPIKTMADLKGRKIGTSPAGSGTAAIAAAILETNHGLKPADYQAVPGNDSRLAQFLVQKDIDAAALRTVTLALLPDVKLRRLGTFREEWKRLTKQDAPPVLGVGLMRNAWMTQNPDAPAKVVAAMRKAYAFGQADKPGVARILKAAANLSDADAAAYAGLWDGIYTVSLEPADIASLKREFDVFKAVGAVQGSLPDTALVPGPYERSKSIP

SEQ ID NO: 1115 - protein, 210 aa, Methylobacterium sp.
PGLVATPSFAADLGITLGRIGAGLAFAALVGLPLGLLLGASPRLGRFFEPVLTVTNTVSSAIWAIFALIWFGLSNWTTIFVVFMTAMPLILTNVWQGTRTVSAEHLELARTFRMPRRKVLTKIYLPTILPAFFAGARLAIGFGARVVLVAESLGASSGIGYRLRQAADLVQTDQVFAWTLTLVALMIGLETLVLKPAEQRLFAWKKVAQP

SEQ ID NO: 1116 - protein, 223 aa, Methylobacterium sp.
MFVFSIVQQKGGVGKTTLAISIAAELRARGKKAILIDADPQASAVAWASPRKLGFEVRAELIGGQTVSQWLRNVLKQQADFVIVDTPAGLGPAFRAAIDIADLIIVPCGPSSLDLNAARQTLSQVSSALRSDARSQARIVTIPTRVDVQHPEGQQIAEELSSFGEPVGPALSHDVYYVRSFSQGVAVTTAAPASPAAAEIRAVTDFLLRRLAERNGGLERNGA

SEQ ID NO: 1117 - protein, 417 aa, Methylobacterium sp.
MLALSAACGLPARAADMRIEAAKITGGDLWIIGYADDPGVEITLDGQFPHRTDSRGYFEFRVVYHPATCIATLRTPKQTRSIVVSECGQQGPQAPGLAGPAGPRGETGPRGEAGPPSERGAMGPPGPPGPQGPAARAAFTHLARWLVARSGTGGTLVALLDRLRPRPSGRYGSLPVSAWDIPTTLGLRAALVAAPEAAYAEALDAALRLAASDPEPTLARWLAVIFADDRPGADHALSARAVLARCDPPDPKAYGNSHVALPLIVDLPPAQAAPWYAAPYHRATLATCDVGAEEAAATVIAVADAAGEPATPGLVWLLEGAVGPERTIVARALLETRAADALDALLPRRAPALRGHQAGPRCPRRRRRGLPRLDAAGLSGRAPGQGGARLRPQGCDPRRAPRARGRPRLGGGRRGPR

SEQ ID NO: 1118 - protein, 280 aa, Methylobacterium sp.
VPTIAVIAPGAMGSAVGARLAGHGARVLTSLDGRGAASRARAEAAGMAHAGDGDLAAADLLLSIVPPADAEALARRLAPALAASPRKPVYIDANAVSPETVGRIAGIVEATGAPFLDGAILGLPPKPGSAGPRVYVSGPDTAPALVLRDLGLDLRVCPGDVGAASSLKMSYAGLNKGLTALAALVIGAAERAGAGEALLAELAENEPALLARFARGLPDMAPKAYRWAPEMEEIAGFLGPDAAGRQVFSGYAALYRRLAAEDGADEIAALMRFAAAAAEH

SEQ ID NO: 1119 - protein, 88 aa, Methylobacterium sp.
LRAPALAELASVPRYFIDLHDGANLVRDRDGFDLPDLAAARAQAVRILTRLAQGLTDPMERQDYVLAVRDAQGAVRLRLRLSYDVEGG

SEQ ID NO: 1120 - protein, 97 aa, Methylobacterium sp.
MPLERYLDGGAHILPADDSLIRFAMTNGQRVIAVEVPVPVLRQHFGGADLAPLELFARNQAVIEAAASQAYDRTETPNDLLDLGPEDFDTRPASART

SEQ ID NO: 1121 - protein, 62 aa, Methylobacterium sp.
VVATSIITARDDGDAKRQAKGLIAGHHAELWAGSRLVTVLGAFDFPIATAIRALADQPKSEG

SEQ ID NO: 1122 - protein, 234 aa, Methylobacterium sp.
VSRGAAAGTEAGAGSGAAIVLANASAAYDGRPVLSGLDLTVRAGERVALMGRSGAGKSTLIGLIHGQAPERVALVPQAAALVRPLSVFHNVYMGRLDRRSTLHNLRTLVRPARADVAAVEAVLDRVGLADRLWARAGELSGGQQQRVSVARALYNGRPILVADEPVSALDRQQGGRILTELARGHETLILALHDVALALAHTDRIVVLEAGRIVLDAPSAGLDPARLSPFYEAA

SEQ ID NO: 1123 - protein, 531 aa, Methylobacterium sp.
MGSVAGKAAGRATGKATGKAAFLPRPGYAAVSRWFLAAALAGLLVADLQVTTLHPFADLARLLGGLIRPDFLAVEGWSVLYTVAFAMLGVGLGAGTGLLLAVPFARSRAVRLACAGLRAVHELFWALLLMQVFGLSATTGVLAIALPYAGICAKVYAELIEEADLAALRVLPAGTGAVSAFLYARLPEVAGRMRDYTLYRLECGLRSSLVLGFIGLPTMGFAFESAFRQGRYAEAGALLLIFYALIGTRRLWVRARTLPILLVGAVLALPPTVGSAAIGPSLARFLGHDVVPAPLRGAPLAEPETWARLWSWLRPILTEQVLPGTAQTLILAQIALAATALGALVLFPLTARRFAGPIGRPLGRALLVVVRSTPEYMLAYVALQLLGPSMLPAILALALHNAGIVAYLMGRHADAIPYRADAPRGLDLYAYETVPRLYGQFLAYLLYRWELILRESAIFGILGVATLGFYVDAAISELRLDVAVVLIAATALVTVAVDAFSRALRRSLRIDALPTRLSGPQPITGAEREGV

SEQ ID NO: 1124 - protein, 245 aa, Methylobacterium sp.
VSVRLADPEPGIRLVTIDRPERRNALDRVTYAGLTDALEAAGRDAEVRALVLTGAGGCFTAGNDLKDFQDVETGGDSPGLTFLKALRACPLPVVAAVEGHAVGIGTTLLLHCDLAYAGDGARFRLPFTALGLSPEGGSSYLLPLVAGSKRAAELLMLGEPFTAADAAASGLINAAVPAGTALETALAKARALAALPRVSIAATKQALRRGHDDSVARALDAEAEVFHALRRGPAAQAAFAAFLRR

SEQ ID NO: 1125 - protein, 131 aa, Methylobacterium sp.
MEQLSDYRSCSAMSMDELALAVGLPGKVGGHGSEVEGMVERGEIDKVRAYCEGDVLNLFGLYVRWALLTGRTDAAGHNASLESLMGCLERERHDRPHFGEFLERWQATGGQSPMILPLAGGTDAGMHTGAI

SEQ ID NO: 1126 - protein, 256 aa, Methylobacterium sp.
VNAVELDHVSKWFDRREGGPLHVLDTVDIAIPQHAIVAILGASGCGKSTLLNMIAGLVEPDQGAVLLNGIPSHAFRDWRAMTYMFQEDRLLPWRTAAQNVAFGLEAGRMGRAERARRVDETLRLVGLEAFRDAYPHELSGGMRSRVALARSLVTEPKILLLDEPFSKLDPEIRAQMHAELLRIAGLRAMTLVFVTHDVEEAVVLASQVVVLHPRPGRIGTVRAIDLPYPRDPLSTEVAEEVRRLRISLSAASARCS

SEQ ID NO: 1127 - protein, 142 aa, Methylobacterium sp.
MNTIDLNEKTSDLNTDLIKCTASPVAAYVSRNAVGVGDLPVLIDQVHTAISVLQGGGSGSGPGWTGPTAAQIEASIQQDGLISFIDGRSYKTLKRHLTAHGLTPERYRAKYGLPADYPMVAPGYAAKRSEIAKAIQLGHKAA

SEQ ID NO: 1128 - protein, 71 aa, Methylobacterium sp.
MADTPDDTQAERMPHGEPERAGLADSPRDTATGTVRPQDGPMERAGTEKEEARRGGASLGAERDRPGGGRG

SEQ ID NO: 1129 - protein, 123 aa, Methylobacterium sp.
MTLPITPSRHTPLPVHSRNPRRAYDVDGFEITPMTFQQAMDKGVLAVRVICGCGHVEETPIYVGAWPSTSFVPDAGMTLRCSACSTPDPWTEPVWPAIPSTDGLEPSCLLPDQLPESDPGLVR

SEQ ID NO: 1130 - protein, 234 aa, Methylobacterium sp.
MGSLALCACAALPGLTPAPARAAEPTRTVFGTLPDGRTVEEVTLTNGTGLTARILSWGALLRSLDVPDRSGKAADVVLGYNDLASYLAKGNYFGASVGRYANRIRAGRFTLDGRTYTLATNDGPNALHGGAAGFDKRLWTITAVKGGAAPSVTLRYVSPDGEEGYPGTLTATATYALDDTNTLTVTYEATTDRPTIVNLTNHSFFNLAGEGSGRSILDQILPSRRSASRRSTPP

SEQ ID NO: 1131 - protein, 284 aa, Methylobacterium sp.
MSRSSLPATRSASSPPQKLNISAVDALVEKFRSRLEVDPAHPLRCSVRQDLAPSTEERRELSVARDYLARRIEPTEDRLEVEAVITTWLSTYDSGKGPEELNIEITDAQYVRALRVSGFSDLDEDPLDDGVTRYYPVQAIAAACDRLNRSHNLVPRNPAFRPHVPQLVNEVRAGLTKVRARIHAIERVLNASVYQPAPTRALSQADVTKLIDTALGRLREGDDRPENEKAIEESKRSIQNRERTEALAHLARRKAEVDAAIKAEEEAARLAASQQPPPSEQRPN

SEQ ID NO: 1132 - protein, 299 aa, Methylobacterium sp.
MKKLLTSLAAFTALTAAASAADLPRRAAPPPVFTPVPVFTWTGAYFGINAGYAFDASSNSTRGFVQTPGNPVALVPGGLVPYQALLPNGSSLVYSNDSREGFSGGGQIGYNWQLTPGSGAVIGFEADAQYLDFGRRARFATNAVAINPGFIPVNGTLNTIDFFGTVRGRLGWAFDRTLVYATGGFAYATGTDDGARVGLQNFAGRRNDFKTGWTVGGGVEYALPTDSFLNFFRSSAVTLKVEGLYVNLDNNNGRAQAPLVGAAISPVGLVPVYSLAGASRNENAFAVVRAGLNYKFGSY

SEQ ID NO: 1133 - protein, 404 aa, Methylobacterium sp.
LTIMTSLFAGIQDAPLDPIMRLFEAFNADPSPKKLNLVVGVYTDADGKVPRLRAVQTAEKRWIEKGLPKTYRPIEGTKPFRDAVQELLFGKGAPILSQNRAATLQSIGGTGALKTGADLLAKLYPNATVAVSNPSWENHKALFSQAGFTVVDYPYFSAETGGADYPAMKAYLQDLPKGSIVVLHACCHNPTGADLGLEEWRDLVPLMAERGLIPFLDIAYQGFGNGLDADAEPVRLFAESGQEFLVASSFSKSFSLYGERVGALTIVAENPAAKAKVESFAKRLVRASYSNPHTHGAAIVEIVLTDPELRADWERELGEMRDRIRAMRERMADSLQQRHPERGFDAIKAQKGMFSYTGLSPAEATRLREEHEVYALETGRICVAAVNTHNIDHVIDAIDAVVKG

SEQ ID NO: 1134 - protein, 113 aa, Methylobacterium sp.
VSHSLVNRDALEELTAVIGTEKLVRILERFVVSLTTAFEGPDRANDDYGREAHTLVSMSGMLGCAELSRACRGLEESAMAGDDLTRSLVDLRILRDRTVAALRDLQAETRLSA

SEQ ID NO: 1135 - protein, 80 aa, Methylobacterium sp.
MLHLAGLLEELERSEPARAAMSILETSLARRSTEEQGAFWRAVDIYYVSRKAPPEATVPGQLGSGEVVPSQAAPELAAAS

SEQ ID NO: 1136 - protein, 506 aa, Methylobacterium sp.
LNGALRSRQSAQAALRELDRQDYLQNHLRFVQRFFREKEGYDMIVGPHHRIMCETLDRVLRGEISRLIINVPPRYTKTEAAVVHLIAHGLALNPASRYIHASFNGPLALLNSTSVKDVMRLPAYREFWHREPRDDLDSKELWRTPEGGGMKAGSAGGPITGFGAGLMYEGAWRFTGALIIDDPLKPKDAPHETMRKAVNDNWNATFASRLATEDVPVIVIMQRLHVDDFSGFLLKGGAGCKWHHLLLPVLIDNAAEYPAEFTHGIPIAHGLPDGPLWPYKHNAEQIEALRHDSYTFAGQYMQVPVVSGGNLFNEDWLHGYDELPKLEYRMIYADTAMKDGERNDYSVFQLWGKGVDGRAYLIDQVRGKWLAPELEKVARAFWWMHADMETHHFGALRAMKVEDKASGTGLIQTLVRPYAGEGGRKGIAIPVIPIQRDKDKVQRANDALPQFACGNVRVPTDAAWFPAWKSELLAFPSGSHDDQVDPTCDAVSDMLVNVSNSRLVFG

SEQ ID NO: 1137 - protein, 535 aa, Methylobacterium sp.
VKPEAQRKAEREKAVALIRALDREEIVTEARERFMPFVRFTMPDPQDPDDAKRSAYDDQDFHRAIGLALEKVERGDMPFLILTVPPRHGKSQLTSRHFPAWLLGRDPRRHIVVAAHTDNLAEDFGADVRNIMSTPQYKQVFPEVAFQRGGNAKNRLQTTKGGLAFFVGRGTALIGRGADFLILDDLIKNAEEARSAAVREEVWEWVVKVAMTRRMSARSPVVIIMQRWHEDDPVGRITDPTNPKHDPMLASKFKIIDLPALAVDDDPLGRPKGRALWPLSKGQPKFDEEFLEQQRRLDPTGFHALYQQQPSAVDGTLFLRDNIRLYSPDELPANLTPYCTSDHAVGEDRKKHDASVLLGGGLDRGNNLWLTNCIWERWATDRIVEAMLDMAQELNPLIWAAERGHISKSIGPFLRKRMHERNIFFPLREITPSENKEVRAQAIAGRVAQGKVFFPRHAAWTERAIDELLKFPNGRNDDFVDALAYFGILLQSMFAPGRSEQERRAAEPKTGSYAWIKAMQKRQEQAEQFREGGGY

SEQ ID NO: 1138 - protein, 295 aa, Methylobacterium sp.
MDVFLQVLANGVMLGGLFAIVSVGLTLIFGIVKVVNFAHGEFLMVGMYLTYLAVTGLGLHPFAAVILVVPVLFLLGALTQRFLIQPLLAAGDHHIQIFATVGLSTVLINLALLVFGADIANTPPSGLRQPLEIGPVRVLLGQVVILGSAIVLVAGLQMFLARTRTGRAIRAVAQNRAAAELMGIDVDRIYALTFGIGAACVGVAAVLIAPLYPTSPNSGTYFVLIAFVVVVLGGLGSIRGAFVGAILIGLIDSVTGFYVGADMREVAVFGVFLAILILKPSGLFGRQLRLSHVSP

SEQ ID NO: 1139 - protein, 295 aa, Methylobacterium sp.
LRTVLARVGAQEDLNFLLTNRLPRRLATRFMGWFSRIEQPLIRDLSISTWRLFCDVDLRDARETRFPSLHAAFVRALRPGARPIATDPALLTSPSDAILGAHGRVEAGRLLQIKGLSYPLADLLGGDVALARAHEGGSYATLRLTAGMYHRFHAPHDLRVESVRHIWGDTWNVNPIALKRVEALFCRNERAVLRLRLAEGGHAVTLVPVAAILVAGLRLGFLPEGLALRETGGRTLPTASRLAKGAEMGWFEHGSTIVVLTPPGFTLCPGLAVGSILRVGEPLMRLPPLPGSAGG

SEQ ID NO: 1140 - protein, 203 aa, Methylobacterium sp.
MASFREALRVQRWDDHRYYHHNRVNQSLHVVSALSFLVAYALAFRDPATAALIGWLVAMTSRQAGHLFFEPKGYDHVNDATHEHKEEIKVGYNLQRKVVLLAIWALSPLPLYFDPSLFGLIAPHQSTADLIRNVGWIWLWLALAGLLFRMVQLFVQRDVQTGLVWVTKILTDPFHDIKLYHKAPLALLHGELVEEREPHERGA

SEQ ID NO: 1141 - protein, 228 aa, Methylobacterium sp.
MALGMHDTGSSRAGTLGPDLDRDGVAKAYGRWAPVYDLVFGPVFAQGRTLAAAAAERIGGRILEVGVGTGLSLPAYRRARSIVGIDISAPMLEKARQRVARLRLRNVERLAVMDAEQLDFPDAAFDVVVAQYVVTAVPNPEAALDEFARVLRPGGEIVITTRIGAEAGLRRAVERTLAPVTSRLGWRTEFAWERYAAWAAGAPVEIVERRALPPLGHFSLLRLRKRAA

SEQ ID NO: 1142 - protein, 267 aa, Methylobacterium sp.
MNDETEARGAGEDLLFSVAEGVATITLNRPERKNAFTFPMIEAWTAALQRCRADAAIRVVVVTGAGSAFCSGGDIVEMGERLDQPPARRKEELYGRIQRIPLTLEDLDKPVIAALNGVATGAGLDLALMCDLRFAAKSARFAETYVRVGLVPGAGGAHFLPRLVGTAKALELFFTGDFVDADEALRIGMVNGVHADADLMPAVAALARKIAKAPPLTLSLIKRAVYQGMRNDLRTNLDLISSHYAVITATPEHREAVQAFIGGRDRT

SEQ ID NO: 1143 - protein, 191 aa, Methylobacterium sp.
LEARHPGLRERYRRSADALAAGPLADLMAARHADEEELRVLRRQRMSPERERELLEANNRLVARAEAAETARHNAEEALATLRRERDVAREAEAFWQQFAFDADDLATRRLIEQTEARAEAERRAIEERCRRERAEAALRLFADRADVMPKEGWASELAKANRDIPLWWFHAARVALEPPDLSRPTESGEA

SEQ ID NO: 1144 - protein, 83 aa, Methylobacterium sp.
MSHSPSPLCIAETEAVAAVPRAAVRAYLALVAGLGGVVTAVMLMMSVAANSGSEAERISATQEDSYATTLVGALAVNLSKPLR

SEQ ID NO: 1145 - protein, 409 aa, Methylobacterium sp.
MTLRHRAATLLGSLCALGAGAALAADLVPVKIGVLNDRSGVYFDSTGEGSVVAARMAVEDFKPEAHGLKVEVVAADHQNKPDVGASITRQWYDRDGVDAVFDVPTSSVALAIAQITKEKNKAFINSGGGTADLTGPACTPNTVHWTYDTAALANGTGKAILKRGGKTWYFITADYAFGLALERDTKAVVEKNGGKVVGGVRTPFPNPDFSSFLLQAQASGAQVIGLADAGLDAANAIKQAHEFGIRQGGQTLAALLIAITDIHSLGLDVAQGLAFTASFYWDLNDGTRAFAERFEKRMPGKKPTSYQAGVYASTLHYLKAVAALHSAKDGAAVVAKMKEMPTDDPLFGKGTIRPDGRKIHPMYLFEAKAPSESKGEWDLYKVLETIPAEQAFRPMSEGGCPMLAGMTAK

SEQ ID NO: 1146 - protein, 145 aa, Methylobacterium sp.
MPSTMADDATTRSGRCHCGAVRFEAALDGDLASIRRCTCSYCRMRGAVVVMARPGGVRILEGAEALTTYRFHTGAAQHFFCSRCGVYTHHQRRSDPNVHAVNVACLEGVSPFDFPEVPVMDGVNHTNDTGQPTRRAGTLRFVPAE

SEQ ID NO: 1147 - protein, 136 aa, Methylobacterium sp.
MRSPLIALVVGAMALALAACDAPKPGPAGPPGTKGDPGPPGPAGPAGVNGATGARGPAGDPGPAGPAGPPGPSLSSQVRLDVACRRDEELIGAYCRGMAVVPSVTVTDGVSTVGCLDMTAKAAKDAKPVAVCMKRP

SEQ ID NO: 1148 - protein, 86 aa, Methylobacterium sp.
MALSGPIELVLRLGAVPRSGAIVLVEQAVDTYLAGYAHPEERAIALDILLRDLARLRIHEPDLDGFVGEVEHYIDLLHRDLARQAA

SEQ ID NO: 1149 - protein, 199 aa, Methylobacterium sp.
MRRPDQPALTAAANGRVSMPFLPTLAVVAILGVASLYCPTSKPGQAGARVEAGLSAAPGPTDFAPMAAVAAPGRPPAVIAFAEQYPLDAVIARTGSLPARPAVAARATSHVAAAGRRACPGRRCPETPRSNSDPMAPARGAADEAEDALLPSQAMPFAASVVETLVPAARAVGDAANLVRSSARAVQGTVALAVADCLR

SEQ ID NO: 1150 - protein, 263 aa, Methylobacterium sp.
MGLYTALSNSISGASAQSLALNNISGNIANTQTVGFKSTETRFADMLAETRDGTQLTGGVLPSTRNSLNIQGTMQSTGVATNLAISGNGYFVVKKNTGTPDSPAFAGDTGYTRRGDFAPDASGYLSNGAGYYLFAGPSATTPVQVPTGASTLASLAVSPAGTLTGTAADGSTLALGTLQLAQFGMQDNLASLDGGTYVATGQSGTPSYGLNGATITAGSVEQSNAGISDQFSKMIETQQAYTANTKVMSTTDQMLQDAIAMYT

SEQ ID NO: 1151 - protein, 96 aa, Methylobacterium sp.
VPKGYIIVRMTVTDPDTYKDYAAMASEAMRKYGCKPLVRGGRCEALEGEGRPRNVVLEFESYEAARTYYFSPEYQAAVAKRRPAGIGEVVLVEGVD

SEQ ID NO: 1152 - protein, 653 aa, Methylobacterium sp.
VDGGTVEKMRSVAALKTLLVGVIGHVDHGKTSLVRALTGVETDRLKEERARGVSIVPGFALLTAAQGEIDLVDLPGHERFVRAMISGATGMRAVLLAVDAHEGIKPQTVEHLEIAALIGVRRGVLALTKADLATPETVAARAAEIAAAAARAGIEAGPVIATSTVTGDGLPELAAALSALVAETEPVRDDGFPYLPVDRVFSRPGFGTVVTGTLRRGPLAVGDTVEIAPGGRTATVRGLQIHGRAVERAEPGRRTAVALRGIDLDQVARGQALSLPGLLAQSPWLDVAITAAPSLPDALAGGTACRLLFGTTEVEARLRLLDRDALEPGASTQAQLHLVEPVAVPAREPFVLRLDSPSVTVAGGRILDPASRRRRRHDPRVMADLAALAAGGPTEAITVRLGQLGAAGAPLNELARIAGSAPDRARQALSEGGARAIGDRFVGAAAFEALRTGTLAALAHHHRDFPMEHGIALERLSRALALPEAVTGAVLRDLAAAGGVAQAGALWRRAEFDPARNENEAARRLEQVFRRAGLSPPDEAEAIGRDVRRREALTYLVGAGTVIRAVDRVQRRAVLFHREAVATAKSRLIDAFPTARTAETGFLAREAGATLGISRKFSIPLLEHLDATGFTRRAGDRRVIVALEAGRAVPDAG

SEQ ID NO: 1153 - protein, 29 aa, Methylobacterium sp.
MSARLEDLKFMLTLSAVVLLGSGLGVILR

SEQ ID NO: 1154 - protein, 419 aa, Methylobacterium sp.
VIVGGGVAGIEVATSLGRGGRADVTLADRSLSHVWKPMLHTFAAGTARADRQKVDLFAQARRNGFRFQPGALVGIDRAARRVRLAVEAAEGVPEVERAYDLLVLAIGSRADDFGTPGVAEHCLTIDDLTEAEHFHEQLRCHLLARLDGGGLLEIAIVGGGATGVELAAELKHAINLFAVYGSPDLPGRLRLTLIESGPRLLPAFPEKVSRAAARTLSDLDVEVRTGAMVTAADADGFILKDGRRIPAGLKVWAAGVKAPDVLAGLDGLERSRAGQLVVGPDLRTTRDPAIVALGDCASLTDSRTGHPVPATAQAARQQAQHLARHLGRALARGDAPDADLPPFHYAEKGAIVSLADFNGWGTLGRYTFGGGRLNGLSARLTHDLLYRQHQIGLYGPLRGTMTWVLDDLDHLISPPVRLD

SEQ ID NO: 1155 - protein, 80 aa, Methylobacterium sp.
MTVPEFTLADPGQVPEVPPQPTPVPDRPYDPPQAPTQPPGPEIPGNTPAEAPGIQPPEIPVNDPGVPEISPPTGPANPIA

SEQ ID NO: 1156 - protein, 52 aa, Methylobacterium sp.
MAFFIGIACPWLLIAVLDRIAEGRRGAELSALGITPQSAPARSSYLVPDRPY

SEQ ID NO: 1157 - protein, 354 aa, Methylobacterium sp.
MLTVDSLWRARHRLAQFGKKRTGSPRILVIGVCQAGSIAKTMRYLLPHAQVDFVSAFTASRRFPRLADLMAHADGYDHVFTSIYLPKFKGGGTIDTLRTHPKVRLIPTIVFSAYHPDLVHVGVQDHVTLNGLISGPMGHSHSAITLFAYLSGFSQAQALRLFSEPVFERLGYFNLWDESVAYLRGLGVQAGYDLDTHLTRWARRGCFMHSINHTKLYVVADLARGLLTRAGVPFEECDLDAFLPDDLGGQGSWPVYPEIAQHYGVPGSALFFKAETRRSGPARTMSRPEFVAASYANYDRRERKLLISQRVQGWLNDAPTVDFLREAAGRGEAPARPASRAPAVNAGSLAGHAS

SEQ ID NO: 1158 - protein, 113 aa, Methylobacterium sp.
MRKVFVTLALLGTLAAPEAARAQSRTTLGVGSGAVAGALVGGPIGAVAGAVVGGFVGNSSERGRRHVRRGRRYGYAAPRRSYPRRAEAAVPRTTGSVARAAPPAQPTTWKDPR

SEQ ID NO: 1159 - protein, 177 aa, Methylobacterium sp.
MPLIDPARSLLLVIDVQVRLMPTIAEGDGVVANAGRLLAAAQLLDVPVLVTEQNAGGLGPTVPALAPEPGTAFAKMSFGATRTPGFLERLPADRDLVVSGCEAHVCVLQTVLGLRESGRRVAVVADAVGSRRIENREAALARMAAHGAEIVTTEMVAFEWLGTARHRRFRDVVRLIK

SEQ ID NO: 1160 - protein, 397 aa, Methylobacterium sp.
VTRLDDLERPGAAEPRALPPPPAEARPAKPVRDARVDVVRGLALLTIFIDHIPRNAPALLTLHNFGFSDAAEIFVLLAGYSSMIAYGGLFRRAGIRTALARIAKRCLRIYLFQAGLLLATLVIVRIWMDLTGLTPRFGVAPLLQMGLLPGLLRGLALNALPNYLDILPLYILLLALFPLIYLGMRRGIWGVLGLSGALWLAANVDHQLNLPNAAAVDDGWYFNPFAWQFLFVIGAALAVTIRAHDGLLPQRGWAVAAAAAYLVFAFLQGGSWAEWGLPDLRPLAIGPPDKSHVAPLRLINMLALAYLLFSAPAVARASRWRRLRLVDACGRHSLEIFAAGCLAALIGRILYRTFDPTWPLQIAVNVGGIAVMLGLAHVLDARVRRAAGTDPDARRPG

SEQ ID NO: 1161 - protein, 101 aa, Methylobacterium sp.
MRWASVDSKGKGAGSSGSRSSSVETLALHIGRLLRHPAYRREAVVSPLLRRHLPFEAGYAWNGEAGLRARLTSAALDEASIDHLIRNVQAEFLRLRRPADT

SEQ ID NO: 1162 - protein, 345 aa, Methylobacterium sp.
VPALGRACALVAAMLIAGGSARAADPAAGPLTIAEQGSFFVGGRDVQSDTLSTLPAYAPSGTISVDQIYVRYQVPVNAARPPLVLIHGCCLTGKTWETTPDGRMGWDEYLVRRGFPTYVIDQAWRGRSAASPAQINAVKTGQADPKTLPVVFSAGREPAWAIFRFGPEYPKVFPGMQFPLEAQGEFWKQMVPDWSAALPVPNPTVPALSELAKRLKGAVLISHSQSGIYPFQTAALDRTGLRAIVAIEPAACPDPAKDDLAPYKDLPILVLFGDYVDASPRWAPRLKQCRSFVAAANAAGGKAELILLPEIGIHGNSHMLMQDKNSLDIADWLVGWIDKRAPGKS

SEQ ID NO: 1163 - protein, 134 aa, Methylobacterium sp.
VRRVGVPTLALTLALTLRLAGTAAAQVPATPANPAAPASALDNYASAAATTIIAEQACPGVQVRAGQLTTLRLAARVNAGQEAILEEKLRTRATQVRQQLAADGRETWCAQALAAFGPAGSVAKGILSTGAPIR

SEQ ID NO: 1164 - protein, 472 aa, Methylobacterium sp.
MRRTMVWAVLALLIPAGARAEPKDSFARIDQINRASLVMTVETGIVPRALGATVARALDQVAADAAKPGAERPDDYLRIEPLITAIAGADATRMHSGRSRQDIIPTVLKLEQRDRLLNLAKALDETRAALLAVAEREPDTIVPAYTNGVQAQPTTLGHVYLGYAAVLARDADRLRETWARLNLSPLGAAALGTSSFPVDRERLAALLGFDAPVENSYDSGQLAPMDMGIELTGLAANLATTAGSFAQDLYAQYHQTRPWILLREGALTGPSSIMPQKRNPVALYSLRMKASDVVGAAQAFVIMAHNVDSGMPDYKRNQAEPPGRTLAEAAEMCRRWTRVLDGLVVDRARAADEVAADYSTTTELADTLQREADVPFRLGHHFASELVSYGRSHDLRPDDLPFPEVQRIYAEAAAGSGLKPDLPLDEARFRAALSARGMIDAAKGLGGPQPAEVRRMLGAAQARLRTDRDWLH

SEQ ID NO: 1165 - protein, 70 aa, Methylobacterium sp.
MTLIKPLETGETRSSKLAADPARRAAQAPSATLIPFPGAEARRTCRIPRSGERRGEILLFLGVRYERLAS

SEQ ID NO: 1166 - protein, 464 aa, Methylobacterium sp.
MQLWRLTATDLAALIRSGQVSAREVARDALDRLDAVNGRINAVVEHRPEDVLAQADAVDAARARGEAPGPLAGVPVTIKVNADQRGFATTNGLRLQRDLVATDDNPVVANLRRAGAVLLGRTNTPAFSLRWFTTNQLHGDTRNPRDPALTPGGSSGGAGAAVAAGIGAIAHGTDIAGSVRYPAYACGVHGLRPSLGRIPAWNASSPERGIGPQLMAVSGPLARSIADVRLGLEVMAAPDPRDPWWVPAPLEGPPVSRAVALCVRPGGLATAPEVEAALREAARRLSEAGWAVTEIADTPPIREACELQLQLWLGDGYAAVRAAAEREGDPAAIGLLESFRPRAEAMAPDAIARALTRRATLARDWALFLTENPVLLVPVSGELPFPDGLDRTGDAGIARAFEANLLQVGLAPIGVPALTVTTGLVGRTPVGVQLVAARYREDLCLAAGAAIEAGGVPEMPVDPA

SEQ ID NO: 1167 - protein, 530 aa, Methylobacterium sp.
MKRRTLLTGAGALMAGALARPALVRAASATTLRFVPYADLALLDPIITTNYVTRTHALMVFDTLYSLDTAYRAQPQMVAGHEVASDGLTWRLTLRDGLRFHDGTPVLGRDVVASLKRWAQRDAYGGALFATVDELSAPSDTVVQFRLKRPFPLLPDALAKPTSYVPVIMPERLSATPATQPVPEIVGSGPFRFVPEERVPGSLNVYRRFEAYRPRPDGTPSFTAGPRIAHFDRVEWRTIPDGATAAGALRSGEIDWWEQPLVDLVPDLNRQPAVRVDLVETAGLIGQIRLNHTLPPFDNPAISRALLAAVDQTEMMDAVAGSDPAIRRGPVGIFTAGGPMASSAGMEALTAPRDLAAAKRALAAAGYKGERVVLLSGTDVPRINAICEVMADACRKIGMNLDVVATDWGTVNQRILNAKPLDQGGWSMFGIFSGGLDHLSPAYHLAARGNGRAGVPSWLTDAPLEELRGAWFDAPDLDAQKALAARIQARALEVGAYLPCGQYFQPTAYRRDLEGMLTGLPLFWNLRRSA

SEQ ID NO: 1168 - protein, 429 aa, Methylobacterium sp.
SGGGPVPDAAAIRAAASARLAAERRPSLRPVFNLTGTVLHTNLGRALLPRSAAEAVAAVMVQASNLEFDLETGARGERDDHVEGLICRLTGAEAAVVVNNNAAAVLLVLNALAMRKEVVVSRGELVEIGGSFRVPDVMVRAGCRLREVGTTNRTHLRDYAEALGSRTGLVMKVHPSNYAIAGFTAAADPVALHALCRERGVPLADDLGSGSLVDLAAYGLPPEPTIRAALERADVVTFSGDKLLGAVQCGIVAGRKDLIARVRRNPLKRALRVDKMTYAALEAVLRLYLHPERLRAELPTLRLLTRDRDSIAAQAERLAPAVAERLAGRAAVTVAECISQIGSGALPVETLPSAALVLTPASAGGRGAGGRCRRLAEALRRLPVPVIGRISDEAVRLDLRTLEDEAGFLDSLAALPPVLDGGRTPRRTP

SEQ ID NO: 1169 - protein, 304 aa, Methylobacterium sp.
MASMTPAEMARVLGSGLLSFPVTHFRDDLSFDETAYRDNLGRLADYRVSGLFAAGGTGEFFSLTPAEIDRVLRAAVEETRGRTPVIAPAGQGTALAVEMARAAEAAGADGILLLPPYLVGSEQAGLAAHIEAVCRATSLGVIVYNRANAQLNEQTLAGLCERCPNLVGFKDGVGDVELMTRVYAALGDRLTYVGGLPTAETFALPYLEMGVTTYSSAIFNFLPEWALSFYDSVRRRDRDAVYRELRDFVLPYIAIRNRKRGYAVSIVKAGMSAVGRHAGPVRPPLTELDAAERAELTALIGDRR

SEQ ID NO: 1170 - protein, 359 aa, Methylobacterium sp.
MSVANLFPAERQDAKTVDRITIRRPDDWHIHLRDGAMLKAVLPYTAAQFARGIIMPNLVPPVTTVAAAQAYRERILAALPAGMDFTPLMTCYLRDDTDPDEIERGFREKVWIAAKLYPAGATTNSHAGVTDLVGITPVLERMERIGMPLLIHGEATDPEIDIFDREAAFMEGSLVPLLARHQGLKVTVEHATTAEILDVVREHRSRCAATITPHHLVINRTHIFQGGLRPHLYCLPVAKRERHRLALRRAATSGEACFYLGTDTAPHVRGAKEASCGCAGVFCGPSALQTYVQVFDEEGALDKFEAFASLNGARFHGLEPNAGTVTLERRESRIAEAVAVDDTAVVVFRGEETLPWSVV

SEQ ID NO: 1171 - protein, 287 aa, Methylobacterium sp.
MLDDHAHEAAVALDLPNDDAGRRRTSIYQPEQAGLIFPEIPDFADHAEERDYRKKHLVAACRAFAMHGFDYGFAGHLTIRDPERPELYWTNPMCVHFSQVRMSNLILADHKGRVVEGRHAINRAGFVLHAAVHEEYPEVMAMCHAHTTYGTAWCATGRPLEMISQDAAAFYNSHAVIGASAGAVAVEKESGLSVAQQIGRNRGVLHQNHGLLTCSQHSIDDAAFWFIALERACQQQLLVEASGIKPQLLSEKTARYSREHVGSDYIGWLHFQTLYNHIAETQPDMFA

SEQ ID NO: 1172 - protein, 302 aa, Methylobacterium sp.
MRRIPSFSALRAFEAAARLGSFARASEELHLTPSAVSHQIRALERWFGRALFRRANRQALLTADGQRLLAGLSSAFDAIEAVCADLSPPSPTSLAVHCTPSFAAKWLGPRLPAFVEAHPAIAIRLSTSADRVDLGRHEEIDILIAYGRPPHGPGLTVESLGPEEIAALCAPEVARAAQPDAAGSIGPFTRLDSSFSPVRWPDWFTHNGLPLPTGAAGAAFDRGSLVISAAVQGLGVALETLRFAQDELAAGHLVRLGGDRVASLARDLHFICYRERDGALEKIRAFRHWLLDVEARSRAEVA

SEQ ID NO: 1173 - protein, 55 aa, Methylobacterium sp.
MAEADPRKPGDEAPPGTPGTGENLCRTCGGTGKVADAQCSECRGSGTVTTGIGGA

SEQ ID NO: 1174 - protein, 74 aa, Methylobacterium sp.
VGLAAFVFFVVPWMAVAIWMSMRPSGARLGTPSAPWRPLTDYPPPARDQRQAGETRSMESGSAHDGKHAPIEAV

SEQ ID NO: 1175 - protein, 122 aa, Methylobacterium sp.
VVERRRTARRRVCLGGRLRVAAFLPEIDCTVRDVSLDGARIRLPAEAVLPDCVELFIPCRGEARRAFVAWRAGEAVGLGFAETRAATEPEAVARRLAASEAEVARLRAALLDGNSPEPGRVH

SEQ ID NO: 1176 - protein, 331 aa, Methylobacterium sp.
VANFFRRKPAAPAADKTPKPAEAPKPRRRDFSELKPDPDKIGISGSVPFVRLPDPATLFADRAARLTEAAPGHPLEAYLRFVGEVARAQAAIQARFPAPAAPDPADQALRSEHGMPPLSRHSLEADQDFDACLLALLDALDLATAPEASAAARDALRAAAPEERRDLAVQVFEGALPVDRIAECLFVSAALQVRFAERAACLDTRTLKPVADGVCPCCGGAPVASVIVSWTPADKARYLSCSVCGTYWNHVRIRCTACGDGEGVSYYGLDEVSKDVQVETCTTCHSYIKHLHQHRAPALDPVADDIASYGLDLKIAEDGFRRAGLNLLFVI

SEQ ID NO: 1177 - protein, 310 aa, Methylobacterium sp.
MADYSSLDIRQRSASTETPPEIRRQVEVAKLIDVSKCIGCKACQSACEEWNDLRDDIGVNTGTYQNPHDLTPKSWTLMRFTEYDNPETNNLEWLIRKDGCMHCTEPGCLKACPSPGAIVQYSNGIVDFIEENCIGCGYCVKGCPFNIPRISQTDHKAYKCTLCSDRVAVGQAPACAKACPTGSIMFGTKQAMIDQAHDRVEDLKSRGFAHAGLYDPAGVGGTHVMYVLHHADQPNLYAGLPNDPKISPLVAFWKGGAKVFGLAAMGFAAVAGFFHYVTAGPNEVVPEEEEEAVEYDEAKRRENGGEARPH

SEQ ID NO: 1178 - protein, 806 aa, Methylobacterium sp.
MDIKHADVITVMGGNAAEAHPCGFKWVVEAKAHNNAKLIVVDPRFTRTASVADLYCPIRQGTDIAFLSGVAKYLLDNDKLQHRYVSAYTNAGYVVREGYDFSEGLFTGYDADKRDYDKTTWDYEIGPDGYAVVDETMQHPRCVMQLLKKHLAIYTPEMVEKICGSPKETFLKVCELMATTASPEKSMASLYALGWTHHSKGSQNIRSMCIVQTLLGNIGVLGGGMQALRGHSNIQGLTDIGLMSNLIPGYLNIPVEKEPDYASYIAKRQFKPLRPGQTSYWQNYNKFFVSFQKAMWGDKATKENDWAYDYLPKLDVPTYDVMRGFELAKQGKMTGYVIQGFNPLLSFPNRAKMTEAFSKMKFIVVMDPLKTETARFWENHGEYNDVDPTKIQTEVFELPTTLFVEEEGSLSNSSRWLQWHWQAQEAPGECRSDIEIMSEIFLRMKAAYKKDGGAFPDPIVNLKWDYAIAEAPTPTELARELNGYTLAPTPDLNGTVIPAGKQVDGFAQLKDDGTTACGCWIYSGCYTEKGNMMARRDNTDPGDRGIAPNWAFAWPANRRVLYNRASCDPEGRPWSEKKKLIEWNGKQWIGFDVPDYGVTVAPDKGVGPFILNQEGVARLWTRGLMRDGPFPTHYEPFESPVANLAFPKIKGAPASRIFKDDLADLGDAKEFPYAATSYRLTEHFHGWTKHARINAILQPEAFVEISEELAKEKGIAKGGWVRVWSKRGSLKAKAVVTKRIKPLICDGKPVHVVGIPQHWGFMGHTKKGWHPNSLTPVVGDANTETPEFKAWLVNIEPTTPPSDAVA

SEQ ID NO: 1179 - protein, 197 aa, Methylobacterium sp.
MTVQVSRRGLLKGAGAGLAGGSLGALGFGGLEPAMAAAVRPYKLAQMRETRNTCPYCSVACGVILYSLGDRSKNARSSVMHIEGDPDHPVNRGTLCPKGAALLDFVHAETRTKYPLHRAPGSSEFKRVSWDFALDRIAQLMKEDRDKNFVAKNGDLTVNRWTTMGFLGASATTNETAWLTYKTVRSMGALVFDNQAR

SEQ ID NO: 1180 - protein, 113 aa, Methylobacterium sp.
VSRSIPLMMSVLLGLATAASPCLAQTKPGEIKGVDAMGDKSRSAQDGWSQAPVPREQSAAKDAPDPGGNSIKENADRPVPPAQPGGTSATEPQAPLEHRTAGPSGANPANPSK

SEQ ID NO: 1181 - protein, 51 aa, Methylobacterium sp.
MSLVTILLIILIILAFGGGGFLGGGAYRGPGFGLGGILLIVLIVLLVTGRL

SEQ ID NO: 1182 - protein, 261 aa, Methylobacterium sp.
MRRAPPAALLVAALSAVAALSSAAAPAAAAPDPSRDVLWAALKTCVLAKRLANRTFPCLSVDLGDGDRPGSAVLRAPGEPTHSVVMPTDTVPGLEAPVLRGPRGAAYWRAALAARPLVSDVLKGRLTPAEVGLAVNSARGRSQDQLHIHLDCLRPSVLKAIRAHGRQVRHTWNRFPVPLAGDRYYALRVPEAEAAQFNPFAALHTLPGARPDLHRTSFAALATPPGDPEPGYILLAYRAPSASAEDVMDHSCRLAASRSGA

SEQ ID NO: 1183 - protein, 579 aa, Methylobacterium sp.
MNRADAPQGYDADVIVVGAGPIGLTTGNALRHHGVSCLILEERTDVKAYSRANNLWARPQELLAGIGLRDLLAENSYAIHTINFFVNGTPTTPIPIADVASPYPKVLYSGQDVIERTLAGEFASRGGKLDRGCTVTGVEQDDESVTVVLRRGKDGPEERRRCRYLVAADGAKSTIRPMLGLDFEPERLPNCMNRQVDAKLSWRRSMEPDQLWFFYYERGFAGILPVWGGYHRLFFLADDAGVPDRDPTLDEMQAVAREVTGDETLTLSDPQWLTHSRFQYGVSPEYVRGRVFLAGDAGHLSLPIGGQGMNAGLHDSVEIAWRLAMTLRGEAGPVVLASYDGERGGEHARLSAQQARGFRWTVYRGAVTDTVLGLAAKALPNLGSLLQGTDDMQQMGVEYPKSLLNEDRLSGLATLLRSGPKPGQRAPDAEVTHNGEATSLFPFLCNPDGHTTGWALLCFDGRSSDAGESLLDIIEAVAPWPWVRPRLVLAGPMVDSRSVPVLSDMDGKAHGAYGLEGRPALVLVRPDGHIAFRSDADRADCLVAYCRKVFGSAREAPEADARRMEPRLMTEECRGRQLD

SEQ ID NO: 1184 - protein, 834 aa, Methylobacterium sp.
LTSLGPITSLIESAVDVGAADEGGSPLPGALADTANQIVLDTHAQLENAGHQVAALNGPLHGLTNLGETVGLGHIGEAGNLITDLTGAVANPTDAGSVVPVLNDAGQVAAAAGTLLNTVTALPVAGNGLVGSGGTLAPAVGILNQAVLDLHTTLEDVGHQVPVLNAPIHGLTGLGETVGLGHIGAVGNLLTDTLAVPGSLLTGGGLASATPVLADLGSVLEATDTLITSVTGAATAGGLLASGGLLAPVANLANTAVLDVHMTLENLGHEIPLLNGAVHGLTNLGETLGLGHLGEGGNLLTDAAALPGALLGGQGLGALSPILGDVGAVAGAAGGLLGGVTGIVGDLGGAGAPDAGSLLTPVTAAVDGLLGTVTGGAPDGTGILLGPDAPLQPVGAVANTLIDTVHGALEQVGHDVPLLNDPLHAVIALGNTVGLGELGDSHNLLTDTINLPGAILTGNAPGGVAQVVDDLGHVAGALGGVVGSAAGLLDSAGGGLGSGLPGGGLLAPVTSALGGLTGDQGAGALDGLLGGLNGGPGSGAAGALLGTNAPLQPVGDVANTLIDGVHAALEQVGHDVPALNDPLHAVINLGTTVGLGELGESSNLVTDVVNLPGAVLNGDGGPAVTQVASDLGSVTEAAGGVVASVAGILPAAGGDGHQAGSPVDGVVATVTTVLGGGETGGAGSAVGNLLGTLTGGTSGEPGAETHPLIDVSAGPTTPTPVADVAVLTPAADPAHTVDVSAVAVSADQPSLATANLLSGDSIHLPQTGGGADSLVGHLVNAVSGTSAAPAEAGAAQGVSVDLGVATIDLGGHTEVQHTDPTPHTATSGLHLLGL

SEQ ID NO: 1185 - protein, 392 aa, Methylobacterium sp.
VPIVLQLPGSLRLLALAAVAGLAAGCRDANQYVPPPPPTVSVAQPLVRTVTRYFELTGNTKAFAAVELEARVQGFLEAITYKDGAVVKKGTPLFSIQRNTYEAQLKQAQGALAAQQAALANAQSEYQRQSTLGRQEFASQARVEDAKTKQDQASAAVMEAQANLDIAAINLGYTQVSAPFDGVVTNHLADVGALVGISGPTKLAQLVRIDPLYVYFNISEQQVLLVKEHLLATHRTLGDLSKIPVGIGLQTETGYPHAGKLDYLAPQVDPSTGTLMARALIENGDHALLPGLFVRVRVPVGRQDKALLVRDDAIGTNQQGSYVLTVGADDTVSQRVVTLGPRDGRYRVIETGLAPGDWVVTDGIQRAIPGAKVAPQKVAVAEASPDPAPLPR

SEQ ID NO: 1186 - protein, 304 aa, Methylobacterium sp.
MRAVFVDASETLAAVARRLLRPDDPPFAIHADPGIAPEDLPAILDGAETAVIDHTALPLDVARACAGLKHVVFLGTGARSYMDPEALRDALGVTVHTIKGYGDTAVAECAFALMWAAARGLPEMDRAMRAGSWLRTEGIQLTGKTVGLVGFGGIAAEMARLCRGVGMRVLAWNRTPKTHPGVDFVPLDRLLAESDVVSLHLLLTDATRGFLSAARIAAMKPGAMLINTARGAVLDEDALVAALRTGHVARAGLDVFTVEPLPADHPLAHLPSVTLSAHSAFRTPEASDNLIGAALDHCRRIASG

SEQ ID NO: 1187 - protein, 450 aa, Methylobacterium sp.
  MOD_RES (313)..(321): Any amino acid
MTHIAVIGAGITGVTTAYALAQRGYRVTVLDRQRYAAMETSFANGGQLSACNAEVWNKLSTVMQGLRWMLRRDAPLLMNPKPSWHKLSWMAEFVREIAHYRANTVETVRLALKAREALFAMAEAEGIDFDLKTRGILHFYRDRASFEKATVVNALLREGGLERYAVTPEEIRAIEPTLAGRYHGGFFTPSDATGDIHKFTRGLAAACARKGVRFVQDASVETIAPGEGGYAIGWREAGRPAGDARVLRADAVVICAGCASRHFAAMLGDRVNVYPVKGYSITVNLLTPEAQAAAPEVSILDEAAKIVTSRLGXXXXXXXXXPRRRAPAGRRHRRVQRLQPRHPPRPDRAAGRLDPRAVPARRHRPGGGLERAATDAADHAAQGRPRPTARNLLQHRARPSRMDPLGRHRRARRRGGRRRARPGADDPAARGLTRVPEGPEALRQAVTAEP

SEQ ID NO: 1188 - protein, 422 aa, Methylobacterium sp.
MADRDSSATDGTVPPARGGRRWLALLALAGLGVLGYRLWPDASRAASPVAAEAKPPTVRVAAAARASDTLSLTQTGTTQAFDIANLYPRATGYIVERKVDIGSHVKAGDLLFRISAPDLDQQLVQAQSQVLQLQAALIQARAMVDQAEANRHLADVTNRRTSTLAGTGVETRQNADTSQAGVLAQTANVDAARAAVKVAEANIAAQEAQVARLKVLTGFEEIRAPFDGVVTARNNDVGDAVTADTNTGAPLLTLNRDDVLRMAVNVPLYAADGVRDGLAATVEVAQIPGRTFPGTVSRSSTTLLSAARTLVTQVDIPNPDGALRPGLYITITLEIPRVSPAVTVPNDALIFDQHGTRVAVVEAAGDGGGVVRMRPVTIFRQTRTLLELRDGLNGGERVVVGPPASLRDGDRVTLRPEDRAGA

SEQ ID NO: 1189 - protein, 384 aa, Methylobacterium sp.
MRIEAETVERMVAWRRDLHAHPELAFQEVRTADLVARELAACGLSVKTGLGRTGVVGTLSRGDGPTIGLRADMDALPIQEATGASYASRTPGVMHACGHDGHVAMLLGAARHLASRTDLSGTVHFIFQPAEECEGGGRAMVEDGLFRLFPCDSVYGLHNWPGLPLGTFATRVGAIMASLDTFEIAVAGFGTHAAMPERGTDTLVVASEIVLALQTIVSRRIAPTDPVVLSVTQIHGGDAYNVIPERAFIRGTVRCLDEAVRKRVAELVAAIAGGTAATHGARAEVDYRFGYPATVNTADAVGTALEAAGAVPDITARRGEVGPSMASEDFAYMLEACPGAYAWIGTDGTRKSLPLHNPGYDFNDEALPVGAAYWAALGAHSLRP

SEQ ID NO: 1190 - protein, 76 aa, Methylobacterium sp.
MPGETPHGPHLPEALTRLLKAPRAAIWPTPEDRNRLRPGRSRPRQPSRAVLGVWIWAILYNVLGFAILAALWWTMR

SEQ ID NO: 1191 - protein, 128 aa, Methylobacterium sp.
MTTISAKDLVAQANREVETLSAEEALARLGQPGTVLVDVREGEELAKAGRIAGAVHVPRGFLEFQADPASPTHRAELGGGKRLVLYCGSGNRSALAAKSLNDMGLGPVAHVAGGFTALAKAGATVAPA

SEQ ID NO: 1192 - protein, 218 aa, Methylobacterium sp.
VPRSRGAGEADRVAAILARLAERDPDPKAGFDRTDPFRLLVTVLLSAQSTGPTVSRIADALFAEARDPAAMAALGEARITEIVRPVGLGPSKARNIVRLSAVLLAEHGGAVPRSAAEMRRLPGIGRKSAEVTANFAFHEPVIAVDTHIFRIANRIPLAPGATVDAVADGLARIVPDAFKDNAHVWLFRHGRDICTARKPACPRCPVSDLCAWPGKATA

SEQ ID NO: 1193 - protein, 74 aa, Methylobacterium sp.
MSFALVPVAEAALFTFGCLVIHALRRHADVVTATLACLATLLVLMIGIACAPESFAKYQAASVADFARLDQAIY

SEQ ID NO: 1194 - protein, 76 aa, Methylobacterium sp.
MDEPKPNYDHPARSIATELVVRIMLEMMERSDPALRAEILRQATARAAAMTEHMPNADFFRGRVEAALAEIVGPDA

SEQ ID NO: 1195 - protein, 325 aa, Methylobacterium sp.
MAAAFVALALSMFGLFDLQAPRWWRDRFGAPAAQGGSVAGAAFLGFSSALVVGPCVTPPLAAALLYVAQTGNVLRGALALFSLGLGMGAPLVLVGAFGAGILPRSGPWLVRAKQAFGFVFLALAASLVTRLLPDGLSLLLWAALAIGTGVALAVLTSNGRPSRAGRAAGLVAVAYGGLLLLGAATGADGPLRPLAGLAPSHPNQIAEARMVSTLPAFEAALLAARAEGKPVLVEVAADWCTVCKTNERTVLADAGIRERLKAVSVIRADVTRDDDATRALMRRFEVVGPPTLILMRADGGEVREARTEGELTVEDLKRRLALVGA

SEQ ID NO: 1196 - protein, 217 aa, Methylobacterium sp.
MKASEAERSSGAGAYERLLRAIEEGELAPGSRLREAELAERFQISRTPVREALGRLEAQGLVAHEPHRGASVAQLDYGQVSELYDLREVLEGTAARLAAIHASTVETEILEEMVARDRTLLGDAPALARTNRLFHRQIHGAARNRFLQSTLETMRLSLVLLPGATTLAAPDRAAESLAEHAAIVAAIRTHDGDAAEAAARAHIRAAFKARIRIWQES

SEQ ID NO: 1197 - protein, 229 aa, Methylobacterium sp.
MAKLTTLALMSLLAITTGAQAAPKVERLRGTVEAVAGGGFTLKTRDGASETVALAPDAKVSWVVPSSLDAIRDGVFIGTATKGEPPVALEVVLFPEAMRGTGEGHYDWDMIPDHTAGGAPVRSAMTNGTVKADVRSTAPDAPRVKSAMTNGTVKASRGGAERTLTVDYGQGQSLQILVPPQAPVVSFEPANAAAVAPGAKVFVIAARGDDGRITARRVAVGKDGLTPPM

SEQ ID NO: 1198 - protein, 203 aa, Methylobacterium sp.
VRERIGVIMSAIVDFLTKTRDTFQAALDDSRFHATLAEIADLVTVSLRGGGKLLTIGNGGSAADAQHIAGEFVSRLNYDRPPAAAVALTTDTSVITAIGNDYGYEHVFERQVLALGRPGDVLLALSTSGRSPSVLTAMDAARGLGLRVVAFTGATGGVMPERADLCLHAPSDATPLIQQIHITAAHIVCGLVEESLFPRGTAA

SEQ ID NO: 1199 - protein, 145 aa, Methylobacterium sp.
MVLVHTGIARRATTTVAAQIAVTRARAIDKELSELYRLVEECVSLLEAGTSGWLGQLGEMLSASWRIKRTLSREVSNAVLDDLFEAIVGSGAYGAKLCGAGGGGFFLALIDPDRLPALIERVAPLSVVPIGIDVDGSTLIYRQTR

SEQ ID NO: 1200 - protein, 89 aa, Methylobacterium sp.
MRTGRRFSLFSLPIDPWPQASLAERTAVGMVLTGLLLVPACAVGAALLVFTTLAAHVYWSYDLGASLHAFIARHAGAAVARRGRLVHKA

SEQ ID NO: 1201 - protein, 164 aa, Methylobacterium sp.
MRSRILLLSLAALGLANAPASAQDASVIGKDTILPATGPGTSTDGKGGGRLTEAASAEDAAKRQGLKPVTFLTTKMIGVTVRNAAGDSVGKIEDLLIADGVTLKAVVIDVGGFLGLGSKLIAVEPGALVLRPGGDRFSAVLNMGKDTVAAAQPFDPAKVIAPPR

SEQ ID NO: 1202 - protein, 188 aa, Methylobacterium sp.
MTGQSGHATASRTVWLDLPERYGRVSRGFHWVMAALFAWQFTGALLYVTIGDAALTRLIGGSHFTLGFTLFVLVLLRGVWGLANLHRRPAHPGAPGRAVAAGHGLIYLLMVLVPSLALLRQYGSGKPFAPYGIPVMPARETKIEWMMLPADLFHYWLGFTLLVVVLGHAAMAFLHRRLWNETVLTRMT

SEQ ID NO: 1203 - protein, 446 aa, Methylobacterium sp.
MARTDVDAEILRFESETGEIRQAPEPVGLRVTTLVLAAFLTIGVGLSAVARVDRVVTSDRGRIIPSQGPILFQALDASIIKSLDAREGEQVHKGQLLATLDPTFASADVDQASKQLASLDAQIERAKAEQAHRSYDPHSSDPDRVPYDKLQKQLFDQRASQLKSQLASFDAKIAQTKATIKKLEGDEARYTEREKISGQIEGMRQQLVEKQAGSLLNLLIASDSRLEMLRTMENGRNAMVEARQQLSSLQADRDAFLQQWLSQSSQDLVTAQGTRDTVVAQLAKAARHKDLVQLHAPADAVVLTRAKVSVGSVLREGDTLMTLVALDAPIEAEINIAASQVGFVRAGDPVTLKVDAFNFVEHGFAEGHLRWVSEGSFSLNEDGQPVPPYYKARVSIDQLKFTRVPVGFRLIPGMTLTADIHIGDRSVLAYVLTGASRGLSGAMREP

SEQ ID NO: 1204 - protein, 561 aa, Methylobacterium sp.
MSEANTAPRVLMVFPKFYENSMWNFKEAMELQGARAPAPPLGLITLAAMLPPAWQVTLVNRNCEELTDAQIQAADLVMTGGMLPQEPDCLVVIDRCVALGTPVCVGGPAPTSTPEVYDKADFLVLGEAEGILDKFVAAWEAGERRGRLTAEKFKADVTKSPIPRFDLLTFSHYLYIGVQFSRGCPFTCEFCDIIELYGRAPRTKTTPQMLAELDRLYGLGYRGHVDFVDDNLIGNKKAIKLFLPHLIQWQEEHGYPFKFSTEASLNLADDDELLGMMRDANFFALFTGIETPDEATLIQTQKKQNTKRSIADSVHKLYEHGMFVTAGFIVGFDTEKDSISKAMSLCIGQTGIPIAMVGLLFALPNTQLSRRLRKEGRLYENYAATTADQGDQCTQGINFVTLRPQRDVLADYRDVLQEIYDPPNFFDRVRVVARRVKRPKFAAQKLNWGHIAHDLYSLLRVCWRMTVRRPELAKHFWSVFLETARRNPAALEAVVTNMVIYLHVYPFSRYVIREINGRIADLDAGRWVQPPVLAPEAETCKAPPVGKVVAKAEVKHLAAVA

SEQ ID NO: 1205 - protein, 299 aa, Methylobacterium sp.
VAATVAARGLFPVKVVADVLGVARSNLVEQIRSGSRSRGPYRRADDEAVLIAIRAITDVRPTYGYRRVTAILNRTRRATGEPALNHKRVFRLMKRDSLLLQRHTGGRPVRAHEGRVIAAASNQRWSSDGLEIGCWNGEAVRVAFAIDTHDREVIAWVASTGGITGQMVRDLMLTCVEARFGSLEARFGSLCATHPVQWLADNGSAFTAAETLSFAAALNLVPCFAPVRSPESNGVSEAFVKTLKRDYARVQPRPDANTVLARIGAWITDYNEHHPHRGLGMRSPREFIRAQMQPAPCPV

SEQ ID NO: 1206 - protein, 136 aa, Methylobacterium sp.
VRWCSDHLELRCRDGAVVRVLFAIDACDREIIAWSATTTGVSAEMVCNLMIACCERRFGATKTPHPVEWLSDNGSAYIAKETAQTAAALGLRLLHTPVRSPQSNGIAEAFVKTLKRDYARLAILADAETVMRLLSA

SEQ ID NO: 1207 - protein, 153 aa, Methylobacterium sp.
VRVAFALDCCDREAMSYVATTAGITGEDVRDLMMAAVEHRFGAVNQLPSLIEWLTDNGSCYVARDTRRFARELGLIPKTTPLESPQSNGMAEAFVRTLKRDYVRVSVLPDAESVLRQLPVWLAHYNDLHPHRALGYRSPREFITRSTQETLSG

SEQ ID NO: 1208 - protein, 82 aa, Methylobacterium sp.
MNVMLGRVSLAAALVIGVSGAALARDAGPKAHGAKGTAGLHGIGFNEPKFRSDLRTGKEQPYTWPVSDRYRPVSQPFYGRAY

SEQ ID NO: 1209 - protein, 59 aa, Methylobacterium sp.
MTSRTVQSALLALALVAGSAGMAAAQSTPNGNTSSPGAPAGDNSTGNGATGSGAAPSGR

SEQ ID NO: 1210 - protein, 261 aa, Methylobacterium sp.
MARPVIGVIGNARLIDSRFPAQIVGENNMRAVAAVAGALPLMFAAVPTITDLGDLLDIVDGVLLTGGRANVHPARFNTEPCAAHEPYDEDRDAVALPLIEACVAGGVPLFGICRGFQEMNVAFGGSLHPEIRDLPGRLNHRMPRLANGEIHPDLELIFADRHEVRLTPGGAFARLLERETIRVNSLHGQGILEPGGRIVVEGVAEDDTVEAIRVRDAAGFALGVQWHAEHDPATNPINRTLFEAFGAAAATRHRARRAGRG

SEQ ID NO: 1211 - protein, 740 aa, Methylobacterium sp.
MCVDFAPAPSDRPQKRLPYWGPLLLSAAVGIALPADEVAAQPVSGGQTAVTLDEIQVVGQGGLSPNTATGPVNGYVAKASASGTKTDTPIIETPQTINVVGARQIRDEGASTLAEALAYTPGLSSQAVGGFAKVSDGFTIRGFTVEAGNSGLLRDGLKLQSGVYDGTQEPYGLERLEVLKGAASILYGQLSPGGIVNAVSKHPLQTPFNEMNVSFGQYNRKEVSGDFTGPLTDDGAWSYRLTGLIRNSDSYLAYTPDDKRYIAPAITWRPSTATSVTLLGYYQEIHTRFQPPLSAVGTLLPNGRFPRFAIDRFYGEPAFDRYDSRSGAIGYQIDHAFSDSVRLRHALRYYQSGVDWDYLLPNGLLANRQVATRGISMRNENATGVASDTSLETKFVIGPTAHTLLTGIDYYRSFLNSERYTNGTVGNLNVYAPVYGLTYPRINYAINTGSKSLLDQVGIYVQDQVRFDRFVFLAGGRQDFARTQVLTYRTGTQLDQNDSAFSGRLGLLYLGDYGLAPYVSYSQSFQTFAVTDRNGNPFQPSLGEQYEGGLRWEVPGADTLLSAAFYRINQTNALVADPVNPVFSTQAGQVRSQGFEAEARTNFGPLEAVASYSYTDARQTRTTVAANFNQRLDLVPYNQAGVFGTYDMGMFGIPGLRLGGGVRYVGSSNISGATFDSRAATLFDLVALYDFGAADPSLKGWRAQINARNVLDHSYVTCVTVNGCRYSEPRNVFGTLTYRW

SEQ ID NO: 1212 - protein, 637 aa, Methylobacterium sp.
LAITGTEQRYNTVAAVEDGGRWRMILPFPQDSIRAAALVGAAGLVCLSDDGELCLIDWRAGRDRVRRRLPGEGPFNHKLFVTRDADRIAVYRSHGPKNDEQYFDDIVVLRASDLEILQHGRGLVWHADGPVGSLSPEEAYPPRPDGPTILTIHGDLFEDPGGRLAFIGFRCGPDGSAYGLCRLERAGATLRYDPLPDAVKPYWFSPSGRYAVTPHSDPARGGPPEAAADTGDAGPPRLGQAVELWTTGPVARAATLVARAGSEPPRAITEVAWEPDERAFWIKSGYFWDRTTDFQRIGLDGTRSPVFSFARYDGAKAVSAFADVADAERVEIRFFSDSVYIPRARCADAAPARTITPEEDGYRPRPSAGPSASAVRCFLARSQPVVTVAAFSAAAIAEALDALTGRIRADLGGLLRGDVLALTFEVGGRAMTESAFFARIARERVAVVPALRALLTTYLAVQPGVVEARKLYRQLWGPEDDQGALAPAMQALLHLDPTAHDVFRDYLAQRDGEHEVYSTDVMMRTYIAEAGWRDRAMIRFGVYFALIRYRDGLITLSGGFLEEYGVLDAAEGLLEPADFAALILEELDGFAARPDLDCRLGRDDLYRELRASLATTAYGRTVLTALAARSAASSRLA

SEQ ID NO: 1213 - protein, 55 aa, Methylobacterium sp.
MPGDLIPCSLFLIGILVSVAADCRLRRVEAAPWANGCITAAGAALVFAACAAAMR

SEQ ID NO: 1214 - protein, 113 aa, Methylobacterium sp.
VQIRIALAFGAITLGGGALAPAPAQAYQLDTVNLVGCAQEGGVCRMPYPTNVYYGVPGRTNGRPFPQGGVVPCNTQTFGDPAPGQAKSCWYAPRINAGGGGGYGGGGYGGAHQ

SEQ ID NO: 1215 - protein, 286 aa, Methylobacterium sp.
MDSGNRRRGRPKGFGGAKPAATIQALDRALDVLDVLAGGDGLTLSELAGRLEQSVATMHRVLATLERRGLVEISADKQEWHVGAEAYRLGSAFLRRHNVVERSRSMMWTLMQETGETSNLGVEKDGNVLFVSQVETHETIRAFFPPGSLSPLHASGIGKALLSTYAPARTERLFRGKTFARFTDKTIGSLDQLRDDVEATRRRGYAIDDEERSIGMRCVAAPILNVHGEAIAGISVSGPTHRLSDEKLRAIGERVRRGAAAVSRALGAPAATMTATPDAPGAPDRD

SEQ ID NO: 1216 - protein, 688 aa, Methylobacterium sp.
MTAPRPPVAPPAATAPPRWFRLPLAGKFAVAFVGLVSLVLLINGAVDLTLNYQDAKRTAIETQRTKARAAAERVDAFLSSIEGQIGWTTRAEWRRVSPEQQRYDFIRLLRQAPAITEVAYLDPAGKEQLRVSRLEPDAVASGKDFSTSPRFTQALAQKTWFGPVYFRRGSEPYMTVSVAHAGRDPGVTVAEVNLKLIWDVVSAINVGEHGYAFVTTATGRLIAHPDLSLVLRDTDLSGLPEVAAALPGSRMAGQDYEITTGLDGGWVLAAHATIPRVYWIVFVQESLRDAMGPALESVIQTTSLMGLGVLLAAVAGTFLARRMVVPIRELEDGAERFGAGDLSERIVIRTGDEIETLAHRFNTMASRVQDSYETLEAKVEERTRDLNRSLDDLQRAQSRLVQSEKLASLGQLTAGIAHEIKNPLNFVNNFASLSNELVDELREVLEPTALDPDTRAEVEELAGLLKGNLEKVVQHGKRADSIVKNMLLHSRTGSGEHRPVEVNALVEESLNLAYHGARAAKPGFNVTLVRDYDPAAGLADLYPQEITRVLLNLMSNGFYATEKRAADGEPGYAPTLSVATRDRGDGVEIRVRDNGTGIPDSVKAKMFDPFFTTKPAGEGTGLGLSLSHDILVKQHGGTVDVATEPGAFTEFIITLPRQNVTPEAPPRPPTVAATEPATEAATETESQP

SEQ ID NO: 1217 - protein, 469 aa, Methylobacterium sp.
MATRTAVRASDEGLDPGAILARLDRLPATPTVWRLVVLLGLGFFFELYDLLFTGYVAPGLVKAGILTPTTPGLFGASGVASFVAALFTGLFIGTIACGWLADRFGRRAIFTWSLLSYTAANVVMACQSDAFGLNLWRLIAGIGLGLEMVTIGSYLSELVPKAIRGRAFALCQGIGFTAVPVVAFLSYLLIPAAPLGIDGWRWVVLIGASAAIVVWWMRAGLPESPRWLVEHGRLAEAEAVLRRLEARIAAEHGRPLPAPAAPEPVQPRGAFRDMWVQPYRRRALMMAGFNVFQTVGFYGFANWVPTLLVAQGITVTSSLAYTALIALAAPVGPLIGLAIADRFERKHVIVAAALLYIACGLAFAQTRDVNAIVALGIGLTLASNVMSYSFHAYQAELFPTGIRARAVGFVYSWSRFSAIFTGFVIAFVLREAGTPGVFLFISAAMLAAGLLVGLLGPRTRDVALEKIAG

SEQ ID NO: 1218 - protein, 65 aa, Methylobacterium sp.
MSDTNNPGDKTLNRTSPKPLGLKRPIEAGTVRQSFSHGRSKQVVVETVKRRVIGAAPAAPAREPA

SEQ ID NO: 1219 - protein, 83 aa, Methylobacterium sp.
MNGEDPQDDERGALVRIARTLGVPVATFLTADPTDTPDIETVVEGPDHLAEFVALLRLFVRLKSPEARARCLAYVVQEATHDS

SEQ ID NO: 1220 - protein, 60 aa, Methylobacterium sp.
MLVSAAIAVLGLLVALGYVGHPIDAQLVSNYGWSILIIGVALFVLFTWARYSRTRRRRSV

SEQ ID NO: 1221 - protein, 58 aa, Methylobacterium sp.
HMAQPHVPPAPRAPAAPAVPQYRPAQGNLDGQGRAAPQPRMMDDDQLEIPAFLRRQAN

SEQ ID NO: 1222 - protein, 53 aa, Methylobacterium sp.
MIMILICFLAPWLAMFLRGKVFQGILCIILHLTIIGWIPATIWALVVTRKEAA

SEQ ID NO: 1223 - protein, 89 aa, Methylobacterium sp.
VTLLLAGFWPGLAGAAALGLVVGALVGWPDRLAASLGLCVVAGLVAAAAIAGFVPGLPGLWLDGAALMLPVYCAACLLGALGRRLAGRT

SEQ ID NO: 1224 - protein, 149 aa, Methylobacterium sp.
LAEDIRKLLLAAFDVEHREHVAAIRGALGSATPDWNDVFRRAHSLKGASRAVDLPAVEAVAHRLETLFEGVRTGATALDREAANAVHLALDRIESYVAGLTDGSGPDMPADALAALGQVLRLPGETPPPAPPAPPAASPAASPPAPLPD

SEQ ID NO: 1225 - protein, 182 aa, Methylobacterium sp.
VAGLVLAGLAAGTLGMLPASAAAPTAAPPATDLKSEGPTQPAKVQDGQYTDKNGNPTYHVTDGGKMVDWYTMSGYVRYSANCMACHGPDGLGSSYAPSLVDALKGMDYAQFAGIVVGGKRDVNASQELVMPAFGENKNVTCYLPDIYTYLRARSDGALGRNRPSEHEPKPAAFEKAEDACMK

SEQ ID NO: 1226 - protein, 182 aa, Methylobacterium sp.; identical to SEQ ID NO: 1225

SEQ ID NO: 1227 - protein, 243 aa, Methylobacterium sp.
MTDFNRAAFFNAVRASGLCGKTLSQTVVDGLSGILDASAQYQPGADLRHVSYPMATAWHEARLNAAIREIGRGAGHPYGKPAGPYGLVYYGRGPCQLTWYDNYVTFGKLMGVDLARFPDKALEPEIGAAVLIVGSRDGLFRKGKSLSRFFSATVDDAVGARDIINGDVKKNGAMIAGYHRVFLAALKAAGSVGPVPVAAAPAPAPAPSAKATATAAVHGLGAGIRDALDSVHTAIHDVLRKAA

SEQ ID NO: 1228 - protein, 271 aa, Methylobacterium sp.
MTAALDRQAFFNAVRLNPFPGHLTPAQVSGMEAILDACPVDTPSEHLAYDLGTCPIETGWTMQPIKEKGGAAYFAKMYDIRGDRPDKARELGNLSPGDGIAFCGRGLVQLTGRANYRKATLRLRALGLLITGQDLETVPDLAMHPDVAAAILFIGTREGWFTGKKLSDYLGGGKADWKGARRIINGQDRASEIALHAQAFATALKKAGYAPGAVVTKIPVPPVQAAPVAPLVAPAPRRAADPPPPDTGGVTAPPVGLVAWLKKTLFPKKAA

SEQ ID NO: 1229 - protein, 136 aa, Methylobacterium sp.
MPDTSALNSAAGALAAGRQVQSGRIRAISENLANADSVPTTPGGAPYARKIAVFAPVAADSPRDPVGRIVRDTTGFRTRYDPTNPGADPTGYVRLPNVNVAVESADLQRVVRNYELSLSASASIKTLAQATINLIS

SEQ ID NO: 1230 - protein, 32 aa, Methylobacterium sp.
MVLKGFSYAMIGAFLGGLAMTVTGSAGVLMGF

SEQ ID NO: 1231 - protein, 608 aa, Methylobacterium sp.
MLSGDGTVRHDDAASPMGAVTSIEGSKVHLELIVQGGRPRVRVTVGNLVRIRAGEAILVGIVTTLSSGSERGHRPGAYASLDLLGEIVAAHGARRFSRGVSCYPAIGDDVELLSATDLRIVHQVSATGTAAVGALYQDPETPACIKIDDLLSKHFAVLGATGVGKSSGVTVILDEVMRARPSVRVFLLDVHNEYAASFGDRASVINPRTLKLPFWLFNLEEIADVIYGGRPAVDEEIEILAEVIPLAKSKYGQYKEASDRQIVKRPFGKGAGYTVDTPVPYMLQDLLALIDERMGRLENRVSRMHYHRLITRIEAIRNDPRHGFMFDNANVGGDMMGEILAHLFRLDPDGRPMTIMQLAGLPMEVVDAVVCVLCRLAFEFGIWSEGAVPLLFVCEEAHRFASADRSVGFTPTRRALARIAREGRKHGVHLGLVTQRPAELDATIMSQCSTLFAMRMTNARDQAFLAAAVSDAANLLTFVPSLGTGEVIAFGEGVPIPARMTFRPLPSARHPRNDASGRAAEDDATVAGAAFVGAVVERWRGATMNKVAGYDSDPAAAARLGRETGSDSPHGAALEQVHRRLLRRPLEGGDQAQTGAQPAKPLWQQGGA

SEQ ID NO: 1232 - protein, 562 aa, Methylobacterium sp.
MSEPAFPERRTLLEAALQALPVGVVVHDTQGHCVLANAAARALGDRAVQALPAAAGSAWDAATVEALNDRMFEVRTRPVAEGRDGFTLTTLTDITHHHRIQRELITKAFIDALTGLPNRTMFEQSIADVLAGSAPGDRFALAFIDLDNFKHINDYYSHAAGDALLRKVSDRIGGALRPSDLLARIGGDEFVLLLAPVTDGDAALAAVRAISERLKQPFFIDGHEIFASASIGVSLFPEHGDSYETLARQADNAMYRVKGELKGGVSVFDDAMSQAATARMAVEQRLRLAIRDRCFCCAFQPKVDMRSHAVTGVEVLLRWRDEVGMIQAPGDFIALAIELGLINEITLQLLAETVRAMPDIDEVFGPDVTVSLNIAAKQACDVPFMTAFCAALGETGLAERFVLELTEEAFFTTGRFQREVLPKIRAIGARVSIDDFGVGYSSLAALADITADELKIDRSFITDIDKRPRSQIVLKAIESLGAALGMTVVAEGVETFEEVAYLLGATQIRCAQGYYFARPLLLDQIRQAEPPRMSGSRGPATRGRASDLRASDLRASSLMRRA

SEQ ID NO: 1233 - protein, 406 aa, Methylobacterium sp.
MRVLARALAAALVLGAAAQAAGPTTARAADVKFGALFPFSGQLALLGEESARGVEIAVDEINAAGGVQGQKVVLARGDAVDNNQAIGEARRLISLEKVAAIFGSYSSARSIAASQVAELSGIPYFELGAVAEEVTGRGLQYLYRTNPTAEDMAKLAVEMIVNKVAAGLGKKPEDLKIGIIYEDSSYGTSVAGFQKKFAAQAKLNVVTAQGYPASTVDMSSLVLDLKGRGIDVLLQTSYQNDSVLFLQQANEAGFKPGAIIGGGGGYSMQPTADAVGHKVIEGVLDTDFTQYLVNTKYTPGIENFVAAYQKKYGSAPRSGHSLNNYVGAKLILEAIGKAKGFEPDTIVKAVQAIDVKDGVTAVGYGFKFGKNNQNERAAMMGMQWQGGKLVTVYPDSAAVAPMEMRK

SEQ ID NO: 1234 - protein, 58 aa, Methylobacterium sp.
MLALITARIPGPSVETADRDPGFLTLIFAVARTLRGGAESAFARRCALARSIGGPNPL

SEQ ID NO: 1235 - protein, 105 aa, Methylobacterium sp.
VTRGTLVDGRVCLARTDAERAPLVRRLARIEGQVRGLRAMVEADRHCLDEIQQIRAATAALREVGLLIIDQHVAAGLRLAARDPDREAVMADLLRVLRAAMAEAG

SEQ ID NO: 1236 - protein, 131 aa, Methylobacterium sp.
MSPLSMLPRAVIAAAVVFGLALSSAAVAARTAPGPAVRAWLSDLVTRIDAADRAGTRPGSGRGRGTVVVHVQIAADGVVQGAEIEESSGSANLDQRALRAVQGISPAPAPPAALLGVDGIVDLSIPVALGR

SEQ ID NO: 1237 - protein, 168 aa, Methylobacterium sp.
VRAILLICLLGFLGVTAVLKLRDATRPAPVALAVTPPPEPVPAVDAAGVALQAGRNGHFYVNALLDGRSLPMMVDTGASACAFSEEDAARIGIRVTPADFTRVWNTANGTVRVAPIRIAIVQIGSITVRDVDAVVIPRGLLSTSLLGMSFLRRLRDFGISGSTMTLRG

SEQ ID NO: 1238 - protein, 320 aa, Methylobacterium sp.
VSFTFAPAASFTERAGLFVSLTGGTNSGKTYSAMRLARGIAGPEGKIAVLDTEGGRTLHLKDAFAFDANVMDAPFRPERFSQAAQAAEQAGYAALVIDSFSMEWVGMGGVLDWQAAEHKRLGGSDAKKGQSWIAPKMAHKAMVYALLQRRIPIIFSIRGEETFIPPNTKVFKSITNRMFPFEVTVSFRLESERKGYLDLSDPKSWKMEGAHQEIFRHGDRLSEEHGARLAAWARGERVAPAEEKQTEAPAPAAASMTKRELYAAARAAAAKGQDAFDEWVNPLPEAAYDALGQIWAELQALIAKADEGFPGDTPAAGQAA

SEQ ID NO: 1239 - protein, 490 aa, Methylobacterium sp.
MPKSLETRRPLVLAAVMASMFMIAIEATIVSTAMPQIAGHLGDLHLYAWVFASFLLTQTATTVVFGKLSDLYGRRPVLLFGIAVFLAGSLLCGLAWSMPSLILFRLIQGVGAGAIQPVSLTVVGDLYAVRERGKVQGYLASVWGISSVAGPLVGGLIIGHLSWPWIFWINLPIGVIAAGLFLRFLHEGVERRPRRIDAIGAALFTAAIAALMIALTEAGESAEAALWPALAFVVAAILFVVQERRAPDPMLDIRLWLQRPIATANTATLLSGMTVIGLTAFLPMYVQGVLRQSPLIAGLTLTLMVLGWPIGATTAARSFVRFGLRPILLVGATLLPLGAVAFVALGPDTSPAVAACGSVVMGLGMGFLSTAAIVIIQDSVAWAQRGAATASNIFSRNLGSTLGATVLGAVLNYRLANPSSGPAVNSDQLRRLLDDPASLGAGGEAIRAGLEHALHGTFWTVFAVAGLTLLLSLLVPPVAISDRPRELAVE

SEQ ID NO: 1240 - protein, 385 aa, Methylobacterium sp.
MAGPKPLLLTPLTIRGVTLPNRIAVSPMAMYRAQDGFPTPFHLVHYGKFALGGAGLVYVEEAAVTRTGRITNGCLGLWDDAHAEALAPVAAFLSAEGSIPAIQINHGGRKASAQRAWEGNGRLTPENVANGDESWQPLGPSDNPFSEGWPVPRPLNRDDMDTIREAFVAAALRAVRAGFRIVEIHMAHGYLLQSFLSPLANARTDAYGGARENRMRFPLEVARAIRGALPGDVPVFARISAVDWIEGGWEMDDSVALARALGEAGIDLVDCSSGGNLLKGATNTNLARAPGYQAPFARRLREEAGVFTQAVGLIRTPQLAEELLQAGSADIIAVGRQMLYDPFWAHHATEALGETGAFEAWPRPYAWWLEKWAAGLRSSGEAPAA

SEQ ID NO: 1241 - protein, 354 aa, Methylobacterium sp.
MEAIVPSDGTAPRVVRRRIGLLYLVLIAANVAAWSWAYSLFAGQPALLSTALLAYVFGLRHAVDPDHIAAIDNVTRKLMQAGQRPVSVGFWFALGHSTVVVVAAAAVALAATSLITASEGYRELGGLIGTGVSAAFLILIGLVNLVVLAGVWRAFRQVRRTGRYVEADLDMLLANQGVLARILRPLFRLVTRSWHMYPLGLLFALGFDTATEVSLFGLSAAQASQGIDLWTILVFPALFTAGMTLVDATDGVLMLGAYSWAYVQPMRKLFYNLTITLVSVVVALVVGTLEALNLLADKLNLQGWLWERIAAINDHFGVLGFGIVGLFAAAWLLSFLIYRLGRFDRIAVEPADIP

SEQ ID NO: 1242 - protein, 326 aa, Methylobacterium sp.
LLAGAALLGAARAAGAGWEPSQRVPDPAVEILDPAFAKYRLASATVERVATGFRWAEGPVWFGDMGALLFSDVVNDRIMMWEEASGALSVFRKPSNYANGNTRDRQGRLITCQHKTRSVTRTEHDGSLTTLMDRFDGKPLNSPNDVVCHSDGAVWFTDPAFGPNPHEAMAAPELPGNVYRIDPKTGQASVAVEGVAGPNGLCFSPDESKLYVVEARAKPNRLIRVYDVVENGTKTANGRVFYDAGTGTPDGFRVDVDGNLWCGWGMSEAEDGVIVLSPQAKLIGRIRLPERCANLCFGGLNRNLLLMTSTHSVYSLYVNTRGAGTC

SEQ ID NO: 1243 - protein, 286 aa, Methylobacterium sp.
MFDATKMLADALGEHLALTYQRTFGSREPRYAEIIEAAARLTIERIVGSDALYHDGDHTALVTLVAQDILRGRFLQQGITPEDWLHMILAALYHDIGYVRGVCAGDRLQAFVIDAQGTTVSLPRGASDAALAPYHVERSKLAVQERFGTHDLVDASRVIRAIELTRFPVPEDDSHRETGTEAGLLRAADLIGQLGDPLYPRKLNALFHEFAEIGVNAELGYDSPADLAERYPSFFWGKIEPVIGDAIRFLDLTVEGRGWVANLYAHVFAIEHDRRRMGPHPGPDPL

SEQ ID NO: 1244 - protein, 71 aa, Methylobacterium sp.
VTPVTVEELLRQKAETEAWRKRSAAAADRRRKRERADQEAYVAEQRARQAERDRHWARARADRPGAPEDGT

SEQ ID NO: 1245 - protein, 372 aa, Methylobacterium sp.
MPDSGDPIPKTMPYLPQLDGVRALAILIVFAAHCGYSHVVPGGFGVTVFFFLSGYLITTLLRIERARTGTVSLPAFYLRRSLRILPPMYLTLLASGALYAAGWLDWMQVAPAAILGQATFLTNYPGLFGTEAVLPVPLWSLAIEEHFYLVFPLVFLLWLGRLRPRRAALACLGLCAAVLAIRCVNVWRLPDYSLNYSWTHTRIDAILFGCCLGLWNNPVVPADRAWRPAPWHVAASLAVILGTLAVRDPAFRESLRYTLQSAALFVPFAYLLHGDGPLVRLLASRPMRRLGLWSYSFYLAHMTVVALVLHLRPGLHGVGLMLAAFPVTLLWCWGMYGLVERPCARLRRRLLADRPPEPSLAEDGRRAGVTPA

SEQ ID NO: 1246 - protein, 242 aa, Methylobacterium sp.
MADLSGKTVLVTAAGQGIGRASALAFARAGARVHATDINADALADLRADNLSTATLDVLDAEAVGALVARIGAVDILFNCAGTVHAGTILEMRDDELDFALDLNVKAMIRTIRAVLPGMLERRDGAIVNMASVASSVKGVPNRFAYGVTKAAVIGLTKAVAADYVGHNIRCNAICPGTVESPSLQERIRQQGDYEQTRAAFIARQPIGRLGTPEEIADLAVYLAGATYTTGQAVVIDGGWTI

SEQ ID NO: 1247 - protein, 326 aa, Methylobacterium sp.
VITGPCLIVQPIHAAGLDRLRAAGLEPRPASGTDPETLAREVADCVAVITRNTGFPARAIAAAPGLRVIGVHGTGTDHVATAEATAAGIAVVNTPGANAVSVAEQTLALIFALAKALPEADRSVRAGDDSFKFTARLVELAGLTLGLVGFGAIGQATARLAAALGLRVLAYGPSRPDADFANAGALRAASVDALLAESDIVSLHVPLTPGTRGLIGRDQLARMKRDAFLINTSRGGLIDEAALVEALEAGTIAGAGLDVFAREPLPVDHPLARQPRAILTPHVGGSTGAALIRTAETAATRVVDVLAGRRPGGLVNPDVWERRRGV

SEQ ID NO: 1248 - protein, 310 aa, Methylobacterium sp.
MGAKTYTIGDLARLSGQPVRRIRFYSDRGLLPPALRSASNYRVYTDSDVAKLDLIHALREAGIGLDVIGQLMARKLSLHDVLRTRLEILEAEIAAKRRSAAVLRATLRVPDPAESDLRRIWTMSTVSNQQMKALAGEFVDAIGAGTTLEGEWRRRVLAMSVPDLPDDPTPEQLAAWDALANLLADPTFIHEVQDGTKAFWTDALDPAAYETASRRAYEAATDAVARGLPPESPEAHAIARAWLDESAHALGRSPDLALLQWHFDQYEKNAGRLGQYRAFLATLNKQSPTAADPTVWGWLNNALKMLSSAL

SEQ ID NO: 1249 - protein, 37 aa, Methylobacterium sp.
MFASPHAFVLHHRERLAVLVSSALFLAGALPLFWAIG

SEQ ID NO: 1250 - protein, 86 aa, Methylobacterium sp.
VAKRAIPGSGASLVRVVVPAGVSAPAHSHDHEQFVQVLSGSGILETEQGREPFAAGSVFHFPAGAWHAAAFETETVLIETNLVPGA

SEQ ID NO: 1251 - protein, 304 aa, Methylobacterium sp.
MRLLAPLIAALLLGAPAGAARAAELTGTLRKIHDSNRLVLGVRDTATPFSYLDQDQKVVGFAVDICLRIADAVKRELKMPGLEVGMEFVNSSSRIPLMTNGTIDLECGTTTNNAERKKQVDFTNTHFLTATRFVSRKDQHIAGLDDLRGKTVSSVAGSTNILMLIKANNERKLGITVIAAKDVPEGFLMVETGRAAAFVMDDVQLSVVAAQSKEPAAYAVSDETLSNPEPYGIMLRKDDPAFKAVVDRATADLYRSPEITVLYDRWFLKPVPPRGLNYNVPLSSALRWAFAHPTDNSDPAFYAH

SEQ ID NO: 1252 - protein, 131 aa, Methylobacterium sp.
MPSVDTLVPVGAFALLVLAFAVKHLAADFFLQTNWMAQGKQRSSAWLAPLCAHTGLHGLGTLLIALAVKPALWWLALVDFAIHTGIDRGKVLVGRRTSLPPTDARFWWLIGIDQFLHQVTHLGLAVVLAAA

SEQ ID NO: 1253 - protein, 512 aa, Methylobacterium sp.
MSGTPHSPAADRVAALLADLLPGGRIGSVVAGEILAGTGAALDLTNPADGGVLASFADAGPSVVEAAMAATRDAQRAWWSMSAAARGRAMWAVAALVRQHAGALAELETLSAGKPIRDTRGEVAKVAEMFEYYAGWCDKLHGDVIPVPTSHLNYTRHEPFGTVVQITPWNAPIFTAGWQIAPAICAGNAVVLKPSELTPLTSLALGLLCDRAEGMPRGLVSVLAGAGPTTGAAAVAHPETRLVVFVGSAEAGAQIAAAAARAIVPSVLELGGKSANIVFADADLDRALIGAQAAIFGGAGQSCVAGSRLLVHRSIHASFVERLSRAAARIPVGAPTDPATQIGPINNRRQRDKIADMVEAAAAAGATIAAGGACPAALRDTGGFYYGPTIVDGVAPDAAIAREEVFGPVLAVLPFDGEDEAVALANGTPYGLAGAVWTGDGGRGHRVAAALRAGTVWVNGYKTINVASPFGGFGRSGFGRSSGREALMAYTQTKSVWVETAAAPAVTFGYVG

SEQ ID NO: 1254 - protein, 456 aa, Methylobacterium sp.
MAGELFATNTRPVAPPVSGGGKLTLFLLALVIVVIAEAIGNISIPVGAGKIVLLPLLWALLLGGALGLMSPRLPAPLRLSGALQNAAGAYLQPALLIFIAKLGLLVGGSLPKILASGWALAFQEFGHFFGTMVFGLPVALLLGIKREAIGATFSVGREPSLAIIGERYGMDSPEGRGVLAEYLTGTVFGAVFIALLAGLITSLGIFNPLALAMGAGVGSGSMMAAASGAIAAQQTPEVAKDVATFAAASNLVTTTIGTYFTLFLSLPFTIWAYGKLEPILGRNRPDAARPAAADPQAPAHQPAHEEVRIGLGETVLAWILIGAYGLIGNWLTYGIVPDAQVVAGMAIIIGTVLAGWGLYLLLGRRLPAVLWVSIIGMALTYPGTPYAAEIAALTGKLNFLALATPILTFAGLSVAKDVPAFRRLGWRIVVVSFMANAGTFLGAALIAQFFMHPPLG

SEQ ID NO: 1255 - protein, 176 aa, Methylobacterium sp.
VTLVLCSLSRGDDDRPDTFEQGRIVALSGDRWHATGGANRQRWKDIGEGARPHVVLNVAGCTIDAANTGDTPLTSRPKISSVPIVPSEVEGTLEAPVIYFEATSTHGFGGGVGRLALEMMLSEPSADGTPISRRKIVVHLRGPMGAFISLKAAIEHIEEMAAGPLTADIAEDGKPN

SEQ ID NO: 1256 - protein, 106 aa, Methylobacterium sp.
MGPISLVDPIMPKSAASAPKPKVDFVEGHNAPIISFDEVPFFGSLDGVGRITIAAQVFSQTNDDGTISAEHVITAHLRGSLRAMANLRDTIDQMLMAAMPAAPGEQ

SEQ ID NO: 1257 - protein, 97 aa, Methylobacterium sp.
MADYYPLLARALDALPDRTPALRKAVYDRARNALISQLRSLDPPLSEADIDLERRALDAAIERLEVDHGGLPAPANDAAQAPETPAPAPVSPPAPAP

SEQ ID NO: 1258 - protein, 384 aa, Methylobacterium sp.
MAAKDEATWRVGVLFSRSGVSGITETEHFLGTALAIEEINRAGGVLGRPIEPVCYDPAGDTDAYRTLARRMLAEDGVEVVFGCSLSASRKSVLSTVERHNGLLWYPSIYEGFEYSENIIYTGATLNQNVFALADYLLQEHGDRIFLIGSDYIYPRESNRVMRDLIEAKGGTIAGELYAALDADDAAHAAMIAAIRDAAPDAVFSTVVGRGAERLYRAYAESGIDRARCPIASLTLAEGQIRAIGPAHCTGHVLAAPYFGALPGEENRRFVAAFQGRFGAERPTSMWSETAYAQVHLFARALAEAGTLDAERLGAAALRQRLAAPEGELAFDGETRHIWLTPGIGVARADGQFDVVWRARRPVRPDPYLAWSRFETNWLEEGLAA

SEQ ID NO: 1259 - protein, 208 aa, Methylobacterium sp.
VTAPARKILDDLRRARALVIHPRDEEAAALLEQLRRLGCAVSLAWPPPAALPADIDTLFIQLDDAQVMHLLPSIEAIEPAVIAIVAYESPTSLKAIADVNAHGVLNKPLHPRGVLTQFALARYRRGYEGRLTSKINRLEETMKGRRTVEKAVRLLVDLNRIDEDAAYKMLRDRATAARVPMASVAESVVSAHEAMSGLGLRIALAEKT

SEQ ID NO: 1260 - protein, 384 aa, Methylobacterium sp.
MVKWSLAGAAALALAATAAQAADPKPIVIGIPIGLSGANSVVAPSVVQSAELAVEEINAKGGVLGRKLVLEVADDASGAAGAQKAFDSLIYQKKVDVLISMETSAARNAGLPAVTKGKVPYIYTSFYEGHSCNKNMFVDAWVPEQQVPPVVDAFKAKGARTYFLIGSDYAFGRGMLGFAKSYVEKTGGKVVGEEYLPMDGSDWTAIISKLKEAKPDALITSTAGGAPNVTLTKQLRGAGVSLPFANLALDEGTAKSMGADAEGVYLSASYVTGIDSPENKAFLAAMQKKFGAELRTPNDLSVPEYEAIYLYKAAVEKAGGTETAKVLEALPTVSFTGPRGTITMSKQHHAPLTMYLGQIQKDGTVKVAGTFKDVDPGEQCPKLQ

SEQ ID NO: 1261 - protein, 277 aa, Methylobacterium sp.
MLLTLDILTTAAILFIVSIGLLAIFGVLKIINFAHGAWLTVGAYCAVVTARLGLNPWLALPLAFVVGAALGGLAEHFIIRPLYRRPLDAILATWGLGIVVGQLITLAFGRDVQLTPNLYAGTVEFLGVDYSAYRLVALGIALAIGTLFALTIERTRLGLSARAVIMNETLARSLGIDTGRVRLVVFMLGAGFAGLAGVLLTPLTSVDPNMGVSWLIGAFMLVMVADASYLALAAACLVFGAAQVLISTFVSPILGSIAVALLAALVLRISPKGFSRA

SEQ ID NO: 1262 - protein, 604 aa, Methylobacterium sp.
VLETLPVAERAAAAPPGRRLSRAAPFVVAALAALALWIAPLVLDTFAVNVLTRSMIYAVLAVTVDLLWGFAGILTFGQAAFFGIGAYATAMILAAYGATPLGIAAAIAAALVAPALLGLAVGWLSFYHRSTPLYASVISLVVPIVVVQLIYAGGEWTGSSSGLVGFDVLPFETEGYFRLAALFLIAVTLAAWILVRADAGRALVALRDNEARCAYLGLNPRRLQIRLTASLAAVAGLAGFLFANASGVVAPENAGFLFGTELVIWVALGGRGTLLGPVLGTVAIDYLAANLSGDLPFLWQLLLGSAFVVIIILLPGGLADLVGRLWRALPVGRREPAPPRLVARAAGPEAAGTEATGTPILKVENLAKAYGALTVLEGIDLEIRAGELVSLVGPNGAGKTTLMRCLSDGTEPFKGAIAVGGTPITGLTPNRIVGLGVGRKFQVASVFESLSVADCLRLARASHDGLSPVGRAETLGLPQPALDVLRMTGLDRQLTQPTRLLSHGQKQALELAMVVALEPRLILLDEPTAGLTKAERTTIGTVLKALTAEGRIAAVLVEHDLDFVREISSRIVVLHQGRLVLDGTVEAVVGSELVRTIYSGGGHG

SEQ ID NO: 1263 - protein, 233 aa, Methylobacterium sp.
VGAALALDGVSSGYGAVAIVRDVSLSVGAGEIVALLGKNGMGKTTLLKTVLGMVALRGGAITVGGQALAGLTPAKLNALGVGYAPQEQPLFQDLSIRDNLRLAVPSDRMLPAALERLFGHFPFLKDRMAQRAGTLSGGEQKMLILGRALMLRPRLLLIDEISEGVQPSMVERLRGVLQAERAAGVSMLVVEQHVAFALALADRYAVLKLGEIVDSGPAQAPDARARVIDHLAV

SEQ ID NO: 1264 - protein, 269 aa, Methylobacterium sp.
MNRRHVLALAALCASLGAGLLAAPATRAAEGKLELIEPGKLIVATDSTFAPFSMRTPNGELDGLEVRVMREVCRRLGLEYSPVNIKFDALLVGLMADQYDITSESMDITPARQKQVAFADGWLESGARIVTRKDTGIKGPADLKGRNVGALSASTFGKLAEENGATLKSYKTAADAMQDLVGGNIDAVINDAVAGNYAIKARKLPLVMIETPLSTVQKGFAIKKGKPNLHAAVNKALGEMVADGTYAKLVTPLIGYDPAPKEPIRTPAM

SEQ ID NO: 1265 - protein, 226 aa, Methylobacterium sp.
MKTLDAASYTTALSARREQSLGQMAYDRLLDMLVRRDLPAGTVLHERRLAEMLDISRTPTREAMSRLETEGLIERQPGGMLVVKEFSLRELIEILHVRRLLERESVALATGRIADAVLADLQRQMEALLAAGDPDAPGNWEVDRRFHDLIAEHSHNATLAKTIKDLRLKTQMFNLSRMPERFEAVHREHLAVVAALRAKDAAAAADAIAAHLENFKQGIIRRLSEV

SEQ ID NO: 1266 - protein, 578 aa, Methylobacterium sp.
MGEDQVQALERAQAGPQDLAALGGSPVDRLLYDRSGFGSGPNGFTGSADPYGSRNVPMPPSRPSDADLLAAPTATGSLSSPRRPTGSSIVAPAPGVTAADTGNPASSNLQPVNSFDPLTGQPVSGSPKLMQAPGMGGPANGGGQMPSAGGASQGGSFLERFAQGLNNPAVGNLLLNVGIGLMSNRGFGPGIAAGLQGYQQSQTGSVKSLLEQYKLQQEIQGQQATRAFLRSKGLSPAAIEAGTLNPSLLAQINKDSQQFTVGGNVFLGRPDQDPSTWQKLGPSAGPPSGYRLAADGQSLEFIPGGEADPAVKERNAKAVATDKEQTPLLDIEARRKVGIPDNDTRAAWADPNGKVTFNDGPPLIQGRPGQTVYERGSLRPLLTVPPAKPDGYDTETKLRGEFSKQLGSFADVHDGYGRLIAATKQRQENPGSVSPASDISLIFGYMKMLDPGSVVREGEYATAKNAAGVPERVVNAYNKALTGEFLTDTQRRDFLNQASELYGTARKTAEGVADRYRNLATSYGVDPGRSVYLPDAPTPPKIGQLSQSSSGAAARFQALMNSGMSKADAFAQMRKEGL

SEQ ID NO: 1267 - protein, 370 aa, Methylobacterium sp.
MRLSLSALLMIACGTQAALGQAAPAERAVPRFAQLEAEMGAANAAPGPRTVPAKVVPVPDTTSPQFRSAVAAPYRVPAWNANPPDAAAWKALVDKLAAAGAATLPALREKLGVTSEAAVIGGVKAFVIQPRQIPEANRDRLLLHIHGGGYVYNPGEAGTLEAILMAGLGGYKVISVDYRMPPDAPYPAAMDDATAVWRAMLSMQKPQNMAVFGTSTGGGMTLALMLRAKAEGLALPAAIGLGTPWSDMTETGDSYRTNEWLDNVLVSYSGYLTPAAKLYAAGRDLKDPQLSPIYGDFAGLPPAILVTGTRDLFLSNTVRTHRKLRAAGIEASLQVFEGMSHAQYLFTPDSPETREVFGEMAHFFDDHLGR

SEQ ID NO: 1268 - protein, 52 aa, Methylobacterium sp.
LRKIAEIRFLAGILRESVRPFPIAPLRTVLRVRERIDARRAVSPEAADLDAV

SEQ ID NO: 1269 - protein, 101 aa, Methylobacterium sp.
VILSAGLEPEEDGTAALVPLRPDFDAAALRTLAKSSRDPDQTRRLLALSAIYAGSLRSEAAALGGFGLQTVRDWVLAFNAERRPPIALVRRECEFSGFVSP

SEQ ID NO: 1270 - protein, 211 aa, Methylobacterium sp.
MHRRTLLALIPAVALAPALPPLMPHAGEAFAQGIDPNAILNDPEAPVSGNPKGDLTIVAFLDYNCPFCKKAEPDLLRLVKSDGRIRLVHKDWPILGDASVYGAQLALAAKYQGRYDDVHRALMGIPGRKIPKERMLEAVSDSGVDMARLEADRTTHQGEIAALLQRNLDQADALGLQGTPVFLIGPLKVAAVLDYDGFKQAVAQARAKGRS

SEQ ID NO: 1271 - protein, 237 aa, Methylobacterium sp.
MSPADALPGNFPAHLPAKDAYATEAICTRILARHRDRISVRKDHVAVANLARIIEAVLKLSSRQGFHETSLRDLARASGLSMGGLYSYFDNKNTLLVMILTEVAETAEAVLRQAPARLAADPAAHLRWLIETHIRLTEAMQPWFVFAFMEAKGFPAPARTMATESEAATERIFAEVLARGAAAGVFAVADVDLTAALIKPLLQDWYVKRAKHRKRGIPIQRYIAGVTAFVEKAIAAG

SEQ ID NO: 1272 - protein, 379 aa, Methylobacterium sp.
VQHDLILKGARVVDPSQNHDGICDVAFADGRVSGFGRDLQAGPGTQVRDMEGAIVTPGLIDLHTHVYWGGTSLGIDADAFCRTSGVTTSVDTGSAGPGNFAGFRSHVIERSQARILAYLHVSFAGIFGFSKTIMVGESEDPRLMAPREAVEVADANRDVIVGIKVRVGRHASGDQGTAPLDIALQVAEETGLPLMAHIDEPPPSYEQVLAMLRPGDVLTHAFRPFPNSPITAQGAVKPALREARARGVLFDIGHGKGSFAFKTARAMLAGGFLPDTISSDVHQLCIEGPAFDQVTTMSKMLCLGMSLTEVVAASTVNAAVALKRMEYGTLKVGALGDATVLAVRDGAFDYVDTRGEHMTGDRRITAEGVVLKGRWWHPA

SEQ ID NO: 1273 - protein, 83 aa, Methylobacterium sp.
MRTILILASAALTSAAFTGLAAADDRLHLTPPLYRDQARAAQQIRAIHDLTTTPQPVAAPATVNRTISSLGRPIVQAAVEASR

SEQ ID NO: 1274 - protein, 682 aa, Methylobacterium sp.
VVTSPGGANSAKAADWRPLSGRQVMIWPDNDVPGLTYATDVERELAGVGAGTVTMVDAMRVAAVRFNGEDRKPIEGWDAADALDEGWQPEAIATLVLQHVDRVEPSPAYVSFDRFTMNSDGLTAEVTKGRGESVTTEDVWISAPFEVIGRARDPNGFGWARWLRWRDPDGRRHEHAVTDAALHGDLGALAADLATRGLVVARSGRSQLCDYLNRVMVRARVTTVSRTGWHLIGEQRVFVLPDAVIGQPDGETVVLTGATAAPYSRKGTLQDWRDGVGRLSTGHGRLVLAISTAFAGPLVDLVGGEGGGVNLYGQSSRGKTTALKAAASVWGRGASDPGFVRSWRATANAQEATAAIVTDTLLCLDEIGVAEGRDAAAAVYQLASGVGKGRSARDGSIRAPMTWRVLTLSTGELPMAAKIAEDKQRKAYAGQAVRLLDVPADAGRGYGLFDNAGPDGDPARLAEALQKSALLAYGEAGPAFVRALMDMGQEEARALVVDLVESFVTEYAPADADGQIRRAAARFGLIAAAGELARTFNIVPWEEGEAEAAAARGLADWIGSRGGTEPAEVREAITQVRRFFEAHGDSRFENADDPDARPVPNRAGWRRGHGDSRVWLVLPEMWKSEVCVGLDPVATAKILAERGMLKRDPNGRLQRSERTPGGATLRVYVLTSAVFDGGSDAP

SEQ ID NO: 1275 - protein, 606 aa, Methylobacterium sp.
MCVACDWAPHFQAFGGGRAVNRRAVLRSGAAITATALALDLVPTGARAEPGSGRAAATGPADVVFHNGPVYTVAGPAPWAEAVAVRGNTIVHVGDAAGAMALAGPVTQVVDLQGRLLMPGFVEGHTHPFLGAFLTSGVDLQRENLAQILAAIEAYAKAHPTGPIRGFGWRVDMFPPEGPNRAELDAILPDRPAFFFAIDGHSLWANSKALAMAGVDRDTPDPIPRFSYYARDQKGDPTGYVLEVNAVLGLVNAVEPISVAAMGSLLEGWLPKAAAAGITTVFDAGVPPVGSDQAAIIALYVEAEKRGTLPFRVSASYSVKSLPIDDTVEQFNAVRRQVSGELVHVDIVKIVGDGSQGGYTAWLIEPYADLPDSTGGSPFTEAQWHDLVGAVDAAGFDVHVHACGERTARVALDAIEKAVAHNPARDRRHAIAHLVYVEDSDAPRFAQLGVTAQFSANWSSADPDTLQNMMARYGAHRASRMYRTRTILKQGGRVSFGTDWPAAGYVSTYEPLTSIQVGVTRQLVGRPDAPVLSPADERLTVAEAIQANTMGAAYQLRMDDRIGSVEVGKRADLVVLDRNILTIDPHEIHRTKVVLTMMDGVVRHRT

SEQ ID NO: 1276 - protein, 90 aa, Methylobacterium sp.
MIRGFLGTATLGALSLALISPLAAQTRAPDQTGTGGGPASTITALNTNSLGVTKPPGTSLGPGEVPTPEQRRRERALTDKIEGSICDGCN

SEQ ID NO: 1277 - protein, 180 aa, Methylobacterium sp.
MTTLARARFSQLVLPRLDEGYRLAHWLTGNATDAEDVMQEACLRAYRAIEGFAEGNARAWFLTIVRNTGYSWLQRHRPRAVVFADDLAPEARAELEIGGALTEAPETPEATLIARDDAGQLARAVEALPVAFREALVLREYHGLSYREIATVTGVPIGTVMSRLGRARQHLLARLAKDGR

SEQ ID NO: 1278 - protein, 272 aa, Methylobacterium sp.
MTDDETLLLLSAYADGELSPGEVLAMERRLAADPEARALAERLRDLSATLRGTLAGPPAPESLRARVIEQIGFTDPPPSRSRLGGPLGSWVEAWLESWRGSRQAMAATLLAGLVGGAALGGAVVYLDRPDGAPDTGAAVLAGHLRGLAAPQPFDVASSDRHVVKPWFNGRTTLAPEAPDLSDKGFPLVGGRVDIVGGTPVPTLVYRRDRHVISVTVVPAADGPGAGEERRDGSTIKRWRLGDLTYWAVSDLNRRDLRAFADLFQSRTGGPPG

SEQ ID NO: 1279 - protein, 132 aa, Methylobacterium sp.
MNVLILVVDDEPDVTDLFRQQFRRELRAGRFAMAFAHSAAEALERINGSNEPSLILMLSDINMPGMTGLELLPLVRAARPDVPVIMITAYGDADTREKVRAAGAVGLITKPIDFAVLKAEIDRRLSAFAGTE

SEQ ID NO: 1280 - protein, 79 aa, Methylobacterium sp.
MVAGLANTDDVFETLLRRTITDFVIGGMDHGIPDEDGLIVRLRQYEQRARQEQLSSQTLQVISSARRLLGDWTEAGRAS

SEQ ID NO: 1281 - protein, 213 aa, Methylobacterium sp.
MPAPAPVVADARARYLPLIAREAAGTGLPLAVADAVARIESGYDPTVVGSVGEVGLMQVRPTTAAMLGFRGTVAELASPEINVRYGVRYLAEAWRRADGDLCRALMKYRAGHGSEAMSPLSQLYCARAQAILGNPEARVVRASARAAAPDRLAARSAGPVHRTRVAAVPAKPMSFWEAHRARIARLNAAVVSRWRARGWSAAPDGSSGEPAGG

SEQ ID NO: 1282 - protein, 423 aa, Methylobacterium sp.
MPIVLRPDGVPALLPWLWLDLELRDRGLQAGTLRAYAGVSCLLEDWFALRGVDCTARLRNQQSFEDWEVRDLRNHLYRLTPAGARVRRHAIAKRDRLVEEGRREVGEEPIRLLEGVVSQPVLKQRISVAAIYLRWLDETLSRMIFPDPRQRAEAEHVLTHLADGLCELKVRALEVRREGLALHQQKLLLSAILPPPADQPQTRPLFHESVRHRNFAFILLLASTGLRIGEALGLKMQDVVLQNDWLSVTVRRRPDDPEDPRPRRPQAKTLERTITLPHVAAVALLDWCDFHRKIERLYGPEHGSPFVFLACNIHEAANFPATPLSLAGADKIFRDLRERLPPEAGNVTAHRLRHSWMDHLWTSLRAAGPQDPFVIDVINYAAGWRPGSGQAQAYSQRAQREAADGFAAIFQKQLVSLLEPDRK

SEQ ID NO: 1283 - protein, 442 aa, Methylobacterium sp.
VASWIEQAVWWQVFPLGFVGAPDEADPAAPVTHRLAHLHGWLDYAVELGASGLALGPIFAASTHGYDTVDHFRIDPRLGDEADFDALVAAARARGLRVLLDGVFNHVGRAHPAFQDVLRHGPESERAGWFRLTWPRGSGPGIEPDYACFEGHRQLVTLNHDDPRVADHVAAVMGHWLARGADGWRLDAAYAVPPRFWARVLRQVRLAHPEAYIVGEVIHGDYARIVQDTGMDSVTQYELWKAIWSALNDRNLFELAHALERHNGLLDRFAPLTFVGNHDVTRIASRLTDERHLPHALAILLTCGGTPSIYAGDEQAFRGVKEERVGGDDAIRPAFPPTPADLAPYGWPVYRLHRDLIALRRRHAGLHRARARALHLANAQIVLALGDGSARVLTALNLADTDATLPAPEARAIEAGTGDLAEAGSPDARVTLPAHGWAVLAV

SEQ ID NO: 1284 - protein, 169 aa, Methylobacterium sp.
MWGTDLTTTWTAEGQVAVFVAIDHRSAECVGIHAARRATRFEALEPIRQGVRQRFGGFSAEIASGLSVRHDHGSQYMADAFQAELAFLGIASSPAFVRAPEGIGCAERFIRTLKENLLWVEHFETVEDLRHALLAFRDLYNETWLIERHGFRPPADICAAQLPPAAIAA

SEQ ID NO: 1285 - protein, 81 aa, Methylobacterium sp.
VRKLTFAFAVLASLGGAALVQPASAAPAMPGAVSAPDAVTHVRMTPMERRMMHRRMERRMMHRRMERRMMHHRMHRRMHRM

SEQ ID NO: 1286 - protein, 945 aa, Methylobacterium sp.
MSAETIKALSRRHFLKAGAAAGVAVKVSFLAPPARAQLAETGLSAGSPWAAPGRPRYRLDAVAKVTGAKTFSRDYRARDLAGWPDGQAHAFLVAATRADRRFTGLDLSRLPAALRPDRIVRHEDLVADGVSVPHADFFGDWFLVPQGETPRLLGQPVAILIYADFPRFAAAKRALRFADDVVQYGAETGPRPPAHYGASRWVRIEGDAPDAPDRFSPFAQSPIFAGFSGDEPAWPKAGDDGPFARGMAAAAAIAAEIDGTGADALVMRRTYRSQSTDASAMEADNGNVWYDPDTGTLRLMMATQSPYDVAEAAAALVSKSRFPLREVDLKVGYTVGYGTKDHHIFPFLCVVAALYAGGRPVRLANDRFEQFQNGLKRHAFRMDNVLLVDRASGRFRAMTGRFACDGGGRPNYSVAVSFVGATAAQSIYYLPKSDFQAIALASRAVEAGSTRGFGTLQTMSATEMMVDEAAALLDIDAIDLRLRNVLRSGQRNSQGAVPAGALRNAEILTKAAAHPLWRDRAARKAAYEAAHPGRRYGVGFAQVHKDYGTGAEAAVASLELDPRGRLSLRHVAHEMGPGVTTSQAVMVAEILGRVPAETAFGVVRWPEMPLETSDQPYTTPQEEEDRRAQNPRWTPRFTSPMSATNSAYYLGHATRTAARFLVDHAVWPAARALWARGGGGGALASYHVVARDELRLVDGQVLGGGLPPLSLEAVAAEAHRLGLPVGVTLHTFNRWQWAEAEFDLPGTGRTRLPIDALSVRYGAGAPPERRALMADAGWHFVPRAAVFYPPTQRNNVGTTYYAPMATLAEVAVDTASGDVTILSHHSILECGRQIVPELVSGQVQGGLAMGIGHALKEVLPLYEDGPGDGTWNWNRYELPRARDVAPWNQTVEILPPLSETDPPKGIAEVVMIAVVPALANAVAHAIGHRFHELPIRPERIREALA

SEQ ID NO: 1287 - protein, 118 aa, Methylobacterium sp.
MQGGTIGNGHAIPPGPAAARLPDLERALVNPAAVFDTPATLRDHPRLLPSCKREILRRWAWDEYLKEVAAAEGMAEGEPSRLDAVKAALLALGEARRPDPAAPAAAFPAPRALDRAAA

SEQ ID NO: 1288 - protein, 167 aa, Methylobacterium sp.
VHQPDRMTDPITLASLEGTAHVVQVALSPVFLLSGIATLLNVFGARLARVADQADHVSGLLAGAGDAERVRLGQRLDRLHRRSLALDAAVFLAALGGVATCGSVLTLFVGALRDSTVATLLFGLFGAAILCTLCALVAFGFEMLLANRSVRDRINQRRASAGVPPDR

SEQ ID NO: 1289 - protein, 237 aa, Methylobacterium sp.
MNLVLLPGFMTDADLWSDVVARLAEVGPITHGDLARDAAIADMARRVVAEAPPRFGLVGFSMGGYVARAVARLVPDRVEALVLVATSSRADTPAQARRKAAAVAHIRQQGYRGLSRSAILQSVHPDRAGDGALLARIRQMGDRLGGEVFLRQAGQARESDSDRLGAIGCPTLVVAAAQDALRSLDEARELRDGIPGATLTVIDGSGHMLPFEAPDALADAIVPWLRAQASGASTIGS

SEQ ID NO: 1290 - protein, 65 aa, Methylobacterium sp.
VAPAEFRLREAETIAGAYHRAAKGDGWTALVAAIADALVDLDAPERRLARQGGLISLGYARGRTG

SEQ ID NO: 1291 - protein, 1129 aa, Methylobacterium sp.
LAALGDAEAARLAGMPPDRDGLAAWLDAVVDAAEARRQGNPSRAATGDAVLRRALASVLRYAVAEGGTETVARLADRRRPNPKTPRAYQRLSWAEPLHLALRAALVHAPEADYDAAVAFLNARIAEDHDWPAACAFAFILADDRAAPHPLQPVAVVEAAAAAGIDVAADTAYLPLLADAPPEAVAGWRAKRSYHVYFVYCALDAAEAAATLLAVARAAGQPALPALDWLLHYALDEERRSVALAILSTGEAGALPALLSHLHEKPVAAALDAALEADPAAILPRCLAALAGGRSEPALRARVNRALDAHGIDRVRGWLAASGGRGAGILDALAEARAVPLAEPAAWPRVLRDPPWRTKARTRDDLVLALAPLPTPFAHAVPEVAPSYWRARNAVTLDGPEALSAFVAATELSHPTQGWSRIPPPLSEPPRDDPPALVAWVAARVAQIDEACHYWANSPYRQLVGSLERQPEPLALALWAQSRVVAGCFHVSQWPEIVWAMLSRFGERAMPGLVGLVEADPVGLLPAVLAVDDGRLAPPAARALTKLKKAREPALAWLRRHPETALTRLLPDAVGRPGALRDAGEHALRVLAQDRADGRAIIASVAARYADQAPDVTEAVAQVLDRDPLARVPAKVGKPPAWVVPSMLTRPRLRDGTALPDAAILTVCEMLSFTNPDAVYAGVPMVREACTEASLAAFAWDLFSAWIAAGTPSKDGWALRALGWFGTDATARDLTRLIRRWPGEAAHARAVTGLDVLVDIGTDVALMNLNGIAEKLKFKGLQEKARQKIAQLAEARGLTPEELADRLAPDLDLDERGGLDLDFGPRGFRVGFDETLKPWVRDAAGQRLKDLPKPAKADEAGKAAAAVARWGALKKDARAVASLQVARLEAMLAGARRVQPTVFGPCFAAHPLVRHLAQRLVWATFADADPRTGPGLTFRVAEDLTYTDADDAPLDLDLTGAAPGLIGLVHPLQLEAGALAAWGALFGDYEIVQPFPQLARETYAFTEAEAAASTTSRFAGTVVEANRLRGMAARGWPLGAPQDAGVVWWIERAVTFPGGAAGQASLTFSEGLFTGAVEFEDREQTLGDLTLGSPWSSRSDPGQRTFGELAPVTASELLRGPSLLAGTRLR

SEQ ID NO: 1292 - protein, 801 aa, Methylobacterium sp.
RGAGRLDRLLAAGSAPQAAPEALPSVLRDPPWRRRGAALARSERAVAPIPTPFAHGFDPDEALDRSTFYFEAGTLVESMTDLAARIRATEAEALYDMPIPPPAEPVPAADADPAIALAWLDRRLDLDRDAFTGFFYFNYGPWFRMVGWQPEPLALMLWEKTGPQRAHYVAWRRTIAVMLSRFGARAVPGLVRLVAADPAQLLPEVESVDAADLAPVAARAFHRTRKLRPAAAAWLRAHPRTAALRLLPETLGPAGPDRDAADAALRFLAAEPAGRAALDAAVAAYAERDPGVPEAVAAGVDSDPLEQVPSKPPKLPDWVVPAALPRPVLRSGGALHDAAVTALCEMLAFSDPLAPYAGVAQVRAACTPESLDAFAVALFQSWIAAGAKSTGEWAMQALALIGGDHAARDLTRQIRAWGQAGLKPRGKAGIAVLAGIGTDVALMNLSAIAEKSPLLQLREAARAAIVDAAEARGLDEVDLADRLSPDLGLDARGGLDLSFGERRFRVGFDETLKPVLRDAEGRRLAALPRPTKADDPESAKAASRHWAAVRKDAEAAAGLQITRLEAMLASQRRVAPGVFWPFFAAHPLIRHLAGRLVWGLYPDAAPATPPGRVFRLAEDLSPTDAADDALALDVAAAEGVVGLVHPLHLDPEERTAWSGLFADYEIAQPFPQIARETFAFTEAERAAAETHRFDGVRVGGRRLRGLRPQGWSTDTGSEHVHAVQRPVALPDGTRLVAVLRFEDGFWHRPGPEGDGIQTLRTLTLSETGWRAAATHRFGDLDPVTASEVLRTPSLLAAAGDA

SEQ ID NO: 1293 - protein, 74 aa, Methylobacterium sp.
VDNDDPPWDTDPLWYDRTESGTPPGPILEALAWLFLLAIAGCAALVWLYGMPDRLWRAAARRLMRRDPADAGRF

SEQ ID NO: 1294 - protein, 1103 aa, Methylobacterium sp.
MHPDDQMTAGYYSISGTSMAAPHVAGAAAVLRQAFPFLTAPQIAQTMFTTATHLGDGPANAPNATFGWGLLNLGKAIDGPGQFTSDWTVNTTYNGQAYYGRFANDISGVGGLIKVGLGTLELAGTNTYAGPTTVAGGTLFLSASGSLTSSVSVQSAGTYLNAGWTQGSVSNAGLLINTGTISGGATNAGTALSSGVIAGGVANSGTLSTSGTVTGGLTNAGLALNTGVIAGGVANSGTLSTSGTVTGGLANAGLALNTGTIGGGTANSGSLVNAGTLAGGLANTGTALNTGAIGGGATNNGILSNAGAIGSGVANTGTLATSGTISGGLTNAGTVLASAGRIDGAVANNAGLLAVAGSVAGTGPFANAAGATLAVTGGGSYSLAGPLANAGLVAVAQNASLTASGGLSNAGLVASDGTLTADLTNTGVARLSGQFNGTLTNAGLVQITGPLAGLTGLTNTGALDLGGTALTLTDLAGPASAVLGNGALTVSGSAASTYAGAILETASPTSLTKAGPGTLTLTGPGRFSGPTTVQAGTLSLNGLWTSPVTVAAAGTLRGIGTVAAPVTVAGALRPGNSPGTLTVLGPVAFAPGSSLGLDIDGPGTGTGAGSYARLLALGPTGTVAANGTLVPVLRGITGNAGNSFTPALGQRFGVLTAQAGLSGSFSGLVQPAAGLPAGTRLDALYAATGLDLVVTPAAYGNLAGLGLAQTGNARAVGAALDLARPAAGTRPDAARARVFDPLYAAGPATLPGGLASLSGQSYGDAVMTDLAARRLLSDTIDRHQRGLGGGAGAFGAGDPGPGPNRTALQVRGGAGAAAAPLAVGEGRVWADALYGFGARAGDRAAAGAGFDAGGLLMGVDRQVGADTQVGAAFSYLREGGTSRGAGLGRFTTDSYGGTLYASTRLGAVVLRGTAGVSYADGRVDRTVALGTAVSQASGLSSGWNGGVSGFAGYALATGLPVEVVPEVGFSYDRLTRGRVSERGGLVGQGFGGQGFAVADLDAARSLVGGRVTSWALAGIPDLRLEGRAYWAHELADTAAVIRSSLFGAGFSSRTSALGRDGAVLGVSLTGAVAEGVRLSVGYTGDVRPGATAQVFSAGLQAAW

SEQ ID NO: 1295 - protein, 146 aa, Methylobacterium sp.
MCNLYSGMPSADYEGETRSIRLGGHSTSIRIEVMFWNVLEDIAAAQGMTLPRLVTLLYDEVLALHGEARNFASLLRCACLRHLEMKAARLASAHRRAVEQRGRVAGDVDGALDRIDDRDVGVGHVARTARALRGDAVRPRDARGEG

SEQ ID NO: 1296 - protein, 508 aa, Methylobacterium sp.
MDMPVDVVVAGAGPVGLLTAIELTLGGARVRMLERLTEPSTTIKALGLGPLGVEALQRRGMGAAIEAVEARSLAAMDRLPGQIGGGPRGAEVSGHFGFLFIRRDPQAEPDRRMRAVDQQSLEAMLLDRAAALGIDLRRGCTLTGFTEAADGVEVAWTAPTGDARVRCAYLVGCDGGRSAVRKMAGFAFPGTPPTMTMYQAIADLDDPAGTLPVGWHRGPGGVFGHGPFPRRLFMLDFSGPPADRQAPVTRDEIETALRRVSGTDVRVARIAVANRWADNTRLVDTYRRGRVLLAGDAAHVHAPFGGQGLSLGLGDAANLGWKLAAVLRGEMPESLLDTYTAERRPVAEAVTANTRAQAAILRPDPQSGALRDLMARLLESDEVSRILGGLMRGLSARYDLGSAEDAVGRMAGDGPLGASGATLYGAMQDGRGLLVDGSADGAASRMVAAATGRVTCVAVPDGPSTLVRPDGCVAWTGAATALDGLREAVGRWFGPSPAGPLGAPAPMC

SEQ ID NO: 1297 - protein, 293 aa, Methylobacterium sp.
VSLSIGKRILLGFFAITVVVVALGLYALEQIGAVRDTTDAIVRRDMTILRQLDDLGNDARDLGLLRRTAVIAMLMQAQGRATQAGDTLAAWRQTAAQVENRLATTIQLATQYRTQVVSAERVAAWDRIAAAATAVQGSFREVKAQGEAQFAAIAQQDVAAVEARNAEISRLQAPFLEGIKNLRAQLDGGMALGQRAAQEVYERSRLSIYLTLAAAVLLAVLITWLISRAVVRPLETVMTFVARVGEGDLSGQLAAGGRDEIGRLSMTLNTMVSGLSDLARTNRAATADLNAAA

SEQ ID NO: 1298 - protein, 423 aa, Methylobacterium sp.
MWVRDTSPAERRVLGAAFAGYGVDAFDYMIYTFLIPTLVVVWGLTKVEAGNIATAALVTSAIGGWAAGILADRYGRVVVLQGTVAWFTLFTVLSGFTHSYEQLLATRALQGFGFGGEWSVGSVLIAETIQARYRGKAVGLVQSSWAVGWACAAIAFWAVFGLAEPAVAWRILFWLGALPSVLIFWIRRNIEDPEVYRQTRAAMRDVGDTGSFLDIFSRPLIGRTVLASLLATGMQGGYYAVTTWLPTYLKTERNLSVLNTSGYLLMLIFGSFVGYLTSAWLSDRIGRRLGFVLFGLCAGILVLAYTLIPITDPVMLVLGFPLGFFLSGVFSGMGAFLSELFPSRIRGSAQGFCYNFGRATGAICPALVGHLSGSLTLGIAIGVVAAGAYCLVIVAALLLPETAGRALDSRSADPAEPEPVAAL

SEQ ID NO: 1299 - protein, 349 aa, Methylobacterium sp.
VLDLPEEILEPSTRSPVARDVARRAGVSTATVSRVLNGSAGVRADKRAAVMRAAQDLGFVANGAARALSTRRFMAVGAVVPNIENEAFVRVLSSFQDRLRQAGYTLVAANAGYDLEDELREATFLLERGVDGLMLVGDIHHPDLHARIARAGIPMVQTFSLSRERPCVGFDNAASAARATNYLMDLGHRRIGVISGLRKDNDRGGARVTGIAAALAARGLRLAPEHDIEISYGIGGGRDGFRQMLAGGPPPTAIICGTDQIAFGAMIEARARGLSIPGDLSVIGHNDSDFAPFLDPALTTIRIHSAEIGHAAGDHLIARIQGRPMVRLTEIDAELILRASTAPPRRVGA

SEQ ID NO: 1300 - protein, 311 aa, Methylobacterium sp.
VRAAAESLGYLPGGPAQALASGRTHTIGAIIPTLDHSIFARAIQALQTTLARNGYQLLIAAHEYSAVEEAALVRSMLGRGVDALMLVGADHLPETWALVTEAPIPVVLTWSFDDRLDSIGFDNAQAGYLAARHLLAKGHRRVGMVSGFTQANDRARLRIDGVRQALAAEGLEFSNARVSQQPFSLAGGRAGLLQLLALAEPPTAVVCGNDLLAVGVLLEAEQRGLTVPRDLSVVGIDDLEIASHIAPSLTTIHLPTEELGREVAEHLLARLRGELRASRTEMPIELIERRSSGPLLMPADQPVAGHRRGVK

SEQ ID NO: 1301 - protein, 351 aa, Methylobacterium sp.
MTDPALRGLAFVGCFTTERRRARGRGIDIYRTSRDLGDWTHLGRVENLTNPSFLVTDPARAILYTVQGDGEAASAFALEPDGTLRGLGSAATGGTNSVHQALDPGGRFLIVANYASGSVALMPVRADGGLEPACQVLPLPGEPGPHRTEQACAHPHHVVLSPDGRHVIVPDKGLDRVFVLKLAGERLAIVSQTAMRPGAGPRHIAFHPHRPLAFLVNELDSSVATCRWDADAGALTPLHLVSTLPPDFFGASTAAAIAVTPDGRFVYASNRGQDGIARFRADPAGRLEPAGWTPSGGRDPRFMVLAPDGGHLLVANEQGDCLVAFAVDPETGDLSRTGERPSLSPCTIAFL

SEQ ID NO: 1302 - protein, 211 aa, Methylobacterium sp.
MTILDRFEAAFAACPLVAILRGLTPDEAPAVGEALVGAGFTLVEVPLNSPDPFRSIAALAERLAGRALVGAGTVLTPTQVGEVATAGGTLVVSPNADPAVIGATVAAGLVSLPGYQTPTEAFAALAAGATALKLFPADVATPLALRAHRAVLPPDTRVLAVGGVLPESIAGWRQAGADGFGLGSNLYRPGKAAADVARDAAAYVAAFERSA

SEQ ID NO: 1303 - protein, 112 aa, Methylobacterium sp.
MRRIGARRADGAVALIGPRVRALPAALPSALPALRDWVVAGLAREAEQRRLFPWLAVAFGGGILVYFAAADGAPSPAAPLIAAALALAPVPALGARPAALAAALAVASAFLG

SEQ ID NO: 1304 - protein, 300 aa, Methylobacterium sp.
MTLRDGLAAILVVTILGLAFVAIKVGLETVPPLMLCALRFGFAALPAALVIRPPRAPVVLVAGFGLALGVGQFGLLMTAIRLGMPAGLSSLLIQVQVPFTVALAWALQGERPRRRQILGGSIALLGVAAVALGRGGGAPLGPLILVVGAALSWASANVVAKRIGRVDRLALMVWSSLATTPPLLILSLIVEGPGALTALAHPSWGAIGSVAFQAYPTTLLAFGLWNGLLTRYPAAAVTPFALLVPVAGILSTHLVLGEPLSADILAGGGLILTGIALSLRGTRPGAVAPPGPAPESSKVA

SEQ ID NO: 1305 - protein, 97 aa, Methylobacterium sp.
VDLTRRGPGTQTTTMQLRPILALALLLVARPASAEEGFLDKLFGGSGRGAPPNPFASNYPSAPPTAEEARAARERRSVRGERGSPAGPLPPGRIPEE

SEQ ID NO: 1306 - protein, 152 aa, Methylobacterium sp.
MSVSRRAALAAAIAAPVLIRSGSGSAAGTDPAARGAAVEQAVDALTKALLAADGPALDALTLDGLSYGHSSGQVQDKAAFIETLTSKRSTFPSITLSDRSVSVVGDDAIARHVFTGEVVSGGKTSPVHIGVMQVWHSDGGRWRLLARQAFKI

SEQ ID NO: 1307 - protein, 507 aa, Methylobacterium sp.
MSTYPVITLRPPDGVAVARGAIEPGTPVADGVAAAERIPAGHKVAVRAHRSGEPVTKYGQIIGFAKADIAAGRHVHVHNLGMGEFARDYAFGVDARPTQLVTPPATFQGIRRPDGRVATRNYVGILTSVNCSAHVADLIADAFRRHPILGLDPLAPYPNVDGVVALTHKTGCGMAMGEPLRLLRRTLAGYARHVNFSHIVMIGLGCEVNQIGAFLEEQGLGDRIRSMNIQSLGGTRKTVEAGIAFVTGILAEANVVHREPVPASELIVALQCGGSDGYSGVSANPALGIASDLVVRNGGTVILSETTETYGAEHLFTRRAVSPEVGQKLVDLMHWWEEYTRKEGSEIDANPSPGNKAGGLTTILEKSLGAMAKAGSTNLVDVLRYADPVTAKGFVFMDTPGYDPVSATGQVAGGANLVCFTTGRGSVFGCKPSPSIKIATNSAMYRRLEEDMDVNCGTILDGAESVEQAGHRIFDLILRVAGGERTKSEQFDFGSSEFAPWQIGATV

SEQ ID NO: 1308 - protein, 309 aa, Methylobacterium sp.
MLKDVVRSAGRRAGVDIFRASREAFRWSHTVHDYYPVVPSARWSPGRAPHGQLKAVLARSHAAYDSFLTELEARADLLHSVPHDAPVTGGATPHWNNTWFTALDGAALMTMLAWKRPSRFFEIGSGCSTCFARHAIDTLNLPTRITSIDPMPRREIDALCDWTVRSPLESCDLKIFEELKAGDILFFDGSHRSFANSDVTVFFFEVMPRLAPGVIVQIHDIFIPDDYPSAWNCRLYNEQYLLAAMLLCGAPPFRVTVPVMYICQDPAMSARVKTVFAARGTGPDIPFLYANDSRTPGASFWFEMTGTPG

SEQ ID NO: 1309 - protein, 1067 aa, Methylobacterium sp.
MSDLSILLLDTEPQTHNRYLVLAIADALRRHPAVGRVHVGDHGDALATFVEQGLDTLIAFGGARAHAPLVGRLAGLARTSVLWTTEDPYEREANVRGSGAFDLVFTNDRATVPAYGGRAHHLALGASSLFHDLPVLEDDARYRYDLLFIGTAWPNRVATLNALSAKLPRDVKFKLALPWNAHIGPPELEDEALVTDWRCGNRDFALLANRSRVVLTLPRIFSAARADQATGSTPPPRLFETALSGGYQVVVSPEPETAAYYTPDAEIALCGDEAGAVEAILTALTEPEARIARARAAQARTRAEHLYDHRVATILDAVIDRRRTQTRRPHLAPSATRTVLMLTHNRMGHRPGGGVEVYQELLTELGEPYRVLFLFPVFGDGRWSLRLEGPGIAESFACGPVTPPLSTDPFVEGIFQRLLFEHQVDLVHIHHLMHVPLSLPLIARACGIPTVYHLHDHFLICERWLLLDHTGRFCDVVNRGADQCDACLVSGSQYPPGSKARRDGMMTLVTDAIDAFVTSTPATAGYLRRYFPGIPADRIVEIPMVAPNTAPAGARPVSKRRRDADRLTVAILGNLAAHKGGQQAINLIRSCEAYPIHFKVIGRIDDLYREAVAGFGPDQVTVTGAYEQHAIGGLLAGCDVSLHLSTWPETFVIALTEAWQSGLVPVVADIGALAERVEDGIDGFKVPPDDAGAVRARLIELHYDRARLARMQASIGRKSFPDTDGHLGSVRALYERLIEARPLRHGRVPSHLRHGFDLRLETLGYRTNAASWTSAAIAWDEAARAPEVSPAVTAAARARPVPELPDAFRRLTLRPVRRSECGWSLDVLRTDERLNRSLDLSSVVARASVFLRGWLHVSGPAPKAIYLRLTGRTGTSWVALQSDLRPDVAKWYGEPAAATSGFTGQIDVAGMSFGRYALAIVQIAEGSLRILEDVASIFIAPDTEPPARFVPEPRHLVSGPPHVPDLHHSLPDAGDALRVSPGQLWAAEVAFPGTVPRLGKDTLAVFRGTNGQTWRAPVLKIDERTVRITASVPNIDPGAYTVSLAEPHNRTLRTLATLFRTQVARSE

SEQ ID NO: 1310 - protein, 331 aa, Methylobacterium sp.
MNFVSAISLAGPHVLVTSTFPDALNRNPGIRSDLAEGFAELLGAERVRHTPLELAVAAVRASRPDVVIAVGSLVPDLADLRALRRAADAVGAVLIFWLTDDPYEFDYAFKAELYADIVVSNDSWAAQHYRHPDVHHLPLAAAPERHFRPIAPVAERETVLFFCGVAYPNRVALMRRIDDLLCRHVVEVLGAEWPDTLRCAVNRRLTPAQMADYAAAARLTLNIGRDLDVANRRLSLPQATPGPRTFEVALSGSAQLFFVTGLEICAHFEPDSEILLVDGAADIARAIERSLDEPAAIEAIARRAQARALREHTYRHRAARLLDLSRLTVPA

SEQ ID NO: 1311 - protein, 204 aa, Methylobacterium sp.
MLYELATLSCPLLAVGQVSAGVEAWLDDPDAKGELVGCWRTEIGTLGRLIVLRGFAAPEDMTAERRRALLSANPFNAGHVITALEMDSYAPFPFLPPIRTGDRGGVYEIRTYRQKPGGLPPTLAAWEAAIEPARAYTQHLVVNMYALDGAPRITHIWGFRSLEERAALRARAYEAGIWPPKGGPDQIAEATATIALPQGRSPLR

SEQ ID NO: 1312 - protein, 86 aa, Methylobacterium sp.
MTGLIVAASVALFAGGAQAMPVAPLTGGDAAVTLVRGGCGFGAHRGAYGGCRLNRGPRGAIRRAITGAPRGCPPGLYRGPRGVCRR

SEQ ID NO: 1313 - protein, 158 aa, Methylobacterium sp.
MASVVHRGPGPNAVIGGMRVSYLARSDETGDGLGIYRVAMDPRTPGAGLHRHARLTETFSVEAGRLALHVDGVDHDLGPGDFALIPPGVAHAFANRGDRPVRFTLSFAPALGREGFFEGLARLAAEGRLGDAAAMTDLMARYDQEPLAGFAGWSSVSG

SEQ ID NO: 1314 - protein, 80 aa, Methylobacterium sp.
MPSEPKAPIRGRHLEALRAVAENPGGLRHEAYPTVMPILEELGYVEERTTRGSTGRRVWHLTSGGRELLIALGIRESAEP

SEQ ID NO: 1315 - protein, 239 aa, Methylobacterium sp.
MSGLSPETRAKLKTVSTATLMTALYKRGFRNQMIQGVLPLKAGGPTMVGEAYTLRYIPAREDLNPITVFRDRAHPQRKAVEECPPGAVMVIDSRKDARAASAGSILATRLMVRGCAGLVTDGGFRDADEIARLEMPSYHARPSAPTNLTVHQAIDINVPIGCGDAPVFPGDVIVGDGDGVAVIPAHLADAVADEAVEMTAYEDFVTEEVRKGRTILGLYPATDEQSLADFAAWRTRTGR

SEQ ID NO: 1316 - protein, 97 aa, Methylobacterium sp.
PAPEHHPEPEPQPEPAPEAAAHAAPAAETPAPQSGSGDGLHGDARIDDVIESLSQALGAAIHQQPDPAAENKDGKSEDPASMFERWTVRPRRTQQQT

SEQ ID NO: 1317 - protein, 53 aa, Methylobacterium sp.
VVVNGAAVPARPRERIFGGPAPDGPLPGHLLVLLSRLHRAEAEPKDRPEAKLG

SEQ ID NO: 1318 - protein, 79 aa, Methylobacterium sp.
MAAALTLASVTAWADPVSQTGTGGGPATTAKAPHTAATGQTVPNPGALGPNETGSIERRDAVEERNDAITRGICIGCNR

SEQ ID NO: 1319 - protein, 134 aa, Methylobacterium sp.
MDDRQMARGLAWFGIGLGLAETFAPRRVAAATGLDGHEGLIQLYGLREIASGAAILAAAEPERLLGLRVGGDLLDAGLLAARATPSNPRRNRTLAAALAVAPVVMLDAAIWLRARDRRSPSPGDPGRKPGAIAR

SEQ ID NO: 1320 - protein, 391 aa, Methylobacterium sp.
VEDEAMSEGLAARTVAAANGVAQDAAFGAVIAPVHLSTTFKFPAFEQPGPYDYSRLGNPTRDALADTIAKLEGGARAVLVASGMAALDLALSSLRPGDLLVAPHDCYGGTHRLLSFRADRGHYRVAFVDQTDPDALAAALAQGPKVVLIETPSNPLMRVVDVRRITADAKAAGALAVVDNTFLSPALQQPIALGADLVVHSTTKFLNGHSDVIGGAVIAADKAMGEDLAAWANTIGVTGSPLDAYLTLRGLRTLFVRVEQQQRNAAALAAFLDAHPAVARVHYPGLPTHPGHALAKAQQAGFGAMLSFELAGGRDAVRTFVEALRVFTLAESLGGVESLIAHPPTMTHAAMDPEARAIAGITDGLLRLSVGLEAEADLLADLSRAFRALDG

SEQ ID NO: 1321 - protein, 340 aa, Methylobacterium sp.
VVTDPKLAVIITCYNYENFVGRAIQSVVDQRNDSCEIVVIDDGSTDDSWSIIQRSGVAAFRIPNGGQRAACLYGLAKTRAPFLLFLDADDELLPGALDRILAELDPTVAKLQFCLRCVDSTGAILADPYPALGAFRGQDRTVEDILRSGVYQTPPTSGNVFRRDVCDLLHQCTYDQAVDGVILLAAPFMGEIVSLSESLGLYRVHGRNDSGLGRVLRAATVERDLQRFQLRLGHLRSLLRDWRPGISLVEPEKTYYFQFLEFCMAILRGVRYGGRPFLGLIRSVLIEPRSLKWRIVNALFVVATFLAPVRCAQALLAFRFSLRRRPVRQILRAKIGAGHC

SEQ ID NO: 1322 - protein, 254 aa, Methylobacterium sp.
MHLPETAARIVSCDVFDTLLLRDHRSERCRFHEIAAVASQLLAAEHGVARRPGAIYAARLEVQRAAYRALDLANPSGDVRFADMLAAMTRVLGLDDRAADILYRAEITVELAQLRANTRLMTWLRGRARAGGRIIAVSDTYHRGETIAHLLNTLAPDHPIARVYTSADHDATKRTRALFDVVLQSEKVPPAEILHLGDDTLADVTMAAAAGLRTAQLLRPRHVVLRRRLDAVRARVLHRHWIGAARSGARRIGP

SEQ ID NO: 1323 - protein, 435 aa, Methylobacterium sp.
VSATDAARGPAGDDAVAFGQRVLGPILAEFCLRLWLAERFLAPDRTVLLFCARGGLRLQLVYERFLQRTGLPQNLPRAALMVSRLVAARTAFDPPSPGMLSELGREFSGRSMAEIAAALAQRDDLALPESWNEPFEEGAFTALLSGNQPGVARLHAAIAQQDARFRAHLEACAGPARHCVLVDTGLYGSTVRMMQEGLPERTWSGLQLARCNYKRLATPHFRRTFGLSVESDWYKPWDARTSVLRFWHLIEACLEPDLPSVRTFAQAVPGSPPRANLQDDGWEARIASTRPDLFTGVLAHIDELRSESVAAIPDDAARAWAALKKAIIWPDDRTVSTLSLGGRSRDFGRVELSAQYATPRPARPAQQIRDSLWREGALLRFFPRAGRFLLPVIEAVYAGRALQREATSRLVRRREPAPEARAEPPLWRRQASGAN

SEQ ID NO: 1324 - protein, 368 aa, Methylobacterium sp.
MPECLVFRVPAQHPADVSEVMGLVASGAVDATEIVAIFGKTEGNGCVNDFTRQLAVMALETALATALNCTAAEVGARIALVMSGGTEGGLSPHFLVLARREGPAVPESKALAIGTAFTREFRAEEIGRMAQVEATAAAVGRAMAEAGLTEPADVHFVQVKCPLLTSARIAEAAARGHGVATHDTYASMGLSRGASALGIALALGEVDREHLADSAIGTRRDLFSGRASCSAGIELMRNEIIVLGNAQGWTGPLAIAHRVMDDGIDLPAIRRVLTDLGLLEAGQLPPHESERVIALLAKAEPSHDGRIRGRRHIMNDDSDINATRHARALVGGVAAAAIGRTDLFVSGGAEHQGPDGGGPVAVIARVRG

SEQ ID NO: 1325 - protein, 442 aa, Methylobacterium sp.
VRIPSLTTPARRVGAGLAAALAVAVSTAGLVASGALERSVVARDVETPLSAEAVRALAPRGAKVAAAADCFACHTARGGAPWAGGLPLETPFGTIHATNISPSPQGIGGWSRADFHRALRDGIAPGGRHLYPAMPYTSYRGLTPEDVDALYAYLMTRAPVAVENRANTLAFPFDQRWTLAAWNLLSLPATVAAPDPGRSPLWNRGRYVADALGHCGECHTPRTVFQAMRPDAVYRGATIEGVEAPDITPTGLARMGFTPHGLVGFMRTGLSAQGGATHQMFDVVHFSTQHMDAADLTALSAYLFDRDALPAEPETPVAATPAAIPAAVAARGRASYAGLCAGCHGGAGEGIPHVSVPLRTNTAMRVAGAGGLLRAILVGLPAQRFPGNERMEAMPPFAALIDDAALADLATWMRAEWGGQGQAVTPDEVARQRAGLRADASH

SEQ ID NO: 1326 - protein, 312 aa, Methylobacterium sp.
MRFISEEDSAALVDHAMAFDAAREALIAAVAPGTTLFPAVLGHGSEPTNRFSIKSGSTADYAGLKVGSFWPGNPDRGLPRHNSVILLFDQAVGRVDTVIEAGLVNAYRTAAADAVAASVLARPDSAVLAVFGAGNQAEFECAALARILPIRTVLVVARDAAKVAGFAERLAGQGASGLDVRAAAPREACAAADVIVTATPARAPLFEADWVRPGTHVAAMGADAKGKQELPPALLERAALFCDLPEQSRTIGEFQHASADAQAGMRALGDVLRSGEGGRTDPEAITVFDSSGIALQDLTIARAILAKADARL

SEQ ID NO: 1327 - protein, 301 aa, Methylobacterium sp.
MATLARSEVLALDRAARARPRIPSGVGGVLPGTLLVVLALLGPLALMLRYSFNRFVPGELMVEGLTLANYAKFLHDSFYRDVLLTTLWVAALSTLICLVLGFPVAYALVRQVGPRWKSKLLILIILPLLMGNAVRTAAWMVILGDKGLLAALLSGMGLTPPRLMYTPSAVVIGLVSVTLPFMIVTLQSVLERIDPVLEEAAESLGAGHLTILRRVVLPLALPGLLAGTMLCFILSMNAYATPVLIGGPQFHMMAPEVYQQVAKAMNWPFGAALAFVLMTVTLVLTTTANVLVQRRYRRWSE

SEQ ID NO: 1328 - protein, 375 aa, Methylobacterium sp.
MQIGIVGCGYVADFYMTTLVNHPELRLAGVYDRDPERRAVFCRHYNARAFDSLEALLAEPEIGLILNLTNPHSHYVVTKAALEAGKHVYSEKPLAMEYAQAEALVELAEAKGLSLSGAPASILGEAGATVREAVASGQVGSVRLVYAELEDGPVFREPVHEWRSVTGAPWPAEDEYRVGCTLEHAGYYLTWMSLMFGPVERMTAFASRLYPDKGTGQPPDTVANDFSTACLEFRSGVVARITCGLVAPQDRSLHIIGDRGVLTVTDSWASQGPVYLRSPSGEAPGRLGRLLHRIQRYLPGRIFLGRKLPTPRFGGKLPSYPSQMDFARGPAAQAAAIRAGVPAPLPARFVLHITEIALAMQNAGGGAVIQLRSRF

SEQ ID NO: 1329 - protein, 96 aa, Methylobacterium sp.
MRRAWPIGTPMRKLLAFAVAVVVCAGPALALADQPARDCDRDPETTGALPGDPRSLYLPGERPVKADRDPPEASWQDEARETSEQRRRDLLACGVD

SEQ ID NO: 1330 - protein, 76 aa, Methylobacterium sp.
MKHIIVLAIAATALTACNAANRPGRGELFMSEADVAAKDDAICRGYGAEPGTPEYVQCRGTQDQRRDAAQAPRRSG

SEQ ID NO: 1331 - protein, 272 aa, Methylobacterium sp.
LAAIWLTALIRALTSGTVVVLASVLAEWLGPVWGALVVSLPVSAGPAYVFMAMEHDAAFVAGAALNGFAANAATGLFLIVYAHRAAGRDMTATLGPAILAWLAAALPVSAFTWTPTTAFLLNALVYGAGALSTRHVVRATLVRSAVVVRPRPLDLLIRASAVALFVAALLALSTALGPARTGVIAAFPVTMTSAFVILHRRIGGAAMARLASVAIRGVFGFGLTLLTLHLTIQPYGAALALTVALLVSLVYSAGLLVVQPRPGRQEPGIVTR

SEQ ID NO: 1332 - protein, 288 aa, Methylobacterium sp.
MSGLPRAAPDSVPDSIPDSAPATTPLARTGIRRRGILVPAVSAATVLAALGLWLVATRVGWVKPLFLPPPEAVLAAFGQAWRGEIDGAPLGLHIGDSLLRVLGAFALAALVGIPVGLAMGTSRIARGILDPPIEFYRPLPPLAYLPLMIIWFGIGELSKVLLIFLACLAPVALAARAGVRSASVDQINAARALGASRWQVLRHVVFPAALPEILIGLRIGMGVGWTTLVAAEMVAAQAGLGQLVLNASNFLRTDVVVMGILLIGLFAGLFELGMRGLERVLVPWKGRH

SEQ ID NO: 1333 - protein, 64 aa, Methylobacterium sp.
VKWFNETKGYGFIQPDDGGKDVFVHISAVERAGLRSLNEGQKISYDVEADRRSGKESAANLKAD

SEQ ID NO: 1334 - protein, 498 aa, Methylobacterium sp.
MQRPDDAQWDVVVVGSGNAAMSAGLAALERGASVLMIEKAERDLAGGNTAYTAGAMRFVYAGNDDLIPLLVDPEDPRLPRTDFGAYTAQKFEADLLGFNDGRPLSREQRILIDESGAALRWLATQGVKFEPIYSRQSFEKDGRFVFWGGLTLATHDEGFGLARAELQAFTRAGGEIRYGCPARGLIVEDGRVVGVETLQGPVRATSVVLACGGFESNAALRTRFIGEGWDKARVRGTPHNQGDGLQMALDLGAKAHGFYGGCHATPMDLHTPDYGNLDLPHGERKHYRKICYFLGLMLNANGERFVDEGKNFRNYTYAQFGRSIMEQPGHVAWQIFDAKVDHLLYSEYRFHDAHFVEADTLDGLLDKLEGIDRAAARRTIAAFNAAVDESVPFDPTVKDGRGTKGLALPKSNWAQRIETGPFKAYPVTGGITFTYGGVEVGDDGGVKRADGDTIPGLYACGEMVGGVFFNGYPGGSGLTSGVVFGRRAGYGAAARAKG

SEQ ID NO: 1335 - protein, 110 aa, Methylobacterium sp.
MRSMPHTHPPYAAEFRRQMVELVRAGRDPADLAHEFEPSAQAIRNWFAQADRGESRGASKSDVLTLAEREELARLRREVRQLRLERDVLSKAAAWFARESGAVPSGSSSS

SEQ ID NO: 1336 - protein, 50 aa, Methylobacterium sp.
MSDGGARLKVVSVIGVPDAFVLAYGVGGRRRPARVTWRQETELGVSFGDA

SEQ ID NO: 1337 - protein, 103 aa, Methylobacterium sp.
MMRAKVLGLVAVAAAALATATTANAAPFGYGPPDAGSVIERVAGGCGPGFHPNPWGHCRPNDRGWGWGGPRGPYGGRPGYGGYDRGYGGYGGYEGPRRSYGGW

SEQ ID NO: 1338 - protein, 146 aa, Methylobacterium sp.
MIAGLVAGASPAAALSAKDCSVKYQAAKQAGTLNGQKWNDFRKAECGAAADNAPTTAPNPVSPTATTAPAAPPAAPRAGTTSAAAASATFPRAVDPKYAKESAGKARMHTCLDSYNAAKAAGTLGGMKWIEKGGGYYSACNRQLKG

SEQ ID NO: 1339 - protein, 153 aa, Methylobacterium sp.
MRRALAALVLALPPAVPLTAAADDLPPPVAAAAARAEASCGSEPATLKPGFVTRQDVNGDAVPDFILDFAAVQCGDDESAACGTAGCEMQVFASTTDGFVDAFDAVAHDLRFRTVGGRPAVIVDMTGATCGRSGQDPCGAIAVWNGRTFGRTR

SEQ ID NO: 1340 - protein, 146 aa, Methylobacterium sp.
VEIQRGSRIGPRCKISSHSFICAGVSIGAEVFVGHGVVFTNELYPEATNADGSLKRDGEWELVETVVEARASIGSNATIVAGITIGEGALVGAGAVVTRDVPAFAIVAGCPARVVGDTRTKRAESAARARSVQSPRPEPAEPLQVA

SEQ ID NO: 1341 - protein, 201 aa, Methylobacterium sp.
VRGRPRKEPGDRAADRQALIAAAVAILNAGGAAALTARGVAERAGTAVGSVYTQFDSLELLRLEANAVTMRRLRDTLAGALAACPSRETEARLLCLADAYLAFAAEHHAAWAAIFERRTVAAPDSVQADIAALFGILEGVLRDGGRLGEAAIPVMARALWSSVHGMTYLADLGSLGPLGVSDVRPMIDALVRAAVRGFSAG

SEQ ID NO: 1342 - protein, 230 aa, Methylobacterium sp.
VISQSHLHTRRAETISGIGSAQERRVQAGGTPAFPDPTLVEAALHLLAEHLEQGLAVTDRYGRAHFLNRAAQAFVARGLLCLEHGGLRGATPEDSAALRRVIARCAAGHRGGSVRLEGAGGTLLVAASVIPGTLGPIGEGAVLLRLTDPGSPRLPDPGILQDQFGFTPAEAALAVDILAGNDLAASATHRRITRNTARVHLRHLFEKTGTRRQAELVRLLLLCPQPIADA

SEQ ID NO: 1343 - protein, 38 aa, Methylobacterium sp.
MGNIWMRKLPLVLLAVTAMSGCTYLPAAGPTAGAIQAG

SEQ ID NO: 1344 - protein, 328 aa, Methylobacterium sp.
MRRRDVIAGLGGAAAWPALAAAPAKGQRRLGILLVYGEAHPDSPVIVETLKESLKRAGWIWGENLTVDLQYGNGDAERMRVQAEEIVARVPDVVLAQGVVGATALQRATTTVPVVFMMLQDPVGGGFVTNLSRPGGNLTGFTNFDFVLVGKWLQLLKELSPGVTRALALINPDYRARLAGYTVEMARIGPALGIDARIAGVHDAAEIEAAIAGFAAQPKGGLIALPDAVTGVYGQLIVDLAATYRLPAVYAYAAPVRLGGLAAYTTSVEQDVQRAAGYIDRILRGAVVGDLPVQASERFITLLNLTTAASLGLTIAPSLMAKVDELVE

SEQ ID NO: 1345 - protein, 149 aa, Methylobacterium sp.
MHAVHELPPITITTRDFDRLVVFGLDAYLRGDRRADFLLSELKRATLCPPRALPGEVVSVHRWVHYRLNDDPTVRGQLLVHPHDLTDLPGGLSVASPLGTALLGLRVGDRMPFRIDDAGIQHVVAVVGIGRRFSDEPVRGRGAPAPREA

SEQ ID NO: 1346 - protein, 184 aa, Methylobacterium sp.
MGSRLVGVLARLSAALDAAEAGRQVPGAFKDDLIALVPRLRRYALSLTYDGVEADDLVQFTLLKAWEHRQRFQPGTSLVAWLFTILRNGFINGRRKRRLEVPDPDGAHAVTLSEPAAQEHSMGLKEVRAAIDRLEPAYREALILVAVDGLPYEAAASVIGCPAGTVKSRVSRARDRLLHELGER

SEQ ID NO: 1347 - protein, 85 aa, Methylobacterium sp.
MAEGAEGMRDWHVLIVGGLPTDGQKRATVIGGIADGLRRGGAGVRIVKAADRSEFDTEAGRLKDARSHLNLIEIAYPGLVDVPAG

SEQ ID NO: 1348 - protein, 127 aa, Methylobacterium sp.
MSAAIEIKDLSLRVNGAAVGPIPVPVGTSLLDVLHEWLGLTGSRMGCGQGICHACTVMLEEAAGPREIRACITGAHWFEGRSIRTVEGHARTAPDGTVVLSPVQQAFIEAFAFQCGYCTPGFVTGAS

SEQ ID NO: 1349 - protein, 114 aa, Methylobacterium sp.
MATFDLRGGHGFLPRSRRGRRGGPARTTDGTVLGRWLLSTALCLALAAPCPAPALPWVLAALLSLSGFAWLGRAITRAGPPANARHLTAWDAALLSFAASFAVQSAARLGLFGG

SEQ ID NO: 1350 - protein, 212 aa, Methylobacterium sp.
MRILLLNPNTSAAMTARMARAAEAALAPDAHITALTAATGLPYIASRAEAQLAGAAVLETLAAHHSGHDAAVIAAYGDPGLVAARELFDLPVVGMAEAAMLTACQLGARFAVVTFAPALLPWYEDAVALAGLSARCAGLHAVRRPFQAVTDVQDELRPEILALAERAVGEGADVVILAGAPLAGLAATLRDAVPVPLVDPLAAALGQAQALV

SEQ ID NO: 1351 - protein, 472 aa, Methylobacterium sp.
MNAPVPAPRTRPDAATIAGLAEALRAVLGDRVTASPAVREQHANQLTWAPCEPPDLVVFPHATAEVQAVVRACAERDVPIVPYGVGTSLEGHVNAPFGGVSIDTGAMNRVRAVHADDLDCTVEAGVTRRALNAYLRDTGLFFPIDPGADATIGGMAATRASGTNAVRYGTMKDAVLALTAVMPNGDIVTTARRARKSSAGYDLTRLLVGSEGTLGIITEVTLRLHGIPEAISAGICPFPSIKAACDATILTIQSGIPVARIELLDEVQVAACNRYSKLSLPETPLLLVEFHGTDAGVREQAERFGEIAADLGGGPFDWATGADQRARLWQARHDVYWASVALRPGPTIKNMSTDVCVPISRLAECVEATKRDIAATGLTAPIAGHVGDGNFHTLPLVDADSPEEMSAVAGFLDRLVARALDLGGTCTGEHGIGQKKMRFMESEHGPEALGLMRTLKRAIDPRNLMNPGKLIP

SEQ ID NO: 1352 - protein, 524 aa, Methylobacterium sp.
MRVAVGDLSDYALPSASVIGRLATNFESLRSRQLAFLLSSAERRPASLGRLRETMASVETDLKDYAPLVSPGEEALWKAVQDTVPAYSKMGEEFLRRLAEGDEKGGSAFLLDSMLPALNAARTALKADVHFNDAFGRKAGEAANALGDSARTAIVVVLGLIVAVTLAISWMAVATVSRPVRRMAGVMHEVAKGDLSPAIPSAGERSEIGEMAAALQVFKDNLARTRQLEEETALARASAEEQRKRAMREMADGFEAAVGGVIGMVASAATELQATASSMSGIAAETAAQSTAVAAAAEEAASNVNTVAAAAEELGSSVAEISRQVEDSANLAQRAVTEADQTGALVQELSTAVSRIGTVVSLISTIAEQTNLLALNATIEAARAGASGKGFAVVAAEVKALAGQTARATHEISEQIVHIQASTSQAVASIGGITGRIGQISAMANAIAASVEQQGAATQEIVSNVAQAAAGAGEVTGNIAGVASAADETGAAATEVLGAASELSRQSESLTAEVARFLATVRAA

SEQ ID NO: 1353 - protein, 252 aa, Methylobacterium sp.
MMRALEGQVAWVTGAGSGIGQAAAVALARAGMRLALTGRGQEALARTAEMVRAAGGEALVAPADMGVADDVQRAWEAVHAAWRRCDLLVNSAGLNVPQRGWSEITPAGIDAVVGINLNGPFYAARAVLPTMRAQRSGLIIHVSSWAGRYVSKLTGPAYSAAKHGLVALSESLNQEECGHGIRSCCICPGEVATPLLDKRPVPVTAEDRGRMLQPEDLAETILFVARLPVSVCVNEILISPTWNRGYLEGVKL

SEQ ID NO: 1354 - protein, 419 aa, Methylobacterium sp.
MSHVLSGPVPSEILLVPRGEAGHFLPAALGWLGKRVTVTAQPGPANHVLCLPVLDFVRLGFPEANGRLDLLEPGDAENLRAGRAALLLDLSNEGPGLHAPTFEALHRNLEELGIPRERVILVTQNRLLRLDYERLYGEGLRFWTFEFFPLQVALWLNEAEGPRLFPQHPLDRAGYAPFARATGPARFLCQNAALRWHRVLLYRWFQLSGLDRDGLISFHGIGEDNPKAGGIDVFHAPPEIEAAFGPLLADVGSWIPRRARRIDADQGTDMVMTLDTRAYAECDLTVISETDFFEPGVERITEKSIKAAATGLPFVTVGAPRAVERLSELGFETFGGLIDHHYDLVSDPAERLPLVFRSIERAWAACRDDRARWHRLAREQAEANVAHARRGLLPQYERVMVAPLIERLNRFMETGAILH

SEQ ID NO: 1355 - protein, 302 aa, Methylobacterium sp.
MADFRSLEVFYWVAKLSSFRRASEKVNTTQPAVSQRIAALEHEYGTLFERRSRDVALTERGRLLLGFAERFLALQTEMSAALHETGRTRGTLRLGVSETIVHLWLSRFIERMRATHPGIGVDITVDISPNMQAALVADEIDLALLVGPITLPSFANRPLFSTPVAWIAAPGLLPGDEPLSLGALLHHPLITYPRNTSPYVELRDLVLQENLLPSQIHTSASLATIVKMGVEGLGICVIPPAVVEAELRAGTLRVLPAEPQLSDLTFTAMHTKRPAHHFVADAARLAQHVAETWAAETWAAGR

SEQ ID NO: 1356 - protein, 271 aa, Methylobacterium sp.
VSQHPGADGAPPVFADAADARRAIRAGRFRGHTSGLVPAHAQGNLMILPRAMAEDFHRFCQQNPKPCPILGVSQPGARALPTLGTDLDLATDVPGYRVYEGGALVAELPDLTGVWRDDLVTFVLGCSFSFEAGLIEAGIPLRHVALGRNVAMYRTSIATQPSGPFHGPLVVSMRPMKAADAIKAVQVTARMPAVHGAPIHLGDPGLIGIRDLARPDFGDPVPVEPDEIPVFWACGVTPQAVAMAARLPLCITHAPGHMLITDLLNRDLPFL

SEQ ID NO: 1357 - protein, 276 aa, Methylobacterium sp.
MSADTVPPKPVLLTGASGALGRVLTRSLGAQGWTLRLTDRVPFPDPLPEGARFQVADLEDGPAILRLAEGCGTILHFGGISVEHPFETVIGPNIRGLYHAYEAARREGARMIFASSNHAIGFHPRSEVLDDDCGLAPDGYYGLSKAYGELLGGLYRDKHGVESVFLRIGSCFPEPTDARMLATWLSYADLTRLITRATLAPDLGPTGSVVIWGASNNSRMTWWRKDGRAVIGWTPQDSADSHAAALKGKTSGNPVVERYQGGGFTAIDYSRAAPPR

SEQ ID NO: 1358 - protein, 292 aa, Methylobacterium sp.
MGDRPAYIAVDWGTTNRRACAVSEAGAVLDSLHDERGVLALTPDAYPAEIAALRARLGALPIIAVGMIGSNRGWQAAPYVAAPATLAALAEACLEPAPGVRIVPGVALRSGDRPDVMRGEEIQVFGAIGAGAAPATALFCQPGTHNKWIETVDGAITDFTTVMTGEFFALLRAHGILAGTLDGTVGDGAPFRAGVRRGLASRNLAATLFEVRSGLLLDRLAPEDAAARASGILIGADIGTRDDLRRRPVHLLGGGRLGALYAAAIAEAGGDPVIVPDGSTTAGIHAIWSLRA

SEQ ID NO: 1359 - protein, 100 aa, Methylobacterium sp.
MRADLAVLALVLAATGAHAQQQLPTVPELLTAEANAARACESTGDPAITREQCRLRDRLSGRLAQAGYCWGRKGQADEKKEWHACQPDSIYEDDIEAVQR

SEQ ID NO: 1360 - protein, 186 aa, Methylobacterium sp.
VGQRLRGLRRARGLSLEAVASTTGLSIGFISQVERGLSSPSLRVLALLADTLQIGIGGLFEAGPDAPDLDPIVVFRKDRPELQLWRAGITKQLLTPPGGTQGMSLFHMVLKPGASTGDEPFSHDGEEAGLVLAGRLTLIVEARTLQLAEGDSFRFESRRPHRFSNPDPRSQTTVLWVNVLGSPATP

SEQ ID NO: 1361 - protein, 539 aa, Methylobacterium sp.
MSIVGVQVSSVGAVMMEGRKAAVRAQVESAHGIVAAFARQAEAGAVSADEARRRAAEALRAMRYNGGDYVFVYSSEPGNIGRNVVHPDPRIEGTRSRDDAAMKKTFVWTMIQHAREGGGFTEYRWARLGETEPAPKVAYSLAYEPWQWVISSALYVDDIHALDRARMVTTLLWLIPLGIAIGLVGFLLARSITRPLSAFTAALRRLAGGATDVAIPGLGRRDEIGQMAEAAGVFRDSMIEARTLSTEQRAEQERRQERAQWMEAVTRSFDTEASQLLARVDTAAADMREACRAMADTAAQASRQAGSAAGAAQQAAANVQTVAAATEELSASIGEIGGQVTKSAAIAGQAVSEAERTDRQIRGLAAAAERIGEVVRIISAIAEQTNLLALNATIEAARAGESGRGFAVVAAEVKGLAGQTAKATEEITAQIAAIQGETTEAVGAVHSIGRTVDTMNAIASAIAAAVEQQRFATGHISQNIDEAARGTDAVSANVVSASSAAEATHRVAGEVGAAAGDVCRSAEALRAEVMRFLVEMRAA

SEQ ID NO: 1362 - protein, 238 aa, Methylobacterium sp.
MRRRPFLSGMLAALSLAGRPARAADTGVDLLLVLAVDVSLSISEARFDLERRGYAEAFGDPRVLRAIGDGPTGRIGVALFDWAGPGEQQVAVDWMVIASAQDAAAFAARLRAVPRPFYGRTAIGSAIGFASELLARAPFRAERRVIDISGDGTGNAGRPIAEARDAAVAAGITINGIVILTEPEGMPAFLKEHTNPTGGLAAYYRSVVIGGEGAFVMTAESFAAFGRSLIAKLVREIS

SEQ ID NO: 1363 - protein, 356 aa, Methylobacterium sp.
MRIPADRLTAYVRDIFVREGCAEPEAERIGRFLVAANLTGHDSHGVVRVTRYVEWLRAGEVEAGRTPEIVTDAPNFALVDAHYGFGQTAGPVAVDLGIAKARANGVAIIALRHAGHIGRIGEWAERAAAAGLVSVHFVNVAGSLLVAPFGSVERRFSTAPFAAGFPVPGGDPIILDFATSLVAEGKVLVASRGGKPLPEGALIEPDGRLSADPATLFGPLEGVERDNQRGAGAIRAFGEHKGSGLALMCELLAGALTGSGTAGPGQRRICNGMLSIYVTPSALGTEDALAAETRAYLDFFKSAKPMPGAEVLLPGEPERRMRAERLAEGVPLPEPVWETLLAAGRPHGLDGNAYRT

SEQ ID NO: 1364 - protein, 83 aa, Methylobacterium sp.
MSVWTVAILALLPPLAVAAALAWRGRPGQRFAAYQLAGSVTVLILTLMAFATDQASITDLALTLVLLNLPGTMLLAVFLERWI

SEQ ID NO: 1365 - protein, 83 aa, Methylobacterium sp.
MTDAGGFDLDGTAKSAHEREVLLRQIAHALNVPVSIFRGPPGSPAARGPSAAECAALLTAFSRIADPDLRKECLALAERLGRR

SEQ ID NO: 1366 - protein, 155 aa, Methylobacterium sp.
MSLASVRAFFAEKAPDIAVIVLETSTATVAEAAEGHGVVPAQIAKTLSIRVGEQVALVVTRGDARLDNRKAKAAFGGKVRMLDLGEVEALTGHPVGGVCPFGLLTPLPVYCDVSLRAFDEVVPAAGSTHSSVRIAPARMAALTGAAWVDVCALPG

SEQ ID NO: 1367 - protein, 160 aa, Methylobacterium sp.
MSRYRCVPIPTETADRFRTTGLDDRGNPVRRVVATADGGFPCRHCLELGRPGETMLLGSYDLPEPRGIYWTPSPIFLHADECPRAEAVNGLVPIVRANALVSVRAYDADHLCLYDLGQVCPGSEAEVPLRRALGDPRTRFVNIHTARPGCLLSRVERVAD

SEQ ID NO: 1368 - protein, 328 aa, Methylobacterium sp.
VKILKHEAGRVTKPGLYQMPAAVYHADPAPEPSLSSSLAKVLLDYSPEHARAAHPRLAPPRPADDDVEDKPTRPREIGTAVHRLVLGAGCDLTVIQSPDYKAKDAQAARKAAYAAAGAPILAPDLLKAERVAARVLSHVASVQGCEGFATAPAEVVAVLRDRSGAWLRTMMDRVEIHPTHAVIWDVKSSSQSSAPQGLGRRVEQMAMEVQAALYVHVLASLLPHLSGRIVFRWIFVEADEPNGVCIAQADGAGMEIGARKVAAAIHLWNRCRAADHWPGYPAEIVRVDYPEWAERRWTERESLDLQLAGASYDVAQSPFRPLGMGDAA

SEQ ID NO: 1369 - protein, 188 aa, Methylobacterium sp.
MAYQIPTAARLVSAPIVCRILTMRQYDPDPAIDARIRRAVRYGQTRWAEIWLSVIMWVVGLICLMPWPTFVGPQYRIITAYVSEPTAGWIALVVGTARIVALYINGRRGRETSFVRTIGCLGGFLFWLAMALGFALAFPPLSLSAGIYSVFAIAELHSSGRAAGDMAAEDTFGFRKRRRASAGNSTAA

SEQ ID NO: 1370 - protein, 401 aa, Methylobacterium sp.
MTSDRKLKVVAVAGSGTLFFHAAVLGTFLAASAAPTPLYRFYQETYALSPVITTAVFAVYALALLKALLVAGSISDHLGRRPVIFGALLLELVAMALFTTANGAWGLIAARFVQGVATGIAASSLGAALVDVDRARAQLVNAIMPLIGMAAGALGTSALVQYGPHPLHLVYAILAAVFAAQAALLWLTPETGERRAGALRALRPRVVIPPQARRPLAAITPTNIATWMLGGFYLSIVPSLVVAATGSRTPLTSGVMVAALMVAGAFAVLQRRGRDAAANLTIGTLAMTAGLVIVLAGMHGGSVPVLIGGTLVGGAGFGTSFLGALGTIVPLAKPSERAELLASYYVESYLAFSLPVICAGYLVRRIGYVTTADLYAAAILAMSAAGFLARRALTSRRVSPG

SEQ ID NO: 1371 - protein, 91 aa, Methylobacterium sp.
MTEMLRDNVERGRFELQVGGDVVFATYRREPGQLVISHVYAPPVLRGTGAADRLMEGVAAHARAEGDRIVPLCGYARAWLRGHRTHRDLLA

SEQ ID NO: 1372 - protein, 49 aa, Methylobacterium sp.
MSSLTIGLGAACCAAGAAAHFLDRTQRKEGLFGLAGFALLLTGMFLSRS

SEQ ID NO: 1373 - protein, 576 aa, Methylobacterium sp.
MTARKKTLDDLRSQRWFGATDLRSFGHRSRMLQMGYERADFTGKPIVGIINTWSDINPCHQHFRERVEHVKRGVWQAGGFPIELPALSLSENFVKPTTMLYRNLLAMEVEELLRQHPVDGAVLMGGCDKTTPGTVMGGISMNLPMIFLPAGPMMRGHFGGTILGSGSDVWKYWAEKEAGNITTQEWNDMEAGIARSAGTCMTMGTASTMTAITEALGLSLPGSASIPAADADHPRMAGACGRRIVEMIWEDLKPSDILDRRSIDNALVVHNALAGSTNAMIHLVAMAGRAGIPVKLTEFDEFAQKVPVIANLRPSGQWLMEDFHIAGGIRALMARLSPLLHLDARSVTGGTVGDGLAGMKVFNDDVIRPLERPIVAMGGTAILYGNLAPDGCVIKPPAADPRFLNHTGPALVFDTYDAMSAAVNDLDLDVTPDHVMILRNAGPIGGPGMPEWGMLPIPKVLLRQGVRDMVRISDARMSGTSYGACILHVAPESAAGGPLAAVRDGDLITVDVPGRRIHLHLDEAEIAARVKAFVPPDRAYPRGYNRLFAQHVRQANEGCDFDFLEGAGGIPEPEIH

SEQ ID NO: 1374 - protein, 513 aa, Methylobacterium sp.
MATSLIRSRRMITRTLDHDRWEEIADGAVLQTDGVIAAVGTYADLHARYPDAPVIGSGREILLPGFVNGHHHVGLTPVQLGSPDMPLELWFVTRMVARNLNLYLDTLYSAFEMVGSGITTVQHIHGWMPGSLEEVEARSNEVLRAYRDIGMRVSYCFAVRDQNRLVYQADMDFVASLPAPLQDPMKRWFERFQMSLEDNFALFRSLHAGQEGASRAKIQLAPANLHWCSDAALEGLAGLSESYDVPMHMHLVETAYQKAYAEKRGGGTALEYLDRFGMLGPRLTLGHGVWLNEADIERVAATGTCICHNCSSNFRLRSGVAALNRFEAKGINTAIGLDEAGINDDRDMLQEMRLVLRAHRVPGMDEADVPSMAQVLRMATVGGARTTPYGDSLGTIEVGKGADMVLIDWDQIAYPYLDPETPLLDAVIQRAKTGGVTAVLCEGEVLYADGRFTRVDRDAALKALHDDLSRALSDDEVERRQLSKALLPHARRFYANYIDPSRHEPFYRPSSRV

SEQ ID NO: 1375 - protein, 268 aa, Methylobacterium sp.
LASDLRSDDAVACRGVAKVWAAGTARAHEALRDIDLTVRPGEFVVFLGPSGCGKSTLLYLIAGLESASGGELLAFGEPVTGPSPERSLIFQETSLLPWLSVWQNVSFGLSLKGVPEAERRSVARAALQRVGLAEAFDKRPDELSGGMRQRVAVARALAMRPKVLLMDEPFAALDVQTRQKMQDFLLDVWRDSGASVLFVTHHIDEAVALADRVVVFTARPGRIKTIVRNDLARPRDPFSPEAEALRRHLTELLRDEVDRAFAEQEALV

SEQ ID NO: 1376 - protein, 309 aa, Methylobacterium sp.
MATFLARAAAVPQDRPRLPLGQRLALPEGLVPLLRRTGWMLISVGCFAGLWELLWALGIADAKLLPPPHIFLGNLAEQARFFNTAQRWQIGTGMNTGPSPAMAVLITVLASTGRVLAGLALAASLSILVGVAIRYFKLFERLTLPTITLLAPVSPIAWLPVAIFMFGIGNAPAIFMVFIALFFTMVLSTIQQIDGVNRNYINVARTMGASKRQIYARVIVPAILPGLLAVLRLNLFGAWMVVLVAEATGVGYGLGQVIMLARNTFNPSLVFFTITLIGLLGFAFDLLFRLVQRRLLYWLPRDAGSSLGL

SEQ ID NO: 1377 - protein, 350 aa, Methylobacterium sp.
MCDRHGVYRVPDLTRFKPSRRRFLGGTAAALTLAVGPGLTGPAAAATGIRATHGTGFCNLNFFLAEAMQLAKDDGLTIDFVNTPTFSDQVTFLGMGQVDAGVMPYTSFMALYDAGAPVKIVAGGGIEGCVLVAQPGLDSPEKLKGKTLGTFQLDTLEVLPYDWLKKNGVAFKDITVRYMGSTPEAVEAFRAGALDIISTIEPYGTALLTDVKGAVKLSDGTDIYGKGYTDCVLAVRNELIAKNPAAVKALIKGMMKAQGLAESDPQAALNKLVGSYYKTSMSNAQLAMGRQPSVVDARNQTQFILDRTDSVAEMGYIKRKPGRDAIDWTLLEQVIAENPDLYGKLKLKSA

SEQ ID NO: 1378 - protein, 484 aa, Methylobacterium sp.
MRERHADHDALASILAEALAALALPPEAGDRLAVTGTGSLPSCFPGTALATASIGAAGLAVSELLGLSGPAPAVTVDRHLASAWFGTSVRPQGWTLPAAWDPIAGDYRAADGWIRLHTNAPRHRAAALAVLDCPGEREAVAAVVARAAAEDLEVAILRAGGCAAAMRGPDDWEGLDQGRAVRAEPLVAVAERPVQHRSPWRPDPARPLAGIRVLDLTRILAGPVATRVLAGLGADVLRIDPPGWEEPSLALDVTLGKVCTRLDLRQAADRRHFETLLAEADILVHGYRPDALERLGYGAVRRGTLNPDLIDVALCAYGWTGPWAGRRGFDSLVQMATGIAAAGQRWKQADRPVPLPVQALDHATGYLMAAASVRGLIARQRDGRAVTARLSLARTARLLTDHPGSAPGPAFGGYRDADYAPEIEDTAWGPALRLHAPVRIEGAPLRWDRPARDLGATKAAQVRHFDSARSSGPDATPGSRRAIN

SEQ ID NO: 1379 - protein, 100 aa, Methylobacterium sp.
MFGAAKLTGRFWFRKTWTGKLVLLVEEERPRWFSRTGLTKLRWRDARLLDLAEAPMRTLMTLERSYRADYAAGPARVLQAVIPPGTRGAIATPIGTAANA

SEQ ID NO: 1380 - protein, 261 aa, Methylobacterium sp.
MRFFSASRVAALVVATLLAVPFAAPARADDLDAIRAAKTLRIGTEGTYAPFTFHDASGQLVGFDVEIGRKVAEQLGVTPQFLEGKWDGLIAGLDGKRYDVVINQVGITKERQAKFDFSEPYIRARAVLITRADRSDIKSFADLKGRKAAQSLSSNFARLAEQSGAELVGTDGFDQSIQLVLTGRADATVNDSLSFLDFHKQKPNAPVKIAAEQADADASGIIMRKNNPALKAAIDKALEAIKADGSYAAIAQKYFGADVSK

SEQ ID NO: 1381 - protein, 308 aa, Methylobacterium sp.
MTSSVPAYRGVFPVAPTVFDAAGALDLDGQRRAVDFMIDAGSQGLCILANFSEQFVLTDDERERVMHAVLEHVAGRVPVIVTTTHFATQVCAERSRRAQEAGAAMVMVMPPYHGATIRVPELGIVDFFRAVSDAISIPIMIQDAPVAGTPLSAPLLARMAREIANVAYFKIETAGAASKLRELIALGGDAVVGPWDGEEAITLMADLDAGATGAMTGGGYPDGIRQITDAYAAGRRDEAMDAYARWLPLINYENRQCGLLACKALMAEGGVIASETARLPIQPLHPATRAGLIELARRNDALVLRWAR

SEQ ID NO: 1382 - protein, 136 aa, Methylobacterium sp.
MPPIYSSSATALLPVTGRVLMSAIFLVSGAGKLAAPAATLATIEAAHLPLPPLAYAAATSVEVVGGLLLVAGYRTRLVALALALFAVATAVTFHAALGDQNQMFHFLKNLAMAGGLLQVAAFGAGPLSLDARQGRA

SEQ ID NO: 1383 - protein, 325 aa, Methylobacterium sp.
MPTSDAPLTIGIIGAGIMAERLLGAIHGAADSPVRVAAIWDPAPAALDRIGAAFPAVPRVADSAAVVAASDCVYVASPPASHLGYARAALAAGRSVFCEKPLAIDRADARAFVAEARGAGAVNFPFASSPGVATIERWIAAGAVGTPRALTVAVEFARWPRPWQADAARWLDARGEGGFTREVVSHFLFLARRQLGPLAGLAGRIDFPEPGRSERAIDVTLTAGGIPVTLTGRVGGVAADDHNTWTLEGEAGVVRLRDWAIAERRGADGRFEPEPDAIPNEKLRPITLRRQLDGVVRMARGEPHHLATFAEALDVQEVVESILTL

SEQ ID NO: 1384 - protein, 79 aa, Methylobacterium sp.
MSDMTTRGPRNPSRIIFVTVALFGIAVGFATASLAWFTLAILGSAALTCAGYGLIRRRLGWKPLSGEYLFNLLHVLSPH

SEQ ID NO: 1385 - protein, 536 aa, Methylobacterium sp.
MEFQMRPLTVVPVVPRTAMIAVIRPGAARAIPIAAGLLLCTALATPVQAQLLRGALDTTANGILGTGLTVGTSSPGSGVLGTGLNVGTTNGGLLGTGVTVGTTNPGTGVLGTGVNVGTTTGGSVLGTGVTVGTTAPGTGVLGTGLNVGTTGGGVLGTGVLVGTTGPGDGLLGTGLTLGTAGGTGTGGCGTCGGTGGGGTGGGGTGGGTGGGSNQGIYIITGNVTQSQGQTVINELRLSQLTSVMGVAANNTSNQAAPIAVGSDALAVGYGSSAAGTASTAVGTGASAANTGSVALGYAASAQGLGGTAIGTASAASGAGSTALGFVAGATGTGSTAIGAAASAAGNNSVALGNGAAANQANTIAIGANVKTTQANQVAIGNSANTYRLAGIASQASAAAQSGATAFVTTDANGNLAASAYGPSTIAGLGNRIDSVQAQVNNLEAKTDSVQRYAIQTRKEARQGVAMAIAMATAPMPSAPGKTTWATNGATYRGEWAGGLAVAHRLPTCCVPIAVTAGVAYGGDNAVGVRAGLAGEF

SEQ ID NO: 1386 - protein, 406 aa, Methylobacterium sp.
MTDVTVSKSVSPGHDIVPAASGAAGARRGRLPMVPLRAYGLVVALAVITLFFEVATGGVLFQPLNLTNLILQNSYVVVMALGMLLVIVAGHIDLSVGSVVGFVGALAALLMVRFHVDPYSAALLCLAVGAVIGGLQGYFVAYLAIPSFIVTLSGMMVFRGLTQVLLQGTSIGPFPEVFQLLAKGFLVNVAGPWTAVLIALALVATQIGLSWRRRARLRNGSPAETPAAFIARNGVTALLILAFAWQMSAYRGLPNVLLVLLALVALYGFVTTRTTIGRRIYALGGNIKAARLSGIKTERLTFLTFANMGALAGLAGMIFVARLNTANPKAGVGMELDVIAACFIGGASAAGGIGKVSGVVIGAFIIGIMNNGMSILGIGVDWQQVIKGVVLLAAVCLDVHNKNNRL

SEQ ID NO: 1387 - protein, 357 aa, Methylobacterium sp.
MIARQTVLKYILGLSLFGASAATPAQAAGGDPIGVAMPTKSSQRWIDDGNNIVRLLKAKGYKPDLQYADDDIPTQLAQIENMLTTGVKILVIASIDGTTLSDVLSKASERGVRVIAYDRLIRGTPNVDYYATFDNYKVGVQQATSIVDALGLKDGKGPFNIELFGGSPDDNNAYFFYDGALSVLKPYLDAKRLVVRSGQFGMDKVSTLRWDAATAQARMDNLLSAYYGNAHLDAVLSPYDGISTAILSSVKSVGYGSGGVKLPVISGQDAELQSVKSIIAGEQTATIFKDTRDLAKVTVAMIDAIEAGRQPEVNDVKTYDNGKKIVPSYLLTPVIVTRANWKPALIDTGYYTLDQLK

SEQ ID NO: 1388 - protein, 260 aa, Methylobacterium sp.
MRRLLLLFLALVGLAAAPAMAADKIKVGIMGGDAEVLWAKAKEIAARDGLAINLVVFSDYLLPNEALQSGDLDANAFQHKPFLANQIKARGYKIVPVGETIVTPIGLYSKRVKAVGDLKDGAQIGIPNDPSNGGRALLLLQAEKLIRLKDGVGLLPTVFDVVDNPKRLKFQEVDAAQLPRSLEDLDAAVINTNYAVDAGLIPGKDSIAIESKVDNPYNNVIVVREADTGKPWVPKLVRAFQNDAIRQILKEQFPGQFPAF

SEQ ID NO: 1389 - protein, 84 aa, Methylobacterium sp.
MDDWKAGLRAEMRAIDIATGEAASAQLPDLLRRLSRHQAGLGGNPVLSLYRRWRIRRLARAVADARWHAEQGRLARRGGLDPRP

SEQ ID NO: 1390 - protein, 449 aa, Methylobacterium sp.
MDAGDVGKRGAAGAPWHAGLTRRHWRILWGSYLGWIFDGYEAVALVYALRPALASILTPEQAQAPAFYVGLAIGITLLGWGIGGLMGGIAADYIGRKRMMMVSILGYALFTGLTAFAESFTQLAVLRFITGLAIGSEWSTGIALVAETWPNRARPKGCGFLQSGFGGGAVLAAIVWAVLAATEPLGAESWRILFALGALPAFVCLYLRRALEESEQWMRALKAQRWAATAEDADRAPRSARRPFSLTEIFREPESRRRVLLATLLSFATTVGWWAVSSWLPAYTEGLAKAAGAPANVWGPRMGIVYNIGAITAYVISGFVADAIGRRAFLLVTYAGCIATSLACYLWTGGLVPFMALAFLNGFFTLGFAFSWMAIYLAELFTPAVRATASSAVFNGARLIAWIFPILAGQIVTAFGGVAAAALTLSSVYVIGLVVPWFMPETRGRPLPE

SEQ ID NO: 1391 - protein, 346 aa, Methylobacterium sp.
MVRTSRTGSLLPGRRRLLRAGSVLLLAGLALATPARADDAKVRISRQPGFVYLPAVLAEQHKLIEKHAKAAGLGDVTVEWVNLTSGAAGNDALLSGNIDIVDSGSTNMLLLNDRTKGDVKGLCGVGTTPMMLLTRNPDVKELKDFSSKDKIALPSVKVSSQAVLLQIAAKKAFGPENATKLDPLTVQLGHPDAVAALASPHNEVNSHFSLPPFQQRELQDPAIHKVLNSYEMVGEPVSNAIFYARTGWYNRNPKLAAAIVAAIDEANAEIARDPLKAAKDYVAATNEKTPPETLVEIMKEPGTNFSTTPYGIMLQARHFYAMKTIKTEPKDWKDTFFPIVHNLPGR

SEQ ID NO: 1392 - protein, 147 aa, Methylobacterium sp.
MEAYALCARAMPSVTEWQAAIDEIGFDLKLDAVRMPPATQGHLSATWRRREAGFECQIIPLSDLTDTYIDIDFGRPWTCVYAFYFATLPACAGAWMAVAACAARSDGIVFDPQEGHLLTAEDAIRYARDTVARIVSLDAQFETSADD

SEQ ID NO: 1393 - protein, 113 aa, Methylobacterium sp.
VAAALAWAVFGTWAEARRSSLQKDIPALRPGIEADLAARNCPAVRIDTERFRQFSRENHLNHADFFTKKRSVALQHGLDAELAQLRERPEEACAQMWTKYGDDGTVQHLLVRK

SEQ ID NO: 1394 - protein, 72 aa, Methylobacterium sp.
LTHAHDREDAHLGEGDDPVLDAVAVLRCRGYTVEPDDDCARWRIDGADWITLSDLFARALRLGLRDGPGRAQ

SEQ ID NO: 1395 - protein, 413 aa, Methylobacterium sp.
MTPSIEPRGDAPCDLRLHDAALAEGSRVTIDIRGDRVAALRDPGAPLPPAGRTIDLGGALLLPGLSDGHIHLDKCLLGLPWRPHATAGSVRAIIEDEKAFRRATRIPLAEQGAEALLERMLRGGTTSLRTHVDVDDVTRLDHLAQILDLRARWADRLQIQIVAFPQSGILGCPPVADDLDAALRMGADLVGGLDPVGIDGDRDGHLDIVFALAERHGRGIDIHLHEGGAAGLVTIAAIAARTEAAGLGGQVTISHAFALAEADDLELGRIAEALNRAGVAILSSVPGGARCPPIPRLRALGVPVCLGTDNVRDCWNPATVTSMIARAQLAAYRFDLRTDADLAALLLPITAVPARVLGLGPGAVAPGARADLIAFAAGGVPQVIVERQEPVLVVARGAVAVDRRGAAAGAPLP

SEQ ID NO: 1396 - protein, 304 aa, Methylobacterium sp.
MNRRFFCRTLLAGGVTLALPVRGRAAGTTVAADDGVAAVDTHAHVFTRSLTLTGDRRYAPDYDASIADYRAMLDRNGMARGVLIQPSFLGTDNGYMVSALRSAPERLRGIAVLAPEAETATLRDLAGQGVVGLRLNLIGRPDPDFASPVWRAHLARVADLGWQIEVQAEARRLAQLLPPLIAAGVPVVVDHFGRIDPALGIADPGFADLLGFGRGGRVWVKLSGAYRIGSGEAGRQTAVQAAERLRGAFGARRLLWGSDWPHTQFETKASPAEARRDLDAWVPDPAERRIVLAETPAELFRFDR

SEQ ID NO: 1397 - protein, 317 aa, Methylobacterium sp.
LADSAHTADRSIPPCPITGAPALRCVERLDAGFLTLLWHYSGRVDVGPLLRPAGTFRLWESPTGLIFFDPPVAGDAAFYRAFYGRIAAHDKLAGPETERLEFRQAAAHVPSGARVLDVGCGHGGFRAYVPDATYTGLDPNFSAEDPTGAILDETVEAHAARVGPVYDVACAFQVIEHVADPLGFAQALAACVKPGGVVLIGTPLWPSPNTTIPNFVINAPPHHLTWWTPRALEALAGTLGCTPEAVHAIGMDRHDSLIHWMAKVSPVRCRDRFFRRTWSWAAALAFAYGVGAVLDRVLPVPKRTRPNALLLAARKAA

SEQ ID NO: 1398 - protein, 143 aa, Methylobacterium sp.
MSSSPKPKSATETDRSIGGRIAALRVAQGLSQTDLGQAIGVSFQQVQKYEKGRNRIGAGRLQAIADLLRVPVDTFFADPRDNGGGRVGPAALFEDPKVMELVLAFTSITDETTRGGILSIVKAAAALQESGAAAPRPDAVDEA

SEQ ID NO: 1399 - protein, 258 aa, Methylobacterium sp.
MTATGDQRARYPSLAGKRVLVTGGASGIGEGLVEAFVGQGARVLFCDIADDAARAVVARLAPGAAHAPLYRRCDLTDIEAVRALVAEADTVLGGLDVLINNAGNDDRHALADVTPAYWDDRMAVNLRHLFFAAQAAVPPMRRAGGGVILNFGSISWHLGLTEMPLYQTAKAAIEGMTRALARDLGRDNIRVAAIVPGNVQTPRQERWYSAEGEAEIVAAQCLDGRIQPADVAALVLFLASDDARMCTAHAYFIDAGWR

SEQ ID NO: 1400 - protein, 488 aa, Methylobacterium sp.
MQDEAPDATAEITLVKGARWVVAWDPDSGGHVYRTGADVAFADGALIHVGPGYAGPEPARTVDASGCMIMPGLVDIHTHLFSEPMNKGMWDEVGSQRLYNTSLYEYLPILRPDAEGTRAAYGVALAELALSGVTTVCDLALPSAGWLDLLGASGLRVCIAPMFRSGRWLTRNGHSVDYEWDAAAGLRGLEQALAEIAAAEGHPSGRLSGMLCPAQVDTCTAELLRDAHSEAVARDLRFQTHAAQSLSEFHEITRRTGMTPIEWLDDLGVLTERTIVGHGIFLDDHPWTHWHSPGSDLRRLAERGATVAHCPTVFARRGIALHHFGRYLQAGVNMGIGTDVYPHNMLDEMRLVSYLARVVAENPRDTRAADVFHAATVGGARALGREDIGRLEPGCKADFVLVDCGHPAMRPCRDPVQSLIYSAGDRAVRQVFVGGREIVRDGRALTIDYAAAAAALEEAQGRALAQVRQLDWAGRGPDAIAPPTFPGL

SEQ ID NO: 1401 - protein, 226 aa, Methylobacterium sp.
MRPRDTTEPARILIINPNASRAVTAAIDAALAPLRLPGGPILAVTDLPEGPESIATQRDADSVVMPLVRCVADDPSDAFVIACFSDPGLHAVREAASGRPVMGIAEWGILRALTLGERFGIVALSEGSVRRQRRTVRQMGLGDRYAGSRPVEARASETADAAMGPRLIAAGRTLVERDGADVVVLGCAGMARHRAAAEAAIGCPVIEPCQQAAAAALGAVLLRAAP

SEQ ID NO: 1402 - protein, 291 aa, Methylobacterium sp.
MDPSEIARVRRFARAVTAEVGALDSSFLGRGRPLGAARVLNAIGAGRAEIGAIRAYLGLDSGLMSRLLRSLEEEGLVATAPHPADARRRGASLTEAGRREFAAYEALSDARAVALLERAPQVDALLHAMDRVALALGRDTIAIREADPTDAGARACLAAYYAELATRFAGGFDVALSCDPEAAAMVRPRGVFLLASADGLPVGCVGLKGGGGAVAEIKRLWIDPAARGLGLAKRLMREAEAAARDLGIGTLRLDTNSALPEALALYRRSGWVEIDRFNDDPYPDHFFEKAL

SEQ ID NO: 1403 - protein, 206 aa, Methylobacterium sp.
MLPETRIPTLTPGYATVPPGHLATIVTSLEMLRPPPPRPGRPFPPGLALEPLERTDPETYRNLFRAVGADWLWFSRLTLTDEALAAILADRDVEILALRRDGRNVGMLELDFRRPGTCELVFLGLTGDAVGTGIGRTLMNAAIGRAWARPIARFWVHTCTLDHPGALAFYRRSGFVPFAIHVEVAPDPRLDGTLPRDCAPHVPRLG

SEQ ID NO: 1404 - protein, 127 aa, Methylobacterium sp.
MSRRLITSGSPFERDYGYSRAVVDGDTVYLSGTTGYDYATMTMPDGAAAQAEACWRTIRSVLAEAGTGLAGILRATYYVTDRDDAEAVLAVCGRVLADVRPAATIVVVAGLLRPEMRVEIEVTARIG

SEQ ID NO: 1405 - protein, 549 aa, Methylobacterium sp.
MMSQIVLTGLLIAVIGVVGLRMYYQEMLSGRLQSLRTVTELFTTYAQSLETRVRSGALSREAAVAELAETAMAMRFDNGTNYVAIYAMDGTVLAVPDRRLVGSNQLETRVNGVRAAGTLIDRLKTSDTATLSYLYPRPGQEGLSPKTTLAVRFEPWDIMIAAGTYTDDIRTAFQALALAAIGLLLGVGALGVIGSVLIGRGITRPLDRLGRRMQALARGDGAEPIPGLERTDEIGQMARTVEVFRQALVAKAETDRAVAREAEAKVRHAQSLDALTRAFEARAGALMTGVSAAATEMQATAEAMARTASRTSTRATRVAGAAQETAGSVQSVAAATEEMAITIQEISGRMAQSSAKTAGAATEARRTDALVGELADGAERIGAVASMIAGIARQTNLLALNATIEAARAGEAGRGFAIVAGEVKALAEQTAAATEEIAARIGAVQASTRQAVEAIHGIGRSVGEVSTLAASVAAAIEQQGATTEEIVRIVARAAAGTEAVTGNIAEVSQGAEATGEAAEQVLGAAIDLSRRSDQLSAEIHRLLDGIRAA

SEQ ID NO: 1406 - protein, 278 aa, Methylobacterium sp.
MSDAVTGPAAIAGESHEAPPRDKERLRAGVLVLLVQIALLAALLSAWEWQTRLNPQASFLFGSPSAIGRFLWQGLADGTLLRDAGVTALETGLGFLIGNVVGTLAGLSLWYSTFVSRVVQPFIVAIGSIPIIALAPIIIIWFGTGLASKVAMSTLSVVVVALVTSYKGALGVDPDQINLLRTLGARKPQIFAKLVVPSSLADIFAGLKLTVGFALIGAIVGEFMSSSVGLGHAIFQAGSLYAIPKVFAALVGTIALALVLTFLVGRAERILMPWRDHL

SEQ ID NO: 1407 - protein, 286 aa, Methylobacterium sp.
MSEGPPHAATHPAPPLAVEHLAKAYRTGGRLLPVVGDLTFALARGEIVAIVGPSGCGKTTLLNAVCGLTPVDSGRILWNGVPLDRRGRPPSGIGYMLQKDLLLPWRTALDNVKLGTELRGMPRGQADERARALLDQLGLHGFAGAYPATLSGGMRQRVALARTLINDPDVLLFDEPFAALDFQTKLLIEADTVRLVREGAKSALLITHDIEEAVSIADRVLVLSGRPTAVKASYTIDLDCAPDDMIGARESAGFGDYVRQIWADLDIPRSTLGGAGRGIRRAAARS

SEQ ID NO: 1408 - protein, 317 aa, Methylobacterium sp.
MAGLAVGAPLVARAAGLKTVRFSEAVHNLGYINLYVGIHAGIFEKNGLAMQVSAAGGDTQTFAAVLGGSADFAIGDPTMVVISRENGGPGMVVGTVVQRAHYFAVSKTVEPFTDPKGFKGKRIATSPEPNTNFSVTKRLLESNGMKLGADATIVPVSPGTEIAAMLAGAADIAVAYQPGVAQAVAQGARIVFDFSNYVGPFCNTGIMVLPGTIQKDPETVQALVTAFEEAGRRTYGDPDYAKKVARLEFPDLPGEVVDAAIEAELKYKIPASTVVTEKDAWESLMGMQKYLGNIKGTLTFDQVVDNTFADKAAKRAG

SEQ ID NO: 1409 - protein, 499 aa, Methylobacterium sp.
VLLLEAGRDWRSADAPPALRSANIIPFMYDLAHQADWQWPGLMSRRTRVQEPRFYWRGRALGGSSTVNAQIAIRGVPAAFDAWAEQGCTGWSASDVLPLFDRIEDDADFGTEDGARRGGPLPVHRAKPEAWGAVDLGLRAAALAAGHPWKADLNAPTGEGVSCNPINSRDSHRVTTNDGYLEPARDRPNLEIRCEALVDRVLFAGRRATGLRVRFGAEPWTEIQGREIVLCAGAVHSPAILMRSGIGPAEPLRALGIPVRQAHEAVGRNFMDHPILRATMDLKPEHRALGPDARHTNCCVTYSSGLSGGGERDMIFVAYNHRTLTGPEPTPQGAVGVGLYDAFSRGTLHLTAADPEANPVIDENMLDDPRDRLRMRDAVRRLAGLAAHPALADLATAIRFGESPLPIGDAARLPDDELDALMLAEAGDIQHAAGTCRMTGWQDASGVVDPDLKVRGMDGLRVCDASIMPSDCRANLHFTCVMIGENLARRMLTGGSRHP

SEQ ID NO: 1410 - protein, 137 aa, Methylobacterium sp.
MATVKLWSDADAEADPRVRAVFADIRATRGSDFVNNFWRGLANDPALLERTWSTLKTVMGPGTLDPLTKELVYIAVSIANGCPYCIHSHTAAARAKGLTEAQHGEFLAVVGMANQTNALVNGMQVPVDPAFRVEEGP

SEQ ID NO: 1411 - protein, 227 aa, Methylobacterium sp.
VGARVQRSLRSRTVTWMTVGFATILVMTAIALGAFVYQQRGVDAVRHTVAVDGRLARVLSAVQDAETGQRGYLLTGDEAFLLPFTEGRLNVDQQLDLLRDLVQDDPDQRGDLDTLAGLIRRKLDELGASVALMRAGDGAAARASVADGRGKQVMDAIRDRVRRMEAHEARRMERRQATVSRIALAIWVMVGALAVLFVLFAVSALREATRRNRLSRFLPQELVLRQE

SEQ ID NO: 1412 - protein, 166 aa, Methylobacterium sp.
MKDRWLRLRADDCVTPSGHIVDPYYVLETPDIALVLGIDAADHVILVRQYRHAYGGPSLELPGGAIDPADPDILAAAEREMREETGYIFADAERVVTLNADPARYANRMHLVRARVTAAGPAQPDPAEDIAVVRVPRAEALQLAQSGAIVGAVHAAMLLIGLSSTG

SEQ ID NO: 1413 - protein, 200 aa, Methylobacterium sp.
MTTDHTANPWLTLSSETYHEDKYLRLDVDQVRHQSGVEHPYTAVRFKVFGLTVLPIDDAGRTFLVGQYRYLLDRYLWELPRGGGAVDVPPIETAKRELAEETGHSAAHWFELPKLTASPEITSEWAPCYIAWGLCPISAEADPQESLSIRRLPFGEAVNAVLAGEVVDAASVALLLGTAERARRGQLPQDLTALLGTGGL

SEQ ID NO: 1414 - protein, 252 aa, Methylobacterium sp.
MDAMDRENGTTRLGMLTPSSNSVLEPATAHLLAGVAGVSAHFARFRVTEIGLSAAALDQFDPEPILAAAELLADARVAAILWNGTSGAWLGFDADERLSAAITDRTGCPASTAALAFRDLFRARDFRRIGLVTPYTGDVQRRIQANWGAAGFDCAAERHLGLSENFAFAETGPEAIAGMVRAVAAEGVDAVAIVCTNLAGAALAPTLEAELGVPVIDSVAVTLWKGLELAGCPTAHLAAHGRAFAAGGAGRP

SEQ ID NO: 1415 - protein, 327 aa, Methylobacterium sp.
MAGPIGRRADAPGTAGIDDPLSGLAPLLRVRPHLDDVCRFGGAWAAPHAPEPTRQAYFHLVTRGRATLRRPGGAPLQVAAGDILLLPRGDAHLFHGAGSPPSTPLPVAVRHAHDLRFKTTVGAEPDVELICGRLAFEAAPQTLIVTALPDLLVLSVGAEPLATRFAPLLAGIRAELNDLRAGSVAVAENLASALFMMMLRAHLEASAPAEGLLRLLGQPLTARAVLAMVRDPVHPWTLDELAATAAASRASLVRAFRVAAGVAPLEFLTDLRLGLAHHRLRTETVPLDRLAAEVGYQSAPALSRAFLRKYGIRPGQARQAEAPPQAV

SEQ ID NO: 1416 - protein, 186 aa, Methylobacterium sp.
MSDVALLVIDVQESFRHRPFWNDADVPPFTARLQALIDGAAARRIPVLQVFHVAESGPFAIASGHVRTLEPVVIAPTATFHKRRHSALVDSGLSGWLTQHGIRRLIVSGIRTEQCCETTARHASDRGWQVDYVTEATLTFAMTHPDGRRFGADEIKARTELVLTDRFARIATVDQALAGPDLPVAA

SEQ ID NO: 1417 - protein, 312 aa, Methylobacterium sp.
VWIPSPRYPDPAVEILDAAFARYRVFNAAVERLATGFRWCEGPVWFGDGRYLLWSDIPNDRILRWDEESGAVGLYRRPSGFANGNTRDRQGRLVTCEHGGRRVTRTEHDGAITVLADAFEGCRLNSPNDVVTAADGAVWFTDPPFGIGGFYEGVRAEPELPQNVYRLDPVTGALQAVATDLAGPNGLCFSPDGRVLYLVESRGQPTRRIVAYDVVAGRTLRDRRVLIDAGPGTPDGLRCDVDGNLWCGWGMGDDALDGVMVFNPDGRPIGRIRLPERCANLCFGGRHRNRLFMAASQSLYAVYVDVQGCAGG

SEQ ID NO: 1418 - protein, 279 aa, Methylobacterium sp.
MKQTMPQTLGLNRILGGAIGVIALVSVLTSGAVLITADQLRDATDARSRSNQLIRALDGFRAAMLNQETGLRGYLITGRDGSLEPYRTGRQTLDEAIDRLRTLIGHDPERTRLLADAVAAARSWQTEVGEVVVRIAADPAKREEAVKIEADGQGKRLFDTFREKLAAIEGLEGAVRAALAERVARSERNESLALWGGTLITLLICLGIGVAINRLVVRPLVGVMGFVGRVGEGDLSSTLDVRAGGEVGRLSTTLNTMVSGLSDLARTNRAATADLNAAA

SEQ ID NO: 1419 - protein, 118 aa, Methylobacterium sp.
MSATTPGRQSLGFGDDLDAFDPAEFALVKPKAPKPEPEISRKAAEAVGFRSREAQKAEPAPAKIQQRRRRTGRNAQLNLKAKPETIAAFTRIADAKGWGLGEAFEHATALLEREYATK

SEQ ID NO: 1420 - protein, 149 aa, Methylobacterium sp.
VYVDCATCKRSGRYTVASLIGRYGADISTLDLLRHLTASCRYQRAPGAPPARKYEHLCLAAITLPPALKQIPPVPPGTPYTIEVWDRIGGKLELHLATIYPLTVAIAAFEAACLEWPTNEVTLRDRARIVRKRELPPRSTTASASGEPR

SEQ ID NO: 1421 - protein, 346 aa, Methylobacterium sp.
MRPKPILQLRGESPGHRQADDWRDAVAPFWDFTIRREDLPDFRGQSRVRHLGTAIVCSARASGLRFVRARALTARMGVDHIVAHMRVSGQSRVTIGGRERDCAPGDICLFDLSQPLSAASTDYEAITVVLPRPLFGSRQSGLDALHGSVIRGATPFGRMLSDHLHSLSAHATGFSEPEAAAAAEATAALLGAATLGLPEDGGGTQPPERAPLLVAIRRFIEAELASADLSAETIGRRFGVSRSALYRLFVPLGGVSGYVRQRRLARAYRDLAAGDGRFARISEVAYRWRFESPAHFTQAFRAEFGCAPRDVRGRAAAEADRSPASEPPAQAETWADFYQWVLKLAA

SEQ ID NO: 1422 - protein, 342 aa, Methylobacterium sp.
MISIGIVGYGYWGPNLARCTSESERCQLVAIADQSPAALGRAGKRYPAVQLHQDWRDLVADPAIDAVMVATPVSSHFEIAINALRAGKHVFIEKPITPSAFEARLLIEEAAKRNLRLMVDHTFVYTGAVEKIHELITTDAIGDVFYYDSTRVNLGLFQRDVNVIWDLAVHDLAILDHILDLAPVAISASGTGHFSGRPENMAHLTVFYPRGVVAQINVNWLAPVKVRQTLIGGSKKMIVYNDLDPIEKVKVYDRGVTVGGGSDDITELMVSYRTGDMWSPHLSFREALIVEIEHFADSIENGTAPMTDGHSGLRVVEMLEAAMRSLRQNGTPIDLMPLARAS

SEQ ID NO: 1423 - protein, 52 aa, Methylobacterium sp.
VNEVCHSLSLSRTTVYELLAKKRLRSIKIGVKTLIPADSLRSLMASLEMEAA

SEQ ID NO: 1424 - protein, 308 aa, Methylobacterium sp.
MDLNLRQVRAFVSVVQVGSFTRAAALLNLSQPALTVQIQRLEEMLDARLLDRTSRTVAPTRLGRELLPVFERVLRDLDAVVVDARDLAARRHGVVRVATLPSFAASVLSDAIVRFRAEHPAVTFLIKDVIAQRVLDLVREEEADLGIVGGDVRDPEIGVLHRTRDALHVIYPADHPIGALPRVTIAALAEHPLILMDPATSVRAVVDRAFVGSGRLPRVACEATYMMTAVSMVRAGLGLTILPGAAREIRAEPLLRSRPIDDPLFERPVCLIKKAGRTMPPAAEAFCRMVADRLADPGGTSAGAAPSL

SEQ ID NO: 1425 - protein, 276 aa, Methylobacterium sp.
AEAEIVAWLRGAVRPGHIVATVCEGALLAARAGLLDGYTCTTHHASCDRLRAAAPGARVLDNRLFVQDRDRFSSAGVTAGIDLMLHLVAEWAGPATAVAVARTLVVYMRRGPEDPQLSPWLEGRSHLHPAVHRAQDAIAADPARDWSPALLGRVVGASPRNLARLFRLHAGMTVTDAVNRSRVALARDLIAQSDLGLEQVAERAGFGSARHMRRVWRQFHAAAPSRLRAGPADGASAPVRPRPPRDTRPCERSEAIQGSAPLSGVARPWVTSLRSR

SEQ ID NO: 1426 - protein, 316 aa, Methylobacterium sp.
LPLALAGWPRAVLAQGQAHVAALWPFAEGDFEGRVLAESFHAGLRDHGHPDQRVDDRWTGADRERTRLLATELVAAQPQVIFAYLSAQLTAVAALTKQIPIVFVGASNPVRFGYVESLQRPGGNITGFTLYEAPLGGKWVAALKEAVPSLRHVTLLSNPSTEIRGENLYAGPFRATAAALGIEPQVVKIDKAAEIEPVIAALARRGDGGLIVAPGTFSEANGDQIVALTTSLRVPAVFAIRRFAYRGGLMSYGPDPVETVRRAAAYVGRILRGENPATLPVQAPTKFDFIVNLKTARSMGVTISSALLAQADEIVE

SEQ ID NO: 1427 - protein, 212 aa, Methylobacterium sp.
LKAGRRQHAAIVFVDMRGSTTLAESLDPHRLSEFLSAFRRRVTRLARLRGGVVDKFIGDGALVVFGLPEPRPDDAARALAFAQDLVAVIARWTDRAGPAQAVRIGVGVHYGEVFCGIIGEEARYEFTVLGDAVNVAARLEQATKLHGVPILVSEAARRAAGAPAEAWREVSREPLRGRREGMAYHTPAASGAAGPGPRREEDIGLSAVEPAL

SEQ ID NO: 1428 - protein, 304 aa, Methylobacterium sp.
METSPDDPRRPENRLAYRAAVDRPRLTLPGGKHVAVWPVVNVEHWLIDNPMPRQILVPPTAASLLPDIPNWAWHEYGMRVGFWRFLEAFVSRGIRPTLSINGSVCTAYPRVAEAAHAAGWEFMAHGFHQVPTHRVADQPAMIARTVAAITETTGRPPRGWLGPGLTETLDTPDHLRAAGLAYVGDFVVDDRPCRVATRTGDLVALPYSVELNDIPLLAIQHHRADEFVERALAHLDRLAAEAAGSGPLGGAKVMGFAIHPYITGVPHRIGLLERLLDAILARDDAVFMQGGEILDWYRATGDES

SEQ ID NO: 1429 - protein, 210 aa, Methylobacterium sp.
MHFDSGEISTLVWKAAAKLDVVSPRTGRRLHVTPRRLRHTLATNFAALGIPPFAIAEALDHSSLNTVMVYVDNIRVIQERIDHALAEYMAEVSGGFLGRLIPDEVAAGGSAADRIYADFGEGEVEAVGNCGLSSECNLAPPISCYKCRFFRPWLDASHERVLEMVEARAHRLREAGAIERLVELNVDAIRAIRNLMNEASALRKAGGGSI

SEQ ID NO: 1430 - protein, 152 aa, Methylobacterium sp.
VRSDLAGGRMSRQRKRDAVLWLLRGEDLESVSRGLGVTAATLSGRRDAFLAAGEASLSTRPLDAEALESGRLKAKLGEMLLEREVLETKVAALEARGPGPFWPAGGRSHEPDRLAGQRQRLGLARVCRIWRVSRGTPAVKAAVVLPMGCQAA

SEQ ID NO: 1431 - protein, 78 aa, Methylobacterium sp.
MDVMARFSGGIGPVRSSGIRAAALLVLPVLLLADAPARAQYAASCPPPKKFAAGACVTACPGGYEDRGPVCVYRNTSR

SEQ ID NO: 1432 - protein, 65 aa, Methylobacterium sp.
MVETFFKTLKSELVWRTAFQTRAEATIALARYIDGFYNPCRRHSALGFKSPTQFEKGIAHQTALH

SEQ ID NO: 1433 - protein, 142 aa, Methylobacterium sp.
VIRSAALLTRHAAGLPDRLARGLAALALLVLATAALVAAPARAEAARPEGPACAIASPRLTILSGTPDAQPEAKRSEAKRSVFGRTDLCAADSEILTELGLPRPPVDAPRPRHTVNASFDYRSDSVPASAPDGSPHRPPRRA

SEQ ID NO: 1434 - protein, 401 aa, Methylobacterium sp.
MPRLGVAAAAWIVLFLFAPVVGEQIKLPGVDKAIWIGSDLIAFAFLVMRRDLAATLFGSRLLLLSWPLLAIASALWSLTPGLSAYHGLQLLATIVAGITLRTTMGLSRLVRIVFLGLLAGQLLSAFLTVAAPALTRGTDGNWAGIYSHKNVLGSLSSLQILCAACLFLQGWNRLLTAFGFCLALALLVSTHSATALVAAAAGLLPLAAIFAWRQGKHVTGFCLGIAIALAGVGILVVAARGADISASVLSDLGKDTTLTGRTILWQFGLDQFWREPLIGIGYKAYWESPLTTAAYLHFVTKQKLWFFHNNFIDTAVAFGIVGLVLFTAALLDTARRVIAHFARSSGYVEAWPILFMSQLFVLVCFECPLFVNHGLHQLLLAAILPVVRSPTVDGSDPAARD

SEQ ID NO: 1435 - protein, 221 aa, Methylobacterium sp.
MPESALPSRPLAALLFDMDGTIISSIASAERIWSRWAEAHGLDAASFLPTIHGVQSVETIRRLNLPGVDPVAEAAAITEAEMADVDDIVAIPGARAFLEALPRHRWAIVTSAPRRLAERRLAAAGMPVPDLLVAAEDVARGKPAPDCFLLAAERLGVAAPDCLVFEDAPAGIRAAEAADAAVVVVTATHHEPVRTGHPTIADYTGLRVAAAPEGIRVTRTA

SEQ ID NO: 1436 - protein, 159 aa, Methylobacterium sp.
VALLFNIDPDSAEDSVPLSAIIDSVHVDDRERVLAVIRRSAQEGATYLNEYRVVSADGQTRWVLSRGRFTKDHAGRPVGGSGILVDITGMRIREGTFDDVESGQIAAPLERAADHAISAQQAIVDLQDPELKACADALLMALGRKLAEREVLERRKGMH

SEQ ID NO: 1437 - protein, 429 aa, Methylobacterium sp.
VAEPFPLAPSLWATTAAPAPDTPPLARSGLAEVVIVGGGFCGLSTALHLAERGIRPVVLEAQEVGYGGAGRNGGQVIPGLKYDPADLVARFGRERGERLARFAGGTADVVFDLIARHEMDVPHSRAGWIQGAHTEAGLAEVAKRAAQWADLGAPTRVLDRAETEQLLGTDRYLGGWLDGRGGAIQPLSYARGLARAAQKAGATIHGGSPVTGLERTGSGWTVTTAQGERVTTGRVVLCTNGYTGGLWPNLARTVIAANSFQVATVPLTDNLRRSILPEGHVSSDTRKLLLYFRLDHTGRLLMGGRGPFREPRDPADWAHLERIVGKLFPQLDGIAFDHRWCGRVAITRDYLPHLHEPAPGLLIDIGCQGRGVGLQSAMGRAMAAYIATGDAGNLPLPLTPIEPLPLHGLNRLYVSAIIAWYRLRDGGIR

SEQ ID NO: 1438 - protein, 243 aa, Methylobacterium sp.
MIVLEDVRKHYGALEVIKGVSAEVTKGEVVCIIGPSGSGKSTLLRCINGLEAYDGGEIRVDGQRVDRDKRGIKAIRTRVSMVFQRFNLFANRTALENVVEGPIHVKGEPRGEAEERARALLARVGLSGKEHARPNELSGGQQQRVAIARALAMRPEAILFDEPTSALDPELVGDVLKVMRALADEGMTMLVVTHEIGFAREVADRVLFLDGGRLVEQGPAAEVLNRPQNPRTRDFLQRVLHPL

SEQ ID NO: 1439 - protein, 230 aa, Methylobacterium sp.
VGSAAVGRPVLTFMREFLADAQDYLPILLQGVQLTILITIASLVVSTLLGLVWAVMRVSGIAILSGFSAVMINILRGIPIIVQLFYIYFVMPDFGLSLTAVQAAIIGLGIAYSAYQAENFRAGIEAVDRGQVEAALSIGMGWGMTMRRVILPQAIRIALPPYGNIMIMMLKDSSQASTITVAELALQGKLIASSTFKNTSVYTLVALMYLALSLPLILLVRHFEAKGRHR

SEQ ID NO: 1440 - protein, 253 aa, Methylobacterium sp.
LAKLCLSSALLLGVLGAPVGAQSLKVGSTPTGLPFTFLDTKTNSIQGVMVDLVNAVSKEAGFTVAVEPLQFSTLIPALTASKIDIIAAAMFITPQRKEVVSFSAPVYSYGEGLIVPKTDTKDYTSFADLKGETVGAQVGTAFVEPLKKSGLFNEVKIYDAIPDIIRDVNSGRLKAGFADAPILAYYVKQGLFPGVRLVETFKPTVVASVGLSVRKTDTELLAKIDKALAKLKADGTLQAILTKWGLPPSADRS

SEQ ID NO: 1441 - protein, 167 aa, Methylobacterium sp.
MRAGSTQAGPIGGPGKRSRRDGAAIWVVLALTYLVFAGSVSLNEGMAAVGCASLGTLWWWGVGRRGGLRFRFDREALRPLGPAIRDMPRQTARVGLHLLRAILGRACGGATRERSAAEIAWARPEGDAAPAARAVGLLAASLAPDSYVLTLDRAHGTVVTHGLEEAR

SEQ ID NO: 1442 - protein, 533 aa, Methylobacterium sp.
MMTRIKALLLGSSALMIPIGGAHAADLPTFKAAPVEFVRVCNAYGAGFFYIPGTDTCIRLSGRARYDFLYQTSKVRTGGGGDLTGYLGLMRLNLDSRTQTDYGTLRAFLRIDVANRSGPFLTSGSRQRESLAIAGLGADAFGRTQTYVNADKAFIQFAGLTAGRASSFFDFYAHDFELIGGTAGSDTFSTNLLAYSAILGNGITLTASMEDPTYRRFPIFGTGSAVGAFTAGGGFAGYSNAFNPFTPSTWLAPIVVGPGNVAFVDVTQKSRMPDFVGAARIDQAWGSAQLSAAVHEINAGDAGSTVAGITTATTGLGISPTGRASNAYGWAVQGGLKVNLPFIATGDTLYLQGAYGQGAIAYTGISNYTAPYDALGAAPVGGGSFAQYYADAVLNPATGRLELSTSFSAVASLLHYWSPAWRSAFFGSYAQIDYNSKGRNALGVLGFGFAPAGASTSNALAFATSPILRGNNQMITGASLIWTPVKDLDIGVEGEYIRTALNSGVTPDISKNALRYVNSQDAAQFRFRVQRDF

SEQ ID NO: 1443 - protein, 97 aa, Methylobacterium sp.
MKNIILACSMGAMLIAGPALAQDGGATIDPSLIVRTNGSGLDAWSASEGNDKAGGMWEGATGYSAAIQRPSAVETVPANRQWSHLNSRERRRGQPAY

SEQ ID NO: 1444 - protein, 461 aa, Methylobacterium sp.
VRLLEVRRTSGFRVACLFFATFGTASLALSGFLYVDTRSYGRKAAFEWVEWESKHLLNLSPRALRERIDASEDFAEGGRPLVLFGPDHVRRAGAPIAFPDKAPIGKPFILAQPLDHRSRTLFSQLTELPSGEYVLVSRSAQDLQSLEKALVETFVWGMAATIVIGLIGAVVFGAGSLRQNDAITKAVERIMRGDLSERLPTRGVSADLAHLTRVVNDMLDQLERLMLEIKGVNENIAHDLRTPLTRVVGTLERSLRKADSVVAFRAFNEDVLAEVKSIVVRFSALLRISEMEDRLRRSGFTQVDLGRLLEDAVEYYEPLAIERDIRLLWDRPDGLCTIEGDRSLIFEAVSNLIDNALKFTPGGGRVTVALLRNPTGIQVTDTGCGIPAEELSAVRARYRRGALKTDKSGFGIGLSLVDSIARLHSATFDIASDGSGCRVTLSWIHSVSGHSSIDLLPAASL

SEQ ID NO: 1445 - protein, 222 aa, Methylobacterium sp.
LVVEDDRRVAAEIGSALAEYGFQVDEAPSGSIGLRKALDGNFDVIVLDRMLPEIDGLSLLTELRAAKVSTPVLILSALSAVNERVDGLRAGGDDYLAKPFEFIELTARVDALARRKMAAEAVNELVVGDLRLDLIERVLHCGDREIELLPKEFAIIEFLMQNAGTLVSRKMIFESVWGYSFNHQSSVIDVHIGKIRKKLDPDGLNPRIHTVRNTGFILRAPS

SEQ ID NO: 1446 - protein, 461 aa, Methylobacterium sp.
MTRFNDAPGSGAEAAARAHQHAAEIDPLRQDGAGEALVHAVPPPPRKRPFLVAFLALGSALGLGAWHHWETYQASLETQTEAVNFVPTVRTGPAQVDDGPMTLTLPGQTEAFDHADIFARATGYIAERRVDIGSRVKKGDLLVRIAAPDLDQQARQAEAQLGQFKAQLAVAQADVEQAKASVTLANVTDARTATLAGQGWASKQNADQTRAGMLTATATLAAAQAKVKVAEANITAQQVTVDRLRTLTTFENVVAPFDGIVTARRVDVGDLVHGDAGSGTPLFTVDSTDVLRVAVQVPQSAAVGIRDGVKARVQVAQIPDRIFAGTVSRSSVALQSSVRTLDTEVDVANPDGVLRPGLYVAVTFAVPRTHPRVTVPSEALIFDADGTRVAVVGADDTVRLRPITIARDLGTRLELRSGLDSGETVVLNPPAGLQDGSRVAPRGSVASQVPTAKLSEQASAE

SEQ ID NO: 1447 - protein, 309 aa, Methylobacterium sp.
MAFANGSERRVAYVAETNFGVIPATPAFKLLRITGGTLRTNKGTVVSDEIRADRNVADELMVSQDVSGSYDFELSGDTFDDMLAAALRGAWATNVLKNGVLRPSFTIEETINFGGSNSFSRFAGVMVSKLALNLSSRQKVTGSFDLMGAQETLDSAIITGATYAAASTTQPATASANVGALTVGGTTTPFRVKQLQLSVDNELRVRDQVGSLYSNEFGAGRSNVTGTVDCYFEGNDQFQAVLAHGSGAISFTVGVEANKKYTMLIPKARFLDGARNAGGNTDDVMISLPFRGVYDATTGASLQITRSVA

SEQ ID NO: 1448 - protein, 404 aa, Methylobacterium sp.
MASIRSCVLSVAIGFAALAGPALAEPIRVKVGVLNDMSGVYADTGGKGSVVAAQMAVEDFAKTEPGVQVEIVSADHQNKPDIGAAVARQWYDRDGVDAILDVPTSSVALAVSQVTREKNKVFIDSGAGTTELTGKQCSPNTIQWTYDTYALAHGTAGAMLKRGGDTWYFLTADYAFGLSLQNEAKAVIDTGGGRVLGAARVPFPATDFSSFLLQAQASGAKVVGLANAGGDTVNAVKQAHEFGLTDGGQKLAALLIYAVDVHAIGLQTAQGLVLTESFYWDLNPETRAFSERFYPRNGNSMPTMNHAGVYAGLLHYLKAVAATKSTDPQKTMAWMKANPTDDPLFGKGVVRADGRKIHPMYLFEVKAPSESKGPWDLYKVLETIPAEQAFRPLSEGGCPLVAKP

SEQ ID NO: 1449 - protein, 206 aa, Methylobacterium sp.
VGVGVRTKRRGGSSVARALAVSDVGTWTWHIADDVLRCDPVAATMLGLPRSKSGSGTTFGSFLDRIHPEDQRRIASTLDDLRRQGGLYIAQYRTVPEPGEVRWILARGRFILDAQGGVSEAHGIVIDVTECGRDGFLDESAFCATDVAAGGIDRVAEMALALYNAAEDGLPQPGFERLKPLLDVLLHEIGRQLVLAPAVPDLDRVH

SEQ ID NO: 1450 - protein, 134 aa, Methylobacterium sp.
MLISEHHVRECAYYIWENEGRIHGHAAAHWIRAESELRANAMLAAAASETVEAAAKAAPVKTAAKPVAKTTATKAATKTAAAKPAASKTAAAKPAAVKAAAKPAAPKPARASKAAVTAGLAAKAKPARTPASMH

SEQ ID NO: 1451 - protein, 147 aa, Methylobacterium sp.
VTNLERFYRSVHGRDLQPWERQLAVRIAAALNTTTDDDFVVHLLLVYMSTNAITNMYNELVAARNGLAEHNRDLIGALTADLRRNRLITYVLLGAAALGMLVGAGILGTVLNLAQGSAASAARLAAALESCESRGPAGAQRGLGIGR

SEQ ID NO: 1452 - protein, 277 aa, Methylobacterium sp.
MTDTTQSKVPAWYSPDEIQDIQRDLLGAAAKVLVLCLGGKGGVGKTTIALQVADLCAEVGPVLAIDTDPANRHFHTALMQETTPGSDNFVPRRPGITAIRQRLRAEDSTGRVDPTLCQDLIERVTEAAERLVVVDFPAGDTETTRRCTEIIVESCREANVRLAVVVAAGAVDPTALEVLRELRPMLIECDRAILAKNTAQAANFDYLESSDLVRSLRKQSNFRVIEIERIGERLIEALRVQNTTWQALANSAPMRLRVEGRRLRRNFHTAWRDALRP

SEQ ID NO: 1453 - protein, 107 aa, Methylobacterium sp.
VTESLPAAFAATLTGSEPPSVWDAPLAALWWLARDAAGPASAAWERAHRLVQDADGSDAAWVHAHLHRIEGDDGNARYWYARAGRPVPDGTLAEERAALVLALWPRS

SEQ ID NO: 1454 - protein, 144 aa, Methylobacterium sp.
MTASSDARARFARLCGGLALAATLLSPAPASAADPCEGTTQADLNACAAADYRAADTALNTVYGQLMKKIGPKTKDALRGAQKAWLSYRDATCFLETMGLDGGSAHAMEYNGCLKGLTDARIKVLKGYLDCKADDVSCVGRLGE

SEQ ID NO: 1455 - protein, 231 aa, Methylobacterium sp.
MAEPIVFVGDSITELWGFHRAGTFEAYDLIPRGGSGQTARWITMRFARDLAETGARGVHLLCGVNDIGRNEGVFVPVEEICRTLAGMLDEARAMGVKAWIGSLTPVDGIPWNPEVRDAPAMIAAVNAWLRDHAHEHGATFIDYHAVLATETGGLRPDYGTDGLHLSPAGYAAIEPLMLRALGRIPDAPPAPAQPVKNAPAKATRSVRTRLIGVAVAAAFLAAIAALVLELR

SEQ ID NO: 1456 - protein, 353 aa, Methylobacterium sp.
MRILHLLNHTRRLNGHVHAAVDLACQQAQAGHRVAIASQGGDFDALLRSNGVEPIFASHARTPARILTSFFGCGGVLRRWRPDVVHAHMMTSAVLAWPTCKLMRVPLVTTVHNEFEKGALLMGLGTRVIAVSGAVAASMRKRGIAASRIDVVLNGTIGSARMRGRSEEPQNLDHPAIVFVGGLHPRKGLPDLLQAFDKAFPHNRAMRLYVVGGGPHRDAYEQTARTLACADAITFAGPRDDPYRWMLGADIFVLPSHADPAPLVLSEAREAGCAIVGTDVDGIPELLDGGRAGVLVPANDPDKLAQALIALTSDPGELSAWRAKSQINLDHLRIARVADETLTVYRRAAGLAG

SEQ ID NO: 1457 - protein, 541 aa, Methylobacterium sp.
MQTLRGADIVARTLEALGVTRIFTLSGNHIMPVFDALLETGISLVHTRQEAACVHMADAWGRLTGEVGVALVTGGQGHTNGAAALTTALAAESPVLLLSGHAGLSELGRGAFQELAQADIARPMTKAAWTAGSVAALGPDLARAFRIAREGRPGPVHLSLPVDLLETAVPAASVRIPDRAAAAIRAAEPAPDLVADLLAALAGAERPLIACGPALCDASGRAAMATLEETLGLPVVGMESPRGVNDPALGAFAEVLARTDLLVLLGKPLDFTLRFGAAPALAPDCRFALVDPDPALLARAPADRLAVSGLADPRPVLAALTARATALPRREAWHREARAALAYRPPAWADFHGTGQRLHPVELCRAVDAFLERRPDGTLICDGGEIGQWPQALVRAGRRLINGVSGTIGASIPFAIAAALERPGAPVVAVLGDGTFGFHMAEFDTAVRYRIPFIAVVGNDARWNAEHQIQLRSYGPERTRHCDLLPTRYDTVVQALGGFGALVTEAAELPAALEAAQASGLPACVNVMIESVPAPVIRRPG

SEQ ID NO: 1458 - protein, 387 aa, Methylobacterium sp.
MRTTRRVFLTGAASAVAGGLAPGVIRSACAQGAGSTVRIGMVLPVTGPGADAGRYALAGARIALETVNKAGGVLGKPLEIVTEDDQTTNPGAVFAFSKLASQGDLVGFLGSIRSTQNHAMAPDILKTGKPVCFGGTDPVLTQLGNPWLFRFRPNDNFSARVIAEHGVNGLGKKKWAIIHSTDAFGTSGAKALTESLAKGGATVALDQGYTNQSQDFTPVVLAIRQSGADVIGSYFTFENDIGIFARQLRQLGVTAPWVGSPSITNVTALKLAGPSLYGTYGVADYAEESGDAARAYGKAYRAAMKIAPDNQSSWTFDAVTVLAKAINAAGKTDPQAVREAILAVRGHEGAEGTYNFDKNGDGLHGYNVVRNDKGNIVFDRRIDFYQG

SEQ ID NO: 1459 - protein, 291 aa, Methylobacterium sp.
MDLILQLLFTGIGIGSVYALVALGFVLIFRATNVVNFAQGEFSMVAAFLMVVFAVDLQWPYWLSLLLTLGGMALLGALFNLGVYYPLRHRSYLPVIISTIGASIFLANTTLALYGPQPQVLPPVFETQGFLLGPVFLDSQYLLIIAVTAALVAFQYWFFEHTLVGKKLQATSQDKEMAALLGIPVAGMIMLTFVYSAVLGGIAGILVAPVLFVSIQMGATIALKAFAATIIGGFGDVTGAIIGGLALGIIETFGAAYISVPYKDAFAFLVLVVFLVVRPQGLFGERVAEKA

SEQ ID NO: 1460 - protein, 253 aa, Methylobacterium sp.
MIESSLDRGPGRGARAGTTRILLVEDDAGMQRIVSDHFADHDVAVTAATDRAEAEKRLAEATFDLVVLDLRLGSENGLDLLRDLRARSDLPVIITTGHRRDEIDRVIGLELGADDYLVKPYGLRELLARVRVILRRAEVAPAPARVQESHRSRFEGWVLDRRRRRLTNPDGADVALSKGEYALLVAFLDAPQRPLSREQLLQATRVHEDVFDRSIDVQILRLRRKLEVDPSAPRLIVTERGVGYVLAATVEKL

SEQ ID NO: 1461 - protein, 202 aa, Methylobacterium sp.
MVNKHVAIRTEDGVCGTHVVAPDGAGPWPAVILYMDAGGIRPALGDMARRLATGGYRVLLPDLFYRYGPYGPFVPADVFKGDFRAILGPLMATTDNLKAAADTAALLAYLDTRGDVAGRAVRAVGFCMGGRMAITAAGTYPDRFAAVASYHGGNLATEEPASPHRVAPALRAEVYIAAAENDGSYPPAMAERLETALSRASV

SEQ ID NO: 1462 - protein, 111 aa, Methylobacterium sp.
MLTRTAIYEGTVRDGREEEFFRRVRDELEPFWRRFPGVTAVRVQRLVSKDDDARPIAMILEMDFPDQAALDACLASPIRPESHAATEAVMQMFDGRFYHLVSAGRTLALVD

SEQ ID NO: 1463 - protein, 358 aa, Methylobacterium sp.
VAPSERRINGFDGLRALAFLMVFVSHKAPSPRTEALGTAGVWLFFVLSGFLIVRILAAARTSVEAGASTPLGSLGLFYRNRVARIVPVYYVFLFVLYTVRPGDPASLGNDAFKLATWFYVTNIYIELNGWGTELGHLWSLAVEQQFYLLFAPAALFLPRRHLGTLCWLLVGISVLAHGALWRAGAAPRCFDVDTLANVGLIALGGLAGLRTRPLPGWLARDAALAGVLILFVALPLLIAPTGWWLVLGRLSGVLAALLLLQVVQAREGRAVALLEIPWLRRIGVISYAAYLFHVPLHAERVLALVGLDVAGPRSVSMALDLMLTLLLAELSWRLLERPARRLLRAPRRRVGASALVGR

SEQ ID NO: 1464 - protein, 162 aa, Methylobacterium sp.
LFDRLEALRGKPVENVFLAVANAPALCDGVLAMAMSLRQSTLLDRQLRELAVLTVGLETRADYEVAHHWNSAVKAGLSQAKLEQLAQFETDDRFTASERAVMRFARDVTRTGRVDDGLWAELCGFLDEQERLELVLTTAWYNCVVRILLPLNIELEDWFSRL

SEQ ID NO: 1465 - protein, 411 aa, Methylobacterium sp.
VFRWYREVGPAERRTFWACLGGWSLDALDVQMFSLAIPALVASFGLSRSEAGLIGAVTLVAAAIGGWLGGLAADRIGRVRALQITVLWFAVATFLAAFAQSFAQLLTLKALQGIGFGAEWAAGAVLMAEAIRPEHRGRALGAVQGGWAIGWGAAVLLSTAAFSVLDQETAWRALFACGLAPALLLLYLRRSVPEPVRPVAGPAPSRAGGLAIFAPGLRRITVLATLLGLGAHGGFHALFTWLPTYLSVERGASVLGTGLYLAIIIAAFGLGCLVAGGLVDRLGRRRTVALYAAGCMALVVLYLLLPVGGTGLLLLGAPLGFCTAGIPASLAALFSELFPDGLRGTGMGFCYNAGRLASGLLPLGVGLLSEICGLGPAIGLAALGAYGLVLLAVALLPDRRCGGALIPQTVR

SEQ ID NO: 1466 - protein, 81 aa, Methylobacterium sp.
MTTTATRPAGANDTGLSLAQDLLSGAEAIALFMFGEATEANKRKVYHAAQKLGLPTFRIGGTLCARRSTILAWIERQENAA

SEQ ID NO: 1467 - protein, 352 aa, Methylobacterium sp.
VRIPATTRIPRLALLLPVILSTALSSALPRPARADDSVATLATGGLVLEKTDRIALVSEDLFLSEKAVRIVYRFRNLTDRDVETTIAFPMPDISGGPDAMLNIADPKHDNFLRFTTEVDGRPVDSQVEQRAFDTPAGKPEIEVTGRLRSLGIPLVPTVEATETALAALGADQRRGLVADGLLEPQDMGKGTTSLFPVWTLRSKFWRRQVFPAGRDVVVRQSYVPGVGGLSSLSFGTATEGADEKAEYARKYCTDAAFLKAAQGLARRIEAAGGRGVQAFEQYLSYVITSGGNWAGPIGTFKLTVDKGDPTTLVSFCATGLRKTGPTTFESVVTDYVPRRDIDILMLKTTTGR

SEQ ID NO: 1468 - protein, 313 aa, Methylobacterium sp.
VSAVSLSVLIVTYNAGRDIETCLDLLAASRVRRSYEVILVDNASTDGTPERVARAFPWVRVIAEPTNLGFAGGNARALEHARGTAILLLNPDAFLHDPDALAGLLDHLDAHPDVGAVGPRLTFPDGTHQVGDAGYEPRPLSILVHAAGLSGRLGLRGLYLAGRQARGARALDVDWICGACLLLRRSAIAAIGGLESPMFLYGEDVDWGCRLRDAGLRVAYRPDIAVTHLQGGSGSARSARWLDGLAAIYSLRNAGRLLSSPAFFSGPLRLGFTLRAVAYGVAARLRRQPDLARKAEDMRRFSGHLRSLRLRPR

SEQ ID NO: 1469 - protein, 70 aa, Methylobacterium sp.
MRDEPDQTLSDEELDRLARELFAEVRGEYSEAKVERALKTAGEVAGEVLPGIPDWLLDGSDDASAGDSGT

SEQ ID NO: 1470 - protein, 263 aa, Methylobacterium sp.
MPPAEGTPIWFELNAADPDVAQAFYEAVAGWRVAPSPMPEHGGYRIAEADGAPVAGIRRPTPEAPGLPGWAVYLATSDVDALAARAVDLGGAVRFGPVDIPHVGRFAMVSDPQGVVFAAMNPAHPGASRAFGPVPLETERTRGHGVWIELATPDPAAAIAFYGALFGWEKLGAMPMGDLGEYAFIGRGDLRPGAVMSSAATGAPARWNWYIHVADIDAALATVRAAGGTVLQGPDPIPGGSYAANIADPAGHQLGLAGPRQAT

SEQ ID NO: 1471 - protein, 48 aa, Methylobacterium sp.
MSKPKPPTNALLTPEKRTEDVDQTIRPLSLSEFIGQRAARANMQVFIE

SEQ ID NO: 1472 - protein, 56 aa, Methylobacterium sp.
VEAFRAKVERGIYSQPVRQQGCLPKWHRERLTHDIALRHGLQHELPLIRKDFEHLI

SEQ ID NO: 1473 - protein, 393 aa, Methylobacterium sp.
VKDSLNVAGFATGWGSRLYAGEGAGEAVDRDETPVARLRAAGAVILGKTNVPELTVQGYTGNPVHGVTRNPWDPALTPGGSSGGAVAAVASGIGPLAVGTDAGGSIRRPASHTGLVGLKPTAGRVSRTGGLPPIMLDLEVVGPMARTVEDLAAAMRVLGAAEPDSVAPHGFGPFGSAAVPERPLRILHVPAFGTAPVDPEIADSVAEAAGRLAGLGHRVETGRFDAATAITAAWPVLGQAGIAWLMRAHQGGLDALGPDIRALAEAGAALSAADLFEVQRMALALRRDLAALFADHDLLMTPAAAALPWPAEDTHPPCIAGVPVGPRGSATFTGFVNAAGCPGISIPCRPSGAGLPIGFQLVAPWGGDETLVAMAAAYEAAHPWRMVWEDAAP

SEQ ID NO: 1474 - protein, 504 aa, Methylobacterium sp.
VMLVILDGWGLRDAVADNAVHQARTPVFDGLMRERPRSRLTTFGADVGLPKGQMGNSEVGHLNIGAGRVVLQDLPRIDAAVADGSLARNPALVRFIEALRASGGTCHLVGLLSPGGVHAHQDHAVALARALTTAGIPVRLHGFTDGRDMPPRSAATCIADVAAALPKGARIATLCGRYFGMDRDRRWERVQTAYDALTEARGTRFERAGQAVAASYAQDVSDEFMRPAIIGDYAGMQDGDGILSFNFRADRTRQILEALLDPAFAGFERARTVRFAAALGIVQYSVEIDAFAETLFGALDLPNGLGETVARAGRAQLRMAETEKYPHVTYFMNGGREEPFAGQDAILVPSPKVATYDLQPEMSAPELTDRAVEAIGSGRYDLIILNFANPDMVGHTGSLAAAVKAVETVDTCLGRVVEAVTAQGGALLVTADHGNCEMMRDPETGEPHTAHTLNPVPAALVGVDGVTLADGRLADVAPTLLDLMGLDQPAEMTGTSLIRPRGEG

SEQ ID NO: 1475 - protein, 207 aa, Methylobacterium sp.
LNSLFAQAEASSPLSAIGDLSADERTRLMGSRTGYRDFYSRLKDMPLAVSRETGRLLYMLARTRRARTIVEFGTSFGLSTLHLAAALRDNGGGRLITCEFEPSKVVRARANLMEAGLADLVEFREGDALQTLDLDLPDSVDLLLLDGAKGLYPEVLSLVEGRLGPGALVVADNADHSPDYLARVRAPSRGYLSVPFADDVELSVRLG

SEQ ID NO: 1476 - protein, 311 aa, Methylobacterium sp.
LRRRPEFERLVTFAEAGSQIAVRRARAYPDLPAAVRGVTNLVPSETYVPGSLWSEVLEARLAREGWCPDAVAAWAGTWLQAVSRRFAAGAPLEIETILPGRALDAIPKNLVSGADGTFIDLEWDLGDPLDAGHLAVRGLVNALTDARDWHSGGPSTLTVLDALRALLPRLGLALDDAQLADRLALESRFQTIVSDRVTERGLDWAAATRLPVDLETRIDADPRAALAEASAEIARLHEENAALRAARAVDAAAHEAAARESVRRTDRVIAYAAEMHRARDHLQDTLDARRASAGDGSRLSLRLLRLMRGTP

SEQ ID NO: 1477 - protein, 337 aa, Methylobacterium sp.
MTSAGPHRRAVALAALAALVLGAPFPGTARAADREVTFAHQDMVVPFRALMASGAIEKATGYTIHWRKFGGGGDVIRAMASGSVQIGEAGASPIAAAASQGLDIQLFWILDEIADAEQLVARAGSGVTGVADLRGKTIAVPFVSTAHYQLIAALAEAGLTQADVRILNMRPPEIAAAWERGDIDATFIWDPVLARVKKSGTVVVSAGDLARRGKATFDGLVVDRAWAARNRDFLVTLVRLIAAQDAAYAARPWGADAPEVAAVARISGSAPAEVPASLAAYRFPTLEAQASPAWLGGGAAKALTETAAFLKAQGRVQALAPDYARFVTTEVVDAARK

SEQ ID NO: 1478 - protein, 66 aa, Methylobacterium sp.
MAYDRPAWTGSTPYDVETTGSFGAPLGGRYDRDPWTCPQSSAAEGNANQQNFPVKQYGQTAGGNRC

SEQ ID NO: 1479 - protein, 91 aa, Methylobacterium sp.
MSAEATLWDLVTAERIAIEDVGAAVDAYLAEPSTQDHAIGPDHVLDLAAAVAAHPSAPAIVVDTESDEPSRRMAVRAALLMSRPTTRSNSD

SEQ ID NO: 1480 - protein, 414 aa, Methylobacterium sp.
MSLHLDDPVTDPVEDRLPPPPSPPHRIRSDAEAIAAARAVARIFAAGAAERDRDRRLPWAEIAAFTESGLGGITVPREHGGAGVSHATLAEVFAILAAADGSAAQIPQNQFGVLALVAAAASPAQQARIYRDVLAGHRIGNAGPARNGKAITGVDTRLTAGPEGPRLSGTRFYSTGALFAHWIPTRAVGPDGGPLLVFVRRDAPGVRVVDDWQGFGQRTTASGSVIFAQAPVEAELTIDLAPLAGRPGLFGPVSQLIHAAIDAGLARGAVAAALDFLRTRTRPYPFTAETVAEDPHILGEVGRLTVDLHAAEEVLARAGRALDRIAAAPVTAQSAAEASVAVAQAKILTTEAALEASERLLELAGAAATRDGYNLGRYWRDARVHTLHDPVRWKYHLLGNHALNGVLPARHQWN

SEQ ID NO: 1481 - protein, 320 aa, Methylobacterium sp.
VPLRRRPTAARRPSEKRIAPTVSTPDHGLSELAQIEVNLEADTSTLWAFMRPQGRPCQNPEMLADFSRLQDGIERGFGNGGLDLNYFVFGSRFPGVFSLGGDLSLFASRIRAGDEAALVGYGNACVDVLHRNMNALNLPIITIGLVQGDALGGGFEGLLSFDVIVAEKGTKFGFPEILFGLFPGMGAYSFLARRLGTIRAQEMILDGRTYTAEEMHELGIVHVLAERGQGEAAVRAYIAGNHRRRNGQQAIYRAAREVNRISLEELRKIVSVWAAAAMNLTDRDLCIMERLVLAQDRLRGKAQAAQARTVTARGLAASTR

SEQ ID NO: 1482 - protein, 28 aa, Methylobacterium sp.
MPQMFDWIFFAIMLPFPAYLVWDFMRHR

SEQ ID NO: 1483 - protein, 308 aa, Methylobacterium sp.
MPGPERDIVIGADGFLGRNLVQRLRAEGREVVEIGRAAGDLSEWANVERALRAAPPSSRIFHVVTRQRTGAVQYDIQGELLAINARVHLNVLEAWRLFQPQAKLVSTGSSCTYPESAEPLPEARFGQGATHPSVIGYGLAKQVLATGSAAYAHQYGLCFLHCVLATLYGPHDNKASDRSHFVGALLDRAVREKAAGAAQFEVWGNPQTVREVLYVDDQIDAILAADRAFDNEILNCAANTPVTVEAVARAALVALDWSVPLVSPPGSFQGAAYKMLDSSRFLDRSGWRPRIALEAGLRRLVAAEYADR

SEQ ID NO: 1484 - protein, 325 aa, Methylobacterium sp.
VAALPLTSLPDTVVVVGATGFVGRNLVAHLADRVPRLIAVSPSGRAVPGAHEAARFDALEALSVPADAIVVNVAAQRYDADKFETAQSDLLTGNAEIANRLYRFCLTKGIREVRAASSVAVYPAALDPLDDAQAVDLNAPPNRNEAFYAWSKRWSEVIADLHAERYGIHTISFRLSNPYGPHDSTDPRKAHVLPAFVMRALAPGERFEIKGNPLVERDFIYVGDVVDVFARSLEMRETSDALNLCRGETTTLLDLARTILEVAGEDRPVHAPDTATHGVLARRSTNQRLRERLGMSTFTGLADGLRPTIAWYREAYRDGAHHAGA

SEQ ID NO: 1485 - protein, 310 aa, Methylobacterium sp.
MRILITGGAGYIGTILVPMLLERGHHVTVLDTFKSGAPDLFSACQYDTFEPIKGDARDTRILDELIPKHDVLIPLAALVGAPLCKEDAIGATTLNRDAVIALVERAGGGQRIVYPTTNSGYGVGEAGKFCTEDSPLRPISLYGTTKVEAEKAVLESGRGVTLRLATVFGMAPRMRLDLLVNDFTHRAVTDRALLVFEGHFKRNYIHIRDVAKGFIHAMDNYDRMRGEAYNLGLSSANLSKLELCERIKVHVPNFVYVEAPIGEDPDKRDYIVSNEKLEATGWFPDFDLDRGIKELIKGFRMIRNSRFANV

SEQ ID NO: 1486 - protein, 583 aa, Methylobacterium sp.
AYAVLAAALVTLAATTPLSGYALNILMQAATYAIAVIGLTVVLGLCGQINLAQAAFFGIGAYAVGLGTVDGGLNFWICLITGLGLAVVLGAALGASTLRLGGHYLAMVTISFQQILTLVLTNWIPVTHGPDGVPNIRRPALFADGQSYLALCVLVLAVVGWLVWHMPRTRLGRAMRAVRDNELAAGVSGIDIYRTKVAAFALGALLAGLGGGLFAGSFTYISPDQFAFAESIVFLTMALLGGVGSPVGAVIGTALLILIPEWLRFLKEIPGLYLAIYGLAVILIVVFMPDGIWGFLGDQVRRLRRARPVPPPAAELTLSQGEPSAAPMLEVSDLSKHFGGLKAVDAVSFTVARGGIHALIGPNGSGKTTTLNVLSGLYSPTGGTVRLAGQDVTRLSPHRRAAAGIGRTFQNIRLFRSMSALENVVIGAERPNNPSGARDRASLEARARAALAFVGLEDRALEPISGFSYGHQRLIEIARALAGNPALLLLDEPAAGLNSSEKNALTVLLRRMAAKGLTILIIDHDMTLVSDVASHVTVLNFGRRIADGVTATVLREPAVIQAYLGEDAAAGPAASLKTDLAPA

SEQ ID NO: 1487 - protein, 251 aa, Methylobacterium sp.
MTTPATPLLEIRDLVVRYGEIEAVRGLSFSVGAGEVVTLLGSNGAGKSTTLKAISGLVRPAAGTILLEGRPLEGLKPEAIVRLGVAHVPEGRRVFPGLTVRENIMLGASNRSGLGKRALRDEVEAMFDLFPDIRRFGDALGWTLSGGQLQMVALARGLMAKPRILLLDEPSLGLAPVIVQAVFAIIAEVRRRGTTVLLVEQNARMGLSVADRGYVLETGRLVLQGAPDALWANDEIRSAYLGGRTRPELAG

SEQ ID NO: 1488 - protein, 131 aa, Methylobacterium sp.
VAAATEPLTESADALVLGTDFFGFLASRFPRFCSAAMISLLDTMTAPTTSSSPFGRRLVWKQPDRGRDRGLEQAEDGNEAVACPEFGMMPRDQTRCLPLGVAVVARCDDASREHTTGRGEPMDLIGAARVS

SEQ ID NO: 1489 - protein, 312 aa, Methylobacterium sp.
VVDVFTHAGTGGNPCPVVSDARALDAEAMRGVARRYGHESGFALPADDPAHDLHLRFFVPNHEMEMCAHATIGVLWVLAREGRLPDGSVRIATGSSSVTGFVSPRGADAWSVAITQSVGRVRPLTDEQSAAAQAALGIGRDALAARPVHNAVTSRIKTLVPMRDAAALNALAPDSDAVEAACTRIGSTGLYPYAVLDGPARLFEARQFPRASGYPEDAATGIAAAALAFGLLQDGLIEPDDRPIRILQGRAMGRLSEIRVRLGFVDGRPVGCLLEGDVALAESADSVTATDEGGRIAGEWLTEPSRPGGRRR

SEQ ID NO: 1490 - protein, 157 aa, Methylobacterium sp.
MTDLTVRPAGRPDLPAILDLYAELNGGRVATLEQAGALLDRLATYPDYGLYVAERDGAVVGTFCLVILDNIAHWGTPSALVESVVVASRHRGGGHGRAMMHEAARLAEARGCYKLALSSNVDAKPAHAFYESLGFERYGYSFRLDPPFLPDAAEATR

SEQ ID NO: 1491 - protein, 103 aa, Methylobacterium sp.
LQAEVEADPTFDPPALRTRPDLWPHLAFVSNAFSELSSDRPLGALGGCGPIPWSAIERYAARYELDDLESFERFAHLIRAQDRAYLTIMAEKQKSGSGGKGKP

SEQ ID NO: 1492 - protein, 116 aa, Methylobacterium sp.
MHPLNRRVVAVPAVALLVAAPLPGRAGEFAQVPPVPGMALTLPDPGMANGAPAPTAAPTPDPAAEPPAPVRAASVPAVERRFRRLGSGLSSIDGQLPNQRTGQRHQHVVRDICIGC

SEQ ID NO: 1493 - protein, 124 aa, Methylobacterium sp.
MTRALLFAALLGTAVVPGTARAAEEADDTKRAETIRGLVRIVGAQAGIVLHCRKLYTIDDTVSEGLSRTVRRALDAGLGHQRARNAIAEEGRRVADEIAAVGPEQWCADQRDLLNTDGVRVFID

SEQ ID NO: 1494 - protein, 68 aa, Methylobacterium sp.
MLMLVLLIALLAVVVAMFVLRRWTGRLASLATLLAGAIMVLWLAEVGLLPGTQGPLTAYRPLVPGLDR

SEQ ID NO: 1495 - protein, 84 aa, Methylobacterium sp.
MLDDAFTYGGWVLGLIAVGVWIWLARRAFPSFESFVKGFDDELQLGASPEERARSARWRQVRQAAMALTAVAALCLSIGFAIPD

SEQ ID NO: 1496 - protein, 89 aa, Methylobacterium sp.
MMMHVKMIAAAAAVVGGLGLASAGAAPLAPAGADTLTGPAAVSTVAFGCGPGWAPGPYGRCRPIYRRPRFYGPRCFFRPTPWGPRRVCR

SEQ ID NO: 1497 - protein, 78 aa, Methylobacterium sp.
MLALDAGTAHRSRAYRAFRLDRAGRVRAAEILSAEDDTQARRRARAMVGRDAIELWERTRFLGRFEPTVAAAQDRAGR

SEQ ID NO: 1498 - protein, 81 aa, Methylobacterium sp.
MVEFVRPLMCPVMRKLIGMIVRMSQHPGLQEQGQLIDQLTELETEGIARDVPWRTVEAIRATRLRLRVEGLMPRTPLPRGH

SEQ ID NO: 1499 - protein, 316 aa, Methylobacterium sp.
MALREPRADTADACPGLAGGVGRRARAIPLRRRLTVAAAGRGRLLAAAPLPLLLALAATTTPEPVAVGLGGLALAWLSLRVQRLRGAACAATRQRNNLARLTAPTVARWVAETDRAARRPGWEQEATVLFADIRGFTRLCEGMAPGEVAAFLAPFRSRAARAIEAAGGLVDKFVGDEVMAVFGVPDAAPGDAGRTVAAARALAAAMAAWSGERGQAGLPPVRVGVGLHRGPVFIGVIGAERVEFTAVGDTVNVARRLEQMTHALPCDCLASEAVVRAAPSGGARIVAVGPVRGARTVLRLFTLRLDPAAPSRDGSE

SEQ ID NO: 1500 - protein, 79 aa, Methylobacterium sp.
VNHQRRLLNKAAEARDYQITIRQRADASWPGDHSRLTALESTGHLRRIDVLEGPGGPVAVWQITAAGLSQLRALTSGAE

SEQ ID NO: 1501 - protein, 365 aa, Methylobacterium sp.
MNLLKRLFGRADAARAAEAAPDEPLLVNAYATVRDLPALPFDHALNGRRDLSDPELQPHLDGFIGYVMGRGDGQMTALRYHLWRHLQRVRNHVSFAVAASDLPRVEAWALAANAVLFLPDGSVRAPDMALLLSAAGETDPAARLPYPPDAVARRARTLEHLEDLDPKPPAGMPPALGEAELALRPPAEVLRRALALLYVAAWGQAFGAGTTLREPGQRALNPTGFAALSPAERAQIEAADPKDAAAASWRYEAANTLLWALGVRAARIADRDATVDVDALWRAVAPLARDAGAADAARLRPPGEILEALDRAWRAHWVVRQARQKGTTLAGLNGDVVAERHVALNWLTGFQNDRDTPWDATDTPT

SEQ ID NO: 1502 - protein, 115 aa, Methylobacterium sp.
MQSSRWAGAFLAAGLIVAFAPPARADAALVLRETRLHTPPDSHEPQRAMVNLRNTGPDLATNVTVLCTFTGAGGTVLDTQQASVPEVVSLADVQAETIYYGWPRASSATCRLAEP

SEQ ID NO: 1503 - protein, 319 aa, Methylobacterium sp.
MSKPNPRTAAAITLRDGASAIADLETQHRMAERALSGAEGALQEASAKYDAALGEGREAALAARQVRTTAEVDLDIARRNVDTLGRKLADAHEALRLAGIEHKRTEAERLRSVFEETVRQGLARMGVDARSILRAWAEAELAIREARAAQGPKGPAIPDAEEFRSVRRGADKEIRRTRITRWIRPGTREPYADEIEREIIRHGSIGFLPNPCMSGGGREIAERGVFDRVTYEKAVGAIHMPKLIESLCVPALVGGQVPGWMPVEGHVDPRTILTRLAELEHPAAEPKGELQTVDTFVHLVGAEAAAAWDCQEFRVRAAG

SEQ ID NO: 1504 - protein, 559 aa, Methylobacterium sp.
MSSTLPITGPDKSLDTALRRLVRPVAERARYYLILLAQIGALLVLLKISHGVTAINNYYGVVLPVALALAMTRVRFAAADLASVRLLQMIGVIAGGYALIHYPLFPVILPGAKATVAVTAIAVLWVAAVAGGVLCLRWPSLALISATYLVWSKQAVIRVTGLWHGHIIDVVPLAEVSFCLVAGLLVAHGTARLRDWRGLGAAARSDVASASAMFSKVLIAAAISIHLGNYYSSFLAKVTLDDGPFSWLLNNDPGKIFIVGLDNNHVPYAGWPVLVEAMRTILSHSSALTNTLILVGQGIALVGILMPRRWLLLLLLGFDVMHLSIIVLMGANFAPWIMLNLAIAAVVVSRHYERPPVSVGILSVLFILTGNTFMTQAWLGWYDTLANNKMYFEAVDRTGQRHYVPTNFFTFYSYPFAHMAYGAPDAANAFALDNPNGGTQVFRKVTASTTCDVPVLTAPDGLGQEYSKSEIDGPALDAYVRGYHRLVSTIRDRTGLFPYAVYPHHFFVPLQYAAGFDTLAMADIVAYVYRRESVCFSLQDGVPVRRVVSEAEHRIDLTP

SEQ ID NO: 1505 - protein, 559 aa, Methylobacterium sp.
VIRAFHCLANGTVTGLGTLRGHQTDLLERARPYVILLAQIAMLLLLIKMARTFDERSVVGVAFPLLLVAIMVRYRPAAADAALVRLLQLIGVISGAYALIHYPLFPVVHQGVRATVVLVALGGLWVAAVACGALCLRWPVLAVVSASYLVWSKKAVVWVTGLWHGHVIDVGPLAEVSFCILAGLLVARLFEHVRDRLSWSTPVAADIGVASALFSQAVIAAAISIHLGNYYSSFLAKVTLDGGPLSWLLHNDPGKLFLVALDDNHILFSGWDWLVDAVKLILQHTSAVTNAFILIGQGLALVGILMPRRWLLILLLAFDIMHLSIVAILGANFAPWIFLNLAIAAVVVSRTYRRPPLLIGLLSVLFILTDSRFMSQAWLGWYDTLANNKMYFEAVDKNGTRHYVPTNFFTFYSYPFAHMAYGSPDAATAFAVDNPNGGTQVFRKVLASMTCDVPVLTARDDASQDKAKDGINVPAFDAYIRGYHNLVSKVFDRPGAFPSAVYPHHFFIPMQYGTSFNAVKMSDIVAYIYRRESVCLSVQDGVPVRRIVSEAEHRIAVTP

SEQ ID NO: 1506 - protein, 60 aa, Methylobacterium sp.
MLPSVQTTDLLGLGFLIIGLAAAGIASASRSARFAEEPREELAGGALLVAILGLAFVLAE

SEQ ID NO: 1507 - protein, 60 aa, Methylobacterium sp.; identical to SEQ ID NO: 1506

SEQ ID NO: 1508 - protein, 700 aa, Methylobacterium sp.
MLRLPRPSIGTILCAILFSLSAMLLAAGARTALEAGAQERESRRVVALTEGSRILLEILLAVRLERGRTLQALIAADRIPPADAALIARQRATRIDRLEALLRLVRAIDTAAVAKTVDPLRRAHEAVTGLTSRIDAALSVPVAEREAATAEVAATAFRDLLDALTATSGAVDVTIPRRDAALARALDVKRAAWITRVAIGGNVARAETAVTRGTGWSEEERLAEAEERGRVAASWANLVDHMDDTLPPAVQDAFVRAGASNFEGEVAARRQALRAALSRGRPPGVAIQDLRDRNTREVNTIADLAEAALNAMVARAQALAAEAGATLLHTALFLAASVLLAGAGAVVVVRRVLGPLRAMIQAMRALASGDVAVEIPARGRRDEIGAMAAAVQVFRDNLVRTRALEAEAAEAARAAEAQRRSMTHTMARSFEAAVAGIVGQVSAAAAELQTTAWEMTTTAQETASQSDTVAAAAEEASAGVSTVAAAVEELGTSVQEIGRQVQGSSELARIAVGEADQTAALVAALNASVARVDAVVELIARIAAQTNLLALNATIEAARAGEAGHGFAVVATEVKELAAQTGRATDEVGRQIGEIRTVTGQAVRAIGTITGRIGEIDAVAAAIAAAVEQQGAATREIVRNVAQANAGTQEVTGNIAGVAQAADRTGRAADHVLTAATALTRQSEELAAEVERFLTGVRAA

SEQ ID NO: 1509 - protein, 97 aa, Methylobacterium sp.
MPTALPSRATPVRRLSWPDTARLLILMVRVRLLDLRLHVVVRQGSGLANDRLLRLMRRWLALHEAIGALLPGMPEPQHVAEVRAILRVPAAKPETGL

SEQ ID NO: 1510 - protein, 166 aa, Methylobacterium sp.
VIDVSFMLVDATRRQVVDLGPGSYDLERTYLVSAGSGITDVAHVDRPCLRIVAIRGTTTFRASARTLTRTQPLPVPSVAEAVARMRAGQADAFALSRDTLWPVVPQLPGSRIVAGGFQQTQIAVAVPKGRPAALARVTAWLDGAKRTGVVRRIFDARGFHDDAVAP

SEQ ID NO: 1511 - protein, 897 aa, Methylobacterium sp.
PLARLDQRGLDALLAGHALAPDSLADLYPLTPLQEGLLFHARLEPGDAAYRNQVRLDLEPLDPDRFARAVRATLERHDVLRTAILDPADGPPLQAVLDAVPEPLTRLDWTGEPSSQDAPHEDALAARLAERLADCLAALAAEERARPFDLARAPLLRLVLVRTGPDRHHLVLTVHHLILDGWSTARLVAEVLARYRGEEPEPVTGRFADYLAWLARQPRAAAERFWQHALAGLDAPTRLADTFDPPGMTGMTGAPGARDGQRPPGHGEVRHHGEVRHRVPAAAAGRLLARARAAHLTLNTCVQAAWARLVAARTGQARVAFGTTVAGRPADLPGAETVLGLFINTLPVVVDLDPARPLGAWLAGVQEAGLGLREHGHLPLAAIQRLAGPAGAGTGTGTGTGGLFDSLVVFENYPVDQALAAARHGRDGNGNRDGNGDGDGNGGGDGDAADPHALRLGPAIVAETTHYPVTLVVHPETGPDGTRLALRLSYAADRLGHADAEALLAAFVAQLAALAEADPATPLGALPPPLPDSDRAVIGSANATARAYPDGAGDVLAAFADHRAHDPDAIAVTDAQGALTRRALDSAASALARRLVRAGAGPDTLVGVGLERSCALLVAWLAVLKTGAAILPLNPELPRPRLVATAREAALRLLVTESGPAARMPGPAELPDLQILTPDLAEAADDPALPAAAPHPDALAYLIYTSGSTGTPKGCANTRAAIANRLAWMRAHFAVGPADVILHKTPVSFDVAVWEILLPLVSGARLVMAPPQAHRDPDALAALIRRHAVTIVHFVPALLEAFLASGRLAACPSLSRIVCSGEALAPDLAAAVRAQSRADLANLYGPTEAAIDVSAWTCGPEPDAPRVPIGHPIANTQLHVLDDALHPVPVGVVGELY

SEQ ID NO: 1512 - protein, 545 aa, Methylobacterium sp.
RRLSRRDSFFERGGDSILALQLVARARESGLALTPRDVFTHPRLAALAAHLDAAPNSAAAPPPQVDPAREAGPVPLTPIQRRFLDGPVPNRQHWNQAIVLAPRAPLDPGRLAEALAAVEAAHPALRLRFARDAHGAWTQTCRAPGQEPPLWRRAADGAPAFAALAAQAQTSLDLAEGPVWRAVHVTLPAEGTERLLLVAHHLVVDAMSWRILIQDLAAALAGRPLAPPPTSFPGWARSLDVLARHPGHAGRRESWLAGWLAGGPGADAALRPVRPEAPNVESAQTEIADSLDADTTDAFLRRAGRPYSAHPDEILLTALSIALARRGDGTAVGVILERHGRDADALADALAEPLPEPVAEPLSDAQDGPTLPRHDLSRTVGWFTTLVPLRLDPLGGEPDLPPDDDARGLALGAALGAALCRVKEARRALPQPDLSHDLLRHGPAADLRHRIAATPEPGILLNYLGQIDADRADPDAPFALAPESAGPMRDPHSPAGAELTLTALVRAGRLHLAWRFSPDRHDAAAIAAIARDTRQTLEALLAHCA

SEQ ID NO: 1513 - protein, 345 aa, Methylobacterium sp.
VAAPKRVCRFNVWINPVFDARLGAEPDIDLQVGDLQGPEDALAALLARAHVLHVSPARDELPRRWHVTDTLLAECPDLLAVSSAGAGFDTVDAAACTRAGVAVVNQVGGNARSVAELAIGLMLAVSRKICVSDRLLRTARGFTRESLMGHEIGGATLGLIGIGHTGREVAKLARGFDMRVLAHDPLLPDAEIRARGAEPVDRARLLAEADIVSLHCPLDDTTRGSFDAASFAAMKPGALFITTARGGVHDEAALAAALTAGHLAGAGLDVWAPEPPPLDAPLLQLDTVVATYHTAGVTHEARRNVAAWGADQIVGLLRGETPPRLVNPEVWPTVLERRARLLGGA

SEQ ID NO: 1514 - protein, 265 aa, Methylobacterium sp.
MKLGAYKDRLSGHCGFLFTELPLAERFAAAARAGFRAVEHPNLFATPAREVAGWLERAGVPLVQTGFPAGDAAKGEKGFAALPDRIDHFRSTIEPTLDYVAQLGCRMVHPMAGVRPAGVERARLWDTYLDNLAFAADAAGARGMTVIVEPIGPGSIADYAIDDPLLAVEAIRAIGRDNVKLLFDAYHCVCLGHDPAALIRAHAPLIAHVQIADDPGRHEPGTGTIAFDPIFAALEEVGYSGFVGCEYHPAAGTEAGLGWMRAPAA

SEQ ID NO: 1515 - protein, 223 aa, Methylobacterium sp.
MAPRIVLLHATPVAMAPIQAAFAERWPEAETVNLLDDGLSLDRAKEPGAISEGMIERFVRFGRYGHDMGADGILITCSAFGPAIDRLIETVPVPVLKPNEAMFRAAIAQGARIGMLATFGPSVGTMTDEFEEFVAEAGRPASLRTVLVDDAMARLRAGDAETHNRLIAERAPDLRDCDAIMLAHFSTSRAAEAVRKAVDVPVLTAPHAAVDRMRAMIETGGSA

SEQ ID NO: 1516 - protein, 431 aa, Methylobacterium sp.
MFAKRYRFLIAFLLFIAGIINYMDRAALGVAAPFVKQDLNLSPSELGVIFSTFFFGYALFAFVGGQLADRYGPRSVYSWAAASWSVLCMLTGAVTGFAQMFIVRALFGFAEGPMNSTTNRTITTWFPREETARTIGFTFSGQTVGSAIAAPVVGLLAIQYGWRVAFVAIGAVGLLWVVAWRMLMTDRPQDNPRVHPEEIALVERSRAVTHLAPSDHARSLREYLFLPSTLSLGLGMFAVNYTLYIFLSWLPSYLTDALHMPVKEMALVASIPWACGFVGYVGGGVVADFVYTRMGDKLAARKITTIVPLAIAGVALIMVNAATSTAMAVALIALAVLMLTSSVQSCWATIHELVPEARVGGVSGFIHLLSNISGIIGPTATGLAVQYLGGYASAFVIAALIAAAGVVAMAIFVRRPRNPAEAGPLAAAKAV

SEQ ID NO: 1517 - protein, 67 aa, Methylobacterium sp.
MFKNTARAALCLACLWSVTPALAAPKEMPQGKRDEMSMKDTKHEVVMQRKENKEANKNVDSLITNRK

SEQ ID NO: 1518 - protein, 32 aa, Methylobacterium sp.
MPLKPFSYLMIGVFASGLAMTVFGAVGVLAGS

SEQ ID NO: 1519 - protein, 59 aa, Methylobacterium sp.
MIFDSKDTALDALAAQCLRVRELIDSVGDPLMRAAIDLLLLEVARALAQTGPQDQASGA

SEQ ID NO: 1520 - protein, 76 aa, Methylobacterium sp.
MTDDATPPTTRWLLERIAATLNVCPTYFLQTERPDETAADQDARDCAEVAALFQAIKSPARRTAVLNLLREMSRET

SEQ ID NO: 1521 - protein, 234 aa, Methylobacterium sp.
MLTLERVDAGYGATSILHAVSLEVRAGEVVTIVGANGAGKTTTLRTIAGLVKPTRGRILFEDEDVTRLSGHEMVARGVTLIPEGRQLFPEMTVRENLLMGAYRRAARERQSETLADVLDLFPRVRERLDQNAGSLSGGEQQMVAIARGMMARPKLLMFDEPSLGLAPIVVAQVFAVVDRIVKTGATVLIVEQNVFHTLQVADRGYVLENGEIVLADASAALLDNDHVRRAYLGI

SEQ ID NO: 1522 - protein, 280 aa, Methylobacterium sp.
LHKRPLAAVTMAYNEKTMLPLWLKHYERQVGAENCYILDHGSDDGSTTGLRANVVRLPRLPLNEWERAHTVRDFCASLFIGFKYVLYADSDELILPDPDVSSTLSEYIAARPLPPILDLFGADVMHVGDEAPIDVAAPISGQRRYIRPISTLCKATIVSERVDWHVGFHCLIQDHRPDFRDLFLFHLAYLDHDILFKRQQKRNAAAPIGIPNSHHAIDPTEFLTFVKADIGRVPRRPVQMRPGEAHFETTKRLFADAIERKSAIQAPDLWTLPERFVGSF

SEQ ID NO: 1523 - protein, 470 aa, Methylobacterium sp.
MDRAQQLLRSLTKDARIVEIGPSFSPLAPKRDGWNTFVIDHAPRSELIEKYHDQTVDRIEEVDFVWTGGSIADAVPVDQHGTFDAFIASHVIEHTTDIVTFLRASETLLRPDGVVILAVPDKRKCFDFYRSLTGTADAVAAFLEKRNRHTVRTHIDYALNMALKDNGTVGAWSGRDTRPAIPANPLTDEPQWLGAAQLPYYADAHAWVFVPASFNLMILELAQLGYIDLRVEDFLDRDATEFFVWLRKGRQQLAPDEIREQRTALMQRAIVELAEQVQQLPETSLVEMASAGALRDQLLKATYRTEALRTVLAALRASIGRFGLDRAKFKRLIGAASQKVPGNLSAAVQHKILLTEATKILDGITDPAVEADDRDPAVIDGAVLVAPLGAAQFGDPLLAAELERERQRARAVRMVLDAVLGSLRGRALDKKRFRDLVTQAAARTPNDGPESARHAVLSEESRRVLGLPVA

SEQ ID NO: 1524 - protein, 106 aa, Methylobacterium sp.
MDDDVADGMDGGDASSAAAQEANGIAFLLASAAYLTLADAHLRREGPEGLALMDEIEDRITEALRSFVEETSYEDARPDILQHATRKVRALLEAGRSLAPEMRRFQ

SEQ ID NO: 1525 - protein, 228 aa, Methylobacterium sp.
MSVLATALLTGASLGLSIAAPIGPTSLLCVQRTLSGGLSTGLATGLGVATVHLTYGGLVMRWGADLAAVWSNGAVLSLISGAVLLALAFRVLRSVSVLQEGRACRDTLAVSYGSAVVLALANPVTPVLFLAAMPAFLERGTAPFPVLAAGVFVGSFGWWVVLNTAVSLFRRCVTSQVLNRMNKAAGLLLALLALSLLVRGLDGGTVARSSSAGVSGVSGAGVRAPSRL

SEQ ID NO: 1526 - protein, 236 aa, Methylobacterium sp.
MPEPLLATTGLRAGYGGKPVLQGVDLAVRPGEIVAVIGRNGVGKSTLMRSLVGLLPASAGGIAFRGAAVEGLAAHRRARLGIGYVPQGRDVFPRMSVADNLTVGASLLPKGERPDYERAFGPFPILRERRGQRAGTLSGGQQQQLAIGRVLVGGPALILLDEPSEGIQPSVVQQIGRTLVDLNKRTGVTIVFVEQNLDLIRAMAQRSYVMDKGRIVAELTARDLDDRDLVRRHLAV

SEQ ID NO: 1527 - protein, 330 aa, Methylobacterium sp.
MQWLDQSIMARKGVAGGKPGREHTITEAEQGRYHYVYGPFAEPVLTVDPGAVVTVETHDAFEGKIRHETDSPTQILNFPYLNPQNGPIYVNGAEKGDCLAVAIRSIRPRGPQPCGTTLIMPEFGGLVATGDTALLNPPLPERVRKLEVTAENGVRWNDRITLPYQPFIGTIGTSPEIEAISSLQPDYYGGNMDLPDVGVGAVIYLPVNAKGALLYLGDCHAAQGDGELCGVAVEHPTHTTVQIDLIKGWTFRWPRLETEDFYMTIGSSRPMEDAARIAYRELIRWLAADFGFDEIDAYMLLTQCGRVRLGNMVDPKYTLGASITKAIAHA

SEQ ID NO: 1528 - protein, 333 aa, Methylobacterium sp.
MTARILGALVFALAFVTPAAAQSPIVIKFSHVTTTDTPKGQGAERFKQLAEERTKGAVKVEIYPNSTLYKDKEEVEMLQLGAVQMLAPSTSKFGPLGVKEFEAFDLPYIFPNEQVLRRVQDGPIGQGLFKKLETKGIKGLGYWDNGFKILTANKPMHAPEDVKGLKFRIQSSKVLEAQFKQLGALPQVLAFSELYQALQTGVVDGQENPPSNVTTQKLNEVQKHATLTYHGYIGYAVIVNKGFWDGLPADIRTTLEGAIKDATAYEHEIADKQNEKALADIRATGKTEVYTPTEAENAAWRKALAPVQREMASRVGKDLVSALNKEAEAAPNN

SEQ ID NO: 1529 - protein, 269 aa, Methylobacterium sp.
MDAEIYEIYAIKYAHHHRMARENFIGGDIHDGPMPIDYFVWVVVGGGRTIVVDTGFDRAMATKRGRSIVRPVEEGLARIGVDPLRVEDVVLTHLHYDHAGNHDLFPTARFHVQEREMAFCTGRCMCHPEVRHPFAAEDVKAMVDRLFEDRVRFRETTDTLYPGITLHRVGGHSDGLQIVRVQTARGWVVLASDAAHFYANIGRRLAYPIVYNVGDMFEGYRTVRRLAESEEHIVPGHDPQVLAIYPPASEDVAGWIARVDLPPTASPTY

SEQ ID NO: 1530 - protein, 39 aa, Methylobacterium sp.
MIDVQPEDRAARVIDRVLLCAAMLSLTFGLATGLWGLLQ

SEQ ID NO: 1531 - protein, 71 aa, Methylobacterium sp.
MLLNRVLVAALIVAVAAFLLYLAALARAALSPNEPYAASIGLTLDQCVAAQDSLSAEAARLYCLRPVPKRL

SEQ ID NO: 1532 - protein, 72 aa, Methylobacterium sp.
VSTMTAEPDNLVLALLRRIDGKVDRLIDDVNDLKARTSAVEENLAGVHRRIDRLKLRVERIERRLDLADAPH

SEQ ID NO: 1533 - protein, 93 aa, Methylobacterium sp.
VNSTALFTMLGLVIGWAVLAGAALITGRVATFAFLILTLIALYLYVPWVRLRASGIEGSSRPVRFWTNVAMLAVSLAACLAFGIMLARRTGLL

SEQ ID NO: 1534 - protein, 297 aa, Methylobacterium sp.
MIRADLNDYVYFAEVVAHGGFAAAGRALHQPKSKLSRRIAALEARLGARLIERSSRRFRVTEVGQGFYECCRAMMLEAERAEALVAEAQTEPHGRIRMSCPTGLTDIVAAHVRGFLVRYPKVRLQLVVTDRPVDLIEDRIDVALRVRRDLTSDASLTMRTLGTSRWILVAAPRVARGLGPDIAALGAVPTLGTRDDPGEAEWRLEHRDGTIFTLRHEPRLTCGDFAALCDAAADGLGVAFLPDHACTDAVAAGRLVPVYPDWQGQPGIVHIVFTTRRGLPPAVRVLIDHLAATFPKL

SEQ ID NO: 1535 - protein, 113 aa, Methylobacterium sp.
MSLLNTLGGSLGQIALKALPGVIQQVLPGGLNALLDQLRRSGYESQVNSWLGRGPNEPITAEDLRKVLDNEQVRQMAEKLGVPMDQLFPTLAQALPETVDRHSPEGTLQAPKT

SEQ ID NO: 1536 - protein, 126 aa, Methylobacterium sp.
MLATLVAFMVANPAMSHALTAIPETAGVAAALILLRSPRPEGIAALVVSTYYYGREAGQREHALKHAGWDAVQAHLGAEFLYGWSLPNLQQWVAPTCAAGAVAAAIHLVRSRMARAAPPGARLRRE

SEQ ID NO: 1537 - protein, 81 aa, Methylobacterium sp.
MKRMLVGAAVALTTLAAAGGAEAKGCIKGAIVGGIAGHYAGHHGLVGAAAGCAIGRHRANARDRQVEQQQMAPQARPVSAQ

SEQ ID NO: 1538 - protein, 38 aa, Methylobacterium sp.
MGTFIFGTLGGLMIAGVAAIYAKQAALEEADSHTDGHF

SEQ ID NO: 1539 - protein, 454 aa, Methylobacterium sp.
MAPTDDPTPVLVDLAAGRDPRIVSDAGTGTTWLEVDLGGRFPIHSVALRPGEGAVPPEPGDVAVAVSQDGATWTEPDLAGWTATPDALVAAIVPDERAWARAVRIAAPEPARIAGIDIRADEAAVDLIALRAMLGLDVTLLNETPGANVYVTYALQSAPDRASHALVGLSLFENGAFGNCLVQYIIAVSIAKALNLKYIKVPKVDRSKVIFLTERLTCDGITFIPPDEPLPADGYFLSGLYFDPTQFERVTALRGPTDSRAIVQSVIRPLFNGLPKTFPAKPDDQLLIHIRSGDIFSTWVDPHYPQPPFAFYRMVIDRLLAEGRIRSVKLVFENRLNPVIAEVEAYAERRGLPVEVQSESLISDVAALVNGRYLVFGLGTFGPGICHLSDRVEQVFYFASNWPQGFQSIPTIGKVVEVRDLEGRYMKVGEWQNTDAQRRTMVDYPAEALAFDDA

SEQ ID NO: 1540 - protein, 79 aa, Methylobacterium sp.
MVVAALLFLVGWLLGRSYSVIILALTSSVILFTATTIFVSVYGIDLLRVLIVLGYLTAHQAGYLLGAYLTGYPENGRGR

SEQ ID NO: 1541 - protein, 419 aa, Methylobacterium sp.
MTDRYGDSLSRRSLLRAGGAALLAPALASPALSQGQSEVIRIGHLTPRTGFLGPLGEFAVQAAQLAVEEINAAGGIAGRKVELLSEDSVNPQTASAKAERMVQRDRVACLVGEINSASALAISQVAQREKILFINTGANSDALRGSDCKRFMFHVESQNTMMVRACGRALLDRGLIKGRKVYALTADYAFGHDLLKQAKKYFAANDATLVGEDLIPTELTDFSPFLLKLRQAKPDLVICNLAGAQITNFLKQYSEFGLPFPVAGFGFDTALAWGAGPGNFLGTWPVIWHHQIDSPSAKKFVAAFKAKYKKPPENQGWGDYTAMKIVAQSMNELKSTESIKVVEHLESGAKFDIAKVREGYFRPWDHELMQEMFAITALPADQVKNPYDIFTSTGPLPGPGESLEVLATTRDENACTFPA

SEQ ID NO: 1542 - protein, 291 aa, Methylobacterium sp.
MQLVFILEQVLNGLLIGVQYLLIALGLSLIFSLGGIVNLAHGAFYAIGAYMTVLLTPTIGFGGALIASPLAVAVLGLLIERFLLRRFYRGDPTLGLLLTFGLAMVAEQALRMAFGAAPVPFGIPPWLRGQVFIGDLIYSRYRLSILVVALACVAGLWLLLTRTSFGRVVRAGVQNPDMVAALGISLRPYMTAVVTIAVGLAALAGTMMAPVTGVQPAMGAEILTFAFVVVVIGGLGSFWGVVLAALIVGVVRGLTAYAYPPATEAAVYALMVLVLLLRPRGLFGEHIARFE

SEQ ID NO: 1543 - protein, 1055 aa, Methylobacterium sp.
MPIEVEGPDGAINEFPDGTPDAVISKAMQSVYGAPKAAPATTGGLGDLVAVALSRAESAAGGLVERAAEKVGLGPKGPSPYQQSSDLDAQMRGVPAAPVTSKPQEGGERRSGALAGLFGVADQGVRGVAQGAATMAGLPVDLTTMVLNLTPGVAQLRTALGLTPNISKPFLGSDFNKSALDTANDATIGGINAATGANLDLPVREGANVFERAANRVGQEIGGAALPAGAAIGKAAQVGMEGARAIQNPIARHFVEQAAANPSKFLGREVGAAGVAGAGAAGVNELTRAAGVDEHGVGHAAGDLAGALGALGLYGIGSHAISKVGDVYGAITGSDRFANQVVRDAVVDRLATASGAPTVPVGKRDVFDMSDIVSAIERGRANPISDTVPGYQDTLADVTRNPGIAATEYGRRTSGSPTLAQRGVENEQAVNSAIDSLAPEGNAGALREVLAGWREQLQTGASAEAQAAQARFEEAASRLQAQMHPDARGQDIRAALEDAKAAARELERSHWVGVSTGDADIRPLVDAFGNVRSGLTQTARDLFDPSHLTGIPQRFVPAEAGAAADGAGAAGRAAMDGLDPSERAMAERLLGDRPAPAGAAAPEPEPVLVPLRETADLRSALAAEHRGALSTSNPVRARVIEQYISALDDYARQANPNVEAYDAARDFSRQLNDRFTRPQTDVAQVLDRNQGVYRQSDASVPGRFARPDTADQGGFEALMREAGTDPRARNAVADQIREAASAAQTPEAATRFMEEHSRVLDQFPELRTQLETRARTQRSANLAEERRAGLERELGTENTRGSSAVGQYLHYGTEQTSRAIQGVFSAAKPAEAARELLDFAGREKGAVDGMRRAIWEEAERVGRRKGETTASTDGVQPWMPGKLKAFVDKPNVRAVLQEAYRDEPEHLANLDKLAEVLQHTNVGARGKAPNSSGTAQGMMDTIRASVSPESIQSGVMSVKRGQIGVPWFVTSIAARLARNSVKAAQAGAINRMLDEALVNPEAAAALLRENNPVNRAYLSRSSKLWGIEHADQIASALNDNEEPDPVKDALKRSRR

SEQ ID NO: 1544 - protein, 95 aa, Methylobacterium sp.
MHIGRVAGATRNLGAPRDWDPAKDGICGGLPIRDEPHSPGVNRMVSAWLPTPEEIALIAAGAPIYLGVLGIEHPPVSLFVGNPPADDAAQPEERS

SEQ ID NO: 1545 - protein, 85 aa, Methylobacterium sp.
MSGTEDDPGIPGSAGAADPAGPGAAAPSRPVPVGGPGRPIDDGARDRIGRGLRLHYAGVLALPIPDRLRALLDELAAHSDTEASR

SEQ ID NO: 1546 - protein, 315 aa, Methylobacterium sp.
MRVLVTGAGDYLGRRLLEALRRDLPAGSPILGLDRSPPPPLDGVALKAVDPFDARDLAETVAAFDPTCVFHLAALASVAQSSETPSYAWRAELLGTLNLAEAVARTRAALVFLSSTVVYGEVFRACPRPDESVTPRPDTISGRTKNACEYILRDVLANARIKHLVLRPSNYIGAGQSETFVVASFAGQIARIERGLAPPSLEVGDLSAGRDFFDVADFTAACLRVIARIDDLPDGGIFNVGSGVVTPVSDILETLRGLTDARFDLRVAPGRVRPAGVRSEGCDPAAFGTATGWAPTIPLARSLATILAEARARLG

SEQ ID NO: 1547 - protein, 70 aa, Methylobacterium sp.
VLLVEEERPRWFGRGSGKPRWRNAKLLDFAEPELRPLMAMEKQHRAGGVTGQVRTLRPVPSAPAARAANG

SEQ ID NO: 1548 - protein, 64 aa, Methylobacterium sp.
MSETRPPYDPESYAAAAAALLGLTLDPAWIAPVTANLRVLAAAAELVEAFPLADEIDAAPRFEA

SEQ ID NO: 1549 - protein, 153 aa, Methylobacterium sp.
VDVTADQTLAQDLLKDLREAQAKLDAARAEAASLKVLLALRTHQHDQAWQEGQRLAAALAEAQTRAESATTARAETQANAAASEAAAMADERTEAVRTVLGAVLASIGPRALDRRRFQDLIARAGREAPDQGPGAARHAVLLTEARRVLGIAQ

SEQ ID NO: 1550 - protein, 228 aa, Methylobacterium sp.
VTESGPAAPVRPRAGQALRWLCAQALLQAGAVVAGFACFVLLFQTDLWSGVTILFYRGLILLAVAFLLTLTITAALTGLGRAWGLRRRDALGACVLSLSLNLSAFVILPVTVDRSISVFLLGQMAAHPGERFTPERARAVFERVYLGEFRQMERRLAEQQASGNVARAGDGYVITPQGSAFIRFCGLVARAFRTDTRMIAAAPSPPGGDDAEAPAGAPEPGPAGAVRR

SEQ ID NO: 1551 - protein, 78 aa, Methylobacterium sp.
MPGRPRRRHTTFLVSVTAEGAGAAPGATVYAVMKPSAEEALEAVRALADPSASLAIVGSLSTRIAKALKLKPDTPRVV

SEQ ID NO: 1552 - protein, 230 aa, Methylobacterium sp.
LDFAGGGSASAAELRRPRSLAETAYDAIEQMIISRRLAPGAMVSEGELGAELGLGRTPVREALARLKTIGFVEVHPRRGVLVTQVDIIRHLELLEVRRPLDETVARCAIARGTENDMARLLDRVGGLRRTAEARDREAYFRHKRALHEGLVGAAYNPTLAGTMAALHAQSRRFWYTYEPTASFPDCAAIHAAIVSGIAARDAGAALAGIGTLFDFLDRMTRRALDRRPLV

SEQ ID NO: 1553 - protein, 172 aa, Methylobacterium sp.
MNATFWAQLDARIARERGEPTEPAPGIADGPRMADAPSPAARSEASPEIDPETPSRPVADWSQILDTLSAASVAKQAQDQRLRQQSTACETLAADLEAAQQKIRTLRALLEEARAQAARQVHEREAEADRRVREAEARAEAATLRAAAAEDWLKRIEQASRDLLPDGRHAAA

SEQ ID NO: 1554 - protein, 183 aa, Methylobacterium sp.
MEQTKHPKAEALDQIDAVARDAREPTTRIRTGNLVLLAADERVSAQGRNQNPSPVERWPDLLERVQGAARYIRDVEDRAQEQETHVQDLLRQVRADMDAARAQVLAAERETHEVHAQAIKLIQAAEDRAAAAEERAAAAEQMLQRIAETIDAEFVMQPGGQVAGQAGSTQDARARASATRAAS

SEQ ID NO: 1555 - protein, 331 aa, Methylobacterium sp.
MSTNPRSSLRDWQPPPAYNVAATLLALAAAVGLAYLAFLYYAYTPWTRDGRVRVYTVQVAPEVSGTVVAVRVRDNQFVRKGDVLFTIDPGTFRNAVTQAEGALASARARAGYLAGIAQRTADLDDLATTPQQKQTTSGQAQAAQADVVQAEGALAQARLNLERTTLRATVNGWVTNLLLQEGGFAATGQPALTLVNGDSFWIEGYFEETQLPRIGAGDAARVSLMAWPDRPIRGRVTGLGRGISVADAAPGVQGLPTVNPIFTWVRLAQRVPIRIDLDDVPCPIVLAAGMTANVAILAEKAGSPDALPPDRRTGAAAGQRCDGAPVVESRR

SEQ ID NO: 1556 - protein, 55 aa, Methylobacterium sp.
MPRWLFILLATALALSVLGSVLIVLRSPNSTPPLRGAAAGAPVPGPQARPDSRSP

SEQ ID NO: 1557 - protein, 135 aa, Methylobacterium sp.
MIAERVALAGALLLLSITPAVPQLRRPMTCTVEASTSLDVAAPEGAKPQSQKARTFSLVSSGGLLTVISAGRSDYYECQTASPRLNERTPRNAIKCQNGVYFLLIDLNKMNFVEAQLNPEERNDVKVSYGNCRTL

SEQ ID NO: 1558 - protein, 45 aa, Methylobacterium sp.
VTLSLVLSTSLPLLTGAVALLWAGFVAPEREERPDVPGARDLRTW

SEQ ID NO: 1559 - protein, 165 aa, Methylobacterium sp.
MSAARAWAEPAAPHPLSDPALPRDGHADPIDRVVALFSGAAAASPAPASPAAEDDWSTSLTAVRGAAARVRALQASARDSVREAQSSVRAAETALRAAEERARHAEALLQAALARAERAEAQARASDERAERAEAQRAEARAWLRRMHECMVNEFGALSGAADQP

SEQ ID NO: 1560 - protein, 117 aa, Methylobacterium sp.
MVVLQEIAMAGNRMDEAWRPAFKTGQIFFGHPQECCDCLIWELRTSGARIEVQPEAVPPHAVRLVSIALLLNQACEVVAREGRTIELRFSPRPEPAGGAPGATRPVLGRTRFPPHRP

SEQ ID NO: 1561 - protein, 159 aa, Methylobacterium sp.
MNESVTLRRGAPADADVIRALVETAYTKWIPVIGRLPIPMRADYAQALRDHRFDLLLAGPDLAGLIETRTEADHLLVVNVAVHPAFQGRGFGSRLMGRADAVAAETGLARLRLYTNRKYTANLRLYGALGYRVEREEPYDGPGRTRDDDVTVHMVKDLV

SEQ ID NO: 1562 - protein, 152 aa, Methylobacterium sp.
MHIVIESNCRFDVGEDVRLSMANIYIGPGSVLRIGDRTGFTGLVHLNPVEGKVIEIGTDCSIASGVWMTTSDFHSIVTRDSGARLNPAKPVRVGNHVWIANQATLLKGTVIGDNAIVGAHAVVTGTVPAHCVAAGNPARIMRENVTWRSDLI

SEQ ID NO: 1563 - protein, 334 aa, Methylobacterium sp.
VSGAADGTPGPGLAGARCLVLGGGGFLGLNLCNRLAAAGAEVTCFSRSHPQAEVLDRRVARVSGQFSDRLALANAVERQDVVFHLIAGSIPESSNRDPSAELSAAPIATLHLLEICRSARIGKLVFASSGGAIYGIPAAIPIPEQAPTNPISAYGISKLMIEKSLHLYRHLHGIDYQILRIANPYGRFQLGTKHQGLIGSYIHRVLTDQPLEVWGTGAAVRDFLHIDDVSDAFLGAVGYRGPHKVLNVGSGQGLSVNEVIAELKAAFGRDHLTCVHRPSRAADVPANVLDTALIRAELGWQPRVPLQAGLTGTIAWMRVHLAQSWAAGAPSGAG

SEQ ID NO: 1564 - protein, 801 aa, Methylobacterium sp.
MQDGAGASAPGSTTAPPALEPWQDDFATIYASGLFDHIGYATRYPDVGLTDLSPLEHYVKYGARLGRWPRADFTAPPDETFDGSFVNPFVAWIQARAETQPAPAWNRPVVSVLCISYNQAAFIRQTLESILGQATDFPFELLVGDDRSTDGTAEIIAEYAARHPNLVAVLRSENLGPNRNFADLTARARGEFVAICEGDDYWTDPRKLQRQVDFLRARPEFTLCFHRVRVVYEDMPGVDELYPKQCSPQPSLSDLVAHNFVQTNSVLYRWRYHGEEAFVFDEGIAPGDWYVHLMHAEVGRVGFLPEVMAVYRKHAAGMWATYATELARHKKLGNSEIAFFRKLRGHFGGRYAAGYEAAQKSIFRRLAEAYLDEEDVPSLGRLIEANPDIARDALSDLGLDAPEVLTGDPDALRAWLMEQLTVSVIVTAYNQAADIGRCLDAVLGQRGLFRLQVVIGDDKSTDGTAEIVERYRARDPERIAVRPRPHNLGMLRNMQDCLAACTGRYIAFCEADDYWLSDRKVAMQMRMLRNDRKLDMCFNWVLLHYPATGSYVPHDEQGRYPTGPISFPVLANSPLTANFSCCFYRAEALRRVPEAYYANASAADWLMNLYVADKGRIAFLRELLSVYTVQEKGQWSGLPEDIKNARIAQYQKEFAAIFGEGRGFEKYEVGCTVAELDGELPDSFARANLEAPQDRVWAEIQDGQVVLAGWVVSASRAKATLIVEADGEVQRIPADVHRPDVIAAVLGDMPTTMEEARCGFRFTLPYALHLEVLLSIEVEHEVVPWLSVIFTHRVKRAAERG

SEQ ID NO: 1565 - protein, 397 aa, Methylobacterium sp.
MHRAEVLMRLRRRLRPRHTTLVSFAAKYHYVESQRRLVASAAATGNFDTIESWSPDRLRETPFYREHREILDRSRGAGNWAWKPYVIAEALEKRRDGDFVVFSDTGMQAVGDDPLPPVAPLLTWLDGSERRVAVGVLHGKPQRAWTKRDCFVLMECDAARYWDADQIQASWIAFMVSPATRRLVAEWLRYAGDARVVTDIPNQMGLPDLEGFIDHRFDQSILSNLIYKLDLEIPHLRQPSKQIRTLIDEMEMDTLVATRPSENIALGKTWTASSASPWSGTTGTYGARTTGDPSFFFHTGLDRNPWFVLDLGAVERVSEIRIYNRWGQLSERAQLMRVWLGETESDYHLVFDAVDAHCHPGLPLHLRFDNARFRYLKIDLDEEQHLHLDGIEVFAAR

SEQ ID NO: 1566 - protein, 62 aa, Methylobacterium sp.
VANESVEQAAEKTYFGLTLSQHADRIRKLATERGLTGETFDRVTAQAVAMIPTIKVTDAAQR

SEQ ID NO: 1567 - protein, 128 aa, Methylobacterium sp.
MNPTVKAVLLNERASVLSAIAARQGTVSDLLVQINGVENDIWRLRHRLIDIEAYLVGHRVELPDLGEGQTETADGTDVLVPRNAPQAATRSVEVIGLPTCKPLGDFVRPKTSARKAQAAAGPRQVETA

SEQ ID NO: 1568 - protein, 253 aa, Methylobacterium sp.
VIALSAIEKRFGDNPVLRGVDLAVPEGRVTALIGPSGSGKSTLLRCANLLEVPQAGSLTLGEIRLTFRPGSPPARRDVLAVRRQTGMVFQNFQLFPHRTVMENVTEGLVTVGKWPQDRARARALELLERVGLAHKAADWPASLSGGQQQRVAIARALAPSPRLLLCDEPTSALDPELAAEVVDVLAGLASEGTTMLMATHDLRLARRVADTVVFLEGGQIVEQGAAADVFARPADPRTRRFVRTLLGEAAEGA

SEQ ID NO: 1569 - protein, 72 aa, Methylobacterium sp.
MPRPFEPYADALRTAREIVREQAGTVVEAAVRADSHAYDEACHVLVVRIAQAIVDAGEAGSGHGLGRGSEAA

SEQ ID NO: 1570 - protein, 327 aa, Methylobacterium sp.
MALRTRLTDAFGLRQPIVLAPMDPASGGALAAAVSAAGGLGLIGGGYGDHATLDREFARAGNQRVGCGFITWSMARDPSLLDAALARSPAALMLSFADPAPFADRIRAAGVPLICQVHTLAHARRALEVGAAVVVAQGTEAGGHGLTARGTAAFVPAVADLIARERPETLLLAAGGIADGRGLAAALALGADGVLMGTRFWASREALIHPAAKQRVLAATGDDTIRTQVYDIARQRAWPAPYTGRLLRNTFIETWHGREDALRAASGDRRRDVEDADAAGDYDVANVTVGEAVGLIDDLPGAGDLVLRIAEEAEAAIRRISGMAAAP

SEQ ID NO: 1571 - protein, 68 aa, Methylobacterium sp.
MGATGGHLYTVEVRPSRHDPGRFTWAIRDRGKLVRGSYRPHTSEHAARAVAEAEVERLIGQDGRSGGA

SEQ ID NO: 1572 - protein, 428 aa, Methylobacterium sp.
MDRTVNRTNLPLSRERLWDSLMELARIGALPNGGNDRQALTDRDAEGRALFQRWGEAAGLTLTVDRVGTMVFHRPGRDPGRKPVAVGSHLDTQPTGGKFDGPLGVLAGLEIMRALQEAGIETEAPLLLINWCNEEGARFAPPMSGSGVAMGIVPEADILATRDLAGHAFGDELRRIGWEGTADPAALREIGAYFELHIEQGKRLEEAGLAIGVVDRALAQIWYEITVLGEEAHAGSPMAGRRDAMMAAAALITSLEGIAEAAVGAGAERGRATVGVLRAEPASRNITPGRVWFSLDTRHGDTAQLEAMGARIRARADALAAERGVTVQVAEFWRAPPTPFDPVLVDRVQAAAEARGHAWTRMPTAIYHDAVYCARAVPAALVFCPCHGGISHNEAESITPAWAGAGLEVLADAVLATAGLAGPRTGPE

SEQ ID NO: 1573 - protein, 104 aa, Methylobacterium sp.
MVRIGTVSRLGPTQVRSTRRAPVPDADASPETARTEVQALALIDGGRSDEPPAPRTAERAAAGRPRAGFIAQLLTAGDPTLLPSRLERTRMAAARYAEAARRLA

SEQ ID NO: 1574 - protein, 59 aa, Methylobacterium sp.
MAATDPRETAKIYDLSAFRRARETARAAPEAKPAPVPSFGGGAWYHEAAIREDERPRRS

SEQ ID NO: 1575 - protein, 204 aa, Methylobacterium sp.
MNRPINPALYRRPRSVPALVLVDMQQEYEIAGRPLALAGIEPALSNCRRALAHARASGMQVVYVRWIGAPLFQAGSRFVRWIEGFEPHGCDMIFDRDRPSCYASPAFADAMERGSPPLVIAGFAGESSCLATAVDGFHRGQDVTFLSDASASHDLDGISADVIHRSVSAVMRVFGDVTDTQSWIAATAPFEPMPAASRPTHAND

SEQ ID NO: 1576 - protein, 71 aa, Methylobacterium sp.
MTDRSQNHGIPDGVPAGDDDVDLRLGRHAIELLQAAREAGEPTLIAQAEAMAMTVGFVLASRLPGGTPETA

SEQ ID NO: 1577 - protein, 59 aa, Methylobacterium sp.
MDAFDHANIARDADETVDSPLEDELVVLWRALAADRRAQDERTARLRAMRLIGGEDGAD

SEQ ID NO: 1578 - protein, 75 aa, Methylobacterium sp.
MASTLELDGLNELRDALIEERQVIVASVRKLRDARRQKGTFVLGDGADAGPRLVAVQEQIVVVESIIAALTRSRA

SEQ ID NO: 1579 - protein, 340 aa, Methylobacterium sp.
MAHRPPDDSADARRRKFLQSFQNFDANSRFPAPYAQFAGKPLTEVSGQGWRYDALGYRNDAHADARPPSETLRVFVVGDSTLIDGQVFADTVPGRLETGLKQAHGPGARVYNFGAVSACLNQMIALITTRLMDLQPDVILVVGGATDIFQPWSFDPRAGVPYNHFANESLYDYFFDPRKSAEDAEDLSYDGLQAMIFNRLENLRALTNWQSDIWEWEGVRQFELALRRLARLAPGIGAPVRFLLQPTVVRKGTLAGAEAGAASGAFLAYLDRQYERFESVLGRLDTTDRAFAARDLSRLFEADTRALFTDIVHVTSEGRQVMADRLQAEVVETVGAATVA

SEQ ID NO: 1580 - protein, 370 aa, Methylobacterium sp.
MPAGNREKVQILYLQPGTSVFAGIERVVDTIGAELAQKCGTEFAVDVLRVTQHANYPAEPRHYRSVFRPVTSRLHLLRIFRDVSKGGRYDLVIVPQIEPTVIFWLARLGIPQRITMHLHGNPRRESASLKSKVKFFLLKHYILPRIASVFGTSPRQLRAFEADFNCRRPMYWVPNPVRHFEVSDADIRPDPAVITFVNVGRYAFQKGQDLLVRAFARLYERRRNVRLNLVGHGSDKAALAEQIQALGLSEIVRLVHCPDNPQRALFASDVFVATSRWEGWSLAICEALRCGLPVISTDCEFGPSDILVDRRLGRLIPPDDEEALIESMEYYCDNIVVERSFSEFRKHHIDQYSAERIVHIHADAIRQSAC

SEQ ID NO: 1581 - protein, 436 aa, Methylobacterium sp.
MRLLRSIYGQVLLGIALGIGVGVVAPDFAVGCKILGDMFINLIKMIVAPVIFCTVVVGIAHVGDMKSVGRMGLKTILYFEVATTVALAAGLLFVNLLRPGDGVNATVDSLDAKLVAGIAGKAHAQSPMEIVANIIPHSAVDAFAKGDLIQVMFFSVLVGMGLAMLGRRGEFPLKVVHAFGDVLMKVVGLIMHFAPIGAFGAMAFTIGKFGLGILAQYGMLIVSLYLTFIVFIAVFLGGVMRFYVGLSLWKLFRYSREELFILLGTTSSESVLPRIMAKLNGLGVDKSVTGLVMPAGLSFNMDGSCIYLTMAIGFIAQALNVPLTWEQELGILAIALVTSKGVAGVAGAILFVLAATLQASQLLPVAGIALIIGVDRILNELRCVTNAVGNMVATLVIARWEGKIDLAHARAVLDGRITPNLDLLDDEDEVADAIPA

SEQ ID NO: 1582 - protein, 334 aa, Methylobacterium sp.
MRRRDVLAGAAALLAGPVPGRAQEVGAVAIARQPSLGHLPLMLMEEQGLLQKAAAARGVAGLQARYLTLAGGAAMNDALLSGTIQFAAGGVPPLVLLWSKTEGTAMAVKGVAAMNSMPLLMNTSNPKVHRLADFTDRDKIALPAVKVSVQAMFLQMAAEKELGAGRRNDLDRLTVTLSHPDGMAALLGGSEVTAHFTAAPIQELELRRPGIRTVLNSFDVLGEPSTFNVVWASSAFAGANPRVVAAFGAALDDALAAITADPSEAARAYVRLARDGSDVGLITEILKDPQVTFTATPRAVGKVADFMARTGTIRRRPESWKDLFFAGVHDKAGS

SEQ ID NO: 1583 - protein, 180 aa, Methylobacterium sp.
LGLIRASAPARPRIRPGSAAFSALLGLLAALPTFGIDMILPSLSDTAAALHVPATAMGAAMGVYLLGFGGALLVYGPVSDRLGRKPAIVCGCLLLVVGSLGCGAARTLPDFLLFRALQGIGAAGPGMAVLAMVRDLFEGEAARARMSFVVLTINVVPMVAPTVGAGLMDLGGWRLIHAAP

SEQ ID NO: 1584 - protein, 235 aa, Methylobacterium sp.
APVAAALAALVAIRHIDEPLRRSAGAGPASGILRGYGRILASRVFLGHALCNAAAAGAVFAYITGSALVFIDALGLSPLAYGLVFGASSLSMMVGAFLNGRLAARGAPPPRVIAAGLVLATGAASLLLVAALARPPAAGPVVAAMVGVALAFGLVSPNAMHGATERSLDDAGAASAVAVFLQMLGAAVASDLVARFFDGRSALSMAAVMLGCCLAAAAAHAGLARPATRAPSQPH

SEQ ID NO: 1585 - protein, 248 aa, Methylobacterium sp.
MNTILITGCSSGFGLETARTFLERGWHVVATMRGPRSDLLAPSDRLSLLPLDVTDPDSIARAVAAAGPVDALVNNAGVGLLNALEGVSMDAAREVFETNTLGTIAMTRAVLPQFRARRAGVVVNVTSSVTQRPLHLLSVYSASKAAVNAFTESLALELEPFGIRARLVIPGRAPKTAFGANARARMGMDIPEAYAAVAAKVFAGIQQADGDLTRSSDVAEAVWRAVTDPSCPMRLPAGADAVAWAKAG

SEQ ID NO: 1586 - protein, 301 aa, Methylobacterium sp.
MTDPLTQVVGLLRPSAPLSKLVTGSGHWAVRRTDSGLPFYAAVLEGGCRLAIDGEAGIVLGEGDFVLIPAAHAFTTTSLEPPTLRRTAQRPVAVSPGVFRLGDAEGPPNVRMLVGHCVFASSDADLLVSLLPRYVHVRGAARLATLLGLLNEETRADRPGRDVVLARLLEVVLIEALRATAGPAAPSGLLRGLADDRLAAALRRMHDRPTASWTVAALAREAGLSRSTFFERFRRAVGVAPMEYLLAWRMALAKDLLSREAVGMAEVAARVGYSSASTFSVAFARHVGRPPIRYAREWQAR

SEQ ID NO: 1587 - protein, 67 aa, Methylobacterium sp.
MTHPAKPLTGAVPGSTPDRRAAADHSAPHALLHGAAFVLLCLWTRTAPERLRDQLSPDAGDGAALGF

SEQ ID NO: 1588 - protein, 76 aa, Methylobacterium sp.
MTAKAKVKTGDDVTYKWGKGTVSGEVTKVHTQDVEKTIKGNTVKREASKAEPALEIRTAKGKTVLKSASEVRVKSA

SEQ ID NO: 1589 - protein, 33 aa, Methylobacterium sp.
MHWSSLVIAAYAAGFVEFWRLCLQAPAAEEDPA

SEQ ID NO: 1590 - protein, 341 aa, Methylobacterium sp.
VRSLEASSPVPEVCVIIAARDAADTIATAVASALRQPEVAEVIVVDDASADPTGAAAAAADDGTGRLRVIRLAENVGPAEARNRAIAAARAPLLCILDADDYFLEGRLGRLLSAPRTWDLIADDIVMVRGREAASAAGLVTGPGRPQRLTLAAFVTGNIPRPGASRRELGFLKPIMRRGFLDRQGLRYDARLRLGEDYALYVEALAAGAVFAVTAPCGYVAVERSNSLSAQHRTDDLGAMLAFDDAMLGRPGLAPEARAALRAHRAATARRWQHRRVLDRRRAQGYAAALRELLGTPLAWRHILSVTLAAKLARLVPASKPERETGPRLLLGPERRLEPAR

SEQ ID NO: 1591 - protein, 101 aa, Methylobacterium sp.
MGSDNCDRGARSADVALEVLVRAYHALAVVYELSSPGAYTALHGKMMPYLLDSFRHGTAPDAVDPDLDATFSTALERVRSALDEVRSDVAAVRARREERDR

SEQ ID NO: 1592 - protein, 101 aa, Methylobacterium sp.
VSPPDAGHSEVSTTLALDMVGRAYLALALLYETAHPGEFVDVQQKIRAFVEDNFRIIQETSRDESLTTGTVDGALHLVNSVLVEVETKIATMIRPARHLRG

SEQ ID NO: 1593 - protein, 73 aa, Methylobacterium sp.
LAARFYFEIANAEETIHDHVGVEAAGLEEALIEARSVIAEMADEITGNGREPPWTLLVRNEEGWLVGRLPIRK

SEQ ID NO: 1594 - protein, 326 aa, Methylobacterium sp.
MGRSLLQFRAPDGQRGVALLADGWARRVLGVDSVLALARRALAAGDDLAATAERAGLGAPVDLDAVRLLPPVDHADPAHLLLSGTGLTHLGSAEGRDAMHRAAAADPAPTDSMRMFRMGVEGGKPAPGETGAQPEWFYKGDGSGLVACGEPLVSPAFARDGGEEPEIAGIYLIDADGTPVRLGFALANEFSDHVTERGNYLWLAHSKLRPAALGPELWLGALPPDVRGTSRILRDGAVLWEKPFLSGEANMSHSIANLERHHFKYAPFRRPGDVHAHFFGTATLSFSDGVATRPGDVFEIAAAPFTLPLRNPLAIAPADAPSVRVL

SEQ ID NO: 1595 - protein, 308 aa, Methylobacterium sp.
MAAPIRIGLVGVGKIARDQHLPAIAASPDYALVAVASRHGGLDGVPSYGSLEAMLAAHGDLDAVALCQPPQARFAAALAAIAAGRHVFLEKPPGATLAEVGLLVAAARDRGVSLFASWHSRYAPGVEPARRWLSGRRIRSVAIAWLEDVRHWHPGQDWIWDAGGMGVFDPGINALSIATHILPPFYLTGATLSVPVNRQAPIAADLHFADAAGTPIGARFDWRQTGPQTWDIRVETDDGPLVLSRGGAALSIAGRDQPLPPEAEYRGLYDRFAALVRSGTSDVDLNPLIHAADAFMRGERRAVEAFTD

SEQ ID NO: 1596 - protein, 108 aa, Methylobacterium sp.
MTDIPAPPPGPADAATRAATQAATEAATELGLGTDWAALGAPDWDRVCRRAGAILAGQGQAPAPGWDGALARALGRPDPAAARDELARDAANTVLAEKGEVFAPEDDA

SEQ ID NO: 1597 - protein, 54 aa, Methylobacterium sp.
VDVFFDPDPRDDRSMTEELLTLWFSIKDPGARHRILDCARAAKAEVGAEAQPRP

SEQ ID NO: 1598 - protein, 66 aa, Methylobacterium sp.
VQFEIRERSRSLWSWVLVNETDEPVLESRRSFPSRAQATAAALAFSQLVSRAGRSLGGGPRQVGFL

SEQ ID NO: 1599 - protein, 55 aa, Methylobacterium sp.
MTLLFVFLLLPLAVAIVLARGEPIRTISCLGAMGVGCVIAATSLVSLVRHRIRTT

SEQ ID NO: 1600 - protein, 326 aa, Methylobacterium sp.
LRPGGRRLAGARLATALMLATMTLATVTLAPVAARADEVVLRVGDQKGGNRSLLEIAGYAKDLPYRIAWSEFPAAAPILEALNAGALDVGYTGDLSFLTVVAAGAPIKAIGGTKSDPRTQAILVRAESPIRSAADLKGKRLAGTRGGWGQFLISATLEKAGIAPSEATFAPLNPVDAKVALMAGSVDAWAVWEPYVAFATLKDKARPIADGAGLTPTITFIVASDSAIATKRAALQDFLSRLNRARLWSLDHLDAYARNTAALTKMPEDVLRAAYTAQRTRPIALDEGVVKEVQDASDRATRYGILSKTLDIGRAVDRSFTEAASN

SEQ ID NO: 1601 - protein, 319 aa, Methylobacterium sp.
LKTSGNGVAVGHDGWLYWVGRAREVEAFYGDTATSRRILKRWTRLIGRRARRLDDLGIRHVHTVVPDKLAIYPDLLGRPFPGLDDPPGVRLARQVAGDSGAAMVDLQAPLLAARAEEPVYLRTDTHWTYRGYLTAYRALCEALDAPAAAHVFAGTGATERFTFDLGEKLVPPVDEAYIAYDFPRCATRIDANALVAVRESGRAVRPRGLFVGSRVVLRNAEAPDPRRVVLFGDSYIYSPGARLTAMLAETFAEVHAIWSANIDWSYVEDVRPDIVIFEIAERFLRQVPNDRIRIDRFAAARARRAVRPTLRERIRRWLR

SEQ ID NO: 1602 - protein, 96 aa, Methylobacterium sp.
VSRNASTPAAVAERRATERRPTALLAFAQQRDGARYPCQVMNISDRGAMLEFLGSQAVLLEDVFDLVLASAEMRYAVQLVWRKERTVGVLFCGEAV

SEQ ID NO: 1603 - protein, 347 aa, Methylobacterium sp.
MRIRPGTALMACFAIGVPTVAAAEAPGQPPRAAPATDPASAPQPWPPNFSRSVQGTGVMGLDGGHVFLWNRPQGFDPVSTLRVDRHVPEGSGEATHTYKALWALGSTGPHNAGYEWTITGELHNRALASTGAQNVAVNGTIFKEPNGLGPVGPSWAGNFNCVDMTDEADPVASCIGAEIDVSAQSPTTDRNRQRVGLQISTGGVPGAHTGYGILMGNLTGSITDRAISFQGEGTYGIGIDAAAARFTGVPMLLAAGQAIGLDGDREGGFSRSLGFDGRDLVYGTAAGPVMRVSDNGQIVAASLRESLPRPPASSRAPCTPGDHAWDESYEYRCVAPDRWKRAALSDW

SEQ ID NO: 1604 - protein, 113 aa, Methylobacterium sp.
MSTRASLAAALGFAALFTGSALAQAVIVTPDEFGPDDDVVVRDYIVRRPVGPGPIVGSIPLRPGSIVPPDVRLAPFTEAPNPRLRRFGYFVAPGDKIVVVDPDTRAVVRILDR

SEQ ID NO: 1605 - protein, 245 aa, Methylobacterium sp.
MAALFGDPLAPRYLAWLLQGFGMTLTLSATTCLAGTVLGLAACGLREAGGRAGRGVVAVSVGIVRNTPLLVQLFVWYFAVAAALPEGVTAWLNAPHVMDLGSGILRWPAYESLAGFCGLTLYAGAYIAEELRAGIGAVRPAQRAAALALGLTPVQAFRHIILPQALRVAWLPIVGQYLNTLKNTSLTMTIGLAELSYASRQVETETFQTFQAFGIATLLYVGAAAAAETTGQILERRARRPGRHR

SEQ ID NO: 1606 - protein, 231 aa, Methylobacterium sp.
MNPSVIIDNLGYLLVGAWPDGPVGGLALTLILSGLSGLASAALGLILGIALAVSAGAARAALTAGLGFLRAVPVVMLIFWAYFLLPILFGVSIPEIGTVAAALSLVGGAYLSHGVAAGIASVGRGQWEAGLALGLDPWRTLRFVVLPQALRAMAPSFVNQWTTLIKDTSLAYVIGVPELAFVAAQVNNRAMVYPAEIFLFVGAVYGILCAGLDGLAARLTDLGKAAAHRTP

SEQ ID NO: 1607 - protein, 88 aa, Methylobacterium sp.
MRYFTDFTDDRGLSLDEEGLSFADRHEACLSATEALIEAVHDRLRLRADRPAPGDAGLVLEARVRDATGSTVFRARLTLDLDWQPADG

SEQ ID NO: 1608 - protein, 123 aa, Methylobacterium sp.
MSRHALIPGRAILATALLLSLAAAPSAAQSQGDALNADDGTGAVKVCSPVAMPRWRSMTPVPKTWTFLDCMGFAGEMGATHFQLGCLFANVTPHAQKYAWGAMVPIEKSAMAKAQPPIPNCGW

SEQ ID NO: 1609 - protein, 114 aa, Methylobacterium sp.
MQRPPALPLSPVASGFGTPLRRFGIASRAAQTLGIEYLDSVKKALDDLGATWGALAAARSPTEILAVQAAYLQRAGERAAVRSAAAGDAMLGLTGALLRPKAVAPAAARPGPAR

SEQ ID NO: 1610 - protein, 113 aa, Methylobacterium sp.
MIRIIAVILAGMASVSAAVSTARAADLARFEGAGPGPGRWHHGAGGRIAGTVAARGRPQYSYYGEYGYPGPFGYGYAYAPVPSRGFEYGYSGPRYVWTAPDSYSGPAFGYHVW

SEQ ID NO: 1611 - protein, 470 aa, Methylobacterium sp.
MTTAATDALWQAPITELARRIAARELSSAELVGASLDRIARLDGALNSVVHLSPAALDAARAADAEIARTGPRGPLHGIPIAIKDNYTTADMPTRAGTAVEALTFPAADSHAVARLRAAGAVILGKTRMHEFAWGMVTPPTRNPWDPDRVPGGSSGGSGAAVAARLCPAALGSDTGGSIRIPAALCGIVGLKPTYGRVGRSGIVPHSWSLDHAGPLTLTVADSALLLQALAGPDAGDPAASAAPVPDYTAGLDRPIRGLRVAVIRNHFFDTIDDDVAAGVEAALRFLEDRGCTVRDVAVPSLRHGLGAIYAIELASSTAYHDRSLARGHVAGFAADVRDLVEMGRLVTGPDYLRAEQVRALIMDEMAAVLAEADVIVGPASPLTAWRTDESAVSLGGRAESVLAASWRLTYPFNLAGLPAIALPCGFDRRGLPISLQIAARPFAEAEILRVAHQYERAHAWWSRVPPLAG

SEQ ID NO: 1612 - protein, 380 aa, Methylobacterium sp.
VAILGTRGVPAAHGGFETLAERLALELVARGWRVEVYCQVREPATPMVWRGILLIPVAVRGDGAVSTIVFDLKCTLRAAFRPALPLVLGYNTAVFSLLYRLTAKRSVMNMDGIEWKRDRWSKPAKAWFWLNERLGSLFSTHLVADHPEIARHLARRTSAARITTIAYGADPVLEASTEPLVKFGLRPRDYGLLIARVVPENLVLQIVRAWSEVRPGLLLLVLGKLAESDPYHRAVRAAGGPDVIFAGAIYEAERVAALRFHARFHIHGHTVGGTNPSLVEALGAGSPILAHDNPFNRWVAGPQALYFGDETELRRGILGLVRAGPRRLEVMGEASRRRHAEAFTWRGIFDAYERVLRRQLAPRRQGREARPAVRREHGRA

SEQ ID NO: 1613 - protein, 376 aa, Methylobacterium sp.
VETVHSGGRPLTRAALAGRRRALEDGRTVSRRELSAAGRDAAKALNLRPALRSILSALCAVWGEQEWERLVVWPSNEHLCGMTGLSERALRYGLRDLVALEIITPRDSANGKRFAIRGPGGAVIDAYGFDLTPVVARKGEWATAIMEATARDAQRGRAFDLLTVRRRAVSEALAALRARFPATDAADLLAAQEALERSTPRRRASGADPDVVLDAWGELQVMAEDRFYQAASAGNSSRHIEQDTGSPTDPCAKAPGKEPEPTRRLEPSLVAAACPVAAEFGVTLRTEADVIEIGRLMRGGIGAHPSAWSEACKALGPFQASVLVLIVAQLHDDDVRRGEIRIRNPGGYFRQLVRLCSEGRYGLEAELMAMRRRKMT

SEQ ID NO: 1614 - protein, 338 aa, Methylobacterium sp.
MKTIGFLSFGHWSPTGGSATRSAADTLLQSIDLAVAAEELGTDGAYFRVHHFARQLASPFPLLAAVGARTKRIEIGTGVIDMRYENPFSMVENAGAADLIAGGRLQLGLSRGSPEQVIDGWRHFGFAPAEGETDADMGRRHTEVFLDLLKGTGFAAPNPRPMFANPPGLLCLEPHSEGLRDRIWWGSASDATAIWAAQQGMNLQSSTLKAEETGEPFHVQQARQIRRYRQAWQDAGHARTPRVSVSRSIFALVNDLDRAYFGRGTSSDQVGIIDNMRAVFGRSYAAEPDRLVDELRADAAIAEADTLLLTVPNQLGVAYNAHLIESLLTHVAPALGWR

SEQ ID NO: 1615 - protein, 65 aa, Methylobacterium sp.
MPSETNRAMQGAPAREPILELWRILALALIVAAGMLFVHLVVPAEADASAAPLTTVQKTGSHTLR

SEQ ID NO: 1616 - protein, 70 aa, Methylobacterium sp.
MFESVFWGAVLVALIGSAALVAIGASVQPRLGRKMEMDARLADPRRTFGRKRRWARPPRTMRRPGLLPMR

SEQ ID NO: 1617 - protein, 85 aa, Methylobacterium sp.
MSVRQICDQVRIAEQAFTAALGNMKAAGLRESLTRELQEMESAEIDAGQDAAAARSASWKRVKMLHGLGYPVDFGWLHAAASPVR

SEQ ID NO: 1618 - protein, 268 aa, Methylobacterium sp.
VETASDGTLSSSLAFMLPGTPRAEVEAVFKAEGQPAEAVPIPTNPSLVRIGSEVILIDAGSGNSFQPTAGKLGETLESRNISREAITQVVFTHAHPDHLWGAVDDFDDSERFPNARYVVPAEEWDFWTREDVETLVPDWLKGLSAGSRRILRRLEAKVERRKPGESIAPGLSYVASPGHTPGHASVLVEARGEQVLIGGDALSHAVLSFRRPAWAFGSDLDRDLAASTRLALLDRLATERMMLVGFHLPGSGVGRVERAGHSYRFIQT

SEQ ID NO: 1619 - protein, 680 aa, Methylobacterium sp.
MAGGVTFDPAEFEAFKQSAGAPSAPATSGFDPAEFAAYKAAQTGTDTGREAGAMNAAARGFVDGIPVAGPYILGGIDRADAALRSYQGGTDYGSEVAKAQRYGADVKAAHPYANTAGEVAGGIAGTAPLIAAAPAAFGAGTGGLIGRSLISAASGSALGGADAAVRNDGDLIAARNGAIAGGALGVAAPASGAALGTGIRNFYEMIGSRLGPSSGFGPAATRVLAEDAANSGGVPQIRSRMGELGSDAMLLDSSPSFQGQAQGLAVRPETREAVTAPIVSRAAGMTDRLATDINGAFGPAVSPQTATSAFASARQIPNQAIGDAVRGAGPIDTTDVLANLADRLRTAEGPQRAALMQARNMLMTEHPLTGAAIPQTSAENLQNAKVALSGMMEHGAESLGVPRGSVAQREGGLGATVADLNRALRDQVPGYGAANDVSAALARRMEAVEAGSQLLRGGQGATPPADLAARFAGMSQGDRDAMAVGTRGAIDQAVGTRRNDLTAMQNLLQGEGGWNTANLARVHGQAPVDRIVGAVNREAAFDQANRRIVEGSQTAQRTQAADRVAPRTTLGNDIGGTVAGAIGGPAGWLAAQGGRVARFGINAAGQAADIARNRQLADAVTLTQGDRLNTLLNAIEARGAMQQRAAVLGNVAGRGAQAALLSQSERARPYLPAALPAFSR

SEQ ID NO: 1620 - protein, 282 aa, Methylobacterium sp.
MDDQDKQFITQQILDVGRQLYAALDSKIMTAHAQQLAQMQDVRRLAVVQLAPKNDFCLVTDHPIAYESNDHTVPRGTKDDNTRNQRFCHAVESHFGRKVRALDLGCAGGGLVFDFLIRGNAAFGIEGSDYSLRAQRAEWSIIPDYLKTCDITKPFALMDQRSGTKAKFDVITMWEVLEHIEESLLPQLFANVKSHLADGGLFVGSAATYDDVANGVSYHPTVKPETWWRELVRQHGLEFVPMTMFQFKDFCRGSGNENAFYDADFSKNPELGFHFVMKHRPA

SEQ ID NO: 1621 - protein, 354 aa, Methylobacterium sp.
MIRVLCLGYSVTELPGYVERANALAEAEGRPVTFLRSGWGGHSLPSIAALIDEILDALPCDRVLLELFTGNVRYFDGATMRAYLDDILAATARRDLPVAFLNLHQGGVDYGAEPVAGLLAEYRALYGIPYLDIAAPVAAAGAGDITYLLKDATHVTPAGADLYGTLVYSFLRAPPPGDAYIDRFRTLPGRFEVLPLRALPGLTCGFTLRRNGIPLDFLEIPEGTRVAVPLGRPRDVIGLLVTYGPQAGTLTVENPATGRARTLVAYDEFSYYTRAMFRSVTLPAARALTIAQSAARPDIVLRKGAPDPGPRIGRVSHVVCRRRLGLAPRAVRELHRLRRGLRRVGLRLGLVRGV

SEQ ID NO: 1622 - protein, 350 aa, Methylobacterium sp.
MTASAALKDPRRYFEAIGADRASEALAPPVCLYLEVTNRCNLLCETCPRTFETLEPPADMSWDLFTRIVDQVPNVARVVLHGVGEPMLVKDLPRMVRYLKDRGTYVLFNTNGTLMQPKRFRELIDTGLDELRVSLDAADRASYRRVRGKDFFDRIVRDVGKFVAFQKASGATTPRVSLWLTGLKETVDQLPAFVRLAAEMGVTEVHLQRLVFDEAGYGMARADLSLFESARAEETAAIAEAEALGRSLGVTLDASGATEPGISLKRQEDRAWATCRRPWSLMYVTAHGRALPCCIAPFSVRGYSNYTLGDATQATLREIWNGAAYRDFRTSLLSDVPPAPCRNCGLRWSL

SEQ ID NO: 1623 - protein, 87 aa, Methylobacterium sp.
AEPRRAAGPLPWTLRVAGLVGIVAVIGAYQLARLSRPDAPTPGTALATAALPPMAEPETTGAIAAARSARTTRLDPCVASAGDRLRP

SEQ ID NO: 1624 - protein, 123 aa, Methylobacterium sp.
MTRIALLSAAALIGAGTLASTAAEARGGGAIAAGIIGGLAAGALIGAATQAHAAPGYGYGNADYGYAPAPVVVRPAPVYRVYEEDAPVYATRRTVTYERVPVGYGPARHWGGDYEGGYGYRGW

SEQ ID NO: 1625 - protein, 215 aa, Methylobacterium sp.
MTLRRRALPLAALALALPLATPLATVAARAQDRLPTIPPQDYTPEQKQAAEAFAQARGKPPFGPFEPLMYSPEVMTLARSMGDYLRFKPKIGTTLSELVILMTARRWTQDYEWYVHAPIAEKAGISADIIAAIRDGRRPAKMSDDETLVYDFTAELQDTKRVSDATFARAEARFGKPGVVDLAAISGYYTFLAMELNAARYPIPADGKPLPRMPE

SEQ ID NO: 1626 - protein, 376 aa, Methylobacterium sp.
MAVTAGDAAARPEPPSTVTSPPRDFRPGAAPTTYFTDPDIVTVDPAFEPYIVPNSAIRRLWTGALWAEGPAWNAVGRYLVWSDIPNNRQMRWLEEDGHVSTFRMPSNNSNGNSFDRQGRQLTCEHATGRVVRYELDGSATVLADSFEGKPLNSPNDAVQHPDGAYWFSDPPYGALLYEGLPDAAGGPSNRQGHLDPRLGQPAGTVPRRRVLPNAVYRIDPSGRVDRVLTDDEVPDPNGLCFSPDHRTLYVCSTGKGPGDTGPGGKGEIYAFDVGAGAALSNKRLFSDCVVDGVKCGPDGLRSDVDGNLWVSSNAGRAVGYNGVTVWTPQGKLIGRIRLPEVCGNLTFGGPKRNRLFMAASQSLYALTVNTQGAGPA

SEQ ID NO: 1627 - protein, 149 aa, Methylobacterium sp.
MTSVASAETLPARKAGLWESKTTSPDGNTTARQCIDEKTDQIAQAAFGGGQNCAKRTIVKTSTGYKGETECKLGPISAAGTTEISGDFNSKIHMEVDTTLTGMPNAKEPVRRQMVIDATYIGPCAAGQSPGDIILPDGKIVKMPQPTAR

SEQ ID NO: 1628 - protein, 304 aa, Methylobacterium sp.
MSYPARVQVIEVGPRDGLQNEPAPVPIAARVALIEALAEAGLTRIEAGSFVSPRWVPQMAETAEVLARLRPRPEVGYSVLVPNLQGLERALASGVRDIAVFAAASESFSRRNVNGSIAETLDRFAPVLEAARANDLRVRGYVSCVLGCPYEGDVAPAAVARVAASLHAMGCHEIALGDTIGTGTPRAARRLVERVAADVPLQAIALHFHDTYGQALANILACLELGVSAVDAAVAGLGGCPYAPGAAGNVATEDVVYMLRGMGIETGIDLDALAAAGRSIASQLGREPASKVARALAAAPPPTP

SEQ ID NO: 1629 - protein, 132 aa, Methylobacterium sp.
MSEITEAAPAAEPDYDRLLRANLRRVFNERDADARAAALDEFYVAEPILFEPDNVVRGRAAIGAVAGTLLDRFGPTFRFVPVGRGVGHHGMGSLRWEAGPEGGPVAVTGTDVAEIVDGRIGRLWVLLDPPAT

SEQ ID NO: 1630 - protein, 177 aa, Methylobacterium sp.
VFIGDSITAAWGAVRAETFARHGFVARGVPGETSGQIRARFLRDTAGARGVHLLCGINDIAEIGGPVTDRAIAGNIVAMGRMAFAAGLPLTIGTVMPSDFWGWRPELRPVARIRALNGWLRAYCAAGPARLVDYGPPLATEAGALRRDFTDDGIHLNGAGYAAVEPAMLRALGAVPE

SEQ ID NO: 1631 - protein, 386 aa, Methylobacterium sp.
VSAAARSGTLPAVFMRGGTSKALMLHRRDVPGDLAAWEPAFLSAMDSPDPFGRQLNGMGGGVSSVSKICVVERSARPDADIDYTFVQVVVRDGRIDLSGNCGNMLAAVGPFAVDEGLVDVPDGPVRLRIFNTNTRKLIVAGFAAAGGRSVYRGDLAIPGVTGTGAPIQLDFLDPGGATTGRLLPTGAVRQWLDVPGLGAIEASLIDAANACVFVRAADLGLAGTELPAALEAVPGLLDRMARIRRAGSVAMGIAPDLEAAARVVHVPFVGLVAPPQDSGSLSGATIRAAEIDLTARVISNGVPHQALPLTATLCLAVAARLEGSLVHEAARPTEAALRVGMPSGILTADAAVTHGADGWRAERGAFFRTARPLMRGEVFYDAPPPV

SEQ ID NO: 1632 - protein, 151 aa, Methylobacterium sp.
MTARKSHRWITSLAALLVLGVPLATGPAFAAGKDVTYRAALTGSSEVPATASSGKGEITATFDPATKRLSWSGQYSGLTGPVTAAHFHGPAKAGENAGVLVPVTAASSPFTGEATLDDAKAADLEAGKVYFNLHTAANPKGEIRGQMERVP

SEQ ID NO: 1633 - protein, 111 aa, Methylobacterium sp.
MAVLGLLALIPAPVAAQEPLYIRIRPLPDAEVARVAREMLWAHRQAHARAVIESVCTGCLGAWKPEPVPPPTPAPAQDRIANLTVPIGVELDPGSGASEPDPDPSTFERHP

SEQ ID NO: 1634 - protein, 299 aa, Methylobacterium sp.
MELKWIEDFLSLAETRSFSRSAEARHVTQSAFSRRIRSLEVWLGTALLDRSTYPITLTADGRHFLETAEEVVRLLTLSRADFRNRSERSSLPVVAITALHSLCLSFLPRWLGTLRGELGAMSSRVLPENFNICLQALVEGGYDLMLTYHHPGIPIPLGPDRFPCLVVGQDSLVAVAAPADLPRDREGRLPLLQYSRGSFLGRLAAIAQAREGAPATYPVHTNENSMAEALRSMALAGHGVAWLPRSLVAGEIAAGALAIVSPEMSMEIRLYRSAERARPFLEAVWSAAAADSKNYSGSE

SEQ ID NO: 1635 - protein, 176 aa, Methylobacterium sp.
MQETGAHLSRRGFLGAAGSTLLAVAVMPDGSVTGRAWAQMPKATKPETFASLVQMSRDCYPHDRVADRYYAAAVQILDDAARTAPGELTLLEDGMAALNRAAVERHRLPYAKVPQDTDRAALLETIEPTPFFQKVRANLIVGLYNQKELWPIFGYEGASFDKGGYLERGFDDIDWL

SEQ ID NO: 1636 - protein, 197 aa, Methylobacterium sp.
MTEHPVAGPALAVDVTVDPLATPYFDYILDGVRLDLAHLEPRGLTFFVKNLGRDLTVDVKFSNHCFTVDFDPAVHNPAHVIMDHKRRRAYDPERHALSRGLPDMIAALPSAAVYLTPSDRNYVYVARLVTPAGMVYPMYFHLRRAKDTAPRNLQMVVESAYPVEDARAVLAGTTKISFAVLCAKVFRGERIRPQARR

SEQ ID NO: 1637 - protein, 160 aa, Methylobacterium sp.
VRLRAVALSRSVSMTLARDPDAHLSSTTDAAKLSLPLSWWRVFAPEALDMAAQCRLSAALNAVQPLPSPDWSAACRGDSAAAIHIALNVLAEAIAFPGRLDPAMSAICLCAVRGDGSCIDLLVHVLGRRARRRADLKVLCLAHAWCSVPRRGSDRVGVAR

SEQ ID NO: 1638 - protein, 91 aa, Methylobacterium sp.
MRPLIATLTAASLGLAAAAVTPALAQVQQNNPNAANQSMETSGQVRALRQEQTTQSNTLRMDIQRNQAATPAPNTGPNAIGPTGGTGVIGR

SEQ ID NO: 1639 - protein, 242 aa, Methylobacterium sp.
MDVVARRRGRPRKAPVVPVAQLPRTGLHEQAAGRLRDMIVRGVLPAGASLVETDLSVALGVSRTPLREALKLLAAEGLVELHQNRSARVPDWTPEEILELFEALAGIERLTAELAAPRISETLMDALRGKQAQLDRMHRDQVLDAYFALNQEIHRTIVEAARNRPLAEAHAALQARAQWARLRALSSGSRWEESAREHRDLFEALAARDAAAAGTVAHRHVLRTGVVIAETLQARRTDPAAP

SEQ ID NO: 1640 - protein, 71 aa, Methylobacterium sp.
MRKGRRVPAWLARRTYFKRIERWAKPGKARKAAQPPETEAAAMPSNVVPFPIRMNRPDRPAFEDLRGVGTA

SEQ ID NO: 1641 - protein, 62 aa, Methylobacterium sp.
MSDAAIEARRLTLIRFEHAAGAAFGCDDDAAGVPPARALVNATTITLATFATAVAATITYLV

SEQ ID NO: 1642 - protein, 327 aa, Methylobacterium sp.
MEDAVMELVTKPLRDEGPLPLLVTPPEGAAGTALADALPAIRAAAEAHLHAAGGLLLRGFSLDGPDAFRSFAAGFGHDLLSYEFGSTPRSPVTQGVYTSTEYPPHQHIPLHNEQAYARDWPMKIWFYCQQAAPEGGETPLADSRAIYRAVPEPIRARFAEQGLMYVRNYGNGLDVAWEQVFGTQDRGAVEAYCAGHGITCEWKPDGDLRTRQVCQGTARHPETGEPVWFNQAHLFHVSNLEPEVRATLLDLVDEPDLPRNVYYGDGSPIPDADLDAIRAVLAEHTVVFPWQSGDVVMLDNMLTAHARTPFKGPRKVVVAMAQAGRAQ

SEQ ID NO: 1643 - protein, 32 aa, Methylobacterium sp.
MRKILIAFLLPKVVSYLRRRYGGPHANRNRAF

SEQ ID NO: 1644 - protein, 88 aa, Methylobacterium sp.
MIVDGLAFLLVAIALAAVVAGYERNLPDPSASPALVAASAPVWTDPETTGSIAPAAGPVARWADARPPFAAPESDRAAGGTWVSPPRR

SEQ ID NO: 1645 - protein, 139 aa, Methylobacterium sp.
LVTLVGEIVAAYVSNNSVPPTALPELMASVHAALASLDGQAPAASVEPAVERPTPAQIRKSVQEDGIVSFIDGRTYKTLKRHLTAHGLTPERYRERYGLPDDYPMTAPGYAAQRSALAKAIGLGVPGGRVDQRRTGTGG

SEQ ID NO: 1646 - protein, 283 aa, Methylobacterium sp.
MLAFAEEAAPLALAMRAGGLAMSNKGPDLGQALTEADLAVSRLMHARFGPDLIEEETAEDLGQAAARALLARDAWTFVGDPIDGTRPFAGGLSGWGVMVAACRGGWPRACVMSLPAWNENRSAPAGSVPAEATEGVLLAASEGRAYWAPTRGGRMTTALRPLERPERRTGHVGWLSVTAQRYTLDYGRGWFPWSEGGAISDAALLATGRLDATLSNNRLWDLGPILPLFEALGFRLFHWPDLGDPPAAFVDLFDAELSAHDDLWLVCRDRAQAADLATAIRPA

SEQ ID NO: 1647 - protein, 191 aa, Methylobacterium sp.
MVETPPALPLEVIHRGWNTFGIATLTLQDGSTVRRALEDHGQAACVLPYDPERRVALLVRQARVGPAFWGESAEFDEAPAGGLDGGAPEATAIREAMEEAGVRLTRLEPVAHAYSMPSVSSERLWLYLAPYAAADRVGPGGGLHAEGEQVVAVEMPLAALAEQARAGRLPDLKTLVLVQALMLRSPELFAA

SEQ ID NO: 1648 - protein, 80 aa, Methylobacterium sp.
MMYGEVGRLADESLRLGLRQAENAVLLAMAAQYAWADLWFEGYRAAMTALSTARDQRARTRRLIRRGVEPSVAAQELHVV

SEQ ID NO: 1649 - protein, 60 aa, Methylobacterium sp.
MSRSILLALALVVCGAAVTLFAFLRAPQSREFAGWDAAFMGGIGAVALGFLTTLVEVVTE

SEQ ID NO: 1650 - protein, 141 aa, Methylobacterium sp.
MRRSTALTGPLAAALLLLVAAGPAGAQTAPPPPAGSAAATADNAVLLTVFLRHDQSRPLAELNAQLAKQGFYKAFPPPGIEVVSWNVVMGIGQIIVLRLPASRLREVNRVMEDTAWGAYRTEFFPTYDYRAVGLAEHEKAR

SEQ ID NO: 1651 - protein, 89 aa, Methylobacterium sp.
MKKLLIATLALAPLAYAGAAEAQGTARGAQRGVEDGTAAAGPVGGVVGGAVGAATGTVGGVLGTDPDPARRARENRREERMERQERLGR

SEQ ID NO: 1652 - protein, 124 aa, Methylobacterium sp.
MRSADPTPRLFAAAAALTGTGILMCRTEPSWDGILIGLFCLGLWALGTFGTLTARPGRPVRSAPRMRPIVLEAVVVETPRFPPELLPAPRPPAARDRALAGPSRQPELPSHRQRVVERYTRRRG

SEQ ID NO: 1653 - protein, 59 aa, Methylobacterium sp.
MSIAILIAFVAGALCLGILSAVIPFGRREVEELDEALPYEDEFFDVGGPVIDLEPRHLT

SEQ ID NO: 1654 - protein, 83 aa, Methylobacterium sp.
MAPDASAEPARDRAPSPGAARTSDALSRIAGILDVPVASFYPDADRPDAAMTQAADLVSAFVAIDSPAARRTCLAFVRAMASS

SEQ ID NO: 1655 - protein, 48 aa, Methylobacterium sp.
MILFTSSTQNIAAPVSGGWSLKAIVREMLNSWLAHHQRLADSGIGGDL

SEQ ID NO: 1656 - protein, 56 aa, Methylobacterium sp.
MQALIGCGLVLAGMLIESAASRHWRSGVRADRLDARAALALGLPALGLAVMAAPIA

SEQ ID NO: 1657 - protein, 336 aa, Methylobacterium sp.
MQLRIPTRPQARFRGRVRAGTCVAARAAALVAPLFAGSLAVPPAAPARAADAPAPLWPEPDGTLILARPFGRSEISLRLSRRVAGAVDTLTWDGVTFLADTEPGDALQARAEIGSGAACRRASEAGTPQDGSGAPAAHRLRALRAGRSWAETETRMAWDGPADPADEPPSDCPTASASPAIPAPLLRKRVALGLPGLGNAVEVQASFNLIEPAAALRLEPLAAAVPAEFSAAWRFDPSTGGLAPLGPGAGERPDPVILATPEGSHALAVWAPGPPEQEPDAPRPGFAVAPEAGANRLSCRFRLANAAAGAHDFACYALVGTLADVRAALRSLTAPP

SEQ ID NO: 1658 - protein, 74 aa, Methylobacterium sp.
MILSFLKSARKSRIAARNLRILSALDDEMLSDIGLDRRTLRTFCENGCAHVPPPSQAEAPRALLMPGGLGIAFR

SEQ ID NO: 1659 - protein, 180 aa, Methylobacterium sp.
VRVPNNQVGGFRPAAALAMASHEDARGPVRGRRDGDRAERPVVGRETAPREALMRDASAQELLLLSALQECRIQLDAARKDEAARAAVREELEAALHREAALAAAIAEERERTEAVRLVLQALLMSVRRFGLRRRLFGARIARLGRETPDSGPQAARHPVLLAEARRVLGKPSPEPPAGR

SEQ ID NO: 1660 - protein, 66 aa, Methylobacterium sp.
MKIVAANHADSLRRPGSRDSAESAVLDTVREGLLSVYGTADRDLPAELAALARQLDRPGPAGCGPT

SEQ ID NO: 1661 - protein, 273 aa, Methylobacterium sp.
LTRDGGRLAHIEAGPLTPEGQPLLLINGWTGDHGIFTPQIRHFSRTRRVVAVDLRGHGASDAPERDYTVAGFAEDVAWQSRTLGLVKPIVIGHSFGGAVALELCGRHPDLAAGLVMIDSIVLPSADRAGGAAIERLLAGVGGPDYRSVVREMAWAIGGDYDHPARRKAIFETFILGPCQRTPQHVAYAALRDLVLAHDPVPAARACRIPMAYISADVPLVAEARDLDRLRELCPQLVTAQTLLAGHFNTIEVAEQVNAMIERFLAVGLRPRAR

SEQ ID NO: 1662 - protein, 61 aa, Methylobacterium sp.
VDPETAKTLVSAALVASITLFSLVSLQAFVAQILADLRDAGSAPKPVPVPVRVDRRDPPQA

SEQ ID NO: 1663 - protein, 647 aa, Methylobacterium sp.
MQAVARSESLAAAPCAGPADRAGRRGGWRDRWRAPRLRVVLALGFGTLGFLTTLTLAALVSREATRRLEAEVGGQLAEIAGQMARSLDIGMFERWRDIQIAAASDSLRDPGTGTAAKRAVLERLQATYPAYSIIGLIDADGRFSVTSTGALEGADVSGRDYFRGGRAGPYLGDVHPAKLLEALMPPDEAAARAASREPLRLLDVAAPVRAPDGRVLGVLAAHLDWTWARDMARILEAGLRGHRQGAEILILSRDGTVLLGPPALQGAPLPRSVLAGGRPLDPEGTSRVGPWPDGAAYLSARASTAGHRDYPGLGWQVVVRQTADRALTSVAALRGGILAAGSAVALAAALLAWLLAGLIARPLLDLAAAAETLGRDQPLPPLPRSFVREGATIADALAAAADERARRAETHRLLIDELNHRVKNTLATVQAMAAQSLKNLGAGAAAGRDAFEARLLALSRAHDILTRESWASADLRGIAAQAVRPFLGPDPAGDDPSNRDSSGRETSDRDAAGGDTADRDTLGANTPRITLDGPDLRLPPEGALALTMILHELCTNAVKHGALSVPGGRAALAWTVEAGPDTETLRLTWRECGGPPVVSPSRKGFGTRLLERGLAGGRTASLTYEAGGLVYVAANPLPAARLHTGRA

SEQ ID NO: 1664 - protein, 111 aa, Methylobacterium sp.
MRPGPAPILAVLLSTLLLPTLLLPTALLLAAPAEARRQAAPPAGRPHHRAASDMDLTLARMAARDRPLWRVWQRPRPLARTVAPATRERVAAPPLTGWGYGGTVPGAAPGF

SEQ ID NO: 1665 - protein, 88 aa, Methylobacterium sp.
MPHFGGSLLMRYARTIRLTLLLLGAGPLLDPAVAADWPRDPHPPRSVRYRSPVRSVPAVPPPVLVRGYLPRNHNVPMYNEPPRREPAW

SEQ ID NO: 1666 - protein, 225 aa, Methylobacterium sp.
MELSGRVVAVTGAARGIGRALAVAARARGATIVALDRDGAGAEAVAAELGGRAFALDVGDAAAVAAVLARIEAETGPIALYCSNAGILERDPDPDLATSADIESWARAFAVNVMGHVHAARVLVPLWRARGGGAFLGTVSAAGLLSQIGSATYSATKHAALAFLEHLAIAHAEDGIRVAALCPQGVDTAMLGAASAASRDGVLAPEDVAEAALDGLAAGRFLILP

SEQ ID NO: 1667 - protein, 481 aa, Methylobacterium sp.
TGPSRRGILAGGGAAAAAALLPRAARAAPRIILNDASGLNPTPVTRHAVLPTGSTDALIEAVRAEIREAAAAGRPVAVGVARHSMGGQSLARDGTAVTLDGGPIEPDRAAGLYRVGAGARWSQVIRQLDRIGYSPTVMQSNSDFGVGSTFCVNAHGWPAPHGPFGSTVRALRLVLADGSLVTCSRDENAELFGLAMGGYGLFGIVVDLVVEMVPNRLLTPTFAVMPAADFAPAFAAAVARDARLRMAYGRLSVAQAGFFDEAILVTYAEAEHPPQVLPAAAAQGAFSAVSREIYRAQVGSEFGKRARWIAETRLNPALDPGLATRNSLMNEPVANLASRDRSRTDILHEYFVPPERFDAFLAACRETIPRSGCDCLNVTLRYVAADPDSTLAYAPGPRIGAVMSFSQGLTPGDEAAMMRMTEALIERVVAIGGAYYLPYRLHARRDQMARAYPKLDAFVAAKRRYDPGLLFRNALWSTYMA

SEQ ID NO: 1668 - protein, 86 aa, Methylobacterium sp.
VLAGLVLLGLSGGAVARPFPEPDDRNLDRHGHYRSRDGSDVHRPAKSLDGRKPAGATAKCRDGTWSFSHTHRGTCSRHGGVAHWEG

SEQ ID NO: 1669 - protein, 77 aa, Methylobacterium sp.
VPYTVEITTPPVRIDGAEQASRMYQLPDPFSTLAEAKEAAIAHIGGLGLDPAGILYTVFDREGFTVASNADQRAGAG

SEQ ID NO: 1670 - protein, 121 aa, Methylobacterium sp.
MKALLAAAMVFGSTVGALAADSYADYRDYFDAKPVATDRAPRGASKRAYGVDTRRPGDERAAKSTANFRPGYWNQAGGYVPPDYALHPRGASQDGFWTPNDASAANWGGPRAFTGTLGTRR

SEQ ID NO: 1671 - protein, 46 aa, Methylobacterium sp.
MASVKIRATDDGTFVVYRNGAAVASGLTREQAERCATVLGWIAQGR

SEQ ID NO: 1672 - protein, 76 aa, Methylobacterium sp.
MAFDVRAVARLREIAAVIGCPVEAFYGPGGEAVDLGMTHELFRLWHAIQDPKARQRVLNSARREALGDAVHGTAAE

SEQ ID NO: 1673 - protein, 113 aa, Methylobacterium sp.
MIRFLAASAACLVLCGAAAAQDMPGLATLSPPDPVQPLGASPALPAPDGAVAPGSRAEAGRVPLGNLTLRGTAADPAQTTASLKVPATGSGASKPWCAQERRIGTGQGFCLVN

SEQ ID NO: 1674 - protein, 272 aa, Methylobacterium sp.
MRTSLRRDLDWFSFHGAVLLLAGLCLVLLAAPTVIVVVVSFTSGFSLRFPPPGYSLRWYAALAEAEQLRAAAWNSLVVAGWTTLLSVALGTAAALAIARSPRLSARLLDSLFLSPLVLPALAFGLAALMLFSLAGIPVSPLTLVLGHTVVCVPYVVRTTVAALSQMDPVLLESSTSLGASRLYTFRRVTLPLIRPGILAGGFIAFMASFDNVPVSLFLRDAATDMLPIRMWQDLEGRLDVTVAAASSLLILVTVVLAAVMERAAGLSRRMAG

SEQ ID NO: 1675 - protein, 300 aa, Methylobacterium sp.
VSAGPATAAGPVAAPLRPGRAWTAAYDIRLALPLGAFFLVFFLAPLALLLLVSFYADPAMTRFGLDQYARFLLDPFSLRVLGATLWLGVEVTALTLLLGLPLALLLTWAPGRLRGLLTLIVLLPLLTSVVVRTFAWIVILGRQGIVNAALLGLGLTDAPLKLLYTEGGLVLALAQVQLPLMVLPLVTALSRIDPNLADASAALGAGAWRTFLRVTLPLCLPGIVAGCLLTFAAAITAFITQSLIGGGQMLFMPMYLYQQASSLNNWPFAAAIAIVFLVAVLACVTLLNLAGRLSGGRARA

SEQ ID NO: 1676 - protein, 347 aa, Methylobacterium sp.
MPLHRRSLLAGALTLGAAQAFPGLSRAQARKLVFATFTGSWEEAHRAVLVPAFRKSSGGDVILDPMLSVDQIAKVQAARANPPIDVMLHDPGPALTAIAQDLVEPYPVAQSAHYGDLIADAQEPMGPAPFFQIVGLTYNPEKVKTPPTSWADLWKPEYRGRVGITNLNSTLGTGFLVEIARMHGGSETDVEPGFKALEALKPNLAAVAANPGALAALYQQEQVDIGPGNFNAIQILKARGVPVEFAAPKEGIIAFKTTIHIVKNTPSKELAFKLIEAALSPEVQAKLMQSPYLIVPTNRKVAIDGEVAKVLAKDADELKRKSVFQDWAAINRGRPAWIERFNREIRV

SEQ ID NO: 1677 - protein, 340 aa, Methylobacterium sp.
VTIARYGAALALLCGFGFLSPLRADECPNRGQLDDAYCDANKDLVADVPAKTRDPSVIVFAYTPVEDPAVYENSFKPFTTYLSQCTGKRVVYYPVQSNSAEIEAMRSGRLTVAGFSTGPLGFAVNMAGAIPFAAKGTEKGAEGYNLIVVVKASSPYKTLADLKGKRVAHTAPSSNSGNLAPKALFPEQGLKPGEDYKLIYSGGHDKSALGVGTGDYDAAPVASDVFYRMVARGTIKGDDYRVIYTSEKFPTSGFAYAHDLKPELAEKLKQCFYDFRFPPDMVKDFEGDDRFAPITYLKDWAIVRKVAEESGTPYNKVAYEREAAREAEAARKKAAGAPKP

SEQ ID NO: 1678 - protein, 285 aa, Methylobacterium sp.
VTQAVKQAVTQAVTAGSAARAVAAGPEGDPRAEDPRALVIRGLTKAYRAGQPVLKGIDLVVPGTGLTAIIGPSGTGKSTLIRCINRLVQPTSGEILFRGEDLARLSGPALRRARRRIGMVFQEYNLVERLSVMENLLCGRLGYVPAWRAWLRRFPEADIARAFDLLDAVGLSGFATRRADALSGGQRQRVGIARAIMQEPEIVLADEPTSSLDPKSSVEIMEILSRLAAERGVPVVVNIHNVALAQRFAARIVGMSGGHVVYDGPPDRLSEADLRGIYGGENWLE

SEQ ID NO: 1679 - protein, 260 aa, Methylobacterium sp.
SPDAADRVAFRPNWTARAGWALLAVYAVYAATQLGFSPERFAGGLAHGQQFLARMFPPNFSRWELIQSGILESLQIAVIATVVGIAVALPIGFLAARNLMPPWVTWPTRILIALCRSFHPIIVAILFVKAIGFGALAGVMALIVASVGFIAKLFAEAIEEISLKQVEAVRATGAGFLSTLIMGVQPQVLPRFIGFATYQLDSNLRNSTMVGIVGGGGIGATLFTAYQRFDFDVVLAILIVIVALIMVAEIVSGWARKVFQ

SEQ ID NO: 1680 - protein, 410 aa, Methylobacterium sp.
MFGSRRRRDEAYDNEKAQALIRAVVIGLACLYLLPQIYGGIAPPEARFVAYLVTCHWVFAVALYGWISRNPGSNTPRRVVTFLLDLGGMTYTMAVGGAPFLPLYAIVIRLIVGNGLRYGVTALKASTAAALVSIAVTTYFNAYWRANPFLVLTLTAITVLVPTYIYSLLERLRGAYEREQEASLSKSRFLAQASHDLRQPIHAISLFTACLRGARLGPEELQMVENIDRSLQSVSRLFKSLLDISTLDSGRVEPRPEPVAINDILEDVRRQNSEAAQIAGTALRSRACAVVVRTDRALLTTMVQNIVNNAIKYAPGRPILIACRRRGDRLAIQVYDRGPGIPVAHQERVFDEFYQVRRRGDRDVEGVGLGLPIVRRLGALLDLTVTLRSVPGRGTCVTIGNLPLARAPEP

SEQ ID NO: 1681 - protein, 49 aa, Methylobacterium sp.
MKRLTLIGIFIVLLLAIVAIAATWSKVTPVNPAVAPDTSATPNPTGERK

SEQ ID NO: 1682 - protein, 74 aa, Methylobacterium sp.
MGQDVDAAREALGTVPPGRPAAPEKRPDPAAGGSGPHAPGPVEPGTDAAPESGGYDTRPPAPQPDNRKGGYGAG

SEQ ID NO: 1683 - protein, 46 aa, Methylobacterium sp.
ATILPGLDTRPAPMAPLHPPAAINDNPLQALHDAVERDLRASGHLR

SEQ ID NO: 1684 - protein, 62 aa, Methylobacterium sp.
MAEPETFDMRPDAEGWTVYNVRTDKPARVKGVPQTGLEMEKADDLVDLLNRLAHRTGESFSL

SEQ ID NO: 1685 - protein, 157 aa, Methylobacterium sp.
MSDPITLDTVAAGRLRDAGHLNYGKRGGGTIWQHTTIARLSAIDRPTLSAEETKRLGVSRLREWCVDGVAVGSLETAIAALAVPPVLTEEETAILARVPADWVELHAFREALGAEWGAPVGATLIMLRQKGAIQNERRPGETRPQPWIRRTPEAGHG

SEQ ID NO: 1686 - protein, 134 aa, Methylobacterium sp.
MVSSNDPPRAERVEVITSVQRRRHWTTQEKVRLVEETYLPGQSVSLVARRHGLNANQLFTWRRLMERGAFTAAGAGEEVVPASELRAAQQQIRELQRLLGKKTLETEILREAMERVVAPKKLPSRVTSWPEDGR

SEQ ID NO: 1687 - protein, 98 aa, Methylobacterium sp.
MSSDPTAPPVHGEILSGVQRRRRWSTTEKIRLVEESQQPGSSVSFVARRYGISPSLPFSWKRRMLEGGHQAVHADEEVVGTSRVRELERRVRDLERLL

SEQ ID NO: 1688 - protein, 250 aa, Methylobacterium sp.
MYCFGISLPRFRERHAYLSRHLAEVWGPRCEITGYEGPVPDPNAPFQPDLTAGQIGCALSHMSAYERMIALDLPHALIVEGDVILPPQIHQIVAGIEAALRPGDVVLLFNWAEMVGPFSSVDTVTVGEYRLCLPMDMSSLGTAAAYVITRSAAEGILRANRPVAVTSDNWAYFFERGALTCGRALVPNAVSRKPFESTIFTSRSRIAAFLKGSPILKPLFTARRRVLAERVAAKLTFVDETSPLAGHAPR

SEQ ID NO: 1689 - protein, 137 aa, Methylobacterium sp.
MTAPSTEAALTVVYDGECPFCSNYVHLMALRRSVGTVALVDARSGGPLVDEIARRGYDLDEGMVVRHGPDLYYGADALVLLSRLSDDRGAASRLLARLLRSPGRARLLYPAMKLGRRVTLRMLGRTRLARPGGAPAR

SEQ ID NO: 1690 - protein, 294 aa, Methylobacterium sp.
MPSATTDDGIRLHYEESGRGTPLIFVHEFAGDHRSYEAQLRHFGRRYRAVAFNARGYPPSDVPEAVSAYAQARAADDILAVLDHLGAPKAHVAGISMGAFATLHFGLRHPGRALSLCLGGCGYGAEPERQALFRAEADATAAMLLRDGMAAFAERYAVGPTRVQFETKDPRGHAEFKRMLAEHSALGSANTQAGVQKGRPSLYDLTDELGRMTVPTLIVAGDEDWPCLAPSLMLKRVIPSAALAVLPNTGHALSVEEPDAYNRLLDDFLAQVESGRWPMRDPRAISATITGIRG

SEQ ID NO: 1691 - protein, 183 aa, Methylobacterium sp.
MARALPDVTSIEEGVGLLRTQLLSISDAIARTRQEIADLRQEQETSRARDELLAVVQGTEDATNAILTASEKVDTLARGIVRRSGEDANRADARAIQIEMQTIFESCNFQDLTGQRISKVVRTIVLVEERIGEMLRVWSGPGDAPSRPNPTTDTRSEEAALLNGPVLPGDASVSQDTVDAMFP

SEQ ID NO: 1692 - protein, 194 aa, Methylobacterium sp.
LGLVLLAAVAGAVHAQAAGAPKSEPLMTVAPAPSGPAGLASADPPALRYGVLYADDKGHSHVQYCDLKNFIFKSYAPPAAPQYVGFPPGEVTSIKYAVLPVGYVGTWHTAPGPQWVITLSGRWSVEATDGSVLEQGPGEVEFNADMGSTPQGPEGHVGHLTRQVGDVPNVQLIVSLKPQAGKARSTDPCQPSQP

SEQ ID NO: 1693 - protein, 154 aa, Methylobacterium sp.
MVLGEREQATDALARARTALAGDPQGLAQVEQGARAVGLGAEGAAPAPAESGRTGPSAQAEKEAAMAAVRAMPQAEQQAAIRGMVEGLDRRLAARGGTPDEWMRLVRSYSALGERDQAVKALDRARMALAANSEAVARLDGLARELELPSKPNP

SEQ ID NO: 1694 - protein, 108 aa, Methylobacterium sp.
MIVEMRVYYCAPTRLPALLERFRSTTLGFFQKYGIEQIGFWTTLVGPDNHALTYLLKWDDMAQREARWNAFQADPDWIAARAETEKDRPIVARIENTFLAPTDFSALR

SEQ ID NO: 1695 - protein, 93 aa, Methylobacterium sp.
MTRMIGPWSAPAAWPVRALAVCAVLAGSGPALALENPASAFCATMGGQTILAKLPDGGTIGLCALPGRKIVEEWTLYRMLHGVKPAPDADPFR

SEQ ID NO: 1696 - protein, 104 aa, Methylobacterium sp.
MRNGSPEDEGTTRRRARPVALAEGPRGAAAADGRDRIAGSQPERADAEPTATLGDLGDALLAAYRLAEQDGDALTVSLLGQALLRTGRRLARGMSPADVGIACH

SEQ ID NO: 1697 - protein, 73 aa, Methylobacterium sp.
MQRVRRIGRAIENGIVGAVTGTVARVSRTIDGLIGLVGRLSDRLDAKLASLADESRARHRREGRRQIDPISLE

SEQ ID NO: 1698 - protein, 64 aa, Methylobacterium sp.
MPRTFPARRVPRHHLALHRSPLRHDRGGAQPLRTSDLILALLGVVMLGGFALLAAYALTLGAGG

SEQ ID NO: 1699 - protein, 46 aa, Methylobacterium sp.
MPIVRYILAECRADRVYALMVVALGGWSAVSLALLALNVFEPLRVQ

SEQ ID NO: 1700 - protein, 473 aa, Methylobacterium sp.
MPSFRNNAVDPQQISSAFDSIANAFKVTPQEILAGAKSRETMQKVQYLADAYKLAQDPNSDQGQLDRLASIAGAYAPSQSLTAVDRNNATSLRTNAADNARALQVAREGQAGETTRTLLSPVGEGQTRFIPPSVASLYGLPAQQIGAVKANEGQTVALPGGGTVEGREKPLTEDAVKARVLAGMEPAAQRAAAFGNTPVETVMTPQGPRISSRLDAIGQAPAPDTQKAQFFNYDTPDGKSGTARTDGSGKLVDTQTGAELPPGSRTYTAQLTGNKTDTGLGASAKSNIETQLLDLSNLEQSVNALDKIATSNPQSIGLTGQVLGIGQDAMATMKEAATMFGPKAQDYLKQVEDGSLPPEMSRYFNPNIPQATLLENTILAQYAKMQDPNGRLSNQQMEIAAKALGIDGMLKSADKTKAVIAGIRQQIAQKRAMLGGAAPAANAIRPPDAAGGPAPAPAGAPVRRKWTASGELQ

SEQ ID NO: 1701 - protein, 268 aa, Methylobacterium sp.
MERDRRHKAFMRRGEILPEPGVEAPVEGEAEAQPEAKPAESPREKHQRERREREAERVAARRAEYDLPEGKQWAMVEACVGRTGELCEKLTQAKIPHFRPRDEIDQVLSSGRIRKMQVPLFDRTVFVGLKDRGQLEELAAEHPWLMERRVYGDMPWLRRDKTWAWDVEHVERCVLGQDKDGHPVIAAATIPDKQMREFAETLIGSMPVFDVEEVFSIGESVRVADGPFASFSGVVEEFDAGRGMVKVEVSIFGRPTPVELELHQVERQ

SEQ ID NO: 1702 - protein, 79 aa, Methylobacterium sp.
VQPDPRPLPDSLTRLLAVPEQRPVRARPALSRTAGAPRAPKPRSAHAALETAIIRGFVFGLAGLVWLVVLALSVRHIAH

SEQ ID NO: 1703 - protein, 429 aa, Methylobacterium sp.
MSDDRYHRKALGNRPLRPETLMLGYGYDPALSEGAVKPPVFLTSTFVFTSAEHGKAFFDYVSGRREPPVGEAAGLVYSRFNHPNSEIVEDRLAVFEEAEAALVFSSGMSAIATTILAFARPGDAILHSQPLYGGTETLIAKTLAGFGIAPFGFSDGTDPASVRAAADSAADAGRVSVVMVETPSNPLNTLVDLGLVRAVAEEIGARQGGEAPVVVCDNTLLGPLFQHPLREGADISVYSLTKYVGGHSDLIAGAALGSAARMKPVRLLRSAIGTGLDPHSCWMLGRSLETLSLRMNAANRNGEIVGRMLAAHPKVARLHHLAHLEPGSRQAQVYAKQCAAPGSTFSFDIVGGEAEAFRVLNGLQLFKLAVSLGGTESLASHPASTTHSGVPKTVRDRLGITDATIRVSIGIEHPDDLVADLAAALSVLG

SEQ ID NO: 1704 - protein, 705 aa, Methylobacterium sp.
MAPSATHDLGTSLFRPERVAVVGASDDASKTTARPLRFLRRSGFGGTVYPVNPHRETVLGERAWPSIESLPETPDHAFVLAPTEGVLEAVAACAARGVPLVSVLAGGFGEAGKAGRAREAELTAILAGSRTRLLGPNSIGIVNVNTGLVLTANAAFAEPTLPAGGLFVASHSGSMIGAILSRGLAKGIGFAGFVSTGAELDLSLGEICAATLDDPLIDTYALFLESIAHGSAIRAFALAAAARGKPVIAYKLGRSAQGAELSQSHTGAIAGEDGIADAFLKDCGIVRVETLEGLIEGAAMLRRVGRSGRSVAAKPQVAVVTTTGGGAAMVVDQLGLRDVAVVSPSVETMAALAARGVAAAPGRIVDLTLAGTRPAVMKAALDTLLAAPEFDVVVAVAGSSARFQPELLVPGIVEAASGATKPLVAFVAPEAPEALARLAGAGIPCFRTPEACGDVVAAVLGRRPAKPMVPTKPVTDAEAALARPASPHQLDEAEGYAVLARLGVPVAPHAAVTPDATASPVGYPAAVKLLSAEVLHKTELGGVVLNVRDDAGLRDALIRIVRNVPRAAPEVAVERLLVQAMAQGVGEVLLSLRQDPDAGPVVMLAAGGVLAEIHRDRSLRLAPVDRDEALAMIGEVRALKALAGYRSRPKGDLDALADAVVAISRAGPEILEAEINPLIVRDEGQGVVAVDAVVRLAATQEGSAA

SEQ ID NO: 1705 - protein, 92 aa, Methylobacterium sp.
MVDTVAPVTLDYAEQVARVLRSNAETEKFVAEQRKLIDQQTKLQAEAAKLHAETLKLGRDRVLAPLSIGFASMAAAAAFFGAGAAFVKLLSP

SEQ ID NO: 1706 - protein, 163 aa, Methylobacterium sp.
MSSHVPTLHLVCGKIAAGKSTLTDRLGQSPGTIVVAEDPWLARLYPGEQTSLADYARNAARLRDAMAPHLVALLRLGLSVVLDFPANTVASRAWMRTLFEAAGVAHRLHVLDVPDAVCKARLRLRNAEGAHPFTVTDAEFDLLGRSFVPPAPEEGVTLVVHRA

SEQ ID NO: 1707 - protein, 195 aa, Methylobacterium sp.
MMADAIQGPRPRPVDLSAALDASGIIGAWSWSPRAERCVLDAGAAEVLAGDPGLAGRPLPLSVAKACVHPEDRPAVVRQFKALRERGGLFVAEYRTLSPSGQVRRILDRGRIPPGASSRRLGHGVIIDVTDEQPATRAMAEPADALTQAVDRALECRDALEGVADSELQLLIDMLLLHLGRRIAKAATTGARRGH

SEQ ID NO: 1708 - protein, 477 aa, Methylobacterium sp.
MNGSGSDEAAATTRTWTEAHQAAFARATGDVNPMHMDARMARRTLAGERAVHGVHAALWTLDACADAHPLDRLATLQMRFERFVLVGDRTILTVHEADARQLRLSLAVDGVRTLTIQATFAADRAPAQPVEATPTAIPAEPVACDPAALPGLAGAFALPDPAAIAALAPRLARALGPGRVAALGGLSTLVGMFVPGLHSILSKIDVTVTEGGTGSSLGYAVKRFQPMLQSVTLDAVGPGLVARVEGFVRPRPVEQESLRDLAALVEPGAFAAVSALIVGGSRGLGAATAKLVAAGGGAVCITYASGADEAEAIAREIRDAGGRCQVLRYDAAEPAAPQLAALAMRPSQLYHFATPRIFRQKRAPFEPACLDEMMRVYNTAFYELSQFCLERGDAVAAFYPSTSAIDEAPRDTLEYVMAKIAGETLAATLARTLPNLQTVIERLPRVKTDQTATIFPVPAAAPSALMLPIIRRMSAAA

SEQ ID NO: 1709 - protein, 105 aa, Methylobacterium sp.
MTPPTSTSSRSDRGAVEAAARATFARLVETWGRPDLENPGPEDDVYERLDSFAVVELLLETESEIERTVGRYVPLANESILDSTKSPLRRFQGWIDYVAETVEHG

SEQ ID NO: 1710 - protein, 75 aa, Methylobacterium sp.
MTEGAFLDELGTILDQPGPLARGQSLGAIETFDSLGILNIMALYDTLGLEVDPQRIAGAATTDDLIALAGAKLQA

SEQ ID NO: 1711 - protein, 245 aa, Methylobacterium sp.
MSEPMSEPGGHVLVVGASSGIGRAVAERLRAGGARITALARRADRLAELEALGCAAVAADVTDLPAIGGVLQAAVAERGLLTGLVYCAGVQVIKPMRSLGVEEVERLYRTNLVAPTLFAAAFGSARVSTRDAVFCAVSSVAAQRPEPAIVPYAASKAGLDALIKGLARELAPRRAVGVAPGWLDTEMTQAHARLYGAEFKEALEKRSPAGAATVESVVDAIAFLMSPQARHVTGEILRVDGGAVL

SEQ ID NO: 1712 - protein, 216 aa, Methylobacterium sp.
VTGTAQRLALIGGGGFSKEIAEIARALGHTVEDTYSTAPEVQVGRYRGYLDALLADRAEYDGVVLAVGGVSRRAIRARAELIAWLDRHALPCPALVSPRAIVSPDVAVGAGAFVAHGVIVNADARLGRFCVLNSAAIVGHDTVVGDNTTISPGAFVGGRCTIGADSLVGPLAKILQGLTLGQAVTVGMGCNVLRALPDNATIWPRADFVAPAPKPA

SEQ ID NO: 1713 - protein, 622 aa, Methylobacterium sp.
MSHFLHLIRDHRGDQADLIAQLGALAVDPEAAGTNPATMIRHLDALAFRLDGGGAPGLAAQTFDLAATLAGRDGSRWALAAAEARLRDLCARGRFAEADPVVARLRAADANRLRPRIMEDLIDRAWLLELRGEAEASVQCYRLALDLNGGAPGLASRDGDLLAKKIKNLRRLQLDALIEAGEFDAAVALHETTRRLIGAGPLACYDMVAAASLAGRPGIDYAELRPSRPIQAPELKFTEPPPPLTSEPGDLEAPSQYLAFVDGCHAFPRSNLVVKDGHLIYDLAAHPRRRDVLLQDGVNPDQIVMAAFGERRALVEVPEDSLSIEAGLSMFGLQSRNYGHWFCEFVPRMLAYNDPRCPDGIPLCIDDHMPATHEEVVRLLDTRDRPIIKLPPRPVAFGRLGLAPVPAFFPFEMRPGQRVYDTIWPADILVDLRTRILDSARARGALSGRTGRRLFISRKAFAQRQLVNEVEIAEALRPHGFEVITPETMTFLEQVEAFHAADIIVGSSSSALTNGLFCRPDCRILGLIHANLSFNFRGYTSFIEAGGAQITFLRGATTNEDGHAFHASYHVAPSTVVAALGSLAQPASVLSPLQPPHRPLSARSVVGRLLGALPFARRIEGQ

SEQ ID NO: 1714 - protein, 138 aa, Methylobacterium sp.
LGEDLEALRAELAETQARLKEAQGELARLVRLAEADLQRRRPGEQSSVVASSVRRPAAKEVAARIARFAHLYREAAEATPDRAPVVPEQTMLAWLETSGLFDRQFYLACNDDVANAGADPMMHYYNHGSEEARLPSTL

SEQ ID NO: 1715 - protein, 552 aa, Methylobacterium sp.
MSTPMQDKPLFPFGPFLFLGDSVTAGWTAQNPPLFSGPQAVGRGIAGQSVRDTARRLRSEIALYGAKGLHLLCGRDDILDGARTPTLDGIVADIAAMLRDTSDLYVRTWVGSIAPVDPTAPGAAGRPIALIGAVNAWLRDHVQEYGAHFIDYDPVLATETGALRPDYSDDGIGLNAAGRAALEAATLAVLTVPDLEPIWPPPESEDAARRRKFLHHFGYLDSNTRYPSPFIQFAGKPGASHYGVPFDADGFLNAAPIVERKPEGETRILVVGDSTTIDGGDIANTLPGRIERILRADGLESAKVYNFGVMSSCLTQMTHLIWSRLVTYGPDGILVLSGSTDLFQPWTYDPRPGHPYNAFITQRLYDHFFDTHDPRAREDGLSYEALITLIYEELKRLRAEVGWQSPGWEDAIVHHYELAAHRLTKLSHDHGVPIVSVLQPTILRKRHLTEVESGVASGAFLAYLDRQYAKLEAFTAELAARRPYRRTFTAVDLSGIFRDREEGTFYDIVHYDDPAREIVATRLAAEIRGALDRARARTPLARVRHLLGGRRR

SEQ ID NO: 1716 - protein, 447 aa, Methylobacterium sp.
MNGDLIDAAFGRPWHRADAAAGATDHPAGTPGFQVDLGFRCPIRRVEIAAISASPPRLALSDDGQAWRAADLDAARSGPASLVLATGEGAWARHVRVTSDGPAGGAPPEARVLCDRADFDLIALRRVLDVPFDMADERPGANVYVSYRLVGAERPRSRALVGLALYECGAFGNCLIQLLLAIGIARNLNLKYIKLPAADRSEVIGLTGPLTCGGLTFIPGSEPLPESGAFLSGMYFDLGIQQLAGTLGPDETRDIVRTCIRPLFNRLPAEIPAKPDDELLIHIRSGDIFSTWVAPTYPQPPLAFYQMVIRRLLAEGCIARIKMVFENRLNPVIPVLEAWISEIGVPLTTQSGSLIDDVAALINGRYLVFGLGTFGPGVCQLSEHVEQVFYFASGWPQHFKSIPTIGQVVEVLDVAGGYTKVGEWDNSPERRALMLAYPAENLAFDDA

SEQ ID NO: 1717 - protein, 122 aa, Methylobacterium sp.
MRSIIMRLFMLAAALLALPAPASALCRCTCIRGEMKAICQETDLTVPICQGICETSIRPERVIVPLAGGRQAFEPAQSTNPSPGGLATQDPNLDTNPNGTVLGTPSQLSGSVGSSLSSGSGR

SEQ ID NO: 1718 - protein, 128 aa, Methylobacterium sp.
MGAAAPRAEPDIDPLPVVIPGTLKLTDAQIGQNGVNPLAVLDSSMRNRMSWKSLRPENLTKPPIYSGLSRMSNGAGVGETSATQKDNIPGFDKDLATKRIMSEYNREAAMAALLKGGRGAAKSVCSGC

SEQ ID NO: 1719 - protein, 427 aa, Methylobacterium sp.
MSLNVLCISWGTTGNLSPVLTAARQLRRAGHRPRVMADPAMCGEVEAAGFPFVGWRRAPTGLDADPADFSDLADWLRQTMFSPAGAYAADTLDEIRRLPTDAVLSLDLLPGCALAAEAADLPHAVLSPHVSIRPLPGIPPAASGLTPPRTEAERDAVDAATAAIVSAMERGRPALNAARRAFGLPPVASAFAHFDRADRVLLAVSRAFDFDTQALPANYRYIGPLLDEPGWSRGTGQAWSGSGRRRILVAGSTGAQNQTDLLRRVAHAVGAVEAETIVTTGPNVGPADLAAPAAVRVVAAASHDALMAQADLVVCQGGHGTVSRALLHGAPLLVIPLARDQADNAARVALRGAGLRLPTDAGEAEIAAAVRRLLTEPGFRRAAAILGAAVRADLDAGGLVREIDAMVAARRASADRGGARGGDRLWA

SEQ ID NO: 1720 - protein, 342 aa, Methylobacterium sp.
MTRFRPGRWRVAVAALLGSAAALVAAAAHERPAAHDRPADTALSAEAADALGVITPVPDTLEADPARAAIGRLLFTDTRLSRGGDRACITCHDIRTSGASAVPRNLTADGTPVPRNTPTAFNAALSFRLGWAGDIPSLREQAELALTRSEFLGGSWPRILDTVRGDPVLVPMFQAAYGRAADRETVIDAINSFERTLLTPDSRFDRWLRGDAHAITGAEQAGYDLFRRIGCASCHQGVNVGGNLFEKVGIFVTIPNKVAEVLRVPSLRNVAVTAPYFDDGGIATLPEAVRLMARAQLGRELTPAQIDGIVAFLGTLTGTYEGRPLTAPPAPGAASQDGKPQL

SEQ ID NO: 1721 - protein, 820 aa, Methylobacterium sp.
MRLTLQAVTLGALLAALLTWLLINGNGGMEAAYQATQRTVDALALAESRMQRDVLRARTGLLRNYDPIVAHLRAMQEAVADLQASNAGDADVQALAEAVEREAEMVERFKTGNALVQNSIAYFDSLSDRLSESDIAPGLARAVAALQIRISELVRDSTPARLADIRTRLETLHAADVAAARVGDVDAVILHGRQLLELLPHVDAVTRSLPASSSEAAREALLESRRSLRDRRQARADGFRLALYAVALALLALVVRVGVLMRAGTRILRRTVDFQTVVAQAANRFLAIQPDETATRIVDVLAMVGEGLDTDHGYVLMLDGTGAVHLWNRPGLAPPSGWPAAQQALVHDVAAAASDLIFVEVADETGPPALRRSLAERGVVSWAGARLRRGDRIVGLLCFERTTSGLPPWLRHSRGLLQVVADSFAAALERQHVWAERREIEAALRRAQRLEATGTFASGVAHNINNVLNVMLGHAEIAGDALPAHPGRAAEHIGLLVQAGGRAREIAGQILDFGRPARSAQCTSAADAVIHETVAQIRASTAGPATIALAGTAEGARVGGEPAQLQQVVHNLIRNAVQASAPGAAVDVRLDHVALPRMSTLTHGTLRAGAYVRIRVSDTGRGMDEATLARIFEPFFTTRPAGTGLGLATAFEFVQEHDGAFDVRSAPGSGSTFAVWLPVIPQAAAGAAAGGTVMLVGRTRRSVQDDEETLAALGYEPVGYADPEAALAVLRREPGRFDLLIVDNRLADLSGLAFAHRAARISGRPIVLSLSATDAVQPELLAAVPVADIVRRPWRSNALALTLRRHLASADPARRPAAVS

SEQ ID NO: 1722 - protein, 182 aa, Methylobacterium sp.
VILPPLRRTAADARTVATVAHDGQVDKAGRPYIEHAARVAAGVLGLSEGCPFWSDLERDEALQAAWLHDVVEDTRYGFGDLAKEGFSDNVLTSVAMLTKPGGRVTYAAWINNIAKVGTLRATLVKLADLEDNSDPGRLALLPAETRERLHLKYEPAKAILRAAAAAKGWLGSTTTVEGSGPR

SEQ ID NO: 1723 - protein, 65 aa, Methylobacterium sp.
MPRKRRPRRLINRYAQSRLYDVETRTYVSLERLREWRGEGFDVVVREVETGRFVSDEVLPTGFDA

SEQ ID NO: 1724 - protein, 91 aa, Methylobacterium sp.
MSSTRKTALRGALLGLALAGPALADDTPTTAGAVDRLKGLANEAVGGAKRGVGNLTDDEALKAEGRDQKLRGQAQQERGKAKDAVENALDK

SEQ ID NO: 1725 - protein, 123 aa, Methylobacterium sp.
MSSDQAARLAATIEVLSGAVGFLIAERVAAQPAPIQDDLLCVLQRALSRAPGAGGDPVGRWIPVVAAAMIGEVRRQIGHPAGDAAGPMISGPDAIWASEVAEGSGREHALGAIAHFEARRAVA

SEQ ID NO: 1726 - protein, 288 aa, Methylobacterium sp.
MTIWSGPGRRLCVAATLLLQAYPASAGETATPPAAAQAGSPAAAQAAQAAQGGSSFVELFSTLNERRWYVSDGWVNGDWQGCTWSKHRARIATPGELSLSLTDITYKERPFSCAEIQTRERYGYGTYEVRMRAGTGSGMVSAFFTYNGPDNGDRRTNDEIDFEWLGKDTSKVQLNYFVGGVGEHVSLDALGFDAATTTADYAFEWLPDRLRWYVNGRLLREVVGTPDRPIPSHPSKIMLSVWSGQGPDFASWLGPTEYSGQPVTALFERVAFTRMGDPCGFKESIVCR

SEQ ID NO: 1727 - protein, 493 aa, Methylobacterium sp.
VRSVICALAGITLVLIAPVGRALAEPAADPLATAARVAAEGLAIGSPSGAGGDPQTSVAQPVFSAGRAAEVTTSFQPLLGAAGDPGGYRAFLESRGITFGLISVAETYRNLRGGLRRGSTGLTLLDLDVDVDLDTLAGWKGATAHATVYQIQGSGASRSRVGNLMTISEIEALPASRLSELWLEQSLFDDRLSVRVGQLSADTEYMVSQTSILFTNGTFGWPEIFAANMVDGGPAYPLSAPTVRLKYVPTPDLSFQASVIDGTPGGGRPRSGVDPQRRNPNGIRFPVSDPPLVIAEVAYAYNTRPSSEGRPGTVTLGGWHRFGRVDALTPDPVSGLDRRVSGNSGLYGLIDQTIYQEPDDPNDGASVFLRASVSPGDRNLVDLYIDGGIAYRGLIPGRSDDTLGLAVGITRISPAARRLDVIAALQSTTPAPRRSAEILLEATYQAVLAPGIALQPTVQYVAHPGGGIANPRDPDGKRVRGAAVFGLRAITRY

SEQ ID NO: 1728 - protein, 286 aa, Methylobacterium sp.
MEWSDVRVFLAVARSGTLGGAARSLQTSHPTVGRRLRALEQAIGHTLFQRTADGLVLTEEGHGIIALAEQMEEGALAMERRLAGQEQNLKGSLRISSADWFGAYVLPPILADFSRAYPNVDVEILTGTRLFNLAQREADVAFRIVPFNTADVVQRRLFRLEYGVYIAEEAPDPGYGDGTGFRLITHETSTGHFPDIAWLIESFPNARPVLRSNNRNVQGRMCKQGVGIAVLPRVVGTQIPGIRRLETPTQPPARDIWMGYHRDLRRLRRLRAFISTVSDHLVNATV

SEQ ID NO: 1729 - protein, 176 aa, Methylobacterium sp.
MTAPVPRGINHIGITVPDLEAAKSFLVEALGGQVIYQSFGPQDSPRQGSEFERAVGAFPGTVVRGQAMVRIGTGPDIELFEMHGPEQAQPVRASDFGITHFGLYTDDIDASVERFEKAGGTPLTAPRAIPYATEKGPGNKVCYCRMPWGTTVEFITTPDRMAYHDQTDLRRWQDED

SEQ ID NO: 1730 - protein, 488 aa, Methylobacterium sp.
MSATEQSFEPRPSEEQPGSAEARAATRPEHFDVLILGSGQGGKLLAWHLGHAGRRVAVVERRWVGGSCPNIACLPSKNEIWSAKVAHLVRNAARFGTITGPVTTDMEAVRQRKRAMVEGEVAFHLKAYGDAGVDLVMGSGRFVAPKTLEVRLNDGGTRVLTGDQVFLNLGTHATIPAIPGLAEAAPLTHIETLELDAVPAHLIVLGGGYIGLEMAQALGRFGSRVTILQTGPQLLSNEDADVADEMQQILAAEDIEVITGAETLSVTGRSGQAVSLVVRTGEGERTIGGSHILVAAGRTPNTQGIGLEEAGVALTDRGFIRVNERLETSAPGVWALGEAAGSPQFTHVSVDDFRIIRDNLAGGRRSTQDRLVPANMFTEPPLARVGLNEREAQRQGVPVRVARLPMSAVLRTQTTGETQGFMKALVGEDDRILGFTMIGSEAGEVVAVVQTAMLAGLPHQRLRDAVLAHPTMAEGLGSLFAGVPPRSS

SEQ ID NO: 1731 - protein, 460 aa, Methylobacterium sp.
MDDHYDALVIGSGEGGKFLAWHLAKAGQRVAVIERRWIGGSCPNTNCLPSKNEIWSAEIAHRARQADRYGIETGPVAVDMGRVVARKRAMVRDLIDMHLDRYRESGAELVMGTARFTGPRALTVALNAGGSRALTAEQIFLNLGTRATIPDVPGLREAGPLTHIEALELDAVPAHLVVLGGGYVGLELAQAYRRFGSAVTVIEHGPRIAGREDPDVASALAQLLEAEGLAIRTGTEVVRVRGRSGEAVEITVRGGAGEAVIAASHILVAAGRAPNTDGIGLDRAGVALTERGVIEVDDHLRTSAPGVWAIGECAGSPAFTHASADDFRVIRDTLAGIPRSTAGRLMPSCLFTDPPLARVGSTETEARADGHAVRVARLPMAAVLRTRTTGQTDGFMKAVIGPDDRILGFTMLGAEAGEVMAAVQVAMLAGLPYTALRDAILAHPTTAEGLNSLFAAVPAR

SEQ ID NO: 1732 - protein, 429 aa, Methylobacterium sp.
VEQDSGEDDGQPAAQVRTPISRPLDLLNFLLIDVNGAIKPYLNVYLYVHRGWDDASVGLVGTVSGIVGIVAQTPIGTAIDAVRDKRVILLGALVALSLATLLVALFPQFWPVLAASCVLAAVGGMLSPAIATLTLGLFPADKLAQRFGRNAALERTGNVAIAVLIGLVGWLFPDRAVFLLVPACAIVSAAALYSIPRGAIDARRARGGGEDDAEQAPAGWRTLLTCRPLMIFAACVGLFHFANAPLLTLVAQEIGQARPDWSSVIVSVCIVGAQTVMVPMGLIVGRRAERWGRKPLLVIGFAALPARALLYLVWRDPYWLIAVQCLDGVGAGLLSAVKPLVIADITRGTGRYNAAHGLIGTVQGAGASLSFVIAGTLVHHVGFDAAYLACAAVAAVALGVLVVLLPETAPGKPRVGLPARLRALRPGKA

SEQ ID NO: 1733 - protein, 278 aa, Methylobacterium sp.
VRSQARPARLSPRSFPRSILRSGLVGAVCALGTVGARAAPDCAGIRDRVETLICADPALTRLDEELRRLFDRIVGETRGVDGETGQAIDTFGEDHARWRARVRDACPDTACLTRAYTARIAQVRRDWSRALPDTPALRHVVNARFGFSVDVPADFVAEPPPDNGDGQAFRSADGHLHLTVSGLNDVLDQDLDAVVAADRKTCLRQPPEYAARKPGWIVLSCTTAAGILYRKTLLAGGRGGAFVTLRVRYPAAEQARWQAAVTAAATSLRLTEPGRSAR

SEQ ID NO: 1734 - protein, 535 aa, Methylobacterium sp.
VPVIESALDPRAPEARANAEAMRALVADLRATADRVRLGGGEAARERHRARGKLLPRDRIRALIDPFSPFLEIGQLAGHGLYGGEVPSAGIVTGIGRVAGRECVIVANDATVKGGTYFPMTVQKHLRAQEIAQQNRLPCLYLVDSGGAHLPSQDEVFPGRDHFGRIFYNQATMSAQGIAQIAVVMGSCTAGGAYVPALCDESIIVRGQGTIFLGGPPLVKAATGEMVSAEELGGADVHARISGVTDHMAETDAHALGIARRIVANLNAVKRPALAPRQPEPPRYAAEEIYAAVPADRRTPYDVREVIARLVDGSDFDEFKHLYGQTLVCGFAHIWGYPVGIVANNGILFSESALKGAHFVELCAQRGVPLVFLQNITGFMVGRRYEAGGIAKDGAKMVTAVATAAVPKFTVLIGGSFGAGNYGMCGRAYGPRFLWMWPNARIGVMGGEQAASVLATVRRDGVEGRGGTWSAEDEAAFKAPIRAQYEEQGHPYYSSARLWDDGVIDPADTRRVLALGLSASLNAPIPETRFGLFRM

SEQ ID NO: 1735 - protein, 200 aa, Methylobacterium sp.
VGRTAGSNGPRTAAAIRRAGLRLIYRHGYEAMTLRALAAEVGIQAASLYNHIRSKQDLLFDIVRDHMETLLARTDAALAAATGTPTDRLRAFVAHHVTYHLEKKQEVFIANFELRSLDPPHYAAIVALRRAYEDRLVALLERGSEAGELDVRDARVAGYAILGMLTSACTWYRPDGRMTKAAIVALHTDMALRGCVRRQP

SEQ ID NO: 1736 - protein, 37 aa, Methylobacterium sp.
VLIEEFRKAGELPDAAAGWRMEIHDANGTVLRTLPLS

SEQ ID NO: 1737 - protein, 375 aa, Methylobacterium sp.
MLRIGIDAHVLTGKPQGSRTWLVNIIGRAAARHPDATYVVYSGDPEACARIVSGNNIEHQRLPRVPATVRLTLVWPWLFLRDRLDTLLTTYIAPPFVPGDRQVVVVHDILFETHPEFFPWSMRWRNKILTRLSARRAKLVLTISDYSRDSIANVYGIARERIAEVRCGSTPPQAVTERTPLADGRPYLLMVGRLEPRKNLGLVLDAFARLPQGAARLIVVGKGDGERPETLDRLARTPDAVHIAGIDDRGLSDLYARAAALVFPSRGEGWGIPVLDSLARGTPVIASSLTAIPEAGGSAASYFDPDAPDRVDRLAELMGAAIEGRLPFDACAARAHAARHDWDGPAATFVDLMRRSFTARTHLRDLILAAPNLRG

SEQ ID NO: 1738 - protein, 460 aa, Methylobacterium sp.
MKWPRTVLVGALSALVLPILAACGPAGAQVQQNILVDPAGGTKPGYTTVARLADVPFASLGPGSSVLVRGGSYGDVVFVGSRGTAAAPVTVAAEPGTQPRLSNSVVFENATYVTVTGLSVQGAVNSGFIIRRGSSHVTVAGSTVSRSGLGIWIGDGAGAGHRITGNTLADNQTHGVAVDVINAPAENPSYILDNTVTGNGIHGMEINGSGYVVEGNRVSGNGVGMSGTSGIHVFAKDAAQDAGDRNIIRYNIVTGQKETTGQDGNGIQIDQWCDGNIVAFNVAADNDGAGINLFDAGSNTVVNNTTTGNMRDSGGKHVYRGEIVLASDYTKQVDRTSNNRVLNNIAYATRPNVAAIVVEATTTDNNNAIGPNFVGSAVGAPLYRWGTQATGDGASLPLNGQGPDLTGTPAFRDPANPMAGGLALTAPPARAGIPLGATRDIAGQAYAPGEAPTFGAYRSP

SEQ ID NO: 1739 - protein, 313 aa, Methylobacterium sp.
MSDRPVLSVIIPTYNRADTLRLCLRAFDRQETDAPFEIVVCDDGSTDHTGTVVSRAVATARIPVVHLRQENAGANAARNRAIAAARGERLLIVNDDTIPVPSLVEAHRLAHARRGGRETAILGRMTIDPALPFSPFSALHHDASYDALAGRDEVGWDAFLTCNVSVDRRFLEEAGGFDPKLFWHEDIELGERLARRGMRLFYAPEALGYHHHLLDEAAYLRIAEREGAALVLWYRKRPDLVADLGRLGLVGPPPLGAAARHRVADLAMPQALLPGWQMAARALTRISPEAGRSVWRRLFQRRKRLAIARALAA

SEQ ID NO: 1740 - protein, 485 aa, Methylobacterium sp.
LSGQRRAGGLRYGANLLGQAAGRGVYLAAGFAAFVMVGHFAGPAALGRYGLALAILAVALIAADFGTTLTFGARLGAVGPEMRAAEFGRMLSARLVLGLGTGAALLGVLPMLPDAIRPALALAALLMPLAAARFLDALFQVCGRPAWSVWPSLANAALLIGGTALALWLRLPESALSLVAVAAGIAYGAVGLALALRLVPARPASLAHALATIRAAAGVGVSNALGSLNGRISLIMLAAFAGAAELGQFTAGFRFFELGAAVAITLCAPLVPVFGRAVGPLVDGRSRAGTTALRARVRGALVPILAASCAGAVATCALAEPLVRLAFGPDFGGAVPVLRIATGMSVLLIAATILFAGLVPLGRTGFAVRGSAAACATNLFACTLLIPWDPLLGAGLAALLAEAAMLGVLAQAFWREAGPPLALADVPILAAPALLTALAWAAGPAALAPAAVPAAAVLSAALAGWLCLRRAPTDPLDLPLPEASS

SEQ ID NO: 1741 - protein, 173 aa, Methylobacterium sp.
VRAALSADRDHWRRRGGGPARLRRGYHAVWLYRLSRYAHERGWRMAAWLLWLVNGWWTGADIPPSSRIAGGLFLPQPYGTVIAGAVGRDAAFGIQASIGGLLKEPDQDIGGGPGLPVLGDDVVLEAGAIVLGAVPIGDRARIGPRTIILKPVQADEEVMPQPWRPLPGRGVAA

SEQ ID NO: 1742 - protein, 196 aa, Methylobacterium sp.
MTDHVTLPGLRRLLAADFARVLRQTTGGKPTSRLRRAMHLTLPAMQVAILHRTAHLLHGRGWRRCAALVADLSLRLTGACLHPGSRLGPGLFVPHPARVAFCGTGGADLTLLPGTLVGPRDWVFPSQPFPADGPSIGDGAVVGAHAAVQGAVTIGAGATIGIGVCSLRDVPAGTVTMLVQRQLRSGGRGPEAGRGR

SEQ ID NO: 1743 - protein, 245 aa, Methylobacterium sp.
MVTVEQRLFREMGAGGYSRHDHRMEYIVRVNALLRSDMRVMEFGAGRGKWSDDPVPLRRHLGDFRGRCAQVVACDVDEAVLGNRSADEVRLIGHDGVLPFPDGSFDLISAFSVLEHIEHPEVTAAELGRVLAPGGWLCAWTPNRWGYVGIGARLVPKRLHARVLRLVEPRRVEIDSFVPLYTMNTEAARKRLFPTDRFEHFTYSFDGQPFYHGENIVLGKFWELLFRLTPGPFKGYHMVFIRKRP

SEQ ID NO: 1744 - protein, 534 aa, Methylobacterium sp.
MSAAPVRALRVLPLAGIGFAAAAGAIALSAAPLKFAVVGLAAAFGGVGALIVGRLYRLTPLLLVALAVGLTVKLDVSFLQHFEAVGQYLPSIGGGAGLTVSVALLVAVALIVAKLTGLGEVAPGLRLDRPLVLTQLGFLIAGLLSLSNATDPAYLWFDTWRFAGLLLVSVAVSNLSEGDIRTLALAICALCLVQTAVAGLQYVSGSELGLSVLGEEQIVEENINFSAQRRAGGLKVHPNILGYYYEFVWPLALALALSRGPLLLRLAGAAGAASALVGVVLTLSRASWLTFPISAALLILLVYRDRLFSRTSLIVFALLAIVGAVAALYAGPLIWERLTADDGGSAAQRGPLNAAALALFEQFPIFGVGLNNFGNQFAVLDRTGLSRLAGLFDRSNHVVHNLHILILTEVGIVGYAAFALVFGIGIARGFRAARRAPVGDPLAAIAAACAVGLIAHLLHGLVDPGFRLNLGIAELLYTGLGLIAGVRAAQRRRAVAASRAVASTGPIGAARARAERIPMAYGRRPSLAAYGDRP

SEQ ID NO: 1745 - protein, 213 aa, Methylobacterium sp.
MIAAAIAPKIDPAILEPALVQLTRHEARVRRVGLTAVQPGEGVSTLARELAGAYARRGRSAVLIEANWSRPSLAEAYGLTGRPGFADIVAGTVAPSRGVHPVADNLSVVPAGSPSAIRQATLDDGRVEDFLALVDDRFELAIVDCEPITEIGDAAALSPFVDGFIVVIGAERTRRAVAQRALADLKAAGGAPLGVVLNRTRRPIPRWLYRWLG

SEQ ID NO: 1746 - protein, 510 aa, Methylobacterium sp.
VRQSDLTAADAVEGPAFDLRDALAALFRHIRPALLILVAAILGAGIYLLLTPAEYTADAKLIIRLGREKAGAPLQGGANQNYMFSERAQNVNNEIEILRDPSIVRDEFATLKAITPTGDLGPPPADWMDWLIYQGRQAVRGAKAVKTWIVDTVRIPFEAVGLLRHLTPDEKLYEAYLAAFKVVFVKETDVILTGFTWTDPHFAAQALNRLLDAYKRRHVEVYADETPASFYQSKLERARADLAAIDAQLSTYLKGNNTASFEIEQQNDLGTLADLAKQKSAAQIEREVVETRLKRTREAGPDRWQPTPPDADPTVTAFDQRWADLRTKRAELAVRFRPTAPEFVSLDRDLAALARQKYQALLAADTAKLAILAEKIQSITGIEQSRRRAAIGQSDAALAYGRLTQQKGLLTDEITETQKRIDALKTGSGLDAQAVTSSALVARAVPPRLPSGPNRPLILGLAAGLGLLAALAYVALAEILAQTYRSASEVARSLRVPVLAAVPLQTGAAA

SEQ ID NO: 1747 - protein, 384 aa, Methylobacterium sp.
MAFTLSAFLGVSRRRPGRPSGAAAVALALLACAPLLAGCNSGRPQSAARSGLDVAQTGSVTEGLPAALVAAAQEEVGRTMRLGLANYRLNVGDNLEVSFLIDSSVVQPTYRLNPNDEFDVDFRTHPEYNRTVIVRPDGRISLPGKNGIKVAGLSPEAAAALIKSTYDDVLIDPVVTLMLRRFRTVTDDFRDLTQRADMGRVKVLAIEPDGKINLPMVPPVQAAGRTVHEVMGSLNAAYKHQLASVTTSVRLASLVPANTMVFGEVRAPGPVTLQGPRTLAQVLGSAGGVLPTAAGEAVRIIRFDAEAAGSVRIVDIGQPGLADSIVVPPNATVYVPPSLLAKTARAVDLVVRQILLFNGTGFGVNYITGPSASTSTSATVRSGT

SEQ ID NO: 1748 - protein, 38 aa, Methylobacterium sp.
METTMTWTNRITIAATLIGGAIALVTYAQALSLPTHFA

SEQ ID NO: 1749 - protein, 134 aa, Methylobacterium sp.
MADAVASQRAVLIVEDDPVQLMDAAAALRDVGYAVAEAATVEAAQAHLAARPELVAMVADVDLAGEPLSGFTLAKAVAARWPELAILIVSGVAWPAEEQMPMGARYLRKPFTPEGLAGALGAVLAARGVGSVPH

SEQ ID NO: 1750 - protein, 74 aa, Methylobacterium sp.
MTAEERLAELKAADTRRQTRRREALKQKGMTQQNVWLKPSVKAVIDQAIQNGRFKSRTEAIEWALASAFEEKSA

SEQ ID NO: 1751 - protein, 388 aa, Methylobacterium sp.
MHEFTELRGREAAFPEAEFSARQAAARAAIAGAGHDALVVTGPETIYWLTGRQTAGYFAFQALLVPVDGDPALLVRQLELPGAAANTWLDDIQAYPDGADPAAALAALVRGRGVARPALERDGWFVAPALAARIDAALGSGPLPDGSGLLAPLRAVKSAAELAAIRAAARYAQAGLAAGLDACAAGTDENAVAAAMLAAATAAGSEAVAMEPLVASGPRSGLPHMTWRRRRLEPGDAVFLELAGSHARYHAALMRSVWIGPPPAEAQRMMDCALRALDAALGAIRPGHPCAAPHAAAQAVIDAAGYGPAFRKRIGYSMGVAFAPDWGEGALLSLFTGQDRPIEPGMVFHLPATLRRYGAWTVGASETVIVTADGVEPLSDLPRTLSVR

SEQ ID NO: 1752 - protein, 113 aa, Methylobacterium sp.
MGVDIARVKALIATLEAVTSAPHFHRTAFRTPRKTFATLDEVGHDINLMFDPDLRDFFCEQVPAAFSPVPGGWGRMGATRCDLAIVDEATLMSALTAAHRLAAPKPRARRGGA

SEQ ID NO: 1753 - protein, 156 aa, Methylobacterium sp.
VDRMMLSRRGVSGLAALVAGLVASRASADPAAGPKTHRVAMQVSSNEGGVFDLALNNAVNLAREYSDQAEELEVEIVAYGPGLHMLRADTSPVRLRIHSITESVPGIVLSACGNTVKAMEKAEGHTVELLPHVGVVTAGAVRLVALQEAGWSYLRV

SEQ ID NO: 1754 - protein, 559 aa, Methylobacterium sp.
MTSRRDFLQIAAATAALVPSGWTRAFAQQRLTQDDLLAFEPMGNVTLVHLTDIHAQLRPVLFREPSTNLGVGAARGQVPHVTGRAYLDLYGIPGASQLAYALTPEDYVALARSYGRMGGLDRIATVLDAIRAERGDKVLFLDGGDTWQNSYTSMVSRGQDMVDCMALLKPDAMTGHWEFTLGTERVKEIVDGLGCPFLGQNVRDAEWNEPAFEATKMFERGGAKVAVIGQAFPYTPIANPRWMIPGWSFGIREEDVQASVDKARKDGADLVVLLSHNGFDVDRKLASRVKGIDVVLTGHTHDALPQAVKVGNTLLIASGSHGKFLTRVDLDVRDGAVKGYRSKLIPIFSDVIAPQKAMADKILAIRAPHEAMLKEELGRTEALLYRRGNFNGTLDDMICDALLSEREAEIALSPGFRWGTTLLPGQPITREDVYNATAITYPAAYRMPMTGARLKEVLEDVADNLFNADPYYQQGGDMVRVGGVSYAIDVARPAGSRISDLTLLRTGKPIEAGTSYTVAGWASVNEGTEGPPIWDVVASHIKAKGTVNPTPAQVTVRGA

SEQ ID NO: 1755 - protein, 191 aa, Methylobacterium sp.
MSTRRRFLAGALALGLPAKAMAQAIQGDDGLYREPWFLESFLDLPDDLKAAREHGKRLAVLWELKGCPFCKQIHLVNFADPATSAFIRERFEILQLNFIGSREVTDFDGQILSEKAFAEKYGVRSTPSIQFFPSEDEALGGKPPLQREVLRLRGYAPPEEFRRTFAFVAERAYERTNLQDYLRSPKAAQRG

SEQ ID NO: 1756 - protein, 113 aa, Methylobacterium sp.
MAGAWGLALWPGSVEAAELIKFERRGCPWCKAWDKEIGSIYPKTDVGKRAPLRRVDLDAGIPPGLTLKRPIRYTPTFVLVEDGSELDRIEGYPGEDFFWGRAERLLERLPASP

SEQ ID NO: 1757 - protein, 347 aa, Methylobacterium sp.
MSDILPAYLLRAALGLVLGALLGTVARRGRFCTLGAIEDAVYAHDTRRARAWLLATGIAILGTQLLETGGGLDLARSIYTGPRLEWGAMILGGAMFGFGMALVGTCSFGALIRLGGGDLRALLVLLVLGLSAYMAISGVTALLRVTMTEPLSIDIGSQRLGELLRLDQTGRIVVGVVAAAGLCIAALASRAFRETKRLLFGAIVVGCVVVAGWWTNGIAGFDEFETRAVGSFSFARPVGDTLLYVMLASGTKIDFGVASVFGVLLGSFASARHAGEFHWEAPDDAREVKRHLFGAFLMGTGGVTALGCTIGQGLSGLSTLSVGSMLALGAILVGARAGLYYLVDRHA

SEQ ID NO: 1758 - protein, 73 aa, Methylobacterium sp.
MSEDIMRVLTEPTVDVELAGRVLGISRKTAYRARETGEIPSIKIGRQYRVPTAKLREMLGLPPYSMETQTLAA

SEQ ID NO: 1759 - protein, 110 aa, Methylobacterium sp.
VTGLSLHAVDAATGRPAEGMRVRVLRAGGKRRVIAEGRLGADGTLDHPVVRTRLAAGLYEVVFVIGDFVGAAGEGFLEEAAIRFRLDDPDRHCHLPLKFTAFGVALFRGC

SEQ ID NO: 1760 - protein, 416 aa, Methylobacterium sp.
MSNGLTPTADRIVVASEADWNDAWYLVCMKVSTIGFVVVDARERVATLDALRAAGITDIAAHLDAHPDVADRLRHGMVILDVNEAAVRMFGAGGRADMIGQRTQRFFDPLCTAQVNSARAFAAGATSFQQQAHSVRLDGSRFETLFCVVPRADGATSGLWLASFVDITEHVARQMSLEVLRDELAHVSRISTLGELSASIAHELGQPLSSIGMTAGAMLRLLDRADLDRDLLRRQCQRIVDQVTRAGDIIDRTRRMAAKRDSVRAPVSVAEVLAEAARFVAHDLNRTEIRLTVAPADAAAQVVADRIQLQQVFVNLLMNAIQIHRQARTPGPEIAVETVCRDGSITVDVIDNGPGLDPGTLDRLFDGFFTTRAEGLGLGLRICRTIVAAHGGSIDASPRDGAPGARFSVCLPLARS

SEQ ID NO: 1761 - protein, 60 aa, Methylobacterium sp.
MPKRRDPGRSPPPPPDAVPETVPDRDAVERALETILDRLRPKPGGAPRGSRKPRPDGAGG

SEQ ID NO: 1762 - protein, 57 aa, Methylobacterium sp.
MTIASVIGSCVTLLLVRGLDPLVALLLIPIGGSVATVLVILLFQAVSLTLAVRTGPH

SEQ ID NO: 1763 - protein, 54 aa, Methylobacterium sp.
VVYVLIIMLAGSGSAIGSVEFNTKQACEAAAKQIAEAERPYGGASPVTVCAPKG

SEQ ID NO: 1764 - protein, 217 aa, Methylobacterium sp.
MPDRPSLGISRRKQPRQARSSDLVAAVLEAAAQVLAEVGAARFTTARVAERAGVSIGSLYQYFPNKAAILFQLQSDEWRDTSALLAGILTDPACAPGERLRAAVHAFVRSECAEAAMRRALDAAAPAYRDVPEAAEPQLAGSQAFRDFLRAALPAAPETDLRVAGEIIAMTLGEVGERISETVRTEAAMVTFADALADMLCAYLDRLGSGGRAGAPS

SEQ ID NO: 1765 - protein, 132 aa, Methylobacterium sp.
MSKRDAVFPPGRQALYDKHRYSAAIRSGDLLFVSGQVGSREDGSPEPDFGAQVRRAFDRLNSVLAAAGCSFDDVVDVTTFHTDPETQFDTVMAVRDVMIGEPPYPNWTAVGVTWLAGFDFEIKVIARLPTPV

SEQ ID NO: 1766 - protein, 594 aa, Methylobacterium sp.
MRLLVACDHLALTGGLLRFERVGRVLARRGHAFAYLTLGTGEDGFETRLPVLHREDAARESWDAVMVPGGGFPDATIEGFADLRAPNFGARIQHLLNAPVRRDAYARVTRTLAPDLVVANNEHWDDAALHGLGLPWRRLVGAVDTGLFAPPVSPPARGARRRLGGIANKRPAAQLAALDRLGDAWALHWFGRPDWGLVGAHADLVASGRLVVHGPLPEADLPAWYHGLDAFCSAEAHAGWCNPAAEAMACGTPLVATVHGTLAFAEDGVTALVVPDGPDAVLGAAIAEAVGRIATDPAGAASRAEAGRARIRALDWDTYADGLLAVVAEAIALRAGRTTAARPSGPPRETALRLADLASRDGPLPEDFDALGYIRLHADLAALFEHAWQGQLHYLEHGRREGRIYPSNLTRAQQKAAQASRIALAVDGLDGSGKSSIARHVAEALGATVLNPFSGQVGAILVHLARTGQHALADDVAHAAVAAAIANAPPGPVVFDRHWFTASQLLSPAFRPGWEPRPFTVMCWADRPTTIARMVARGVPNPSEHMTEARIASYRTLAEELRVPLLDTSRIAPEEGAAQVLAMLGESGDTARRA

SEQ ID NO: 1767 - protein, 221 aa, Methylobacterium sp.
MHELGPDFVGPAAEPRPSEPCGPEIAASDWPSVRQWRKETRAALIARRLGMSAQDRAARSERIGQGLRAALPSPSGLSIGLYWPFRGEFDPRSLLTELRGSGARLALPVVVEKARPLRFRVWSPGDRMIRGVWNIPVPAEGETVDPDVLIAPLVGFDQAGYRLGYGGGFYDRTIASMSTKPRVIGVGFELARLATIHPQAHDVPMDIIVTEGGVWPRTERS

SEQ ID NO: 1768 - protein, 405 aa, Methylobacterium sp.
LVANIAANVLTRGTLIGPFLYSLANLAEVMLAVRLLRRTYEHDALLQSTRSALRFLAIAGLLAPAASGVLGGLTAHLVFGEPLLRSFGTWVASDGLGLIVFTPFLLSLFRGDYANALAERSWRDRLEAAALLVLAGSVAYATFFCTSRPLLFLIFPPLILIAFRLGRLGVTAAAMVVAVIGGVATMYGRGPMVLIAADAVTQAQAFQVFLAFILLTCLPVAAEVSARARLTAELAAHDREMTRSAFTDSLTGLLNRAGFEHQIETILPIRALPPVSLIAIDVDHFKQINDRWGHPAGDRALETLGSLLASQIRPGDLVARLGGDEFVILLRESDLERARAVCERIRASARAAAFSTSAGSEAPVSLSMGLAVARVGERYEALAQRADSALYEAKHAGRNALRWAA

SEQ ID NO: 1769 - protein, 212 aa, Methylobacterium sp.
MAPYSNAQLMQDLWVLYELQEKRNGYFVEFGACDGISLSNTFLLEKRYAWQGALAEPARAWHEALHRNRSCYISDKCVYKTDGIEVLFNEVDIGELSGMEDFAGDDFHAQFRQERRQYPVATISLERFLSEARAPRHIDYMSIDVEGGEFDVLQSFDFSRHDIALISVEHNFSGSREKIETLLSSHGYRRRFRQLSLFDDWYVRPDLVIARA

SEQ ID NO: 1770 - protein, 76 aa, Methylobacterium sp.
MPRYFIVTSDHITVKDDEGVQLSGRDALRDTLRRLLTDILRDEGYRTEVNAFTAQAYDEAGKLVMSASASFSATDV

SEQ ID NO: 1771 - protein, 94 aa, Methylobacterium sp.
MDVRMTDRETCLDALGALIVRADPADLAAAQDILLRLVLREDGAARRAAALDGLRAELACATRAASRSREQEAFHTVLLAMIERTRDMAGATTA

SEQ ID NO: 1772 - protein, 295 aa, Methylobacterium sp.
MTIVPHPAAQRGGRQRLAARRQPGSATTSRITVPLGSAAALGCGHVQPAIQQICAPELMAAAQAALDGAFRATFVPDPLLGPGLSQLGSVLASMVKRHGSLIEAAITDVLERSGRYVVLRNVAMPITVPTQELVRASSVAQLNQTSIELTGAVAQSVFLDLIVVDRKESRAIIAEVKRGSGKNEARKIHQVEWVLRCAQVQGRSFLASLGYEVAQIRAVLIDVYGRAGYGDDITVSGPAIDQLFATPVLAALETVTAALQARLHAAVPDLLTMALASLAVPENVKHPHSPGPLAP

SEQ ID NO: 1773 - protein, 225 aa, Methylobacterium sp.
MVAAPTATWSHILSQVADSLDRFVEGPSAEILKLKPSFDTVEGPAALSASRIEPVAHPPILPEPAVNDAGPAPDPCESEAVSDWMSTLDIITGMAGRAEAQKQRLQEQSMSHEAALAAAQRALAETRHRLQLSEMRVREVEARADIRLQRVQAEADAQVQDIRAEAEARVRTIRAEAEAWVRAAEEQVRVADLRAETAEKWLGRIDAAAKALLLGGHASRGPAGA

SEQ ID NO: 1774 - protein, 104 aa, Methylobacterium sp.
MARDGNRPHPSALARYPVPIELISALFRADDAERDRLLAPMPAYGRARIAAYCAEHARLEALGLKVARSCDEATLVRAAGETVGADLFARSRAPAPSPIQLQAA

SEQ ID NO: 1775 - protein, 91 aa, Methylobacterium sp.
MRASKPVTVTLGDLQDRVEARVKSGSYASVSEVVRAGLRALDREEAALDAVLRQRVQEALDDPRPPIPADQVFTALQAHHAARMKAAKRGA

SEQ ID NO: 1776 - protein, 416 aa, Methylobacterium sp.
MNATEDLTRQAGPPEAPTGVLTGVPTLTVAELEADPHGVYRAWRPRLPFVGHEVAGVLVLRARDVELLMRDPRARATETLYPESRAIPEGALFDIFAHGMLTANGAVHRRRRSPFTRTFAARLIEGLRPRIRVAAEGLVRDWLGDGEVDLVARYTAQIPAQVIADILGLPRDDIPRFTHLAYEVSRVLSFSFGPEDIPDLEAAAIALQDYVAGILAARRSAPRADFLSRFLAETEAAGELTPQEVVIQLVQMIIGGTDTTRVAGAMQVALLLQHPEQWAAVSRDPDLIPAAVAESLRYEPSAGSAGRVAREDIPLDGHVVPAGSLMLLSTLSAMRDETVYARPDTFDIRRTDLPRLHPVFGGGAHRCVGEALARVELEEGLGAVLRLAPRLRLTGAMPVLRGHSGIRRIDALRVAA

SEQ ID NO: 1777 - protein, 147 aa, Methylobacterium sp.
MPASASLEERPPLVIPTTDLLSLREIVTATHPSDPRAAVAAWLAEELDRAAVVAPEAFPPRVITMHAEVSYRDDVTDQVGRMKLVYPGEEDAEGHAISVLSPVGAALVGLSEGQSIRWRTPSGGFRGLTVLRVLFQPYGGAGASDGP

SEQ ID NO: 1778 - protein, 90 aa, Methylobacterium sp.
MRLLLAATLLVLNATGASAGEPLLDGPVVAGCFGMGGSDYYGDVHSRMPFTGEAPPRPVGMADIVRVRAARARAATASRRQAPRRPAHRG

SEQ ID NO: 1779 - protein, 57 aa, Methylobacterium sp.
LQRSTPGGPPGQDLDFGTMTTLANFVSRLEGAVRRAAAERYAEQRERIARTGGAGMI

SEQ ID NO: 1780 - protein, 76 aa, Methylobacterium sp.
MSRYFISTDDHVEVMDEEGVEVPCRDALRDLLRQTLTAILRDEGEMTGVDEFTAKAFDERGRLVMQARATFSVTDQ

SEQ ID NO: 1781 - protein, 76 aa, Methylobacterium sp.
MPRYFIDTADHVAVRDDEGTVLPDRAALRDLLRRTLTALLHDEGEETGVNDFTARAYDEDGRLVMRARANFHVVDP

SEQ ID NO: 1782 - protein, 85 aa, Methylobacterium sp.
MAAVAFDTLTFARTLREEAELSPEQAEGLADAMAEALQGDLVTKADLRAELAGTRSEIVRWVAGLIGFQTLAVIGAVVALARALH

SEQ ID NO: 1783 - protein, 283 aa, Methylobacterium sp.
VADRPILLREAEVRAFLTGRRTQLRQPLDPQPQFFDVPILEGRGVGRVGHPGELWPFRCISTAVERDFQCWARRAVPHLAVGDRLWGQEPWQVAHETLDYETGGEYDVFEWREDEYGDPRPFLGGDARFGTRAGLFYSADGQDENPSNFYPLIGIRGDVLRPAEINWMPAEDMPRWASRCTLLVTAVRVERLHDISRDDAMAEGIVQTWGDFRGHPPEWALREGEDASHFYDNRTSVENFRLFWDHVHGPDAWAANPWVAAATIALQPGNIDSPAQAAEAAHA

SEQ ID NO: 1784 - protein, 220 aa, Methylobacterium sp.
MNTDAIAARIRALLAKTVSAGATEAEAMSAAEKARELMEKYRIEAGDLDKEPIRMETPEQRRGALIRAHLMAGVGRFCQVMAYRGADGNFRFVGRDGDVVFATWLLDALEAFVSRRTLDHVASLGGMSRGARERTLQSFTLGVCARISERLREASPAVSRGEARAIAEYLKGQGITIRTGKSSGRTTVDRDSFNAGRSAGDGAQFNRPVNAGQPARRIAA

SEQ ID NO: 1785 - protein, 57 aa, Methylobacterium sp.
MLARVWDVVKATLAVSALIAAALVSADKLDRQRSQPVAGAALVEPATTGAIAPAIRP

SEQ ID NO: 1786 - protein, 294 aa, Methylobacterium sp.
LATLCWAGLAAPSVAEGRLDKIRATGQISLGFPDASPPFGFLDQNAKPVGYSLEICEHVAQKLKAALGLNKLEVRHVPVMSATRIPLINNGTIDLECGTASNLPERHKLVSFAPTTFVAQVVLVAKKDTPVDVDDIASFRGKAISAQAGGETQRVATRINVRDKLDIQVMPAKDTAEVFLLVETGRAAGAINDDALAHATVAGAKRPADYKIGTKGLEFAPYGILEPKDDAAFKAAVDKAVVELIQDGTVARLYGKYFEQPIPPKGINLELPMSDVLKRALANPTDSGDEAAYR

SEQ ID NO: 1787 - protein, 42 aa, Methylobacterium sp.
MGLIAFILIGGPWVAATAWLWHQAGGAEAWRNAVHGTVPGRQ

SEQ ID NO: 1788 - protein, 427 aa, Methylobacterium sp.
MSGLIIFGLLIALMLTGMPISIALGLTVLTFLFTLTQVPIESVALKLFTGIENFSIMAIPFFILAGNFLAHGGVARRMIAFTTSLVGHWPGGLGLAGVVACALFAAVSGSSVATVVAIGSIILPAMVAEGYPRRFGAGVITTSGALGILVPPSIILVLYGVSTNSSIGNLFLAGVMPGIVLSAMLASVTFVIAKRRGYPRMPRASWAERLRAFRESAWGLFLVVMVIGGIYAGIFTPTEAAATAAVYAFVIAVFVYRDLKLSDVPRVLLASANMSAMLLYIITNAVLFSFLMTSENIPQTMAAWLIAMNFSPLVFLLVVNIILLIAGNVMEPSSILLIMAPILFPIAVKLGIDPIHFGIIMAVNMEVGLCHPPVGLNLYVASGIAHMGISELTVAVLPWLLTMLAFLVLVTYWPALSLWLPRALGAM

SEQ ID NO: 1789 - protein, 195 aa, Methylobacterium sp.
MLLKLLDRLEEVLIGTLMAAATVITFATVVHRFLSGIPALQDYTDRIDFGWSQELCIYMFIWVAKFGAAYGVRTGIHVGVDVLVNRLPPGARRVMVLVSLAAGALFTGIVGTLGTNFVWRIGHTDQTTPDMEIPVWIVYLAIPLGSYLMCFRFLQVAWSYWKTGHLPARDHAHVDGVPTVEGVDPIQLGREGGPA

SEQ ID NO: 1790 - protein, 423 aa, Methylobacterium sp.
MGELCVPDHSAKTHSAETNRDGPLAGVRVVDLTSVIMGPSATHILADLGADVIKIETPEGDSFRHYRPARGAGMGGNFLHLNRNKRSVRLDLKRPAARAALDRLIATADVFVHSMRPDAILRLGYGYARVRTLKSDIVYCGAYGFGADGPYAHKAAYDDLIQAGSGLAALQTAVTGQPGYLPTVLCDKIAGQAIACAILAALYERRAGGGGQAVEVPMFETMVEFNFVEHMVGYAFEPPLGPPGFNRVLSPRRKPYRTRDGHACILPYSDRNWRDFFIHTGRLEFLDDPRFAPLAVRVENIEILYALVEEEAPRRTTAEWVAFCDSVSIPCMPVLGLENLPEDAHLKAVGFFGSAEHPSEGRYRTMRRPVSFSGSRFAIRRHAPRHGEHTAEVLAEAGLDPAEIAALIDAPDKPDTAPLEAAR

SEQ ID NO: 1791 - protein, 290 aa, Methylobacterium sp.
MEQRTIGVIGLGMMGDPMSRCLARAGHALRLLDADAGRTDALARDLGAATLTLENASKLDLLITMLPNSAIVEAVLLDEGWADALPAGATVIDMSSSEPVRSRALGETLAGKGLGYLDAPVSGGVRRAVDGTLAILVGGEPDLLARWRPVLEAMGSSVLHIGPAGSGHAAKALNNFVSAAGLLATVEALHVAQRFGIAPEAMTDVLNASSGRSNTSENKVKQFMLSGSFASGFSLKLMDKDLGIAGALAESVDYPLGFGRHCIETWHAIAGEVGPAADHTEMYRLLAEGA

SEQ ID NO: 1792 - protein, 196 aa, Methylobacterium sp.
MSALGVGIWEDAPHTGCVRGDATMARIFGLTEAEAADGITWEQLSALFHPEDLARDQSERRRVREEGGLFAWEHRIVPAPGVVRWVLARGRFERRADGHIYGRGIVIDITDSRVDGPYEPPVGFLGAPAEPGTAVERMADYAMRLWELVGDLGPGEAKRVQPLLEVLLYELGRQIAATLSGEPPEAPRRPRNPRAH

SEQ ID NO: 1793 - protein, 307 aa, Methylobacterium sp.
MDRSARVTEILSWYGADSPGTLTNLARMLEHGKLGGTGKMLILPVDQGFEHGPARSFGPNPPAYDPHYHFELALAAGCNAYAAPLGFLEAGARDYAGRIPLILKLNDHDLLADEEDPEQAITGSVADALRLGACAIGFTIYPGSAHRNAMYGQIREIAEEAKSVGLAVVIWSYARGSALSKEGETAIDVIGYAAQIAAQLGAHIIKVKLPSAHIEQPAAKKVYESTGIPIGTAAERVRHVVQCAFNGRRIVIFSGGAQAEEASFLDEIRAIHAGGGFGSIVGRNAFQRSKADALSLLGKITDIYAGR

SEQ ID NO: 1794 - protein, 218 aa, Methylobacterium sp.
MATDTRAGQAIYNPRTLQIYDLVVLRLSNPLIWRCPTARILDLYDRHAGLAHLDVGVGTGWYLDRCRFPAPAPRVGLMDLNADSLAFAADRIARYRPETYQVDVLGAPASGIAPFDSIGMTYLLHCLPGDIAAKAKAFDTVRPCLADDGVVFGATILSGGVPTTGAARALMRVYNRKGVFSNAADTLPELRAALEQRFRSVEITVVGCVALFVAREPR

SEQ ID NO: 1795 - protein, 69 aa, Methylobacterium sp.
MAYKITFRRGKRESFTKLWPCDLEAATAYALAQLPLQQRENGATSVTVVCERTGEVVFNSTEQPEVATV

SEQ ID NO: 1796 - protein, 95 aa, Methylobacterium sp.
MIRRCLLLLVSALSLPLQTGVALAESEMPAGGAFMSSYTSDPYFDPRSRYSQAHSTGDIRGQPMLAEPGDAQPPCELFDTACAAAFERSRPHAYR

SEQ ID NO: 1797 - protein, 279 aa, Methylobacterium sp.
MKFPDGDTVRGSWTIADFSQYIGGYDLQGKSVLDVGTASGFLAFNAEKAGAQVTGLDAASTDEFRHVPFSDSLSYRDIRQFKDTWTIHNLIPIKNSWWHAWHKYNSKAKCVYAPMPELYEWPEQMFDVVMAGAIVEHLSEPVYAIGAWARLAREAVLIPFTDVVPVDDLMMRPITPLDNSAINYVWWHLSRGLYNKIFDNLGFDLHYTLARAEHHDAEGGTQLATRPSIIAIRRGTDAARRFDASKLEDPFPSVLVSAVPAPPDTLIPGGKKRWWRGKL

SEQ ID NO: 1798 - protein, 112 aa, Methylobacterium sp.
MAARPRFASTAQAMRASAAIRRAVPTAGGAARLAHHLGLHAVSVAQWTFCPTQHVEAVEAASGVSRHDLRPDLYPRAGKGRDLTPDQAVAAHLAAGDHFARTGRCLSSEAHT

SEQ ID NO: 1799 - protein, 358 aa, Methylobacterium sp.
VRAPAVVGLVLLLMAGPGPASAQVEPSPAAEGTGSAAARGETVVVVRATTDEAEVADLLAGFREAHPGVAVSYTKMNSATLYDGFVEEAAAGTVKADIVWSSAMDRQIKLVNDGYAAHYASPEASSLPAWAVWRNEAFGVTAEPIAVAYNRTLLPPEQVPQTRADLIRALTDHPETWKGKVAAYDPERSGVGSLILAQDADVTSRTWDLVSALGQAGVKLYTRTETMLDRIAAGEAILAYGVFGAYALERARHDPAIGLVLPTDYTLLVSRIAFIAKDAPHPAAARMFLDYMLSREGQARLAARSLTPARTDARRADDPVASAPALRPVPVGPELLANLDQIRHARMLRRWRRAMEGR

SEQ ID NO: 1800 - protein, 466 aa, Methylobacterium sp.
VTRPRAPSIRRRLLVRMLLPALALALLLGFAGALVIRNVVETTHDRLLDGSVLAIAERLTVEDGEVSVDLPRVALGMLESQAQDRIYYSVTYGGALVTGYRDLPGLDVDTLPLGVTTHRDGIVRGAAVRIAAQARRVYGKPNPVLVQVAETREARQGLERRLLAGLALAELGLMGLIGALSWYSIDSSLRPLTRLSDAIDRRAVPGAINLQPLDVAGVPREALAPVLALNTLLERLEQSIAGERTFTSDASHQLRTPLAVLRMHVELLRRLTPGEPAHAAAIDDIDGAARRLERLLAQLIALARADAGAAGTDAPAAITDLNDIAARVVTEQVPHALARGGEIALDRPDGAVPVVGDPFIVGEILTNLVDNAIRYNRPEGTTVVRVRRTEIGACVDVEDEGPGIPPEVREKVFERFYRVATRDGPDGSGLGLAIVRALADRIGGAVTLGSRPGGSGLVARASFRVP

SEQ ID NO: 1801 - protein, 669 aa, Methylobacterium sp.
MNGTFSDACGVAVATLLGIPLVLLPGYALGGLTGILGFRTLAPGDRLLCGALLGIGLLPALDSLLIQAGGVPVATLATGALGLAALRPVVRSLRESLDRAALALALLWLGVVAYALIDVDTGTALYRPVTIIDLVKHAALTRAIVEHGLPPVDPFFARPERAGYYYGFYTLTALVDWAGGRLVDGRTAFAGLAFWTGLALLGLIDRLLAATGLVADAVPRLVRHAVLLLLPAGSLDILLVLADRATSGTWLPVPEWLNEQILNWPASLVWVPHHVAGALAGWLGLLALAEVADRTRPDRRAEAAAIGVAALAFAACAGLSVWVCLGTAAAAGAWLMLLGLERRWRAAARLAVAGLLSAALAAPYLLSVLANRTDGGAPIRFAIRRFGPLDGLVDEPALSALRLILLPLNYYTALGVCAAGALLFWRLVPCREAHGREAGRLLTLCAAASLLLGGFLRSAILNNDLGARVVLLAQVAALVWTVVALTRLSEARRLRFPGLLAALLILGYATTLYGFVGMRAYPASDRPAFARLAGRPDIDRALRAAYAWAGTHLPRDLVLQQSPVPHRVFDFGLYGLQPTGVADAEARLFGAPPDAVASRLADVAPIFRDRLDGAEVRQRADSAGIGALVVTAQDAPWSSPDSWVWRSPAVYADPLVRILRVQDLRGGSP

SEQ ID NO: 1802 - protein, 193 aa, Methylobacterium sp.
MAESPFPQITLVRHGETAWSRSGQHTGRSDIPLTPEGEDAARALAPRLARRAYAEVWSSPSSRAAATCALAGFGDSRAIDPDLAEWDYGAYEGRTTKAILADRPDWRLFRDGCPAGETAADVGARADRVIARARARDADLIVFSSAHVLRVLAARWIGLEPRCGALLVLGTASVSVLGYEHDRTEPVLRAWNG

SEQ ID NO: 1803 - protein, 318 aa, Methylobacterium sp.
MFAERPRGGVGAWPLIAATLVATVVWMAVAGLHFAWDSALVTLAACGGLEALARVYRTRRPEPRIAATLSALAQVIAFSACAAALSYTVASTGGPLWDSTFDAWDRRLGLDWRAYLAFVDGHPRLGLALSLAYRSLILQTMLAVILLGFSGRLRALRDFVLAFALAGTVTVLISALTPALANFVFLGLSPADFPNLHPAASYVRVADLTGLRDGTLRTISLDHVEGIITFPSFHAALGALYIWAFWHLRAARIPALLVNVFLIAATPIDGGHYFVDVIAGLVIAVLAICAARALGRRRRATDALRPGAPEGGPAPGRA

SEQ ID NO: 1804 - protein, 335 aa, Methylobacterium sp.
MRRSILFLAACLLAGITPAASAGPAADGVADLGSYAARVEVHPFESLTLTDRQFLTGTSEGAKPITVAGILRVAKAGTERLPTVILMHGSGGLGGNIEFWQRALAARGISTFAIDGFTGRGLTSVNTDQSLLARTNLILDIYRALGVLAKHPRVDPARIAVMGFSRGGQAALYASLKRFDAAWNRSGVIPALYLPVYPDCSIRFRDDTAVADRPIRIFGGGGDDYNPAATCAAYAERLRAAGADVDLTVFPGAQHVFDNPAGPTQPVVARGAQTVRACAISEAADGALVAGPDATPFTYADPCVQRDPHIGSDAAARAGILARVSHALDVAFRGR

SEQ ID NO: 1805 - protein, 361 aa, Methylobacterium sp.
LLEHYVPIKPSWGKLTPQAFVTSYPLSIRDDIVRAGPWGIFRIVLSAAFSRVARRRIGNAREFARYWIGDYLLRRSGLESYMKRFFGVPADRVDLEFAEKRMLWIKEHASPRVLLRYVRRHRAPGPTNRQLARPREGFNALYEVAARTLRQRGSVFHLGERIDSITRRGTQFDVRTGGRRLTAKRLISTIPIARALTLCGVREDPGLASVTLISLYFSFDGNRGFDCSILYNFAHDGAWKRLTMYSDFYGRVEGREYFGVEVIAGHANDSVTIAEEDFRAHVAKNGLFAGDLVCEGSQVVPCAYPIYTGQAHQRVSRALAQLADFGIESFGRQGGFDYQPTARVSTLNAAAHLMPTRTSDA

SEQ ID NO: 1806 - protein, 845 aa, Methylobacterium sp.
LARELSGGGLRVVLLESGGLDRMESADALDAIVNVGRPRATQWAVRNRIVGGSSHTWGGRCAPFDTIDFEQRAWVPESGWPFQRDALDPYLERTAKYLGLAYGNHFSDARFWELFGSQPAWSEPDPRMLLPFFWQFSRDDAESYPFEYTRFGRKLDEKLGPNVTLISGATVVAIDVNGTGDRVQGVQVAAPDGAIVKLPARHVVLCAGGIENARLLLASDHQVPGGLGNRFDRVGRYLMDHLRGPVAHFDPHRSRALQRRFGRYTIEDRLFRGGLRLSPDVQRSRQLLNCAVWLGETLAPDDPGDAIRRILVGKPRAKDILTLTSNLPLLLRGCRDHFIARNGFPRKLSELSLECMVEQRPDPESRVMLSDRRDHLGSRLPLIDWRSHEDEGRTMRETARLVVSEFARLGLPVPELADWVREEAPIPLSFVDVAHPTGTTRMADDATRGVVDARGQVHGIDGLFVTGSSVFPTGGHCNPTQMIVALAIRLADLLKVREQRDTVVSDLRTSPPVPADLRVLVTGATGRIGRILVEDLQERGYAVRAVTSQPLTEAQPRTGRIEWRTFDFTADQDYAGLVHGCAAVMHLAAELGKQDRMQAINVEATRRLAEAAERDGVRAFCYMSTVSVYGSGRARTMTETAPVLTSSVDVKSEYWALDYVRAYGRTKLAGEEAIRRVASTLPYVILRPTVVVDLHNLIGLRDWSLSKRLFAAHRPSHHVYVRDVTDAAIWTMTRSLSGAWPAGEVQVFNLSDHEARDARIGDFMRRAFAISRDPRFRVIPMPAVVDWLHDFLRNRTLPLRNPLWRMRFPNDRLRQAGYRHRYGMARARAMALDILRAETRERTRA

SEQ ID NO: 1807 - protein, 324 aa, Methylobacterium sp.
MPGTNRRDLVRAALAGGAVLGLGGRARATAPFGGAQAPGFYRTRVGSCEVTILNDGARSFPMPDRFVRNVPRDEALGAARAAYMPPGQVTVPFNPTLINTGAKLVLIDTGNGPVPGAPVGRLAANLAAAGIRPEDIDLVLLSHLHPDHTNGLKRADGSLAFPNAEIRAAAPDWAFWMSDANMARAADPVTQGYFANTRRVLGDLKDRIGTFAWDEEIVPGITALAAPGHTPGHTAFAVASGADRLLVQSDVTNIPAFFLQHPDWHVMYDHDADQAQATRHRFYDMAASERALVVGYHFPFPSLGHVERDGPGYRLVPIAWTGAL

SEQ ID NO: 1808 - protein, 96 aa, Methylobacterium sp.
MNITMVGSGYVGLVSGACFADFGHTVVCVDSNRGRIDALNAGRMPIYEPGLEALVAENVRQDRLSFITDLEAAVGQADAVFIAVGTPSRRGDGFAD

SEQ ID NO: 1809 - protein, 458 aa, Methylobacterium sp.
MADASKTRVAIEQASENERARIYRKISLRLIPMIFLCYVLNYIDRVNVSFAKLTFQSDIGLSDASYGFGVGIFYVGYILFEVPSNLLLGRIGARKTLTRIMCLWGLVSCSMAFVTSPATFYLARILLGAAEAGFFPGIVLYLTFWFPHRLRGRVMSLFVLAIAVSGIVGGPASGWIIQHLAGAAGFKGWQWLFLVEGALPVLVGVGAFFVLSDRPADAAWLTPREKAIVAADLSSGTFEQGHAPARAFLSALRNPKLWIATFGYFSITWAGTVLNFWAPTIIQRSGVADVFSVGLLSAIPYSVGAVGMLLLCRSSDRRLERRWHFALSAFLAATAALAISLVAQNVAAAIACLALLAIGYLSATALFWTIPVRFLTEAEAVGSLAFISSMGQVGSLAAPIAFGFFTSLTGGLAVSTGLVAFVLATGGMAILSLRNPRLVERPLSSKPINTGCDFGTRS

SEQ ID NO: 1810 - protein, 239 aa, Methylobacterium sp.
MSSRELASVSTTATANEPELESDMAAKQVTLTFDNGPTPHVTDQILGILDRAGIKTTFFVIGQRLDDPAAADLMRAAHTAGHWIGNHTFTHSVALGDRTDRDYALREIEETQQRIGSLTRPEKLFRPYGNDGLIGRHLLSRAALDHLLAERYTTITWNSVPGDWKDADGWVETAMAQVREQDWSVMVIHDIEAGCLVRLPELLQRLTDLGATFEQAIPRSVILTEAGRTVSMSPDFMAD

SEQ ID NO: 1811 - protein, 300 aa, Methylobacterium sp.
MELRHLRYFVALAEHLSFTRAARQTHITQSTLSHQIRQLEDQVGQRLFDRVGKRVFLTEAGQNLLPRVLRALGELDEGLRALSPQDQVLTGWLRIAATHTFNVNLVPACLTEFLTRNPSMRVVVEELAASVIEERLLAGALDLGISYRPDHQQDLAFEPLYDEPLDLVLSPEHRWAARKWVRMAELHHQPVVLLSPEFTTRRLLDDCFRQCGAVPHLVAEMNTIGPILGLVRRMNIVAILSRQAVPEDGTLLSVPLETPTPMRSPGVLLRRNEVLPPHVASFLHTLRRACNKTSHSTRRL

SEQ ID NO: 1812 - protein, 431 aa, Methylobacterium sp.
LQWRLLPFLFACYVAAYLDRVNIGYAQLHMRAELGFNDAVYGLAAGLFFVSYFLCEVPSNFVLQRVGARRTLARILILWGLASSATMFITGPHSFYALRLILGAFEAGLAPGVMYYLTLWYPNRRRAEMTAIFLSGSMLAGVIGAPVSGFILEGMQGVLGLRGWQWMFLLEGMPAVLLGLVALRILVDKPQDAPWLTSSEKMLLLAEINRDANLAAGGHAFGAAFRDPRIYVLALAYFTLVCGLYAITFWMPVMMQAAGVQGAAAIGLWSVIPYAIGGIGMVWLSRRSDRRQERRWHYAVCVGVGACALIGASLAGANLPVVLALLSVATATLFGAMPIFYGIPMAYLPERSAAGGLALINCLGLTGGFVSPFLLGWIRNATGSLTPGLWFMTGLMLTGIVVLLLATRRPFTRVTPHPANSGLSFGSEAGR

SEQ ID NO: 1813 - protein, 218 aa, Methylobacterium sp.
VSLDSLAHRWYASEGSRSPLLLLHGTGGDEDELVPFAQAAAPGAPMLAVRGAVSEGGKLRHFARHPDGRFDSSEVVRRADELAAFVAAARDRYGFGPPLALGFSNGANIAAALMLLHPALLTGAILLRAVPPLTGTAAAALVGQRAVVVSGETDTIAPPALGADLALCLTELGAEATHHVLPCGHDLTPADVPLARDWLSSLAEGAPAGPASSHLIRP

SEQ ID NO: 1814 - protein, 990 aa, Methylobacterium sp.
LGIVSTSYVGRSVERVEDAALLSGLGRYIDDLGTRPGTLHASILRSPHAHADILAIDVQAAKALPGVTAVITGRDLDAVTTGLVPALRAAVDARAIAVDRVRYVGEPVAIVVARDRYLAEDGCDLIEVQYRVRPAVVDPLAALAPDSEILHEGVGANLVSDRRFRYGDPEVAFADSPHSLSVTVRYPRNTGSPMETYGVVASYDPTDDSYDVLANFQGPFSIHAVVARALKVPGNRLRLRTPPDSGGSFGVKQGVAPYAVLIAATARLVGRPVKWIEDRLEHLSASVSATNRVTTLRAAFEADGRVTALDWDQVEDCGAYLRAPEPATLYRMHGNLTGAYAIRNVAVRNRVVLTNKTPTGLVRGFGGPQVYYPLERLMQRIAVTLGLDPFAVIRANLIPADAFPYRTATGALYDSGNYQRALDEAARDGGLVELKRRRDAARAEGRLYGIGLTAAVEPSVSNMGYITTVLTAEERTKAGPKNGAQSTATITLDPVGSVTVQVASVPQGQGHRTVLAQVVADVLGLPMEQVRVTADLDTAKDAWSIASGNYASRFAAAVAGVAHLAATRLRDRLARIAAAQLNLRPEDLLFADGRIASRLNPDAGLPFARVAATSHWSPGLVPEDLGAVIRETVFWTPPELTAPDAEDHINSSLCHGFIFDICGLEIDRVTGKIAIDRYVSMHDCGRVLHPGMVEGQVRGGFAQALGAAVYEELAYGDDGAFLSGTFADYLLPTATEVPDLRILHVESPSPFTPLGAKGVGEGNCMSTPVCLANAVADALDLEAIDLPLTPAKLAALAAGGDEPAPPAGRAAKAAAKAGDRTLRGDGAATVTAPPETVWAMLLDPDVLASVIPGSHGVRKLSDTRFRADVTLGVGPVKGRYKAEVILSDLDEPRAVTLTGTVTGGLGSGGGTGRLTLEPDGSGGTRIAYVYEAAVGGKVAAVGGRLLDGAARVIIGGFFTALARRAGGSGKRGLRLPVALRWLLARLGVSA

SEQ ID NO: 1815 - protein, 69 aa, Methylobacterium sp.
MTVSDSAVPYVLGAAAVRSVEVIDGGGTLAIRLRSPDDSEFCVLLPIGVVGDLLFQLADVMSVSLDPRP

SEQ ID NO: 1816 - protein, 323 aa, Methylobacterium sp.
MAIRHDDLIVIDGLIVSDFGPEVFADMRRGGVTAANCTCSVWEDFATTMRTMARWRRWFREHADLITPVHDVADIHRAKAERRTGIIHGWQNTSAIEDRIEYLELFHALGLRIVQLTYNTQNLVGSGCYESRDSGLSDFGRDVLAEMNRLGILCDLSHVGPKTSEDAIRASQRRVAYSHCLPAALKDHPRNKTDAQLRFIAERGGFVGVTMFPPFLARGAAATIEDYLDAIAYVIDLVGEENTGIGTDFTQGYGQAFFDYITHDKGDGRKLTDFGEVLNPEGIRVIGDFPNLTAAMERRGWPAARIERVMGGNWLALLGDVWA

SEQ ID NO: 1817 - protein, 57 aa, Methylobacterium sp.
VLPRVTEDCRARLCRVEFDRVPGVGHLSMAEDAAPAALDRIGDRSAGVPAPGDCGEP

SEQ ID NO: 1818 - protein, 37 aa, Methylobacterium sp.
MTVLRFLRNWFLVSIPLGLLIGRFIKAGEGPPRRDRR

SEQ ID NO: 1819 - protein, 309 aa, Methylobacterium sp.
MLTALLAAAPARAQAPAQAPAPAPAGPATKPESDPAQETIRKLNAYVGLLNRTLRAQDSLGRYQSWVNMKTGPTGRERIIYGLYGLYDVRGEIAKAEAATAQPPAMPDLDGAVKTYIAAYQALAPTVTEAEGYYERQDYRADKMEQGKALHAKLAVAGPAFLAARAKVDAALRVEKEKSDALELAALEAREGRKARWHVANVMTACRKVMDLLPTDAKPVVDMAAFDAALGRYAVAVKDMDGYSAANPNSFHVFESRPRALLGKLREFDDKLAKARGDARRGAGRDVTWIVNDYNMMVSTAQTATTFSR

SEQ ID NO: 1820 - protein, 534 aa, Methylobacterium sp.
MFGKILIANRGEIACRVIATARRLGIGTVAVYSEADAGARHTWMADEAWPIGPAPARESYLVAERILDVARRAGAEAIHPGYGFLSENADFAGACAGAGLVFVGPPSAAIRAMGSKAEAKALMERAGVPLVPGYHGAAQDVPALKEAAARIGYPVLIKASAGGGGKGMRVVEAAAAFEAALAGAQREARASFGDDRVLIEAYLTRPRHIEIQVFADSHGNTVSLFERDCSIQRRHQKVIEEAPASGMDPVRRARMGEAAVAAARAVGYVGAGTVEFIAEGETFYFMEMNTRLQVEHPVTEMVTGLDLVEWQLRVAAGERLPLGAPDLALRGHAIEARVYAEDPARDFLPAVGTLAHLRQPEAVPGRVRVETGIVQGDRITPDYDPMIAKLVVWGEDRAAAIRQLATALAAYEVVGVTTNLSLLRAVAGHPAYRAADLDTGFIARHADDLLAPLATGAVDPALWAAAALTVLRDRRTAVAAQAQASGDPWSPWADPDAWRMNGAGYQDLQFRHGDAPPVTLRACPRPDGSARLDL

SEQ ID NO: 1821 - protein, 331 aa, Methylobacterium sp.
LFARVGQPAACPWRLALITLLQFSENPSDRRAADAVRARIDWIYLLALDLTDPGFDASVLSEFRSRLVAGEAEALLFDTLLTLCRERGLLAKRGRQRTDATHVLGAFRSLNRLGCAIETLRAALNALAVVAPDWLRAYTDPSWIERYGRSIGDFHISQGETARRACAETIGDDGHRLLAAVDTKAAPGWLRNVPAMVVLRRVWLQNFHVAEPPAEGSEGDGRIRWRTEAEGIPPALAMVASPYDPDVHYAKKRATTWIGGTVHLTETCDDAQPPLIVHVATTPAPAWTGRCSTRCTRRWRRRICFRRAISSMLPISTPTASWPPREITTSP

SEQ ID NO: 1822 - protein, 503 aa, Methylobacterium sp.
VSAAAPVLSEAAAAEEEPGLASGAAVTRRSFDAARWVALASVGNVVLSFGVFLVLARLIGPAEFGMVAIAAVFIDILQIVARCGLPDAVVQRADLDEDFAATAFWVMLVTGILCAVGLVALAGPIAWIFDLPALQPVLCALSACFVITAAGAIHEARLQRSFGFRKLALRALGANVLGGAAALVLALDGYGVWSLVVQRLVAAIATTLLTWAAARWIPPLRLHLASVREQVAFGSRLLCTYLLLVASIRSQEVIAAYFLSATDVGYLRLAWRCIDLVSQVAVIPLTTVGLTTYARLQDRPGELAAAFHGFTEASAFLAVPAFFGMAAVAPTLIPFLFGDQWHDAAPVLRTLALLAPEFVATSMLWMIFTALGRNGTALRLAGAQFGLGAVAAFVTAPFGLAALVAGHVVRAYLFTPAIVASAGRVVPVTNERLVRLLAPITLCAGAMAGLVLLVQGPIHAALGDRFGLFAAVGLGIAAYLGLAWIFMRGTLRTAVGLFLRRPA

SEQ ID NO: 1823 - protein, 378 aa, Methylobacterium sp.
MPRVLVNMPSQHAGRPSGVALVAFRVIAGLVARGTFAVVLRSPWRRDQLPAAIRDRVEVVTVPRPRIMLLDVLRQCLAVPRLSRARAIDVVLNIDPYGAAFGGRARVSVVHDLYFRTLPERIRSREALTTDPIFRLVLGNSARVIAVSEATRRDLEYHYPRLRGRTQTVPSAAMLDPSAGGSAAGVPAGPYVLAVGNALYNKNFATLAHAVVGLGRSGIGIVHVGEDSDEAIATALGDAPVPLTRLSGIGDDKLAALYRGALCLCVPSFAEGFCLPVLEAQALDCPVICSDRSATPEIAGPGALTFDPADAAALTECLRRLLDEPGLRDALIARGRDNVRRYDWAETARRYETLLLDALRDGAAARTAREVPHAHPAP

SEQ ID NO: 1824 - protein, 408 aa, Methylobacterium sp.
MTEVLHADALAERAPRDRAQASRSDVAARPRVLFVSHTGTMSGAELVLRDAVRPWAGSSAFLFEDGALTEALRNEGLEIRLARRRSALAGLKRDVSPLSALPVLGQLGALALEIARAARACDVVYANSQKAFLLSSLAARAVGRPLIWHLHDILDGAHFGRAQRVLQVRLANLCAARVIVPSEAAARAFVQAGGRRSLIRIVPNGLDVDPAPCPAATLRAEFGLPDGPLVGVFSRLAPWKGQDVLIEALATLPGLSCVVVGAPLFGEDAYATHLRDLATRLGLSDRVLFLGQRDDVPRLMQAVDAVVHPSVDPEPFGRTLVEAMLVGVPVIATDTGASAEILDGGAAGTLVSPRRPDRLAAALSALFADPDSFRARTALAQERAPSRYGADRMQRDLADIILQVAGRA

SEQ ID NO: 1825 - protein, 389 aa, Methylobacterium sp.
MRVAIVHDWLYIVGGAERVLEQLLRIYPDADVFALFDFLPEADRARLGYTQAHTSFIQRMPFARTRHRNYLPLMPLAIEQFDLSAYDLVISSSYAVAKGVLTGPDQLHVSYIHSPMRYAWDMQHTYLRESGCDAGMKSVLARLILHRMRVWDFRTAAGPNAIVANSAFVARRIHKVYGRTAEVIHPPITLPSQRYDGPRGNHFLVASRLVPYKNVEAVIRAFALLPDLELVVAGTGPDAARLREIAGPNVSFSGFVPDAELRHLMATARAFIFAAEEDFGIIVVEATSEGTPVLALGRGGARETVQTRGPQRTGMFFDTPEPVAIAECVQRFLLQEGHFTREACWAQAELFSAELFRSRFSTFVDDQMAMHRAACETRPRILPRLEAVG

SEQ ID NO: 1826 - protein, 530 aa, Methylobacterium sp.
MKRRTLLQGAGALVAGAVAAPALVRAEAARTLRFIPQQDLVTLDPVTTFAYITRNHGYMVFDTLYGMDAAYRATPQMVEGHRVEADGRRWDLILRAGLRFHDGTPVLARDCVASLRRWAKRDPFGGSLMEATDELSAPDDRTIRFRLKHPFPLLPIALGKASVPVCAMMPERLAAIDPFQQVPELIGSGPFRFKPDERVPGDRVVYTRFEDYVPRPDGPLTWTSGPKVVHFDRVEWRVIGDTSTATSALIAGEADWQEYASHDQIALLQAAKGVSTRVLDPTGFVTMLRVNHLQPPFNNPAIRRALWGGIDQTACMQGVVGAEDPGLFHVPLGFFCPGTPMASTDGLQPLTDPRDPARVRADLKAAGYGGETVLLMVPSNSAPLLALGQVAADLLQRVGMTVEVYAVEFNAMLQRRNRKGPVSEGGWSAFVTNWSGMDWLNPAGYIALRGTGESGYAGWATTPRIESLRDAWLTAPDEAARAALCRDIQLQAMQDVPYYPLGQYLQPTAYRSRLTGILDGFPTFWNVRPA

SEQ ID NO: 1827 - protein, 759 aa, Methylobacterium sp.
VPPARPGAGAARWIPPAILAAGLLATGLSTALSWQAAALRDRLTFEHATEIELRTVEDQFRTYTALLRGAAGLFAADGDTVTLAQFRAYVQRIEFQRLYPGFLGIGFTPTLPASARETFAARAAALGVENARVRPPTDNPMISPVLFAEPPNPRNLAAIGFDVMSDPVRRDMVERARDTGQPAASARIQLVQEIDANKQAGFLVAMPVYAGGAVPPDLEDRRRRFLGFVFGAFRADDLFNSIVAAEAEEDAAFAIYDGAPSEANLLHRSARASAAGAGRLTREAHLELGGRTWTVAFAQRVSPRRGSALPEIWLVCGGGLFATALLAFAAYRQRRTQDEIRQLNASLEARVEERTRDLRAAADRLRQAGEERARMEEALRQSQKMEAVGQLTGGLAHDFNNLLAGISGSLELIEARIAQGRSKDVGKYIAAAQGAARRAAALTHRLLAFSRRQTLAPRAIDADRLVRGMLDLIQRTVGPSVEVRHVGADGLWVALADPSQLENALLNLCINARDAMPGGGRITIETDNRWIDRQQADAQDMPEGPYLSLCVSDTGTGMAPEVVARAFDPFFTTKPMGEGTGLGLSMIYGFAKQSGGQVRITSTVGQGTNVCIYLPRHFGEADADGPDPGRGLMAQAEAGETVLIVDDEPTVRMLVTDVLSDLGYTAIEAADGAGGLSVLQSGARIDLLVTDVGLPGGMNGRQMADAARVARPDLKVLFITGFAETALPGDGRLEPGMAVLTKPFAVEALAARIRELIAR

SEQ ID NO: 1828 - protein, 363 aa, Methylobacterium sp.
VAEAAGGRDARANNFGSLRLLFAGLVILAHAPELVDGNRSRELLTQVFGTLSLGEIAVDGFFLVSGYLITASYRAKRSFGDYLARRALRIYPAFVVASLLCIAVVAPLGGGNLAAASPLETLLRLSLLLMPVVPGAFAELPYPLLNGSMWTIPCEFGCYLLLGLFGTARALRRRGRYLGLLGGLGSLLALRWLFLPVGHPGDTLGSLSEMIRLTFVFCCGGAFRLFADRIAYTRRGATRAALLLLPLMFSRPLAEPAFAILGGYLIFWFAFAVRPTALSRATAQVDPSYGLYLYAWPVQNLLVARIPGISPWTVAALALAAAIPLGLLSWYLIERPMLRFRPGPGGARPEPGAIPAAGSALGA

SEQ ID NO: 1829 - protein, 210 aa, Methylobacterium sp.
MRVLALTTQKGGSGKSTLAASLAVAAMQDGETVAALDTDQQASLAGWGQRREANGLDIQRVEPSAFAGTLGKIREAGAVSLVIVDTPGRFGPDVALVLREASLCLLPVKPSILDVEAARPTVEQLRLLGRPFAFVLNQCNPTTQARTLDAATALVSTGALAPSMVATRSDFLDSMTTGQGVTELAPKGKAAVEVRLLWQWIKAQLGGAKA

SEQ ID NO: 1830 - protein, 99 aa, Methylobacterium sp.
MSNVITLPSRAKAAALATHYETVATYGETGPVSIALLRRLDASAGLIHVALLGVLQGVEIIASLPDNDQGRAIADFVGPAALRAVELSEVEFAVTSEAC

SEQ ID NO: 1831 - protein, 109 aa, Methylobacterium sp.
MTVEMRMLMAQALPPLTLPTDRARRSRLSDPLPRLRRLVCVVAALTLPVLGVAVAETVHRAGSPRAPQAAAPATPSGGAAAPSGAVGPRRAARTLRVAARTEENHEVRS

SEQ ID NO: 1832 - protein, 574 aa, Methylobacterium sp.
MHPDETVLFSVVPKMRLRRSIVSKLILPSIIGFLLFLANSTVGLMQIQAINAAAVETRDVWVRKDNDLHTIRFLMLRYHTTTIRKVVAVDDGENRDLDAEFVEMDRTIPEAFQSYRARATTPRERALWDAFEGRWKVYRTAREAILAPLRRGDRNAARDAIAPARTPLVAAFDALAELAQVTAEGTNVSVQRSEDAFRTAWSVTVALAVIGLLMTGAAVWWVWHRVARPIRSMAGTMGRLAADDLDAAVGGSERGDEIGVMAASVQVFKDGLIRARTLEHEAAQARATAEAERRSGMHRIADAFEGTVGGIIGTVSAAVAALQDTASAMNGAAADTADRSGRVASAAERAASTVNVAAAAAEELGASVQEIGRQVAGSTELTQSAVADAEATAHLVQELNGAAIQIGHVVTLISTIAEQTNLLALNATIEAARAGAAGRGFAVVAAEVKELAGQTARATDEIGGHVARIQSSTGDAVTAIGRIGGRVQELSAVATRIASAVEQQGAATQEIVRNVSQAAQGAADVTGTITGVADAAKGTGAAADQVLTAASELSNRSGHLRDEVTRFLATVRAA

SEQ ID NO: 1833 - protein, 520 aa, Methylobacterium sp.
VDYYFARLKIFSRVREKFVDAALMNRNLIIGEPKGDIPLFRKRYDASVKAVADGIETLEQGSRRAEIAALQRQIGAVARDYFDLLDRSNYLALRNDRPAVIQVGVVASREVRAQFDRAAQAYEAEAAARLGEAKIATQQGAEQARTVLIGATVAGLLVALGLSAAIVVVGVTRPLHRLVAALRRVAQGDGAATIAEARRGDEIGAVGRAVEAIRSLIIRNAEAEAEGRRRAEAAAAAARKEATMGLARTFEAAVARIVDRVSTAAGELEGTAHQMTATAQETASQSGAVALAAEAAAVNIGAVASATERLGSAIRAIGRQAGGSSELAQQAVGEADQTAGLVAELRQAASEIGDVVRLIASIAEQTNLLALNATIEAARAGEAGRGFAVVAGEVKALAEKTARATDGIAAQIGRIQGVTGSAVGAIGAIIDRIREINGVAIAIAAAVEEQGAATQEIVRTIAQATRGAAEVTGTIAGVAEASERTGVAADHVLTAATALSRQSEGLSAEVGRFLANVRAA

SEQ ID NO: 1834 - protein, 497 aa, Methylobacterium sp.
MPQTPRHTETLEAQLFDLAPVSLWLQDLGALKARLDAWREAGMVDLRAWLRDPGHLRTCQSLIRIVRVNRSTLATYDARDEAELFAHIPAIFNDPRADALIEVLCQLWAGATQVRLVTQNRTVAGRVIDVSYAGQMLPGHEADWARYLISIEDITQREALRRESDSDRRTEALFQHAPVPTLIRDESELAARLAALRADGITDLAGHLAAHPGWLAEAEASRRIVDANRPALALFGVDTRAALARHLSGGLGEAPLQLFREELAELWDGAAPRSRDIAARGRDGRHLHLKMQRSPVPATGDGRRLVQIALTDIGDNKRSEARLEILSLTDPLTGLRNRLGYAAELDRLEADRTVPTSVIVADLNDLKVTNDDRGHEAGDDVLRRFGAILARHSPVTARPARIGGDEFVILLPGLDAAGAAALARRILDGIDGENRSGAAVISAALGSATWRGDGSLKAAVACADSHMYAAKRRYRDGAWDGEPPVPGTSVFSQASLR

SEQ ID NO: 1835 - protein, 247 aa, Methylobacterium sp.
MGPGPTSASSATCAIGVMAKAPRSGRSKTRLCPPLNPDQAALLSAAFLRDTTANILEAARAAPIAAYAAYAPRGAEALVVPHLACGTRLVPADGGIPAPAAVEGFGLCLLQAVGGMLAEGHAAACVLSADIPTLPTRRLVQAARILLAPGDRAVLGACDDGGYYILGLKQAHARLFADIAWSTDTVAAATRAQAREIGLALVELEPWYDVDDAASLARLSADKTGYAAPATRAVLARLAETSEAVPA

SEQ ID NO: 1836 - protein, 232 aa, Methylobacterium sp.
MHPVSIVIPTLNEVEAIGAVIREIPPAYAADVIVADSGSTDGTQAIARAAGARVIEAGCGYGRACALGAAAAAPASRVIVYLDGDGADRGDLIDRIAGPVLAGSQDLVLASRTLGSREPGSMLWHQVLAGRLAGLGIGLRYGVRYTDMCAFRAIDRAALRALDLRELTYGWNIEMQMQAARAGLRIREVPMPYRRRMGGSSKVAGSLAGTLRAATRIGATYLRVAAGPARGA

SEQ ID NO: 1837 - protein, 195 aa, Methylobacterium sp.
VASGRRALKMEETRARLIRAARAAFAEKGYAAASMDELTEAAGLTRGALYHNFGDKKGLLQAVIAQLDAEMVAKARVARERAPTPWLGFLDEGVAYIELALEPEIQRIVLLDGPAVLGDPSRWPGQTACLRTTTETIQALVEAGTVKPVDAEAAARLINGAALNAALWVAASDDPPAVLGRATEAFRCLANGLLK

SEQ ID NO: 1838 - protein, 523 aa, Methylobacterium sp.
MSLFITSTAFSIPALFGALGALATGPAAAFLGKQVFVRAQSLAAKGRMDDLVMIGLSAMAAVFGISLFALMGWCLGRFLGQAHDWWGNCLLPRRALGGADTGADAGSVCGINPYGMIVILDVAVAAILAGAVWLFGRVNVNRFSMHGVYRNRLTRGFLGSARTRRDADPFTDFDEEDSPRIADLGTEKRLLPVVNMTLNLTDLLHTEWAERKAASFTATPFACGSAILDRADRARDRPGTDGPRGAYIRTSQYAGMETPGDRVSAGRGPLLGGLLTISGAAVSPNWGYHSSRLIAFLMTLFNVRLGAWLPNPAVARRDDLKLAKPRNSVLALLSELGGRSTDVRQAIYLSDGGHFDNLGVYEMLRRRCARIVVIDAGQDERCTFFDLGNVIRKAEVDGLAKVQMGEMRILPRATIEREGKRAGALGYARGTIAYPGARDAASLIYIKPSFLDDIPAEVRAYGATSPAFPHESTANQWFSESQFESYRALGFYQVSKMFGSQLTTLSDWSVYLDSEIGRRTADS

SEQ ID NO: 1839 - protein, 405 aa, Methylobacterium sp.
MSASVADIQADASPHHLPALTTGRDAWFLDTEQALAEEMDHFCGPPEPGDRAPWQARADQARLAALCLSGGGIRSATFCLGALQALASRRMLGEFHYLSTVSGGGFAGGWLQTFIRQCGGIAEAERQLGGSGNEIFAKLRRYTNYLTPEVGILSRDTWAGIVLYIRNTILNWLIIFPLLLFVPLALLAYRTALEAASGSTLWLPLVLGSAALFVATFSACTLLPSHRPRTGGVTAYASPARIAACIIAPTCVWALALPFTLRALFEQPLPLSGLSLCRLGLAYFAVQVAAYLSGLIWQTSKGHPGLWLYERNLGPWLASSLVSAGLICVCADASIGWLVGGSAAGFDAAKAEVSQVLTVAAPPALIVIHLLQSVIFIGFRKSAECADLDREWVARVDGQLLLAAM

SEQ ID NO: 1840 - protein, 236 aa, Methylobacterium sp.
LKLVRGDRGRNFLLLGISLLFVAAGLGIIATGADGGVTATVFFGVCAAVAVWQLRPDLLESESRSAGSLAAQFPGPVILRASVRKLLFLALMAAGFGGVTLWMVLHEAPSTAMQLLLWPGVVLFLGGVPFLILTAIRGSALHLDETGFTVVQVGRARRVRWRDVSVFEPVSMPGSGQRLVTFDDASAGATRLGAMNRRLVGRNAGLPDSYGLDPDALASLLTAWRKRALQREDDRF

SEQ ID NO: 1841 - protein, 571 aa, Methylobacterium sp.
MYRISSSGLLLCLLSQTAMAADLPRRALPPAATAVPIFSWTGAHAGLFAGYGTLDRATQFVCTGPDGQPGARNCPVIPSKRASDGSFVGGAEVGYDWQVSSGFVAGAAADYQFTRLWGYDRREGAFPAAGGGFYRRSVAHSGQRLDELATLRGRIGFAVDRTLVYATGGLAAGTVRTDNTLSLAGFPLFDGRQGTVRVGYVAGAGIEHAFSEHLSAKVEGLYYDLGSRAVLPAPSYPVLTGYHAGTRVATDGFLARVGLNYRFGAGLPTLAPIASAGPATWDFEGGLRYFFSSGTPREKLGDPDAPGQLNSRLTYNNTQAHAGESFARLEHNPTGLFAKGFLGSGGVTGGRLADEDFPPALRRYSKTLSPIKDGDIGYGVIDLGYDVLRRDGYKLGGFLGYQFASELYNGYGCRQVAGGAPCARPYPTSMKTLGESMQWNALRVGVIGEARFDRIRLSLEGAYLPVVSLSGVDRHWLRPDINPGPEGGRGDGYFLEGIISYDLTPSVSVGVGGRYWQLQADKAHTTAFPFSPPSPMKFETGRYGGFAQLSYRLADFGFGETGAPAAPIRKD

SEQ ID NO: 1842 - protein, 263 aa, Methylobacterium sp.
MIEIRNLSVRYGQGTDAVGALSGIDLTIGPGEFVVALGASGCGKTTLLSAIAGFLAPTEGRILLDGEPVRGPGAERGVVFQRHALMPWLDVAENVAFGPKMRGVPRAERRRIALATLDLVGLPDCADRKVYELSGGMQQRVGLARALAGDPRALLMDEPLGALDAFTREQIQELILRIWHRTGKMAFFITHDVEEAVFLATRLVIMSPRPGRIVETLDLPFSRAFVEGRDARAVKSDPAFIAVRERVLARIRGGAGAAPEAVR

SEQ ID NO: 1843 - protein, 124 aa, Methylobacterium sp.
MRFHFDSYVLTALVPVTMPDHGSPGRLIIHPNTRALRRSYLRNLVDKVLVDNPLAQKLLTRAYDRGSDRVIRLSLKPGSLYFFWGYRSLHTNEPCASDAIRATALLHYVDPHAGSRLKRVLRRR

SEQ ID NO: 1844 - protein, 225 aa, Methylobacterium sp.
MPRVAGQAVIADDDPFFRIALASILTGHLGFDGVHQAGSLDEALETLAEKPDVRFALFDLAMPGMESAASLSAVRECFPEVLTVVVSGSTDREDVFLALRAGVHGFVPKGTSVEALIQALGMVFNGFVYVPAFVTRVPGEGAPTAPAAWREAARDPTASLTPRQRQVLDLIVAGQSNKEIARSLALGEGTVKIHVAALLKALGVANRSAAAAWAGANLGRVRASP

SEQ ID NO: 1845 - protein, 355 aa, Methylobacterium sp.
MHAITSDAVVIGVDTHKDVHVAVAINGLGARLATASFPVTCAGYREVAAWAAAHGVVHAFGIEGTGSYGAGLMRALTAMGLRVIEVGRVNRQLRRRQGKTDTVDAKSAARAVLAGEAIDEPKLGDGAVEMIRRLKIARDPALKVRTQAMVTLKTLLVNAPQALRERLIGITGKMTLIRAIAALRPGAPVSTTASAKVALRALANRWLVLDAEIKEHDAVLEQSVRAQAPALMEAPGVSTGTIAEMLVVLGDNLQRIRSEAAFAKLCGVCPVPASSGKTSRHRLNRSGNRRANAALYRVAVVRMRHHLPTREYIQRRTSKGKPPREIRRCLKRYIAREIFRHLCIGSASVPDRKTA

SEQ ID NO: 1846 - protein, 142 aa, Methylobacterium sp.
LTTAGPGLELQTEVSASKNLIPLAQGCCMMTNPVDAIEITYIRRIQQQQVELTLVRAERDAVMRERDLAQARSEATSTLIEALIGSVRPFGFNRKRFLAAIRKSARALPDHGPAALQHTILLEGSNRILAASRMPDQAATRS

SEQ ID NO: 1847 - protein, 61 aa, Methylobacterium sp.
LAERSGVAATTLAHFEVGKRDPYTRTLADVRRTLEAAGVIFISADEVGGPGVRRTRETTVA

SEQ ID NO: 1848 - protein, 111 aa, Methylobacterium sp.
MVIGTRVLTIRSLDADISVPVRLCAPEYADGHWICRYTIGWPEHPWDSFGAGVDALQALHLTMQKIGIDLYSSAAHKAGTLKWEKPADGYGFPIPKNGRDLLIGMDKIFEG

SEQ ID NO: 1849 - protein, 114 aa, Methylobacterium sp.
VSISDKTDDIRPNRKRSETNLPPVLRRGREHRIVRWIGAANRKAPRPAEEPAAADNRVIKLSWADTFGRPGRAEPGRSEPGPAQVLPFQGRRSETAPRATPRRAADQPPVPVLR

SEQ ID NO: 1850 - protein, 640 aa, Methylobacterium sp.
MAAPDGIRAVTLSSGGLAEVTLVHAVDGDGTIGLSVRPEQVDDILKSLVVRDPVGTVGALRLDGVDQADETLRTMPFTADDLSAPARLVGKLQGVPIRVQSGGRTLEGRVLGVSERNAGTETGDVSILTVLTATGTLESVPIEDGASVTIQDSAMAAKIAEAIAAAGKAKVGDAHRVEIAVSGRGQREVRLTYVVAAPVWKTSYRIVDGGGRANLQAWAIIENALGADWTGVDVTLSSGSPVALLQRLHKRYWRKRPEAPVMVEDVGMPDLDPGTVASKSVARLRAPAPAAAPLPAPMARMDTRDSRMEAAEPSYDAAAATAGAAASEGDVAANFTLPHPVDLRAGGTLSVPFLDTEIEAERVALWKPGQGVHPIAALRIRNSAGATLPAGLITLYDRKAGYLGDARLPATPVGEQRLASFALDRKVAVQAETAPSDALTKITVVDGVARATVIAREVTTYTIKGAPDAARSVIIEHPRRDGWTLTASARDSETPTAYRLKVAVPAGGTAETRAVLERVRIDAYDLVDADEALLVRWASLATDPELGGKLKILSQARAEVAAATRTVEEIGERAAKVQAEQERIRSNLGAVPKDSELARRYLSRMGAQEDELAKLDAARTQAEDGLRASQARIRSLIAAL

SEQ ID NO: 1851 - protein, 336 aa, Methylobacterium sp.
MAAEAGRAATRLARRHRQAACDRRQDGLGRGRKLGPGIVQALDSLPHGLCLFDSADRLLFVSDGFRRLFGPPANRIRPGMHARAVGAASAAGAVPADRDPCGLWAARRRLLARGATDAVVQTLADGRQVAITLHPQAGGSWTALWEDVTERRRAESLLRYMAHHDPLTGLPNRHHFAARLDRTLADLDGAPCALLCLDLDGFKPVNDRHGHAVGDALLQHLAERLRAALGAGDCAARLGGDEFTILLGDAAPAPALGFALRLQARLAEPYDLGTGSPIRIGAAIGVACAPLHATRAQALVERADAAMYAAKRLGHPYLWDDALDLGPVGPGGAVPA

SEQ ID NO: 1852 - protein, 178 aa, Methylobacterium sp.
MYRISAMLVLATSPALAAPAAAGDPGTRAPFIREHRCAVVERLDAIHRRGPVDVSRDRFIVVAPHGQAQRYVQCIFQDRDTRMFCEAASGAYGPPGRRRLRLDATARQALAALGYVQADPAENYARLVELGTPPDMGIVADLMLAALHDAYGARPGDILDIEAPHGGMPGRGCGAPVS

SEQ ID NO: 1853 - protein, 336 aa, Methylobacterium sp.
MQIKAAIDRIPGGLMLVPLLLGALCKTFAPGAPAYFKGFTQGIMTGVIPILAVWFFCMGASVSLKATGTVLRKSGTLVATKLVAAWAIVLVAGLFIPPEGIQTGFFAGLSILAIVCAMDMTNGGLYASLMQTYGSREEAGAFILTSIESGPLMSMIILGASGAAHFEPQIFVGAVLPFLVGFALGNLDPKLRALFAPGGQLMIPFFAFALGNTVDLNNLLSPLAGLGIVLALAVIVLTGIPLILADRAIGGGTGTAGLAASSTAGAAAANPLAIAAVAPQFAPSAQTATVLVTICIIVTSILVPILTGLWYRRFGAGVAEARAEEEGGAPLAVPAE

SEQ ID NO: 1854 - protein, 52 aa, Methylobacterium sp.
MPPGTRIALAAVLLLGLAACDDKQAQNNTPTKPDSTKMEPQTDQAAPNTQKR

SEQ ID NO: 1855 - protein, 321 aa, Methylobacterium sp.
MTGRGPARATRRRVLAGGVLATGAAASGTVRAEVHPARAGEVRHGTVRADGVDVFYREAGRPDAPVILLLHGFANSSFYFRHLMPKLADRFRLIAPDLPSFGFTHVPEDRAYVYDFASLSRTAEAFVGALGLDRYILYTFDYGAPVGWDLALAHPDRVAGIVSQNGNAYLDGLGDAAWAPLRAYWAAPNAAAVAAIRARMTLDGVRAAYVQGVPDPSRIEPEAYTLDAAILARPGNADRQVTLKLDYERNLARYPLIQAFFRARRPKLLAVWGRNDAFFIPPGAEAFRRDIPEARVTFLDTGHFALETDGDAIAEEIRRFF

SEQ ID NO: 1856 - protein, 119 aa, Methylobacterium sp.
MVEPSRTEEEGKARTGASSWPDNLPPRPLVIFPRGEAALDVLSTVPEGPPRRFRWRARIHRVAHAEGPERIAAEWWRAPGADRDYYRIECEAGHRLWLYRDGPHAPDRPAAWYVHGLFA

SEQ ID NO: 1857 - protein, 55 aa, Methylobacterium sp.
VPPPAMPKVEPAPPVPAPPPSAPTPDAKGSGNPFSVEEIEAEFARLLGRPLDKRS

SEQ ID NO: 1858 - protein, 81 aa, Methylobacterium sp.
MISHRTRAAAATALGTLLTVLAAPTAAPAQPVPRFAQPDVPSVAAIARARPFRTDLDLRSPAVEREHSRAQRIIARVCSRC

SEQ ID NO: 1859 - protein, 309 aa, Methylobacterium sp.
LRILVATDFSTRSQRAVRRAGILAQQTGADVMLMHVVNGAGSRQVARDVREAQRMTVEQAAVVPELFRVDCRSLVVPGRLPDPVLNAAAARQVDLIVVGSDHGKDAQGLGQTVRDLIRAAPCPILVVNRSVVGPYAEVTVPVDLSAASARALHSVASLGLADRARVTVVHAFDVLGKPRLSGFGIPREQIEGYVESWRSVYAEETEAFLEAEGLARRNWVRRTEEGRPDEVIASLAARTCSELLVMGTRGRTGFRRALLGSVTEAVLAAGQADVLVVPPPRPGSSSRSERSGWPLSAKAERTALQVVTA

SEQ ID NO: 1860 - protein, 273 aa, Methylobacterium sp.
MGAAGRGAALTLGLMLAGPAVAQDGPPAPRVASAVKGLRFVPLAELPRAPGGAGRQAGCPGEVVPARSEAARSVAARDWFVTGEAALGRYRAVSFASDLQQGTSGTCFIADGNVGLFAGPRLVALVYGAGRTGAVGRIAARSEGARLWDGDIPPAPVGDLTLRPDGTVSLEPPPKVESVCGGRGSVPAIRGLPIDEARTSLIAAGWTPVKGPPSDDARERALARRGVTEVDGCSGTGLAYCSFRYAGAAGTLSVTTTGDAELPEVHEYGVACR

SEQ ID NO: 1861 - protein, 398 aa, Methylobacterium sp.
MRFLVATIVLIGLCGQANAQGKSKKPQPQQPSTRYLSFSEGSLDGSATYLIDGVLKLTSQGSQITDASIDVCYPTSTLSRRVDRLVIPLKADGANFSGAGASSAGDRVAVSIKRSGSKDEQQLNGSLKLPDHSVAIAATGLTFSEEDPTALPSGSTAEDEPEDVSDKPVPDPGTLSVTTKLPNIVDLVKLVRTEGARMDPAGLVPNCADLRGGTSSISIDVDPESAPALLEKVKKLPGVATAEYGQVADKSQLVKLKAKPGDADLIAALGRALPKAIPDATIVSSGKDAGRGEIQMALTRKVSYLDPMGAQEAISLRATAWQDPQDKSVSYVQLRSVDARLVDTGKEKVFSVGAAESEGEDAVVASDLDTAAAQQAIAAALASDLHGQAWVEDAWVSK

SEQ ID NO: 1862 - protein, 390 aa, Methylobacterium sp.
MVTNVLPPLDPAALPAGIRARFVEGVNGLRMHVLEAGDGGPDRPLILLVHGFPEIAYSWRKVMPALAAAGYHVVAPDLRGYGRTADAPVAFADDLAPYRLHNLLLDLLCLMSALKRDRVAALVGHDYGSWVCGYCALARPDLFGMVALMSAPFAGAPGLDALARGLRTPADDPIHAALAALPRPRTHYHRYYATRRAAADMERSPQGLAAFLRAYFHHKSADWPDNRPRALAGWTAEALAEMPTYYVMDEGRTMPATVAPEMPERGGADCAWLTEAELAVYAAEYARSGFQGALQGYRCRMDGSIDRDLARFAGRRIEVPLLFVSGARDWGPFQAPGALERMKEAAGAGLLGCHFVAGAGHWVQQEQPRAVADLLLDALGRGGAGSRPGA

SEQ ID NO: 1863 - protein, 210 aa, Methylobacterium sp.
MHPYVSDGLHADPFDAFRVRAHRGPMGGDPRGRHGPHGHPGRGPGERRMFGRGGRGDLARFFAHGDLRLVILHLIAEKPRHGYEIIKAIEERVGGAYSPSPGTVYPTLTLLEELGHVTVTPGEGTKRLHAITPEGQAFLDGNRPTLEAILARMAEAEAARADGPPPSVVRAKEGLKLALQMRLARGPLSAEQAAAITAALEAATAAVERA

SEQ ID NO: 1864 - protein, 77 aa, Methylobacterium sp.
LAERVTHLAAATLSAKRRSLDRQLGAILATPSRCDLTRDLQAKISRARDQLLVFLAYPGQVEPTNNGSERLLRPAVV

SEQ ID NO: 1865 - protein, 677 aa, Methylobacterium sp.
GYGFVEPGPGSFIAGAQITGGNGGAGGAAGGPGASGGAGGNGGIGLFLYGSTGTNTGQITGGNGGLGGAANGGMAGVAGQGGAGLSGANIAITNTGTISGGFTGGSTTVRAVAINVTGGTNSLTPSTGTLNGGLGIAGGATTLRVLGNAPNNLGPVANAGTFDISGTTAGASITTLSGTGGTTLGAQTLTITNGSTSYSGAISGTGGVAVNGGTQTLTGASTYSGGTTIGSNGGAVSSTLQLGGPTSAGTGTISFGTMSGTATARLGLNVAAQPTNGGTFANTISNFGSGNEIALAGLTNSSVSYNSANSSITITGTRSGGGQVSENFVLSAPRTTSFAAVSDGQGGTIVRAATAPNPTNPTNPTNPSQPANPAPCYVTGTRIRVLRDRVISDVPVEQLAVDDLAITAAGTPRPIRWIGTRAYPGSTVPPAERPVRIRADALGEGVPARDLLVSPDHCLWLDGLFVAAGHLVNGSSITRGEMVADLTYWHVELDTHDLLLAENAPAESFLAAPGVRGGFDGVQALDVGTGRMPYAARAELGPDLAALRGRLALRAVSFDGAAEPGPVRAWLDRCVVAGDGLLHVGGWARDEAQPDTPLCLDVLVDGVVVAFAVAAEFRSDLAAAGFGDGRCGFDLGVDVRLAPHVHHSVEVRRSADGLLMCAKRMDATGAWTALLAA

SEQ ID NO: 1866 - protein, 51 aa, Methylobacterium sp.
MMRRLDGFARGLGLDEAATRRIVEKIVAEMPDRSDEERLDTARQHMIIASA

SEQ ID NO: 1867 - protein, 526 aa, Methylobacterium sp.
MGAIYTVELQAHTGSAVESFYVASGEFNTGPADVPAHQHFHPSLQTPANFERSLFGNGSTSGAASIGFGEIVIVNAHGRYDAWPDYAFDGRPCIVKAIPIDEQTGKAAWAYKDAPVLIRGTIDSLDITDAFTTIRLRVYDRLSDLDKPLLTQRYGGTTLAGGQGADGTADLKDTLKPAIYGFKASVSPVTVNPYDLIYQVSLRACVSIVAYDGGVQLTNAGDFGTVAALLAATLTPGKYATCLASGMFRLGGSPAFAVTADVTAAGAGTAADIARQMLLDFGLAGSDLDTASFSALAAKNPALCGVLVTGDTSVLSCVSQVLASVGGWIIPDGRGVFTVGRLELPTGHPVALFEEWQVEEKLERLAPGDSNRGIPAYRIIVRYGQLGRTLADSDVAGSVSPDRTAALALEWREATAEDGSIKGRHLLAQEMTFDTCLVNAADAQAEAQRLLSIYGTRRDIWRIQVDMTDLDYRYDQSAGDPFTLIIGLGAEVQLSAPRFLNPPKNLIVIGRVEDCNKNRIQFDLWG

SEQ ID NO: 1868 - protein, 351 aa, Methylobacterium sp.
MGQTTIKDVARRAGVSFQTVSLVLNHPQKVARTTRETIETAMRDLDFVPSLAARSLRKKPSRSIACVFAPAPEPAADGGRPGEAADHGHVLRTFGTVTDQQGYTLVHRCRRADDPDGPGRIAGLVSEARVDGLVVFAEDRDDPLIGLLQAKRCPFVVFGLDVPGTHYVALAERDAVHGAVRHLIAAGSRSICLLAGDARRPAAATERFCGYRDALAEAGLPLRDALVVTCDGTAAGGYRAARALLEAGPGARPDAVVAASDRVAFGVLRALHEGGVRVPAEIRVVGFDNLSQGAYAVPSLTSVDVPVLDMVRSAFATLVELIEGTRAPDDLAQTLFPARLVVRESSAVAAP

SEQ ID NO: 1869 - protein, 156 aa, Methylobacterium sp.
LKKLLRKAHVKPLKQVAALPFRVGADGRIEVLLITSRDTGRWIIPKGWPMTGRKAHQAAAREAYEEAGLEGQIAANPVGRYHYQKRFDHGRAFPCMVRVYPLRVEAQHERWPEQAQRTLQWFPPEEAARLVHEDELQELLTDFAARPVEIRGDGRG

SEQ ID NO: 1870 - protein, 502 aa, Methylobacterium sp.
MAELREGPEATAPPAFSKRRSLAWMGFCQGGLFLAQFGTSLALARLLTPHETGIFSLAAAIAGLLSTLRSCGLSSYIVRAERVDAALLASVFTVNLMLSGAAAILILAFSVFGSVLLGDPEVQRALAILAVVPLVGALEFRPAAMIERHGNFRGVALVNMLRGLVASGAMLALALLGFSYMSQAYGQAAGAVAAALAANGLGLRYVSLRLGLAGWREILTYGGRLFAIAGVAGIAGRMGDLVLGRMLGLSALGLYSRAASLNTLMWDHLHVVITRITFVDLANQQRNGQSLRTCYLHTLRMITVLLWPAFAGAAVLAGPIVRVLLGPGWEGAALPFCLLSLAAIVLTSLSMTWEVFLIRDQTALQARFEFLRHGAGLVMFSIGCLFGLGGAGAARIGEAFLAVGLYRPHLERMTDTFRRDYAPIYLHAATLTAVAVAPAILVMSAWGWSAETPLPSLAAAIAAGIAGWVCGLWYLDHPLVAEARLLLAHMRPARPATTVSDL

SEQ ID NO: 1871 - protein, 262 aa, Methylobacterium sp.
MAMVTISRRRALGAVAAGAAAGLGPAAAAEAQPAPLFPLPQATVPILGEAQVFPVRRIYCIGRNYAAHAREMGSDPSREPPFFFQKPADAVQVVAGGVADHPYPSLTQNYHHEIELVAVLKSGGRDIPAAQALDHVYGYATGLDVTRRDLQRGMGNQKKPWEIGKSFDQSAPITPILPVARVGHPARGRIRLAVNGTVRQDADLSDMIWSVAEQIAELSRAFELKAGDIVFSGTPENVGPVVRGDVLAGSIEGLPDLSIRIV

SEQ ID NO: 1872 - protein, 117 aa, Methylobacterium sp.
VRRFWISTILGLELLLGGTLAASARTAGVPDFNIRAICAPEHRAGSTAIDQASYRGCLSDEAAARRTLIKRWATFDVAERRTCATESQIGGAPSYVAMLTCVQLGSDALPINPPGQP

SEQ ID NO: 1873 - protein, 727 aa, Methylobacterium sp.
VRASSSRKRKILVADLLCGAGGSSTGCQRALAGLGLEMELVAVNHWPTAIATHTLNHPAARHYVQDIATVRPHLLVPEGYLDLLMASPTCTHHSVARGGKPTSDQQRSDPWHIITWLTELRVKRLIIENVWEFTSWGPVDHRTGKPVASRKGEYFNAWIDTLKRLGFKPEWRKLNAADYGDATTRSRFILMARSDGKRLAWPTPTHRRRDEMAGDLFSGSKPWRPAREIIDWSIKGRSILGRKKPLAPKTLVRILAGALKFKWPAPFLGLLRAELERSLAYHLRWTLSVRNAPRSRVDRHKRRLLARRLVSQLRQARADARAPAQSSPVADPMVVTLRRNGAGSDVGRPIPTVAACGTHIGLAQPVIVNMKGRSTASDANQPLPTQTAHAPHLFAAEPIVVSTAHGVDAGEADPHSRRSRSVDEPLGTVHAGGGNFGVAEPFVVSPRHSREGAGPGPRAVGEPLPTVTAGGSQVAVVEPLVLSRHAGGAARSVEEPTPTQVAKHSHVLISPYYGHGWQERAGGAPACLNGDEPLPTVTSKGRFGMVVPVCQSGGGAAARDVEDPVPTMTTAKGGEFGFVMPVTHHDGSDRARDPASEPLPTVTGANRGELAFIAAQFGEREGQAPRVHDIDQPSPTLCATGRVNLVQGTEGYDILFRMLEPHELAAAMGFNDEERRYEFTGTKTEQIKQIGNAVSVAKMKACVGAIMADTVPAARDFPLSMPLIAAE

SEQ ID NO: 1874 - protein, 94 aa, Methylobacterium sp.
MLYMVHMQVNIPASLPDEEVARLKAEEKAYAQKLQQEGRWRHLWRIAGQYANYSVFDVAGNDELHELLSSLPLYPYMAISVTPLAQHPSAIAAN

SEQ ID NO: 1875 - protein, 269 aa, Methylobacterium sp.
MSSAVTATGITGRTRVYGILADPIYHVKAPEVMGALFARHGVDGVLVPLHVAADGLAAVMDGLRQLRNFGGFIATVPHKTAMTGLCDALTREAEQIGAVNCVRREADGRMVGTMLDGIGFVEALRGSGLEPRGRSAALAGAGGAASAIAFALAEAGVARLTILNRTADRARALAERLRAAYPGLAVAAEGVQAEHDLLVNGTSLGMRPQDAAPFDLGALHAGQFVAEAIMDPETTPLLAAALTAGCRVQKGLPMLECQIALMARHMGAL

SEQ ID NO: 1876 - protein, 349 aa, Methylobacterium sp.
LRKATAAFGADLVHVDAPAAPGAGRVTVAVAAAGICGSDIHAFEWTPGYGFMTAFMPVTLGHEFSGTVRAVGDGVTALAVGDRVTCWPTVPCGACAACGAARPQDCQGRRVVGLHADGAFAEQIVVPADNCRRLPDGLPLTVAALAEPLAVAVNAVDVAEVGPGHRVAVLGPGPIGLCIAFVAQQRGADVLLAGLDDAARLDLARRIGIRDTVDLAGIGLDDAVRRAFDGEADRVIEATGSARSVSDGMAVLRSGGVMVVAGIHSGSLDLDLTGFVRSKKQLRAAHDTTARAFDAALALLAAHAGTLEALITHRRPLADAGAAFELARSRQAMKVLLLPEAAASREAEQ

SEQ ID NO: 1877 - protein, 197 aa, Methylobacterium sp.
LLDLRERAARFARARGGATAVEFALVALPFFALVGACLENGIVFWEQEILQQAVSDASRQIYTGTFQTTNAGTTDPATLMSRFRTAICTQPNGTPRVTIFTCANVRVSVMKVADYGSATPVSPVATNASGASDWNPNFASYACAGNSAIVIVQAAVDIPVFFPLLGAAVPNLPNKRRVLQAATVFKVEPYTAPSGCS

SEQ ID NO: 1878 - protein, 67 aa, Methylobacterium sp.
MKTVVATVVVVLFCAGARADELNDMPDIACAQASSAVERDHIGCPGTDKAAAGSRAATSPLDHAEDD

SEQ ID NO: 1879 - protein, 138 aa, Methylobacterium sp.
MPAAGGSPAGLRLTCTDAAGLLARIAPRIGRYATLRLALAGGEAVLFAPDTGPGRPALPWCATPLGWLAADGPLLLPFGCRLAVPAPWRAEVARRLLDRHGMSGPALLVPEGETLRLLDLAGSRALPDIDTGRLGEAA

SEQ ID NO: 1880 - protein, 230 aa, Methylobacterium sp.
MNKIRAIQPDTLRQKVEDAVREAITTGVYAPGERLIERELCEGLGVSRASVREALRRLEAEKLVHTVPHRGPVVASISVEEARQLYALRAVLEGYAAHEFATQATDAAIAAFGRAAGDLREAAGSGDTDRVLRAKGVLYDVMLSHCGNDLVRETLRGFYSRINLLRATSLMHPERLPHSLAEIDALVAAFQKRDAAQAEQLARLHVTNACAVALKQLAFRIAQTSLDAVS

SEQ ID NO: 1881 - protein, 171 aa, Methylobacterium sp.
MLAVRLSKVALVGALAMTCTLVVYGNVTEPAVNLAFVQHVLSMDTILPDSGIADRAITDPALQRGAFAMIVAAEAVTALLLWIGVALMLARLRAPRGDFDRAKTWAIAGLSVGFLVWQAGFLGIGAEWFGMWMSKVWNGQQSAFRFAMTVLGVMIYVALPEAEDPEASGRG

SEQ ID NO: 1882 - protein, 405 aa, Methylobacterium sp.
MSRTSPSAIDRAPVADRSGTGNVVRLAVAQALAGANSTVVFATGAVVGNMLAPSKVLATLPISIFVVGMAACALPTGSIARRHGRRTAFMVGTGCGVLVGLLSAWAIVAASFWLFCAAMFLGGAYAAVVFSFRFAAADCVPADRRPRALSAVMAGGVFGGVIGPQLVTHTMNLWPPYLFAATFLAQAAVAAAAALILAGVRLPRPAAGSVSGGRPLAVILAQPRFVIAVICGAVSYLLMNFVMTAAPLAMRLCGHAQEDANLGLQWHVIAMYGPSFFTGRLITRFGASRVVATGLTLTGAAALVGLAGAHVGHFWLSLILLGVGWNFGFVGASAMVLDCHRPEERTRVQSINDFIVFGMVAVGSFSSGGLLTSYGWDTVLWVSFAPLALAATALALTTGRSAKAW

SEQ ID NO: 1883 - protein, 225 aa, Methylobacterium sp.
MKNRTIAGSIGTEIRRRILDGRYPAGSQLRQDGLAAEFGASRIPVREALFQLEAEGLVRILPHRGAMVAPLSPADAAEALELRAALEPRLLALSAPRLTDDDYARADALLEEYAAALRAGATARWGALNTELHLLLYGRAERPRALGLVGSLLAECDRYTRLQLSTDSAELERADREHREIVRLCRNGHASAACALLTDHIDHVAAALMAFLGAAPGPARATDIV

SEQ ID NO: 1884 - protein, 110 aa, Methylobacterium sp.
MAAGYVVAAFLEAAGLAGLVIAVLKMRTERRARAADLRSFLRSGQIPTVEIGVTRRPADAAARLIAVPYTTGRGGAPEARPSAARAALRRAFTSGGAAPRAGLTGAISAG

SEQ ID NO: 1885 - protein, 953 aa, Methylobacterium sp.
VTGTVFSRSLRARLVGATLSTAAIALAALVFLVVLRSGQTLREQAQEVSTWSEAQLSDRLLSDAKLAAARLQMQREDVERRFATMSKRWDVAKAVFSGNTVAASELLRPALALADLDGAIAFDLNLRALTADRVEADLLAANAAFRTSPVAASLRAVLARNDREHADGFVMSLRWDDALARALAATESGTVADVFGEPLFDDFGEVIGGLVGYRVLRAHEPTLTAFASLSNRDVLILADQSLLSSAGSEVSNAQLGPPSGAELHDVLGAEKVARCIPQPPDIRLCVAAPLRELQQLTGKVVGIGEESSRSLLRTLSVVAGLTLCLVAVVMLFLSSRITRPLVRITQTVSEVARGNWHVSVPDIDRADEVGDIARAVVVLEHSLSERDQLRDDVFRQNTVLTERERQLQEQNERFDAALNNMSQGLCMFGVHGRLKVYNSQFCRIYGIAPGVLDLEPTQDEVHRLAGLTDWSAAESGPIRRTLTRTLADGRCIEITVEPMADGGWVETHEDVTASVTAQARIAHLATHDALTGLSNRALLADRLAAAFADHAVGGRAVTVICLDLDDFKGINDTLGHPAGDELLRQVGRRLTGLCPSGGTVARLGGDEFAMVLFEADLPDGVLALAEQILIQLRRPFFLAGQFVAVDGSLGIAVSGTEDADGDDLLRRADVALYAAKADGGRRVRVFEQEMEERQNQRRWLERELRLAIGTAQIELHYQPLFDLATNAVTSFEALARWHHPERGMISPGEFIPVAEATGLIDALGAYVLERACADAMTWPGSLRVAVNISPIQFREGNLDRFVEEVLLKTALPSHRLELEITESVILSQDQASLEMLSRLRRLGVRFSMDDFGTGYSSLSSLNTFRFDKIKLDQSFVRNLLEKDEAAAIVHVVAELGRSLKITTTAEGVETPEQLARLRASGFSEVQGYLLSKPIPAAGVAAFINAQEHIHVAA

SEQ ID NO: 1886 - protein, 269 aa, Methylobacterium sp.
MALLFTSLRRVIAGGIILLALPAAARADDLAVVGTGDGIEMLQAVAAAYNAESGDARVSVPPSIGSGGAVAAVGGERQRLGRVARPLTEAEKAQGLVEVPLARIPSAIFVHQGVGVTNLTSAQTAAIFAGTVDNWSALGGPDLKIRVVRREETDSTLTVLRATMPGWRDLALTSRSKTATTTQDAIATVRETPGAIGFGPYSPALAGDLAVLTIDGRAPRDPAYPSAVTLALIYKAATRDAAASAFLAFATSDRAGQIMAERGGTPLRP

SEQ ID NO: 1887 - protein, 345 aa, Methylobacterium sp.
MADRVTLVINGRRVSASAGQTLLDAGLAAGQAIPHDCATGQCDTCRVRIHAGAVDDAGTRIGETVQACRARLTTDAVIEFDEVPETVRRTGTVDRVVDLTAEIVEVTVALRKRLTYLPGQYVRVSFAGLPARDYSPTLRADGSGELNELIFQIRRQPDGAVSPLLGGRIGPGTAVKVEGPFGTAFHRLGRGRLVIVSSGVGWAPAWAVARASRMREPERDLLVVAGARHPQNLYMRPALDWLRERGATTVLTCSGGNPPPDARPGRPTLHMPMLTRDDTVLAAGAPEMVAAVQFLAAATGATCYADPFYAAARGADGKPPSDTNFLQRFLQRVAGHRTAKTEPVA

SEQ ID NO: 1888 - protein, 590 aa, Methylobacterium sp.
MSEPLTLAPHPPGGAETAPSWRSAPAVQVDRHPRSDVGTIVIHWVVAIAMVASLLTGLRISADAPVARTAKFLAPLLPQGEVWTVHFVAGLTLFFGITAYLVYLVRGRLTDRNGLSRLRALRVSGRSRAARKARWGGINVALHWLIYAVTLVLTGTGVALYLGYGGWVVWLHATCALVALAYIAVHTLAHFMYGGLWQLLRLFRPAALADGAARRRRPLLAAAVIGLPVVGGLAFADVKGRSTLVIDKVTAGPDLSKLLDDPVWRTARPVSVRTIQGANFGGTGETTVEIRAVRDATNVYFAFRWWDPSRSLKRVPMIKKADGWHLLDADAARADVTAYYEDKLAVIFSRSDAFGSGGSTHLGARPLPDAPAPLNGRGYHYTTDGSYIDMWQWKAARGGMLGVVEDMHIGPPTDPTAAERAVKGRYQAGYWGDPGTSAYRYNFKFEGPGGYAGAVEPLRLPKDWQATVAKLGTVDLDFDASTSPGSAWWMVEKTETVPYSAAADAEIPVGTVMPGVLMTDGYTGDRAGISAAADWADDHWTLVAARKIATGSKYDVDFLPGNTFYLYVSAFDHTQTRHTRHMRPVEVLLR

SEQ ID NO: 1889 - protein, 762 aa, Methylobacterium sp.
VNAHARTVRTAYAVAFLQRLDLHGRHHLTALDPETGEIEARYFPAESWGEIAAWIEARAHRNLYYSVNEPIPDAPHAKLRKEHIARIRAIVADLDPAGSTPEETQASRHELLDRAHELADDSEHPPTLTVDSGNGVQFAWILREKLNPAIYRIDAEDLGAGIAAALDGDAVQNIDRIMRLPGTINHSAPKKRARGLMGGPVTILDDCSHPDRVYTIEELETEYDPITGADQKDRDAAVQAAMDDLDWNTAEAGPGAELVARMKADAEADPYFKGLLSGRLSSAPGDGSGSAWRAALAGAMARKGYELNDYAAVAFVYPPGQPGNGGPVTLRMVARDWARVGKAAQAAAPKAAEMFVAIEAEPDTSMFPAPVPESFDTYDLLASTAPAPVIQLIDPADWYGREPNVKEWYVEAFVPRGEVTMLTGKGGVGKSLLALQLLIAVALGIPFLGLQTRRAKCLGFFCEDDPDVLHARVRDICRALGRDERELSGWLYLVSRKYDDNLLCTFDRNGSGVVLRATPLFEELVRVTKELGVELSCLDTIADIFGGDEINRQQVRQFVQGCAGRLAAETGGACLMLGHPSRAGEQNGEGTSGSTAWHGSVRSRFYLDHIGDEGGLYRELTTKKSNYGPAGAKWKLMWKAGVLEVVTASRAGSEGAPEITGSLHRIVLDAVANANSDGVRLGLGKTSKFKAEPTLRRREPGPLAPYSAEEVEEALQQLVALGAIVEAEIGRDSSRRPIMSLKAVAETAGEADISSEEGGLFD

SEQ ID NO: 1890 - protein, 750 aa, Methylobacterium sp.
MSGLEIDFETRSPVNLKVEGVYRYMEHPETAPLMASYTIDGGPVRRWRPPEPCPADIVAHVEKGGTIVAHNAGFERLLWQMILSKRYGWPAVRLRQFRCTAATAAALSLPRDLDGLGVVLNLSVQKDKMGKTLIDRFSKPRKVTKADVERYQGRPMPALFHEPGDFPEEFERFHDYCDVDVLTEQAADRRMMPLRTECQEAYWRSEQINDRGLRIDVESAKAALLLVDRAKLRLDREMRHLTEGEVEACSQVAKLKDWCAVRLGQGPAMQAALEFFDGVLPEGEGEEIASLGKADMDDLLEREDLPPAVRKALELRRDYAKASTAKIKAFLSRAGQDGRIRGAFLFRAAGTGRYSSTGAQVHNLPRPRKVFDDAHLDPRDLFEAIRKANVEWLEMLYGEELGKPLPLLSDSIRGFIWADPGKELLAADYSGIEGAIQAWFAGEEWKVKALFDLIADPSLPDMYRRAAAGIFNTTTDLLTKKDKRRQVGKVSELSLGYQGGVGAFRSMARNYAMKLGPIFGPAWEAADPERRERAAKRYEECCERGELLTKQLTREEWMGAELVKIGWRATHPAIVAAWKALEEGTREAVSSPGTQVQVLKVSLLVARGFLWCKLPSGRCLAYGAPSIREVEVPWADKALTPELREKRPVVTCLGVDSQTRKLVRYALYGGLTFENIVQAIALDLLDNGIEIAERAGYPVVGHVHDEIITEVPRGWGDLAWFEKAICELPGWACGLPLTAGGWRGKRYRKD

SEQ ID NO: 1891 - protein, 80 aa, Methylobacterium sp.
MPGLAEDDWLIYYDQRVRGLPDEWIGQLCVVWISEDEVYVKKVFRGRDSGPYLLVSTGGLPPIEVEEINWSAKVAWIKPR

SEQ ID NO: 1892 - protein, 321 aa, Methylobacterium sp.
MTAAAATMPSSAAGITRSALDLIGKTPLVALDRVHPGPGRLLAKAEFMQPGGSVKDRAARAILLAARADGRLAAGAPVVEMTSGNMGAGLAVVCAALGHPLVVTMSAGNSLQRVRMLEALGAEVVRVPQVDGVPGQVTGADVRAAADAAERVATERGGFYVDQFHAPEGVRAHRETTGPEIWAQLSGRVDAWVAAVGTGATFLGVAAALRARNPSLICAAVEPAGCQPLGGLPVTKHRHLIQGTGYGSVPPHWTAGLLDLSIPVTDAAAEEWRRALATREGLHVGYSAAANVAATVALLSSGHLPRDATAVTVLCDTGLKY

SEQ ID NO: 1893 - protein, 261 aa, Methylobacterium sp.
VSSMNFVTGKTTSVRAAEPGRKRARKAVKGASQGASQEASHAAGGDDDLPDLTLTDRAYQQLEEMITTLVLPPGLVLGEQNLVQRLGIGRTPIREALQRLARDGLVVVMPRRGILVSDINVRSQLRLLETRRVLERLIARLAAERSTREEREVFAGLAQDMRDAAAASDDLAFMRLDRQFNELIATASRNEFAVRSLESMAGLSRRFWYQHYKQAADLPLTANLHADVCEAVARRDVEAAGAASDKLVDYIESFARKTLDL

SEQ ID NO: 1894 - protein, 185 aa, Methylobacterium sp.
AEPVAALLRDWTAANGLCRGGSGDDPRTQAACERRDGLDRRLAAAGWCYGRPADTGAQRTWQPCGVGTRQPAQAGTETPQGAARRALLDVARGPAEAGRGQPVQFVVHALNRVGPWAFLFARMQRPDGRPLPRAADDLDSNDYAALLRQDGNGWRVVDFVVGPTDVAWEGWDRRYGAPASVFAVR

SEQ ID NO: 1895 - protein, 430 aa, Methylobacterium sp.
MKRLDVAVIGGSIAGLTTACLLARSGHAVTVFERSAAALTGRGAGIVTHPGLRAVLARCGAPAGAGDLGVTVEGRRVLDRDGTVIAQRSLPQVLASWGRLYGLLLDAAPPDSVRYGAALAAVEPDDARVVAFFEDGRRISADLLVGADGQFSTVRSRFLSGVAPRYAGYVAWRAVVDAAALAPATREAIGGHFAFCLPPGEQILGYPVPGRADGAAAGRCFNAVWYRPTEEAALAALLTDTGGVRHALSIPPGRIKAAVLDSMRTDAARILAPPFAEVMLRAEQPFLQAILDIETPTMIPARGVALIGDAAFVARPHVGMGATKAMEDAAALADALDAAGGDVDAALTAFEARRRAYGAAVVARGRDLGAYLQAQQRGAAERTAAERFRSPEAVMAGTAVPLRPRGGSPPRARRPGARGAGSRCPGTRRW

SEQ ID NO: 1896 - protein, 107 aa, Methylobacterium sp.
MPKRLTITVPHNLGAAEVRRRIDRHMDWAFRRLEKEKIQVEAEDWFGNRRAFSGTGYGQKASVAIQVAEDALEVEALVPWMVGMFAPVIEAIGRHYAGRLLSDEGAS

SEQ ID NO: 1897 - protein, 106 aa, Methylobacterium sp.
MPKRLAITVPHDLGTAEVRRRIDLHMDWAFRRLEAEKIRVEAEDWLGNRRSFSGSGYGQSARVAIQVADDALEVEALVPWMASLFAPVIEAIGRHYVGRLLSDEAA

SEQ ID NO: 1898 - protein, 328 aa, Methylobacterium sp.
MIEFWAAALALTLMLYVLLDGFDLGVGMLFGIAPDETARRHMMQAIAPVWDGNETWLVLAATILFGAFPTVYALLLSAFYLPLLLMLAALILRGVAFEFRYKSRRLRRVWDAGFVGGSVCAAFVQGVTVGALVQELPVRDGLYAGGAFTWLTPFSLLCGVGLCLGYALLGAAWLCGKTESDVRDLGFRLLPRLLLGVLVFLGAAFFYALSMNLRVLHRWVERPEMLVLPLVGAAACAGLLYAARRRIDALPFPLVALIFAAAFATLAASFLPYMVPFSVTVTEAAAPEASLSFMFWGAGIVVLPITLIYTLVVYRVFKGKVDIAEHYD

SEQ ID NO: 1899 - protein, 470 aa, Methylobacterium sp.
MDISALMLSRIQFAFTVSFHIIFPAFTVGLAAWLAFLQARAMISREPVYDRLFDFWLKIFAVAFGLGVVSGIVMAFQFGTNWSELARRTGPIQGPLLGYESFTAFALEASFFGVLMFGRRRVPRWFYLFACLMVCLGTSLSSFWILVNNSWMQYPTGFAQRPDGVFVPTDWWAIIFNGVVWVRFPHMVLAAYVTTSFCVAATGAWYMLRGSDRIEARAMVRMGLGLAAILVPLQLFFGHLTGDYVVKHQPSKIAAIEGHWETQKPAGEIIIAWPDEEQERNHFELALPAPVGSLIDAGNTTSAVIGLKAIPKADRPPVLIPFFAFRIMVGCGLLMLALAWGGMAFYATGRLERARWLQWAIFLSFPLGFVATLTGWFTAEVGRQPWTVYGQLRTADAATPFLAAPQVATSLAVFGAVYALIFAAGTVYIYRMLKAGILPTPAGAGSAANPKRPLAVPGNSPGTPSSTPAE

SEQ ID NO: 1900 - protein, 448 aa, Methylobacterium sp.
VDGSIAAVTRRLDSLPMTRLHAAALAVCTLGLFTDIAEVALSNALAAIFLAPPHNMPRGSLSLLLASVFAGGAVGAPVFGMLGDRLGRRRALQASLALMAAGSLAAAASQGLTALTIARTVSGFAIGGVPPLVATYLAEVTPARRRGATLLVCAGIGLLGGLAAIGLVQMMAPAAPLGIEPWRWALILGGALAALGGLLFARLPESPRWLASVGRSAEADAACRRFERAAGRMRVAAPGGPHPAPATTGPAGFRGLFAETRQLRRTALFVGLYTLAPLATIAFPLLSAVVMVEKGFKVEQSLVFAALSMLGPPLGTLLTALVIDRLERRAFLTALAAAMAALGTAFAASGTFLTLVLVGIAFNTAAATYGSILAVYATELLPTPLRASAMTCAWAGGRVAAALAPIILLPILSAYGPHAMFAVITLVLAASAALLLAGPRGLSGRAVA

SEQ ID NO: 1901 - protein, 135 aa, Methylobacterium sp.
MVAAPGPILAGALVVAGLGFASAAEAQMPTRVGTCAATTIALIGTRFSDTLVKPKGDGIGDGTSVDLKNGVYGVSYAYVEAVARSRVGDRVMTCLVLLPTGCPKGDDRGKMYTTTNLRTLDSWTLPDSQHMCGGA

SEQ ID NO: 1902 - protein, 426 aa, Methylobacterium sp.
MHDLSDPVTLPAGTVLFEEGAIGHCAYLILSGRIAIFRRRDGGEAVLARRGAGEIFGEMAILDALPRSAGARAEADSVLVPVDAAQIRRRLAGADPILRLCLEGLIARFRETLPRLGPAVAEGLPAPPSPAARADFDATVASLAQERALRRALARDEFALFLQPIVRLATGRLAGFEALIRWHDPERGLVPPAAFIPAAEANGLILAITAWVIDAIGRIVPRILQAGLRAPASVEPSLFVSFNVTAQDLARADIPGLVDAMLRRTGLAPGALKIEITESALMQDPAGAAAALARCRAAGLGIAVDDFGTGYSSLSHLSTLPITTLKVDRAFVRAMLAEPRDRRIVQTILRLAEEIGVVAVAEGIEGRAEAEALAAMGCALGQGYHFGRPMPEADALAAAAAWNAEAWRVGLSGEADPGRHGFHARA

SEQ ID NO: 1903 - protein, 63 aa, Methylobacterium sp.
MSDDDGFDRMVEATILAHQLVAAHGTATMQLLSRLLLMEIGTEIAARRDPDPAANDNPDALED

SEQ ID NO: 1904 - protein, 427 aa, Methylobacterium sp.
MSVRETLEARLARIAAGDPAVFTRLYPEQARAAADAADARRRVGISLGPLDGAMVSIKDLFDVAGETTRAGSVLLADAAPARTDAPVVARLRRAGAVILGKTNMSEFAFSGLGLNPHYGTPGNAADPARIPGGSSSGAGVSVGQGTSDIAIGSDTGGSVRIPASLNGVVGFKPTASRVPLEGAFPLSYALDSLGPLARTVADCAAADAVLAGEEPAPMEALAVAGLRIGVPRGLLFTETEAPVAEAFERALSRLSRAGARIADHPIDDHLAAMDAALPDGSLAAIEAAAIHADWLDSAADRYDPRVHRRIVAGRNATAAGYIRTMRRRAALIAAFDRHLAPLDVLALPATATTAPLTAPLAADDAAFLAANRLMLRNTAFGNFFDLTGLSLPMPDLPRPAGLMLLARHGQDRRLLAIGAGIEAALAG

SEQ ID NO: 1905 - protein, 96 aa, Methylobacterium sp.
MSRSRVPEAQSRPDGTGVIPSHDTAILGSGAVGAGAIGASALGALALGAAALGVVAVGAFAIGRLSVGRARVGTLEVGSLEIDTLTVRSVRMPDRG

SEQ ID NO: 1906 - protein, 95 aa, Methylobacterium sp.
VTMPDLRWTEGPVHCTDLVDGTGKVFGYVGPCAAGTRGYVVQSGSEWPPRPAAFADHPAAAAARAWVEAAVSARAFRPVRILREEVAREDSAPEA

SEQ ID NO: 1907 - protein, 149 aa, Methylobacterium sp.
LSKWYLYGIALVAGVANAIEPGQNATLAKVTGQPMLAGLFCFGLAIACFLAAMVVAQLRGRTRAEAATPVPWWAWPGGILGAAVVLAQLYISEKVGAAPFLGCVITAGVVGSIILDHHGLVGFARHRAGRWRILGGALMVAGVALVAVF

SEQ ID NO: 1908 - protein, 151 aa, Methylobacterium sp.
MTGARISSTEIAIPARAGLVWSVLTDLDSYPAWNPYIRKAEGRLREGARWRLERTLNGRAYRARQVTVTCWEPGRRLTWRGGIPTPPLLIGEHEVRITETADGVRLVQAETVAGLLAPGLFPWLRTRMQARFTAMNEALREEVARRLAESA

SEQ ID NO: 1909 - protein, 76 aa, Methylobacterium sp.
MTRTLTIAALAALLAVPAVQAQARPRHTPAKAQPSAAIKARQTVLNDFNARMSRLDALMGAPSTSSVRARSAEAGR

SEQ ID NO: 1910 - protein, 471 aa, Methylobacterium sp.
MLASKTLRGAGWSVAARISARAIDLGTLLVLARILSPADFGLTAIAASLISIVEMILEIPLVQALLRLQKIETSHLDTAFTLGLLRGGVIAVLMMAAAWPVAHIYDDVRLIPITLALASAPIARSLYSPAMVHLFRKIDFRASFLADFSGKVAAALISIGSLYLGAGYWALVINPAASAILPTVLSYVLAPYRPRLSLARLSAFSAFTGWFTSSQILAAFSWQFDRMFLGYHVDKAVLGRYGVASDFSVLPTQSVIGPAMRPVMAAFATMANDRTRLRAAFLKAARLTMIIALPAGVGIALTADQIVSVILGAQWISAAPYLRWLSLAIMFTAYYQPVSTLCLAMDEPNVMLKITLLESVVKVSSMAIGFYVGGVMTMIYARLVTALFHFLISAIYARRLVGAGVAGQIRNLWQIGLSCAVMAAVVLGLRDALSRLDIGSAGLLAALILGGAAAYSASMLLLGFRLRTLRP

SEQ ID NO: 1911 - protein, 108 aa, Methylobacterium sp.
VPIMMFAVPALLLELALTTPVSDKMPVFDVRGSCRAATTAMTLDPVRQKLCLQDEGSARSEVAKKWSSYPAVDRTRCAAEAQLDGLPSYVDLLECLTLAREAKAEDDQ

SEQ ID NO: 1912 - protein, 38 aa, Methylobacterium sp.
METTMTWTNRIALAATLIAGAVALVTYAQALSLPAHFA

SEQ ID NO: 1913 - protein, 261 aa, Methylobacterium sp.
MQAMFADGQVAVTLSGEGPPLVLLHSLLADRTSFDRVTPALGRDFRLLLPDLPGFGASAPAPGGLEAVADRVGAALRAAAGGRPAAGLGNGYGGFVLLLCALRHPDLFDRLVFADCGACFPEPGRAAFRGMAGAAAEKGLAALADTAMRRLFAPAFQAAHPDLMAERRAAFLRTDVDVFRAACAALAGLDLRARLSEIRAPALVLVGEEDEATPPAMARELAAGLPDARFVTLPDCAHVPQLQAPELFAREVLAFLRPGSA

SEQ ID NO: 1914 - protein, 376 aa, Methylobacterium sp.
VTEATGPYWPTEDWAERDPGAAGLDAGRLADAVAFAQAHESAWPRSLYYPDGRYVGIVEWNETGPWSAVDGPVRPRGGPAGVILKGGRRVAAWGDTARPDMTFSIAKSYLAVLAGLAHDDGLIPDVDAPVRDSVPDPLLDGPHNGAITWRHLLQQSSEWQGTLFGKSDQVDHFRQIGPGADNSRKGEARALRRPGTYYEYNDVRVNLLSYCLMRRFGRALPEVLRERIMDPIGASRDWAWHGYDTAWVAVDGARVQSVPGGGHWGGGLFIGADDHARFGLLVARGGAWNGRQLLSERWIRAMLTPSPTLDSYGYLWWLNRGAAAKPQLPASAFSALGAGNNVIWCDPEHDLVAVLRWIDKAALDGFLLRLVAALRP

SEQ ID NO: 1915 - protein, 105 aa, Methylobacterium sp.
VRLPARLAAALRPPARAGVQHLPRRVWPGEEAAWRDENGVRHPRAVRRALAALAALEPRGRYGARIEGRGKVVTGPASALVLRDAEAEIGFVLGLTPDGYGAEPF

SEQ ID NO: 1916 - protein, 287 aa, Methylobacterium sp.
MKPAPFAYLRATSVDDALEALRQHGPEARIIAGGQSLMPMLNMRLTKPAVLVDVMRIPALKEPRLDKGALVIPAGVRQAILLDRPGLARDLPLLAAALPWVGHIQTRARGTLCGSVAHADPSAEIPLCLVALQGEVHLRNRRKVRRVAAETFFAGMMATDRADDEMIEAIAYPLRREGTGTAFAEIGRRHGDYAIVACAAVVDGTRMRLAVGGVADRPTARDFPHLDGSALDDALNAFAWDLGAGDDLHATARYRRDLVRSLGRRVLEQAAKVARGDTHQEAVPCHS

SEQ ID NO: 1917 - protein, 221 aa, Methylobacterium sp.
VQHFGVTVQNMDRAFAFYTEVLGGTEVMRDGDFKGEPVHFTLMADQEIVARERRVDPRTIGVPDLKGGSQRLDVRFVQFENVVIELLQYRDATQPMGGGDSWAEPRDHMSPAYPRSMHICFYVRDDVNFDKFIADLEAECARRGMTQVRANRTVPVHSEEQRRAAPRDTNSIKIHEGPSNGWSIIYCKGPEGEQLEFVQVLGPVKKTFADAAEARRATNRG

SEQ ID NO: 1918 - protein, 171 aa, Methylobacterium sp.
MAYHPVPVTHVGLTVTDIRAATEWYTKAFSCRHIIGPLHIRHDGSHIGEVFKGIFGDRFEEGYVSHLATANGVGIELFEFVTPKSEAVDDNFRYWKTGVFHFCLVDPDVEGLARRIAEMGGKQRSKVWTLFEGEPFKAVYCEDPWGNLIEIYSHSTELMYANRSTTAARAE

SEQ ID NO: 1919 - protein, 100 aa, Methylobacterium sp.
MRGTQSSTGAPKAPLADPRRGCDLPRFFLNVRRHGTLIADREGDELPDRTAAEHLARDILREMRRLPHVYGAPRGWRADTFVITDEAGAVVAEVPYASVL

SEQ ID NO: 1920 - protein, 262 aa, Methylobacterium sp.
MSGTLLETVDERGVATLTLNRPEQHNAFDDGLIAALTASLHRLGAAPGIRAVVLAGAGQSFSAGADLAWMRRIAGQSFDSNLADAAGLAGLMHSLDRLPKPTLALVHGAAYGGGVGLAACCDIAIAAESARFCLSEVRLGLIPATIGPYVVNAIGPRWARRLFQTAEVFSAERARAIGLVHEVVPDDRLEAAGAEVLRDILRGAPGAQAEAKDLVFLCEGRPVDADLGRETGRRIARRRASDEGQAGIAAFLDKRLAPWRRD

SEQ ID NO: 1921 - protein, 119 aa, Methylobacterium sp.
MPVTEGLTHLTFSIIRLAMFAPRSICSPCGRSGRMARRGVFVRAEEVAFLEEARRWWQRCVLVLTRAKPQGPLYNATSKVIDAIDDVAEVVTGDRRTFYQRDATTPGENLPPMKWRTVE

SEQ ID NO: 1922 - protein, 78 aa, Methylobacterium sp.
VRAEEAAFLEEIRRWRQQCVLVLTRAKPQGPLYNATSKVIEAIDDVAEVVTGDRRAFYQRDATTPGAALPPVKWRTVE

SEQ ID NO: 1923 - protein, 71 aa, Methylobacterium sp.
MVSEPVGPEGYKRRVRYEKPHASIYAHPKVFKALREIAAATDCKPHDLYIEGLRMVLRQHGRDFDALNRGE

SEQ ID NO: 1924 - protein, 452 aa, Methylobacterium sp.
MTRLLASPVRRLAALGLALLVVNVGALAIHVPGADTVGSVTRANVFVGVVVVGLGLYLLAVGLVLRERLPRAALWTILGVAVLMRAALLPAPPFLSSDIYRYVWDGQVQAAGINPYRYIPADPALEQLRDPAVYPLINRKDYARTIYPPAAQMVFAAVGQVSHGVTAMKLAMLGFEALGVLAMLAILRGAGLPSARILIYAWNPLALWSFACDGHVDAVAIGLLGLALLARTRRGYGLAGALLGAATLVKLLPVAVAPAFVRGGRLWRPMLFGAAVIAVLYLPYLGAGTNVLGFAGGYGAEEGYETGTGYWLLAGLGHLGLSTQGLLRTYLVCAGLTLAALALRIAFGRDRAPARDAVALCRDAGLLAALITCAASPHYAWYYPWLALPAVVAPAPALIWLGAAPILFLIDPFNDRFLWPALVFVPALVLAARALWQARTAPLAALPEGTAR

SEQ ID NO: 1925 - protein, 393 aa, Methylobacterium sp.
MTAAQPLSTDPFLPGPRVRVAGSATGPLAGLTFAVKDLIDVADTPTGGGNPDWPRIYPTPARHAGVVQTLLDAGASVVGKTVTDEVSMGILGENAHDGTPLNPAAPDRVPGGSSSGSASAVAAGTCDFALGTDTGGSVRVPASFCGLYGIRPTHGRIDFSGICVQAPSSDTCGWFARDAATFARVGEVLFGQAMPDRPPHTLLVAADALGFADAAVQEALAPQIDRLAALIGNRRDVTMAPQGLSVWQRAQRVLQSSEAWQTFEPWLDACNPRMAFSVARSLIQGSMMMDAERSAAGLMRIEARARLAQLLLPGTILCLPTTPFPAPLRGLPLGALHPLRERIACLTSHGGLTGVPQVNLPGAQVDGAPIGLSILGARGADLDLIRIAVALEA

SEQ ID NO: 1926 - protein, 86 aa, Methylobacterium sp.
MTRLPIIVLATLALGGSAVAAEQGASSKTPGHEMQDRGSRAGSPGASGYAPGHEMKSGGTDSSGSTSRSGGSTTGTTGTSSTGTRR

SEQ ID NO: 1927 - protein, 317 aa, Methylobacterium sp.
MLDTDDLRFFVAVAASPSLAAAARSLNVSPPAVTQRLRSLEKRLRVHLVDRSGRGLTLTDEGELLAERGRDLLGAFDDLADALAERVGAVTGHLRVVAPLGFGRRYVAPVVTAFRLRHPGVRIDLLLSDRLGRIPSETWDLAIHVGEIREATPSLTVRALAPNDRILCAAPAYLARQPAPRVPADLRDHTCIALRENDEDVTLWRFRAADGAEVRVRVDAGLVSNDGDVVRGWALAGLGVIVRSEWDVADDLRAGRLARLLEGYALPSAPVVALLGSERRSRAARTERFLEALRRSFDPLPWRPPAGPGAATGDAAP

SEQ ID NO: 1928 - protein, 106 aa, Methylobacterium sp.
MSAQTAIAILDSMFDLFKEMGSGIALDLNWFAITSRLQQVRAEAVWSADLDFVAVKLKAYAAHYAATYREPLGSEAIRYKNAERLDEVVRHYSILRAHLEQQMPAS

SEQ ID NO: 1929 - protein, 206 aa, Methylobacterium sp.
MIDLYAWNTPNGRKISVALEEMALPYRVIPVDITQGAQHAPDFLAISPNNRIPAIVDPDGPDGSPIPVFESGAILLYLAEKTGRFLPEDRRQRVAVLEWLMWQMGGFGPMPGQVHHFLTVAEPDRAYGLARYSKETHRLYGVLDRRLAQVAYVAGPLSVADFAILGWAWRHERHQVDLADYPQVRRWYDRMMERPAVQRGFAVPLS

SEQ ID NO: 1930 - protein, 286 aa, Methylobacterium sp.
VGQSNLALIYENYSDRATLSGGSWQPGSLRLTNLQTPYIAEKARTTSTDPAATQFTVDFGQPYIIGGVCFGPSNVRPDALCRYRMYDSVGLLYDSSIIPFPGTTVDSASLDWEDNGFWEGVSTEFDDLYKGVYFIDFPTLPVSCERITFEIFDANNPAGYIEIGRLYCGKVWQPQYNYDYEGHSLDFQDKTDMQESVNGTRFFNPRPLRRSFSFSFSYLPEADTFRDVYRIATRAGTYRQVVVVPNPGDVSTFVREAFLGTLGALPSLRRPAFGYAATAFKIEETL

SEQ ID NO: 1931 - protein, 76 aa, Methylobacterium sp.
LRKPSGPSGPKLFLDTQVVPLAANIAGSLEVALDRAAARTGVRPALILAGATGLIGLGLVRLFTPRGAAKGRFERM

SEQ ID NO: 1932 - protein, 80 aa, Methylobacterium sp.
VREAIEAAGARLLYLPSYSPDFNPIEQAFAKLKALLRSVAARTIPDLWPAIRQAFTRFTPQECRNYLAAAGYEDDLAVAT

SEQ ID NO: 1933 - protein, 124 aa, Methylobacterium sp.
MDDLLREFLTESGEHLDTVDAELVRFEQDPNNETILRNIFRLVHTIKGTCGFLGLPRLEALAHAAETLMGRFRDGLPATSDSVTLILLTLDRLKAILADLEATGTEPAGSDDDLISALERMAEG

SEQ ID NO: 1934 - protein, 89 aa, Methylobacterium sp.
MALEHSGARIRLSGHCPVEEAEPLLDVLRATPEAVVDLTGAAWLHTAVLQVLMVAAPALRGRPAGAVPAACLAALPEADAEPAAETERG

SEQ ID NO: 1935 - protein, 381 aa, Methylobacterium sp.
VGEVYAESTPVPDTGATYINTTITILRGFNLIYDADSGFAGYQRIAPESADLIAQPMIALQGSLSLASQFTTGLPVFLMSTTALNPLDVASLGGDVSGPGGLIKVGLGTLELAGTNTYAGGTTILGGTLAVSRDANLGAAGTGLTLGGGTLEVLADGFATARPITLAGPGTLQIDVGTATFAGPIADGSQPGVLIKSGSGTAVLSAANTFTGGAVISAGTLALTATGSLIAPVLVGAGASFLNAGLVAGSVGNFGVLANSGTINGAVANAGMAVNAGTIAGGTTNSGSLVNTGTLAGGLTNTGTALNTGTIGGGVISSGILSNSGAIGGGVANTGLLATSGTISGGLTNAGTVLASAGRIDGPIANNAGLLAVSGSVAGTG

SEQ ID NO: 1936 - protein, 433 aa, Methylobacterium sp.
MKVLLCSTPATGHLNPLLAIAHMLIADGHEVMVLSGSAFRDRIVAAGARFMALPGAADFDGRDLRAVVPELAEIAPGPDWLRVAMERVFVDRIPDQARGLRAALRAFPASLVIGDDMFFGALPLLLGPRAERPAIVLCGTSILHCARPDRAPAFLGLPPAETPEQAAAYGRIAEAYEAAVDRPVGLSLAAKLAELGRAAPPWPLFDAVVRLADTYLQLTVPSFEYPFPLPPTVRFIGALPIVPGQAALPPWAGDLDGARKVVLVTQGTVANHDFGLLVGPALRALADEPDILTVVTGGGRGLDAIPGPIPANARLSPYLPFEWLLPRIDAMVTNGGYGSVNQALSYGIPLVAAGLTEDKADVNARIAWSGAGIDLAANDPTPEAIRKAVRTVLDAPGHRREARRLAAEFAAYDAKAEILRLLSSHGGRARSAA

SEQ ID NO: 1937 - protein, 65 aa, Methylobacterium sp.
LVEARERAGLTQHQLAERLGRYQSVVAAIEGGGRRIDLVEFLEIADALELDPVQVVVAVRAMPPR

SEQ ID NO: 1938 - protein, 132 aa, Methylobacterium sp.
VAALAFAAILLFAAATDYVPAFRDAEGRVFGLFRLDVYKDALHLASGLWALAAGLWSRSAAVTFLRAFGAIYLLDGVVGVLTGSSFLDLSLFLKGFQDSPLLSNGPHLSLGLAGVVLGWWPWRARTAAGVAA

SEQ ID NO: 1939 - protein, 389 aa, Methylobacterium sp.
VAVARPDRGRGRRVSPRPPPRRRRRVVRWAVAGLAVLALACALPVAAIEGGCTVRPDPAGPGRSAGGSRFGIAPEGYKRAAGDSYLTFPEWDIVHAYADLAGVTRSASESAFDYWAATTGFWTSLCGATRAAGRTGDVTAGQKVTNYVIGLSFTAEMLIQGAYERTLGALTARWRGPEPTDEDRFNARLLADYAAFLRQTPWYRYPFDAELSRLWHEVPFTPSLRAVERRGALTLQYGVKWAYAQGIAWLAGMDPAGLTIRSVVAGLDAGDAAADPRITLLGPVPAGDGGPAALMETPRYRAFTEIVRGLGARGRTVLEIAGNHRILTTVLLPPGPTVTLAGAEPLFAMPIQSEPGWQRVGYDTAVEQLVAQIRAVEAAGGRFEHAYDY

SEQ ID NO: 1940 - protein, 99 aa, Methylobacterium sp.
MPTITDRRPRRGLPVGAVAAALAGGLGVTALTALAVQPETVVALGNPAALAAADDGALVSAGRAYLVLRPAGPGAVRRLYAGGAWLVLPAPRTGCLGTR

SEQ ID NO: 1941 - protein, 68 aa, Methylobacterium sp.
MSPEETELEMVRRHIREGEGHLAKQRALIARLKASHLPTEEAEALLGTFENSQHQHEAHFARIRGNQE

SEQ ID NO: 1942 - protein, 379 aa, Methylobacterium sp.
MQDLEAYSVLVGSIYDRVGQPEEWSALLEDLTDFVGGRVGQLAVFSLDGNRKPLWAVSGFERSRYREFLYRHATEDPRLPYILSNQGKVIRAEEGVDAVQFRESALFKEVVQPFEIEHSLVTYFAKEADVMATLAAMRGEEGGPFRSDEVRRLAMLVPHLRRAFELYALMRQASERTSDLASALDLLDAAVILTDSDLRVAHANRAAEALARSRTGLSFVKGSLVLKDSQTGRRIARAAGEALAAASGDVAITQADHITVTCGESGMPYRVSLHPLSKRPAGTGSKVRAELAIVIRTGTPKVQGSNAARLQKLFGLTVAESILANAVASGRSLDDHAQDRGIAISTARTQLRALFAKTETHRQGELVARLREGLDVSLN

SEQ ID NO: 1943 - protein, 88 aa, Methylobacterium sp.
MANEHFAHASTHRAATIRLGSFDVPCTVHSSTDASAHVRVVTADGIPEYLILVRDGEARRAHVAMRKQGPLGLDLWLDLQVAQDARAA

SEQ ID NO: 1944 - protein, 475 aa, Methylobacterium sp.
MLPVLVARKGARIGMLLAVLAVPVAGEAGWKGPEAQPLFVNEANPAGYNYAPSVITENGTTDIWWCGQGKTDVIFHRSYTPQTGFSPARIVFQPTPNSWNRQYVCDPSVIRGRFVNPADGQTYAYAMYYSGADNLPGNNNQTGLAFSNDKVTWVDYPEPVIKPINPVVARGNYGTGQPAIFSDGRSGLFVFTTDLTGPQGVPGFGDLYVRHTADGVHFGAPARVPNATTDGSTINPNSDFAYDPKTGEVYVITGLPGRACQQVACKDPGRNPDRETYQMGLFRMPLKAVLSGSPAAWTSLGYLNSDVTGFYLNHSPGFQRDGAGYLTPFLPDITVFFSGGDPYPGTWRIAEARRPKGTDRLPLRRAFGPGGHWVTTGYIGPGYTIERSLGTVLTLPAPGTAMLMSCAAGQDHFLSRDPRCEGQTPLGQTGYVYEAHRPGSHPIYRCIAGGRDHFVSTAPDCEGHASEGMLGYALD

SEQ ID NO: 1945 - protein, 98 aa, Methylobacterium sp.
MKFGVLILAGACGVLVGIVIGYVAGARLSQAFAQLPVTDRSPAAQALRIVDRIATEHGLARDTLLRAMLDQQGGGTGTARPGEEPGRVPGTAPGEPAR

SEQ ID NO: 1946 - protein, 71 aa, Methylobacterium sp.
MTAALAAPVTQVCAFMLGCALIHAARAHADLITRLLAVTAVGVAVLVLLVASLDYAPEGGTFDEVTVYAAS

SEQ ID NO: 1947 - protein, 151 aa, Methylobacterium sp.
VDDALNATRAAVEEGIVPGGGTALLRAKKAVAELKSEIPDVQAGIKIVLKALEAPLRQIAQNAGVEGSIVVGKITDNTSSETFGFNAQTEEYVDMIQSGIVDPAKVVRTALQDAASVAGLLVTTEAMVADAPKKDSPAPAMPGGGMGGMDF

SEQ ID NO: 1948 - protein, 65 aa, Methylobacterium sp.
VESITPRPANWEIAGGGIRLVFPVQAGQSHALIRFTGSPAFRGGVNLTARLDAGEMLSWSQYAVP

SEQ ID NO: 1949 - protein, 152 aa, Methylobacterium sp.
SDDLDELLTLVWKKPAFFVAHPRAIAAFGREATRRGVPPVVVHLFGAPFITWRGMPLVPSDKLPIDLDPVTGAETTSILLLRVGEGEQGVVGLQKSGVTGEIEPGLSVRYMGTNDHSIASHLVTRYFSAAVLVEDAIARLDNVLLGNYHDYA

SEQ ID NO: 1950 - protein, 142 aa, Methylobacterium sp.
MALRSTSIRIASLLLAACWAAPSLAEPAAVARPKMLVYGNYCGLGNNAPLPPIDVLDAACARHDDCTPDTDLPTKACNLRLEREAMVIANDPHQPDGLRTMAGFVAAFAEANPSQVIPDLVPVVVTVNAPARAPRTAYTRLR

SEQ ID NO: 1951 - protein, 127 aa, Methylobacterium sp.
MLTRTVIGLVAPVCLAAAWATPSLAQPAANGGPKFLIHGNYCGPGNNAPLPPIDALDAACARHDACTPDIGLPTKACNLRLEREAAAVARDPRQPDNVRSLAGFVASFAASNASSPAPTVLPARLAR

SEQ ID NO: 1952 - protein, 88 aa, Methylobacterium sp.
VTAADAELPKQDEILALAAMLAEQILAAQSEEQPFTQPQFNALVSATRFLHENNVPWPPIVQQALDLFAEQIEATKLDPREDEAQRWA

SEQ ID NO: 1953 - protein, 88 aa, Methylobacterium sp.
MTAADAELPKRDEILALAAMLAEQILAAQSEGQPFTQPQFNALVSATRFLHENNVPWSPIVQQALDLFAEQIEATKLDPREDEAQRRP

SEQ ID NO: 1954 - protein, 510 aa, Methylobacterium sp.
MSTYHLSQSEFEQQLQSVDPSIQQRVEAALSAAGVDIAKDGVTLETGPQGNVSVGSSVNLFEAVAAGKYTITAGDKSIIATGTNKVTVDLAGSGQNTVIVGSGGANVTTNGGDTVIGGSGSSEFVAKGGGNVLYGGSAQDTLAAVDGNNTLYAGSGRNNLNGGAGNDSLYGGGQSALYGGRGDQQLVGGANGSARDTLVGGNGSDVLFVQHGNNTLIGNSGDTLYGGTGNDSLSAVGGNNTLYAGSGLNTVQGGAGTDSLYGGGQSSLVGGTGNQQLVGGANNSAHDTLSSGAGNDILYVQHGTNQLIGNGGDTLYGGTGNDTLSATGGNNTLYAGSGLNLVQGGSGRDSLYGGGQSSLVGGTGNQQLVGGANSSAHDTLVSGAGRDVLFVQNGSNQLFGNGGDTLYGGIGNDTLATTGGDNYLYGGGKTAFELSNTGGNDTIVGSSTDSLRIDNAGLGTASYNYNQVDNSTTITFSGNSAMSVTVSGLTQVTYSDGSSHSLGQQVPPHP

SEQ ID NO: 1955 - protein, 47 aa, Methylobacterium sp.
LFNTILALLAVLAVMTAHALYKLVRLPFRLVRGLFRHKAPRAQLTAR

SEQ ID NO: 1956 - protein, 47 aa, Methylobacterium sp.
LLNTILALVAVLAVMAAHALYRLVRLPFRLVRGLFRHKAPRAQLTAR

SEQ ID NO: 1957 - protein, 499 aa, Methylobacterium sp.
MRLAVLQFTHETVTFLPNDTTRDDFTYPGSPASGAALLATDPKGYMGGFVQVAREYDGVELVGITSPLWPRTGTASGWITADAYAHFLGQMVAELRALGPFEGVYLALHGAMAVRGVPRPEADIARQVRAAVGEGAILVGTFDLHGNEDAAFLDHADMAFAVKYFPHYDGHLQGQRAARMLVRAVRGDFRPAHRTLKVPILSPTVVQWTGAAPWSDLVQRALVWEAREPDVYVNVFFGFPWGDAPDGGMTVQAITNADPALAERVARDVADLAWRQRRALLETTRIHTIADGVRRARAAVAEGAAPVVLADHSDRSGRATWLLGEILRQRLARTLVATVASPDIAAGSLADGDPFDAPVGGGGDPSAGEPVRITGTVLRVVAAPEPGVAGSGGGGTWICVAFGVGNVLVLSPQLAQIVEPDELWRLGLDPADFDVVAIKSRVHFRRGFDDSGYARTILLVEPPEPFLGTVRLDHLAYAQMRAADFFPYGDPPGPVPSDP

SEQ ID NO: 1958 - protein, 96 aa, Methylobacterium sp.
VTFTWRRTFPGTHHDFVAEEAGQHVGRIKRMDGGPQNGTWTWSCTGCQRGHEAEGVRPLNGMADTRDEAIEALAAAWARAKAWSARSWQPLVPGGS

SEQ ID NO: 1959 - protein, 51 aa, Methylobacterium sp.
MEWVYRGFETSMLGLALCLGLGACLTLGTARVPAGTLSVTLPMLTVTAPAP

SEQ ID NO: 1960 - protein, 844 aa, Methylobacterium sp.
VADEILRMQAEVQDRYSGPLKALRAQLLDTARTGADHSATLAKGFKAVEGTMQSTARTASSVLNPAFAGLGITGLTAGAAVTGISNALNKLTGSMLSVGQLSRETGVAAKTLQEFSSVAGRFGVEQDAVASATKNFAAQMRTFSIGTGEAFRWVMQQGRDASGRKAFQDFATDLQRTSDEGEKLKKALSFMETIKNPVERGIFAQQFFGNQDLGRIADGHLGRVVDLFKKAREKLGEFRPEDIIDAEKFDRSVSSLKGSMQRLGTTIAREVLGPATELTTWADDLVSGKRADVTKSLREGLQELKKELGEINWKQFGDDSLTVLRESTALAGKTAAAFHAIAEAIHAIREGNYAGAARGLDGASGPLARRLAPRVGDDEIAAKEQVESWKKALAEAEYDQETGGPAIDFKSREPLLRKRLKESEDVLSGLQGRTPEQRQKDFEATEKLRKALDANTEELKASRNGATVQKQSMDTQGGLFGGATVQTAGFGSGFRRFGGYGGGSGPGYAGEQGPAGGGAGRSLGGGGRFNGLGSSRPSVAPIGPRPTVPQLGGPAETDEQVTVHGHKWNPGASTSAGKARVQSWLQFFQAPVDQGGLGADAGTARAMVAMMQGESGANLKPDAEGDYKDPVNRRNPTAFGTAQWRLERFQALKDMAGRMGTQWTDVGAQQQHFRNEVLNGRYRGVWRDILNAPTEEQKLRLGIGGFERPKYPGLAYDFRLPNLRRLQRGAAATGGATAERADGSSAALMRPERADGAGWAAREAARKTFEAQQAEAAGLRASGARVASAAAQAGVVAMPKVEVNGSVTNVVERPGPDTRIRTTASGKLFQDVVQRSGAQMRRAD

SEQ ID NO: 1961 - protein, 676 aa, Methylobacterium sp.
MSQDEALRMAAVVTDGFTGPLGKLRDTLRTIGREGGQHNDALAKGFKGVETAMHGVGRTASTVVSPALSTIGVTSLSVTAAVLGVGAAMRSFVSAGASLGQMSRETGVAANEIRILSSVAGKFGVESSSVEGAVKNFAKAMREMHAGSRETMNYLMTQGRTAEGRKFFQDLARDIDSTSDQGEKMKKVIEAMEAIPDPVERGMFAQKFFGNEDFGRLGDKHLGKIQEIWKKTAQNLGPLDPKAVESAESFERSMKSLQTTMSKIGTTIASELVGPAEQFSTFLSEAVSEQRGGAIKAIREGIQGIGTELGRTDWQTAGKDAKAFLSETTALATTLAGALARIAETIHSLREGKIADAFRSADGGSGPLARKLAPRVGDDQIEAQESVDRLRKLLDVSKEAQQHVIGRAQIGAGLLDAPEKVQRDLEAAEARLKVLQSRTPEQRQKDFEASERLRRSVDSLTEEMKAARGSGNATVQQQSFDGAGAGFGGARIQTASLGGAAAAARVGNILGGRGGGIYAPGGGEGAVSPPLDPNDPVVRRRFDAFRENRGGGRSFGEPATPAERVGERLRGEGASGAGDPGMLDLIARAEGTTRRGYDDSFAHQVSGSLTDKTLGEIEQIQRGMRGSSAIGRYQFMRKTLFGGRRGDTGLVGELGLSRDDKFTPELLILPRHRGHL

SEQ ID NO: 1962 - protein, 575 aa, Methylobacterium sp.
MSEMSERANMTGAHALAVALHRHGVRDVFGQSIPSALFLAAPHHGIRQIGYRTENAGAAMADAYARISGRVAVVAAQNGPAATLLVPGLAEALKASIPVVAIVQDVHRRFTDRNAFQELDHLALFAGVAKWVRRVAVAERIDDYVDMAFAAAASGRPGPAVLLVPLDLLDERPDFEAAAPRRSASLGTYPLDRTVADPARIAEAADLIAAARRPLVIAGGGAHSSGAYPELAALQGLGLPVATTVMGKGAVAETDPLSVGVVGYFMAPRARSSHLRSLVTEADVVLLVGNRTNQNGTDSWSLYPADARFIHLDVDGGEVGRNYEALRLVGDAKLTLAALAEALRQRDLAGLEGRRAPLTDTVARAREAQAGDMARLVDMEAAPIRPERIMAEIDAVTTAETVVVADASYASIWIANFLTARKAGQRFLTPRGIAGLGWGLPFALGAKAARPDAPVICVTGDGGFGHVWSELETARRMRLPVIVVVLNNQILGYQKHAELSLFGDFTDVCDFEAVDHAAIARACGCAGTRVERPEDLAPALRDALAGGAVTVIDVITDQRAYPPITSFEGKDALAY

SEQ ID NO: 1963 - protein, 222 aa, Methylobacterium sp.
VPDWVRPIVKESLSERAYRELRVALMRGQLRPDTRLRLRPMSARFGISATPMREALLRLVAEKALALDARGSVVVPRLTLDQLLEIRAIRTDLEGRAAAAGAARRAAEVDDLEAIHAQISHCHASRDFARAVNLNTEFHLTLCRLGQMPILYEIVELLWVRCGPILSHLYDDGVPDWEPHPHRRIIDALRRGDSEAARDAVREDIERGGSGLFAHVRAAATG

SEQ ID NO: 1964 - protein, 215 aa, Methylobacterium sp.
VLVMGSLPIGLGHFRRDERGIAAVEFALVLPLLIVLYFGTAELTRVVDATRKLTLFARTLGDLSGRVDNALATQNGMALATQDGMTKITSAATAILRPLDASGLQIVVNAMGVETVNGSLKGFVCSSWPQNATQRPANQANGSNGLPATPAAYQFDGARYILAEVTMPYTPIIGSALYRWIFGGRGLTFTRQIPWSERTPSEIVMPGGTACPVYN

SEQ ID NO: 1965 - protein, 211 aa, Methylobacterium sp.
VGQAILGTAACADPTLTRLETELDAAYERARERVAGEPALVEALRGEQAMFAEGRAAVAALPGASLADYLASWRSWLDAIGPPRPGWDGIWLTGAGSLEIAPRGDGVYRIVAHADEPTRGAYTCAFIGIGRLRGDAIEVEWDAADGGDGADGWTLTIRRAEDLMHVEQHRGGSEAVTPPFCGHHGSLDGHYLPALVKPGSVTAWGPARATP

SEQ ID NO: 1966 - protein, 989 aa, Methylobacterium sp.
VPGRLRPPPVPDAREPLAALRPRGWVHAGTIPLDGILMARGSVGPDWRARLLPWLEHAAEVRARGDRVLVLFAAPVTRDCSALGPVLPVVRSAGILTAVPLAEPEAPVAAALRDHVVHMTGGRLAAEPLAAFASLDIAGWWDLDAIAVHPAERLPVLRPAPPARRLVSAPALVADADPLAPVRDAVSRRPRRRTKHVLGDLVTRGRRLIVGALGLLWTAYVVLLAFIMVGAMVLGFAENVRTTAEHGAAAAHWGSLALPVLVLLVLAWFAFRRRGARAAREGAAPSAIPPAGTGRTPIWRRAAAWLAWRSPYAAHLRRLYARRLTEVERLFAAGRVDEALYRAIGLGGEARRGSAFADLPLTGPGLRRSLDLDLGPQRASGLSLAPADEIRLAALYRAQAVAMAGRGDTDRAAFVLDSLVGNPHEAVRLLAESGRLETAARLAEARRLLPATTVPLWFRAGQTERALALAARHDAHAELWKELGADDPFRPVLAEAWAARLVGIGALDRAAAVTFGLPALAERRLDWIRQALDAEAPVQAEPLARALRALPWEGRDGNRLHAAFADLVGATGAEAAGRRSAVAALLLDAQFEGGPERPPTPAFALLCRGLARRLATDDGILGHDAERARLAGRLAEAGGQVALRQHLRQLRTRSAPSASRLSGPLVVPDGPALAEIADAALLSGGRLLLGYRSGLVRLLGRAGRERWRGQVDGLTGFARLGAGDRAIVLRETLEGPDVQLFDAGTGRLLPLGPLPITHWHGQADETGWLVFDGEALVRLDTASLLGRAGGAPGSDGALAHHWRLPMTEPGRPLLLAAFADASALIYARHDGLIEWWSLSSRTLAVTCRFWTPPDRGSGVLGLTEAVAWSLEGTGANPHLRAHPHVFTTATREQERALVEAAARAEAADPPRLVAAENDRLWAATATEEGTLWAGVPGANRIRGPAVLWQGSGSLRARFAPEGDVAAILDERGRLIVFETVTGQVTLRLI

SEQ ID NO: 1967 - protein, 637 aa, Methylobacterium sp.
VSAASSSLRKTLPPALAQWTALFSDMAEPDLRILAALVEALRPLVEPADGAGGQPQGEIDGLGGLGTRGGIERLVASEWLWRDLDPDAFLQRAAERDLLTLEPVYRQAADAGAVLVVVDAGPELLGAPRLVAFAALLCLAGLARRRGARLLWASTATPERRWLGALKRSDAAILLRESAATSLDAVELERVLAEPVATRAGGRPGASLWLIGGSDLPEAARPCRRITIAERPRLGSDGLAVAADVAVLDASGPVAGARLDLPPEREAVGLLRDPFRPRPAPGRPPPRRSTPDRSAAPPDWAPRGLAFAPCGEHLLVARPDGILIVPVTGTSGALRLPVAPYERLVGLDVGRSRIRAACLNVYADDARLTLRSWTFDRSGAAATLDRRIPRDHPLVSRRLPKAVLPPLGTLKRRNRSWLLAADGTAFLVSEKRLIEYAPLAGELPLAVTPAGLLMRDRADGVIARRPSDGKVVARFPSRAESLRPGGGLALCAVRGQPTLGIEQAGGHWDVVNAADGTVGHLRPQGRIIGIVPQYDGVRGQAVEGLLALHLDREEAGSARLTFRTPDGVAAGDPLTLPDATLDAVRVTVDADAVPCIAAARCDAAGFVDALAFSQLHRGWSHLTDLGAFAETVPCLGA

SEQ ID NO: 1968 - protein, 358 aa, Methylobacterium sp.
MVHLALVAREHLLLIGPPGTGKSAAVRACAAGTGARCFEYLIGRFTEPAELFGPLDLEALRAGKLRPDISGMLPEAEFAFLDEVFLGSTAILNALLGVLNERRYRRGHFDTAVPLRCCVGASNALPEDPGLAAFADRFLVTAFVDPLADTDLEALLAGDPVASVEPGDGDAPLTLAEIDALAEAAARIDLAPVRPAYAQVVRKLRARGVRLSDRRVVRGQSLVAAAALIAGRTAAEEADLWPVIHLVQDRIAQDEARDLLRVELGAAASPVLPAAAKAAGYGPAARAADLAREGEALAASAPDDRTAPTFEAWLVRAESFLVQIDAAFGTEERPPALAAARDALLTRCRAPVPGMTPA

SEQ ID NO: 1969 - protein, 781 aa, Methylobacterium sp.
MIRGFGRSGIARRVLVVGAIPILVAAAIALGAWILLYEAERARTGAVVATETAQTLTSMNRARADAVSGGTARRDEAERRFDERAATAAGQLERLDGLARTRGQSALVATVTGDLNSQATRMRSLLLSERTANATIADMARRADALVALTDVARRRQQQDNAQLIAVLAVKDAELERNQGVVTALRELREAISTAELNRARIGRPVFPIEFDELAADLRQLDAVGDRLRRVLRVDGEAGAADRATELLKAYRDRSRTEDGLNRVLSEGFELTRATQAGRVLVEWCDQLVQVNVTRQNRLYEEVALLIRHSVLSNEAELSAQDIALTALRLARRTDAALARRDTAEASRVLEAGAELSGTSRTLLIPVSIRDEMAEAIDGWRTQLAATIEKIGEQNETIADMDSRAATMSANAQTLSRAFIDDADQFGSVIRQLLVVGAVGALCLGIGAAAAVARSITRPLHALQHSIVTAAAAPAPEDIGRDSHLLTRRDELGDIARATNAFLEQIRRREADRRNASQRADDALTNLRQAQEDLIRAERLASLGQLVAGVSHEISTPLGIALTTATQVQSDSAAFERLVGENQLSRSRLTQYAGRMREGAQLLTSNLMRAADLLYSFKQVAADQAIEDRRPLNLADWIDELLKSLRALARPGRHVFQVECPPDLVVDTLPGILAQVVSNAVKNAIEHGFQDREGGRITITGIRSGDGIGLSIADDGRGIDGADLGRVFDPFFTTARARGGTGLGLHIVHNLVVNRLQGRVELQSSAGAGTVLRLWLPERLA

SEQ ID NO: 1970 - protein, 295 aa, Methylobacterium sp.
MPASPSLARDRSRIAALALATLIGVGDPRPGWSLDMPDSPRPARPSRPVPPELAAALAAYRTYVVAQADAFVRETARFVAAIQAGQLAEARRLYAPARAPYERIEPVAALFPELIKRLDVRSDEFELRERDPAFVGFHRLEMALFTLGTTEGLGEVAERLAAETVTLRDRVAALAIPPARAVGAASALIEGIAATKISGEEERYSRTDLWDFQANIEGSKVVFTLLRPLLTDRDFVARVERSYKRVEDLLARYRSPDGGFQSYDNLTARDRNALKGPITLLAEDLSTLRGRLGLD

SEQ ID NO: 1971 - protein, 414 aa, Methylobacterium sp.
MMRFPSQVTTRRQLLGGLGAAALVGPARAEDATPTIATEGTLVAQPFYGPHQAGIVTPQPAAALYVAFDVLAERRGELPHLFRTLTERLAFLTRGGAVPDLHPQLPPRNSGILGPTILPDNLTATVSVGASLFDYRFGLGRARPRHLGPMERFPNDALDPAQCHGDLLIQFCSNTAETNIHALRDVIKATPGLLTPRWKMEGFLPPHVVKTMGADTVRNMLGFKDGTANLDVRDLRMMDRYVWVGAGQDEPAWTTGGSYQVVRIIRTLVERWDRTPLGEQEAIIGRHKGSGAPLRQGHERDVPDYAADPDGEAISLAAHIRLANPRLPGTEGSLILRRSYNYSRGLTAAGQLDMGLLFVCYQADLAAGFITVQNRLSGEGLEEYIRPIGGGYFFALPGVSGPGSFLGEGMLAAT

SEQ ID NO: 1972 - protein, 433 aa, Methylobacterium sp.
MQTDRVDPTYRKLRWQIFAGIFLGYAGYYLLRKNFSLAMPYLVEQGFSRGELGTALSAVAIAYGLSKFLMGMVSDRSNPRYFLPIGLVLSALVMFLFGFVPWATSSVGIMFVLLFLNGWFQGMGWPPSGRTMVHWWSQKERGGVVSVWNVAHNVGGGLIGPLFLLGLAWFNDWHAAFYVPAAVALGVAVFAFITMRDTPQSCGLPSVEAWKNDYPDGYDANHEREFSTREIFVEHVLKNRMLWYIAFANVFVYLLRYGVLDWAPTYLKEAKHFSVDKTSWAYFLYEWAGIPGTLLCGWLSDKLFRGNRGATGVVFMFGVMAATLVYWLNPEGNPGVDLAALICIGFLIYGPVMLIGLQALELVPKKAAGTAAGFTGLFGYLGGSVAASALVGYTTDHYGWNGCFILLLAACVLAIVCLSLTLRHSSTAVAQPA

SEQ ID NO: 1973 - protein, 374 aa, Methylobacterium sp.
MSRTDNADAGDEVAGIVLDQVERLLAQHLTPALLAASDGAAGAAAWPTDLWAALAESGLPLALVPEAEGGIGLAATVAARLIRRCGRAALPLPLPETVAGAALWAAAGGQVGDDALSLVPGGGPVRIAPHAEGFVLDGRVAQVPWGGSVAALLLDTVDASGVPHLVRIAAPGAIRDTHHNLAGEPRDTLDLTGCTVPAEDVRAAPGWATGTGVPSVEAAGAWVRAQQMVGALETCLASALDHAQERQQFGRPLAKFQAIQHMLAEAAGHVAAATAAADLAAACWGDPRFVLATAIAKARCGEAAGHVAAIGHQIHGAMGFTQEHPLHRATRRLWSWRDEFGSDALWQERIGRAVCAGGGAALWPMLVRLRGGAG

SEQ ID NO: 1974 - protein, 383 aa, Methylobacterium sp.
MHSFRFSAEPLPPEAESARASVRAFLDAERAAGHFVPHRTSWTTFDAAFSRRAGAAGLIGLTMPEAYGGHGRSGLVRFVVTEEMLAAGAPCGAHWIADRQSGPQILRHGTEAAKRAILPRICRGECAFGIGMSEPNSGSDLAAVRTRAVRDGDDWVINGSKIWTTNAHQVDYLLALVRTGEPGPDRHGGLTQFIVDMAAPGVTVRPILDLSGHHEFNEVFFTDYRVPDAMRVGAEGAGWGLVTEELAFERSGPDRFLSDYRLLVELVDRIGPEPDRFQAVETGRMVAQLTALLGMSASVARLLDQGIVPGVEAALVKDVGNGFERAVPEIARRLVPVEPSLTAQGDAFREALGGVILRAPSFTLRGGTREVLRGVIARGLGLR

SEQ ID NO: 1975 - protein, 303 aa, Methylobacterium sp.
MDPRVGDQGRFEPCGFRNRRFARRVMVERIAPRGAASTDLTVGADPAGSDMTLVKSAGRVLQILELFDEIQREARVSEIAERLNVPQSSTSVLLKSLVRLGYLDYDRGSRSFLPSPRVALLGAWLDKGPVRDGSLVRMLEHLSERTGGTVILAARNAIFSQYVHVLQARTAMRFHVPPGTRRLVVWSATGTALLADSPEAEIGPLVRRTNAEAPAEQPPIALAAVLANLARLRRDGHFFSRGLVTPGAGSIAVPLPRRIDSKGRPLAVAVSGLLDEFERREAEIAATIHDAVARFLPEDPSRP

SEQ ID NO: 1976 - protein, 478 aa, Methylobacterium sp.
MALPDLSRFYIDGAWVEPVSARPFPLIDPATETAFGTLALGDAEDVDRAVRAARAAFPAFSETAPAERVALLRRILALFEERFEIFAETIRQEMGSPIGFARKGQAARGPAHLNALIAVMERFAFEEDRGTTRIRREPIGVCGLITPWNWPINQIVVKIAPALAAGCTMVLKPSEYSAVSAMLFAQVLHDAGVPPGVFNLVNGDGPGVGAAIAAHPGIDMVSFTGSTRAGIEIARAAAPTIKRVAQELGGKSANILLEDVDFDQAVRRGVAACCTNSGQSCSIPTRMLVPRARMDEAAAIAAEAAAGLRLGPTADPETDLGPVVNRTQYERVVGLIRTGIAEGARLVAGGPERPDHLDRGFYVSPTVFADVTPDMTIAREEIFGPVLSILAYDSEDEAIAIANGSRYGLAAYVQGRDRDRARAVARRLIGGQVHINYPPPDVHAPFGGYRQSGNGREWGEAGLQEYLETKAMIGFGLD

SEQ ID NO: 1977 - protein, 317 aa, Methylobacterium sp.
MAFDRHIFSGTIPALMTPCRPDRTPDLDALARKGRELVDAGMSAVVYCGSMGDWPLLTDEERMAGVERLLAAGVPVIVGTGAQNPKRAAALAAHAKAAGAHGLMIIPRVLSRGSSAAAQEAHFGGILEAAVDLPSVIYNSPYYGFETRADLFFRLRARYPHLVGFKEFGGAASLTYAAEHITGQSPDITLMVGVDTQVVHGYVNCGARGAITGIGNVLPREVLHLVGLCEKAAAGDVRARRRAEELDAALAILSSFDEGTDLVLYYKHLMVLEGNPEYALHFNATDALSAGQRHYAETQLRLFKAWYAHWSEAGAGA

SEQ ID NO: 1978 - protein, 48 aa, Methylobacterium sp.
MSTHGDTYVRSLGPGQTVDTGDQLSSVVLLGIAVAGAAVAVLLNALIV

SEQ ID NO: 1979 - protein, 313 aa, Methylobacterium sp.
MLDDHFRTRIALLRAERDFRLAVGGYCQGMIEPAQIVWPSHKLLNQIGRYVVSFMLIHNDYAWRHHGGPRPTLTVLQAMVGSSPRQTAGFVSALKAGRFVTAVADRGDGRVKCLQAAPALVTEIARSGRLFVAAMDAVTRRDPGRAGMLDGPDRLGELVRLSAAHVLRHGTLIAPFPRVLHFAGRDCGYPLLTALVGAHYAATVPGAPAAVSLSLRSLAERLDVSRAHVGNLLGEAETAGWIRIAGGHLTAFDPALLAEFEVWAAGQMLFYDDLAAAILAEAPTAPVPAGASGHAGLACVPVDPGIPTGGTAP

SEQ ID NO: 1980 - protein, 318 aa, Methylobacterium sp.
MPVRLDARLAGDLFFFRALVEAGGFARAGDRLAVTQSAVTQRIQRLERRLGYPLLERGAREIRLTAAGHDLFAAARSGFDGIGEALLRAERRERRETLRISCIPSLASEWLAPRLRAFSDTHPDIDVAVFGETHDLDPGRMAQSGIDVAIRYGPTPPPGATVVFDHPEPVYPVCAPAYRDAASQPGGAVVLLHDATPWEAAASVSEEWDRWISVHGAPWDGGIQNLYFNLAQLALRASLGGSGIALGRSLIVAPYRADGRLVPACGEAVMNGLRYFVIVRALPPAGPAAAFVDWLGRTMAGPPGSPEAPRRGGAADRG

SEQ ID NO: 1981 - protein, 147 aa, Methylobacterium sp.
MTHQETAFVEAMVRTGDALYSATVAGYAQPASAASKALKRPDIVAAINSAVRLRVQSEGAAVAASVLVEIALDKTAPKAPRVAAARALGEMTHLGGLEGAGLDKPLSEMSRAELVEARQRAVAYLAELDAPVIEAEAVEAPAGGLFD

SEQ ID NO: 1982 - protein, 597 aa, Methylobacterium sp.
MNYQRKYSFSGYQANNPQRPLPATQIDAELDAISAAFEQTLDAYGVAKANGFQGNVIEWLASLKGEKGDKGDKGDRGPAGQKGDKGDTGSQGPQGDPGHQGVQGVQGPKGDQGEQGSAGPAGDRGPQGLQGPKGDQGVQGLQGPKGDKGDTGSQGAPGTNGKDGSQGPKGDQGAQGLQGPKGDKGDQGVHGPKGDQGEQGAKGDQGAGVVIKGSVPTPADLPASGNTPGDTYIMTTAGSGYAAGDGYAYTGSGFTNVGQIRGPQGVQGPKGDKGDQGLQGVQGEPGAQGAKGDAGAQGVQGPKGDQGEQGIQGPKGDQGIQGVQGDPGAAGPKGDTGSQGPKGDTGSKGDQGIQGPKGDQGIQGVQGPKGDKGDQGPQGPAGSLGFQPVQQGTGPGQGTNTVSVGWGTIKNAAGIDTAALLLSIDGQAQGAIWTDQLLGQSFGRKRIENLATGAHFCAAVGLGSSGLTASAGNGFQRIMLNAVEADVEGLFKTGSGQSYYLVPMSGVYNITGALRFPDNTGSFFYGFGVHTAEEDGSHMSWSFRPTNNGRYVSQYSRMAHFNKGDQVRMIFYSDAVVANLPVDRAAFQIALLSGDIV

SEQ ID NO: 1983 - protein, 261 aa, Methylobacterium sp.
MCDPLTIAGAALSAGGIAANSIGASQAAAASSRAYAAEQARQAQLRQEAAQVQQHSNSLYEGFAGKQQDRAADLASTLRSAQLPAQGSASTTVEAPASSSNITTQGEASQRANADAYAGQQATALGDLRSFGDLLGTNALAQARDASQIGQIGNFMRGSASVLPQELNAASHAGDTAKLFGGLAGGLGKVGIAAGINGSTLGGLFGGGASSGGNVSTSLPTMAASGMGSIANAYGNLPAAPMSIAQPFGAAPSFASSPYRV

SEQ ID NO: 1984 - protein, 206 aa, Methylobacterium sp.
MSKKDGGAGKQANIARMEEAQRQATIRQGTDQINSTFDSQFTPDFFNKQRDNFLAFQLPQLDGQYGDAQRQLTYNLARNGNLDSSTRGFQQGQLQKTYNTQRTTVADNANSYANSARSNVEQARNNLISTLNATGDATQAASSATNQAAILAQPQAYSPLVDAFATTTGALASQAQADRAAAIANGTYTGGSGLFGTSGGSVRVTR

SEQ ID NO: 1985 - protein, 74 aa, Methylobacterium sp.
MYDGPIPRSRYPATMIDDTDPVLEAVTALRAAGVAVDPIGDELERWQIGDLIFSDADLWRLAASRGLVEDSDSL

SEQ ID NO: 1986 - protein, 126 aa, Methylobacterium sp.
VPATAQQLDGWPGIVIALLGALAVVLVPLTGFMKEWWGYRKEVLAAEKMKPEIARDIGTASGGAVFDSIALADLAKAINGLTAAIVADTASEEAQHTSQMTAALSRFTEVMDRWEDDHGRQPRGRR

SEQ ID NO: 1987 - protein, 172 aa, Methylobacterium sp.
VQTSVQAAVRALLTTTDRSEITVPLVAAAAGVTPSTIYRRWGTLAELLADVAVERLRPDGEPADTGSGRTDLEAWAEQYADEMSSAPGREMIRDVLAAADANCAQRCCSFTRDQIAIIADRAVARGEAFPDPEAVLDGVVSPILYRILFGTALNRERILELVDRTLTAREAT

SEQ ID NO: 1988 - protein, 142 aa, Methylobacterium sp.
MTQGTEPAALPPHLAQEYAAARDNGCVGTRLLSEDDRSRVWTIVLAPGARIGFHTHVLDYFWTAVTAGRARSHYGDGRVAEVDYRAGDIQHLSFGPGESMTHDLANIGDTELIFTTVEFLDSANPPLALPAAVRAEATRRAA

SEQ ID NO: 1989 - protein, 137 aa, Methylobacterium sp.
MKRLAIALTALSSLVLFAPSSEARPHGRGFHHGPHHLGHGVWRGRRHGLHRYRHHRLHRHYRRHRGYRGYRGVHFRPAGYGYRPHAYRSGGLGGYRGVGFATGAGLGLATARPGLYGAAYGRPYGYGYAPVGYGCAY

SEQ ID NO: 1990 - protein, 99 aa, Methylobacterium sp.
VILSRWRGYSAAMAKRPMTLDLFTTLDIVDDDVSAVVDAYLADPTPGSVAFGDGFRIDPAAAVASHPFARTLIDQPWADAGLRRAAIRAAILLAEPERV

SEQ ID NO: 1991 - protein, 383 aa, Methylobacterium sp.
LIHLINMTDWLDRAEALDALGIRAQTLYAYVSRGLIEARRAPGRRHSQYRATDVAALADRRGRSRASAAIAAGAMAWGEPSVVTAISTVHRGSLIYRGRDAVAFARDASLEAAADLLWDSPEPTLFDVPANAAATPFLALAGLLQDAEAALGRGHHRLCRDARRAVAHLAASCGIPEGRAPLHQGLARLWSLDAATADRVRQALVLLADHELNASTFATRVAASTGAPIAACLMAGLSALSGPRHGGAAAAVLRLVDEADATNPREAVRACLDRAGALPGFGHPLYPDGDVRAAALGAVLPADPLLDAVRDCAVAATGARPNIDFALTALVRTAGLPRSAPFTIFLLGRSLGWAAHAMEQGRQGTLIRPRARYEGPRRSADRP

SEQ ID NO: 1992 - protein, 279 aa, Methylobacterium sp.
MLRTAIALTLLLAGAPAWAGPRWQDLPPTPAPVAGTVSGRASVNGIRLYYATIGNGPPVVLLHGGLSNSDYWGHQVAALAARRTVILVDSRGHGRSTRDDRPFGYDLMTDDVVGLLDVLKIPRADIVGWSDGAILGLDMAMRHPDRVGKVFAFGANADPSGLIEGVEKNPTFAAFIDRAGKEYEALSPTPKDYAAFVDAVGRMWGGQPRWTEADLKRIRAPVLIADGDHDEGIKRAHTEYLAATIPGAGLLILPNASHFAFLQDPALFNAALLGFLDGP

SEQ ID NO: 1993 - protein, 125 aa, Methylobacterium sp.
VHFMRMMGFVALVLSGLGLAGPASAAPLSPAPLAGDASGLTRVGYWCGPGFHLNPWGRCVPNARRFYGPGPAFYGARYYGGRRFYRTYNYRWHRNYRWHRNYHWHRNYRWHRNYHWHRSYHWRRR

SEQ ID NO: 1994 - protein, 29 aa, Methylobacterium sp.
MTLALIITGFLIVNFVMAGFFSLVALWAD

SEQ ID NO: 1995 - protein, 403 aa, Methylobacterium sp.
MAEDGIADSGRAWRRLAAATALGTVGGVGMWSVVVVLPAVQAEFGVDRAAAALPYTLTMLGFAVGGLLMGRLADRIGIVPPLVLGTVCLALGYGLSALATNLWQFALVHGVLVGALGSSVAFGPLMADVSRWFWRRRGLAVALCASGNYLAGTLWPPVVERAVHAFGWRATQAGIGLFCLVAMLPLALAMRGRPPRASATRAAGPQAVTTLSPAALQGLLVVAGTACCVAMAMPQVHIVAYCGDLGYGVDRGAQMLSLMLGFGIVSRVASGFVADRIGGLATLLAGALLQAAALALYLAFDDLTSLYVISALFGLFQGGIVPAYAIIVREYLPAEEAGARIGAVLMATLAGMALGGWLTGAIFDATGSYRAAFVNGLAWNAVNVAIVLWLIHCRRARTSPAAL

SEQ ID NO: 1996 - protein, 164 aa, Methylobacterium sp.
VRRLLHAPPLALLIGLGLAPLFILFPRLPGGPEVGPAHDPASQPFAFWVGTALLGGLAGTLDGAARPLYRAAALILGASLLSVPALRLALMSGLPFPHRLAVWLGLDGEFAMEADLYEIWLLSWLVCLGLIVVVWRGLARIIPVRPAEAAGHTETTSTGPNPCP

SEQ ID NO: 1997 - protein, 231 aa, Methylobacterium sp.
MAKFHFVEDYEAYVRQLMRDLPLDEAMSVAVGGDYDRIGAIECEILQHFGLRDGQSVVDFGCGSGRLAVHLARTASVAYLGLDVVQDLLDYAKRRCPRDYRFARNTALSLPVADGSVDLVSAFSVFTHLLHTECYIYLEEMHRALRPGGRVVASFLEFSMASHWGVFTKTVGEQRTSTVPHLNTFIERSVWQTWADHIGFDSVTFLDGTAAPWPSGVYLGQSLAVLGKAPA

SEQ ID NO: 1998 - protein, 468 aa, Methylobacterium sp.
MSEAVSPAVNAGGRLDRLPIGPFHRRIMWLIGIGMFFDGFDIYIAATVLGATLKSGFSTLPQNAWFVSATFVGMMAGSFLTGFFGDRYGRRFTYQANLLVFGLAAIGAAFAPNMTVLIVLRFIMGVGLGAENVVGYSTMTEFVPARSRGRFLGLMAVFVVTGLPAASLVGYLIIPTFGWRAMFALGGLGALAVWYARKSLPESPRWLEAVGRNAEAEALMRAIEAEAARGAPLPPAAAAAPVTQLGLAALFRPPLLSRLLLGCLCLVVINTLLYGFVTWLPTFFIRQGLSVATSFGYALLMGLGAPVGSAIGALTADRWGRKPTIIGASATAILFGILYPMTLDPVLLPLVGFGLTVPIYVLVALLFGIYIPELFPTEVRLRASGLCNTVGRGATIVTPFLVVTLFEAYGIAGVTGLMIGLLALQIVAVAAFGVEPRSQSLESLEAGVAPAEGGPAARARGTVPRPIH

SEQ ID NO: 1999 - protein, 507 aa, Methylobacterium sp.
MTLHAPEPTVETRGNFIDGREVEAGDGALIDVRNPATGAVIARIPNSGPADVDRAMRAARAAFEGREWGGMDIRARARLVNRLADAFEANLDTLYRLETTNNGRPVNETRAQLSRLPDFFRYFAGVALARRDDVIPVEGNYLNYTRRTPIGVVANCTPFNHPLMILCKSLAVVLATGCTTVVKPSEYTPLTTLKLAQIFTEAGLPPGVFNIVLGLGASTGKALAEHGDINKLVLTGGTEAGRIAGSAAAKVFAHQTMELGGKTPVMVFDDFDVERAVNYAAFGAFIGAGQTCVCGSRHLVQASIYDEFVERLAAKTAAIRLGDPFDPATQLGPVISERQRERVLAYAGYGRDQGARAVAGGRAARVPGFEGGYFVEPTVFADVTADMRIFQEEVFGPFTSVTRFEDEADALRLANDSPFGLAAAVRTRDVARAHRVAHAVKAGIVWINDHHRLDPASPWGGVGDSGLGRECGIESFNDHFDVKSVMVATGDGPFDWYRDTAGQRRLN

SEQ ID NO: 2000 - protein, 210 aa, Methylobacterium sp.
VLLRDNIYAAIRADILACILRPGAEVREQELARRYAVSRQPVREALLRLERERLVTVHARQGYQINAISVADARDLLRMRLALEPACAAEAAAGAPASVLASLDAFRAVADGADFIAENRAFHIALAEASGNRRMAATVRDLVEQADRLVRVSLDGIRGRDPAQLVDEHAAIIDAVQRRDGRGARRLVRAHVAQAERRILTALERSAIVL

SEQ ID NO: 2001 - protein, 137 aa, Methylobacterium sp.
MQDIPLGAKGSFAMLVGPSHLASQFKDNILPPVFATPMMVLIMENAALNAVRQYLDPGESAVGTKVDVTHMAATPVGHRVWAEAEVVGVAGRQIQFRVAAWDESEQIGAGTHERMIVDIERLGKRLAAKQPAPSKRA

SEQ ID NO: 2002 - protein, 154 aa, Methylobacterium sp.
MSFMRVTICAVALCLVAGLGHAQEAGQTVAGEGDWVLRKSAAPSSGDVACVLAPKARSRIQIVGDRIEITGLPKNSIFNYQYRIDDGPVSTAMFPTTQMQDAGVITLNGDVLKDILAGRRFSIRLLDRWHEAMTEEISLSGLRGLIDKRAEACR

SEQ ID NO: 2003 - protein, 80 aa, Methylobacterium sp.
MAFPDANEPSATSISALELVNTLIERKENGEPVDADILSFLTDMERLGLTDTDAYATLDAYRPGPALGATGGDDASEADA

SEQ ID NO: 2004 - protein, 96 aa, Methylobacterium sp.
MSKTILALATSFVLATSGAALAQAPQTGGANQGNVNKSGAVGGTGTGAGSMESTGSTGAGLAPGTSGGPRVSTPGAPAGSSSGNGATGSGAAPSGR

SEQ ID NO: 2005 - protein, 217 aa, Methylobacterium sp.
MGGTVATWNSDAGPSGHGIAAGRPGRPPPGGSWNLAAFERHRAAYLARARRILGCPAQAEDVVQDVLLRLIADPPPAQTAIQAAYVGRMVRNLALDRARRQGLERRLFTGLDAAPDPADPGIGTPEAAAASRESLRQVEAAVAELPEPVRTVFQLHRVEGVPQIEIAARLGVSRALVCGLVRRGHLHCLAALDRRCAACPARAEAPGRQRRRTAPVN

SEQ ID NO: 2006 - protein, 266 aa, Methylobacterium sp.
MARLQSSGFFDLGDGRLEYHFVGRQPEVAPTLVLLHEGLGSAMQWGALPETLAQTTECGVLAVSRQGYGASSPVPLPRPADYLEHEARTVLPRLLDAANFRSGVMIGHSDGASIAALALAEGDARLRGGVLMAPHFFVEEVTLSAIRRTRAAYERGLLRTRLGRWHTDVEGAFRGWNDAWLDPARRGWTIEAALTRLTVPVTLIQGTEDAYGTQAQIAAARRSCPPSLLTVREMPGVGHEPHREAFADTVALISAFVEYVLKDEPG

SEQ ID NO: 2007 - protein, 449 aa, Methylobacterium sp.
MQTAATFASDPPALARPTGRQTATAAMASLFGWGLDLFDLFILLYVAPVVGTLFFPADKPMLSLAGAYASFAVTLLIRPLGSALFGSYADRFGRRRALMVAVIGVGLSTAVFGLLPTVGQIGWLATAIFLFFRLVQGVFVGGVVAASHTIGTESVPERWRGLMSGAVGSGGSAIGGLLASLVFYLVSLMAPGEAFADWGWRVMFFSGLLTSVIGLILFRNLEESPIFKELQARKAALREGAPTKASPIRSLFSPSNRGSFAVATLISFGGGAAYYLTSGYLPTLLKLVNGVPNATASMILIGANVAAAIGACGMGELSQHIGRKRSFLLMGVIRLFAFPVLFLTMANTTSLMGVAACAFLLSLIANASYAPLLIFLNEKFPTAVRATGTGLTWNIGFALGGMLPTFVSLIADGPTQIPMVLTVVMTCVTLVYLVGAVITPETQGNLDRA

SEQ ID NO: 2008 - protein, 268 aa, Methylobacterium sp.
MTSDTHTIDPRLTNLDGFRVEIDSERERADVILARPPMNVIAMPQRDEIRKVFEALDEDPRVRVIVLRAEGEHFSSGGYIKGFLDASPEHVSKLAWNMAAPARCSKPVIAANRGYTFGVGFEISLACDFRIVSETCRYALPEQKLGQIPGSGGSARLQKIVGITRTKDIVMRSKRIPGRQALDWGIATECVADADLEKATDALVDELRAFSPIAQRTAKKLLNDTEDASLSIAIELEGHCYSRLRQADDFREGVEAFHAKRAPRFTGS

SEQ ID NO: 2009 - protein, 519 aa, Methylobacterium sp.
MLDLGTSFLASVSRDPWALALVDGETRLTYAEWFGVISATVAGLDRLGLKPGDHLVTVLQNRHEAATLHWACQFSGVVITPINWRAKAEEIDFAIENAEARAIAYEPVSAASLRESAASQLIPRIAVGTPPGPGETAFADLAATEEPSATPRADAEAISLMLYTSGTTAKPKGVPRRHRAERAAAVAHVAQNLYGRGERTLGVMPLYHTMGVRSLLAMSLIGGTFVCLPRFDVAGALRLIAAERITNLYLVPTLYHDLVHHRDFQATNTTSVRKLGFAGAPMTDGLLARLTEAFRPDLFVNHYGSSEVYTFTINHEAAVKPGSAGRAGLNTMVRVVSLGGDPSRTAAPGEEGEIAVIAKGDEAFEGYWHRPEADAKAFRDGWYFTGDTGFADADGDLYVTGRVDDMIITGGENVSPVEIESRLSLHPAVSEVAVVGLPDERWGRIVAAFIKRSGSTDAAALDAHCRAGGLPSHKLPRRYVFVDEIPKSPVGKLLRRQLVAGEYVLEGGAEPHAEGHEAA

SEQ ID NO: 2010 - protein, 177 aa, Methylobacterium sp.
MPQLDAQDRHTVAFTLNGRETAVEVETRTLLTDALRHGLGATGTHVGCEHGVCGACTVSIDGVPARACLTLAVGVEGCAVRTVEGLAPEPGRLGVLQVAFRRRHALQCGFCTAGILMSLDAYLALRPNPSRREITEVIGGHLCRCTGYAPIIEAALEAAAELRGDIPAPSSPEAAHA

SEQ ID NO: 2011 - protein, 285 aa, Methylobacterium sp.
MSEALEIAHGTFGRVALLDMDRSLVRHAHPHCHVLLKVEGDDTEFLVGDRVVALTDEQAVLVNAWETHAYLHDPRRAKAMILALYIEPDWLGAFRRNWAASGAPGFFGKPLGGVTPTIRRFAHDLAAEMVYAPHSSHIQDQLLSGLMIAVIERFTAWREEAESLRAAARRNASDWRIRRTIARVRAEPGATLGIEALAREAGLSRAQFYRLFEQSTGAPPHVFLNAIRIEQAVESIVGSEESLAAIGTRLGFAAPAHFSRFFRDHVSVPPSVFRSIVRRSGQPAV

SEQ ID NO: 2012 - protein, 234 aa, Methylobacterium sp.
MAFNTELDSALEAAFAEARALYKERGFQRRVGFGRRPALINVDLANAWTRPGNPFTCENIDEQIIPGVQALLAACRRNNHPVVHVTTCYQVTDVDSPKTDMGLWHRKIPVEVVDQNKPELWAIDSRIEPVPGEQVLVKKRASAFHGTYLAGFLRANNVDTILVTGVTASACVRTTLCDGLAEGFRTIAVRECIGDRVPGAVAWNLFDIDAKFADVEPLERCVAYLDEVGLRNAA

SEQ ID NO: 2013 - protein, 350 aa, Methylobacterium sp.
LSLDRFSPTRRQALLGGAAAILTAGAGREARAAAGTVVVSNWGGDWNQRTVRFVETPLVEAQGLTVVRDLGMEPERKAKLLAERRLRRGSIDVIHLNDSDGFEMMKQDVLADLDRSRIPNYGDVVPALRKDYFVPWLYSGVVLIYNKDKIKDPPKSYAELWDKRWAGRLGLTNQLYFNYMMMSGLIQGGNLTSVETGRERLVALKELVQPRLYAAHQQLGAALATGEVDIALNYKARGLQWIGEGSPLAIQYPKEGAIAITFGAGMPKRAPNPDGAYVYLNAMLDRKAMAELAAASFYAPANGAAELSPELRARIDFSPEEREHLNFPDYAYVSKNTAEWLEWWNKTMAR

SEQ ID NO: 2014 - protein, 385 aa, Methylobacterium sp.
MSANTYDVIVLGVGGMGSAACWHLARRGVRVLGLERFDIPHAMGSSHGFNRIIRLAYFEDPSYVPLLRRAYENWRELEGRFGEQLLFITGSIDAGPEGSAMVEGSLAACRMHDLPHRLLDGAELRRVAPGYNLPDTHRAVLQPDGGFVSAERAIVAHVTQAQAAGAEIRAREPALSWEPTASGVRVRTERGTYEAGHLILSAGSWMGEFVPQLKTVAVPERQVLGWFQPREPALFAPDRFPVFNMEVEEGKFYGFPVWHVPGFKIGRWHHLGETGGADTLSRECEAEDEAVLRPCVSRYFPQANGPTMAMRACFFTNTPDEHFVIDTLPDLPQVVVASPCSGHGYKFCSVVGEVLADLALGRKPGFDLSLHALNRFAPRSYASTD

SEQ ID NO: 2015 - protein, 316 aa, Methylobacterium sp.
MRPFSYERAASAEAAVAAVAARPGARFIAGGTNLLDLMKFQIEAPAHLVDIRHLPLKAIEDLPDGGLRIGALATNTEVAAHPRVKRDYGVLARAIVAGATGQLRNKATTAGNLLQRNRCPYFYETSLPCNKRQPGSGCSALGGVTRSLAVVGTSAHCIAQNPGDMAVALRILDATVETVRPDGSQRRIAIGDFHLLPDDRPEIEHPLEPGELVTAVTLPRPPGGAHHYHKVRDRASYAFAIVSVAVILHKDGTGRVAFGGVAPRPWRLENAEALLPSGPAAVITAAFQSATPTAGNAFKIPLAERALALVLSEGRV

SEQ ID NO: 2016 - protein, 915 aa, Methylobacterium sp.
MEILTALVERAGQVVSKADLHKRAWPRTTVDESNLKVNIAAIRRAFEGAAPGKRFIATVSGQGYRFVAPVDVMSWPISAAARRHNLPRATDLLGRSEDLAAIATKVLQRPLVTITGPGGVGKTSLAVTVGHALVEQFPDGVWMVDLCVIDSDRYLASAFAQEMRIAIHADDPQAALATALADRQCLLVLDCCENALDQAARLATMLATAAPGTHVLATSREPLRMAHETVHRLRPLPAPTALGIPNAKDVLTFPAVALFVARASAAAPDFRFEDDDAWAVVEICRRLDGLPLALELAATRVGAFGLRGLLRLLNERLDLLDDGRRAGHPRQRGLTATLDWSYGLLSQVEQALFRRLSVFHGVFPLDAALAVGLSAGEAERACIGHLADLVAKSLVVATPGWLARYQLLDTTRAYGLQRLAESGEDDAVRRRHAEFCVAQCRDVSARRSARAASDPREELVALVHNVRAALDWCLTDRRDPVLGRTLAAEALVVWDTLALLQERIEASEWALASAAPADGPEDRYEITLRASLAAALLQVEGPTARIAELWSGALARAERLSDGDGQLRALWGLCDFQTWVGDHSASFALTERIRTLAAASGDRAAGAAVDRPAATALRYLGRLDEAREAAERLLARAARRDSPGRRLEDHGLVAARGTLANVLWLQGRANHAVASARRALVEAEASGQAFALTNALAHTVIPIALHGGDLDEAERGLDRLGDHVARHAMRIWQVIADCLEAIVSLRRGDAGGLHRLEDALVEMGEIGFRMRRPAYLGSLASGLAAHGRLPDALARIDDALAASECGGELWCQPELLRIKGVILLASTGIAGEPDAARHFLQAIDLAGSQGAAMWRLRAATSLAALDDRFGGQEALAATLGDFDEGLDTPDLRAARARRAGRGGLGRDAGRPVSLA

SEQ ID NO: 2017 - protein, 360 aa, Methylobacterium sp.
MAQTVSWGVLGTGVIAQRFVSDLLGRPDARLAAVGARSHGSAQAFAAAFSQASGAPAAVAGVEALAARPDIDIVYIATPNSDHMDSALACIEAGKSVLIEKPIALSGGQARRIAEAARREGVFCMEAMWMRFTPGVVRAKAMLEAGEIGDPLHLDARLFFPRAPNAPGRTDDPAEGGVILDLGVYPVSLALHLFGAPTQVSGVGLDRGGAAARQAALALGWNARTATLSCGSTGEADNAAVIVGTRGRIHLHRQFLCPPFLTRVRTAAAPAPADRAPPRRQAVGRLAFAKRLLQPLDFRRVALIPTPYLGFGLRHQIDEVHRCLLAGARESPIMPLADSIRTLDILDRVRARPQPLEAVA

SEQ ID NO: 2018 - protein, 409 aa, Methylobacterium sp.
LPIGTSAPAASLLADRVAVFLLGAALNFNVLTSTFGLPFQRLSDLLPFLLIPWLGLRRAVVAEAVRQAAPLAGILALIAASLVLKAHKQAGDVYLTLVLLLYVVQAFILLVMFRDRRFEDAFCVGLLAGMLASLAVLLLAASGTPLDRFGLAVPTDGLDEELKLFVQDKQGGLWASGNETGHVFALAGAAALLLSLRYRIKIIYLAYFAALLASFPFTNNRAGLFMPVLFLGLLMRRNLKAPAVLAALGVLGVLLVAWAVTGEIPLPGTLSQAIERRFAEDHNVTGNFDERFLSGVTALQLVVEYPFGVGEVARREELQALTGLVTPHNGFVSLALQSGIATALLLIAGLGRVLLAPAAFGPFLTYSAVFLIPSLMFEELSVNQYFLFFMGFILASLALPPDRAQSETR

SEQ ID NO: 2019 - protein, 445 aa, Methylobacterium sp.
MMTPTLSSNYARVLAEEPRAQGQDRPREQAAARAVTGPLRILHLSALYPPYIVGGAERSVEHLAEELVTAGHTVAAACIAREPEPKSVRGGVTVYRMAHHNDFWLEDWPQASRFGRAWAKVKQQWNFAVAAEFGRVLDDFRPDIVNTHSLLDVSTLVWREAAKRGIPIVHTVCEYDLICGNAAMFRDGKPCDRWHLGCKVVNAAKQITNRSVDAVVSVGTEILKTHVDHGLFAHLAPERRRVIFYSCTVPEGDPEARRRIDRTGQPMTFGYLGRINTEKGVGTMIDAFRRLGPGDWRCLVAGHAMDDSIERFKAQAEGLPIDFVGWAKPAEFLSAIDVLIVPSFWAEPSPRTIYEAYTMGVPVIGAASGGIPELIGEDNADWLFTPGDDADLAARLRSVIDRGRGDLPDERAFQHVIRESTSERVAEKYLDLYAELVAERRASRP

SEQ ID NO: 2020 - protein, 418 aa, Methylobacterium sp.
MRILHLSSLYAPEQVGGAELMVETLARTQADLGHSVAVACAARTEGGPVLQDGVTVYRTGYGTPFHILDWPQRGRADRLRYKLAAQWNRHALDRMAGAVRDFGPDLVNTHSLSELPPALWPMLRRIGVPIVHTLHDFTSLCTNGAMVRHGHPCAQQHLKCRLYAAPHRRCQRAVTAVTAVGTDILDRHLAAGLFTQVPPSLRRVIWNPIPSGSPVARGKRAPGAPIRFGYLGRIEGAKGFDVLLDACRRLPGSGWSLAVAGRAVDGLDSYRGLAEGLPVTFLGYAERDAFLDDLDCLVVPPTWPEPFGRTVAEAYGRGVPVIGTATGGISEQVGPGPWLVPPGDAPALAAAMARIVAEPARLAEGLARSARIRAGTDPLAVATAYLDLYAATRDAARTEPLPELSARAERPHLSECRS

SEQ ID NO: 2021 - protein, 731 aa, Methylobacterium sp.
MSFLTVDLADRTPVRALAQEPARGGPLAAALARIWHRRYLFAAVFATVLGLAVTALLMIQRQYVASGSVIVAEAEPGANNASMAWIQKIGDPADIESQILVIRSPRLLRLAIDDNLVAAVLAECRYAATGGHPDRISEKKEAACTKLTTDRNALVEYLQKRYTVLSSGRSRIITIGYKSPLPETAQTMANGLINAFLDDQREAQASSRKAAADWLHTEISQLDASIRADETRIQTFRRRKGLLKGSLAPISAERLTSISQQLAAAETAKADAAARLSEIEAKGARGADSAPAVLASPTIVSLKQQLSGVSAQLANQSTLLGANHPVIRALETEQASLRARIEQEIGNVARGLRKSYEASNALAKSLRAQLETAKTDAAAAMDDEASIEGMVRNAEIKRTRYADLVKRAGELETERRILTGSTRLVSLAELPQEPFSPKAVPLLAGGIVLAGVLAAAAALLRDFTDRRVRTSAQLIAGTGAPVFAQLPSLEPAGLVGRFSERQRELDLAEALARARVDPVMQNVLRNLHAHLVLAGAGKSRVILVTSAKPREGKSFTAFALAGIGAASGRRVLVVECDLRRPNFEASLGLGRGPGLGGVLRGEIDPAEAVVQAGRFDVIPAGTPTADSTELLMGDRMADFLKWSRRYDLVLLDTPPTSLLMDAAMLARHVDGVLCCARYGRSQLSDTVETVANLRRAGGHVLGIAMTMVRPGIQSTYDVMPLPDPRTAASAR

SEQ ID NO: 2022 - protein, 241 aa, Methylobacterium sp.
VTRLTRRSALALAAGALAAGRAAAAEPLHRCEALIDSIGVNVHLGHRGTPYVDRFAACARALDELGIRHLRDDIVLVGDEPAGQFERIADLADRGYRFSLIFYDGLTPGPRVPPERFAEIARWAGDGLIVAEGGNEPPVAARPGLARLSADHQAALFRAVRADARAEAVRVAGPSYIQGNVAAAQDLAAVVDLANIHAYPGAEHPETDGGGSLARFVTAARPVFGDAPVIATENGYHTALA

SEQ ID NO: 2023 - protein, 44 aa, Methylobacterium sp.
VVEIRMSEDNDGRWTVYAPGLVVTDLTHEEAQAFAASYRRVTAA

SEQ ID NO: 2024 - protein, 328 aa, Methylobacterium sp.
MSCDTLSNLFSTLSVQVHAFAFCEIQAGWQLAKNGMPDAILVHYVLSGCGTIAVEGQEPLRFGPNCIIIPPRGMQHAIGFAGATRAVTADDARRVLPDGLIALTAGDGSRDILLACGSISARYAGALGLFDRLHDALVEDLSGSDRLRHAFAFMVEELVQPSFGTQEVTSALMKQCLAILLRVHLKEKGAQSPIFEALRDPRLVPAIAAILDAPGAPHTVDSLAALCAMSRSGFAERFSAIFDEGPIEYLQRARLQRAARLLTASPMPVKVIAESVGYASRSYFSHAFKAAYGCDPSAYRTRATRMVQALEPLPTRGAGVAGPDPGEA

SEQ ID NO: 2025 - protein, 130 aa, Methylobacterium sp.
MAGRAADRFPQPVRVGDLPGRFLLQPEESQPVLGRVTGLVRRADGGTAVIVRLDGALGLTWLGLRPVAWSGIGPRLVAVPVEAVALLGEHVALMGLTPERLHALPTFATGSATAIPPDETLRVGIVRPFH

SEQ ID NO: 2026 - protein, 371 aa, Methylobacterium sp.
LAAYLDRWSGCAHHALAASDSEPLTLTALLHFAGPEDRRRWREADLGYADPRGADWLRATVAARYRRLEADDVLISAGAQEAVTSVLSALLGPADHAVVVVPIYQPSELVVTRLCAADGVALRPDRNWPLDLDRLAAAIRPNTRLVLINFPNSPTGAALDRATLDGLIDLCRRHGLWLVSDEVYRQTDRDPERAVPPVVDLYERGISINGLSKGFGLPGLRVGWAACRDRGTLDRILAAKNLLSSCLARPSEILAQVALQAEPHLTRRARGIGQRNLHRLRALLDRHPDLFDPDEPRNLAFACPRFRGREGATAFARTLASEDGVLVLPSVLWHSGLASIPTDRLRLGLGRVGSGAALGILAVHLLRRAGR

SEQ ID NO: 2027 - protein, 530 aa, Methylobacterium sp.
MADVLIVGAGPVGLTLACELARHGARCRIIDGAARPSPYCRAIGVTPRTLEVWEDMGLARDMIDAGLWLTGLRTILHGQPPVDAVSAPLDLPYASLGLPQFETERVLNRHLERFGVRVERGLRLTVLEQDAAGIRAHLQEANGAVAEAHFRYVVGCDGAHSTVRRLLGIAFEGEAYPWPFMLGDVHIAWDVPYGLAVRALRLNEDAPPDMFIAIPLPEPGRYRVSMLAPQHLVPAGGSDHGIQVELQGPSLADLQAVADDLLPDGSRLSDLRWSSVYRISMRLAAAYRRGRCFLAGDAAHIHPPTGGQGMNTGIQDAYNLAWKLALVLRGTSPEALLDSYEGERRPVGADVIARTRTASEGYGRERGGAPDRLADTQVLVSYRNTAWIADDATEPTEAGPRAGDRAPDVNGLVRDGLGFPTRLFDALRGTEHVLLIHAAGMSDAVAGPDLPIWARQHRPRVRVVVIGGDAAIPGVTTLADPTGAFDRAYGAGTMAWLIRPDGHLAWRGRTWREPGLHAHLRRQFPSAFPQ

SEQ ID NO: 2028 - protein, 564 aa, Methylobacterium sp.
MSDRAVSYVHGAIGEPLLGLTIGQALDRAAAAWPDHLALIAHAQGVRWTWRELKDQADAFAAGLLALGLRPGDRIGIWSLNRAEWVLTQFAAARAGLILVTINPAYRLSELEFALNNVGCTALVTATAFKTSDYLGMLNTLAPELAASGPGRLSAARLPHLRTVIQIGGPPAPGTVPFDAVAARGDAAGTGALRDLADAMQFDDAANIQFTSGTTGAPKGVTLTHHNILNNGHFVGRAMRLTAEDRICIPVPLYHCFGMVMGNLAALTHGCAMVFPGEGFDPRATLETVQAERCTALYGVPTMFIAELDHPEFAQFDLRSLRTGIMAGAPCPIAVMRRVVEQMNMRDVTIAYGMTETSPVSFQSSSDDPLERRVTTVGRIHPHLEVKIVDPEGRVTPRGARGELCTRGYSVMLGYWGDAARTAEVLDDAGWMHTGDLATLDAEGYCNIVGRIKDMVIRGGENIYPREIEEFLFRHPQIQDVQVFGVSDPKYGEELCAWIRLRDGETLSEPAVRAFCAGQIAHQKIPKYIQFVDAFPMTVSGKIQKFVMRRCVEEQLGLARSETA

SEQ ID NO: 2029 - protein, 1292 aa, Methylobacterium sp.
MLDMDRIGSRKGGLSVFGKATPCPAPCVAALAVAVIGLLAALGAAQWTRAWNGRVTAERFQVAAGRLASVIDGRMARYEYGLRGARGSVLSAGEAGITREGFRRYADSRDLGREFPGARGFGFIRRVPAAGEAAFLAGARRDGAPDMRIRQLQPHDGERWVIQYVEPMARNREAVGLDVASEDHRRGAALRAMETGAATLTAPVTLVQATGMKERGFLLFLPVLRDGAPAATPDERRAATFGWTYAPLIIDEVLAGVDLDADELDVAIRDVEPEGTTRFYAGRDATEVPPGGLAMTRRLSIFGRTWDVDVTARAAFLAGLNLVRPATVAAVVVTGALLLAGLVYLRLTGRRREVLAAVEKARLAAIVENADDAIVGKTVEGVVTDWNPGAERLFGFSPGEVIGRPAEDLVVPAHLRAQERDVLLRISHGDAVAPFATLRTRKDGTVFPVLVTASPIRGPNGAVAGVATVIRDITEQAAAEEHIRTVNASLERQVAERTAALQAGSALQRAVLDHAGYAVIATDMCGTITLFNPAAERMLGYAAEELVGKATPGVFHDPAEVERRAGVLSRELGRPVEPGFEVFVAKARRGQPDPGEWTYVTKGGERLPVLLNVTLLRAGDGTDLGFLGIAIDLSERYRHEAEMKAAQAGTWNYEVATGRVRFSAECARQHGLPERETEIDVEAEWKRLAHPDDVPHVLADLAQAIEAGGSYTTEFRVPLADGGMRWITAVGRVEADASGMTSRVIGLTLDTTARKAAEIALSEAKAVAEAARAEAERANRAKTDFLASMSHEIRTPLNAVIGFTDLMLASGRLDPGNRRQAELVRSSGNALLTVVNDILDFSKVEAGAIELVEAPFPLLAMVDNCVSIVRGPADAKGLEFRLRMDPDLPRWLKGDEHRLRQVLFNLLNNAVKFTASGSITLDVAPQGRISGGERVRFRVVDTGIGIPKDKQNRLFQRFSQVDGSIQRDFGGTGLGLAICRHLVELMGGEIGVSSVEGGGSTFWFIVSMPRASAPAEAPSPALPAAPRRTGRLLLVDDSLINQELARAVLIGAGHVVETVGDGQAAVDAVRDRAFDLVLMDVQMPGMDGMTATRLIRELPGPVSRLPVVAMTANVLPEQVSAFRDAGMDDHVGKPFDRDHLYATVDRWLARSGTDDVIPLPESASPEFDEDAWSAVRRYLSPGRPREVLALLVGELDTSFEGDAADQAVRVRLRLRAHSLSSASGMIGFTEMATACHALERFDEARVASEGVAAFAKALDRVRGLADRCARKAERMLEDMEGSPGLRTVCGRG

SEQ ID NO: 2030 - protein, 412 aa, Methylobacterium sp.
MPLQPHETAFTQAPAPPRPVPVLPDAAAALAVADRLAEAFAEAAAERDLERRLPVAEIARFTESGLWAITVPREYGGPGLDSATVAQVIARIAAADGSLGQIPQNHFYALEVLRNGGTEAQKRALYGRVLAGERFGNALAETGARDHTRRTRLVRDPAGWTVEGRKDYCTGSLYAHRIPTLANAEEDGRAVAYLVFVPRDAPGVTLVDDWDGFGQRLTGSGSVLFERVAVEPDWVVPFQASLERPTAIGPFAQILHAGIDLGIGAGAFAATLPFVRDRARPWIDSGVARASEDPLTLHALGDVQVRLAAADALLARAGRYVDAAQEAPDADSVAAASVAVAEARAASHRAGLLAANKLVELGGTSATDRAEALDRYWRDVRTHTLHDPVRWKYHWIGAYHLDGRQPPRHGAL

SEQ ID NO: 2031 - protein, 374 aa, Methylobacterium sp.
MTVRTAVPDRSGTAPTGSRRASAWTGAAGTLIPGLLLCLGITAVAQALQAGEEHLTGHPYVEALVLAILLGTAVRTAWVPGARFKAGIAFSAKQVLEVAVTLLGAAVSLGAIVASGPALLAGIVGAVALTILASCALCRALGLPVRMALLIACGNAICGNSAIAAVAPVIGADSRDVAAAIAFTAVLGVLMVLGLPLFVPLVGFSEHQYGVLAGLTVYAVPQVLAATVPVGPLATQVGTLVKLVRVLMLGPVVLALSLLAPRLPAAGATARPAAGSAPGSARRRPGFFKLVPWFILGFLALASLRSLGLIPDAWVAPISRLAGFLTIVSMAALGLGVDVRVLAQVGGRVTMAVTASLLVLLAIAVLLIRGLGIG

SEQ ID NO: 2032 - protein, 195 aa, Methylobacterium sp.
LQDASATPEIQAVDAPIAADEPAQAPDHSPDHSAEAAPTGAETVDAAMTGAAPGGASEIAAETAPDGAVDVPSDQGAAAAATTSEAEFEAESGPDTVIDIAPPPVPGAGPGLAATANRISFTPDRLDVVEIGSIIARYVRGEGEAAVAHLRALSGARSPADVIRLQVGEVQRAADASLTCWVTVVGQASRVVAYR

SEQ ID NO: 2033 - protein, 200 aa, Methylobacterium sp.
MSAQHYLPKLRALRIPADARNSEGTVAWCDWCETVHSHSAGGGPRVAHCHRKESPFTAFGYDLAPVGWAPDAGAAVPAGLLVGRRRLSDTLDAAIPGLRTAFERCVVGRKRIGLARISVFGRQWSIEADVTKGEPASGWTTGVGLLGLLSALYGVRRGVAGVRLLEAITGEEFDASARLTIAKAIDASAARAAGSPGARA

SEQ ID NO: 2034 - protein, 191 aa, Methylobacterium sp.
LAFCWAHVRRRFYELAKAGPAPIATEVLARIAELYRIEGEIRGRSPDERRAVRQDRSRPVVAALEPWLTTKLGLISQKSKLAEAIRYALSRWAGLSLFLDDGRVEIDNNTVERAIRPLALTRKNALFAGSDGGTGHWAVVASLVETCKLNGVEPQAYLTDVITRIVAGHPQSNIDDLLPWAYAPQPLRVVA

SEQ ID NO: 2035 - protein, 656 aa, Methylobacterium sp.
MARPDLRALTDDGLIQLANAGLVKRALREVAAGQGPELAEAGDGTVEARFADGTITRLGPGRPPGEASCTCPASGMCRHRVALVVAYRAAPVADGLADGAAEGAAVPAAAPVAWDPGTLDGAALEAGLGGAAAAELRRLLAGGITVGLERGAVPAARLPTATVRFLVPDAVGYARCDCAAGGGCAHVALAIRAFRESAGAAEIRLGGAAPAGAEAKPVGTAETDLAEAADRVVAGLLEAGVVSGPEAHDAALVRLRRAAERRGATQLLLAEADLDGQVAAYAGRHAAYDAAVVLALATELLGRVRGGEAALGLGQPYETAMGKTRLVSLGARLLARGRGATARVALADTDTGALLALERAFAPGEAEADIAAGLPGRLLSPGLSVSGTGQGQILTSVARRRADGLLALGQGTRGRTALLPRDALVALPAPLAARDVPSILRRLADRPPVFLRPRDRLEAFHVFPVEAVLGQAWAPGAQTWQAAVALPGAGGTLHLARAYDPAAPHALDALAGACAGRWGPVRQVAGPVRIEDGTLVCDPWSVSVDRLVVPDLAAPDDAGHPIQPAPDLGPATLLDEAAALLANALHAGRRAFAASARAGGADLVARLAATGYPATAARLSAFLSATLAAPGAQSEPFARAALWVAAMRDDPGPEEA

SEQ ID NO: 2036 - protein, 118 aa, Methylobacterium sp.
MAVRRIVTNIRATEVEAARSFYADVLGLEVVMDHGWILTFAAPGISATPQISVASAGGSGTPVPDISVEVDDLADVLARVRRAGLPVLYGPAREPWGVERFYVRDPFDRLVNIVAHLA

SEQ ID NO: 2037 - protein, 344 aa, Methylobacterium sp.
VPGTTLLALLIHLDGSGAVTFLITIPAMLPLYDRVGIDRRVLACAASMAAGVNFLPWTGPMIRASAALKLPIPEIFSPLVPVQAVGLVFIFAASYWLGLREERRLALVPGAAGSAGSAPGPATTARTLSDAERALRRPDRFWINIVLTAAVLGTMVFLAEKVPPALMFMLGTALALVINYPQVDAQRQRVDAHARAAILMASILLAAGVFTGIMQGTGMLRAMAQTAVTFVPPEMGRHIPFGLGLVSMPLSMLFDPDSFYFGVLPVVAEVAHQLGVPPVQVAQGALLGQMTTGFPVSPLTPATFLVCGLTGIDLADHQRFTFPFLLAASVVMTLACVVLGVFPI

SEQ ID NO: 2038 - protein, 445 aa, Methylobacterium sp.
MRTVRLGAGAGYAGDRIEPAVELAERGDLDYLVFECLAERTIALAQQAKLRDPEGGYDPLLEARLRAVLGPCRARGIRIVTNMGAANPVAAARKAGALARELGLAGLRIAAVTGDDLLDAVRAGDFVLEESGEPVASLGNRVVSANAYLGAAPIVAALADGADVVITGRVGDPALFLAPLVHAFGWAMDDWERLGRGTLAGHLLECAGQITGGYFADPGCKDVPDLARLGFPIGIVAEDGTVEITKVAGSGGRISLATCKEQLLYEVHDPARYIQPDVVGDFSDVEMEQVGPDRVRLRGATGAPATGLLKVSVGYVDSYIGEGQISYAGPGALARGRLALSVVRERLALTGVATTELRCDLIGVDALHGAALSGGREPYEVRLRVAGRTETHAEAVRIGNEVETLYTNGPAGGGGAWKSAREVVAVQSVLVPAALARPRVHVVEA

SEQ ID NO: 2039 - protein, 114 aa, Methylobacterium sp.
MKLRALAHARTGDKGNTSNIALIAYDAADYEHLAAHVTAERVRAHFRGIVTGDVTRYALPKLGALNFVLTGALGGGVTRSLALDAHGKGLGAALLDLDIPDRSAGRAARGSPRR

SEQ ID NO: 2040 - protein, 139 aa, Methylobacterium sp.
MLFHMVSGGPQPVAPFSHAVEVDGFVFVTGQMPDTPDRPGVLPDGIEAQTRNVMANLATVLAGLGLGLENVVVARAFLTEFKRDYAAFNATYKSYFPSDRLPARTCVGTTGLAYDALVEIDLIAHRGGATSPSSAARSG

SEQ ID NO: 2041 - protein, 86 aa, Methylobacterium sp.
GAATGTVGGILGVDDRPRFRSYVRDRGVRSYSWGGPVRVGTVLPEDSVTYYDVPTEYRVRPGYRYTIVNDQPVLVDRGHRIVEVID

SEQ ID NO: 2042 - protein, 52 aa, Methylobacterium sp.
MRIIGARVMAVAVMLLVMAVWRGLEQLGVASVVEGCLVAAIAATAATALARW

SEQ ID NO: 2043 - protein, 301 aa, Methylobacterium sp.
VTRLQAATLATAFASALAATLLAPSSARAIDCRKAASPLERMICADPALRKADAALGAAYSGLLHSTDDAEIRAMLVASQKRWVAARDTWLGDLDAADARAVVLKAIRARTEDLSGRSKSDPARPHWIAAALRQRAFAARFTGGPFAGFDTACYFLPVGQDRVYGCFGSRRYQNGDRVCTLSDDWASGHTSETRTVARVVDGAARTVATCTIGGSDDAECPGPDNADGRWARPAAPAAAGAAAPAGPRPVLDVELAPDADAETWLSTCLTDPAYPPPDPVPAARTAPGSSPPAPAGAPSSR

SEQ ID NO: 2044 - protein, 409 aa, Methylobacterium sp.
MRAAAPETPCLAFLEALPVAERWQRARDWIARAPQPFFAQLRARRTALDCGAAILVAGRAEVEEILSLPQVFSVALYKPKMGEFMLALDGTEVNYRDKAVMRAVLSWRDLPAIRDLAGAETDAALDAGLDQGGGSIDVVASVSRRVPLRIVQRFFGFAAPDADLLRWSYANQFDQFNNLPFDERPDADAIHAAADLARQEMRAAFARIIPARVAAIEAGADLPDDVLTRLLRLHLPAATGFGMDRVVINVGGLLIGAIETTSEAVVHALAELLGRPQILAAARAAARTGPAAFDGYVWEALRFAPIVAFMFRQAETDHVLGRGSPAESGIAKGRVVLPLSLSAMFDATGVPDPDRFDPARPEQTYLHFGRGHHECLGRYVAGAMVPEIVRRILLRDAVRAEGAVEDGVP

SEQ ID NO: 2045 - protein, 32 aa, Methylobacterium sp.
QTAAGTRQVEAASANLTELAQALMALAERYRH

SEQ ID NO: 2046 - protein, 32 aa, Methylobacterium sp.; identical to SEQ ID NO: 2045

SEQ ID NO: 2047 - protein, 90 aa, Methylobacterium sp.
VLGQSRTEFVQIDAGLRLVEGDDQVGSRLDLVRALIAAHRLGRDVALTGETLTPPTGARQADPKAFGSFVPGGAGRDGTDHALTQIDGQG

SEQ ID NO: 2048 - protein, 88 aa, Methylobacterium sp.
MAKERPTLTSLSDRLARKVSTPAVEPVGPVLEAQPKTSKADERVQIIVRMTPAERKALRRIALDQDTTAQALAEEAIRDVLRRHGAFE

SEQ ID NO: 2049 - protein, 125 aa, Methylobacterium sp.
MKLAMLACLAALCLTGPIAHAAPGETTRPAPAANGTHPPETAAPHPATAPAPGAAPAQAAPRAANSARAERRRRSYAACNRASHQRGLRGGKRRRFLIRCRLGYERTRVPGGQPAAAAPAQPGRK

SEQ ID NO: 2050 - protein, 52 aa, Methylobacterium sp.
MQDERKTAAFQVRMRPSVKAAAEKAAAEESRSLASLMEYLLIEHLKAKGYLK

SEQ ID NO: 2051 - protein, 71 aa, Methylobacterium sp.
VTFLMAYIAQTGGTLMRIRYLLPLVGLLALTACKDEKKAEAPPPPPPPASTAPANPAPPATTTNPAPANKP

SEQ ID NO: 2052 - protein, 56 aa, Methylobacterium sp.
MRIRYLLPLVGLLALTACKDEKKAEAPPPPPPPASTAPANPAPPATTTNPAPANKP

SEQ ID NO: 2053 - protein, 456 aa, Methylobacterium sp.
MASFQDFQDGYERTWASLQIRPEKLATVRKLAQQLAAGKPRYQEIEARTGVPWWFIGLCHYRESTFDFDTYLGNGQKLGRRTTIVPKGRGPFTGPQAFVEGAVDALRLQGLVGLGDWSVARALYRLEGFNGYGYHGRGVNSPYLWGGSTAYGPPGARGGKFVRDHVFDPNVVDTQIGTAVILRSLIDLDATVALAAPRAVEAAVSREPDDELADSTLWVQQSLNRLGATPPLVEDGRNGPQTMTAVATFQAQCGLDDTGLADARTIAAIQEALRPAAPDHAVLTRIQDLERQLAARAVTTMQPAPMQPASMPPVVIAPATPAPAAPLADVAARLDELLQALRRQIDGARLPTAPILPSPPTARPDGAVLGPVNGALGQTIGQLLSGRKSAIGIIGAVATQILSQVPLNTGLGQVLAQLTPAFGLSPYTMPIFIGLTAWGALGKFEKWNARAGQATP

SEQ ID NO: 2054 - protein, 456 aa, Methylobacterium sp.; identical to SEQ ID NO: 2053

SEQ ID NO: 2055 - protein, 81 aa, Methylobacterium sp.
MFEQMVEAPRTVRRLEVITTASGRRRWSQAERRRILAEAMAPGAVVLVVARRYGMSPQHLFTWLREARQWKGSCLRTGSPR

SEQ ID NO: 2056 - protein, 49 aa, Methylobacterium sp.
VRAEAAAANETETPREKLGQMEDKARSGTDLGEAIDRATAAVGQDDGKR

SEQ ID NO: 2057 - protein, 149 aa, Methylobacterium sp.
MTISARDVHLRRMENPEYAKAYTEAGPRMELAFQIAEARSRASLNQEELAAAIGSSQTQVSRWERGRSAPTGDYLRRVAAATGSRLMFVPEEVAAAVETIIVKKTVIIEKRPARGTAARSGRTEQAKAAKAAKAPTKKRAPHLALVTGS

SEQ ID NO: 2058 - protein, 146 aa, Methylobacterium sp.
MAPNPKSAKRDRRKKAPETPTAPEAAAPAAAATASGWTVEYLDENVVAESEAWPLPVQANLQRIIDRIEAVGLLKIPSDYRSRVRGKIWELRPDADGVEGRAFYVAVTGKRVVIVLCKIKKRRNTPPDWIDLAEKRAKNLDAGDDK

SEQ ID NO: 2059 - protein, 367 aa, Methylobacterium sp.
LFGVSVDESVRSALLGGARVVFNLSGGKDSGGLSHAANAYLDEIGHPRDRRLAIHADLGRAEWQSTPATVEATAAHLGLPLVVVRRNAGDLVARWEKRFSNALERYEGLETYNLIGPWSQANKRFCTSELKAQVIGPHLARLFHGETIVQVIGIRRDESRDRAKTAISSLDTRFAKPGNRHGTTMMMWNPGVLWSRDEVLDCHARHAIPLHEAYTVYGSTRLSCAFCVLASIRDLEAAASAAGNRDLYLHLVKMEATSTFSFQPDRWLADVAPSLLPASLRAAVQQSKLDAAARRDIEEAMPAGLRYVNQWPPRVPTPEEARAIQAARTAILARHGLRNLYDTGEKVRDRFAELIAKRDAKAAAAAQ

SEQ ID NO: 2060 - protein, 250 aa, Methylobacterium sp.
MTFTAHNIRLADGSETLPEAGWLIADSPWTQAALRSLRLFYGHRLAGRSIVDLGCLEGGYTLEFARAGMRATGVEVRRSNFENCLRVKDGAGVPDLAFVNDDVWNLAAHGPFDAAFCCGLLYHLDRPAAFIRLMAECVRDVVILHTHFATETNEALFQLSPPAENEGLPGRWMHEHDLDDTSQLEAHKWTSWSNKRSFWPTKPALIQLLKECGFDMVYEQYDMLGHDIRGSMESGYYHQQGRSMFVAMRT

SEQ ID NO: 2061 - protein, 236 aa, Methylobacterium sp.
MFATSLALWVIAILLLLAWLHLQERVTEQCRRAIRPQIERLIIENRWMEHHARGAAAFEALWDRELVRLHRAHISRPLSAVVRFRGFRRLVRAEFASILPAEVASWTFVDRASPSQAHYEALMLRCLKSAGWRLDYQDQDHFVLLRARTRVVVCLHWTERDVACLPISDVAAAAERAGSTTACVMTNGRFSGAARAMAEEQNVLALHCSQIDLLLPRDKSTVAPRTVRETGFRLAA

SEQ ID NO: 2062 - protein, 399 aa, Methylobacterium sp.
MAAAVFGAAALTALPASAQYADGGIKIGILTDMSGGYSDLAGRGSVTAAQLAVEDFGRPINGRKVELVFADHQNKADIASSIARRWFDTEGVDAIFDTNSSVAGLAVREVARSKGKIDINSGAGSMALTNAACSPTGAHWSWDTHSLAAGTAAALADDPKNTWFFITADYTFGHDLEAQVTRVVKAKGGTVLGSVKHPFPNPDFSSYLLQAQASGAKIIGMANAGADTINTIKQASEFGILQGGQRLGGLNIFLTDIYSVGLPAAQGMILTTGFYWDMDDQTRAFARRFGERMGGRMPTMVQAGDYSAVLHFLKAAEAAGTDDGLKVMAKMRELPIQDFFARNATLRPDGRMVHDMYLAQVKSPAESTGPWDFYKILKTIPGDQAFQPLSESTCKLVKG

SEQ ID NO: 2063 - protein, 98 aa, Methylobacterium sp.
MPYMIETFDKAGSLDVRRANRAEHLVYLDKIKDRLLACGAKLNDDGSDAGGGLYVVDVETRAEAEALIHADPFYKVGLFERVEIRRWRKAYLDGRSYL

SEQ ID NO: 2064 - protein, 268 aa, Methylobacterium sp.
MTERQTNPEAIVRRASHAGRRVLVTGAGRGIGRAIAEGFGARGALVGVADVNADDVAATVAAIEGGGGRALPLRLDVADYAAVEAALSEAAATMGGAFDTVVNNAGISPKHDGAAHRVWEMDPAEWNRVVAVNLTGSFNTVRALAPAMCAAGRGWIVNMSSVAGKTHSPIVACHYAASKAGLIGLTKHLAAELGPFGIRVNAIAPGRIETPMVRAVGRAVNDEQVRLTPMGRLGAPEEVADLALYLTSAEASFVTGQTVDVAGGLYMT

SEQ ID NO: 2065 - protein, 609 aa, Methylobacterium sp.
MTDIPLASAPSAAPTAAPSAASSAFPRRGAAALALVLAALLAVPVAVGNPFIYHVFITICVFAALSTAWNIVGGYAGQLSLGHGIFYGLGAYCGMLLVGAGISPWIGMVAGAALAVLVALAISYPCFRLHGPFFSLATIAFLEVFRVLALHFRDLTGGATGLMIPLKFGWTWMVFRDRWPPLAIAFGLLLLTLAVAWWMRSHRIGFYLVATRERESAARAAGVRTVRVRLVAVAVSGALTAMVGTFHAMYLTFIEPAAMFSLTLSIQIAMFALIGGLGTVFGPLFGALLLVPITELARGWLGAKALGLHGLVYGLVLVLVVLFLPNGLMGLVSRFARAGAGGRGAQAASVPAVPRAPERPAVGADLVRVEGLQKRFGGLHVTNDVGFTLREGEILGLIGPNGAGKTTVFNMISGFLKPDAGTVSVRAPDGTWHRPGRPADFATLGVGRTFQIVQPFAAMTVEENIMVGAFHRHSDVREARAVARETAERMGLAPWLGSEARGLTIGGLKRLEVARVMAMRPRVLLLDEVMAGINQTDVRRAIDLMLSIRDTGVSIIAIEHVMQAVMALSDRVIVLSSGQIIAQGSPQDVVRDPAVIEAYLGKEFAHAHA

SEQ ID NO: 2066 - protein, 336 aa, Methylobacterium sp.
MGMRAVIADGQGGPEVLRIVERPRPEPGRGQVLVRVEAAGINRPDVMQREGRYPPPPGASDVLGLELAGIVEALGPGAGRFRTGDRVMALVHSGAYAERAVVDEAVALPVPEGLPAVEAGAIPETYFTVWSNVFERARLQAGESLLIHGGSSGIGTTAILLAKARGARVIVTAGSPEKCAACLALGADTAIDYRREDFVAAAKAATGGSGPDVILDMVGGPYIARNLDAVAVDGRIAQIAFQQGSRVAEIDFQPLLMKRVTLTGSTLRARPVALKARLAEALAEHVLPLLAAGRARPPIDSVFPFERVAEAHARMDAGQHIGKIVLSMGDAAQGSR

SEQ ID NO: 2067 - protein, 120 aa, Methylobacterium sp.
MTYVSGFVTPVPDANREAYVASAGAAWALFREYGALHQMEAWGDNVPEGERTDFRRSVALRDGESVVLGWILWPDRETADRCEAAMRTDPRFRDLTMPFDGSRMIFGGFAAVFEASRGAA

SEQ ID NO: 2068 - protein, 104 aa, Methylobacterium sp.
MPDLAEVELYCAEARDILAHAENIVADLDRRGACEGHCLMANQGLAALRNLDRIIERHRRRLTFLALPNAVGPSPPPSPPQKRNWLLFLRRRGGYAGHGIEAHS

SEQ ID NO: 2069 - protein, 384 aa, Methylobacterium sp.
MGLSHHRIGILFSAHGPYGLVGRAMLNGALLAVDEVNARGDCVLEPVIRDPHGALAGYVAGAEQLLDTGIRHVVGCYTSSSRKEIIPIFEKRDALLWYPSHYEGFETSANVVYTGAAPNQHIVPLVRHLLAGGGRTAFCVGSNYIWAWENNRILRETLAIAGGDVAGERYLAVGETAFDQVIAAILAAKPDFVFNTLIGISAYRFFRDFRSACAARGIDQARTMPVASCSLAEPELEAIGPEAVDGHLSSSVYFTSIDTPRNRAFMAAYAARFPEGPTPSADAESSYIAVHLLARALARSGTEDAATVRRAACADAFEAPQGPVRLDETTLHACLTPRIGLSTAAARFTIVAQAEEPVAPDPYLVRSDPRVVPVSRRPRLKVVP

SEQ ID NO: 2070 - protein, 213 aa, Methylobacterium sp.
MTTPRLIQNFSGAQALLIAPPSTATDVLASTLMKLGLTVASVVPAGEAPWLDFEILDPEHHIVIVDGDLPLPGLAASAVPDLPPVPVVGLVGVEAPSRLKGLLQLGATGLLRKPIHGASVYAALFLAVNEHNRRRLLEERLARLEERRRGRRHVVKAILRLMQEHGLDDDAAYETLRRDAMRARQPLEAYCEALVRARPSVTAPAAAPRHARS

SEQ ID NO: 2071 - protein, 253 aa, Methylobacterium sp.
MDLGLRGRRALVTGGTKGIGGAIVDLLADEGAAVALCARNAAEVAAKVAALRARGVAATGRVVDVADSAALRGWVAEAAEQLGGLDIVVPNVSALAVGSDEAAWRSGFAVDMMGTVSAVEAAMPFLERSEAGAIVVISSVSGREIDFAAGPYGAFKAALIHYAQGLAFQLAPRNIRANSVSPGNTYFAGGVWHQIETGNPALFAEALRLNPTGRMARPEEVARAAVFLASPAASFITGTNLVVDGSLTRGVQF

SEQ ID NO: 2072 - protein, 161 aa, Methylobacterium sp.
VSTRDRFSMIAKWHLLMPCVTAVVGYFPGRRLGWLEDLPAGVAYEWAFRGRRMEASYPAAERPALLARFAAVRAPILAVGTPDDPFGTPAAIRRGLGYYVSSPRIQVQLTPSAIGAEAPGHFGLFHARRSGGFWTDTLRWLSDGQNPWPDSVIDSGRPIPA

SEQ ID NO: 2073 - protein, 308 aa, Methylobacterium sp.
MRPRTPPLSTLRLFEAAGRHLSFARAASELNLTPSAVSHGIVGLEKALGVKLFVREPGRLALTREVADYLTYVSEALSLILIGTRRLPTPRSGRTLAISCAPTLATRWLLPRLPTFRSRHPQIAIRIDTSHRQVGFPVDGFDFALRLGRVPTPRHRSVRLFEDWLLPVCSPARRGAVTGPDGALDLRRATTIHVTSATEDWQAWSDASGAVALASADTLHVDTFAMALQAAAAGLGIALGRGALMDRELREGTLVGVGPAVPAATSHWLVSAEGDDDRQEPDQFRTWLLAEARRFAAEQKRRFPTGAA

SEQ ID NO: 2074 - protein, 48 aa, Methylobacterium sp.
MIASFLAIFVAFAACQALLTVKFADFLSADRTRNTVEPPADVANAKLA

SEQ ID NO: 2075 - protein, 32 aa, Methylobacterium sp.
MKLKALSYVMIGAFVTGLLMTFVGSATALLGQ

SEQ ID NO: 2076 - protein, 232 aa, Methylobacterium sp.
MIGPAVTALAAAGPAAPGAGPPGRGPPCGPVPGCAVFGSNFAPDVPDAAVEAVDDEADAPVRPSEADDAAPAVTGSGFALADWAAGPVDGFRPSVPEAGGPASDFGSVVPGLAATTGSVAGLGGVPGTGPCGPFAPPAAVEEVEADMDADVEAVDADVVAGRDAPPDGVGCPGLPGAASGFRPPGPGLSASLGGGVTGKSSNSSASPRPPSTAAAPGARARYGGPASLSPRG

SEQ ID NO: 2077 - protein, 249 aa, Methylobacterium sp.
MLELSLDADTIDAQAPRLPDSVQYHLGHLLAATYAQDNVEPTIADRFAELLRLLDGAFGRAQYGREKAFQASLLALVPNLQRFARSLLRSHVGADDLLQNTLLRAWRSRASFAPGTNLEAWLFTIMRNQFYNEHRKRGREVQDEDGAQAERMVSLPEQGGHLDLSDVQAALDRLAPPMRQALVLVAIENLTYEETAAVMQCRIGTVKSRVWRARTQLAEMLGYTGLEVGSDDVMLAAAGPKGRKSTAVS

SEQ ID NO: 2078 - protein, 436 aa, Methylobacterium sp.
MPRLRWLMIGLCMAANAINYIDRANLAVAAPSMSKELGLDATDMGLILSGFFWTYAIMQLPFGYVADRVGARLSLVVAVVWWSACTALTAVGRGFLSLLGLRMLLGIGEAGAYPSFAKVAASWFPRSERSFASSIFDSGSRVGSALAIPLVSWVIATLGWRESFVVTGVLGFVWAVFWMWLYREPENHPKVSPEELARLRAAQERPKTVDAADAQNQVPWLSLFSYRTVWGMMAGFFCLNFVIYFFITWFPTYLVKARGFSLAELGTLGSLPALASIPAGWLGGFASDALYRRGWSLTAARKTCLVGGMLMSSVITLSIIAPNIYVALLCFAVAYGSLAFTAASIWALPGDVAPTPAHVASIGGIQNFASNVAGIVTTTFTGVMLTVTQGSFVIPLIVAGGFCLLGAFIYLFVVGEIAPLPVRDARAPALRPEAAR

SEQ ID NO: 2079 - protein, 215 aa, Methylobacterium sp.
MAAITAAAQKAPPGEATALTPARDVKPVTAPDPRSIYTLTPEAAGAVFALVENRIQVIDAALDVTDRRGTQAVAAAMATATATTPVVSPETTKTIGAANRNWSEDVRLDHGPSRLVGADTAVAYDSPRVTAAWSLAFPDVAGRRFRAVQLPGPSLRSVLHEAEAGLDDTGSDIYLLCNSAHFETIRQAHPRTHINWINVDNDEIVVVWRKPSEEG

SEQ ID NO: 2080 - protein, 58 aa, Methylobacterium sp.
VGRCRVCGLAYGGILGREAGVIRLDRARWRRLCPGAAWLTVPAACAGLRASFGGGAGS

SEQ ID NO: 2081 - protein, 101 aa, Methylobacterium sp.
MIEQGPRIAREFHVGVGGDRWALMRDLQTGQPYVSHSPGDDAPEVQLDLGSFLVLFTGEEREKLLRLIGSLLPDEDARADADGRAGTSRPLTFVSRWLPNR

SEQ ID NO: 2082 - protein, 83 aa, Methylobacterium sp.
MDNQRNARRVSVNLSGCISVAGHPAIPCVVHDMSRWGVRLRLVGTERVPPAFTLTIDATDTVIGCETVWKNADEIGALTDLME

SEQ ID NO: 2083 - protein, 386 aa, Methylobacterium sp.
MDINSFAVSPLDYGASVNADPETNRVAFQNAINALQAKGGGRFVVPQGIFVVNAPLTASLGQNGSIFMEGADTNSTITFTGGAQNGLVVDAGFIKLSGFRIVVSAMPNIGQGSACYLRNASALGGSFQNIVVEDMRFEGRVDARPSYFLAVNGPATSRIRGVTVVGFYNQSFPVDSTGIYIFGEVSPSGGASGDWSCEGCTVIGVGTAFLVNEGAGPGQATVEGSSFTDCVAVGVQVGLHMVGNGYQVPGHSWKGGHINAAAVCAQFDSISQFEIADCLLYLDAGGANKQGFILFNGCTQMRARDNQMIHIAQTGDTGGGVYGVAFANGTTASRAQNNDGIGFPGGSAVIYNQSGGNNRAGGNGRGGQGALLVGGNLIDLGGNHVF

SEQ ID NO: 2084 - protein, 432 aa, Methylobacterium sp.
MQPVPLPHQIVGAQFLANGGLLLADEPRVGKTGASILALDFLMARRVLVVTTASGRFNFSREVREWQAFPREVQVMMGTAGRVQPQTDVAVVGWSTVGNEQQQAHLLDWRPELVVLDESHYAKSFEAKRTVAAMALADAADRTFCLSGTPMPNSPLDLWPMLRTLAPERVSDLSFDDFMGRYCVVRHKFVAGEWKPIVKRGKNEVELRQRLDGLLLRRTQQDVGIREPIFSTLALDGGAVGTAAIRAALAELPEADEILDAAETGDTKALEHHLGTLRRVTGIAKAHAVAELVKEEIETGKMQRVVLMCWHTGAIEALRGLLKAYNPVVLDGSTPAAKRAGVIEAFQNNRSQVFIGQIIAAGEAIDLSVSRDLIFVEQSFAPKDMKQAALRITNHGQKAQCLVRVAALAGSIDEALTAVLVRKVASIKEVLQ

SEQ ID NO: 2085 - protein, 126 aa, Methylobacterium sp.
MRVLICGGRDLDPALVWNWLEAHATEECADALGRAQHVLISHVIQGGATGADSGAAAWARSSEIPQSCFPADWDRYGRQAGPLRNTQMLAEGRPDVVIALYPAGAGTADMVRKARAAGLPVVEARI

SEQ ID NO: 2086 - protein, 70 aa, Methylobacterium sp.
MTDEQKGYLQALSDMRSWHRWEIGQALGDVRRMEPHEKAIAWLDELIATKKRHAAEDEAELRRGEPAPKS

SEQ ID NO: 2087 - protein, 188 aa, Methylobacterium sp.
MSDAISSALSAGTIGSTDATALAGALSSIDGSLSSTSAASTSATSRSGLDPSSMKDRIDGLIADQVSSGSLTADQATELKNLFASPGRSTQSADATGDGTGAVAGPDGSPPGPPPGPAPTDAAGSAGSGASVSASASTSTTDAARTTNDLLSTFIQQLQSGQAGSVGYGASGTANSGAVSALLLDFRS

SEQ ID NO: 2088 - protein, 148 aa, Methylobacterium sp.
MKSTTQQDQLEIVSALAASLADRMLMERLTQGKLPLANASRLWTASLLLEEHARPIPRIVTDVLEQVRHVEPDDDAADGDDADGIGAGPQPDLAAARRPARPARRRGLTRLLRPFRQAAEACPASTDAPGDGAGPSGGSGVPRARPGR

SEQ ID NO: 2089 - protein, 106 aa, Methylobacterium sp.
MDKVYAGDRTIDGIVVTVNGAPLPDRAEAKCYSRNGFEWSYEGPEPSQLAYAILVDHLGDAAEAERLQPRFMRGVVANFQNEWEMTTADVARVLEHLESGGAARSG

SEQ ID NO: 2090 - protein, 71 aa, Methylobacterium sp.
MPFPIKFGLSVAVALAALAGWFYMGHLGQTGPRWAVAFLGPFMVVSLWIFPEVMRNRSDGRTPRHRIREAR

SEQ ID NO: 2091 - protein, 129 aa, Methylobacterium sp.
MDMIEPNVAALAWFALFAGVACTGFYVLAGMFPLETRPDLRARPLGLALIAANVLLLAALTGGMLAYGVTELRWSSLVIVGGFAILFAPGLFNVWPQRWRDGVAGLAIVLAALCGALGLLQQVGAVFVL

SEQ ID NO: 2092 - protein, 263 aa, Methylobacterium sp.
MELANTRMSERQRNYRANYRQRVAGWYNGFLHIAIIYTIGLTALYIYVSNIHAPSWIELATVPVVFLFCNFFEWWLHRYVMHRPQSNPIGRAVYNRHTLQHHQFFTDHEMRFADHRDYRVTFFPPYALATFTLMSIPGAIVLGNVFTPNVGWLFITTTTSIYMIYEFMHFCCHVEENWFVRNMPFINTNRRHHTAHHDQSIMMERNMNLTFPIMDWLFGTSDLNRGLIGTLFNGYDTRHVKTDMRKTARTPGAPEPRAMQAAE

SEQ ID NO: 2093 - protein, 221 aa, Methylobacterium sp.
MRVLVVEDDAALARGLVAALRHGGYAVDHEADGADAVQLALSEPYSLIVLDLGLPGLPGFDVLKAVRAAGSTVPVMILTARDAISDRVRGLDLGADDYLLKPFDLAEFEARVRALVRRGQAVPNPVLRCGTLELDRAAGTVTLGGAPVALRRRELAVLTILMTRAGKPVPKERLSAEIFGFDEAVAPNALELYVARLRKKLQPDGPEIRTIRGLGYLLMPV

SEQ ID NO: 2094 - protein, 105 aa, Methylobacterium sp.
VRAEIREEIRVAARGRDPCFIRSAWRRSMPFANFKIPQGMMTGPQKADLIHRTTDLLVAYFGEAARPHTMVLVDEVVDGGYGRADEVFDLEALRRLRAHHETGSR

SEQ ID NO: 2095 - protein, 364 aa, Methylobacterium sp.
VSFSALMIAPAAQAASTLEAALRAVPDSVLATPDPMPIVFMDVQALSRATGGALSDAGLRRMAFPQSIRPLNALGYGGAQTWTEKAGIPFEDISYFAAFGQPPARVTYWGLATKAAADTLVAKLKDRNFRPVSTAPRILANGEPRALNLKARQPTDPWSGPMGETSAILAIDRVIAQASAAADLETRVGVGRSAADHEAVATSLTGLAAADERDPGAILQAAVVTPLMGITPDDPAALLSATTDLVAQKKAIEDQRERGRDGVPAYAGGIVADYQGKNGPALLVSLAYPDCRTADRAVSALKARWQAGMTPAASVDGRSVESPQRGCAAVLRVDRAPGANSPFGEFLGTYMQRGFNVLQIGSQR

SEQ ID NO: 2096 - protein, 91 aa, Methylobacterium sp.
MAGEAKRAAPKRRGDDPDAARAEGEKVGARIDAAFEKLAGKLRARADRARAKLDAATKAEKRAVLLRRYELYADAAAYLEERLVDRGGRSA

SEQ ID NO: 2097 - protein, 75 aa, Methylobacterium sp.
MLPTDLDRPAELTLWPGYAPARVAVSHSFPTLRAALAAAVAAIDAEDANPWIITEGGDILAPGWIRANTAGAVLQ

SEQ ID NO: 2098 - protein, 319 aa, Methylobacterium sp.
LFSTADFKPKDSFRLWRETIFERIVPVELTPAAAHAFTGTLEAAEVGPLLITRVTQSAITTVATPDTIRRHGKYETLNVAITLKGRVFSAQDDRTAIQNPGDIVVMDRRPATMASDVDTQTLFVELPRESLERALGSTRRFTCLTIGADQVGTSMVTTFFQELVRNAERLTPDMSNRMASVGVDLIVASIAERLAHETPKNIQGVLIFQRALAHIEAHLGDLNLDPAGLAAAVGVSLRHLQALFREQDRNIADWIWRRRLETAAQRLADPGFAHLAVGELAYSCGFCTQSHFSRRFKDSYGISPSEYRWRNRGADQLAG

SEQ ID NO: 2099 - protein, 134 aa, Methylobacterium sp.
VLTAGLVAAYVSNNRVPTADLPTLIAQCHDAITALAANGAASIEAAGDTDALRDRPTAAQIRSSIRPDGIVSFIDGRRYKTLKRHLTAHGLHPQSYRERYGLPADYPMVAQEYAERRSALARSIGLGVPGERAA

SEQ ID NO: 2100 - protein, 74 aa, Methylobacterium sp.
VIGVVGLRAVDVLGLFVEPAVICLLAALVITWALRWILDWIGINHLVWNRALFDFSLLTAVTALLILSLRVQGP

SEQ ID NO: 2101 - protein, 618 aa, Methylobacterium sp.
MAGEVALSEDAPGLLQRLAAWWPREAAEAVRIALTAIAAIWLAMWLELALPHWAGWTVISVTLATRAASLRKSLWRAGSTLVGVTVAMVLVANFAQATLAFDLALALWMGLLTAASSVESGQRAYGFASMGFTVPIIALADVQNPEAVFQIGVDRCSTILLGIGCAYASNVFVAPGVPAVSRALAGRLEAAAEACDAWMAALRRGERPGPMPIAAVMTLGEEVTDTFTEQPSLRSGGRGIRNAAPRLRRVLAAGLLRALLPDRPGSRSTDLIGAGGAIAVRQVGRVRVSARLLRAGGRVGRRRVPFRPHLLLWNDLDWDGWHAFDNALRTAAAVLLVNGFWYVTGWSHGAGAATWASLVCVLLAAHADPRAESRAFLVGALLAGVVGLTVRYTLLTATGSFALLAAVLLPVAMLAVVGRADKRAIYGIGFGFFVFGVLDPKNPMTYDLADSLNTVLAELLGMAVAAIAFAALPPPVSAATLRLRARRRLVRSVRGAALDPGLLLPPLDRYLARGFGRLALIGADEEAARSGERLLVIGLLLLALRETDDREGRRVGRAVWARLAASRPAGPETAPDPLRALADRATLPLQAERIGALAALVSDLDRAGWPNLDPGGRA

SEQ ID NO: 2102 - protein, 132 aa, Methylobacterium sp.
MIRCVRIWTGDDDNSYFEEGVIDLPHGERGDILSGTTDVVSISFRETQAGGTYAWHAAPTRQFVITLRGTLDFQTRAGAHFTIRPGDILIAEDTAGSGHSWRLVDDEPWCRAYVILAPGAEARLPFVPNKTA

SEQ ID NO: 2103 - protein, 76 aa, Methylobacterium sp.
MQDSIDTVRELSAAELDQVGGGLGVGLTVGLGVDASQELGAVSGVVGQVGGLVSGLVGSVLGAVGGVVGGVTGSLR

SEQ ID NO: 2104 - protein, 137 aa, Methylobacterium sp.
LRKNQDQLEPTISDVALRVVTAYLSNNALPHTSIPPLLITVHGALSALTDRPAVVEAPPEQPDAAQIRGSVRQDGIVSFIDGRSYKTMKRHLTAHGLTPDLYRARYGLPDDYPMTAPGYAERRSKIAKAIRLGRKAA

SEQ ID NO: 2105 - protein, 116 aa, Methylobacterium sp.
VLAALLGGLLAAPFAHGQGTDDLEAEMRARVAAAFPDAGLVTFRKIRPIPAEAESGVAFCGQVSSGPVGQGRSDFQVFLYDRTASAETVRILGSESLNGYRVGRKLIGALRRVGCL

SEQ ID NO: 2106 - protein, 90 aa, Methylobacterium sp.
MEVRMCARKTFYIFVSASDGEQFCAVRQDQPIPSLIDGVRWMYVGCIDTTRDRPYGFDVDAAHAAMRHRSVYFYRRELMFRRANFLLEAA

SEQ ID NO: 2107 - protein, 223 aa, Methylobacterium sp.
VLWFLVALGLVRVVDAAARAATFPGGYWIVLGGALALSWTCSARVFPYWQVHALVGALPFYVAGLRLGRRAFDVSALLGACGLAVLLLCAPRNFVHVATGQYGDPALFAVTAVAGSAFALAVAGRLRGPPRAAAGLLGRASFELYIVSGYFLLLAPHWPAWDRWDRLVLLAAIGLPLHLIAARGLRGPIRAVRAAADSVVDGLVGGLSGRRRRARPGLSGADP

SEQ ID NO: 2108 - protein, 72 aa, Methylobacterium sp.
MTAPQVIATIFFLVSVGSATTLALMAAASAVLDAVAETCDRARPDAGRDRSRRVTEAACRLRRAALARAAIP

SEQ ID NO: 2109 - protein, 73 aa, Methylobacterium sp.
VQHLFQAVAIFAFGCLLIHAGRAYARATTLLLSATALMLSVTLGTVLCQRIGLTGRSVAAGPSYTVALGRPAP

SEQ ID NO: 2110 - protein, 47 aa, Methylobacterium sp.
MTAPLLISVAFAAVTAGAATLWALLVANGMNGVTESRPTERHDIRTW

SEQ ID NO: 2111 - protein, 507 aa, Methylobacterium sp.
MLEWLALRIARRIVDSDYYLTQNADVAAAGVDPVAHFARHWSAAPLRAPNARMEARIYAWSPVLVAVLAMLGQSRQDITDCFRYRINQLATRRGFGLQLRLALALARFLAVRSASPARPSGGAGTALGSIYPVVRIGQDAVPWIDCRGIAEAGVFDFTDPAVALSAQPPTARRLRRPELWCATIRDASLFGFAQIVSHSAFVVYEPEADPAFRYTSRQCEFVITCFGPEGDRVLARVPQEADRAIDAGILLIGRCGANYFHFLIEYATKGYIVDNASIPQDVPLILSDDLFPQEMDALKLLFPGRPFTVRQHGQRLDVKTLYVPSLMTFIPDTPDVEFWTVAAVNHASLSWLRERVIEAVPAPSTPAGRKLYLGRSAGRNITNAAEVEAVFRRYGFEIVNPGQLSFAEQVEAFRTARCIAGPIGAAFANLVFASPGTLVLGLVSPFAVQFSTFASLARFAGCRYLAVPGEHGAYRPGAETRRRSLELTHGNYRIDLDYLGTVLRTNI

SEQ ID NO: 2112 - protein, 270 aa, Methylobacterium sp.
MARRPTYHNDGRGPEHLIMRGTLVVATLLAFSAVPAAIAANPVRDVLWVALQGCVLAKKAAGRSFPCLAVDLGDAARPGTAVLRAPGQPTHTVVMPTDSVSGIEAPVLQGPRGAAYWRAALAARHYVSDALQGRLPPSAVGLEVNSVGGRSQDQLHIHLDCMRRSVTAALKAHGDAVGDSWAPFPVPLAEVSYLAMRVPADAVEAFNPFAALARVPGWQGHLHDASFAAVEADPGDPRGGMILLAYREPEASAEYLMDHGCRVARHGRAG

SEQ ID NO: 2113 - protein, 101 aa, Methylobacterium sp.
MPLTGRFWFRRTWTGKLVLLVEEERGRWFRRRLGRTLRWRDARLLDLAEGPLRGLMTLERTYRAEFGPGEPRRPAGLTAVPGGLALPRGGPEPGTRPSLSG

SEQ ID NO: 2114 - protein, 74 aa, Methylobacterium sp.
MTERDPYRHEDPIWYDRIEADEPPGLILDLLAHVFVPIMAALGAVRALYWLPTRLWGRASRSLLRHRTTAAKRP

SEQ ID NO: 2115 - protein, 66 aa, Methylobacterium sp.
MSDAPDPKRKTIADSVLVRLSTFALGIGLYEGIAQSIVEKAVADMPEATVEQIAAAAQMMMLFVSG

SEQ ID NO: 2116 - protein, 341 aa, Methylobacterium sp.
MARCVPRLRMQPFFSTEGIHPKDAFRRWRETICERLIPIDQQPLHGVPFQGRLDVTSIGPVPISKMAHTAMRTEATPDAIRRHGQPDRLYASMKLSGQDAIQQGDREAVFRTGDFVVVDARPAVCEANTGISLVIDLPRERFEAMLGPSRLYCALTVGADLASTTLANTFLQELVRVGDQLTPDAAARMAAIGTDLIIASLAERMAQEVPRSVHGNVTVQRAKAYVEANLSDPNLDPPQLAAAMGVSLRRLQELFHERGRHISDYIWGRRLEAAAKRLGDPACAHLSIGMLAYGCGFASQAHFARRFKDRYNMSPRDYRQAHRRDTQSGASASQPSLSSPE

SEQ ID NO: 2117 - protein, 87 aa, Methylobacterium sp.
MIVRVTLIGRNCAPFYAVDQAQLQEIGTTLFSQSLDRFGQDRLLKAMNVAETEDTAALREGGAAFWCPLQRAYLNSLRMRGLIGRQR

SEQ ID NO: 2118 - protein, 40 aa, Methylobacterium sp.
MDRFLTMIMVAGGVATVVWIAAMLVVGWQMAVVLMGLSAV

SEQ ID NO: 2119 - protein, 38 aa, Methylobacterium sp.
MTKPITLTNRLVDAVVTAAIAFSLVVHAQVMILPPHFV

SEQ ID NO: 2120 - protein, 36 aa, Methylobacterium sp.
VTLDSHRPGDVPRARGWRVMVPGGGIVVTVCEAEPG

SEQ ID NO: 2121 - protein, 148 aa, Methylobacterium sp.
MSKLSLSLNAVRPGADDHPRPHVALRDEASAIAAAVRVFEDGLTDLRAGVPVADDAASAAAAADAATGLLAGIAGQTSLMALRAAIEAARDGGEGRGFAAAAAEVRDLAGQMVRATDTIVAQVGQIQAAAERAQDTATRGQRQAASAH

SEQ ID NO: 2122 - protein, 95 aa, Methylobacterium sp.
MSARDAADAGRRHWFYDSRILVCTFCLLAVMVIFWQVSRFEGFQPIFTCARNQDVDRDLLSVGMRACMGDAPSQAAQARCMHVVYLLACTDERWR

SEQ ID NO: 2123 - protein, 90 aa, Methylobacterium sp.
MTSTALAVMMAGVLGAFCTIVFAVDWVPGSVVGLPNLPSRRVIGLWVYNGVLCLALAAWLVCTYFCTVDGYEDIPAVRDSYCRPHATVGA

SEQ ID NO: 2124 - protein, 81 aa, Methylobacterium sp.
VIPMSGGMLGSLALAAVFTLGCFGIHSARRHPDAVTIGLFLLLGLLASLYVGRHVGPDVHQPTWQHEALYRESAPTSHPTM

SEQ ID NO: 2125 - protein, 63 aa, Methylobacterium sp.
VDPQPFTIDTEAQAQTYLTDLLNNPKNRSMSEIARHCALRVRNPKIKAFFLTEGAKMLAEMKA

SEQ ID NO: 2126 - protein, 50 aa, Methylobacterium sp.
MLARPFRLFAPALAALGLVALRLASPFIGPVSPPQAGATDDAGVVFRHYL

SEQ ID NO: 2127 - protein, 221 aa, Methylobacterium sp.
MSVNTVSGSSLQRDLVSALRQARAANAARLDVGTAATANQETGKQAAADDTAPSTGTASTPTLSNDLMASLLQLQSDFSQMGLQNGVTAPAEAAANADDSSTTGTATGAAPGQAAGGAPAVHHHRGHHGHRPVSDAEQSEGAAQAGAAADASAASSAISSASTSTSTSASTSATASTDPATATGSGSDLQSFLQQVTKAVTAYAAGGPLGIAAALTSTTKA

SEQ ID NO: 2128 - protein, 73 aa, Methylobacterium sp.
VPSRFYFDIENGEETIRDAQGVEAADLAEALAEARSVIDEMAGELEAAGPAGAWTLVVRDATGAEVGRVPIKG

SEQ ID NO: 2129 - protein, 75 aa, Methylobacterium sp.
MPLSQNVPHAARQADAMAAQMALAAHALRMRGDVGAAESLLAMARHNRILALKLRIAQELAPGQGRAERRATAGR

SEQ ID NO: 2130 - protein, 71 aa, Methylobacterium sp.
MKSCNVDAGTQRLSGAARKSFMADCLAGKSAAPAKELTPQQMKMKSCNADASAKSLKGAERKAFMSTCLRG

SEQ ID NO: 2131 - protein, 245 aa, Methylobacterium sp.
MLLLGIVQSALFAPIHETVHLTAFRARRANAVVGWLAACPSLLNWHFYTAFHLAHHRHTQDPERDPELALMPPSTLDAYLWRVLALPYWRTRLQVAWAGLRGDLSAYPFITDRAAPRIIRSIRLMCAVLLAGAALAIGLIGWWAPLVYWIGPQLLGQPFLRLYLLTEHTLCTMDDNGLTNTRTTLTNGLMRLLMWNMPFHTEHHLYPSIPFHLLPDAHAALRARLGVLQRGYARWHVGFVRTLRP

SEQ ID NO: 2132 - protein, 62 aa, Methylobacterium sp.
VLVVLLVSVGLMIAALAGLMIWQSETAPPDYASQSQAAARKAVTGSESGSVGAPPAGTRSAP

SEQ ID NO: 2133 - protein, 65 aa, Methylobacterium sp.
MRGKDGPDKPPTEPAPAARPRGFFRRVLDGLEAVELLVQAGRLVWWLLRGLWLAAGAIVRLFGDR

SEQ ID NO: 2134 - protein, 403 aa, Methylobacterium sp.
MQAHFAGIDNPNPMIGPARLIRAAFEGADMAALAAEILAEGGDSALDAGTALDMATILLLKHRFTEGLALQSEVLDGQRVFSLRSNPDQARIRVLVLVTAGDLMANTPIDFLLNDGDFGLTYLYLRPGEPVPHDLPAHDVIVTGIAYARTAEPLLEALAAAADQWTRPIVNHPRHVLKTSRHGIADALRGAKGILAPDVVRVSRSILSAAASRIAEGPTYPLLVRPLDTHAGNDLQKIDRAEDLHLYLAQTDAEAFYVTQFCDYRGPDGLYRKLRVVLIDGVPYLCHMAIRDHWMIHYLNAGMLEDPVKRQVEAAAMATFDTDFAERHRAAFAEIHRRIGLDYLIIDCAESADGRLLIFEADTGMVVHDMDSEELFPYKAPQMRRVFAAFQDALRGRVRGRTA

SEQ ID NO: 2135 - protein, 165 aa, Methylobacterium sp.
LAILFAGIALISTAQGGLSLRQLAGIGEAATALARDWVPSLEKVGAIEVAASEVRIKQFRLVLLSDTSEHRDANEAALAKTHAQLRDARRAYEPLITTADERRHYDAFHASWARYAEVDREVRRHVEAGRRTEATALLVRPDVVALDDGARAALARLVDHDETSA

SEQ ID NO: 2136 - protein, 39 aa, Methylobacterium sp.
MTEAEVGPEVGAEAEAVERHKAETETAAGDVADDLADFA

SEQ ID NO: 2137 - protein, 60 aa, Methylobacterium sp.
MRLIYAFLAVRMLRLARFDLFRHELLMADADAALSRSRERVRIAEALAARADLPSLAAGR

SEQ ID NO: 2138 - protein, 72 aa, Methylobacterium sp.
MKERNPAFEVVSRMEDDVANIKRWAEVLSLLGSTHHMIEPGVPHVIARSLKEIADRLSEQWDEAFEIVAGRR

SEQ ID NO: 2139 - protein, 233 aa, Methylobacterium sp.
MGKRFTATLAVLLSLALPVTAATLHSTYIDPAAMALQRVLPPPPEAGSEAAKVDMQAVETAVRARSPDDERRIIANLPCTLDRFTGVLGPTFTAETMPVTAALIEHVFQDGELAVLAAKAAIARPRPYTVKPDLATFGHRSDSTSYPSGHATFGYLAATVLSRLVPGKRQALFAFAASYGENRMIAGTHFPSDLEAGKIAAAVIAEVLFRDPRFERDLDRATAEIAAQGASGR

SEQ ID NO: 2140 - protein, 265 aa, Methylobacterium sp.
MILSPLNALFVGPLEGYRDRIVSAEDPRPSVRGADLLDPRVLTDQLDRFARTFAAPEPRAVASIWAKQHFSMLVVPALAANIVLDLVLPVALDAVEIVPDDGGLTRALKLRGPAAGSDRSGGQTGERAPADRFGALIDAHLAPLVGALAAVSGVAPRVLWSNAGNIFEFVVRRTEGLPQAGRTGHAAAASVLTSRRRSGAPNPLFAPIRYVPEAGDAPAGAPPRRVRKVCCLRYLIPDQSLCGACPLPARPEAGPAGTHGPRRPA

SEQ ID NO: 2141 - protein, 97 aa, Methylobacterium sp.
MRKLALISAVTLSLGALGATGAQAQGYGYGYGGHHGYGYGYGRGYDRGYGHRRDFGYRRHRGLSTGAAIGLGIAGAAAGAAAAGAFDRGPGYYGRGY

SEQ ID NO: 2142 - protein, 59 aa, Methylobacterium sp.
MSALVTFVGCGLVLAGFAAEKFAEHRWLAASRPAPLDTLAVLALALPAVGLTLMATLAV

SEQ ID NO: 2143 - protein, 54 aa, Methylobacterium sp.
MLDVAFWWCVAVALTGSVGLVGLAVVAGRSGRSQPRGLKLSRTEPLVLRHFGRA

SEQ ID NO: 2144 - protein, 65 aa, Methylobacterium sp.
MHFEIRATDTRLWTWVLLDATQMPVLTSDRTFPSEAQASAAALAFAKLVTRAGRTLTAAPPGGLI

SEQ ID NO: 2145 - protein, 175 aa, Methylobacterium sp.
LRAAGYVGAWTADVSAGQSLLDEGTAALLAGDATLAGRPLPIEIALRCTHPDDRDWVFARIARVRQTGGPVSAEYRVLTDGGEVRWVLDRGSLTPDPAGRMRGRGIIIDTTDSHRGPFLPSAAGDLPADDPMVLAIDHLLQARAAIVAMGHQRLQQVSDLALFEVGRALARRARA

SEQ ID NO: 2146 - protein, 160 aa, Methylobacterium sp.
VLAAALVTALAAASTARAEPANQVLGTWRMVSARLDPEGRNAPAYGARPSGLLVFTRDMHFVEVLTDADIPRFASSARGQGTAEENRAAMAGSIGFFGTYTVDADGAFSGNRVEGSTFPNWVGDVRTTEQLRLTVEGGRLSESFRRPDGTRIAITWERVR

SEQ ID NO: 2147 - protein, 100 aa, Methylobacterium sp.
VIRTDPDFEHAVIGGFKLVEDAYARGIISWMRRCALRDLLASGESELYERRTYVTPHSDPDAIQIGVYLEPTSAFLIELGLLTPEMTAPEQADSGADRER

SEQ ID NO: 2148 - protein, 544 aa, Methylobacterium sp.
MRRDEGDGRTVSDGIQHERSPMRRREVLAALAAAAVARPAVAQPAKVLRFIPESDVAVIDPIWTTATVTRNHGYLVFDTLYGQTAGYEFQPQMVEGHAVEADGRLWRLTLREGLRFHDGAPVLARDAVASVRRFAARDAFGRALIDATDELAATSDRVVQFRLKRPFPLLPAALGKTGTSMPCIMPERLAKTDPNTQVTEMVGSGPFRFKADERVPGALTVYERFDGYVPRPDGAASFTAGPKRAHFERIEWRIVPDASTAASALAAGEVDWWQNPTPDLQALLRSRSGIRLEVLDPAGGIGCLRFNHLHPPFDNPAILRALLGAIDQTEFMSAVAGDERALWKDHVGVFSPEAPMATRAGTDGLVGPRDYAAVRRALAEAGYRGERVVMLDPTDYPATHPLALLAAEAFQKCGLAVDLVAMDWGTLVQRRASRQPPDKGGWSTFVTYLNGTNNFDPAGQLGIRGNGDQAWFGWPRAPRLEELRAAWFTAPDSAAQKAICAEIQRQFFIDVPYLPLGAYYEATAYRGLTGVRNGFPQFYDVRPA

SEQ ID NO: 2149 - protein, 393 aa, Methylobacterium sp.
MRTAPAFSSRHLDRLGDRLTADVDSGAIAGADMLVGGADGAIWRRTVGYRDRVAHAPLGPDALWRIYSMTKVVVSAATMVLAERGALRLDQPVAAFIPAFEHLSVLDPDGGLRPARARPTVQDLLRHTAGIAYGYLGDGPARRAYAADGLLAEDLDNAAFADRIARLPLEHEPGTVWHYSHATDVLGRVLEISGGADLQRVLDATVLEPLGMADTLFQISAAMGSRVAQPLPQAPGQRPVFHDPAQPRRGQRGNGGLVSSTADCARFLRMLLAGGSLDGARVLAPASVRLMTSDHLGPAIAKAAYYPPGPGYGFGLGVAVRLAAGEAPFPGNVGDWFWSGVGGTYFWVDPVEGFFALLMMQTSSADQRQHYRTLTRTMVYAALEDRRLSETAP

SEQ ID NO: 2150 - protein, 84 aa, Methylobacterium sp.
MPQNVEYWITDRPDGRFDVVVRLESGKIFRRRGCVSRTEADTWIEGLRMLMAAIGAPVSAADVTSDDPSPLGSQPVDGADHSTS

SEQ ID NO: 2151 - protein, 129 aa, Methylobacterium sp.
MSHPVDWNAFADAWCAAWNAHDVERVLAHFHDDAVFTSPGAARIVPASGGTVRGKDALRAYWTEALRRIPDLHFAVEQVFAGIDTLVIQYRNQKGVSVSEVLVFEDGRVRAGHGTYPIGVDNPVGAAAG

SEQ ID NO: 2152 - protein, 230 aa, Methylobacterium sp.
MKSEKITWRASGSRERLYDDACGTALALEFIGERWSLLIMRELVYGPRRFGEIRANLPGISANVLTQRLESLGAAGIVLRYRLPSPANVQVYDLTDWGREAAPLMRDLGRWAARSPRHDPSLFMSAASAMMSLQALVDRGRAAALSATVAFHFPGEDFVATVAGGEIRVRRGVAEAPDLAFTGDTMALRRTIYGKAPLDRDGAGGTLAVAGSVDLARSFIDLFTLPVKAG

SEQ ID NO: 2153 - protein, 70 aa, Methylobacterium sp.
MDGSDSAGPTMYDLIHTLRLWLWRRQVRAMARECRMSGTSDGDWIAATVAASATSSGPGAPVSYVSGTGL

SEQ ID NO: 2154 - protein, 91 aa, Methylobacterium sp.
MPTLGLKLPLRICVLENAACVEDAGGRRTGYVYWDEGRSGGGDRPFTRAEAIEQVRIIAGAWAGALVHSGTLDTGPAPEPGAAAAEPSPEG

SEQ ID NO: 2155 - protein, 84 aa, Methylobacterium sp.
MRILTRTTLLAAVLAGAAGTAHAAEGQGKAGGRQDAGAPTTSMGAGGLSGTGSTQEGARTGPVESKGQPGGAKPPSAPKAGTGR

SEQ ID NO: 2156 - protein, 367 aa, Methylobacterium sp.
MTRLRLIADDLTGTLDTAAGFTGLCGSIPVAWPEILAGDGSGCLAIDSGTREGSAAEAARIVGALAPRLDGADIAFKKVDSLLRGPWAAELAAVLRAGAWKRCVVAPAFPYQGRRTEGGRQLARHGAGFEPVSGDIAEALRAVGLPARRADVSDGPVAGVAVYDAASDADLARVADLGGDGPVLWCGSGGLAAALARGVAAPGDDRLAGPVLGLFGSDRPETAAQLAAGGPHHLVLSARHPDHAGAVAARLDRDGVVLASLALPEGTAREEAAARIAATFAGVIDRVPRPGTLLVAGGETLKALCLALSVSRLDVTGQITPGLPRSTLRGGRWDGLAVVSKSGAFGTEGVWRDLLHGNGFPRSRSDA

SEQ ID NO: 2157 - protein, 81 aa, Methylobacterium sp.
MPAYHLRRTLEHADGRCGLAFASDRLEADDAEAAIRCARDLCRTAANMLLTGAVLTDSLGRILWSFTLALAREPLCVRPTS

SEQ ID NO: 2158 - protein, 40 aa, Methylobacterium sp.
VNYDWIFVTFGIPAITLAIAYAAVRANERAARRLDPPAGE

SEQ ID NO: 2159 - protein, 255 aa, Methylobacterium sp.
MTFRLTRLFDLTGRTALVTGGNSGLGLALARALGLAGAGLILTARREADLAAAAEDLRAEAVASEVLPADLAEPAAVADLVARLDGRPVDILVNAAGMNLRQPFAAVTAEAFDRHMALHVRAPFLLTQALAPGMADRGYGRIINVASLQSYRAFPDSAPYGAAKGAVVQLTRAVAEAWSTRGVTCNAIAPGFFPTPLTQAVFADAERAARNAAQTACGRNGELTDLYGAAVFLASEASAYVTGQTLPVDGGFTAK

SEQ ID NO: 2160 - protein, 64 aa, Methylobacterium sp.
VFAGRGQWRGPDGRIVREAARIVLIVTEPTPEAVAALREIQEAYRRRFAQGAVGLVLQRSCALF

SEQ ID NO: 2161 - protein, 68 aa, Methylobacterium sp.
MSDRQKLYCTATQVRRRYGGISEMGLWRWIHDGKVNFPKPDLIVNGRRLWSEASLDAFDARQMVKEAA

SEQ ID NO: 2162 - protein, 362 aa, Methylobacterium sp.
MNAAETRQLSLWEQSLRRPEAGADRPTTRLGPALDGRMDVSFLHKGFCIAGLPLRRPKNTMEPWNRRDGRFSLTVEPARFVLPNGRQIEVGVPFGPKARLLSMWLATEARDPRRSAGDRWMEMGRITEWLKAVGLPVTGGERGSIGPTKDQLVRLSFPIFTMVLNGDEGGHVFKRESLIEGGAFKDDDLEVWAAGGHSAMRWPEALMLSQNAYDRFTRHSIPVPTARLRQVAHNAMAIDILVYLCYRLPLLSRGESELLTWRDLMAQFGSSEFASRFKQAFSESIKRTLDAYPEANVAMTAEGLVLRHSDPAELRRAFVAVAGGPTRRARAAPRARKAARVPDQMGPCESADLLTPAGAARG

SEQ ID NO: 2163 - protein, 62 aa, Methylobacterium sp.
MTRILTSVLDGAAWVADALDDILVEAALGFGAAVPLIADPSGDPPTGATTGTSETGAPPIRT

SEQ ID NO: 2164 - protein, 99 aa, Methylobacterium sp.
MGEAVSGTYTAADPGFAQTHRSRILVGTAEGDIIGFVTSTSSPQEITAWTGRLVRTDEKTAEAIHAVFHAVERSSQPKAVTGHVALETTIFSKVENACS

SEQ ID NO: 2165 - protein, 114 aa, Methylobacterium sp.
MKMISTKMLMVAGLAAATLACGAASADARGFGRGGFGHGGFGHHGGFGHRGFGHGGFRHGGFGHHRHFYHRGFRRRFGGFSWGYPANSLFLGPQFGDCRAIYNPVFFGHERVCG

SEQ ID NO: 2166 - protein, 100 aa, Methylobacterium sp.
MRGVCPLLRSREPAMADLIDFPGKRRGAGSAYRLHRFGADGSDRGTVLIRARDDAEARHQADRLAEGLLAELWSGDRLLDHFAPADHPVAGCIGPLRDGP

SEQ ID NO: 2167 - protein, 396 aa, Methylobacterium sp.
VPRRSAGRRRAGAPAGILSLVLFLSLCSAAAAPLAAEPVRAETREAAPALRTTEPETWRVATHPVPPLVMDEDGRLRGFSIDLWNAIARELGVRTAYLRVDDLPALFAAVSDGRADLAIAAVSITAERERRFDFSVTMLETGLRIAVRSEPDATGSATARALRALLSDAAFLQVLLGLAALILAVAALVWWLERRHPGGMAARSGPARGFAHVVWWALSSLAAQAEEMPRSPLARAVTVLWLFTCIALVAWFTAGLTSTATVERLRGAINGQQDLPGKRVGTVANTTSVAYLADHFATPVGFATLEEACAALQAGTVAAVVYDAPALSYYATRPGHEALRLVGTAFNRQSYGILFPASDPRRKRVNQALLGLREDGRYDEIYGRWFGSESGESQGR

SEQ ID NO: 2168 - protein, 80 aa, Methylobacterium sp.
MRAKILVLSFGLICAGAGPVWAARPVLGRLPSAVAQATPGTGSAPILSAGIAGAPALTVLARRKPARRPRGARLGSLRPL

SEQ ID NO: 2169 - protein, 58 aa, Methylobacterium sp.
MRPSSRAFLGCLVLALLIGGLGLGLRRAVAVTPVDPAFRAVLRAYAAPDASGGPQQHE

SEQ ID NO: 2170 - protein, 337 aa, Methylobacterium sp.
MTIRDALLAGPLGFGAAPLGNMFRDIPDHEAEATVDAAWQAGTRYFDTAPFYGSGLSEIRLGKALSKYPRDAYRLSTKVGRLILDEVETGARDQGEKGEIFRYGRPNKVVYDYTADGAKRSIEDSLRRMGVDRLDFVWVHDIARDFHGDKWIGLFEQAHTGAFPALDRLRDEGVIEAWGLGVNNVEPVELLLSLDEVRPNGTLLAGRYTLLDHGRALERLMPAAVERKVEIVIGGPYSSGVLAGGAHFEYGSVPPEIAAKVETIKALCGKHGVPIKAAALHFSLAHPASAAVIPGASRPERIAEDHAAIGFEVSGDFWRDLRRSGVVAPDAPLPSGQ

SEQ ID NO: 2171 - protein, 49 aa, Methylobacterium sp.
VPEYDIKIVAPRDRKAPDAKRETPPKRKLDWDRAMREAAEAELSIQSHD

SEQ ID NO: 2172 - protein, 97 aa, Methylobacterium sp.
LNEPEQGSAEAVYISAMVGEMMRRVLEDALAELARTRGAAFLEIFVARELARCAELFRERPGDTPETTDMLRAWFAMEGGEALRAVVDRASVEAARD

SEQ ID NO: 2173 - protein, 73 aa, Methylobacterium sp.
LQAFDEQLAHELVRGLVQSAVARGLDPAIRLDQFRTLQQAAVALSRDAAVVRTSEQIVRAIDCALEELTAVRS

SEQ ID NO: 2174 - protein, 690 aa, Methylobacterium sp.
MEAYYGADRALLGFQCRFDRADGSKTFQPLTLFRETATGALKWRWKGWPGPRPLYGLDRLAARPEAPVLLCEGEKAADAAGELAPDFVAITSPNGSKSAGKADWSPLKGRRVVIWRDADLAGLEYAEAAAALILAAGAASVSLIDPPGEAPQGWDAADAIAEGWPTVRVLSLVASARPVGRLAERPASGGRLAPTPAPVEAPPAEDVGRRGPGRPPWHDTLLGLTEDYILWHTPKKHAYASIPRPEGHRENWRLNGEAFARELSLKAFEETNRIPSKAAIEETVRILEAKAIAYGPCRKEWLRVGERDGKLYVDLGCPQWRAVEISPRGPEILQSHDLPFVRPEGMQALPEPVFGEENAIGDLRAFVNANSDEDFQLIVAWVLGALRAAKEYPLLILNGEQGTGKSTLSRLLRSIVDPNAAGMLSAPKEDRDLFVLAQHAHLVALDNLSKVENWMSDSLCILATGGALASRSMYTDAGLTILEATRPVILNGIPTLADRPDLAQRSITVRLKPVPAEERRTSTDIEREWEAAAPRILGTFLEALARGLQDVDKVALDKLPRMAGFARFMVAAAPGLGPDFDGQGLFNAYLANQSELASSAFENDPVATAIVALMQAAYSGEWQGTPTELLQALSDPAVTPERVTNSWAWPKKAQTLGNAVERIAPALRDRGIDVRKRHSGKTFYEIRSRS

SEQ ID NO: 2175 - protein, 75 aa, Methylobacterium sp.
MLDGDAFAHEIAALLIADIKTSGARTRGEIEEACRISLESLLGGTAVPPQIAVLMPIGLERWPRVVVKGRPLPDV

SEQ ID NO: 2176 - protein, 32 aa, Methylobacterium sp.
MLRKLLTAFIVPKLIAYLGRRYDRRRGTGRPY

SEQ ID NO: 2177 - protein, 230 aa, Methylobacterium sp.
LPAPPSRFDAVLLDLDGTLVDSLADLRTALNATLAREGLPPVGTAAMRAMVGDGAVALLRRALRASGGDPERAPDLLPAFLAVYEPLAAAGTALFPNAAAAVRDLRAAGYALAIVTNKPARATGLILDAVGLAPLIDTVVGGDTLPERKPDPAPLREALRRLRVEPGRAVMVGDMHHDIAAARAAGTAAILARYGYGRPDDARTADAVLDDIGGLRAMIGALPAGGAPAS

SEQ ID NO: 2178 - protein, 523 aa, Methylobacterium sp.
MRRRTFLAAGAAALAAPSVGRAQGARVLRMVPQANVTSIDPIWTTAIVTRNHAYVIYDTLFGLDADLRPQPQMAAGLKVEQDGRRVTIPLRAGLRFHDGTPVLARDCVASIRRWAARNGFGQTLMAATDELAHDGDTDIVFRLKAPFPLLPQALASVSQPAFVMPERVSQTDPYKQITDATGSGPFRWKADEFNSGSLMVYERHPGYVPAPGTPSLTAGGKVAHFDRIEWRIIADGATAAAALQNGEIDWYEQPPPELQQLLARNRDIVVEGLDRLTNPAILRMNHLQPPFDDVAVRRAVLPAIVQSDFMAAIVGDDPAAYDDRCGIFTPGTPMASQAGLEALTGPRSLEAARAALRASGYDGAKIRLIGPTDLLAPAALTQVAADLLPRIGFNVDLALSDWGTVIQRRVSREPVEKGGWSVLLTTFSSFDNADPAALQPLRASGPNAWFGWPSVPRLEALRTAWFAASDAEARRAICADMQRIALEEVVFVPVGSYRSMTSYRRDLTGRLPGFPILWNLRRA

SEQ ID NO: 2179 - protein, 828 aa, Methylobacterium sp.
MTGAAMTGAPDTPAAAATRALTPEQRACLDAAGAVPNLVAEIDLPGPVDADRLRRGLAAVAARHDALRTAFVREQGFRGLRQAEAAAPAIPLDTGARQGDVGTVGLVPERGQTLAAVLLPGATPRLRLVASALAVDAGSLDRVLSEVAAVCAADAAPGADPEAATYAQYAAWREAVAADDADGEGQAYWRDHLGAGAAPLRLPYRRGVAADAVEEPAAATRLSRAVDAAVTDAFARALARPDLAAAGAEAVLQAAWWLLVARLAERTEILGGWAHDCRRDYAVFAGTVGVFTKTLPLRLALPAETSVSEAAAGLAARLDEHRAFQELCPLDAAGDDRRPAVGFALAAQGAAQDRLLPGPAGFELCLEPALDAEGRLAALTLHADPHRYAVEALETLLDQVETLLARLPAKAATPFATYPLVGAREEARLRAFGRPAPCALPAETLPVLVARHAAAAPDAPALVGAGRTLSYAALEDRVARLGAWFAAHGVGPERVVALDLPRSVDLVVAILAVWRAGGAYLPLDPAWPQARRDRLIALARPALTVALSADTAAGRHALGAILDGLGEARRPAEARDPSDMACLLFTSGSSGTPKGVVIEHAQIRAYVEAVIDALDLSGHGRFALTSTVAADLGNTMLFAALRLGACLVVADEAEMADGPAFARFLRANAVACAKLVPSHLAALLDGVEDPALPALLVLGGEPTPAALVRRIRAAAPATRIANHYGPTEACVGVLVHPDAATAPPDESLPLSRVLAGSEAYILDAAGALAPTGAVGVLHLGGAQICRGYLPGTEAGGTGAFSPNPFGAGRLYRTGDRARLLPGGRLVLA

SEQ ID NO: 2180 - protein, 422 aa, Methylobacterium sp.
MVSRIVVIGGGFAGLWAAAAAARARTEFGLDDRVAVTVIAPDPFHVIRVRCYETDLSALRVPLDDVLGPIGVERREARAIDIDPAARTVTVESAASSAASSGVVETLAYDRLILAAGSLLWRPEIPGIASAFDVDTFAGAQALAAHLDRLGDAGGPDEAGRWTAVVIGGGLVGLELACELPARLAAARDRAGATGPVRTILIDHAREVGSAMGAAALPGIREALRDAGVTCIGGARVGAVDRAGVTLADGTHVPARTSVCATGMRASPLGGTLGLPRDPLGRLPVDAFLAVQGIAGVYAAGDIASAAADDAGHRTVMSCQHARPMGRFAGFNAVCDLAGRPERRLRFAAPDYVTVLDLGAWGAVYTAGWDRGTLVSSGAAAKATKRIINGTRIYPPLDRDAASILAAAAPIIQAAPATQAAR

SEQ ID NO: 2181 - protein, 370 aa, Methylobacterium sp.
MLRSVSRASPRPAAGLLILACGVGLAGPARAEPAPAPATAAATPGTGAADGTPVPAAVRARRQEAGVAVAAATVMAAPPPSFFNFSDTVVSYRFQGPSAEPGLRVQRPDGQFVGREVPKTVINLFHANAWAYGTNLLSLDILRSGSQDPAGNQVRRFEGVGATEFYLVYRGVLSLNKVFDTQALAIPGFVKDVGLSFGADVNTKDTTFDSEKRAGTFGLSFAFDVPAGFVNLKVQGYKEFSRNGFAGYGPVPGFDYAHFRSVEFKMTPEFEITYTIPLPFTGLPLSLAGFNTIVLPKGRYGRFNENDTQLEFVSQTNLVLDVGQLVAGTPNRVEVFAGFQYWHNKFGADPRRTLNTEEKALIAGVAYHLK

SEQ ID NO: 2182 - protein, 343 aa, Methylobacterium sp.
MGNRREFLTATAAGLAAAAAAPARAAEERTAAPKSTPAGAPPFGMPRDMVLLNMRRGDGYALGVKTKDGVLDVEAAGRALGMPVPADMDDLLQNGRGPALRALIDAVEAAPDGRFVLAEAGVAYAPVVTRPEKIIMMGFNYRHHAEETGTPIPKDPPLFNKYNNALNHHGGTIALPTQAAREFDYETELVMVFGRECRNVSEADALDYLAGYCTGNDFSARDLQTLTSQFMIGKTSDGFAPLGPYLVTADRVKDPNNLKLKTLVNGRVRQDWSTNDMIFNCRQLISFASKVMTIKPGDIFYTGTPQGVIFGEKIPRKDRAWLKPGDEVVSELEGLGELRFRLV

SEQ ID NO: 2183 - protein, 108 aa, Methylobacterium sp.
MRSILAATLLLAIAVPAGAQSLSASLEPITPIANPGQLSLGGSSTTGPFPTVSAQTGGLVNAGQLSFGGGGGGGGGGRIGASGGLSAGTTLGTTTAGSGGAGQLGGLG

SEQ ID NO: 2184 - protein, 233 aa, Methylobacterium sp.
TATGGSGVTGTTLGTGGTIGATGARSGLSGASRTGLGSTAGSLLTSTLGTGGLGGGPGLSPGLGTGLGTGLSGAGLGAGVGAGVGAGVGAGVGAGVGAGLNAAGSLGSSLATGSSGVASPGLGSGVAASGIGAAGATLSSGGLFGLFGLGTGTAASGTSAVTVFGAAGAGTGVAGIAGTPGLPADDPAQAARTLPTGGGAIGGAGIGGAAAAPVRTGDLCGGPFAEACLGQGF

SEQ ID NO: 2185 - protein, 263 aa, Methylobacterium sp.
MEGMKALDLRQPHERVTILLVICLPTEGLITGFEAGRWTIVGRFEQIEHAKRRLRRLMHFLEHLEARAFIIQETVPRQSSKRAPWLTLVRFREPELYLDQSDAVEASEEALESWAAIADSFVAPSAMKAKPAPSKRNPIAIAALMATAVVALIGIIAALQALSIKLSNAIPSAFTRAGGITMSIPDEHRAGWYVRVKIYPDKSVEIIDRFPAYARGKHWKEGDMTPEELAADVKRPLTADGNLMDTPDPIPARTGVAAALRQN

SEQ ID NO: 2186 - protein, 73 aa, Methylobacterium sp.
MAQCMAQSSGHEVPTQTRAVAETGLEQARTAFGSVVGAARRASDTVRTTPVRGQDAAREAAAAARDAAGTASP

SEQ ID NO: 2187 - protein, 61 aa, Methylobacterium sp.
MTRARETADPTSRGPDAREADEPPAERVKAEPATIPTEDPEVGLSQKGSGEEAIVRRETEI

SEQ ID NO: 2188 - protein, 84 aa, Methylobacterium sp.
MALKTTYLVQPFELHRNRLRPARQEPAQSEFGALKKAEALAARMPGAAALRVVADDETGELEGVTILGQFGTVPDDFAESLLGG

SEQ ID NO: 2189 - protein, 47 aa, Methylobacterium sp.
MDWFDLPEDPQPPSAADESRMRLYIAAGLIGIGALGMVGGMLHILPA

SEQ ID NO: 2190 - protein, 86 aa, Methylobacterium sp.
MATPETQAPYRLQCMIHRESAGGIIIHDEQIPGPLVEAAVAAAKARFAELRAGRAGSAALRDSAGRVVWSARQDAATPGTGGSATR

SEQ ID NO: 2191 - protein, 31 aa, Methylobacterium sp.
MTDTPAPYLAVAFLSALCLLVAGLQAEGLLW

SEQ ID NO: 2192 - protein, 30 aa, Methylobacterium sp.
MGLVAFIVFVCPWMGIAGLLWMRAQQAKPL

SEQ ID NO: 2193 - protein, 504 aa, Methylobacterium sp.
MKQRTQELRAVERPARAVSSEDGPREDIDRTTEAHEAFLKSWNTYVPTIRTADELKRARGLWDAWQHFLAVGAEAGALDRAGERDLADRVRTTALQADAEAVARDIDTLLTDHDAAVAEQLGAVDAAGSTFRPSLVAGLSTAALAALVLVQATLRGVAQPMTALASAMQRLAVHDLTVAIPPVTGCTELAVMAAATRALQETLRQAVRRDAEADQLRAQSERRRTVIEQATERVETKIGGMVEAVSSSAAALRVTADDMGRAIRDRAVRSTTMGAALAQTRSKVRRCAVSAETFGAAVEEVGAQAESTATLAGSAAADAARTTARVQALSSAVDRIGDAVRIIAKIAAQTNLLALNAAIEAARAGDAGRGFAVVASEVKALAAQTREATDLIGQHVSEIRGSTDAAVSAIAGITARVEDMSRAANAIVDSVERQGATAREIVTAFAEATDGTERFDAEGAGVAEMPEAAEPATTAVLTAADDLTQDAARLGEALAGLLESLRAA

SEQ ID NO: 2194 - protein, 274 aa, Methylobacterium sp.
MLSYLGDKIVGLTLAVLNALAPLEVHVDKGVPYADGSAHRADIYRPAGGKPRPVAVFLYGGGWRTGSKDEVAYVGAAFARRGVVAVIPEYRHVPAASLQNILADNAAAVAWTIAHAAEYGGDPARVTVVGHSSGAWAAAMLGLDATWLQRAGSSPAKLAGIVGLAGPYATSALTDPLDRRVFAGSDPALQPINHAADPHPAMLLATGAADLDVNPAGTLALDRELRGFDGRETMKIYPGIGHGQIVHAMSFPFSLRYSVADDVARFVKGARAGP

SEQ ID NO: 2195 - protein, 81 aa, Methylobacterium sp.
MRITVRDQVKAAIIGTMAEAQKEGRCPLAAAEAAFPGTPTVVLGGCYGEMLSDDEDAWWKRIEHTIDAEVIRNAVASASAQ

SEQ ID NO: 2196 - protein, 135 aa, Methylobacterium sp.
MDHLTDHRSTFMLEKVGAIVAAYVSRNAIEVTALPALIDQVHTAIAVLRCAPSEFGGVGLSQSQVDASIQQDGLISFIDGRSYQTLKRHLTAHGLTPERYRAKYGLPADYPMVAPGYAARRSEIARAIQLGHKAA

SEQ ID NO: 2197 - protein, 37 aa, Methylobacterium sp.
MFAQPHALILRHRERVAVLISSALFLAGALPLFWAIG

SEQ ID NO: 2198 - protein, 90 aa, Methylobacterium sp.
MTRTLFRSAGLALLSLAVPATLAAQGLAPDQTGTGGGPATTITAPNTNSLGVTKPPGTSLGPGEVPPRAVQEHERARLNKIERSICDGCN

SEQ ID NO: 2199 - protein, 323 aa, Methylobacterium sp.
MPADILDELGPLFLGSRLKRLADRFQADAARILRDEGLGIQPAQFPLLAAIDRYGPLTIGDAAAALGVSQPAATRTAASLVALGLLEEARSDADLRQKALSLSDAGEALMARAKDALWPRVDRAVASLCAGLSGPLLDQVAALERRLDAVPFAARIRQDGAAGDAATGLTIRDYTDALADRFRDINAEWIEAMFALEENDRRMLSDPRGEILDRGGLILFVESADLGIVGTCALMRTEAGCYELTKMAVSARARGRKAGEHLLRAVLARAEAMTVETLYLLTNTKCAAAVHLYEKVGFRHDPEIMDRFGRRYARCNVAMRYPL

SEQ ID NO: 2200 - protein, 414 aa, Methylobacterium sp.
MDMQVEKAQGRPLKGIDRNKVIAQSLRQFARLPGLPDTKKGVRSYQSHVKSDPWLPLLFVVCFVLPTLAAGIYYGLIASDRYVTEARFAIRPTIGTADKATPDTVGTNAGVIKATVAQETLIAQEYIHSRPMVEAVAAELPIRAWFGRDDIDMFSRFNPEKPVEKFLRYWRRRVDVDVESASGIMSLTVEAFDPDESLAITKAVMADTERMLNDLSLPSRKDALDVSTRVLKLAEEREAKANAALNELRNREGVLDVIKSNTATIKSVSELRETRTKLAVQLAVLQRDLGPQSRSIVDLKQQIGDLDANIARVQQQLAGTAPTEKRRLSDALTRFEDLEHERENAEKYHRDVQLAYDRARIVAQQQVVALVPIVEPIKAGSSTEPRRILMTSIITAGAAVLFAAAMFTRRMLIT

SEQ ID NO: 2201 - protein, 79 aa, Methylobacterium sp.
MYKLPPGSLYRLRTLAQTGARFYQVSGYMRRMEVLGLVLATGRTDPDAKTVEYRITEAGRAELEERHGPAWPGSAEDEA

SEQ ID NO: 2202 - protein, 125 aa, Methylobacterium sp.
MDSGEALSDRRVGPALRAVVALLALYALLLQAFLGGLMPLPAATDGLCAQHADASAPSGTPVPHDHGDCCTAAQATGPALPPRPASVGFRWAATADLRPAWPLTGSVGARAPPGTIASPRGPPTA

SEQ ID NO: 2203 - protein, 516 aa, Methylobacterium sp.
MLLRATATAIRAHLDDRASRLIAAAGTCLLLCLALLGVYLCLDLRDVAWHNARRNAGNLLAVIEEGVGHSLRVYDLSLQNSARLASRADITALDPDIRRLALFDTAVAGSGLGPIAVTDAAGDVRLTSDPGVRTRPNMSALPEFEFHRSNPEGGLILSGPTVSLITGEPIIRMTRRIRTPDGSFAGIVSGSIRLAHFQALFERLHFDDGIALNVFHRDGTLLIRAPARPAALGQNISASPGYKMYRAKPRGEFQGRSFLDGVERVYSFADLDDLPLIVTVATDVDSIRGVWIYKAAIVAVLILCLCVLAFGLTILLHREVGRHVAAEASSREANAALAVLARTDGLTGLPNRRSYDEHFAVEWKRAAQLRTPLALLIVDADHFKQFNDRFGHQRGDEVLKAVAECLQRTLDTAGLSFRIGGEEFVALLPGVDATAASVAAERVRRAVVNLRIPHAPEVGGIATVSIGVACADPAGGDPPEGLFTAADAALYAAKKAGRNRVRAAAPADPVALALRA

SEQ ID NO: 2204 - protein, 132 aa, Methylobacterium sp.
MDLTHVRAFAAALAAKDRDAVLAQMAEGVVLNTPLAAEPVRGKAAIRPVVDALLAAVDAFEIREILEGPAHVAAFFGATAGPHRLDGMDDWRLDAAGRIAEMTVLWRPLPEAIAVRDRLARAAETPTSAATG

SEQ ID NO: 2205 - protein, 120 aa, Methylobacterium sp.
LEFSWFTKCQMMASNYAQHWEMVLEPDLGSLIQAVATDARTSFTGPQSMRRVAERLTLVADSLVAASDDRARAADVRREDGRCTEALQYLASQLASTAASVEAWKHASASATETSQAPSA

SEQ ID NO: 2206 - protein, 72 aa, Methylobacterium sp.
MEIKRDLMDMAHADTIVKSLKSRGLTRDEFEDVVSGLVDDGLLSLERAQVLTLRFERTEPQSPSLVDDRDVR

SEQ ID NO: 2207 - protein, 73 aa, Methylobacterium sp.
MPTPPDAYLRDILAQAEQDLAAAELRRAQQARIVAGPLNSPETRAAAELLLREIDRTITSIRANRHLIADILA

SEQ ID NO: 2208 - protein, 72 aa, Methylobacterium sp.
MGSSDPETRRRQLDRLRAAYEARAGRPDLSAIGSGARHSRALLGRILVVLGGLPDGAGLPAIGPGGNGRAQT

SEQ ID NO: 2209 - protein, 139 aa, Methylobacterium sp.
MGSMRNAFIYAAILSTLPLPAAAAETCRDHYRSEGTPMLQAITYKTWMIFPSVSPRAAFDRVTRAVLAEGFVGVHVEKALGTLTAQQETSGSGRPQTLRVVVRKAGAGSRVDALFMVQAGQIGQDVDQNLCRIVDAAAQ

SEQ ID NO: 2210 - protein, 165 aa, Methylobacterium sp.
MPLVVILAALCGGLPVLAFGWQTFGFYTVILASCVASAAAVLVGGGLALLRAGRSRTAQDPAKIFDIDRLTSGGRSDFRLVPRRLYFDIEHGREIIKDEIGIEATSIDQALDDARSVIRDMVQELADEGYAEDWVLVVRDARGASVARLPIERTPAQARPDRRSA

SEQ ID NO: 2211 - protein, 52 aa, Methylobacterium sp.
MPSASLMDQIAPVRTSRTRRRPHPALVVASVALAIGLWFVIYAVAGRAIWFW

SEQ ID NO: 2212 - protein, 618 aa, Methylobacterium sp.
VTRSQAARQTARQAARQTARVVALTAAILLPVQAGSRAADRGPADGPGDRPDGTPHFLEQSWTPQERAWFYRASQGSQIMPYAWFMSLERPDDDTLFVADGLARFGYLPNPYDGTRGSDRSGLPIGFVKDVDDRGEWIGMTCAACHVNRVDLRGRSILIDGGPADADMFAFIEELGRALARTRDDPARFERFARRVIPAELSAPGTGPSEPDRRRLRASLTRLAEDFSQYVASSRTAVPWGPARLDAFGMIFNRATGIDLRDPHNIAPPDAPVSYPFLWDTSWHDRVQWNGSAANGLAVERLGRNVGEVLGVFARTDIREPTLPPLWFETSADRVNLLRIENQLGALTAPAWPDRIAPRTEAQARDAAAGKAHYDRYCLSCHAIAPTGANRTLTVTLTPLAEIGTDPKMATNAVSRRARTGILEGIRMPFLATTPPLAAETSSLELVATLVAGAILAPLDRGPDPAGVGADQSVILDRLLKRGAAALEARNAMLDDVSTAGGKGLVAAFVGARRDRDLMVYKARPLNGIWATGPYLHNGSVPNLYELLLPSSRRSRTFRVGSRELDEDRIGFRSDVGPFLFDTALPGNANTGHEGPAYGTEQLDDAQRRQLLEYLRTL

SEQ ID NO: 2213 - protein, 306 aa, Methylobacterium sp.
VRLPVTGDGRFWALAFLGLGLPACLALGWIGLTGETPSTSALAVGGRLAAIAAFLSLGLAALALATRGRAALFALLCFPTSLAAASGPDGPVLALAALAAALLSPRPMTGRHGSARRAGAALAIALVVLARPACAPLVGMLLVPFPPPGRRVRAWRERLPLAAFALLPALLPAASPGLPPPGAAGDGFVSLPVPLPGFLSGVWAAALLAPPVALRRGPLPPPAERLWLSGCALLGLWLAVLSQALAPAGGLGGMQARDLLPLAPMLILAFARGRIGTAAALRWPALLPVLAAALDAVVLPMIALRA

SEQ ID NO: 2214 - protein, 72 aa, Methylobacterium sp.
MTVRLFAAAALAATLAAALATPASAQGSAARHGLSNVTAVMLPEISVTYHRPVPADRSAGPHGAGPAGRQPR

SEQ ID NO: 2215 - protein, 68 aa, Methylobacterium sp.
MTNATDRRAGRRGVRGGRAQVRTVPPGLLLAGGVGANAPLTAVDLIAQARAARREAEARDGADRAEQG

SEQ ID NO: 2216 - protein, 199 aa, Methylobacterium sp.
MDLYAGSAQIRLHEHQIAQDLGISRTPVREALTLLEREGFVSTVPRRGLFVTRKNKREIVEMITVWAALEGMAAHAAARNAEDADLRALGRAFEAFDIATLPDHLKAYDEANLDFHRTIIRLGGCGLMVEMTTNLFIHMRAIRSAFLHRAGRLEDSMREHAAIIAALQARDADRAAILVRDHALGLIAHVEAHWVWPEG

SEQ ID NO: 2217 - protein, 199 aa, Methylobacterium sp.; identical to SEQ ID NO: 2216

SEQ ID NO: 2218 - protein, 95 aa, Methylobacterium sp.
MIVLIAAAIVSGLATAAILAPVSALAALIIAPLAASASAILACIFIAWRNTRDDVGPPNLETQADAMVAVLCEVAQKGKIVPVAAPVRVRGHRSA

SEQ ID NO: 2219 - protein, 37 aa, Methylobacterium sp.
MYALAKTRERTDWELVVVFGSWIVFEIAILMLCLVSM

SEQ ID NO: 2220 - protein, 89 aa, Methylobacterium sp.
MKTLISLTVAGLLATGAAATAAENTGTRMQGSPNAAGYTGQGATGKGETTGTTTGSPGSEMPKQDSRMKGPPNAAGFQPGGGGGGSARR

SEQ ID NO: 2221 - protein, 224 aa, Methylobacterium sp.
MRRPIRKEKPIMTAHRFDAVLFDLLTALLDSWSLWDSVAGSTEAGRRWRAEYLRITYRTGAYRPYEELVAEAAEAVGLPRRLAADLEDRYGELRPWPGVTETLRALAARSVRLGVVTNCSERLGRIDAHCVGVELDAVVTAERAGFYKPDPRPYRLGLQALGVEPARCLFVAGSAFDLVGTAQVGLATYWHDRVGMAAPDGASPPLAHETTLDPLRAWFDPGAR

SEQ ID NO: 2222 - protein, 104 aa, Methylobacterium sp.
DAGAVVRAYDPEGMEQARILMPAVDYAENAYACAEGADAVVIVTEWNAFRALDLDRLRQAMSSGEAAPVLIDLRNIYDPASAARHGFTYCGVGRTKESVARIGS

SEQ ID NO: 2223 - protein, 58 aa, Methylobacterium sp.
AGRASGDASPDCDALPTLELLRLWESLREPVSRQRVLAAARQEARTLRASRAEDAAAG

SEQ ID NO: 2224 - protein, 49 aa, Methylobacterium sp.
MAAPIKTVRPGQVPGAGVTAAADQTIRPLSLAEFIGQRAARANMQVFIE

SEQ ID NO: 2225 - protein, 91 aa, Methylobacterium sp.
MRRDSDGTGRISALTRMRRRLGRLRDPLATPAALHRRWAGAATGADLEARLIAVLAPHVDTAFYASWYGITADPVRDYLVHGWRAGRDPRP

SEQ ID NO: 2226 - protein, 42 aa, Methylobacterium sp.
MMNSVLALLTVVAVLVVTALIKLPLLPFRLVGRLLRSRPAAA

SEQ ID NO: 2227 - protein, 246 aa, Methylobacterium sp.
MSPARSLPAGHLRTSLAALVALAPVLSLGQGASRADEAPAAPVFNKAEAAEIAVPLRQDPALLRSFGTCPADTFARERPFWRWAFAPRRPTERRCAREPASCYALCTRWSNAPACFDLALALEHHSLDVADILDKERLYALACAGGFPAGCTNRAAGIRNGGYAEDPFRDAPRADTDACLARSFRLDCDRRGAWGCAMLGQAYRLGEGVAAEASRARAAFDMACAINPDFAACTFAKRQLAEMGAP

SEQ ID NO: 2228 - protein, 132 aa, Methylobacterium sp.
VSAGDAGPASDALRALYGRVDPMPEGPPAPGHARASLCVDVGDGDDVAAAERWMLAHASRLTRVRSTGCGCCVIGWDIEGPAALVATLPAALGATSDWAGPAATPRRAASARGRRFWAHGWERWWERWVRRR

SEQ ID NO: 2229 - protein, 69 aa, Methylobacterium sp.
ARHDCNDGYGGSGSGLFDAEGHLIAMQSASLSMNQRHAFDIEFHYGSALLIEGRLHEALEAQARATRDR

SEQ ID NO: 2230 - protein, 31 aa, Methylobacterium sp.
MSRGIETDALPETPEAEEPRIPSAPAHPVTG

SEQ ID NO: 2231 - protein, 189 aa, Methylobacterium sp.
VAIAIPCGTMVHADFAVSLGSMMHSLGEMPMSIVVGKSSIVADARNLGLEYAQKYGAEYVLFIDSDMTFPKDALLKLLVRQVDIIGATYSRRTAPFHFLGDILPEQPADAPKGLLEMSRIPTGFLLIKSTVFEKLKKPYFRFRVDEEAGVNIGEDFDFSDRARAAGFRIWCDPYLSKELGHIGEQSFKL

SEQ ID NO: 2232 - protein, 238 aa, Methylobacterium sp.
TLAALLRVCGLRPARAPVEDTGWLGAIGQETLERDAFLDLQARLVAGHFDHGFYRARYGLSEAEDAVRDYCDTGWKKGRNPRPDFKGWAYRAHHPSAEATGLAPLVHHLARALLRGDDLAGEAFDPRYGTLPAEEDADLFEQARLIEPFFDAPWYLKRYPDTRGFENGPAIHFLSHGQEEDRDPSKTFSTRFYRRAYGHLLGPGESPFLHYVRTGRAAGLMGCPEDLGTYPPMEAPAA

SEQ ID NO: 2233 - protein, 54 aa, Methylobacterium sp.
MPRTVDRPHPARRRAVHLPRPRAGAAATGLFLAGLILSAATVPLVEPADAATGT

SEQ ID NO: 2234 - protein, 176 aa, Methylobacterium sp.
MLTLERPDSIAPAATDVPLGTLLAACNAQRAMPLVFTYDGRTIQRGYHVTEVKAGQFAALDCGANPESWSEIFIQLWDVIDGDRTHMTAGKFAAIIRKVSEHVGLDPAARLTFEVSDGVVPMQLHSADTPELIDGVLRVALSPRAASCKPRDRWLEEQNKASACCDPSTTEQPCCG

SEQ ID NO: 2235 - protein, 179 aa, Methylobacterium sp.
MLDLAKIDVAVPPRRTADDIQIGALLATCDEHPAIPLVFVYDGHAVRPGYHVTEVKAGQFAALDCGGNPESWTEIFIQLWDVIDGDRTHMTAGKFAAIIRKVSEHVGLDPAARLTFEVSDGVVPMQLHCADTPELIDGVLQVALAPRAASCKPRDRWLEEQNKASACCAPSTTKQPCCG

SEQ ID NO: 2236 - protein, 169 aa, Methylobacterium sp.
MLDVAKIAVAVPPRRTADDIQIGALLAACDEHPSIPLVFVYDGHAVRPGYHVTEVKAGQFAALDCGGNPESWSEIFIQLWDVIDGDRTHMTTGKFAAIIRKVSDHVGLDPAARLTFEVSDGVAPMQLRCADTPELIDGVAQVALAPRAASCKPRDRWLEAKGTAKACCS

SEQ ID NO: 2237 - protein, 286 aa, Methylobacterium sp.
VVRAIEAAAEAEAEIIVVDNGSEDGTDAALKRWSASVSIDRRDVLLLAQSRPGVAGSRNAAIARASGDIIAFIDDDCVVSDQYLRDLIAHYAGDTESVIRGGRVELGSTEDIDFTTKTEALASRLTYPAHPGGFVHGCNMTCSRAVIERIGGFDAAFGPGATFRAAEDTDFIYRGWAAGVAVEYVPDMSVKHFHGRRDPRTIDRLHWNYQFGNGALYAKHIGRSPWLIKHLYWSARNAARELVGGPCFDAQLGLTWRAIVTANLSGVLAFAWHSARTLLTRAPARA

SEQ ID NO: 2238 - protein, 183 aa, Methylobacterium sp.
MTGAPLQGHAEFSGDAQHRYRLDRWWSDAPRALVCGCNPSMAGAEVNDPTVWRLVELLRPIPTIGGFTIVNWEDRVATDPAAMRAWRMHALHTDEAGYNRARDANLARIRALSAAAPIRIVAWGDLVPMERQTTLVLRAMSLDWTHPLYAFGTTASGAPLHPMARGRSRIPAGTLPTLWREHE

SEQ ID NO: 2239 - protein, 102 aa, Methylobacterium sp.
MSIKTPPPGALHHEEDCGVSTLRQQRTERLLSRIAGAVQMPPSTFYRPPNAVDTGASAAAISVASVASDAECAELLAAFNLVRDPEDRRRLLELVQKTAQRA

SEQ ID NO: 2240 - protein, 96 aa, Methylobacterium sp.
MTITSTKTAILSCLALAALATVPGRAEARGFGHGSFGHHGGFHHGFHHGGFHHGFHHRFGGHGWWSPAGGYAASSYYGDCHLFFSPVWGRYERVCR

SEQ ID NO: 2241 - protein, 242 aa, Methylobacterium sp.
MHHHGLRILLVDDDAEVQRVVSGYLDAHGVDVVPASTRAEARGELADPSQFNLVVLNLRPGAENGLDLLRDLRAVSDVPVILTTAHRCEEFDRVLGLELGADDYIVKPYGLREFLARVRVVLRRVAAQASSRPAEAPCRRFDGWVLNRRRRRLINPDGEEVVLGKRDYALLAAFLDAPQRPLSREYLLQVTRVHDDVFDRCIDVQILRLRRKIERRPSDPKLIVTERGVGYVFAAAVESTSH

SEQ ID NO: 2242 - protein, 58 aa, Methylobacterium sp.
MNRDPRARSKQADGKARTAESDRETDARARQAVVDAWRRALLRMRERRATEDRADPGH

SEQ ID NO: 2243 - protein, 78 aa, Methylobacterium sp.
MPRFFIDLHDGTELVRDKDGYELPGLDAARSQAVKIMTRIAQGLSDRPGRQDYIAAVRDDTGVVRMRFRVSLDAGPVG

SEQ ID NO: 2244 - protein, 140 aa, Methylobacterium sp.
MPIMPWIHDALYVGSFAALVLVARQALVRRDLGLSGLPGLERLRRSLGPGTVSPEWPRFTSPRTSGNTAFDAWRDGEIGRIEGERRALETRLRDFEGFVDALKRAQDRATFERFVAEHPAGSGAAVDIVGTADHAELRRG

SEQ ID NO: 2245 - protein, 92 aa, Methylobacterium sp.
MTPDEMDDREEHPRIEDPRSRPTLFLRRLPPQFRGERDGLTTDAAWLFDAFSGSPDRRDIKLGRGTHRMHLEAGRRALWRASAACLSGPVPA

SEQ ID NO: 2246 - protein, 92 aa, Methylobacterium sp.
MNTLKIASVAAGLCLVPAMSMAQQSVSQDNLKRYCTGDYLEHCGQFAPGGPEVQACFREKAKLLSPNCSIAITAYQKEQNEAGAIRKVSVTR

SEQ ID NO: 2247 - protein, 97 aa, Methylobacterium sp.
MTFLKTLLASLALCAALLVWAGLAIGPEQPMDRTSPGLTTAAVLASDGMAPDGRPGEPSAASGGPDRRDLDRAALDRLAKRVSGQVRDASAAGTPAG

SEQ ID NO: 2248 - protein, 94 aa, Methylobacterium sp.
MLRQIGAGPARAVATPDAATAREIRASIQAEGLISFIDGRSYKTLKRHLTAYGLTPEEYRAKYGLPRDYPMVAPGYAAKRSEIARSLQLRHRAG

SEQ ID NO: 2249 - protein, 89 aa, Methylobacterium sp.
MRHVIGTSSAAAFGTLCVLALVGWTQAADTVPMQASGGAKASAVARDGGACGGGAWPYPPGACAGAGPVGDPAARRVRLIAVDAAPGRR

SEQ ID NO: 2250 - protein, 71 aa, Methylobacterium sp.
MPHFSDDPGADEDPDLLLALRRMLRGGERAPRRLPTCAERFGVPAPRDCARDAQDAVLAGPDPQPPRSRHR

SEQ ID NO: 2251 - protein, 61 aa, Methylobacterium sp.
MLDVIARLLLSAGIMVGTTYLPALSQAVTGQPAGTRIYAADAPACPAKPTMAGIRALACLG

SEQ ID NO: 2252 - protein, 338 aa, Methylobacterium sp.
MPMSLRHAAVAARLLVAALLLPALGGAARAETTSVRIGLQYGLVYLPVMIAQSEGLFDKRAKAAGLDGLSVTLTRFSGSTAMNDALLSDSVELGTLGSAGALIAWDKTRGSQQIKSLTALSSVVYTLFTGKPGVTALKDFTFGDKIAVPAFNSPQAILLRVAAAQQLGDAAKADALMVSLPHPDATAAMRAGQGIAGYFATPPFTQVLKADPKIRTVMTSTGLIGGGDITAATLNAKQGFVDANPKVAQAIRAGMEDAVALIRSDPKRAASIYLASEQVQIDRAQVEAILTDGSIVYDVAPKGMVALAKAMAAQGFLRKVPRDWQEIFFPGLEGRDGS

SEQ ID NO: 2253 - protein, 458 aa, Methylobacterium sp.
MSVTSAALATDTAGARPAASQSIEEKRKSAIRGAFFSEYIDMFDIYLPVVALAPVMFMFQPKNLSPQMETVLASLVFITTLLGRPIGALIFGLIADKVGRRAASIYSVAGFGVITLLIGLLPGYETLGLASYILLVLLRFLDGIFLGGGYTGAMPLAIEYSKKDKRGFVGGLIIAGFPAAYVSINLITMLMFYLFPLDGPGSPYTVWGWRIPFIVGAALAGLLALYYVHKVSESEVWKKEAAAGAEQAEASPMAGLFSGKGGRDLLQVLLLMTGFWTTQNIITIYMPTGLLVKTLHLNGFALTATLMICYTILFFSYIGSGLLGQLIGRRRFFVIVGPLIATVGAYILYTLTVTPDMAFGTRVLLVSLLAVIVTSPWGVIVTYINERFATDVRATGFGIGFSLSVVIPSFYAFYMDWLSALMPLALTPVALLIVGGLIGTVGALIGPETRDVDFGTGH

SEQ ID NO: 2254 - protein, 301 aa, Methylobacterium sp.
MNGNRIGFIGLGNMGGRMTRRLTGAGIDVVGYDTDREAASRWGATDAASIAAVVGEADVVLMSLPDSKVVERVVLGEGGVLAGCRDGQIVVDLSTASASSTRRIAAALAERGVAYVDAGISGGAAAAEKGTLTLMVGGDPAIIDRLGWVFAPIARKVVVMGGSGAGHTTKLLNNFLNAVSLAATAEVMVAGRKAGLDIHRLLEVLNASSGVNFATLNRFPKIVDGDYLEGGLTGKLMTKDVVLYTDLLHELGVASLNASGPMASFGLATALGYGDVISNRVVDAIGDVSGGVRLHGNRHEN

SEQ ID NO: 2255 - protein, 254 aa, Methylobacterium sp.
MTGPAPSPESLRHTVQGELGYWDAEQAALAELAPGFLDAWARLAMVPVRKNHLGAKDRALIALSAATAATHLYAPGTRRQIRNALDAGATAEEITEVLALTATLGIHACNIGVPLLLEVLEEAGQRSGPAPLTPRQEQLKSDFTRDRGYWHAFWDGLLELDPDLFEGYLDFSAWPWRHGVLTPKMKEFVYCAFDAAATHLYVPGLKMHMKNALGYGATKEELMEVLEIVSLIGMHGAELAAPILRDELAARGRG

SEQ ID NO: 2256 - protein, 36 aa, Methylobacterium sp.
MRMRGFPWKSSAFRMREPAQLFERRIYDTAMDAAGM

SEQ ID NO: 2257 - protein, 55 aa, Methylobacterium sp.
MASSMLVTLAWLALSIFVWAQLDAEKVLLLFAYLTALQAGYLVGAYISADAGPSR

SEQ ID NO: 2258 - protein, 82 aa, Methylobacterium sp.
MPADDVPTHDGRAPPAGESRLRSIAKAVSWRVVGSLDTLLLSYLFTGSVLVAGSIASTETVTKTVLYYLHERGWGLIPLGRA

SEQ ID NO: 2259 - protein, 44 aa, Methylobacterium sp.
VPIIPSPRHAARRSLFQSGIGLRLALAALLSALVWLTIAWALAT

SEQ ID NO: 2260 - protein, 119 aa, Methylobacterium sp.
MTFQTKARPLLAALLPPTLLTTVTAPAVAAEPVSTFMAYTAPLAAPLGETAPHIPLIAASALIAASALAMFLPFRKPAAPARVEAPAAPVETAAVGPIYCPRTRRWRDASTGRLVKAPR

SEQ ID NO: 2261 - protein, 88 aa, Methylobacterium sp.
MAEYHVTTYPPHVGPAEMALVARRVDTAGDRFVGAVVAVLDSLSLRDTEGGWRAYRAALAAAGSLRRGAVAARLTVAGGYVVLVERVA

SEQ ID NO: 2262 - protein, 114 aa, Methylobacterium sp.
MQPRSLDELRRLLPGVGISIYAMEPGGPVTLELLEEGDPGETPQAIVWTAPSEREAWEKAFPPTPAEPVPQGSFMPPEGSPARAELAAAVEDPTAGLAAELAAELPADAGGLFD

SEQ ID NO: 2263 - protein, 55 aa, Methylobacterium sp.
MNRQPKGQNLVRATVHLDAALLAELDDAGRARSLSRSAMLAQLLRQMLPKTRRTS

SEQ ID NO: 2264 - protein, 116 aa, Methylobacterium sp.
MFDADDTPGYLHDAYRAALDNGLLSLNLTRVGTDNRMWQASSRFAKSSGFHVEIEANALEAVMKALGAYTKIGAPAPAGLFDDEPAPEGKPLDDGFDAIQDAVYGADEPEDEGLFD

SEQ ID NO: 2265 - protein, 145 aa, Methylobacterium sp.
MKSLAVAALGAGLGMAATAASALTNAVAAGTELISGEPRAARRRQARKGHRFVIGRRGSRSRYQPHQGSREIARRVRQIMDGQLVAWTPPGTEAPAADAALRAEKAIPAQVLIDAGLEAERRAKRSEAARKAAATRARKREAANG

SEQ ID NO: 2266 - protein, 189 aa, Methylobacterium sp.
VNLYKPRANKKNPDKLKYEVNLLYPKSADLSAIKAAVIQAAKAEWGEKAVDLLKNGVIKQPILDGDGPQGVNKTTGERYKELEGMFFIRCASNLKPALLSPKVTAAVEGEHLYSGCYGYAAIHAYTWESDEQGRGVSIGISMVQHAKDGERLGGGQQDPSKFFETIPDDDSGTGGAAADTGDGAGALFS

SEQ ID NO: 2267 - protein, 430 aa, Methylobacterium sp.
MSAGHVQRDHAQWSASASARLWACAGSLALSGRTGRADSESEAAAWGTACHEVSEDCLRTGKDAVEWIGRFVQTKRHRIEVDEEMAETAQVYIDHVREEVAAARADDPGDDQILWLEQRFKLDAINPPFEAGGTADAVIYSRPTRTVKVKDLKGGRGIVVEALGNKQARTYALGAVLAMPGLDIQHVEVTIVQPRAPHRDGPIRSETFHIVDLLDWTTELLEAMRLAKLADDTYGSNGSEDGSFDEWAERFLHPGDHCTFCPCAGSCPALAVAAKSKALLFFKDESGVEQENTVGKLTPAEVAEILDRADMIQNWLNAVRAHAHAEAEAGVEIPNYQLVAKVGRERWNDGAEADVIAACEWAELPLSEYQNAPKLRTPKQVRKALGPDLAKLVERHSTVPTAGTSLVRQDKTVRTPVQPKAHLLFDVIDD

SEQ ID NO: 2268 - protein, 179 aa, Methylobacterium sp.
VSISITINGDNASEAIREILTLAGSMGMSRGTDTSAAALATGMSDASSDSRQTAEPAKEPAKSTRKKADKPAPAAPPEPAPEVKAADAADEAAESEKVVEAKAEEAKVDPAEVFDRNVMRNAGGEYAKLYGMAAAQEDGPKIIGYPAFSKVPDEEIEKATRALRAAIAENPYGRTKAAA

SEQ ID NO: 2269 - protein, 84 aa, Methylobacterium sp.
MGTLSPREREALLLRLEAFADAPREPSRYAANTVQADLVSAFRDGDRHYLLVVPAGGQPVRVDVTGRLGALFAYLGEVIEKAGI

SEQ ID NO: 2270 - protein, 71 aa, Methylobacterium sp.
MGLRIRHTRVPPQVWKKALKIKGGKDDARMEAMRRWPALAKEFRVRRPDFAEAALIAEYGRLQEGANDLFA

SEQ ID NO: 2271 - protein, 87 aa, Methylobacterium sp.
MSVICLIQRTGEAMAGFNSTKFLKAHFPDCATMRSLLTAYGFEPPAADTAEKWWRRGSVPGAWLPVLLGMLELEHGKPVSLLPYLDR

SEQ ID NO: 2272 - protein, 138 aa, Methylobacterium sp.
VREPSFQPQDDNVRKHKLHMIAGRIAELRRDRGWTQAELARRAGLNRNVVNTTENETSFPTRENLARMASALGIELNELTDVFVIEAHHRAPAALSLTEAKGRPGYMAVQINRMLKTATALKIFQLIAEDDADAADRG

SEQ ID NO: 2273 - protein, 332 aa, Methylobacterium sp.
MAAAQIYFGEWLINEQRAARDPKGSGLDFADVWAFYAKEALPKLVSGENTARSGRHLLEAFGDLPVADIGQAHLDDYVRDRRAGRIGRPAKLSTIWLEVAKLKAAVNFAIKRRKLPATARLELDSLEPPEVRDRWLRPEEVDRIIAEAETRREGGRLSRAERFLHLAIETAARRAVIENLQWDQVDLEAGVIHYHRHGDLRSKKKRPSVPISSRLRPILERAFEERITSYVLDTSSDIYHHIERIARAADVKGFHPHLLRHTAATWMARRGVPLWKIAGILGNTMQMVEQVYAKHSPDGLADAVEHISAARKPAQAVRPNVSANDDLGALSV

SEQ ID NO: 2274 - protein, 150 aa, Methylobacterium sp.
MLVRLAIEADRPALVELCVQAVEESVRGIPPDREIINETIDSSFATAEPTFFVVERQRELIGFMMASIGSYAFASGIFTTQQVMFVRPDMRGTRAAALLIRHLIAWSTRLGAKEITGGNNNGLYTEQTARLLEKHGFERVGVFMRRPGVQ

SEQ ID NO: 2275 - protein, 163 aa, Methylobacterium sp.
MILEPVTYATALQVGQGMRERDVMEFAAVAPVGAEDLASWLAQRFGRRSELLCARTNDGEPVCIGGAVEVRPGSATLLFYGTDRFPEIALGMTRFIRRHYFPSLAAAGSHRIECVTLDSYREMQRWLETLGLERESTLRAYGRDREDFAMYAWIDADARSPRH

SEQ ID NO: 2276 - protein, 536 aa, Methylobacterium sp.
MGTIWIREFTGGLDTRKLAETSKGGTLVQAVDGHINRGGEFEQRAAFVPVYTLPKGTVGLAFTKAGPTVFGSIPDPGVPNGVNYQRLQHPDGATELVAVRSFDLFSGKIFAVGTFADGDIYQFYDGKRITNYGTNTAVVPGSPVRTFGRKLYYLTGPNLIYSNLADPTNFDADSGTKLPDGTTTDVSAPDADGKTTKTETTRKTNADGTVTITVVVTKPDGSVTTTTSTEPAPTTGVGAGFNDLSEEDYGSEDLTAIGRYQNYLAIFSDRTVQVRYMDPDPALSKGIQSLHNTGTISPRSVTEFGDTDLFYLDASGLRSLKARDASNAAVSTDIGSAIDVLLTDFVAQQSAEDVQNAIGVIEPRDGRFWLAIGDTIFVFSYFPAAKVSAWTIYKPGFKVEEIIVYKRRVYLRSGDQIYVYGGLGAELLYDDTEAVAWLPYLDGDRPTETKTLQGIDAAVRGSWRVDIGMDPAQVEASDKIGVVTETTFMANRIPASHQATHFSLRFRSDGRYLPNKPAVLGSAAITYSAESDKARS

SEQ ID NO: 2277 - protein, 239 aa, Methylobacterium sp.
MARGQTLLKLLDDLRAECRLSPNPSHNAQQRETQVRLLQRMQEWLYDDYDWPHLRIERTFPSQRGQRYYGLPKDIALERILHLEVRFGTRWLPVGTGIDTECYAGIDSDGGQQGWPVRRWRIWEDDRIELWPVPDQDAGTGIGDDGSIKVVGIRNLRPFRDDTDVCDLDDRLIVLYAAAELLAAAGAKDAQLKLQQAAARYAKLKGDLTPRRRVQMFAERPERAPLRGMPMVDYRPASK

SEQ ID NO: 2278 - protein, 219 aa, Methylobacterium sp.
VPKTVTPAEIQILQRMHGDDAVHDILPGEPVQRSKQQELGRLAGMYSARDEDGKPHLQVMFPSHTLLPMTIDELGLPDEFFRATSRARPTTRTVEVPVEQTHGAPSTPPTQVGWDNTEFEPTEVPADPETQPELAGTMVDPRSQHQNDEPPGVALAATNDGDADKLRARAEAQGTGPGSVPTQTGARTDGGPVETAGAKTAEQKSAEVAPAADANALFS

SEQ ID NO: 2279 - protein, 360 aa, Methylobacterium sp.
MPFTANELANIANSALDYYLNKGKVEKQNIQEKPMSKAFEASAGQFPGGKGLVSIGVKGGQGGGSFQGYTHDDQVTYYNPASNLRVGYAWKEHHIGLGLTHTELKIDGITVVEDGADQTTTEKDGREQFALANLLEGKMEDFDEDKKASWDKLLHGDGTADAKALAGIQSIILDNPAVGSTGGLSRVTYPWWRNRAATAAAAAAGTGQDAIASSAAGGGVLMQFLQKEDRQLKRFSQGGVKLRRFAGSDFIDAMEREIRANGNYSLSGFRAAGTVDGKMADPTWDGNEIIYDPTLDDMGLAKRMYAIDMRRIRLMYMIGEKNKKASPPRPYDRYVMYRGLTSTAVMIASQLNTSGVYDIK

SEQ ID NO: 2280 - protein, 342 aa, Methylobacterium sp.
MPFDREDLPEELDEALEVQAGSEGTDGQAGADGAKPADGEGSSASQAKTEDEGLLGVVRDAAPAKKPDAAAASPAEGAEAGDKPGEGAPKQPDNENYSDVPFNKHPRFRQLLSERNANKGDAEKYRQVDTFIRDNGMTAQEAADLLTVGAMAKTNPAKAWELARPWVENLLKACGEVLSPDLQQAVQEGRMTQEAAYEVSRSRASVAAMEASRGFEERRRQEQSQTEHARSITTAAEDWETDRRARDPNYDTKLELIHREIAWRHHNGDVPKTPQEVKAQLDDAYKAVNAALKPPATPPAAAPGRQAPPRTATKPVTGGSVAGGNAKPAPRSMLEVVQQAAG

SEQ ID NO: 2281 - protein, 741 aa, Methylobacterium sp.
MFDAPQTALADEAPPTAAEVTPEQVGPAKEQAPTEQELALQRRISKTIREDKRHFKKAFEQMRSDMRVAMRGHDKDWSDDKYKANITGRHVKAKTAALYAKNPKAVARRADKIDFKIWNEDQQSLLMAFQTMQAAQQAAQMSQAQAAGDPNALAAGATAPEPQLPPGFAEAQALIQDFQEGMAARMQAQRIAKTLEKLFAHAIKEQQPLGFKESMKQTVRRACTTGVGYVKLCYQRQMGPSPSVEYRLNDSRVRLEHLKALIEAQQGDEGSVADLEAEAAEIEAMVESLSAEPEIVTSEGLVFDFPQSTRVIPDRLCRSLEGFVGARHLTLEYLYTPEEVKEIFGVDLGKKFKPYLASGKLADDTSESYQHQSDILDSEEPAGEQPKGDLCLVWEYFDKAAGLVYYVCDGHEGFLKPPAAPDVYVDQFWPVWALTFNAVESEDELFPPSDVALLRDIQKEYNRSRDGKREHRRAARPRWVFSKGSFTDEDLSWLGTAPAFSATGLNIDPTKDIKTQLQAVPVPGVDPNLYDVGEIMADLQYVVGNSTAGLGAPQKGTATANSIAAGANATADQSAVDDLDNFLTAIVRGAGQILMREMSEETVVKVVGPGAVWPEMTLQEIADELSLEIEAGSTGKPNQAVEIANWEKMLPFIMQMQGISPQWLARETLRRLDDRMDLTDALVDSLPSIVAQNRQAQAAPGDPNAQPDAQGHNGAANGPAAPGGPAGRGAPMGAQSKAPPV

SEQ ID NO: 2282 - protein, 135 aa, Methylobacterium sp.
MQLDLTTAFAFIACILSVGALVFKSGGQAQAQKSFETYSTKVDADRQKWREDFEKSVEQRFGAVNGAVTLCREQVHDVREDLARNYLTKSEVKEIELRVSNSQDRILDHLDKIDTRLNEMQTRVLEAINKATSRG

SEQ ID NO: 2283 - protein, 385 aa, Methylobacterium sp.
MQSRLPTICANYGVRAQNDLGYTRNKVAGLFGNGDVESQGFNTLQEISPVVAGSAGGYGWMQWTGPRRRAYLAWASALGLDPAADETNYRYMVHELLTIETAAHRAILACADTPEAAAAVVCTKYLRPGIPHLDRRIASAKAAVSYIGPAKGASSPDVGPVGVPISPAAPPVRLQRGQWPEDALTRFEVQAIQQRLLDLGYHVVGFVDGKWGERTAAAITALQENAHTALQRTDVAIDGHYGPQTRALLADDASRAKPSPQRAGVTAKTLAKAGNPVVKAGTKISWASLGSVLAGAGALAGTLSSTWTTELPWPFSMLAGFLPPWAMLCLVVAFNLYTGLKASGLIGTAVERVRQGIDNTGAAQDGPAKLTLPNLPFGLDKLLPR

SEQ ID NO: 2284 - protein, 434 aa, Methylobacterium sp.
LFSFTAFQQAQGDDSFPGTELDVELDTTNNALDALLDAFKTVLRADGKLANGIVTRNSLAADLILGIGAARPWSPTQPYLADETVTRGYRIYRALVPSLGVDPAAGGTSWELAADLSQAVVIADGGVGTAALQDGSVTNAKLAAGIDGAKLLDGSVPASKIGAGLGTVPIGARMAYAGFRAPAGWLFEAGQPISRTDYADLFAALTETLQVDIGAGQKTLLNASKSIAGIGLRSAIVEGVGIPAGARLVSDANGQLSINAAATASAVQATIRIFPYGNGDGATTFNVPDSRGRTDFGRDDMLSSYWGTGAGRLVATVDGGSLQAGAFDAGAGKEQTLLKITNLPNNLPAGKVTVNFPKQNLATYGALATASVTTASGALPVQNVWTGTVNGESNPQQASADFQVDGTNANPTGSQPFSIVPPAHVTNKIIFAGV

SEQ ID NO: 2285 - protein, 106 aa, Methylobacterium sp.
MARFPLTAAALEHEAEELISGLLAQPAFKSAIQELLMASVKELRDALDGAKASVDSLTAKVGQVSGSGIDPADLDPVLAEVNTLRSTVEALAASLPEPKPAAAPAA

SEQ ID NO: 2286 - protein, 450 aa, Methylobacterium sp.
MSIKALRQKRADLVKEAQATFDLAAKENRGLTEAEAQRDDAISAELTQLDADIGRLERQMERQRQLGATVDDNAESERRAHAEPRGNDKPFRSLGEQLRAVMSASRPGGQVDPRLSMDGAGFSAGPTGMSEGIAADGGFLVQTDFAADLLANTYNAGEIASRIRRIPIGPNSNGLRANGVDETNRANGSRWGGIQAFWTGEAALKRQSQPKFKRIAMELEKLTGLCYATDELLQDTTALGSWMEQAFKDEMLFKVEDGIVNGTGAGMPLGYLNSGCTIAVAKEINQAAGTIVANNILKIWTRMAPANRKNAVWLVNQEVEPQLFALMLLVKNVAGTENVGAIAFPQVTYTPPGANGNEYGMLMGRPVIPVEYAAPLGTAGDITLADLSQYLGIDKGEMKTDSSIHVRFIYDETCFRFVYRFNGQPIWQQPLIPYRGTATLSPFVTLATRA

SEQ ID NO: 2287 - protein, 78 aa, Methylobacterium sp.
MRWAIIRQQQVLYRGTREEVLAAAERYDLICHTVPGIPQPLDGRGFYPDGAEIPPRLRQGAVMLPEDMLPVRLRRRAA

SEQ ID NO: 2288 - protein, 123 aa, Methylobacterium sp.
MVEHRRKPPIVATPRRKHWREHVRLSSGELRPTVWTAIRLPNGDQRGKTFTRATRVQLRLRDQAESRQFLFLPGTKIPRPAALYWQDMVSLPLVFAEVEGRLWRSRRPVRRFPQRPLREASHG

SEQ ID NO: 2289 - protein, 50 aa, Methylobacterium sp.
VLLDASHLPVMESDRTFPSEAQASAAALAFSKLVTRAGKTLTAPTSGGLL

SEQ ID NO: 2290 - protein, 218 aa, Methylobacterium sp.
MDRKSRHFRTFADDMKQFADFSDVADRDLDGQTPFLPNGYFSYGDALALTTVLATRKPARYVEIGSGNSTKFARRAIGKYKLDTKIECIDPNPRSSVRDIADNWISDGLLDVDPSYFESLNDGDVLMLDGSHLLFHGSDTTHFFLRIYPLLRPGVIVHVHDIHLPYEYPEVCDRLFWNEQYILAMMFYYKPASDIIAPIKYMHREGMCDEGASFWFEV

SEQ ID NO: 2291 - protein, 109 aa, Methylobacterium sp.
MRPWPILVLLAALLGGLASAPARAAPLPVPASAEAAAPAPAVQQAHWRHRRHWHRRHHWRRHWHHRRHHWHRRHHWHRHHHFRRHWHRHHVWHGRPYGRPYGHRHVTFY

SEQ ID NO: 2292 - protein, 121 aa, Methylobacterium sp.
MRSLVFGAVLAVVMPLAAQAQDAGDAAAGEKAFAPCKACHNFQKNGVGPDLKGVVGRKAGTYEGYNYSAALKNSGITWDEANLHEWLKNPKAKVPGTKMIFQGYPDDKKINDVIAYLKTQS

SEQ ID NO: 2293 - protein, 54 aa, Methylobacterium sp.
MSMIATGGCLGSTLLCLLTASSGPLLALAGFFGGGTAGGLLGALAVAALGRGRA

SEQ ID NO: 2294 - protein, 100 aa, Methylobacterium sp.
MRVTSAIGLATVLLSAGSAVAFAPALFAAGPAAVAQLCTESAGTVSCANGYAGFRGPSGKLWIGKDRRGTVIVSIDDRRNDQESLRREQDHGRFVLEQAW

SEQ ID NO: 2295 - protein, 32 aa, Methylobacterium sp.
MAAWSIVDLLSVIGSRPADEARITAQADRIGD

SEQ ID NO: 2296 - protein, 88 aa, Methylobacterium sp.
MTTVVTEGTMQEIQLRDAKATLSAVIDQAKQGAPSIITRHGRPEAVLLSFEDWQRLSRVPSFGRLLMAAPLAADDLPSPSGGLRSAEL

SEQ ID NO: 2297 - protein, 448 aa, Methylobacterium sp.
MQSTPPYGEPPLPISSDAIADGPKVPGAARRRSVVAGAIGNTLEWYDFATYGYFSAVIGRNFFPSDSPTTSLLSAFAVFAAAFFMRPIGGIVFGHIGDRYGRKTALLLSAGLMAVSTFLMGCLPTYASAGLLAPVLLVVLRLGQGLSVGGEYTSSAIFLSETAAPARRGLTGSLACIGAAGGILLGSIAGTLVTGLLTPEDVHQWGWRLPFLFGIVLGVFIFALRRHIDDDHVETVFREDRAPADQRSPLRTAVEIDGSAMLRAFAMNLGLACGFYVVFVYLVTFMHTVSGLPQHTAFLINSLAMVVQAVCIPIAGALSDRFGRKRVLVLTGAGLTILSWPLFMLLTTGDTLLIVLSQVAFAILIAGNAAVVPTAFVEMFQHRSRCTALAISFNASMALVGGTAPMAATWIVHHLAWPTGPGLYVAVLSAISLAAVLTMRDRTGESLA

SEQ ID NO: 2298 - protein, 223 aa, Methylobacterium sp.
METPTGDHSGAFEASPLAAIAVAVARGDVARIAALAPGLDLSVRGGRNLTLLEWAIWNARPRAVSALLDAGADPSVPGLDQETALHMAAMVEDPTYLEILLRHGAPVDPVSPRGQWTPLFRAVQNRREAQIALLLRAGADLNRVDATGNSLLHVAAQVGAANPWVLRLLEAGIDPTLRNAQQKTFQPYFFTTPERLLNDSGRETRAAVRAWLARRGVPADPDR

SEQ ID NO: 2299 - protein, 28 aa, Methylobacterium sp.
VRSDTMLTALSPLHLAALSLIVAYLGWG

SEQ ID NO: 2300 - protein, 74 aa, Methylobacterium sp.
VQRARSWYRRYGRLGAPQTPRPATQGPQAVRGRSLEDWARLGGGLLGPESADAPRPEIRADRAVALGIPISPPD

SEQ ID NO: 2301 - protein, 173 aa, Methylobacterium sp.
MRLTTRTPSRPRSLIVGCAAAACAFLAVPSEAPGQAGPGSEEALVNGIQTIRRGDTVTKVDRTGKGAVLCMRGILRAMRAVGQACHDGADPDFQQELRAALARIDRFIADNAPDRAVPSRDGTTEPQHRPGAVCGRDAEAMYEALRTGGAAGLRAQVDDLLSIPREPVMNPCL

SEQ ID NO: 2302 - protein, 174 aa, Methylobacterium sp.
LLIVAHEDILPRVCGTDGQSTMFEIAQDDLSDTQTRALLALHLAGMHASSPPGSVFALDLSGLQAPGVTVWTARRGGRVASVGALRMATDGTAEVKSMRTHPDFLRLGAGAAILDTIIAAATARGARRLSLETGCGPAFAPALELYRRRGFVSGPAFGTYVPSDFNQFLHLAIA

SEQ ID NO: 2303 - protein, 37 aa, Methylobacterium sp.
MTFHSAAILAVWSVLLLVIGALIPRLLQASRTPRLVP

SEQ ID NO: 2304 - protein, 221 aa, Methylobacterium sp.
MKRLMSTPPDRRSRKRLATRQAISDAATQLFLERGFDAVTVDEIAAAADVGRMTVFNHFPRKEDMFYDRDEEGRALLRETLRQRDPRVAPVETLRQLAHRLVTGRNPVVEFSARSGAFVATAAGSETLKARARAIRDELAGVVRVALAESVGRGPEDPDADLAAGLLLATWSVAFLRAHRTFRATRRTEAANAAFLAVVDRGTAGLVAALAGTPYAEAAAP

SEQ ID NO: 2305 - protein, 37 aa, Methylobacterium sp.
MTDAPDPPEGPPGKTALLVVLTLTAVAAAAYVLIHMD

SEQ ID NO: 2306 - protein, 508 aa, Methylobacterium sp.
VNTISAAVQKPAPKPDRDLAPSPHPAGDRQTLPDPAERGAFDLVLRAVSGGTPAARPETDEGEMGEPESETGEDPRPEAGASPAPPSPVDPGNAAAALAEILSAAVLAARPEMPAGHGAGAPGPAPSAASPAGPDAAPETSLAGNLEAARADASPRAGSSPGPLLQGSPPKIEVLDRAVHFKPVLPGAARHVLPAAAAATSPLPAGPNAADAQPRADRPGPVVPAVAGPDPAPIATAAQVAAQIAGTVAGKVAAAPPKATVALATDPEPRAGDASARAAATGIDGPGELTAREDNRSRSGIAGLRLAPTGRQGPPGGPIPGPGNGSGTEPARLAAVLPAIAAAITEEIERATAAGPERRVGADPAIPAAQDGPLRVLKIQLRPESLGIVTVELRLVDGQLETHLRAARPETAAMLQRDSAILTELLKQAHYRPEIIVEPVRPGDAGFSAGGSPSQGQSGLTDGGARPGHGGDGQRQEDQRAAKRPTIGRRDGERTDETVRPRDGGVYL

SEQ ID NO: 2307 - protein, 44 aa, Methylobacterium sp.
MAEICITEDQNGRWTVYTAGLVATDLTREAAEAFAASYRRVAAG

SEQ ID NO: 2308 - protein, 88 aa, Methylobacterium sp.
LTRSIPAPALVLAAATLAALPAAARAQDRPGPGAAPPAETAPKPAADTKDPGKTATEAVTHPSAVPPTEGAVGTGKPPATGDAPTTGR

SEQ ID NO: 2309 - protein, 66 aa, Methylobacterium sp.
MHRIRLGLRRRAPVPPAPALPESLTRYVSPPAPEAGLITAPLRDIGMALLVGVVVALVGGRILEAW

SEQ ID NO: 2310 - protein, 170 aa, Methylobacterium sp.
MRGLVSTATLSGVLALVFSMPASAASDITVAAIATGRLYVVGTTDRPHTAVILDNRFKTESDENRKFQYELVYHPANCVVSAAIDGTIHEAVVSNCGQQVVPGTWLDPKPAMRRPTPLERVLSPTVEVPSTVFCPSVQTERSQDPARIELADRTPPVFTVVTGMNFSPRY

SEQ ID NO: 2311 - protein, 31 aa, Methylobacterium sp.
MILRAEQVSTGFVGGRIRVRAAEQQDARRRN

SEQ ID NO: 2312 - protein, 314 aa, Methylobacterium sp.
MMRPRWVRRDLLKSCFRDLPICAAASLLPTSRSSAAIDASVDPTQGRTLVFDEPFAEINGRIWNGGPKATTGPSGFYGRSAFAPLAGAEGFKPYEIVADAEATGGTALQISAKYIGRKMSVVNYYGNNIPDYQWISGNLQTGSRSGVVSVGWRHGYLEARMKFPRHPLTWPAFWLLNREGITNAKRSIEVDIVEHKGFEPKLYGAYLHEWGQPGEHNEGTGVPTPVDMTEQYCRYGVLIHDGQCIPYFERKPIINPKTNQLNVWTLTRASEMEQAGDVFWPLLTLALRTDVPAPQLTEAQKLTHMRVDYFRVYA

SEQ ID NO: 2313 - protein, 294 aa, Methylobacterium sp.
VRDAVRGRPGTASPRGSTGRARTGLSRRSLGLLVVLAATAVWLAVALVPNLLGKGGALWAIVHGACVPHALRGQGPAPCSLVDLEGGVEKGYAILKDLRGPAQFLLIPTARITGIESPVLLQPGTTNYFAKAWRARTFVEGRLGHPLDRRDVSLAVNSRLRRTQGQLHIHIDCVRRDVRDTLRRLAPTIGDRWAPLAEPLVGRPYRAMRVLGEDLGTADPFDLLARDDGARSAMGEHALAVVGAEFPGAKPGFVLLDGLVTSRFGKASNGEVVQDHTCAVAAEPASSGFRPLED

SEQ ID NO: 2314 - protein, 99 aa, Methylobacterium sp.
VRNAGAAVGPGTGRGDAAALFALRIPRGPFSDTYPMGHASRGLVIGAGLGHACPHPDAVGGRNRSGGALPGSRRERQGWDDAREDLLDARSGSREAGDR

SEQ ID NO: 2315 - protein, 54 aa, Methylobacterium sp.
LLFSRQAEPTIRTSDLVGATAGVALLGGLCLLLVALLTSEAQGFTDLTSILTDR

SEQ ID NO: 2316 - protein, 93 aa, Methylobacterium sp.
MLTTLLAAMIREVPVVWSTSVDDGPVDRVKPDIVLTEMAERLLHQTVEDDFAVAARVAGHAAAVTAGWRRSREASPHGQGAGLTRPAAFDRRG

SEQ ID NO: 2317 - protein, 57 aa, Methylobacterium sp.
MAVESATATAESFTIPTGHHVDVAEAIEMRSPATSLRAGAPPHVAESAINMSFPRTT

SEQ ID NO: 2318 - protein, 37 aa, Methylobacterium sp.
MFKNRPNLHATAVMTLVCLGAANVVIAPASVLYLLYA

SEQ ID NO: 2319 - protein, 74 aa, Methylobacterium sp.
MQASECCIIRVSIAASLGWLIAITLMWKHGVLAALIVSPLFGTAAAIAAMTLFWFVSLFVSCEPIGPRASDTNR

SEQ ID NO: 2320 - protein, 94 aa, Methylobacterium sp.
VAKPAAPPQQAEGAPGSGQPPDSPGQGVDLNTASVEELNALGAGMIGRRIVAFRPYGSPEDLVTRRVLKKADYEAIRAAVAVRQTESAGAGRPD

SEQ ID NO: 2321 - protein, 84 aa, Methylobacterium sp.
MEAIGVEDRSGGRRDASARLRRIAAATGVPLAAFFGAPAPRPLAELSELIGLWQSIADQEGRNAILAVARARAAGTKDGAGGPA

SEQ ID NO: 2322 - protein, 97 aa, Methylobacterium sp.
MGLTAFAVFVIPWVLLAVFLTRSPSTLRLGTASAPWRSIPTHKEMARADRRALHPHERRAGETDGVSGRDQRVRTDPPAGGALGTSVEPTEPDDKLS

SEQ ID NO: 2323 - protein, 59 aa, Methylobacterium sp.
MLTMTLALLAVLIAGALCLGMISAFLPFQRPREEIELAEFADDEFFDIGGPIIDLQATR

SEQ ID NO: 2324 - protein, 231 aa, Methylobacterium sp.
MNTTVTAIASAILAGALLGAPTGAKAQAGSFANHGFGNHNFGAAAVGGGFANRGFSNPGIGAGAAGGFANRGFGNNAFGPAAGAGGGSFANNGFGNHNFGRPAVGGGFANPGFGHGFGAHRGYGHHRHYGYNRGYYGRPYGYGYGYGRGGYALGGLGLGVAVGGLYGGYGYPGYGYDTGYYGGYAPVTYGYADTETDRVADDDRYCARRFRSYDPQSGTYLGRDGRRHRCR

SEQ ID NO: 2325 - protein, 43 aa, Methylobacterium sp.
VTGIDGPTTRGRLQQIDTHALLTIGPHRRRSAVGSAREPEPVP

SEQ ID NO: 2326 - protein, 70 aa, Methylobacterium sp.
MLCTEGEGQRGVPGGTRAGPGAAQPVPRSDAAGEIGSARLLQGRREIVIRHGDHAYRLRVTASDKLILTK

SEQ ID NO: 2327 - protein, 50 aa, Methylobacterium sp.
LLVVLVFAALIGGAIGFAVVLPKGFLLALLAAQAGAAVAVGLVVLLTRRR

SEQ ID NO: 2328 - protein, 90 aa, Methylobacterium sp.
MSSESTGPVTVRGSVGVGAGVAPATVQGGPLPATSGGRDGAVGPLAIERFPRPVGHRDRPDARLRPPLSPDNPRHRVRRIDGARAPQPGR

SEQ ID NO: 2329 - protein, 53 aa, Methylobacterium sp.
MDRHGQEAGADTAAEAGLGTAGDTAGDAARDTARDTAEARAPSPARASARTAT

SEQ ID NO: 2330 - protein, 46 aa, Methylobacterium sp.
VAAVCMGFLRGMRSLPRWGRFGLWVWMGAIRARAVVSRLGGIEAMR

SEQ ID NO: 2331 - protein, 307 aa, Methylobacterium sp.
MRFDVRHISSCLVLAQELHFGRAAQRLATTQPGLSRLVAELEAEVGVKLFRRTTRTVEVTEAGRAFLAECRIGIDHLERAVTLARRTATGMAGVLRVGYMDFAINGRLPELVRAFSEFRPAIRLELSHVPSQSQREALLNDRIDVGFTLSAVENEHFESLLFDRDSYVALLPVTHPLSNARSLTLKDLASEPFVLGSGGSWSAYREAFFAICHRRGFHPTISQEASSSEGIFGLVAAGTGVSTYASCVRNVQRRGIVIRSLDDVPDTIATYATWMKPARSTSLEAFTTFLATVWGSAPARSNTRSKF

SEQ ID NO: 2332 - protein, 273 aa, Methylobacterium sp.
MKLFDADLVFPRVPATMPSPWMPLEVGRAMGAICKPHDAGGGTSFLGLHFDDHCFGPAPEHVAHAVLALPVRAFDLEPDTRREDLRKAFYLAAPGFGRRPDFTLGAGAFMVRSFEGADPRDTVYLIWPVRCDPGEAGLDCHNGMGRKAFRFAADGALRDVSADVLPADPLLSSDDRVRQTKYGGSVLFLLDDKLPYAPTMRWIMEFDPDSPPLEKDDPKAAGPWAHFGFVHWTGSRFELVDRITRSQWPCRKFHDAPACSTYPDDFEDPFVIP

SEQ ID NO: 2333 - protein, 117 aa, Methylobacterium sp.
MAVESYGDYRDYFDSKPVTAKRAPRSASQKMTPIDITTDLSAVRRRADGDRREMYRYDTGSRLIADMRPRNWDGGHVPVQPHSWSPDGFWSPMVQSREGRERPDQSFEGRGRPERFR

SEQ ID NO: 2334 - protein, 149 aa, Methylobacterium sp.
MRFAVAALLSAVPLAAAADDLPPPVAAAIAEVEAACGSAPATLDPFVIDRQDVNGDGVPDFILNVGGLRCGDEEVSQCGLMGCPKIVLASSKNGFVVVLDIYAHDLRFRPLNGRPAASADDEGWNCGSVRRGPGRTTFLWDGTRFACAE

SEQ ID NO: 2335 - protein, 29 aa, Methylobacterium sp.
MAWSAPVVSEICVGMEVTSYESAEIDTFH

SEQ ID NO: 2336 - protein, 31 aa, Methylobacterium sp.
MKPNTIAPISSDRRGNGPDRQSLPVAQGEEE

SEQ ID NO: 2337 - protein, 26 aa, Methylobacterium sp.
MMEFMNFVSTTSPYFGSGMISRFSAE

SEQ ID NO: 2338 - protein, 47 aa, Methylobacterium sp.
MTDLLVTLQEPAEPAGQAGPESETSALRAHIARILRRLPPAKATKTT

SEQ ID NO: 2339 - protein, 72 aa, Methylobacterium sp.
MVERYHFRLRGPDEVIEDEEGVLANSIEIAVAEATQLIAEMHARGELPDPDERWCVEIHTTDGVVLRSLQLY

SEQ ID NO: 2340 - protein, 122 aa, Methylobacterium sp.
MSGPRPIAVLAEDEEFSRLVAADMLTALGFEVLEAEHAQGALQHLEACDGAVLLYTDINMPGTMDGRALAHAVRARWPETRIIVCSGCDPREATALPEEAHFIAKPCGEKLVRKALKALHLH

SEQ ID NO: 2341 - protein, 624 aa, Methylobacterium sp.
MIIRHTRRLQRSGEAVASRDGRLVAPAPTEPDWDILGLIDLGGRATVVALLGPNDARAFRFLNPDGTALASCAADFLAAPWDGAGPLDWQAEALHTDDGDASNTRAMIEDLHLLIEALARAAAASPEHAVRVVTGGGSDPRAQAMHAALARLNAAPAGAPPHLPELVTKAIVARGGQETAHPDGGDLRFSIYLPMPGFRFVGYAADRNETLCTLIGKNSRLASALLDVRANTAYARPNLGSVGFDAATLVQVRLWRQYLLPALIDGAARSTRVGVVFEHAHISHAIWNELAAVDDVLSLGRAPAVFLFASCNEPISPVDAVFPELAGHVYRGIEGPLPLLQAAVAGAAIFLPFRSYRVSQRLADRLAALARSAEPALDARLTDAARRATIVLIGLRLENRQWVRQLDGYVALIRRLGRRRGERFLVIVDGHNTLAGAEGGYVESYCESLVPAEGSVPSIVRKELELIGALRARVADVSNVELMPLVPCSMGASLVAALHTDLFVTHFGAGLAKYKWVANAPGCVISSRSVLSGKDDLRIYDTEIFRENVSACHYFPAERVTDLDTSTNALHVPGSREREDFDLDLEEFASFVEQNLPKRRAARPHWLRRLTLFRTRAATDAARL

SEQ ID NO: 2342 - protein, 32 aa, Methylobacterium sp.
LVIHQGEQEMLQRRVFVPALPGERQGAVEGLF

SEQ ID NO: 2343 - protein, 45 aa, Methylobacterium sp.
MLEPLLFIGLIIAAVAAATRLGIAAAAPMAPSRLDAWDGRADADA

SEQ ID NO: 2344 - protein, 43 aa, Methylobacterium sp.
MATKMMTRGMTVTDHIVAWSMLTGLALAVLQLALTAALPTHFV

SEQ ID NO: 2345 - protein, 210 aa, Methylobacterium sp.
VVDEGIRGEDHGREHDQPDLLTVAVALIGIARVARFGRPVLLRVARVRGLRRALGRSLPVIRAGVVGRQAQGRGRDESREQRGRVNRELRPAGALRDREKLGIASGDLVDESAEIAASHRAVQDLGRDDVAAVDPGEMHDGVAIRPAEDEPGVRLVAQALLAADLQAGPDQRGLDAVEFRELLLRPAALARRCGSEERDDRAHRDLTSAQ

SEQ ID NO: 2346 - protein, 139 aa, Methylobacterium sp.
MARRSGTPAGTFAGPRRAWIGSACLSQHETRRLIRTRAPGRVRWNGRRLSEMARRIGAPAPPVAILTAALIGGLPRELREVRCWTQARIGRRAGTAGDAVLHPFGCTCADAGGIRIRDRVVPSPCLRRDVHSQTVVRAT

SEQ ID NO: 2347 - protein, 46 aa, Methylobacterium sp.
MAGIPGVRCRVLVMFRRHRAPNRSLASLPVIRFGGSGLDLQVGCRC

SEQ ID NO: 2348 - protein, 38 aa, Methylobacterium sp.
VNGGTLCVRSIVLEVPGRLAASIVLPGAWIGSAHLRAG

SEQ ID NO: 2349 - protein, 221 aa, Methylobacterium sp.
MREITGSLFQSLDGVIQAPGGPEEDQTGFAHGGWTFPYFDASLAGPMGKLLGGDDELLLGRRTYEIFAAYWPHNAEQPIGATFNAIRKHVVTGSDAALDWNNSRRLAGDPVAAVTRLKESEGPDLLIQGSSRLYPALLPAGLIDRLVLITFPVMLGRGKRWYADDPAAARTWTLVEQSHSPKGVHVAVLARDGAVQTGSFASKPPSADEIALRERQAAGRW

SEQ ID NO: 2350 - protein, 114 aa, Methylobacterium sp.
MAVACPVLTPEERKASEILDAAQRAMMETVHAAVAEAAARVRQQSLDAGLDLAPPPRAYFESVVHQRMYLTLCGAAVGTFAGGDARTAIGLIRNQQLIANRYWAAGIAVTPRAP

SEQ ID NO: 2351 - protein, 92 aa, Methylobacterium sp.
MPSTPPRLAFSHAGQDFIVKARPVSDGIEVRGFWHARSRGRTRFFVVVPADALEKAKRPDWADPVQAALKLVRKQIVSAIDEGEPLAEDPQP

SEQ ID NO: 2352 - protein, 32 aa, Methylobacterium sp.
MALKIFSYAMIGAFVGGLAMTVMGSAGVLMGL

SEQ ID NO: 2353 - protein, 71 aa, Methylobacterium sp.
MRRTAEILTTLILFTVVMSALGWVASITAPGIGDWLSARIGEGGIWAGFAVLWVTAGVLLYREKAGRAAGK

SEQ ID NO: 2354 - protein, 841 aa, Methylobacterium sp.
VGDARPRQTTARVLLASLIGTTVEFYDFYIYATAASLIFGPLFFPAALQSAELISAYASFGLAFVARPIGGAVFGHFGDRIGRKATLVASLLLMGLTTSAIGLLPTFALAGWLAPVLLCLLRFGQGLALGGEWSGAALLALENAPPGWRARYAMFAPLGAPLGFFVANGLFLVLTLTLSAEQFADWGWRVPFLLSVPLVWLGLWVRTNLGETEEFAAAVKDAQPPRVPLVALMRDHAGQVVAGMFGVVACFSLFWTATAFALGYGTTTLGYSRASFLTVELGAILFMAAAIVVASWLSDRLDPARVLIVGCAGTIVSGILLAPMLGSGSLATIFAFLAFALWVMGFVNGPLGAWLPSLFPPQVRYTGTSVAFNVGGIIGGAFSPMIAQALAAQSGLTAVGFYLALTGGISLIAFDTSARRRALDALARSERRYRALFEQSHVALCEVDLSEAQAHLAEARATGALGPDLRGQADAALVAALVAECARRIALVDVNDATVRLLGCGSREAVLGSMSRFLPPGNDLVLPLLQRIDRAGGRFEAQGRLIRADGREVTAILVVALPDDEAALDRVACAMIDVTERERAKEALLAAQAELARAGRVSTVGAISASIAHEVNQPIGAMVMSAEACLRWLRRETPDLEAAARAAERAVRDGMRASRIVQRTREQLRRDRSQPEILDLGSLLAEVATLLDREILAAGATVRTVIAATEARVLADRVELQQVVVNLVTNGLHAVRDLPEPRRALRIALTAPAPGRLRIAVVDSGTGIDPEQLPRLFSPFFTTKRDGMGIGLAICRTIVESHGGTLTGGNNDGPGATFAVELPAAEPGAAGGAAAEPAAAG

SEQ ID NO: 2355 - protein, 76 aa, Methylobacterium sp.
LADPEFEIGKFGPNDKRSVLRQIAHALGVPEDAFLDESEALATIDMTGDLLRVWHALTLSDRRLLLQMARGMISRG

SEQ ID NO: 2356 - protein, 69 aa, Methylobacterium sp.
MSDDVAALLLALATENAELRQQLATAQDMLMETAIDAGHLHARIEALQAERDAWQAEAERLARRPPRSL

SEQ ID NO: 2357 - protein, 64 aa, Methylobacterium sp.
MAIDRSGERAALDTEVEDTQDTIAKLREAADGTPPGHSSRVALKKAEEKLAELVKHITRRDRTG

SEQ ID NO: 2358 - protein, 42 aa, Methylobacterium sp.
LIALSGIERARTAPTCGGAAILDLALCLILSVTVVGLLLLAL

SEQ ID NO: 2359 - protein, 74 aa, Methylobacterium sp.
MPKHARLALAAALLSALAAGAVRADGTSAFGAANAAQLRGYTASPAQIYVPAGGPSAKPAAPATQRPKAPARSR

SEQ ID NO: 2360 - protein, 65 aa, Methylobacterium sp.
VTICARTGGEPPLCRIAARCTSEALLREDLFREDGRPFSGTERLRAQAISQGCYATLEAAARSAR

SEQ ID NO: 2361 - protein, 112 aa, Methylobacterium sp.
MRKIGIIATAAAMALGSVAVTTSAEARPYGYHGGYGGYGHGYYRGRRGIGTGAAIGLGIAGLAAGAIAAGAARDSYYGGGYGYAPSYGYGYAPVYGGYGYAAPGYGYYGYGY

SEQ ID NO: 2362 - protein, 33 aa, Methylobacterium sp.
MKGFTKIVSYAAAAAAVCMLAVVVVQSAGLLAG

SEQ ID NO: 2363 - protein, 509 aa, Methylobacterium sp.
MAAALLAPASGRAETTVKAVLEAEIVTLDPYFTTAYITRTFGYMIYDTLFAPDATGVFRPQMVDTWSVSDDRLTWRFTLREGLRFHDGAPVRAADCVASLRRWAARSALGGRLMDVTSSLEPVDDRTFVLTLREPYGLVLDTLGTTSSPTPFIMPARLAATPPTTQLTEVVGSGPFVYDRTAHIPGDHMLLRRNPDYRPRPEPADFLAGGKVVKVDALDIRVIPDGATATGALGTGEIDYMQYAPFDLIGQIEANTSLAVMNFTGSHRFTGHYRINTASKPFDDPAIRRVLLRLVDQREVLDGFGLDPRFSQTCDAFFICGSPYETHVGTDLLHDPSVAAARAALKATAYKGEPVTVMVANDLEAARVSSTILADRLKQAGFTVDLQVMDWAALLARRTKKAGWSLFGIHALGLDLSSPLTNSAINFNCKDAASSGFMCDPRMVALFDRFAREPDPDKRRVIAGEIQTIVYGEGLVVPFGQFAQPAAYRRSLTGLIPSAIPLFWNVAKP

SEQ ID NO: 2364 - protein, 88 aa, Methylobacterium sp.
MLKSLAAAALLAVGIAAPASALPVAGSPLPAAQDGLIQHVYGGCGPYGHRGPYGGCRPGGQWGGYVGRACPRGFHLGRGGRRCWPNRY

SEQ ID NO: 2365 - protein, 45 aa, Methylobacterium sp.
MTLLTALSLLPFAAIANFALVVALANHFDADKPATGFTGPVPNLA

SEQ ID NO: 2366 - protein, 63 aa, Methylobacterium sp.
MSVSAGQEDQMTAPFSLIRRWLDCRRARSELASFSERDLADLDLVGCDVKRIASARSGRRGAA

SEQ ID NO: 2367 - protein, 48 aa, Methylobacterium sp.
MRYRAVSVLDVSAMASEENPTDETLMLREHIRRILRKLSRARAELQYG

SEQ ID NO: 2368 - protein, 101 aa, Methylobacterium sp.
LLSSPFDRALSTIPASIGRGAESIGDDVANATFEILKGIRARVAMPAMAGGFDARVSAIAAAVVALENRSGCRSSAERMPCAAWEIDRKQGTRQSDTIQLS

SEQ ID NO: 2369 - protein, 224 aa, Methylobacterium sp.
MDHAADPDPVLIRLREGFERVALVLRADLWAAAGDAGLNPTQAQVLALLAGRPGGLRAKEIAAQLAVSAPSMADTLSALARKALLTRAPDSTDARAVIVRLTDEGRALGRALAAATSQVMSALARLTPPEQADLLLTQIKLIRTLQQAGAIPVQRMCVSCRHFRPNAHPGEAQPHHCAFVNAAIGTRDLRLDCGEHEAADPDVQAATWTSFANGSPPLRAPRET

SEQ ID NO: 2370 - protein, 239 aa, Methylobacterium sp.
MTRIKARGVGLVAAALCALSTGASAEPIRAQPNPAVLASFDIVETTIATRGDTAVFTTRVRGEAGKDKPDATGKFEGSSVYAYVWPTTLDSDAIGFDKAQGIVALAVTFHPDFDDAAYGARNRHVWHPHWVVLARDAACGGGLKVVDIPDGAKPKVPPTWPKVPLLIDSPDYPTTFRGDTVQVEIPVSLITGIKGASFDGVTSGLKVNGNLHAPLLCVSDVFKVASGNLSLPGKVTPQK

SEQ ID NO: 2371 - protein, 182 aa, Methylobacterium sp.
MTILAPELVTGRWFNTPAPLSLAALRGTVVVLHAFQMLCPGCVAHGTPQVEKLHRMFAGNGAVAVIGLHAVFEHHAAMTEVALEAFIHEYRLPLPIAVDRRGDDGPIPQTMRRYGMRGTPTTIVVDRDGRVREHAFGQVDDLALGILVGSLIAVPGTGSVRGALAPDGCDEAGCRLPEETRP

SEQ ID NO: 2372 - protein, 540 aa, Methylobacterium sp.
MSSFDESVARQQRFMGPLLVAAILFGLAGLPVAVWLDLRGLSERMLATQAIETGRIIDQMRSFYASDVVQAVNAATGRVETRHDYKGVPNAIPIPATLSLELGERISGGDGAVKYRFVSDLPFKDRKPHDLDSFETQALADLRAHPMTGFVSETTGSIFDRQVRIAAPIRMESACVRCHNAHPLSPKTDWKVGDVRGIQEIVLHQPIAANVFAFKYLLGYFILAALAGTTFLLLQARQSRLIDRMNRELTESNGFLASVSVQIAKYISPQVYKSIFSGERDVSVATERKKLTIFFSDIKDFTATTERLQPEELTALLNEYLTEMTAIAVRHGGTVDKYIGDAMLVFFGDPESRGVREDAQACVRMAIEMQKRLGQLNARWRRSGIERPFQARIGINTGYCNVGNFGSDERMDYTIIGAEANLAARLQAAAVPGGITLSYETYALVSDIVQASPQEPIRMKGISREIVPYAIEGDLTAEAPETIFSEHARGIDFYVDVDALEMEGAARLRKRLLDTLAAVDRRMTGAGTPSDDGTRPSAAG

SEQ ID NO: 2373 - protein, 629 aa, Methylobacterium sp.
VTTPLDRRRLNLRWLCASCLIATCGAALMGAALRMSVDTDLAPAKPAFRQGPAQVAEGQGVVGQRGDRLVRRQLVASDREEFSAPVTHQVGAREIIRTQPFVRLVTSLSSGDAVDGQIPPFDPTRQLAEDGEVAPVADEPGDDPSGTTVTITRSALAGTPVPDDAPGLSDEDVTALVERQSDEARQTGPRIAVPLAPQRLLSQILVAAPADAAATAAGADTGRDPFHAIEVRVVPENITDLAETQPASGLSLTETRDVVLKRGETLADALAANGAEPARVTAILAAFSEHARTGLAEGQHVDLLLVRSHAGEAARRIARVTLYGAGGVEEIVAERDSGGFVTVAPPSAQVAASHSGDDGDGEGSGASLYRSIYEAVLRNGLPGILAERIVGIFAFGLDMQRRVAPSDRLEVLFSPSEKAGGAPEVRYVALTLDGVKHRAYRFEAPEAGTASYFSETGNSLRKFLMRMPIADGRITSPFGTRVHPILHYARFHNGVDWANKAGTPIMATGDGTVAYAGPRGGYGNRVEIHHANGYVTAYNHLQRLAHGVQVGATVHQGQVIAYMGSTGLSTGPHVHYEVSVNGRFLDPMTIRLPDSQGVSPRLMTAFERQVAATNALRHHGALAMSALPL

SEQ ID NO: 2374 - protein, 403 aa, Methylobacterium sp.
MNGVAPSIRPAARAGDPDAAFLATVATLRPLIAEHRSALAVGPDLPEPVAEALIDAGLAQLWLPRGLGGPEAHPLSVLAAIEALAELDGSVAWCAAISSGGASRFADLIDADVMRSLIPAGRKFAGSGSGQPTGTAVRHGSGWRINGRWSWASFCRYSSVSALMCVEIEGERPKLDENGRPSLRGVFIASKDVEVVGNWNAGGLRASGSHDVACTDIWVPNEQTIDGASLMMPRDRKPLYMLPMASAAAIAAIGVPLGIARASIDAFIDLAQTKTPHGGKVPLRLREDVQVAIARAETSLGAACAFARDTVSEFWWEAENGRPITLAWQAKLRRACWYAGHVGKQVVTSMYEAAGSSAVLEDLPFARQLRDVYAACQHMHYQDRLLVPTGRILLGLESDAPLI

SEQ ID NO: 2375 - protein, 54 aa, Methylobacterium sp.
MPGGIGIGRGDPLRPAVTRTARFSGPEGFHPGALWLAAAAPLLATLLLLVRLAA

SEQ ID NO: 2376 - protein, 32 aa, Methylobacterium sp.
MMLKAFSYAMIGAFLGGLMMTVVGSAGVLMGL

SEQ ID NO: 2377 - protein, 72 aa, Methylobacterium sp.
MRLLWDRVLDRAWLGLAAAAAVTVAVHEGAAVGRLAWTLGSGGAALAAPAGGGRAVPPARAAACGPAPAPSP

SEQ ID NO: 2378 - protein, 776 aa, Methylobacterium sp.
LGLYSKLRAALAEDALLARGVKRSLVDGLYQPFASLAVGAASGTIVATAAAFWSDDRAITVTAFAVGLIGLTRIVLARIYLTKGPQKHDRYELWETYFSLGAFAYAASLGILSFLITTRSSNLALQVITPTFTIGYAAGISGRNAGRPLLAIAQVLLSAMPLSAGLLVSGDGERASLGILSLLFAYGMIDITLSTREIIVSALVTTREKEALAEKFQAQANLFDIALRNMSHGLCMFDARGRLQVWNDQFLSISGIPSNRIHTNSTAKSLYASSRAIIDERAAGRGATLSTFSAASNALRSGNLVLILPDDRVVSLMQRRTAEKGYVIIFEDITERRRSEARIQQMARYDDLTGLLNRSSFKAKVSQALKASASSKGAFAVHLLDLDHFKVINDTLGHPAGDRLLQMVADRLRGIGALSGSVARLGGDEFVIVQQSVTSPAVAEDLAQRVLQELERPFDIDGTHVTVGASIGIAIAPFHANDEDRLLKCADIALYAIKGAGRSGFKIFQHEMEAATRARHALESDLRAALTNGELELHYQPVVDASTGAVVSCEALLRWQHPVSGYIPPSDFIPVAEDTGLIVQLGDWVLNEACREARNWPSTVSVAVNMSPRQFGDPQLAFHVIGALNRSGLPAHRLELEITESVTLGATHKIVDTIHTLRQLGIRLSIDDFGTGYSSLSSLRNFAFDKLKIDRSFVWDLDRKAESTAIIRAIVGMGRSIGMAIVVEGVETETQLSILRAEGCDLIQGYVFSRPVAAPQIRAMLATAQPVTKLAS

SEQ ID NO: 2379 - protein, 86 aa, Methylobacterium sp.
MEQTMTPRTAHPVAPYLLLAELGAALFGGTAASAEERITLEIIGAVRMTGPGMIRPADATPVRAEDTQAREAGVERPSERIAARHN

SEQ ID NO: 2380 - protein, 213 aa, Methylobacterium sp.
MVKSAKADRAREDAAASGEILAAIPAHLDFLFDERPLLPDENAEQYDALLRSFIQQVRPTDVIEAIWVKDVVDLIWEARRLRRWRRQILVQARLKAVEDFIVPALKNESAFGTLEFGKPSPDALAAGWLTGGEIKKERVDELLLRRGVTTVDITAHGFLLSLPSIERIDRLASLADHRRDTLLREIERKRASFAQKVRSAAMEVLDVEHTESR

SEQ ID NO: 2381 - protein, 29 aa, Methylobacterium sp.
LRGIARRRPDGAEEESWPFVDNADPYSVV

SEQ ID NO: 2382 - protein, 43 aa, Methylobacterium sp.
MIGIFQPFGVLHVWTSIGRPDTAAMLCLLLDPIVGGAVVLRRF

SEQ ID NO: 2383 - protein, 271 aa, Methylobacterium sp.
MGVARTRVDRRTWSVHGAAKRNTAIIQAGLARIVEDEILPRLALAHQADPPSPASTTRSPTPERVASLAQALMEGEPHAEWVRALLEEGLSLDALLLDLFAPAARYLGELWEDDAADFLDVALALGRLQNLTRALCADLEGVDVTANGRRVLLMPCPGETHLFSLALVASFFREAGWDVVLTNGADEDPASLVRAEQFDLVGISLSCDILLPVMAVSVAKLRAASCNPDLRVIVGGPLFVREPASARVVGADAVAADAQSAVRIAEATLAR

SEQ ID NO: 2384 - protein, 229 aa, Methylobacterium sp.
MPDRSLRAVWSDSLMAEVGARLPLFDDLSPDTIQRLSAEGFGRGLLTASLRARLRKAGFPDLGHLAQSSPVAIATIRKFGPIRVERVRHFILDVLARWLPGAREMHTPEATRVRRLDRLRGLPAGCLPLAAGQIAALRFADASCADVAACSRLGLLRTGAVTSGDVDHVVAALTRLARASDPVPPRPLEEAGAAPSCDAATGAARRAALLAEQDREWDEAAPTARRPRR

SEQ ID NO: 2385 - protein, 69 aa, Methylobacterium sp.
MRKLTRLVVRMAQRPGLLESGRLIDQLTDLEAEGLARNISWRSIETIRAARLKLRVEGLMPTSSLPLAP

SEQ ID NO: 2386 - protein, 101 aa, Methylobacterium sp.
MSDMPERIPAMIRVRDAARSARFYRATFRLDTADRPGFETFTPIDLAHAASGLASELTVNTGHDGACGLGVGAARGTARSCFIDDPDEHKIEVLARGWRFA

SEQ ID NO: 2387 - protein, 261 aa, Methylobacterium sp.
MDLQLTGRSALVTGSTAGIGLAVAKRLAAEGAEVIIAGRQQAKLDAAAAAVAAAGRARAILADPATAEGAAALVRAAPAVDILVNNLGIYEAKAFPDIADDDWHRLFAVNVVSGARLAQAYLPGMQARGWGRVLFVSSESGIVPPPDMIHYAVTKSAQLTIARGLAQLTKGSGVTVNTVLPGPTRSDGIGDFLKSVASDPDLSPEAMEAEFFRLHRPLSLIQRLIEPDEVAAMIAYLASPLAAATNGAALRVEGGIVPTVA

SEQ ID NO: 2388 - protein, 73 aa, Methylobacterium sp.
MPRWLQFALGLVTLIALAAGIVRTLVRHMPDAAASWLGPWAYEALILLLAVSFVAIIVRAAQGYRSPRSDKVR

SEQ ID NO: 2389 - protein, 128 aa, Methylobacterium sp.
MLRRLTILLPLLVSTVAHAAGPGARAVGTFEHQEDGYEQGVEVKAAGAAGFTAQFSTGTKGCGGEVTMKGRPTGPDTVVFSKTEGGQTCRITARYASDFRSVVLEEQGCTMWHGASCEFQGTLKRKGR

SEQ ID NO: 2390 - protein, 76 aa, Methylobacterium sp.
VPYSEPMSASTGHGLHDVAQMLRQVVAIDLLHDLLVGAERSSDLAGRHARPHDPRREGVGQCAWQLSKSALTLDDD

SEQ ID NO: 2391 - protein, 320 aa, Methylobacterium sp.
MPVTIPDRLGLGVADAGNGLSARAAEARSRLVRWIVGKRAAARVPTRILTDDEIAAFRRDGFVTVPAITTAEELDTLRGAYDRLFEEARGWKDGSLFDLVDVDRGASEARSPQLLNPSRFEPLLRDILFRANALAMSRQLLGNRAALVFEHAIRKPPKIGAATAWHQDEAFYAAYTNYRAITVWMPLQDVSPENGCMLYVPGSHREPLLTHRSIGGDPRIHGLEALGVPVERAVPCPLPAGGATFHDCRTLHCAGPNLSAGPRRAYALGFGVRAPEHTLRHEHPWNAEKRTLRQERERQARGGLARLKAGAKQQIKALIR

SEQ ID NO: 2392 - protein, 88 aa, Methylobacterium sp.
VHMQHVSADNDRVAQWCAAHPVLLAFGLCAFGLAVVAAVWGLGILTPATATVIAFIYVACLGGFLMEYFGINELIRGVRCIWFVLTSV

SEQ ID NO: 2393 - protein, 76 aa, Methylobacterium sp.
EYALPTDSFLNFFRSSAVTLKVEGLYVSLDRQKNSAGGVFYGNLLPPNGTAYLNGAAAKTEFAVVRAGLNYKFGSY

SEQ ID NO: 2394 - protein, 87 aa, Methylobacterium sp.
LIVRWIGAAARKRGRAANREAPPAPASDNVTRLSWADTFGRAISADPQRSKGPATVLAMRPRASRRACGPIVRARQAVSAAIPTSLP

SEQ ID NO: 2395 - protein, 39 aa, Methylobacterium sp.
MRYRHSGINELPIAESDRKFHGPLGRRPDNQPGLSHFGF

SEQ ID NO: 2396 - protein, 182 aa, Methylobacterium sp.
MSPEYVRPYVKAQKNDDRDAEAIAEAATRPTMRFVTLKSQAQLDMQTLHRVRDQLVGERTALMNQIRAVLLERGYIVPQGRAKLAACLASLMDEAAVPALSARMRVLVAEVRERWQDLDKRIAALDAEFAETVRSDEHARRLTTIPGSARSTPRLSWRPSAMSLPLHGGVTLQLGSASCPGS

SEQ ID NO: 2397 - protein, 267 aa, Methylobacterium sp.
MYLLGTALGFLVFLGGDGVKLIRSSADLLGLAILVISAGLMMPFPFGDSDRPAWPLNNPSWSLSFELIANVAYGYWLWRLGKTFLSALAIVGLACLGWTIFTFGSIETGYTLATLPGGLARIAFSFPLGLLIARLHDEGLLAAIPTVHPFIPVAALIGMLACPLFLDRWIIEILALSIMLPLVLILGIRSRDLLSWRDASSALGGISYPLYILHAPIFVAFKTFGPTLPAHGVEAFATAGAASLLAVAVAALATRVNSRFLLLRSRT

SEQ ID NO: 2398 - protein, 105 aa, Methylobacterium sp.
MFTKTARTRLAAALAFGGLAFAAPAMAAPLGRDAGLQAEAGDVQTVQYGYGYGHRHGGWGHRGYGPRHHHHGWGRGHHHGWGHRGFGPRHHHHGGWGHRHGYGRW

SEQ ID NO: 2399 - protein, 68 aa, Methylobacterium sp.
MSTSANPPDPCAETAALRKDKLRAHIRSVLSTIRSHHTGRGAPSIRATGYVLGGWFCGSAAATIPLFT

SEQ ID NO: 2400 - protein, 70 aa, Methylobacterium sp.
MKHGARNDIPATVTAIKRGDVMAQVEVELVGTAYRMASVMTVDSLEELGLKEGDTVHVLAKAVNVLLVKP

SEQ ID NO: 2401 - protein, 58 aa, Methylobacterium sp.
VKVFRIMQAATGAILWSGAALDPMAALDAMARAAGFRDRTRIPNHLRAGGLHVEELQA

SEQ ID NO: 2402 - protein, 118 aa, Methylobacterium sp.
LRYQALVALALAVSAHATHARAQTQEEQALALLRASSAQSAIITFCGKHYAIDGTTALRISQTARDVATKVLGQERANAAFKDELARRYAEVKEVGEQQWCTDQRDELSEGDVRIFKN

SEQ ID NO: 2403 - protein, 107 aa, Methylobacterium sp.
MDENGLEFLRTIAERKVESSAARALNRIAQSLDLPIEAFYGSDHCGSVDRLTLEGETERVLMLVGVHLRRLDPAARRRFGEAVLALVGPVSAEACARIAENAERGDP

SEQ ID NO: 2404 - protein, 105 aa, Methylobacterium sp.
MLWSCLILITEQAFVPVQWERASVRREAVLEGLVLGVVGAVVGTGALVFSMGAIEISGITHCMDWQRRHDLVRPDDGPLPPLASERLGSQMLKHHAAAPGRTDRM

SEQ ID NO: 2405 - protein, 29 aa, Methylobacterium sp.
MTAKRALITGVTGQDGAYLAQLLLQKGYA

SEQ ID NO: 2406 - protein, 113 aa, Methylobacterium sp.
MAPDMSRYRRLPGEEPRYALAEARTLIAERAYLFSLYAVDVVASDGLTGRHVLAVPVAISAVSITVGLVLTEADSRRAEAGDLAGVVSLAQAVQGGYRRFRTFPANGLGRFVL

SEQ ID NO: 2407 - protein, 89 aa, Methylobacterium sp.
VLRKFLLAALLALGFAAAAPEGASAAPIGPGLALPAEAAPAVAEKAQYYYRRRFYGPRPYWRRPYYGRRFYYGPRPYYRRPYWRRRFYY

SEQ ID NO: 2408 - protein, 50 aa, Methylobacterium sp.
LLGFGQRLEDGAGIPGPAPDEAIRPDRDEMLESYGDRIELAAGGWSSAGP

SEQ ID NO: 2409 - protein, 334 aa, Methylobacterium sp.
MTGPDRPGGRAPPRRDQASGRVTPPGHGDGTAAFEAHRPQLLRIAYRMLGSRSEAEDVVQDAWLRWVAADRSGVAAPDRFLAQVVTRLCLDQIKSARARRESYVGPWLPEPLVEPLVEPGADGVDEDDLTLTLMLALERLSPLERAAFLLHDVFGLPLGDVAETLGRAAPAVRQLAARARRNVRAARPRFPVTRDEGERVARAFFEASASGDVAGLRTLLADRVTLSSDGGGKVLAFVNPIRGLERLLRLYAGARRKWGDGRAALVGFVWIDGLPGYVTRERGGLLQTTALAIENGRIDAIYITRNPDKLRHVARAVAAGPGPGDAGGPVARRS

SEQ ID NO: 2410 - protein, 255 aa, Methylobacterium sp.
MHPAVAAANAFKAVHDAGQVPDYERILRQGYSRFLAPGDVVVDVGAHTGLHLVAFVDIVGPTGKVHAFEPIPFLMKDLAGRFGRRPEVELHDVALSDTAGRTDFTVASVPGESGLLARYFSSPAITSKTIKVRTERLDTVLGHVPAVAYIKMDIEGGELNALSGAAQLLRRCRPIVSVEYGWAGYSAYGHAQDSLYRFAESHGYICADITGNLIDDASTWLAVSDYVTWDFFLVPQERRADWAALFARRPEPGPA

SEQ ID NO: 2411 - protein, 35 aa, Methylobacterium sp.
VALLALYALALQGVLGGLASAAAGPDHVLCLADGG

SEQ ID NO: 2412 - protein, 84 aa, Methylobacterium sp.
MEVPMDRKQALELAIFVIALVPFLRCLMPSATRSRGPRRSGSLSYDSGSGGDGGAIFGDGGCHGSDGGSCGDGGGGGDGGGGGD

SEQ ID NO: 2413 - protein, 445 aa, Methylobacterium sp.
VEFRFDRKEPGVWISAGTHVALLALALVSVAAPALPEAQEGVPVEVITENQFSEITKGERQADKPMPNATSRADRKAEKFEDREPENSKQDAPTAPTRTAEMKLANADEMPLRAEPDPQEAAQAAKAAEKAAQEKRDAEKAAAKAAEKAAEKAAAEKAAAAKAEAKAKAEAVAKAEAEKREQLEKLIEKQEAEAAAAAQKAAAKKAEAAKEAAKEAAKKAADAKAKAEAEAERQKEIAEAKAEAEREKAEAAAKAKAEAAKAEAAAKAEAAAKAKAKAMADAKAKADAEAKARKQAELADKFNAGDIRSVLASKAPSQSTGATGHAVQKVAALGAATGNAQRLSPSLRDALVGLLQQQIERCYSAPPGAAQGVVLPVLDIRLNPNGSLSTEPRIMRGGASAVDQSIAQAALRAVRRCAPYNIPATYAPYYNDWKAINAEFEFTAT

SEQ ID NO: 2414 - protein, 60 aa, Methylobacterium sp.
MTILMAVALAIALLGIALTSAAYRFAPVSKHIASGDIVLVCGISTAALGSLGALLQIFTA

SEQ ID NO: 2415 - protein, 28 aa, Methylobacterium sp.
MVGADHNGTRILGHTVGEPAAYVQAFRR

SEQ ID NO: 2416 - protein, 99 aa, Methylobacterium sp.
MRTGMRVRGVDNRERRHWFYDSRLLVFGFCLTAFVAIFWQVSRFEGFQPIFSCARTTDVDRQLLRLGMDACMGNARTQSDREGCMRTVHLLACMKERWR

SEQ ID NO: 2417 - protein, 50 aa, Methylobacterium sp.
VLLDETEMTVAESDRSFPSRTQASAAALAFAKLVARASRSLNGGASSGLL

SEQ ID NO: 2418 - protein, 74 aa, Methylobacterium sp.
MLDVVARHQFSIKRFPIPTNVASTSAMGIHMDLRDALAAYLDVGTQHIVGLLEQRSATQIEQYGANLHAAMTAP

SEQ ID NO: 2419 - protein, 100 aa, Methylobacterium sp.
MGSKSPVRSRSSRAAAPEDDLFERSAPPHGPGAGRRLQRIADALQVPATSLYGPPGAERGAGVAGGRADEADALLHAYRRIDDPEIRRRVLTLVQDLAAR

SEQ ID NO: 2420 - protein, 202 aa, Methylobacterium sp.
MPKTNASVGQTCLEAFQIALDSADMIGHWAWDPATDRVRVDALVALLFKVDPTAAESGIPLAVYEKAIHVDDRGRVDALIRRSVAAGSSYVAEYRVISVDGRMRWVLARGRFTSDRGGRPTGGRGILVDITALRAREAIGGATAPDLGDTPLDRAVEHALAAQDAIAALGDAALKAEADALLMALGRRLARRQVAERRRRLN

SEQ ID NO: 2421 - protein, 79 aa, Methylobacterium sp.
VPDLRRRALTLTRDAIAGDVQGDDLVRLTLLKAWERRAAFRPGTGMPAWLDTFLRSRPAGGRAGPTGLSRNGVSAEMAR

SEQ ID NO: 2422 - protein, 55 aa, Methylobacterium sp.
MLIPAPTIRRLLMLGLVLVALVALADGVARHELRTAARAMTLADAAPQTERASDE

SEQ ID NO: 2423 - protein, 27 aa, Methylobacterium sp.
MLRGGLLWLLGIPLPIILLLYFLGVFH

SEQ ID NO: 2424 - protein, 76 aa, Methylobacterium sp.
LQSDTGCPRPHHAGDATADMMEHAAEEQAGLRVRIVVRGLVGLDERRHQMFRWTRVVAGCRRPGDGLLAGAPHQIA

SEQ ID NO: 2425 - protein, 26 aa, Methylobacterium sp.
MTILDPITGELVTIAVPRPRPQAGPR

SEQ ID NO: 2426 - protein, 37 aa, Methylobacterium sp.
MTSGTMMRGEAPANVGVMVQGHDALGRDRPDPFRPLP

SEQ ID NO: 2427 - protein, 99 aa, Methylobacterium sp.
VLALRHDRRHRGQLDLLGDADDLCRTSGVQAGAAARTRLGTTRDDCIGIIAQHPAVTLVRGLAPLGLECARCSLRSVTGGLDEVREVLSGCCSHSTTLS

SEQ ID NO: 2428 - protein, 324 aa, Methylobacterium sp.
MRRVFSTAGTHPRTRFKLWQEVVAERIGPIEQRRRADGPFAGEIEIGAVGPLTFSRITQSALTTTITADTVRRRPDGLIRVNFRLAGSSTFQQHGREAVQGTGDLTVIDHHPGVLDARTDGQTLVMALPRERLEGMLGPARLFAALTMPAGSATTRLVTTFFGDLLRVNRQLSPEAAERMATIGVDLIAAALADRMAREVPHSLHGSVVVQRAKAHVEANLGDQTLDPPRLAAAMGVSLRRLQELFHGRGQHISDWIWERRLAAAARRLSDPISLHRSIGLVAYECGFANQAHFARRFKDRHGLSPRAYREAAALRLSGSQPDP

SEQ ID NO: 2429 - protein, 137 aa, Methylobacterium sp.
MAQEMRWQKREGDGRVHLAYEIPDSGAQGLALTCDTRGGQLSVDYYDDRDRARDGTRAEVEFASEGGTLSLPMRAKQLELDDQIVLQTTTTLTQDWVRILSGKTLRVTLSGDTQRIPLAGARSGLAALVAGCSRPSR

SEQ ID NO: 2430 - protein, 209 aa, Methylobacterium sp.
MARRVATTGGAGGTGILVGLLGLCLAGPALAGSTSVTARPGERVRLDGYATHETRPGCPSVPAAAIELVTPPRGGRIEQRREFLVLGQNIDGTPSRDGCQDVERDARTLYYTARPDFAGHDTVSVIVTFVTGEEATYTYRITVPEGEGRRAPAVSQAPAPSDAGLARPAPAARAAPAERATLAASPAATPAPAPREASTGDFLRDAARG

SEQ ID NO: 2431 - protein, 200 aa, Methylobacterium sp.
VSAVIQLGELVMILDLHRQGLSVTAIARQLSLDRKTIRRYIARGLEPPAYTPRPPRERRLDPFTAYLRERVAAYPALTGSRLWRELKERGYAGSTRTANHLNPSSLPHRTINALYTLELHIEAGVVMQASECCIIRVSIAASLGWLIALTLMWKHSVLAALLVSPLFGTAAAIAAMTLFWFVSLFVSCEPIGPRVSDTNR

SEQ ID NO: 2432 - protein, 39 aa, Methylobacterium sp.
MKRQRETGAGTARFRADAAGAAPAERVPGLGLGVAAGRA

SEQ ID NO: 2433 - protein, 182 aa, Methylobacterium sp.
MTAIAIITAPDRMWIASDGAAYTEPDGILRHIAPKVVLCPDWDCVISSRGMGLAAEAMRMRGLRHNARDFDELVENASELAEVAEADLSLSARGVTHHFTLILSGYSRSRRTFETHTVRTRPGPGWDADAGRIVELPPFGVSRQPALLLLPEPAEEIAAHFGLELPRGQANFQLDPPSVSRT

SEQ ID NO: 2434 - protein, 199 aa, Methylobacterium sp.
MAQAALSLAAFQTAYPSAEPRRPAPPRPSYVETAYDPVVRTRAPYPSAMRRARRRARLTALIALTGVSLAGWAVFSHPQGPVRPEAESVAAAGPVPQAAAAPRPSLAWMLDRSPALGAGTATAFGGEAPPVAGFQVAAAAPSPAVREIARQVAQAERARAAQVRMAQAKAAEKVADKIGEKAGEKGAGAPVRMAAAEPT

SEQ ID NO: 2435 - protein, 45 aa, Methylobacterium sp.
MKKLLLASTVLAGMTAAASAADLPRRAAPPPVFTPVPVFTWTGFY

SEQ ID NO: 2436 - protein, 881 aa, Methylobacterium sp.
MQTGAVASEKMATAEAKVQEAVDKAARTFTGGVVLIAERNRAFDRLRAAADPVVKAQQAVERAATAADAAIRRGTTTTDEAARIVGIYQQRLASAKVAADQHVLANDNMAKSTGIASHQLQNLGYQINDVVTSLASGAPAMQVLAQQGGQVVQILGETGVSGAVRGVAGAIGRFLTPATVGVSALSGAVVLGYMAWSRYDDDSRKVGVTLQGLGRETGLTRDAFEKLATSAAAAGNMTVRQATDIGTALAATGRIGPDNISKLIGVSKDLAATFSVSLDDVKEKLVAFGTAEGITRLNDQLQFLDARTLRVVQSLFRAGQEQDAIRIAVERLPVALAKSETAQGAVAKAWDAIKSAASDADNAMGRFLDRITKGPSPADRLKELQDRVEALKAAEAENIVQPGGTRRAYVPSTSPTVASTTPTPLPPSRPSELESAKSDLQSYMEKLAATKRAELEVAERKELEASLNRKSGELKKLTEEAGLGSDSWRKYKDLQIAADEALKSGNPELMKRVDNVKDLSEASSILEHVVTTTTNAEGERMTAGEKAAEQRRIDIASTRAVTVEERARAAQMQTEARQRGQLITVAQAQADAEHAATMVREQAAQQLRMMLRDQDLEADSLKLRISLIGQGAEAQAVAMARQRMEQDLTRQGVVDLNSDLARSVIAGAEANARLGVSYDKAAEAQQRLRDGQKELASEFGSFVEGVTIGGQRMSEAFASLSKSLGSNALKAIISGDGPLAGILGTAPGEKGQLGGLLGGSGGLSKLFDVDKITESLGIGAESGIAKALGDALRPSKPGGGILSSPLGRGLAVAGAGASIGYSSQSPLMGALGGGLAGLASGNPYLAVAGGIAGIAGGVCGHKPSRKKDRDHERRQRHLRFA

SEQ ID NO: 2437 - protein, 906 aa, Methylobacterium sp.
MSTVVTQLVVDARGAEDGVRRYTTAMQSGASASEVMAAAEAKVQAAIEKSERAFTGGVVLIAERSRAFDRFRAAADPVVKAQQTVERAANAADAAIRRGATTTDEAARVVGIYQQRLESAKVAAERHTVANDNVAKSTGIASHQLQNLGYQINDVVTSLASGAPAMQVLAQQGGQVVQILGETGVGAAVRGVGSVIARFITPATVTVGALTGAAVLGYMAWSRYDDESQRVSTTLQGLGRETGLTRDAFEKLATAAAAAGNISVRQASDLGTALAATGQIGPQNIGKLIAVSKDLAATFGTDLDGIKDKLASFGTVEGITRLNSQLQFLDQRTLSLVQSLFRQGKEQEAIALAVDRLPPSLAKAETAQGAVARAWEAIKNAVSDADTATGRFLDRLTKGPSPTGRLKQLQDRVEALKASAAENLVQPGGTSRAYTVPTSPTVSSTTAVPVPPSRPKELEDAQAELRRYMESLAEAKRQEEAVAAQKELEASLNRKSQQLHNISEEVGLGSDNYRKYKDMEIAVNEAINSGDPALMKRVDSVKDLSEMSSILEHVVKSTANAEGERMTAAERAARQNAVDLDGVKARTVAERESVAARAQVERARGQTITAAQAEAQAEHAALMVREEANQRLRDMLRDQSLEADDIRERIRLLGQDTEARAVSTARRRAEYDLIRDGYSLNSDLAQSVIAGAEANTRLGVSYDRAAEAQQRMRDGQRELASEFSTFVTDILAGGQKMSQAFDTLAKTFSGNTIKALISGEGPLAGIFGTAAGEKGQLGGLLGGRLNLGGLFDVDKITESLGVGAETGIGKAISEALRPSKPGGGIMSSPLAGAVASIGAGAAIGYSSQSPLMGALGGGLAGLASGNPYLAVAGPRCGRGAVFGKPAKSKPQQEPSSDDRHQRDRAA

SEQ ID NO: 2438 - protein, 474 aa, Methylobacterium sp.
MPEAQAASSITRIGMCDEADARLDIAAVERFLKEGYPAASPASVTTSRSAVRMASEARGIARQTMDNRIGSPNRAGSHKRRFGLEPDWSLAETHAAQAARARRGELGTDPVLTGFELSQVKTRFDSEGAFAGETITQIPASGPKFELPAGQAISKVTATVKANGQLGTQWIRYKPEGTDPVAFAESLREAMQDCRGLARVPVAVPAQDDELLTVYVIPDLHLGMLAWAWESGESYDLKIAADMARTQLARLLAMAPPARNAVLLFLGDYFHMNDRRNVTPRSGHTLDTDGRWRKVYDVGARLAVGLAEAVAERHDQVEIAFLPGNHDEDAAQTLAVALDLFFERHARIKVAGSPGDHWFRRFGKCLLGASHGHTMKADRMAWMLATDRARDWGETEHRHFFFGHIHHETAKEIGPVRVESFTSPAAKDSHASQGGYRSNRALNAVTFHIEDGEHCRHRVSIRTPQPAVELQVAA

SEQ ID NO: 2439 - protein, 265 aa, Methylobacterium sp.
VSAGAVAVVCGSRGNPHWHWVAEQLDDLHARRPIRRLVEGGQRTREQQGSVWHVVGGVDFHALCWAQDRRIERRTVEADWAGQGKRAGPLRNGRMLEEERPDFVVGFPGGAGTADCLAQARTAGIEVIEIARDCCRFSYVPTLSVELCREWPDALFVFGDNLQGWGRKGQAAIRDEPNAVGIPTKRAPSEAPTAYLVDADYARVAERVAPILAHLREHIERGGRVFWPENGIGTGLAELPHRAPRIHRAFENARIKLQRLGRSMP

SEQ ID NO: 2440 - protein, 241 aa, Methylobacterium sp.
MPVAATETADPFDVPALIREVDELWDPETTLMTHNERVLIEFCRRLAAPLRAIVDTRAGMALSRKLLEQSGGSGPAWKPFINVALQGPEYLMVLAGLRSLSATARGPAPFQDRVLEQMCEICADDPTDLEERRDRHAEEDAELLQSLGLSREAHHRIVDYVHDRPVGDPGQELGGTMHTLAGLAALACLDMVACGEAEFDRVGRPEITAKIRRKRANRHGRGPLPGDDAGLVTSTASRPGA

SEQ ID NO: 2441 - protein, 94 aa, Methylobacterium sp.
MPNNTKPKRADHAQDLRHFADLVERLPFASRRDPEQPHIERKLLVNEMRKRARQIVRLDEPTPESVFRANDIVRGERVVKVQIRRTPGTLKLAA

SEQ ID NO: 2442 - protein, 51 aa, Methylobacterium sp.
MVDGPRRPARSDAIPPGAGSGDGPRRTRFRRRADSARAAANIEAVTGVPDP

SEQ ID NO: 2443 - protein, 27 aa, Methylobacterium sp.
MLDIVFLAAGLAFFAAAAGYAAACDRL

SEQ ID NO: 2444 - protein, 345 aa, Methylobacterium sp.
MPNVVANRQVAHIWAHQAQDSARSHNGNFWFEGRKLYSYSTPIANLVPGVDGELIALVTARSYSITTNGKHIGPAHSALGYGRVRKTFTVPFIGAFGGQNRGDLNLSETNAAEIHAANLEAYLADYTATVERLPRKRDYDRADALASLNRIANPACDYAEAFGLSRPAYDTDADEAAAFRLWSARNTPERIAARLARAEAAAAAKAARDARDAAARVERERALREAWLSGEPTAYFHGRDERGGAYLRVRGDVLETSLGAEVPLSHAIKAFRFVKLCRERGEAWHRNGRTVRVGHFQVDSIEASGDFVAGCHRINWSEVERIAASLDLLDAEPSADAVEPSHAAA

SEQ ID NO: 2445 - protein, 33 aa, Methylobacterium sp.
VTARAVLLPLAEASAVMFGAVAFLAVAVALGAL

SEQ ID NO: 2446 - protein, 37 aa, Methylobacterium sp.
MFYVLALAVVGASVALPFLGLAKLTEWTHRRCHPYDL

SEQ ID NO: 2447 - protein, 384 aa, Methylobacterium sp.
MSVVSPLIYNIVDYGAVSNGGDCSGAFQAAFNALNNTPEGGQIYIPPGRFLIQNPIGGTTDKSCVIKGAGADASVLVFNGPNLNNGLVLQQVTPNNACAFKDFGVVATGCPNLGNGSVLSIIGVLQGCNGITVDGLHVRLTDDAPCSNVLYVRNPSSGVIRDFNVDGYSGWGEGNTATGIYIICDTQGANAIQLYNCNIFRVYKGIWCVGGQIQQYVMEGFEANECTLVGVQYGLHMQGGWYRPPGNAWKGGHINARQICILLETWYEFKISDTLLYLDGSAAANSQGHIRVINCDEIQIHNNSTRYVDEITGGPTQRGIWGIAISDSSNVLVQGNFFDIGRADSAALYSVSGNSNVRSAFNTKRGGGAYGAGAYTEIGQDIVV

SEQ ID NO: 2448 - protein, 38 aa, Methylobacterium sp.
MTAPTRKVRGGCGFCAVVFAAGLMIAGYALAFFVTLHG

SEQ ID NO: 2449 - protein, 107 aa, Methylobacterium sp.
VSLQSECAFYWRFAPILEMAKTSWIAGPILEEARDEIQSIALHTRNALLREMCISLLDATAEDRIVNFSTEQVVNEILRAVVRGSRAQFPGVSEGNKVAHLDVQAFG

SEQ ID NO: 2450 - protein, 64 aa, Methylobacterium sp.
MSKITDQDLLSATSNGDGTHDGVKLAQWLYEAYTGKPLPRDKAEELVQEGVRRARIRKDQEARG

SEQ ID NO: 2451 - protein, 281 aa, Methylobacterium sp.
MTKQPLAVVTMAFNEAMLLPIWARHYGRQVGAEHCYVLDHGSTDGSTRDLPVNVLRLPRSPHDEHRRAVAAGDFCTSLLYFYDRVLFTDTDEMVVADPARDANLVEFVRRLPGAPSIVSAFGVDLLHDHTREGPLDWARPLTDQRSVIRPFNSLCKPTLIRERPDWAAGFHFSHRVPATTIVPFLYLFHIAFVDNDLLVQRQMQRNKVEKAQVDHHQIPPQPLLDHVKRDMETVRRVGTKLEPGDREFERVRARWTNLLDLRQFVQLDEFWELPRRFRGLI

SEQ ID NO: 2452 - protein, 70 aa, Methylobacterium sp.
MPADRDFGAPAQPAAPPITISVQIFREIMGAAGAVLAGYGAWLHYPPAGFMVGGGVLVGLAIVGTLRGNG

SEQ ID NO: 2453 - protein, 41 aa, Methylobacterium sp.
VVYWPRIVDAAQARGIEINNDILVRAHLPRERLAPAETEAA

SEQ ID NO: 2454 - protein, 62 aa, Methylobacterium sp.
MSEGDDPIREAVSALRANGYEVESMAGDHMLWLVNGQALTEGELMALAVRLGLMDSTTDKLQ

SEQ ID NO: 2455 - protein, 384 aa, Methylobacterium sp.
MTITCKGAVLRRIGCSQPYAESKPLSIETITLAPPTASDVVVKVAGAGLCHSDLSVINGDRGRDVPMVMGHEGAGEIVELGSAVTDLRVGDHVAFQFSVSCGRCRACLGGRPNICEAAPAARSRGELLSGGSRITDAGGATLRHQAGVSCFAEYAVVNRGSVVVIDPELPLTEAAVFGCAVMTGVGAVVNTANLRAGEAVAVYGLGGVGLSGIMGARVAGAGTIVAVDIEEAKLDKARSLGATHCFNARDPDLDAKVREATAGGVDCALDFAGAIPALRSAYAVTVRGGRVVTAGLAPFGAQFAFEQGDLVSNEKQICGCYMGSCVPVRDLPRFVKLYRSGALPVDALIDSIIGFDELNAGFDRLAQGSALRQILAPHGGPRPT

SEQ ID NO: 2456 - protein, 203 aa, Methylobacterium sp.
MQTFAHIVDGAVREVVKLADDKVLGKDLYSAAFAAECVSCAATVVAGMLYDPATKTFAPAPVPVVDLGALKGRLKAQVDADAEALRLTLITPGSGQAMEYQEAYAEAVQVDAAVKANASATFDPAAFPMLSASLGYDLDPETGKATTDIPGEARAVLAAYDAYQKAGAAIRGVRLRAKAAIDAAADAASASAAYAAIVWPTLA

SEQ ID NO: 2457 - protein, 199 aa, Methylobacterium sp.
VNALGFDTALARVRVEGVAELFQPRALVASAAGPMITVARATTGEALVCAPYTAIAGLDGATFTDADACLAYLVRTLAQRPAGDPIEAAVAATDLGGQRLVRALGDGRVAYASCDDADAAAATLGLTLGAAAAGAPVDVVTRGPVEEPSWSFDPGPAYLGIAGAIAQAPPARGLRLPIGRFVTPTRLVIALGPAVLLAS

SEQ ID NO: 2458 - protein, 173 aa, Methylobacterium sp.
MAALTAVQRLLVQGAKSLAEYVPVLVGGLSNAFQVPALNAAGQLDVTMMPTGVGPDTEQMVASEALSAGALVNVYANGGAPTARNADGSTTGKQADGFVLAAVAAGGQATVYLSGLNTAVQGLTPGLAFLSDTAVGGIAAAGATAAGRTYQQVGVVTQAGHLQFAPQVPVTRA

SEQ ID NO: 2459 - protein, 155 aa, Methylobacterium sp.
LLDQISSLARDSSYNAQNLLMGQSMKVRLNENDTTGYDVPGARVDAAGLGLLTARDGDFLDAQSLASAGRQISEASIQLQTVAQELATSYSVAKIRDSFTREMTNVLQTGADNLTLADMNEEAAKATALDIRRQLGTSALSSSNQAQQSILQLLR

SEQ ID NO: 2460 - protein, 48 aa, Methylobacterium sp.
LRRPPRSGRDRRAFYGQVHRRRADMLILNPMTGQMVEVRVPRPKPKAA

SEQ ID NO: 2461 - protein, 85 aa, Methylobacterium sp.
LKQIRGLYHQWARSGLVRASGNPLIRLAARRGLPAANDVVTADAQIAALAPHFDTAFYASWYGIAADPVRDYLVHGWRAGRDPRP

SEQ ID NO: 2462 - protein, 134 aa, Methylobacterium sp.
MTQPHLIEFRHILDHRGALTPIEAEKDVPFAIRRVYFIYDVSHGAVRAGHSHKELQQVLIAISGSFKVHLDDGRTRKTFLLNRPNIGLYVPRMVWRDIDDFSGGAVCLSLASQHYEESDYYRDYDTFLRAVESR

SEQ ID NO: 2463 - protein, 33 aa, Methylobacterium sp.
MPTMISVVATGNRMNGAEMPPFMAGPRADVRPP

SEQ ID NO: 2464 - protein, 110 aa, Methylobacterium sp.
MSHTAFSSKSATGRTTASRLVSAALAGLVLVGTSVMPAAAGHFMSEAPAAAKPVRLPALHTTTGFRRVSAVGQTKPPGAALDWRAGTTPGLDAQSHRLDQLITTTICSRC

SEQ ID NO: 2465 - protein, 143 aa, Methylobacterium sp.
MPNCARLIRSAWLRLAVALLPALAVMPAAAQNGEKPAVAIGADVASQAGTTRLTLTLSRAVEARGFVMERPDRAVIDLPEVNFQLDSGTGSRRDGLVQSFRYGLFAPGRSRIVIDLTAPATVGKIETATRPRDGAVLLTIALQ

SEQ ID NO: 2466 - protein, 92 aa, Methylobacterium sp.
MEGKGARAQVIGSSRGDQTTEIHALSEVLGRPGVLPLTAGNASDVTTAPASLAEAQGRIRRPSADMGYDADWLSTDLRRNGIMLVPRHLGAE

SEQ ID NO: 2467 - protein, 141 aa, Methylobacterium sp.
MRHTGGGRTTEGETEMALEHAQPLGSAGVSDSDVTDTLGEGPPWTSWVRTAEASQPEAQADGPALPRQIGKGALAVTVLAACGRSTGGTACRTRTGYDAHDERVGRQLDADDGQAIGHEGQDTAGHGVLRKADLRRWGTSR

SEQ ID NO: 2468 - protein, 189 aa, Methylobacterium sp.
MKKPALTGYTFNPTARTLDFSATSGFTIQSLLVVIHEPTGKTLYAKGKAQFAPKTLAGAVITLNDFVDTTGMAAGDALYVLREDGQDVATDGRLESLRRGSTATSDASGSLAAATNVAPAALAANANRSFIEITNTGPNPLAYRWGAAASATNGHILGPGLTARYHAKVPVGALNMFSTAGTTYFVSVG

SEQ ID NO: 2469 - protein, 101 aa, Methylobacterium sp.
PCLGFAIRSGPRRIAEGRPGVGREVPRSVEQMTELVGRVSMKTLVRETTDLIEKLCIEAALRITRDNRASAAEMLGLSRQGLYAKMRRYGVGDLDGPVEDI

SEQ ID NO: 2470 - protein, 135 aa, Methylobacterium sp.
MRTALAALCLIAAADAAQAAGKAAVSVDQLLADPKAHWGEMVLVRGIRCVDPGPGGFICETTVNGRLIRLDASGLGGHASEAIAEKLIGPCNGLAALTKPACTFDVKFVPTGSGFEDGVTIVHTPEIDMSATRRR

SEQ ID NO: 2471 - protein, 54 aa, Methylobacterium sp.
GAYGGGGGYRNDGYDDRRDAYRDRRDYDRPPPRRPYDDDYGPGPRRYRGDPDEY

SEQ ID NO: 2472 - protein, 65 aa, Methylobacterium sp.
MAEAFVRTLKRDYVPVSVLPDADSVLRQLPVWLAHYNDLHTHRVLGYRSPREFIDRSTQEILSGL

SEQ ID NO: 2473 - protein, 369 aa, Methylobacterium sp.
VFVTLELSKPAWLLAAQAVPSGKTSAHRVSGGDVEGLLALLRRLQAREQRSSGREVAIILGYEAGYDGFWLQRRLAAEAITCFVMDPGSLQVDRRARRAKTDRLDAAMLLRALMAWCRGDHAACRMVQVPSVEREDARRTHRERQRLIAERVQHVNRIKGLLATQGVYTFQPLRRDRWERLKEVRTGDGRDLPQRLRGEIEREFRRLELVLEQVAAAEAERDAAVADPAVTDADAEKVARLARLGGIGTELATVLVREALYRPFANRKQVAAYAGLTPSPYASGDRQRDQGISKAGNPLLRKSMVELAWLWLRYQPGSGLARWFVERVGTGRGRIRKITAVALARKLLVALWRYLATGLVPEGARLKAA

SEQ ID NO: 2474 - protein, 67 aa, Methylobacterium sp.
EGGRARAGAEALQAARALRAAGLPALVVDTGTRGDEARSVADAMGARYLKLPRAEAGQLSAAVRAAL

SEQ ID NO: 2475 - protein, 89 aa, Methylobacterium sp.
LRTLSAAAPLAAVLAGTAYAQAPATAPGAPPTSSGVVTPQSGATGAPGAVTGSPTGQAADTRSNSSSAAGNANQPERPSPQGGSGGSSR

SEQ ID NO: 2476 - protein, 54 aa, Methylobacterium sp.
MSAKDVRFSVDARDKMLRGVELLANAVKVTLGPKGRNVVIEKSFGAPRITKDGV

SEQ ID NO: 2477 - protein, 108 aa, Methylobacterium sp.
LSVLGKWRIVELPGYADDYADMVEPAYILFEATGGEFAFGCVTGAFAGGGDHAAVKFDWNGNDEMDEACGSGWAALQADNSLRGEIGFHADDDIPFIARRWPSSSTAC

SEQ ID NO: 2478 - protein, 68 aa, Methylobacterium sp.
MTSPMTPADRDRFEKCLALADQGATAGERAAARAAAERIARGAGLTLAAAAEALRRSGQASADRATRP

SEQ ID NO: 2479 - protein, 28 aa, Methylobacterium sp.
VERDRYLPNVSPGRMVDEEADLESDTIG

SEQ ID NO: 2480 - protein, 274 aa, Methylobacterium sp.
MIVSAIRDSKDPTPVYAQAPAQIDRKDCYFYHTLELSTGEVVEGGWDLRGRYADYIGHVDLRGQRVLDVGTAGGFLSFSAEEAGASEVVSFDQDTGARQHLLPFAGSPYVVDHAGWVRAHDRAMQAWKNAYWFTHADRGSKAKVAYGDVYDLPAGIGLFDVVILGAILEHLGDPVRAIGSIAKVASNLIVINTDYIPGDEPMARFNGRPERPEYSFVFWTYTIETYRRILAICGFEIEKVYKDSFLGTPAVPGGVRPNMPRAAIVARRIARSSK

SEQ ID NO: 2481 - protein, 688 aa, Methylobacterium sp.
MSAEKIGPQHRARKAVLYVRQSSAHQVQHNRESQALQYAMRERLAGLGFAEVEIIDEDLGCSAAGGTLRAGFERMVAEVCLGKVGAVAAREVSRFARNSRDWQQLVEMCRVVDTLLVDQEAIYAPRLGNDRLLLGLKGSLNEYELDLLRQRSLSARYEKARRGELVVAAPVGFIKVGDRLEIDPDRRVQAAIRLAIDKVAELGSVRQALLWFLEHGLDLPTRVNAGPVVWRRPRYSTLREFIANPAYGGAYAYGRSRVTASYDAAGAKARARRTPRSEWLALKPGAHEGYVTWERAEAIRAMVSENVPTSSRGAPKLGSALLSGLLRCRRCGRKLSVQYTGAKGQIPRYACVRGRIDYGEPNCIAFGGLRVDDVVEAALLSVVQPGAIEAARAAESQASMRRDEAREAMVRDLEAARYAADRAFRQYDAADPENRLVTGELEARWNRALSRVGACEARIAEHDAVAPRPALPPIALETLAADLQDVWSAPTTDARLKKRIVRTLIHEAIADLDEVRAEIVLTLHWAGGAHTEHRLPRRRRGQRTSTPADVIEAVRTLALITRDDVIAGVLNRNGVRTGHGNRFTRERVTALRSQYRIPVFREAAAGEEPWLNLTQAAARVGVAARTLRLAAERGEIDAAHPLVDGPWVFSRAALDGPAARVLAQEALNRGKHPAVPHPAQQSLFASTT

SEQ ID NO: 2482 - protein, 73 aa, Methylobacterium sp.
MERYELVEGSAAKFWEVGVSGPTLTVRFGRLGTQGQSKDKTCADAAAAAKEKDKLVREKTAKGYVRADGAAPA

SEQ ID NO: 2483 - protein, 275 aa, Methylobacterium sp.
VREAVMSNQTTKATSATSLRERAAQARDAAGRFIKRSPPVAPAPTHAEQVAEAALTGDVLAACGIDHRDGTVSYADATGKVVRHPMARWIAFNAVQMYSHVQSEMGRRRVIEANPLPGAEHAAWEARIRRELRVDAIAALTFTPGHAFQVEQDRRTGAEPMADGSILALIEEHRAAYAEWDRLSEVWSEMLTTDPGYAEAVAASEEPGRREIAAYEALFSARPTTLPGAIALTEYLREATERVSTNIQPSDAERALSIIASALRGIVAAAEPRGH

SEQ ID NO: 2484 - protein, 136 aa, Methylobacterium sp.
MVLEACPDVVLYARDGIRSWSDLAGAAEVVRPALGIGPDVWEAALAAMGRDHALAALSAILQRAESIGAPGAYLRDLTRKARSGRFSAWPMLFALWRQRRRASSDGSSGPLRVAEVDRGQHARPLGGGAARASTFC

SEQ ID NO: 2485 - protein, 68 aa, Methylobacterium sp.
MSDETELRHHQAAIQHMMRRLDGFARRLGLDEAATRQVVERIASDMPEWTDEERLETARRSLLAVASA

SEQ ID NO: 2486 - protein, 139 aa, Methylobacterium sp.
MIAARQHALPPDVEARQQVGFRLRAARDAARLQGRAQSPALRREIGAALRAARDAAGMSQSTVARRLGISTPMVCFFETGQKRVPLNRRDDVAAVYGVPPEHLDRPPVVTRSEDEAALVTGYRHLSEDERAALLALVQS

SEQ ID NO: 2487 - protein, 76 aa, Methylobacterium sp.
MAKDRDVPNRQVRPLPESLNRLLLSDPTQPIGWIEDPLIGYHRPSVYDRVLWWFSVAAFAAAAFMTSASMTVRLLR

SEQ ID NO: 2488 - protein, 60 aa, Methylobacterium sp.
LRSAFEIISGPLSQRMCSRMPRRLDLAQLQHDLLRARLLTSPHVRLPWSQLILSISPVQS

SEQ ID NO: 2489 - protein, 133 aa, Methylobacterium sp.
MTKVENPKRAHGLKKLPLELIPRVALVQEAAVYGLGADSPAKAYGRFNWRKSPIDDAIYVGAIERHLTLWAAGEDVDPESGVSHLAHIRACCGILLDAMDAGSFVDNRHRSPETIRVLRGYDAAALPVVAPAG

SEQ ID NO: 2490 - protein, 281 aa, Methylobacterium sp.
VFLRKNYLAKGSTWCAGELNRTVGAVRAMAKKLKLGRPAEEVRFRWTQQHDDRLRRVYENGKIGGVKELAHSLGITPGQARYRAGELGLSTRWQTGPWTEPEIEFVEAHTHLRRSTISLLMKKKGWTRTPVAVQQLIRSRGLAGANDRFLPASTVAAYLGVTPVVVFKWLKDGLLSSESPTGGEQDGRPVYLIENRELARFIVQNPLKLDPRKFDWPWVSDLLARYGSFGLIEGRTMIERVAALDREKRTPREIAEILESTPNSVSVMLSRIRAQERRQAA

SEQ ID NO: 2491 - protein, 1658 aa, Methylobacterium sp.
MMSLFDVPQLPSAPPPPAQSLPVDFYLDGVRALSRGWAARARDNVEAISLSAAILAEGRPATPEEQARLMRFVGFGATDLAQGCFPTTGSFRSGWEDIARLLQAATRPEELKALARATQFAHYTPEPIARAMWAALLRIGFRGGLALEPGVGAALFPATMPAELRGQTRFIGVEVEPVSARIAALLRPSDEIRCEDFTKARLPRDFDLAIGNPPFSDLTVRIDPYRGLRLHDFFLVKAADHLQPGGLAAFATSRGTLDKADGGARVALHAACEFVGAIRLPDGAFRASAGTDVGVDLVFLRRRASGAVIDLPAWLETASAGFPDFPGIRINRYFLNNPDMVLGRPDLARSPRGETVYACRAPEGFDLEAALARAVARLPEGRAQPVAAPRTPVIETERPSAPSAIERLHEGSYLIGADDELQQIVDGRPVPVRIRAGGSGPGIFRTHAAMIRKLIPLRDAVREILRLQMARADSMDAQARLGALYDAFTAKHGPINRTEVSESTDAQGGKSEVHRQVNLIPFRDDPDTHLLASIENYSLEADTATKGPIFSEVVVAREIAPTIETAGDALARCLHETGRVDVDRIAALIGRPVADVLTDLGPAVYRDPDTAEWQTADAYLSGPVRAKLAAAQEAAKADHSYRRNVEALETVQPVDVPPSDITARLGAPWIPADVVQDFVKEVLGGDVVVRHTADVATWWIDLRWFRCRPEASHAYGTPRYSAGQALLDALNARTPRIVDRIRTGVNQWTEVVNAADTEAAKTKQDALKRAFESWVWAGGPLAHFRADRLARLYNDRYNDTVPRSFDGSHLTLPGASAGFRFRPHQLRAIWRILASGTSYIAHAVGAGKSAVLAAAVMEQRRLGLASKPMMVVPGHCLAQVAREFLSVYPLARILVADETAFAKDRRQRFLARAATADWDCILITHSAFKLIATPKAFEQQMIADAIADFEAVLERVAESDRLTRKKLERAKQGFEAKLEALSVRHDTFLTLEEIGVDQILVDEAHEFRKLTFTSNMTVKGIDANGSQMAWDLWVKAAFVRDRRIARGDRRVDRALVMASGTPITNTLGELYTVLRFMDMEALRERGLHEFDAWAASFGESRTELELQPSGTYKPITRFSEFVNVPELIALFRARADVVTEEELRDLVPRPRIRSGKRQIMTSPPSEAFREFQRELGARIKAIAARSGPAKKGDDILLTVIGDGRHGAIDLRMVDPFNDNEPANKLNKLIANVLRIHHENAGCVYLQEDGTPYERTGCAQMIFSDLGTEKSIATRGFSAYVWIRQELIRLGVPVGEIAFVQDYKNSRAKARLFAAMRAGIVKIVLGSTQKMGTGVNAQLRLKALHHLDVPWLPSSIMQREGRIDRQGNQNDEIELWAYATEGSTDATMWQTNERKARFIAAAMAGDRSVRRIDDVGEDAVNLFALAKALASGDPRLMQKAGLESEVARLQRLRSAHYDGQHAYRARIRAAERTIVEATESAQAFEAVAARVSGPFVLTVGKKDFTDPAEGGKALTDAMKAVDRMLEGGWFKGSKAKVEDELVATVHGLRILYTSGVDGGGSWSAAKLQVGSQWVALRCKSITPGAVAFHQVAEEVASIAGAAEAARFEAERARSLIADTEPLVGRPFDLEGELNLKLEELDRLNAELDGASIEDLAPAA

SEQ ID NO: 2492 - protein, 95 aa, Methylobacterium sp.
MNQTEARYDAHLRARHATGEVEWHKFEGLKFRLADNTFYTPDFAVMIAGGALEAHEVKGFWTDDARVKIKVAAALFPVQFVAVQWKRGAWVEERF

SEQ ID NO: 2493 - protein, 353 aa, Methylobacterium sp.
MSPNDTADPLPPKPASLPGRGSVWQHYKGTFYRVAEVSRHSEDPRQWLVTYAPVEGGDAWTRAVRAPLVNTWPGFLDFRPNAPGHRFRHVSGPRTWRDEAPESQTAAERLSAAAPLMLAALKAYRAQYADRPSWPDDEVACLELADAAIAAAMPALEERETIAVTWRDENYGDVSDVLAFRTYGLTSLPEQVRRQVDRVIRAAGFSFNPRRASWMALADPTHDRKAGLTAALEAAGFQVEHRGAIPDVTPPGPAVPAPPGPRPRLTLTWRDENYGAVSGKIAFRCYDKGDLTEGMWAPIRKAVEEAGFTQHLGRSCWMADDTPGRMDSLAEALEALGYFVVHAGAVPADRVRA

SEQ ID NO: 2494 - protein, 180 aa, Methylobacterium sp.
MHYYAHLHVDGTTVHEILELADDQVLGLDLYSKEIAEASVPCDASVRAGFTYDPVHQTFTPPPAPPVDLEAYAGAAHAALRDGGVTIQGMRVKTDAESRGLIDGAFALSKSRPGGQIDFKAASGWVSVDASTMEAIAVSVGLWVQACYSAYRQVDEKVTSGAFTTTEQVDAAFAAVALPS

SEQ ID NO: 2495 - protein, 570 aa, Methylobacterium sp.
VATIKLKRRTSGVVGSPSALASGEVAFNEASGDLNLYYGAGDDGNGNATSIIAIGGFGSYWTTKATALRLDQFSDAIAPLVGVDPTLPQHLATKNYVDSAIQGLDPKASVQRATTGPLPAYTTSGNILTASANGALSLDGGALSAGQRVLVKDETASAWNGIYTVTAAGSAAAPWQLTRANDFNLWVEVPGAFVFVEQGTALADTGWLSSADQGGTLNSTAITWVQFSSAGVLLPGVGLTKSGNTLSVVADFGISVSGSGVRISATYAGQTSITTLGTITNGTWQGSTIGTGFGGTGLTAVPTGLLKGNGSVYSAAVAGTDYAAATGGTQITTVGTIGAGTWQGTAVAVGFGGTGLTAAVNGLLKGNGTSYSVAVAGTDYLAPNWAGSSNITTVGTITAGTWSGTAIAPTKGGTGLTTVPTGLLLGNGTTYSTAVANTDYLAPSWTGSANIVTVGNITAGTWNGTAIAPAKGGTGLTAVPNGLLKGNGSAYSAAVAGTDYAAAAGGTQIVTVGTITAGTWNGTTIAPAKGGTGLTAVVSGLLKGNGSAYAAAVAGTDYLDPGSVIDGGTF

SEQ ID NO: 2496 - protein, 187 aa, Methylobacterium sp.
MFGPRRFGAIRGALSGISAKVLTERLQGLKQAGIVAQRTLPPPASTPVYELTPWGYEAEPIFSVLGRWAARSPSHDPALPLSAASLMLSFRTMFDPAQASGFEATIGFRFDEDAFRVTVSEGELHAARADLVGAHAVVGAAPPVVAAIVYGGLPLADAEASGQVSLEGDRDVVQRFAGLFPLPGKAF

SEQ ID NO: 2497 - protein, 87 aa, Methylobacterium sp.
MRLLRLILLTGTVLPGLTLVQLADAAPGRIQVAQGGPDERGPRGGEPPHGGPRPERPPQERPGPPPGPPAARERPEPRPERAPPPPR

SEQ ID NO: 2498 - protein, 81 aa, Methylobacterium sp.
MPLHVPLANGWTLSISEDTPPAFCAVAAWPSHYSDAPRDQSLWFVFEGRQVECRCWLLEDLLQALELILRAPRPSDLGEQI

SEQ ID NO: 2499 - protein, 238 aa, Methylobacterium sp.
MWIKQLIGRLAGQVVDLPFSAAENVLANGTGELATDAEVLAAGFEPLPAVAPVRTDVLPLGYRVEPTEVGGFDLYDAGGLLLNVEPLANMIVAVEAAHDHREAVYLPVQVVPVGQLPPQLPIPPRVLTADYLLEPIEGGGFDVLDPAGLKINDAPVADEEAARAMVLLHVAEATGRTVEQVEADEMEQPPVTEIDVPEDWKSLHWSQRKALAHRINGGAPVANAAEADHVIEEYLTRP

SEQ ID NO: 2500 - protein, 161 aa, Methylobacterium sp.
MPKENFATRTKLVAVLAVAADGAGRSGRAVNLKNAAFATVLAKITQGNAAPVTLTFLQAQDVSGTGAKPITNPAPIWANLDTDASDTLVRQADGVSFTTDAAVKNKHIVAHIDPAYFDIANGFKTLIVATSASNAANLTSVDVLLEAGRYQSEPLPTALTN

SEQ ID NO: 2501 - protein, 123 aa, Methylobacterium sp.
MARLEADGYDLEAEILPALLDAAAAARTPVRTWRIWADRVAERINAQRLTRASQGLPATPAAPVAEEDKIDLGAPFGRWAEPVLRTAVAKHREMGGWVDHLWGPPPGQPGCKIPPRLLIVEAA

SEQ ID NO: 2502 - protein, 81 aa, Methylobacterium sp.
MRPVRFHYLRLQEWLAHLDEARANARIRSILAFRNRRAADAKRYGAEADAICPPEAPAREWSPRLWDRDHDARSDTRERQP

SEQ ID NO: 2503 - protein, 94 aa, Methylobacterium sp.
MAGAPAHSGTLEDRVRTILFDVLATEPERQVDAAYLVQDLGADSLDVVEFGFELEEAFKLGMDELDLTSAITVGDVIAAVRRVVDARAVPAGGA

SEQ ID NO: 2504 - protein, 112 aa, Methylobacterium sp.
MAAGARETLDLSTIDPAQLAHAAETAARANLAAAGILGACSERSTMRAAVRKIEHGQALASLALLMSFVAEHYASLLPVFLALQEGSVVAVEEVTISRSRKDERSKLALVAR

SEQ ID NO: 2505 - protein, 210 aa, Methylobacterium sp.
MDNEGTSPADKFFSYGIECGPHTILDTLNSSGGVLEQENHEDGCTVWDEQARRDLTYIAALVNDHRAGRLVEVSDAPPGPWRPMLAGANSLGRNRKGDVTINVPTALCWLQFSPDSFTGTEDETRPGVGFTLVAYPGSAGEWPNGVIPRDEAFRLYQMLARFFAAHPPPGEPAARELEAAAADAEPVRGDRLRRIAAALRGAAVGGPRHG

SEQ ID NO: 2506 - protein, 96 aa, Methylobacterium sp.
MGEQKRKAAAGHVPPEGMANVSGRHVTELARGIMDLLEKPFDEGMQADVAAHVMVATAVDLWRANYGDAQVADALKRAIDRRLEKPAEYWGGKRGA

SEQ ID NO: 2507 - protein, 45 aa, Methylobacterium sp.
MPILEELGYVEERATRGSTRRRAWHLTPRGRELLIALGIRESAEP

SEQ ID NO: 2508 - protein, 96 aa, Methylobacterium sp.
VLLNALILVTTLVPHAESGADALARALTPPATVSAPADSPPPHFDPATRSVSNWHAQTGAQLTPRALAVTASLADDPPYVARCVRLNNGWCIKSPR

SEQ ID NO: 2509 - protein, 37 aa, Methylobacterium sp.
VQAWLLSAAAASPSAVCMIARIVRAQRPHFGLQPRQA

SEQ ID NO: 2510 - protein, 91 aa, Methylobacterium sp.
MTTRPPRSGGPTGRKPQAGKFSTSKFRGGKAQADGRARTGPRTSARDAAERAARNRGEDAGTRDPWGAQAAAAPAPARPPKPRRDAATPRD

SEQ ID NO: 2511 - protein, 288 aa, Methylobacterium sp.
MSAPRFEPVTGRYLHLDLLGKPHRLYVEEAGEGIPLLCLHTAGSDGRQFRAILNDPEIAARFRVIAFDLPWHGKSSPPAGWHEVLEYRLTSRDYTDIVLGVVQALGLDQPVAMGCSIGGRIVLHLALEHPDAFRAVIGLQAGAHVDPYYDTQWLHRPDVHGEVAAAIVSGLIGPSASDADRWETLWHYMQGGPGIFKGDLHFYKIDGDIRDRLSGIDTARCPVHLLTGEYDYSCTPQDTLDAAARIPGARATIMPGMGHFPMSEDPEGFLVHLRPVLSQILAAERDPR

SEQ ID NO: 2512 - protein, 310 aa, Methylobacterium sp.
VGGRPAQFGRGARGMTAPLRVGGLTIDVLTEIAHRYMPVSFLFNDLPEPDIARNMSWLGPRFIEPRERTLGLAFQAYVLRAGGLTILVDSCNGEAKHRPTAPWQHDLRATEFLGNLARLGLCCEDIDIVVCTHLHCDHVGWHTRLRGGRWVPTFPRARHLFGRREFDHFRARYDREGAAAVNHGAFADSVLPVVEAGLAEFVDEDHRLLADETGEIALVPAPGHSLGHCCVRLRAGGTEAIVAGDALHHPIQLDLPDLPMRADHDPGLAVATRRSLLAHCADTGAWLCAGHIPDWSIAQIRRFEDRFRMG

SEQ ID NO: 2513 - protein, 206 aa, Methylobacterium sp.
MTAQLQQQQMQLQPPSDAARLFAVEKDVASLKEGLSVLGTSMDKGFRDLATEMKARSTINWQPIAILLGVLGSLGTMGFTWINTGQGRLEMAIAKVETASMRYVPREDLDARFTVLSQRRDDLQRLTDARVERIERDLDAASKQIVPRGEHEQMWAAQRARDADLQRQADQNRQGLYDLNTPRDTIQGMQRRIDELERDARAPARR

SEQ ID NO: 2514 - protein, 50 aa, Methylobacterium sp.
MAEVCIANHEQIVRYGSPEMQAASRALLYVLAAEIQRREQAMSAANNDEA

SEQ ID NO: 2515 - protein, 123 aa, Methylobacterium sp.
MTLRGENLIGAEARRGTEAAFRAVEAATGQALEPDFPGASRSDLDRACALAEAAFDTFRETDPEARAGFLEAIAANILEIGDDLVTRCMAETGLPRPRIEGERARTVGQLRLFAGVVREGSYV

SEQ ID NO: 2516 - protein, 132 aa, Methylobacterium sp.
VKLNHINLTSLNVPADRAMFETYFGLRCSIMRGTALAVLHDDQDMVLVLNDFARKRGAFAYPEDSDVHHIGFIQDSREQVDALNARLRADGWAAPEPRAYHGAWTFHFKAKGGYFIEIATATQIRRAEPTIA

SEQ ID NO: 2517 - protein, 161 aa, Methylobacterium sp.
MGQHNPASVAELLAKRGSLVEIATRDRMAAEEVGTTNQPIHLRELYRLGVVMTPNMELIDIYPEGNRFVGVLRNTMTDAEEERLVDRIVVDHGTLPVDGLCHGLKAGSVNRGQNDQGALLRGEPQPFDLSGGYALHRIGDALAGRNIHAALYDALRLCKDI

SEQ ID NO: 2518 - protein, 220 aa, Methylobacterium sp.
MNVSRIRDAMRYCDLPDVLDYSIAELRLGLAFIALDLLELKAGFRQDQPRGRDGCWCGGSGSLVVARKDKTGDPRIDGKTDAIVDVLGEVVQTCDPGQGPLYGIEVHTKFAARMRELDLPGIGRHGIEQSFSAGDLVRYGLDGSIRTDVILRDGRTSAAPVRAIWDIKTGKAQLTPARARELRRGVGVDDSVPVIEVHLRRGNSVKGLSISAILFGERLP

SEQ ID NO: 2519 - protein, 141 aa, Methylobacterium sp.
VAGTPFDFREPAVIGARIRDGRDAQIVRGRGYDHNWVVTDAPTAEPHPVARVEDPDSGRVLDVASNQPGLQFYAGNFLNATAVGKSGLAYRQSDALALEPELFPDTPNQPAFGSARLDPGKTYRNVITYRFSTSPAHRTQK

SEQ ID NO: 2520 - protein, 294 aa, Methylobacterium sp.
MQIGFIGLGSMGSAMAMNLVKAGHEVRAWNRSRIVQDRVHGITLVPLVADAFQADAVFTMLSDDPAIREVILDAGVLARARPGLTHVITSTISVAFARELELLHAKAALGYVSAPVLGRPNVAARGQLNILAAGKADAIDAVEPLLASISKKVWKLGEDPARANAAKIACNAMIAMAIEAMAEGVVLTESVGLDRAVFFELILGTLFSGRAYESYSAQITNRSFEPGFKSKLALKDMRLAIEAGNQIGRTLPMLEAVHEGLTRAVSAGLGEKDWSIMADMTVRNMAIAAAYSER

SEQ ID NO: 2521 - protein, 611 aa, Methylobacterium sp.
MPYADIEAHGVIGNLRTAALVCSDGTIDFFCFPQFDSASVFAALLDDAKGGHFSITPEPDGVRTRQMYLPETNVLVTRFMSEAGMAEVVDYMPICADGPKSALVRRVKGIRGSMTLRVACEPRFDYARAASRARLRDGGLIEFAPEGEAAPLRLRATVPMTVTKSGAATTVTLAPSEEAGFVFECTQERPSDGSLDAFLESTFSETMAYWRSWSGRSRYRGRWRETVQRSALALKVLTSADHGAVLGAATFGLPEWVGGGRNWDYRYCWIRDAAFTVYALMRLGYTDEATAFIGWVEQRAREQGEGDRLQILYALDGGSEASEEELDHLAGYRGSRPVRIGNAAAEQLQLDIYGELADAIYLADKYGVPASIDTWHGVARALDWVCENWNQPDEGIWEVRGGRQAFLSGRLMCWVALNRGLRMAGQLARPAPLQRWHETQDAIAQSIYTDFWNPEKRAFVQHPGTDALDAAALLMPLVKFISPVDPRWLSTLDAIGRELVSDALVLRYQTKEGANSDGLEGREGAFTPCSFWYVECLARAGRLEEAQLTFEKMLGYANHLGLYAEELGPQGEHLGNFPQAFTHLALISAAYALDRALSEKGRPSMGQDLRG

SEQ ID NO: 2522 - protein, 206 aa, Methylobacterium sp.
MISFAGSALGRDLRNFYPEVAFVDEASPLGRTLRRLSDVLDAAETRDERRFTSDLVGVVPDLRRYALSLSRDATESEDLVQYTLLKAWEHRTSYRLGTSLKAWLFTILRNGHLNGRMKYRREVPDPEGSYAAGLASLADQEHRLDVQDMQEALARLEPAQREALLLVAVEDLSYEAAAARIGCPPGTVKSRVSRARDRLAAELGEA

SEQ ID NO: 2523 - protein, 336 aa, Methylobacterium sp.
MRALIYTGPNALIVDDVPVPVPGPGEVLVRVEAVGICGSDMHAFHGHDARRPAPLILGHEAAGRVAEGPRAGARVAVNPLVTCGRCPACESGRTHLCPSRQILSMPPRPGAFADYVCVPEKSLVPIPDALSTTHAALAEPLAVAYHAVNQGARLLGRPLAGARCVVLGGGAIGFGSGLVLAMQGAGEVVIIEPNPERRSEAARGLPTARCRAPDDAEGPGPDSADLILDAVGSDATRAKASQLARPGAVIVHIGLLPGDRGLDVRKITLQEIVVSGSYCYTMQEFRDVVGALADGRLGPLDWVEERSLAAGAAAFADMDASRVAAPKLILRPDAPA

SEQ ID NO: 2524 - protein, 437 aa, Methylobacterium sp.
MTIDYAKRATKTPETETDAARQVVTEMLAAIEARGEEAVRDYARSLDRWTGEIVVTPEEIARRTKDIPERVKEDIAFAAGQVRRFAEAQRDSVQDFSVELVPGLVTGQKLVPCNVAGCYVPTGRYAHIASAYMSVATAKAAGVPTVVACSTPFRGEGIHPYVLYAMQVAGADVIMTLGGVQAIAAMAFGLFTGKPADIIVGPGNKFVAEAKRMLFGRVGIDVFAGPSEVGIIADETADPALVASDLVGQAEHGHESPAWLFTTSRALADDVIARMPALIDALPPTARDAAAAAWRDYGEVVVCGSREEIVAVSDRYASEHLEVHAADLDWWLAQLSNYGSLFLGEETTVAFGDKTSGPNHILPTKYAARYSAGLSVHKFLRPLTWQRMDREACKTIAQATARISRLEGMEAHARTADHRLAKYFPGHGLDLGEAVTA

SEQ ID NO: 2525 - protein, 368 aa, Methylobacterium sp.
MTEIRGNGCRGGRRRAWLLAGALALAPVVAPALPAKAAEPERIGVSYQPSLYWALPFYIATQKGWWKEVGLEPTFAVFPAGAPQVAAAQAGSWDVGGTGSVPAILGAARFGLLTIGLTNDESKTNALMVRAARHDAILKDPKQLAGQKLLVTTNSTADYAARACLRKWGLGPREMRFVNLGQAQIISAMIADAGEVVGVWAPNTYTLEEKASAQVLCSGADADAMVPGSLITRADFAKAHPDAVAKFLAVYLRGWGWAKANPKDAHDMAKRFYAEGGVEASDHAIDQEFALRPTYALDAQLKAMARADGPSQVDGWFSRIGAFMAEVGTIAQAPDAKGYIDDAFMKRVAADPKLRAFATEFDAAAAPR

SEQ ID NO: 2526 - protein, 261 aa, Methylobacterium sp.
MSAIRFERVEKSFGSNVKALDGVDLTVADREFVAIVGASGCGKTTCLRLVAGFEAPTGGRITVGGQPVTEPGPDRAVVFQQFALFPWKTVTQNIAFGLRNKGMPAAERQERVAAAIDMIGLSSHADAYPHQLSGGMQQRVAIARAYVLEPEVLLMDEPFGALDAQTRVVMQEELVRLARRNPRTVLFITHGVEEAVYLADRVAVMTRRPGRIKEMIDVKAVREAERWEEHARIEDVMDLESFVHLRTHIWKSLRDEKAAGR

SEQ ID NO: 2527 - protein, 263 aa, Methylobacterium sp.
MIASRQPLPLRRSLALGAIGTLAFLGFWAALSRSGLVSPLFLPGPVAVAERFATLTERPFAGGTLPAHVASSLQRFLIGYLLAAAVGVPLGLMMGWSRLLDDIVTPIFDGLRFIAPIAWVPFAALWFGTGIGGPILIIFAGAFPPCLINAYRGARYVDARLLEAAEMLGTPGYRMIAEVLLPAALPSIVAGLRISAGLGWQSLVGAELIVASTGVGYMMVQAQGAVSTATVMVGMVAIGLVGVVIDVALRALETRLRRHHGQA

SEQ ID NO: 2528 - protein, 260 aa, Methylobacterium sp.
VKFSRRMCVGMATLVVIAVLWYVATTGLGLISAGRFPAPGDVETAAVQAFVRGYPDTTLLTHVLHSLRLVALGFLVSVTLGVPLGLLMGWNRTAEALINPVFLLLRPIPPLAWIPLAILWLGLGDGAKVMVIVIAALPPAVISTQAGVRGVPPQIIEAAQMLGTPRLRFVTDVLAPAAAPMIFTGLRLALQASWTTLVAAELVGSLAGLGYVLNVAQQDLYPGMILVGMAAVGILGAGSTALLGMAERRAIGWAQLRGAA

SEQ ID NO: 2529 - protein, 134 aa, Methylobacterium sp.
MDVTVNRPEVVAEITALFERYERALVEKDVAVLDATFWDSPHTIRYALHENCYGFAEVHAARVAADPPPGGAKETRIRLEILTLGNDFATVNLEFKPRGKAGIGRQSQTWMRLPDSGWKVVSAHVSIMPPADCI

SEQ ID NO: 2530 - protein, 538 aa, Methylobacterium sp.
MSDAVLEIEKLTITLPPGADRPNAVADLDLVLRPGAVTCLIGESGSGKSMVARAILGLLPGPRVRVAGGRIQFEGADLAAITPRQMRKVRGARIAMIFQEPMTALNPLHTIGRQIDEVLRIHTPLGRADRRARILALLASVHLPDPGRLLRSYPHQLSGGQRQRAMIAMALALNPRLLIADEPTTALDVTTQAQILHLIRELQREHGTSVLFITHDFGVVADIADTVAVLQKGVLVEQGPAASVLGAPKHPYTRALIAAVPKLVPPPRRAASTAPLVVEARQVEKTYGARGLFGGRITRALDGVDVLLRRGETLGLVGESGSGKSTLARAITRLMPVDGGEILLAGHSVAELTRRQMRPHRRRVQMVFQDPYGSLDPRQRVVDIVAEGPIIHGTEPGIARVQACEMLALVGLDPAAAQRYPHEFSGGQRQRIGIARALAMKPEILVADEPVSALDVSVQAQVLALLADIKARLHLSMLFVTHDLRVALQVCDRIAVMRSGQVVEVAPTSEIFFAPKHPYTKALFAAVPGAQWQEPIPA

SEQ ID NO: 2531 - protein, 136 aa, Methylobacterium sp.
MQAGWSAIPNIIIEKQATLGLDALDMNIILHLTHYWWHPDNLPHPSVETIATALNVKPRTIQKRIKALVELGLMTREERRHTKNGSTTNLYGFQGLIEACRPYAEEKIAEIAKAKEAKQARLVRKKPRLVVDNADD

SEQ ID NO: 2532 - protein, 239 aa, Methylobacterium sp.
AAIGVDLTSGEAIAADVVVSNADSAVTHARLLPEAQRWSPGRFQRARSSMGLFVWYFGTKRRYPAVDHHTILLGPRYRGLLTDIFDRKVLAEDASLYLHRPTATDPSLAPPGCDAFYVLAPVPNLAGGQDWQTLAEPYRRRIAALLEASVMPGLSEAIVTSKVTTPLDFQDDFLSYRGSGFGLEPVLTQSAWFRPHNRSSAVRNLYLVGAGTHPGAGLPGVLSSARILDSVVPDARVTA

SEQ ID NO: 2533 - protein, 246 aa, Methylobacterium sp.
FFTTKEIGKGTGLGLSTVFGIVKQSGGTIDVQSKVGEGTAFRIYLPRHVPVAEPEEVPAPAAEPALPRVEPLAPASTAAHPDSGPDAKPVTAPAAGGDAVVPKGETPPAKVDKPAPRKPAADHTGQGTILLVEDEDPVRAVNSRALSARGYTVLEAASGLEALAIVREGAQTIDLVVSDVVMPEMDGPTLLREVRKHQPDLKVIFVSGYAEDAFRKNLPEGETFNFLPKPFSLKQLVETVKKTMAD

SEQ ID NO: 2534 - protein, 262 aa, Methylobacterium sp.
LTNGSVEGPHGHLKRAIADALLLRTSTDFPDLTAYRTFVDEIVGRRNARQAKRIDSERAVLARLPERRSCDYEQVSVRVSSAGGFRLRKVFYTVPSRLIGHTLRVRLYDDRLDVFVGGSHLLTLPRGRAHPDGRHDQVVDYHHVIHALRRKPMALLNLVYRDRLFPRAPYRHAFEALRAALPERQACRIAVDLLALAHDRGCEAELAECLAVELAAKLLPDLATLRARFAPDPATIPHVTVALGSLASYESLLDSVTTGGAA

SEQ ID NO: 2535 - protein, 103 aa, Methylobacterium sp.
LLGAIQALIADLPTYGYRRVHALLRRQAERDGRPAPNAKRVYRVMKVHGLLLQRHVGGAETRRHEGKVAVATRNTRWCSDGLEIAAENGERVRVAFALDCCDR

SEQ ID NO: 2536 - protein, 103 aa, Methylobacterium sp.
MTGTIVSLRSGRSTTSALTHFDITAMELLREGRATTLSEARLDAIRAELLAKRAELAAVLADLQARPSSGDAQIDAVNATLRIEAGIGLSHIELFIKQVEVCP

SEQ ID NO: 2537 - protein, 58 aa, Methylobacterium sp.
MRFAVSMMQGLVKGPASRRLSRSRRAALAALAVAGLAAPAQAQTLASLPTEAGARVQG

SEQ ID NO: 2538 - protein, 58 aa, Methylobacterium sp.; identical to SEQ ID NO: 2537

SEQ ID NO: 2539 - protein, 77 aa, Methylobacterium sp.
MGDDDLHAPSRETGYLSALRDLMIVHQQWIEDGCGFENVQAHRHAIRFLGGLIAMKQARMASRAKDPKSERPRGWSS

SEQ ID NO: 2540 - protein, 567 aa, Methylobacterium sp.
MEMFEAFGFSERVLKEAYWVNETCFWNPDPSQSNMITRTGRIVDTEEGLSEFPHVIMNQARVHDFFLATMQNAPTRLEPSYGRNFLDLALKDAETGDGIEPSSDFDYPVNVRLERIDDSQTSAVETVRARYIVGCDGAHSAVRGAVGLTVHGDSANQAWGVMDVLAVTDFPDIRLKSAIHSAKEGSLLIIPREGGYLVRMYIELDKLDANRRLARDAVTVDHLIAAARRILHPYTLEVKEVPWWSVYEIGQRLCEAFDDGGLAHREHRSPRIFIAGDACHTHSPKAGQGMNVSMQDAFNLGWKLAAVVRGQCTPQILQTYSMERRAVAQELIDFDRAFARMFSAPPRPSDVTGGDGVDPAEFERYFVKHGRFTAGTETCYPPSLITGQSTHQNLAEGFRIGTRFHSAPVIRLADAKPLQLGHTVKADGRWRLFLFADPESPDARSSRLRAVCTYLAEADDAPIRRFTPAGADIDSVIDVRAILQQGHRQFVLGAMPPLLRPPKGRYNLVDCEKVFCPDPKAGDIFALRGIWRADGCIVVVRPDQHVAHVLPLDAHAELAAFFDRFML

SEQ ID NO: 2541 - protein, 161 aa, Methylobacterium sp.
VAAFVSRQAVAAADLPGLMRTVRDGLLALGDAAPPIVAEPEPDRPAPTPAQIRKSVHPDRLISFINGCEYRTLKRHLTAYGLTPDSYRARFSLPHDYPMVVAGYAAEHSALAKAIGLGVHGAQAAWQASSSIVNDAEHLYRSRNAVLGRAKLPDRQTRMTP

SEQ ID NO: 2542 - protein, 95 aa, Methylobacterium sp.
MKFRPLHDRVVLRRIEGEEKTKGGIIIPDTVKEKPQEGEVVAAGPGVRDEAGKIIALEVKAGDRVLFGKWSGTEVKIDGLDLLIMKESDILGIVA

SEQ ID NO: 2543 - protein, 313 aa, Methylobacterium sp.
MSAVNVICGSRRACVLTDASLYDSAGTIVGFELKAYAVESWTGVITGRGNWWGPTFVRDLAESFGSFDEFMSRSAATIEREHREAMEGGQLAGQTLIEVHAVGWSERRDEPEAYVLRSPSAFLDADEPSYVWRSLEDEDGIFHHAHLSAGELWQLHRQSAEEGVDWTAETFDPVRHGIPLMEAQRRQAADAMAGPDVAGKHVIGGALWLTVVDREGVRQGIIRQWPDSAGEAILPASLDESSLPKVPPSGFSAAWTFERFDRAVRAGVIDFATFDFDPAALARLEAAAPTGVGLSRQQRRAAKAQVRKLAGAR

SEQ ID NO: 2544 - protein, 67 aa, Methylobacterium sp.
VQGIMPDVAVHGHPIAGHACRDSLIGDRRRSSVVGSSRILAVGAENLGRGAIRSNAASKRISPIVRL

SEQ ID NO: 2545 - protein, 62 aa, Methylobacterium sp.
RSSAVTLKVEGLYVNLDRNTRNQGAFVINAANNFPVVYSGIGRRSDEFAVVRAGLNYKFGSY

SEQ ID NO: 2546 - protein, 43 aa, Methylobacterium sp.
VTSGDAFIMLTSVRYCLGRHSYAPSVITQACDGWVQAPMVLRT

SEQ ID NO: 2547 - protein, 186 aa, Methylobacterium sp.
VSSAHDGDPGVGAVQSCDRLASAPWDPDAPDAQRTVNFRDLRAGAAVAACRAAVAEAPRLRRLHFQLGRAYDRQGANHDAFEAYRRAAELGSGAAKVNIGILYQQGRRFEKSDAKARAWFRNAAATGIPEGMYCYAVALDNGIGGSPDAAAARAWYVKAAERGTAKARDALVRLELDGTGTGVRCD

SEQ ID NO: 2548 - protein, 62 aa, Methylobacterium sp.
VSAPSPHGSGGPAPRRILVTGAAGFVGGHVLPLLAGATAGSTAESAARAGWGRSGRRRRALP

SEQ ID NO: 2549 - protein, 357 aa, Methylobacterium sp.
MPFALPDLPTVRRTNRDTLAAFLEGADASVPNSALRVLSDMNAGGAFLNLKYLQWLAKNFLPDLAEKGWLDRWASILFGGRKAATFASGTVTVTGTPGVTLPAGSILATSDGVQYQTAVDVILSAAITPVAVTCLTAGAIGNRDKGALLSLTVAVSSVNAQATVVLIDGGADTESDDDLRVRILLRIRNPPMGGCATDYEQWTLSLPGVSRVWVAPMEMGIGTVTVRFACDVLRAGNDGLPTPDDCALAKAYLDTVRPVTVADLFVLAAIPQGIVPRILNLSNDTPSTRLAIAAALQAMLLEKAAPGQTIFACWISDAITDAVGDATFDLVTGDFVMANAGSIASLRQPFGGGIAFT

SEQ ID NO: 2550 - protein, 236 aa, Methylobacterium sp.
MSDAFIRRDGEDYAQAFARLLPTGEAWSRDPAATLMQLVRGQAEIWGAVVDPRAADLLEIETDPRFTLELLTDWERAYGLPDPCVPVVQTLPERRQRLAQKIAMQGGQSRAFFTGVAASLGYAITITEYVPFQFGLSSFGGSHGRLNPPGFRYCWSVTVTGARLTRFQFGVSSFGRDPLLSIRRAEDLECILGRLKPAHTLLRFNYGPPAPTVRQQRFSFGTSTFGGDPLLRLIAS

SEQ ID NO: 2551 - protein, 98 aa, Methylobacterium sp.
MADRKQTFTPEFGAEAVRLAQTSGRSRREVAADLGVGLSALRNWIDGRREREMDNPPTDRQEDMAAELKRLRRENEVLRQEREILKRATAFFAKEGSR

SEQ ID NO: 2552 - protein, 40 aa, Methylobacterium sp.
MRIAIITPSRLKPSTLAGKAGQYFLEHAIASANAQELDRP

SEQ ID NO: 2553 - protein, 643 aa, Methylobacterium sp.
MANTIRLKRSNTAGNAPASLADGEVAIQQADGALFWRNASAAVQKLLLPRRAPVADAAYPIKSTDTYIGISSLTAARAFTLPLASSYPAGHVLTVVDESRLCSSSLTITFGVTGSDKINGATTFVVSEPGFFLRLVSDGASKWSSSFVGAASKTDLVTKLDQNFGNVSFPGARNTLGLREINAADPQYGGGVVADCTGVGVGTDNGPRLQLAINAWVASGAGSVLKIPRGRYRITTPVIANLGGLAGLVFDAGDALLTPDPVAMVAISIRNGFGLTIRARILEGGPFGGWGASNPYGVDYSSIADAVAGGGQEAIRVSGVSGYTVDLWAQNYAGRLLRITTAASGDPMTSAIKGRIVTTRGTDLSKPRVGQSIFTDNGTGDPTGAWGQLEGLHNDFDAYGPVWRDVNDVAVTYLDGAYAYTGIALHGVGIVHGASWYIGDIDSNASNTHLDFAPSPATGRPGYRLSLAQLTMLNAGNGLNISGTDLSQRAADIGIARMIGATGTFGNAVNIANAKGVAARIEASGAGGSILAITGAGADDVRLDLHASGLNGNFAYIASEVAGRIQIGGAMSNPVPGNSVLVVGGNTPVRLSDLDVSGPSGPSLLYFVSQTNKVRWVSGSKSGAATTYAGYQPAYAAPAVDIQ

SEQ ID NO: 2554 - protein, 466 aa, Methylobacterium sp.
LREINAADPQFGGGVVPDCTDVGVGTDNGPRLQLAVNAWIAAGPGSVLKVPRGRYRITTPVIANLGGRVGMVLDAGDALLTPDPVAMVAVSIHNGFGLILRARLLEGGPFAGWGASSPYPVDYGSIADVVSGGGQEAIRISGVSGYTVDLTAQNYAGRLLRITTAAAGEPMTSGIKGRIVTTRATDLSKPRVGQSIFTDNGTGVATGAWGQLDSLHNDFDAFGPIWRDVNDVAVTYLDGAYAYTGVGLHGVGIVHGASWYIGDVDSNASNTHLDFAPSPATGRAGYRLALGQLTMLNAGNGLSISDTDPSQRAADIALVRMVGASSAFGTALKVDNAKGVSARVEASGLGDAIAAVAGADTDDVRLSLHTPGLGGNFATIATEVTGRVQIGGALANPVPGRSVLYVGGDTPVRLSDLDVSGPSGPSLLHFASATNKVRWVSGSKSGAAMTYAASPPAYVSPAVDLP

SEQ ID NO: 2555 - protein, 115 aa, Methylobacterium sp.
VHGVIAGLLTGAPNFETGAVEQANVEKPSAAQIRKSVRDEGIVSFIDGKTYKTLKRHLTSHGLDPRSYRDRYGLPADYPIVAPSYAAQRSELAKAIGLGQLGAMAGRGRKGDKAA

SEQ ID NO: 2556 - protein, 123 aa, Methylobacterium sp.
VHAVIAGLVAGAPNTETGAVEQADVEKPSAAQIRKSVRDDGIVSFIDGKTYKTLKRHLTSHGLDPRSYRDRYGLPADYPIVAPNYAAQRSALAKAIGLGRPGAMAAQVDEGVQPERKGRRKAA

SEQ ID NO: 2557 - protein, 184 aa, Methylobacterium sp.
LNFNDNGFDAAVIGTNMNFNRTNNTGAIGADWIAHFVQSIGPKPIGSALTAIGKMRVGIDLSHANFDADKMALALPAGARIYGNAYNTDTHSMPRYTMPNVDWIERSPSGFWGIYYNNASTMQFNDAQVTSIPVFFAYGGIREPSNPPPNSQTGCTTGDRAWDSNFEYRCVAANTWRRAELKPF

SEQ ID NO: 2558 - protein, 184 aa, Methylobacterium sp.
LNFNDDGYDDAVIGTNMNLNRTNNTGAIGADWVAHLVQSIGPKPIGSALSAVGGMRVGIDFTHANFDADKIALALPAGARIYGNAYNTDTHSMPRFTVPATDWIERSPNGFWGVAYNNLTALQINDVQVTTLPVIYASGGIREPSNPPPNSQTGCTPGDRTWDQSWEYRCVASNTWKRAELKPF

SEQ ID NO: 2559 - protein, 61 aa, Methylobacterium sp.
MGDERDPVLEAAEALRADGVEVEPAGDDFTLWMVKGKLLTNLDLLALAVLLGPIDALIGVQ

SEQ ID NO: 2560 - protein, 61 aa, Methylobacterium sp.
MVEKRDPVLEAVEALRADGVEVEPADDDYTLWTVRGKVLTNLDLLALAVLLGPIDTLIGVQ

SEQ ID NO: 2561 - protein, 217 aa, Methylobacterium sp.
VPTPLAEGKGLIIGSEALIRSHSVFYEGSMFGDKLVTGHKVIVRELTRAGASFQIGTLGDIQGHCCVGDYVRFQSNVFIGKGATIEDCVWIFPHVVLTNDPHPPSDIQLGVTVRKYAALSTMSVILPGVTVGVGALVGASSCVTKDVEDYRIAVGNPARDKGPVWRIKLRDGSGQPAYPWISHFQRGYPEHLVREWQDLLNGSWERLRPNDMEGSPT

SEQ ID NO: 2562 - protein, 210 aa, Methylobacterium sp.
LAEGKGLTIGANALIRSHSVFYEGSTFGDKLVTGHRVTVRELTKAGANLQIGTLCDIQGHCTIGDYVRFHSNVHICHGATVEDCVWIFPYVVLTNDPHPPSELTLGPTVRKYAAIATMSVVLPGVTVGTGALVGASSCVTKDVADYRIASGNPAQDKGPVWRIKLRDGSGQPAYPWISHFRRGYPEHLVKEWEDLLDGPQMVLGPDEMRD

SEQ ID NO: 2563 - protein, 162 aa, Methylobacterium sp.
MPNRVQSAFRAAAEVGVGLVAACNRLRLPRAANPFVVGVHAPMRAELTLEDLPVTGTIPPGLDGLYLKMGANPVRAATRGHDWFLGDGMVHGLALEGGRALWYRNRWIGSRTAAAALGRPAAPGPRRGGNDTVNTNVVAIGGRIFAVVEAGSFPVELSPTLE

SEQ ID NO: 2564 - protein, 162 aa, Methylobacterium sp.; identical to SEQ ID NO: 2563

SEQ ID NO: 2565 - protein, 111 aa, Methylobacterium sp.
MRRLALLTTLALLPAAAMAQDYDPSKATKYASPPMYRPKVNQLILKGTGGVVCDNPAGCDASTLSVTLPSGAKLTLPDAFAAKMSSINVAAAPSSAGNWGSVDTAFTGDTS

SEQ ID NO: 2566 - protein, 77 aa, Methylobacterium sp.
MYRPNVDRLIVRGAGGIVCDNPDGCDASTLSVTLPSGSKLTLPNAFAAKLSSINVAAPPSSAGNWGSVDTAFTGDTS

SEQ ID NO: 2567 - protein, 57 aa, Methylobacterium sp.
MTIFQVRQARSRAIVWTGEAESADRALEAAAQSAGYHTFAEMPDALRTDMAVEAVTV

SEQ ID NO: 2568 - protein, 57 aa, Methylobacterium sp.
MTIFQVRQTHSRAIVWTGEAATADRALEAAAQAAGYHTFAEMPDGLRSGMAAEAVKV

SEQ ID NO: 2569 - protein, 85 aa, Methylobacterium sp.
MMDERQALTAFAALSQETRLQIVRLLVQAGPEGMASGVLGSELGVSASTVSFHLKELDHAGLIQARREGRSIIYSAAYPALSGLI

SEQ ID NO: 2570 - protein, 85 aa, Methylobacterium sp.
MMDERQALTAFAALAQETRLQIVRLLVQAGPEGMASGVLGSELGVSASTVSFHLKELDHAGLIQARREGRSIIYSAAYPALSGLI

SEQ ID NO: 2571 - protein, 37 aa, Methylobacterium sp.
IEVPVMLTVVWIVNRSQGWYERGATRNAALKTISREV

SEQ ID NO: 2572 - protein, 37 aa, Methylobacterium sp.; identical to SEQ ID NO: 2571

SEQ ID NO: 2573 - protein, 94 aa, Methylobacterium sp.
VRSEAVGRSRLTIISALGVVEILTWGSSFYLPAVLAGPVAQDTGWPLAWVVGGLTLGLLVAALASPHVGTVIERHGGRPVLALAALLLSAGLVV

SEQ ID NO: 2574 - protein, 94 aa, Methylobacterium sp.
VRSDPGGRSRLTIISALGVVEILAWGSSFYLPAVLAGPVAQDTGWPLAWVVGGLTLGLLVAALASPHVGTVIERHGGRPVLALAALLLAAGLVV

SEQ ID NO: 2575 - protein, 46 aa, Methylobacterium sp.
MSTFERYLTVWVALCIVAGVALGHVMPGIFQAIGSAEVAQVNLPVA

SEQ ID NO: 2576 - protein, 46 aa, Methylobacterium sp.
MSTFERYLTVWVALCIVAGVALGHVLPGVFQAIGSAEVAQVNLPVA

SEQ ID NO: 2577 - protein, 185 aa, Methylobacterium sp.
MPHPEIQPASRREWWPETFIDEVSPDGRATPSDWLIRLEGGGYAYGDPTDRLAPPKAVREGDVVEFSFRDYLGSSLMTLDADGEPVWTPPLPQGVNLFWDGHDSDTICDTEGAFAEFVKEYGEHQDSQVTVLCHWSERTLRCQFTAAGGVLRFLPIDDPPPPPVMPVEAPVQPSHDDLFSAAPTA

SEQ ID NO: 2578 - protein, 180 aa, Methylobacterium sp.
MAENLIPAIDGRQWWPSDCLDEIMPEGRATPDSWLFRLADGTHRCGEEGETEHPVCSVSEGDVVEFIASDNLGRARMTVEDDGSVRWEPRPPDDSHIFDADDFEMSGDGPDDFVRNLRSFNDLDPGESVEVYVTRWSAAVQCRFTAEGGPPRFVPLSDPPPAPEKPLAPPAPPEPHPTLL

SEQ ID NO: 2579 - protein, 530 aa, Methylobacterium sp.
MDRVIVYPNALPRALDVLRTNQFAMVGLGGIAQATLGTSTIVDGFTLTPTSPASLSCNLGPGQIYQIDSLEETAISSLPSDGTRIVKQGLLKATTLITFAPQLGVGQSACYLVQAQYDDADTGDQVLNFYNAANPAVPLAGVDGNGQSSKTIRSGAVALAVKPGIPTNGVPTAPTPDAGYVGLFVVTIAYNQTQILAGNIATYAYAPTILDKLPAIPSALQSNKYVYVKDVGAVNALSVNPVPAYTAYQEGQELVVVPNFTNTSTTVTLSVSGLPAAAIGLANGSNPAVGDIIQGRPLRLRRSGTGFWNFTGPAPSEAGPAAAQQAAAAATQGLKTPPYYNLVPGTYSVVVPAGVTSCDSELWGGGGGGGGVGAVNNGSGSAGGGGGYSFKTITGLTPGQTITLVIGGAGTKGGAGGAGGNGGTTTLGAYHSASGGAGGSPNGIGNGGVGGLGSGGDINIGGGYGSAGASTGVSLGGAGGSAPFGGQGGGGAPGIAGDGTMPGGAGGGSGSTTINPGGAGAPGGCIIHWK

SEQ ID NO: 2580 - protein, 151 aa, Methylobacterium sp.
GSAGGGGGYSFKTITGLTPGQTITLVIGVAGTKGAAGGAGSSGGTTTLGAFHSATGGAGGSQNGIGTGGVGGTGSGGDINIGGGYGSAGASTGVSLGGAGGSAPFGGQGGGGAPGIAGDGTVPGGAGGGSGSTTVNPGGAGAPGGCILRWK

SEQ ID NO: 2581 - protein, 210 aa, Methylobacterium sp.
MTAILSLPLLQVAFETATNEDWRDGLAFATAGEAVGYAAPGNTGTGTITDLAVSAGAYIGDYVVTMASPTAFRVTDPDGYTLGAGALGVPFSRSGVSFTVTAGASGFAARDTLIVSVLPAPIDITGIAFRMQVRTAAGNESVKLDVSTEASTIVNGGATGVLGIAVPGERMARMKPAALVFDIVAIADGLERRVATGTINHVPGVTRLIA

SEQ ID NO: 2582 - protein, 224 aa, Methylobacterium sp.
VSNLALIQPQPVDFDTTQATDWLDGLPMIGTPGVIGTLASPSNIGSAGLVVSAAPGAALGVHKVTVAALVNGLIDLTVSDPSATITGFGIAGLPFYAGGLTINLSQVTGGAALAIGDSFAIAVVPVAIDLTGLRFDLDARASIGDPSIALQATSDGPNPTIANGGPLGVIAMAVARASMARLPVKPEGYPYGITASDPVSGLTVPVFYGLIHHTAVPAQIGQGA

SEQ ID NO: 2583 - protein, 68 aa, Methylobacterium sp.
MIVALLLTAAGVIVGMPIVLYGFIRLDERPGRASWLILLLGLVIIVAPVTTALVLHQEESGAGRYVGR

SEQ ID NO: 2584 - protein, 68 aa, Methylobacterium sp.
MIVALLLSAAGVIVGMPIVLYRFIRLDERPGRASWLILLLGLVIIVAPVTTALVLHQEKSGAGRYVGR

SEQ ID NO: 2585 - protein, 321 aa, Methylobacterium sp.
MQAGGMTNGGKTVDTQIADALREALMCSVFISPSDPGLTYEELQEVGRRAGYRDGEVNDALRQVANNYTGRDRYVPEENTFIHGLTWMPDNPELRDFDAFDFVVKALNERIRDIGIREARIDRGVVVEQAVSSGLDRVAVEAAITYMVFGNLLAESNGSLRTTQVMGTMVVPGDRWREWKRGRDVAWPRPHRARMRPIVSDVIGRRTNGRPSHAEPLAAFPDALDRLGFRTFKVWWTQIAREMLTSDPSSAATARIVLAAALVEGVLTFVVQHARSKGLAVFQSSDFQRTPEHWKIVDLIRSAATGGKDAVLTQDAKVRAE

SEQ ID NO: 2586 - protein, 321 aa, Methylobacterium sp.
MQPGGMTNGSEIVDTQIADALREALMCSVFISPSDPGLTYDELQEIGRRAGYRDGEVNDALRQVANNYTGRDRYIPEENTFIHGATWMPDNPELRNFDAFDFVVKALNERIRDVGIREARMDHGVVVEQAVSSGLDRTAVEAAITYMVFGNLLAESNGSLRTTQVMGTMVVPGDRWREWKRGRDVSWPRPHRARMHPIVSDVIGRRTDGRPSHAEPLAAFPDALDRLGFRTFKVWWTQTAREMLTSDPSSAATARIVLAAALVEGALTFVVQHARSRGLAVFQSSDFQRTPEHWKIVDLIKSAATGGKDAVLTQDAKVRAE

SEQ ID NO: 2587 - protein, 111 aa, Methylobacterium sp.
MKNLRQHPDGSGGMYLNWTKEQLVEALQDRIQRKDKVPNGGPYERYFLVIITDEFMLTSDVVSAYLEATVFRVELITDVILGLSYEPSPTPNDRAGTTPTFRLPLAARERR

SEQ ID NO: 2588 - protein, 111 aa, Methylobacterium sp.
KASMKNLRQHPDGSGGMYLNWTKEQLVEALQDRIRRKDKVPNGGPYKRYFLVIVTDEFVLTSDVVRTYLEAAVFRAELITDVVLGLSYEPSPTPSDCPGSNPIFRLPLAAR

SEQ ID NO: 2589 - protein, 164 aa, Methylobacterium sp.
MIRSALRPFWWAYWACVALFMLGTVAGAVGPSVQARVAPIHEDMQAVSIARTPERMCWDYTSRKLREAATDDLDTFLYVAGHDRMVVAPVGEVDGMPWRASRAPGIGPYRKRWCIDLPPGVPVGEPIRFELTAYYRGPWGLWRMPLAWPPVGAKGLPGTRTTTP

SEQ ID NO: 2590 - protein, 362 aa, Methylobacterium sp.
MTAVVASAPAPARRRLEVNLPDAHIGLWQKDPNDPTLRTEIYEGLLGHLKRRGFKITAVPRVAKHHRCISPLYRLAARGDLRAEIHVSGCVVQLDWWSEAAPEGNKSGRQYDFGRRRRMPYLDGLRFELEVRHLLAWVAERADIVTRPQHRGDRRVGIGRGEVSAAEYIEAAYATSWHTDKDLGRPKCSDSNRKSADGDLIEQESRVWFRDWHGRMLTGIAYYSLNNRWMIVTSAHSMSWASAYEIFTRCPPDLRRKRNERQRRKRLEGELAKAIQRMDFRRAETVRKILFGTELTYGIYHVEHDALYGPGFSGYTKDRLEAGRFTWNEAAREVRGHPDLLRLVLPDGKHLPASELGQAKAA

SEQ ID NO: 2591 - protein, 479 aa, Methylobacterium sp.
MNARRSNKLTPLEEELLDLRDRVQELQDALRERDKAFAPEIRIPAEWGLSRAEAVTFSALMNAVGKTVRRAGLLLVCLPSYTVPSDEVLDKTVASLRKKVTPHGYTITSVMGVGYSITAPADPAEVPQPAAAAVAAPAPRKRPAGPNAYSEAEDAIIRAGVEAGKLLPAIRLDLVSAGFRRSCTKSIRSRAEWLGLKVPVELKRWTPEEDEIVATNTNAPIKRVRTLLATAGFRRTIKAVASRRIDLGLQPRPMGLTPELKQIVRACIAQQMTDPSTLAHLRGLGHDVTLSQVKNVGQQIRARSRPGWTKERVDTLRAMAEEGKRPIDIAHALGLTNSKTVNEKARHLGISFARLWLDEEVRTLLAMMGERKTSIEIGEALNRPPSQVVNKARRMGMSFERWPEESAWTDEKIDALRKASEDGVRLADAARALGRAPDAVFQAARRFGISFSRDRKNLLPLARTEQTKINGNHYSVAQQ

SEQ ID NO: 2592 - protein, 185 aa, Methylobacterium sp.
MLSPAHFDYLVSYAVAREIRYWSRADKCQERVTSTGANAVGRMLASANADAYANRYSSHGDEFERGENFRAAREYRWRPFPGPFDPVQVIKAVDCLEYQACEASGWEDSDASMLCHAIRAYAVRALAGYDDAKWCIDDVADLRPAKPAAAPASGVASRALRLAAAVPAFTPPAPPAPFFGQGALF

SEQ ID NO: 2593 - protein, 207 aa, Methylobacterium sp.
MPDLSRRALLASITAAAATIALPASAAPLSGTVIIDDPWHSIPPAPRPLPTLPELKALSERALAALERHWPRHIYGETFLSEGDSPHGLVIRCDCLDRPDTSHGRSGYRCSSVLPGTPMIGAMSGYFEPEWDERTTYGILLDVTWWNERPAAISDADWAEVLAIVDMTPESHAERMADLARQTGEADAAWDRFAEEFNRTNGELPHV

SEQ ID NO: 2594 - protein, 158 aa, Methylobacterium sp.
MKRETAPPRPMTAREAHAALEQLRSEIGPKAYVSISIAASDISDAIIHASIYAHGIAQTSPNFACKGEDLGEAVAALRAGWAGFQEEHARRMSADMALEIIRLTDAHGCCTDAALRGSKFSVGDVRRWGEAACARANEMAGRGPFTIVSIAGANGEAA

SEQ ID NO: 2595 - protein, 151 aa, Methylobacterium sp.
MTDIIKTSAWSQKVPSDHIKIGISRGTPRGHAAGYRLFKTLAPGAWFNSVSATEYRERYFAEILAPLDPAAIVATIQKLAGDKVPVLVCYESPTKDEDWCHRGYVSAWLKDKLGLDVPELGHEERGCGWSHPKLPPTQRVKPAVDGPARLL

SEQ ID NO: 2596 - protein, 182 aa, Methylobacterium sp.
MLTFKRTRGSRLDPLPTFEVLAGAARLGFITDTGPEGAGMRWKGTAADGTPLAATSKAKIAQKLQIHDAATRNAPGPLGPVYAEPARVSDAHGRYFSHIHAGTGREDRGNVIAAVYQGGPGGTLNTGPAVDAAARLLAAAPKLLAALKSVQGCPQAAPWLAAAGIHEEIQAALAAAGPAPRT

SEQ ID NO: 2597 - protein, 130 aa, Methylobacterium sp.
MRTVFAILILAAVGPAAAADVYLFDLLRRPDYKRAYNAMLKSGSSVPKWVTAYSRTLNGPSQPSSEIKADGETYLLADVCKVHDCLDHKLHVIFAPGGRRAWGRLYENGSTSWIGSPSPALRKAAERIEF

SEQ ID NO: 2598 - protein, 340 aa, Methylobacterium sp.
MYDGEGRFPRIEGRRDISEYATGRISTDEVPPHERIDHWTEACRTAFGGFEFVDVERKGFHAALSTLTVDCLTVGHYVGSPHAMARTKAHIRSSDNNFYLVILGSERTFNLEHGRYLNSAPGGISLLDNTQPFLGAHPDGLDIINVFIPRAVLEQAVGPARSIAGLSIDATQSTYPLIASYLSALIRHGGALTPARQARMAAVAVELLAAGFAERIESGSPRSLSGAAILCRAQAFIAEHIGVEGLSINDVAAALNISVRRLQEVACAENVALMDWMWERRLQLAQAKLADPANGVMPVGLIAYQCGFASQAHFSRRFKERFGQTPTEFKVWAGLQRAPA

SEQ ID NO: 2599 - protein, 106 aa, Methylobacterium sp.
LLYARIEPESEHRQNGLLHPEKVIQAGSIQLTSVSFENGSLPIISACAEFQLSFDRAFRDTGGLYDWMEQTDWLDHALCFGFRLQDGGEWDATYDHAGIDFEIVTP

SEQ ID NO: 2600 - protein, 179 aa, Methylobacterium sp.
MSGSGVVHEAAVAASEPFGAFAAGLADLSPLRWAVVAACRRPERDCVVPLLEEARLPPEAARRVAEDARRLVETLRRRGTRGGVEGLIHEYALSSQEGVALMCLAEALLRIPDAATRDALIRDKIAGGDWAAHLGHSPSPFVNAATWGLLVTGRLAATRDEAGLSAALTRLIARGGQAG

SEQ ID NO: 2601 - protein, 58 aa, Methylobacterium sp.
MVSRAVCRTAGPNCLTGGVLLAESGKSEKDMSALPGRSAVVERRASAAAFAEKAPPVA

SEQ ID NO: 2602 - protein, 39 aa, Methylobacterium sp.
MLRGVDILADAVKVTLGPKGRNVVIEKSFGAPRITKDGV

SEQ ID NO: 2603 - protein, 55 aa, Methylobacterium sp.
MRRFIVLWTVPGLGFAFEADVAATSPREARAAFRAMFPSDRVKAVKLPRGNGRFV

SEQ ID NO: 2604 - protein, 164 aa, Methylobacterium sp.
MLSPGLDFDPRFWPSDPSPDETVCLQLSDRIDCYCLLDRQDYLWARRWLWCHTYGSGSFDPDTWTIDRPDGIYARRSVPIPGRITPSGRPAYGNLFLHREILERAEGPPPDPSWVGDHINGDTLDNRRCNLRWASKSLNAQNTVRHRAATLARYAAQHAAACSA

SEQ ID NO: 2605 - protein, 74 aa, Methylobacterium sp.
MADDMSEDKTASRQKSDAAMERTRKLVLDTLPPGPVRDRFAALTLDELRGLEFDSDLWRQVRVALSHVEGRHLN

SEQ ID NO: 2606 - protein, 48 aa, Methylobacterium sp.
MVDCNCTGLRFGKLVFVWLRRERAFRLNGFFAFTFAFRSIRCLCLKPA

SEQ ID NO: 2607 - protein, 289 aa, Methylobacterium sp.
MSSLIFHDLPRGPLPLYISEPVPGLEEAKATLLLDHHHREVRFVAADPFTPFTIPPAGVDRYSWWDVDPMLPRWQVRELYGEARPLLERIQMGTTLTQLPTHWHRTRTPEALAAAEMVEELAAQPAQAAVEWVPGLRPVREETALERAIRITEAAVRSEFIHQFHQKELAGMPIEAHERNFRNLLAHGKDIFYSHGDRTLGMSGSPILNLSPGTGKSQGVIGLLNAMGPVSKSLATDDGSAVGSPSQETMRRRTKGVILPGNHDRYSRKGINGKWGALFEESDVRRIAG

SEQ ID NO: 2608 - protein, 45 aa, Methylobacterium sp.
MTKSLQIIDTKLNKIILTKISEHEAHKRVDLLNSCGIVRYKARAI

SEQ ID NO: 2609 - protein, 486 aa, Methylobacterium sp.
MSWDNEKVVAFRPTDSQLLERLPHCFDTERALLAALLLKPDQLTEVAHGLKVDDLFGAEHREVYGTMLALSAGGLPVSAVTVAQYLKTREIAGQPPARYLASLAADAASWDAPGHATIVREFARRRALVMIGEGLAEQARQGGAEDQASTLIDETDTALLEVRGTGSDGRMSGQDAAQATAWMRERIEGLRSGLLRSTAVPTGIADLDRATNGGFQRGQLWLLAGRPGMGKTVAMTSLSRFAAREAGVLVFQCEVTRDQQIARYLADLSYLHNRPLTFGKIMAAVELDDDELWRIDEAMKRYERLHLKLECEPSVSVAQIAAAVKAEKRRLAKMGQDLGVVFIDYLKFIKVSDRYQGNRVLEIGEISGSLKQLAKSEDICVVLLTQLNRGVESKDRADKRPSLADLRDSGELEQDADAVLMLYREAYYLEKKLKGSSDDDVATRLIEKQNTLEIILAKNRSGPCPTLDLWCDVASSAISQTTRGPR

SEQ ID NO: 2610 - protein, 170 aa, Methylobacterium sp.
MALPKILALDLATRLGWAYGSPDGEPHYGSKLLPSTGAEIGRFGDAYDQWLLDMITLENPALVVFEAPFVSGTGNSNTARKLMGLCWQTELACYRRQIRCLEHNNQSMKKDFAGSGRAEKLDMMAAARRHGWDPKDDNAADALALWACAVHEKAPKYSRLTLGRLGGRAA

SEQ ID NO: 2611 - protein, 77 aa, Methylobacterium sp.
MLGKTLRDRITGFTGIVTGHVEYLTGCNQCLLTPPMRDGKRMEAEWFDVQRLEDTGAAIIVLDNGLTPGCDRAAPKR

SEQ ID NO: 2612 - protein, 133 aa, Methylobacterium sp.
MRNLRLLDVYRDASPRVIAMYGDAGDHSYGVFRVPSPTGGQPLVVIASTGEGWDHVSVSLPNRCPNWPEMEHVKRLFFREDETAMQLHVPPSDHISVHPYCLHLWRPLSGEIPRPPGWMVGPSSTEAAGKVVA

SEQ ID NO: 2613 - protein, 109 aa, Methylobacterium sp.
MRIMLSAKMGEQVRKDPRTVIVDRVPWELFDEQTTRARCESNHGQTIERISERGGFDATEAVGVLTGLKWGELRHLREEHAHRILYQMVHLFRRGVLTGRRSMQEASNG

SEQ ID NO: 2614 - protein, 73 aa, Methylobacterium sp.
MIGRTYLEAGSPVRVLIRWGRTSAGPSAPIGPLSDCSWSRRRAPHNVLIERQDGSRVVRPFRGLRKLPEVDHG

SEQ ID NO: 2615 - protein, 133 aa, Methylobacterium sp.
MGEPMKALSIMQPWAWLIVNGHKDIENRDWRCHRRGHVLIHAGKKIDRDAMQDLRSGRHPVTGELLRLDLPEVFETGGIVGEATIAGCVERSESPWFVGRFGILMRDARPLSFWPCKGALGFFVPAPVAEVAA

SEQ ID NO: 2616 - protein, 74 aa, Methylobacterium sp.
VIAPTEADIGRRVIYHPVRGHTVEEGVITSFNPAYVFVRYGADAGSKATPRELLEWFGPASDSGLKDQGGDSAA

SEQ ID NO: 2617 - protein, 98 aa, Methylobacterium sp.
VGASEIPVGAQFRLEITWRVLGPGPAFAGMPDDGAITATSPDGGLAVDQPNGTVTWSYTTAQSLGIPLGAVARYTLRCLFGSHTQVWAYGPLRVRGAA

SEQ ID NO: 2618 - protein, 60 aa, Methylobacterium sp.
VPTPAPRPVPKRGEDARLYARRALDYGDANAAGLTDTADRYRALAEAMEHPAPAPETTAP

SEQ ID NO: 2619 - protein, 508 aa, Methylobacterium sp.
MGILVPVGIVAVCSAMLLQLRQDAWDKAEETSRNLIQVIERDIDRNVEIIDVALQNVVENLKLYDLEDISPKHRQRILFDRAINAKDLNALLVLDQYGNCIYDAAGWPPRRYNNADRDYFQAHKADASLGLGISGPIMSRSVGKPVIILSRRTGMRGDDFNGIVLGSLSLSYFDRLFQDLKLGQAGTINLFLDNGTRILRYPQNDTGTPPNFADAPNFQRFQREGRGSFVATTQTDGIERLYTFTRVGNLPLMLNVALSTREIEADWQARALVIGLLVFALCGITVGLSLLVAWELKRRNAAEAELAVLSHTDTLTALPNRRAFEAAFARAWAAGRRCGGSVALLIIDADHFKRYNDRHGHDGGDRVLMALAQAFASCTRRPGDFVGRIGGEEFVVLLPDADAEGAASAADTVHAAVASLSVEAGGVHVGRITVSIGLAYGVPRRGGSPEDLLRLADAALYKAKATGRDRTCYVVMDEHRAVGAKAPSNPSSDPGARPTRPEPASLVA

SEQ ID NO: 2620 - protein, 140 aa, Methylobacterium sp.
MFRRPLSPTRLVRAAVLGAALLGTSTAAEARRAALRADVEGYAMAACLTRQDVPYLREQGHLWGNAILQRGHGSVEDWTTLADAVGAAAARQTMSMARGDGAVHDALKPMPLLFCHELVRSPAVRAAKVRAMRHLAPDYR

SEQ ID NO: 2621 - protein, 38 aa, Methylobacterium sp.
MRNKIETRRRHYNESGPQTALEWPTAQELDLATALQAA

SEQ ID NO: 2622 - protein, 67 aa, Methylobacterium sp.
  MOD_RES (50)..(61): Any amino acid
MINEAVRERLGRWRSADILMRSVDFQAVVDMQRAVLWDEIGHHLGTAAPXXXXXXXXXXXXAHGTGR

SEQ ID NO: 2623 - protein, 256 aa, Methylobacterium sp.
MTKTVAIVTGASQGIGRATAMRLAQDFSALVLVARNRTKLEETASAVREAGSEAFVIDLDLAEPTAAATVVQQTLSAFGRIDALVNIAGAVPGLDVFQMTDEQWHAGLELKLHGARRLTIQAWDVLKATRGAVVFMSGNAAVTPKAAAAAVGAINACIEALAKAFAERGIVDDVQVNSVSPGAIMTDRRTAMLQRAAEAKKIDIAEAKQGFLKQAGITRFGTAEEIADVVAFAVSPAAHWMTGTVLRMDGGEVRSV

SEQ ID NO: 2624 - protein, 323 aa, Methylobacterium sp.
MRAIVLDGFGGLDVLTYRDIPEPEPLAGHVVIEIKAFGINHAEVHMRRGEWAEAAPVSGIECVGIVKSCPGGEFPVGAKVAALMGGLGRTINGSYAQLTSAPVGNVALIEADLPWAELAAIPETYATAWTCLFRNLEIQKGQLLLIRGATSSFGQAALKMAVNAGARVIATTRNPERFGKLQALGAERCEIERPDLSKHIADAKQIDAVLDLVGNSVVLDSLAMLRRGGRSCLAGWLGGLDPIPDFNPLLQMASGVYLTFFGSFVFGTPGFPLADVPLGQIAQDAAAGRLDVKPVRIFGFDEVREAHRLMEANAAGGKMVVVH

SEQ ID NO: 2625 - protein, 326 aa, Methylobacterium sp.
MATPEDWLSRLLALVPVRGRLDIYCTYGAPWRIDQAGAAVGEMAYHAVVAGSAVLEDPTGGPPLRLSAGDILLLPQRVDHILHDGSGAPAAPAHTRTAANLLISENEGTGERLDMLCGHFVLARAQERLLRDYLPPRLVVRTADPGASATLSGTQDVLTGLVSLMRHEAVSDGLGGRAMLNALSTALFTLTLRLASEARDRPVGLLALAGHSRLAPALSALFNEPGRPWTLPKLARLCNMSRATMARQFQERLGQSANELLTDIRMTLAANELRNPSASTGAVAETVGYQSEAAFQRAFKQRMGVTPAQWRRDAQSVEPPVPALPS

SEQ ID NO: 2626 - protein, 173 aa, Methylobacterium sp.
MPGLLSRILACRPLLLRWAPVPLRLVVGYGFLAHGLAKAARGFDAFPAIVEAMGLPLPHLFGWLTILVEILGGLAILLGALVPLASLPMAIILLVAAFTVHLPYGFSSIKLQAVTAAGASFGPPGYETDLLYLACLLTLVMAGAGPLSIDELLRKRLGAVPADQTLRHVGRRG

SEQ ID NO: 2627 - protein, 76 aa, Methylobacterium sp.
PVTLQDAIQVRPWLANVLRNGGPNVQLVRHGFVLPLVCRLVHPGSGTSDVGSGGTSKAESNAEYQRLVDRFGRIPW

SEQ ID NO: 2628 - protein, 88 aa, Methylobacterium sp.
MVATSLAISFTVGAIAIAQIGPFAERATPVLASVAIGLGMLALIGGLSQLNAEGAAVSRADPRPEFGMSWRPPATEPYDRTGSGRTER

SEQ ID NO: 2629 - protein, 80 aa, Methylobacterium sp.
MSTVNLENSIGIPVENALRFARLMDSWFAGVGRVAVPPGNPFLGINPEERETIAFGFADLVERLAAIDAQVSGPDGICPR

SEQ ID NO: 2630 - protein, 109 aa, Methylobacterium sp.
MTMRRSFPPLAALRAFEAAGRRLSFRAAADELGVTATAISHQIRLLEQTLGLRLFYRETRRVRLTAEGTVLLPVLRDGFDAFARAIDEIRGRHAAGVLTLSAPTAFVAK

SEQ ID NO: 2631 - protein, 149 aa, Methylobacterium sp.
MRDRAGNRTTMSARALRGSGGEAQAPFYVAIAASLASAYYPGDRPGDENPGLGLCLLDEAFSKLDVRNSQALVDLYRAWGLQLLIAAPEDKRTTLTEVMDTIVTVYKSPDLTSVRIEAEHPLEAARRALHAINPDQVGIEGFRQSDAAE

SEQ ID NO: 2632 - protein, 194 aa, Methylobacterium sp.
VSDVPAPSRSRPPEYVAIGLIQDAEAYRVAAMRVHPSRETFGAREVDLLAPAWHLLCHSSELALKAYLLSTGVDQGSKKGGLMHSSIRHNLNGLYQWAMERGFEPPDEDFGDLIEFLDPYHSAHVFRYREPDRMPFVPPFVIADILKPVISGVARTVRAKWKATREAGSDDADLASVGLAQAQPPESNTKPSRG

SEQ ID NO: 2633 - protein, 66 aa, Methylobacterium sp.
VSTTLKARMMRLENCYPDLKPGPERMSDEELDGVIGVLRQLEAGETVDPTRLDWATAIMQREQMLS

SEQ ID NO: 2634 - protein, 92 aa, Methylobacterium sp.
MNLKALEARLVRLETKHGAGQFDHLTYEEVERALFDRLHRMADAAGGIDELMAEWDAETDPEHSALIAQIRSHECDVRASYLEMEGRLCPRP

SEQ ID NO: 2635 - protein, 81 aa, Methylobacterium sp.
MSAVLQFPRFRAYRPEPDAMRLAFDFGDWCVELRRSGKLARRIRFASLEEARAEVARQEAAGLRRLPDAPMPEPIGGEDIA

SEQ ID NO: 2636 - protein, 67 aa, Methylobacterium sp.
MRPLVYSDTITVRTDADLRRAIDAAAEREGASASEWVRRALGSIVRIDGPPRSPTPAAPAGALPAAA

SEQ ID NO: 2637 - protein, 68 aa, Methylobacterium sp.
MQTLACRTELATLLRGIQGIAGLAACNLETGGSVQDLCGLFSALGQLDANATDLAGRYGVLISTAGSA

SEQ ID NO: 2638 - protein, 95 aa, Methylobacterium sp.
VISRSLQLDDFLWALDNSRRRYRVRPTRLGDLTFRFGETYPGLITVVSVNGIHHVVMTARCEISPGPWLDTDAYADFRLLAINRKRALRNYGGAR

SEQ ID NO: 2639 - protein, 42 aa, Methylobacterium sp.
METSMTLFTRFALATAVAAATVAVLAGTYVEILDRALPMHFV

SEQ ID NO: 2640 - protein, 89 aa, Methylobacterium sp.
MKKLITTLVAGTALLGAASAVQAHEWGGGYGYGYGYGPGHGHSRVIVREGYGDGYRGVRFGHRGWDRPDVRVIERRGYGHRYHDDDWDD

SEQ ID NO: 2641 - protein, 87 aa, Methylobacterium sp.
VRSTIIAAALLAALGSAVAIPASAAPIGPDTGVSAPAGMVSTVQMDPVERHMMRRRMERRMMRHRMERHMMHREMRREMRREMMRRM

SEQ ID NO: 2642 - protein, 138 aa, Methylobacterium sp.
PGGTVLAALAEDAEGERLMLDGVWRRLRAVRRGAELTVIVGGRNATLVHVDPLAPPRTEASGSDRVTAPVPGRLTQLWVRPGDAVEKGAPLAVIEAMKMEITLRAPQAGTVAEVRHAVDDMVEEGTEIVTFAAEERPA

SEQ ID NO: 2643 - protein, 118 aa, Methylobacterium sp.
MGDINGDIDQTTFQQVGRLLGAERAAEMLGLLRGTLTALADMTDDDLRGPAGLAGVHRLKSEAGLMGFGRVSQACEAVDAVGTNGSVPQGRLDDLRAAMTSALATVATLGPNPGRPTL

SEQ ID NO: 2644 - protein, 140 aa, Methylobacterium sp.
MATASASVEIPAPASEVWRLIGGFGSLPDWLPYIPKSELHEGGRVRHLANPDGGVIVERLMAFDEAGRSYSYHILQSPFPQRGYLSTLRVRETGDGQRSRVEWSGEFQPVGVSDAEVTKLFQGIYEEGLAALRKHYADEG

SEQ ID NO: 2645 - protein, 104 aa, Methylobacterium sp.
MKRRRGLLSFSRVRSAAANHTEALVTRWLPDGHREGREWVARNPTRGDARAGSFKVNLSTGAWGDFATDSKGGDLISLAAYLRNISQLEAARNIAEMLGIDAYE

SEQ ID NO: 2646 - protein, 152 aa, Methylobacterium sp.
LALNATIEAARAGDAGRGFAVVASEVKQLAAQTARATEEIAGQVGRIQGATGQTVDAIDGITARIREIDGVATSIAAAVEQQGAATREIARNVAEAASGTGAVTGTIDAVARAADDTGTAATRMLASASSLSEEAAELRREIDAFLHTVRAA

SEQ ID NO: 2647 - protein, 105 aa, Methylobacterium sp.
MRGSDQRSGTLFSYVNWEARVRPDHPLRTIRQLTDVALVALSGDFSALYAARTGRPSIPPEMLLRARIASPEMLPDVGSLPHLICSPRRFGGGSDDEASEHGDAR

SEQ ID NO: 2648 - protein, 81 aa, Methylobacterium sp.
MGEPTEADVLARAKRTFIAKNHDDRAWDAGFTEREARNGHNVACLTEVERQEYLEQARHELRTSSPSERTDRSKARRKGIE

SEQ ID NO: 2649 - protein, 58 aa, Methylobacterium sp.
MLSPIDALQKLRDQMVINRRKIVDQEESIQNVQAEIEAIDRAIKDEEIISKSTGSKVT

SEQ ID NO: 2650 - protein, 137 aa, Methylobacterium sp.
MALLTDTPESSADAVPKQNRDEWAETVSSYIERSLLIVVGASVTVVAGFLSQVWSSASVAFRTDLATNLKALGTLFVATFVLPTLRFFVELHRDDDPKKSRKAFIVWVIAAALMFSFYTRLIDQLGDIVLKYAKVVG

SEQ ID NO: 2651 - protein, 66 aa, Methylobacterium sp.
MPQTLTGWVLFAALWLTGPIAGYAAMNLAAARWEREAIMRRDILAVTILGSLLLVSALLLMFVDGL

SEQ ID NO: 2652 - protein, 36 aa, Methylobacterium sp.
MFWTHPTETMMWVGVSLVIGLFVGDWGADRQRLPPG

SEQ ID NO: 2653 - protein, 181 aa, Methylobacterium sp.
ALVRDLRESATRIGDVVGLISGIAGQTNLLALNATIEAARAGAAGRGFAVVASEVKELAEQTARATEEVARQVGEIQSWTGDASDAITRVVSRINEISAVSSGIAAAVEEQGSATQEIVRNVGQAALGTGAVTNNITDVARSAEGAGSAAAQVLEAASGLLGQAQRLDAEVGRFLDTVRTG

SEQ ID NO: 2654 - protein, 58 aa, Methylobacterium sp.
MSPRLAAVLSLETALCSAILVEAAHDRLEEEAPATGIARVSAWLLLAAIDFLLWSKAT

SEQ ID NO: 2655 - protein, 66 aa, Methylobacterium sp.
MIAFTPNPHKLRVTPSAKEPGRFDWSITRDGVIVRQSVRSFGSEGASEADGDVAFREITARWQSAR

SEQ ID NO: 2656 - protein, 271 aa, Methylobacterium sp.
MTVLAPTSAQETSRNPLAAFGGGAAIGALGGLIGLGGAEFRLPLLIGLFRFDALEAVILNKAMSLVVVATALPFRARTVPFDEIGAHWPVILNLLAGSLLGAWFGAGWATRLRSETLYKVIAGLLVVIAAVLMFGHDAAAGAALVTGSVQIVVGVIVGFIIGVVASLLGVAGGELLIPTLVLLFGADIKLAGSLSLAVSLPTMLVGFTRYSRDQSFSVIGRNRAFLLVMAAGSIIGTFIGGQLLGIVPSGVLLPLLAMILLVSAVKVWRHA

SEQ ID NO: 2657 - protein, 93 aa, Methylobacterium sp.
MVTDASADLAVYLLKEVASRAPSIVAFMVAEGRRLPEDPDEARQEVRQRWPEMSDDERDMAFRMAINVLRRIERDCAENIARLDALTTDAGRG

SEQ ID NO: 2658 - protein, 251 aa, Methylobacterium sp.
MVGLARRKPKNDAVAAVQPLSVIDGLRAARAQADAERADAVRARVDAEGRRHAAVKAEDERALARLDDEIATARRRIDIAEAKFSRLDGELAQAEYDAEQRRRHGVRSEAEAALNQAREIMRTEYPAAALAVVEVLRRVRELQGAAYRANADLPDDAAPLSLIVDPMHVAAASAPQAMMWAHVLFNRRTGERAPSSVQSGPEYELRQVMVPRPAADNHAPTMQAIADFVNLPGVEPGKYFYGAVRWGQPRN

SEQ ID NO: 2659 - protein, 33 aa, Methylobacterium sp.
MIQPPLRRKIRVLSTIGRISVALMRTMRILRSD

SEQ ID NO: 2660 - protein, 133 aa, Methylobacterium sp.
MASVRVPVKPIGVPFARAGGMMGAQANGAESGRTIIPPILDRIRREPHLLASLPGLVEAAIEAGAAVLVQAEISAADIAAWKRGFIHAANALVHPFFEEMQALLDSSPGVGEPAGIPAGRSLRPEDLGALPPR

SEQ ID NO: 2661 - protein, 79 aa, Methylobacterium sp.
MQRNKVSTVFTPARVAADLGQDEDALFDIIVDMEPEDGLIWVHGSGDEAYLAFTNDGIHELKERITALRAERDLLPPRP

SEQ ID NO: 2662 - protein, 84 aa, Methylobacterium sp.
MVLPEPASELEALKARLAVAEQREEAVRMVLRALIASLRPFGFDKKRFKRCIFEEGQDTPDEGPASSRHAVLHQEGRRVLREAR

SEQ ID NO: 2663 - protein, 78 aa, Methylobacterium sp.
MNATASDVETMRRFNRLYVGQLDADEIAAFDNLCSQVLMQRSYERLAGLMGLSQARIPSAGHAAIDAASTTPVTTAAE

SEQ ID NO: 2664 - protein, 466 aa, Methylobacterium sp.
MARLRIAMVSAWCLIPAGALVLLVPALVNGFPFIFQDTSDYLIFTPRLYRSPFYGLFLFGFHLNRFIWAPVIAQALIGSALIYMLIKTLPIRNRPGTFAGLIAFLGAFTSLPWFVGFLMPDIFTAYLFIAVYLIGFHLERFSRPLRVVLVGFAGLTMVVHLSHLVLGCGAIAVFVLLSCWLRQPWRQTIVRAAVLCIPVALTVGAYLTYNLAVFKAVAVSPAGQTFFLANLIEYGPARDYLRDACPGAGYKICDQVETLPSTANAFLWEAGHLDRLGGFAGMNAESATIVRATVMSRPGYVAAVVANNFWRALGAHAPDTDVSSAFPPYSAIFEVIASKFGSQALAAFQASAQMRDVVPHSLIRTVDTVLIALAWVLAAATCLVAVARRERELTALPLFFAACVLSDTLVCSALSGVFDRYQARVIWLLPMTAILCLVSLKDRAWQQLDRARAPYSSNTPGLNAAS

SEQ ID NO: 2665 - protein, 186 aa, Methylobacterium sp.
LVERRYREAQRMQRRQGGDFMSHFRTALAREWASFPGDYGQQGINGGMYPGQRASISRERLTASAQAWLDRREGRVASSASRRAEVLADPNDERRRPDFASTYRALKAEQDAVRDDMMPRVGEPSLLQKSLRANGVGVTPNVEGAVNIRIDKPGPDTKVRAGASGTLFRTIRQSRGRQMQPAGEDV

SEQ ID NO: 2666 - protein, 230 aa, Methylobacterium sp.
VLTSSDPDYLEKLAHIQAILADLRRDEAFFSIDEFGPFAVRMRAGCKLVAPGEVPTVPQWQPSRGSLILTAALELSSNQISHFYSQAKNTAEMIRMLDLLVVRYRDRRRLFLSWDAASWHVSKKLNARVAELNEIAAKGGGPLVETAPLPSGAQFLNVIEAVFSGMARAIIHNSDYADVEAAKAAIDRYLADRNAAFLRHPRRAGRKIWGKEPAATTYCEAGLFKDPLFR

SEQ ID NO: 2667 - protein, 76 aa, Methylobacterium sp.
VSRYFISTANGHVVEDDEGVELSSRGALRALLGRTLTAILHDECAIGGATECSARAYDEEGKLVMQARATIDIADQ

SEQ ID NO: 2668 - protein, 51 aa, Methylobacterium sp.
MTEDFGSRDGQRDDKTGPSPFADMIEATRLTGLGRLEEATALIQRSLGGQK

SEQ ID NO: 2669 - protein, 97 aa, Methylobacterium sp.
VARSHLAERLSRPARPHGPYRKPEDAQLLPTIRAIVDARPSYGYRRVTALVNRALRSRGEASVNAKRVLRILRANGLTLAPHTARRPGRTHDGIVVA

SEQ ID NO: 2670 - protein, 128 aa, Methylobacterium sp.
VLALHVTPANADDRTAVATLADAVQEATGDSVDLAYVDQGYTGERAAKAAADHGISLEVVKLPEAKRGFVLLPRRWVVERAFAWMARFRRLARDYERLPATLAGLYLVAFSVLLLRRAADFAAVRNSL

SEQ ID NO: 2671 - protein, 53 aa, Methylobacterium sp.
DEAPARVPPPDASGPTSGPTSGQGPSPRSTAGRRTNELRLGERWKRRLPHFMR

SEQ ID NO: 2672 - protein, 53 aa, Methylobacterium sp.
MATLIVTAKLNAIDPQAWLADVLTRIADHPAPRLHELLPWHWRSATAPLAEAA

SEQ ID NO: 2673 - protein, 56 aa, Methylobacterium sp.
MTALPFDNSYARLPERFYARRPPTPVAAPRLVRLNRALAEELGLDPDWLAGPDGVA

SEQ ID NO: 2674 - protein, 164 aa, Methylobacterium sp.
MVTLRPMIFEGLTPQERYVWTKKRVNAMRQLFADNDDLPEFAALWSRESTRVRTEPPYGAKGEHLHLLVHTAGARELLRKALHKSFSRREAFVDPADDVVRRLDNGQLGDASTYLLKAVHQNVWRTYPATPHRPSGEIYGPRVGWTRNILDEQPVRRPASRVGG

SEQ ID NO: 2675 - protein, 173 aa, Methylobacterium sp.
MTNHLFSLVRDGAADPAKTVIETPDGRRYAYADLIARSGAYAAALRAAGVAPGDRVAVQVEKSPEVIFLYLGAVRAGAVFLPLNTAYTPAEIGYFLGDAEPTVFVCDPGRREALAEAAAGVRTVWTLDAAGGGSAAEAADRAADAGAAFADVPRGPEDLAAILYTSGTTGRSK

SEQ ID NO: 2676 - protein, 87 aa, Methylobacterium sp.
PVPGRSGVPVSGRPRLGAPEPAARAEAAPDAGAEPDDAPMKPWKVVLGIFVLFQAAALLHPALGLLVLAVALLLGLRRLLRRWRRRR

SEQ ID NO: 2677 - protein, 102 aa, Methylobacterium sp.
LGRVRRLRPVAGRTRTARTLTRRSAIRRGPVGGRVALRGTVRLVIGAGAIPVGRLALLRRGRRTLRRGPPLGRRNLIAIRPLLTLGPRRGRPPCGPRSGRSG

SEQ ID NO: 2678 - protein, 182 aa, Methylobacterium sp.
MHVRVRLDGANPRRWHVALLERLSGLPGIAAVSVDAAPGPDGWPAQADLLFRLEALIFRLAPNGSRLVPPADLAAWTRPATPDLVLDLCGDAVAPCPVWRVAYDGGLGETGLLASLLAGRVPQLDLLEGGTVVAAGRLGSDYRGSIAVSFEDALSRTATLVAAALRALSDGRAFAATPAAGA

SEQ ID NO: 2679 - protein, 76 aa, Methylobacterium sp.
PVTLQHAALVRPWLANVLQLGGPNVQLARHGFVLPLVCRLVHPGSGSSDVGQGGTSRAESEAEYRRLVDRFGRIPW

SEQ ID NO: 2680 - protein, 207 aa, Methylobacterium sp.
PPRRYSVAEALLDRRVLAVAFVYFGNVALLYGLSFFLPQIVKGFDLTNLQTGLVSLIPFAIGIVGMLALGRSSDRRGERKGHAAFALLLAAGGTAAAALVSDPYAKMALFSVSAFGIFGGLPVIWTLPTAYLSGAAAAGGIAIINALGNLSGFAAPYAVGAIKDATGSFTGGLLLIAAAGLAAMVTVLCLTHDRHLEQAARGARAAE

SEQ ID NO: 2681 - protein, 32 aa, Methylobacterium sp.
MTTPEARALGLPGASPGELAHADLVGRLAREI

SEQ ID NO: 2682 - protein, 79 aa, Methylobacterium sp.
LGPTVDAYRDRFCLRYRNHITPNQYPIERVIAGERFHDVVVEVRRADKPDMDFVHSLRSLVATDRDGNPSCLALILKDV

SEQ ID NO: 2683 - protein, 65 aa, Methylobacterium sp.
VTDRPALDVVIVNWNGGGLLRACLASLAAARDAAAVQVTVVDNASTDGSTETLPALPRPLRLIQN

SEQ ID NO: 2684 - protein, 71 aa, Methylobacterium sp.
ISFWFGRGGAGGTGGAGGTAEIVNAGGRIATEGDSAFGALVQSIGGSGGSGGGAFPAGAFFAVGLGGSGGR

SEQ ID NO: 2685 - protein, 357 aa, Methylobacterium sp.
MSVKAHAKEALPGTTAAEAPSLLPGLLVCLAITAAAVALQSAEEHLTGHPYVEALVIAILAGIAIRTVWVPGERYRAGIAFSAKQVLEVAVTLLGTSISLGAIVASGPALLTGIVGTVILAITASYAICRALGLPARMAILVAAGNAICGNSAIAAVAPVIGADSKDVAASIAFTAVLGVLMVLGLPLFLPLAGLSEHQYGVLAGLTVYAVPQVLAATVPISLLATQVGTLVKLVRVLMLGPVVVAFALIAPHLPAEGATGKAGPRRLGFFKLVPWFILGFLALATLRSLGLVPESVVQPVTRLAGLLTVVSMAALGLGVDVRVLARVGARVTLAVTGSLLVLLAISLVLIRILDLG

SEQ ID NO: 2686 - protein, 452 aa, Methylobacterium sp.
LRKVVLPGGREAWLLGLAALLVLAAVALFSVSRATTLTLAVAPNGGTEPALLRAYADELARRKLGIRLRILSFDGVRESAEALRSGKADLAVIRPDVAMPGNGLTLAVLRELAAFVAAPAASGIRTIPDLAGRRLGMLASRTADRTLVGDLAAHHGLELLTEVPEAGVPKTAVALVPVAETDVAAALGEGRIDALALVTTPTSAAARRPIGHVRQASADGEVALIGVPDAAAVLARRPRLQPVTVPAALFGGNPRLPAEDIATVGSAYRLVARADLSRSLAAEVTQHLFEMRAALAEAAPAAEDVTHPSYEDTADATSARLPIHPGAIDYYEREQETFIERYESWIYLVAILGGGVGSTVAWLRQRLGRIRRERIAVATERLLELRSNARRETDRERLEAMAGEVDDLAASIARQALNRPTEPRMLGAATVAIEAARSTVRRALTGPGDASG

SEQ ID NO: 2687 - protein, 81 aa, Methylobacterium sp.
MAEHGVTCSTSRSGNVWDDAAMESFFSSLKTERTARRTYRTRDEARADVFDYIERFYKPARRHSALRYLSPVEFEKRAELA

SEQ ID NO: 2688 - protein, 400 aa, Methylobacterium sp.
VRLDPGNRLTVISALGVVEILAWGSSFYLPAVLAGPIAADTGWPLTWVVGGLSIGLLAAAIASPRVGTAIHRHGGRPVLVCAALLLAAGHVVLGSAPNLPAFLAGWLLLGLGMGCGLYDPAFATLGRLYGAEARSAITTLTLWGGFASTVCWPLSAFLVEQVGWRYACLAYAGLHLAITLPLVLGLIPKAPALTAAKGAEHHADKPLTPRERRAFLLMAGVLVLGGTVMTLVSVHLIALLQARGVALAAAVSYGALIGPAQVGARIVEMANKGRHHPLWTLTVAMALVVVGLAILAVGVPAVGLALVLYGAGNGIYSIARGTVPLALFGPLRYPVLVGRLARPGLIAQAVAPSLGAVALTYGGADAAYGLLVALALANLGLAIALWGARPDVVDGSGATG

SEQ ID NO: 2689 - protein, 263 aa, Methylobacterium sp.
MPASPDAIAGFLVSEAEAGRAASTLGRRLAAIRYAHKLAGLADPTDDEGVRAAMKGARRKVGVAPTQKTAATDGVLLLMLARTPDTLAGKRDRALLALGFAGAFRRSELVALDVADLIEDPEGLRVMVRRSKVDQEGRGFEKAVPHGRTIRPVALVREWLDAAGITEGPVFRPVARSGRVRGDRRLTAQVVATIIKGYATAAGLDASAFGAHSLRAGFITAAAERGADMARIMDVSGHRDPRTVVGYIRRANAFKGHAGSGFL

SEQ ID NO: 2690 - protein, 248 aa, Methylobacterium sp.
MPSASNAHAVNMLVRKLESIARLSDDEHNAILNLPLRVQALPPRQDIVREGDRPSQCCLILDGWACRDKIVGEGRRQIFSFHIPGDIPDLQSLHIHTMDHSLATVTRATVAFIPHGALRDLTACFPGIAALFWRDTLIDAAIFREWMIGMGRRSAYERIAHLLCEMYLKLEAVGLAGEHRCAFPISQTDMADALGLTNVHVNRTLKALRGDGLITLHNHTLVVDRWNELVAAGEFDPKYLHLEKRAAG

SEQ ID NO: 2691 - protein, 72 aa, Methylobacterium sp.
MTVRTVILAALASATMAGSAMADERINLTPTLYRDQARATAAVRPASELTTTPRLVPAAPAAPRIVAEAGTR

SEQ ID NO: 2692 - protein, 271 aa, Methylobacterium sp.
MLALLGLTVADARAADLGYDYLRGSEFDEPAIVTTPLIDWSGVYVGGHAGYSTTNFAFKNAGRTEIAQILRQTAVESEFNVSGWNTLTDKRRSGLSYGGFAGYNIQYGDAVFGLEADYTSLYQKAWSEDGLARRMSGKDGVYYRTATSTYARATLEDYGTVRARLGYAFGPLLPFVTGGVAFGRAIVGSTVTVDSREYSDLQMTQQIGGITRSGGSFKEKFAAGAALGGGIDYAITANVFLRAEYQYLLFGKFGDQQMNVNTVRSALAVKF

SEQ ID NO: 2693 - protein, 310 aa, Methylobacterium sp.
LAPVFDARPVPETHVGASVGMRSYNLGAVLVGEVSAPAQDLERTARMAAAQGIDHVLMQYHRSGTSVVRTERGETTVRPTDFVICDLAQPISISSPPVTAINFLVTRTALGERGSAIDALHGCVFNAGRDAATQIFASYLSDVVSHGDRIEAHYRPGIAEAAAKLCGAALPSPAGEATATERWVSLEIRAFIQAHLADPDLGPEMICERFGLSRATLYRQFAVDDGVQNYIRNHRLARAMTLLTRAGDGPRPRVSSVAYAVGFADEKTFSRAFKRRFDFLPRDAALDRAARPAQPGTGSPLGAWIRQIAS

SEQ ID NO: 2694 - protein, 345 aa, Methylobacterium sp.
MSDTDAGNARNDGARVLCHRFEPPADAAELGRAWREHIAPVFAVSFRAETDLAIPIAMRSYHLGDLIVGDVIAPAHILERTPAMIQQQGLDHILLQFYRRGRSTVASGAVAGPVMETQCVVFDLAQPVRIVADAVDATNVVIPRALLEDQGCRPDALHGHAFDHGGDPFARLVHAFVADVVACGDLLHQHEAATAARAIVQLCGTYLRGRSGASGPQNLDASIRARRFIERELHDTRLTPATIAARLGMSRSTLYRLFGETGGVLAYIRDRRLIRAMRILVGSGAARPLRISQLAYEVGFADEKTFRRAFRRRFGFIPSEAGSHPLGLGEPQTGMSVLRSWFDNL

SEQ ID NO: 2695 - protein, 165 aa, Methylobacterium sp.
MSVILRQDPLPSQDEPRAEGRTRCADDLYTWVQEQVALLRAGRVDALDLDNIAEELSDVGSEQYDKLESAIDVLLAHALKWDHQPERRTRSWSLTIAEQRLRIERQLRRNPGLKSRVGEAIEEGFRLARLRAAREMRRALKTLPAECPYGWDDILNRPFEYEADR

SEQ ID NO: 2696 - protein, 171 aa, Methylobacterium sp.
MEEPVARPVPTDAMDADRPSAPVRARYEDDLCGWALEQVALLRARRFDEVDADRVAEELEDLSRREFSKLCSCLRVLVMHMLKWDQQPEHRTPSWIYSIREQRRRFDRLLKESPSLKARLDEALTDAYPDARDWAADETLLTPDEFPPACPYGLDEIRERPFDLDSAKRSR

SEQ ID NO: 2697 - protein, 161 aa, Methylobacterium sp.
MSAVKAAARPSRTGTAYEDDFYTWTQEQGARLRSGDVAGLDLENLAEEIESLGRSEFNSLVSAWRVILLHMLKWDHQPERRTRSWAISIRTHRNRAADVLKDNPGLKSCLTDALTRAYRDARDEAAGETGLPLKTFPTACPYTREEMLARPFPADPDDTTD

SEQ ID NO: 2698 - protein, 233 aa, Methylobacterium sp.
MRLNSPYAPELRAEAERLMRESDRTQLSIARELGIPPSTLGRWNLCGSWRTPRLRLAHLNPTHWPQARREAVARLYYEPRVAPPDLARALGVGRLSAAAFFRTLGFGVRRRRSGAQAAPVPLDPALAADGPALRAALRGHIARQIAAFDAALSGEGAAVVDSARVLRDLGGLKRLLDELSLEREDGDGGAHGADDLPALRAALARRLSARPGRGGPRPRARRPAGPGAAGAGA

SEQ ID NO: 2699 - protein, 436 aa, Methylobacterium sp.
MAQASDGVHQPVRASTAAFVGTMIEWYDFYVYGTAAALVFGRLFFPQADGFYGTLAAFGTFAVGFLARPLGGAIFGHLGDRVGRKTSLIITLLMMGVVTVLIGCLPTYETAGIWAPVLLVALRLVQGIAVGGEWGGAVLMAGEHAPTQDRRTFFASFAQLGSPAGLILSMLMFKLVTALPDADFLSWGWRVPFWFSAVMLGVGLAIRLGVSESPDFLAERRRRLAEAKAAQPPLREVLRGAPGLLALAICANVLGIAGFYFTNTFMIAYATGYLKIPRALVLDCLLIVSVMQFLITPLSAYIAERVGVHRFLVATAAVSVLTPYAMFALVDQGTLTGITLGVGLAVAGLGAFYAVIAGYVSDSFPTRTRYTGISMAYQLSGAIFGGLTPILGTILAEKAGGAWWPLALLFSTIAAISLVSVLALRGPRERQMMRAA

SEQ ID NO: 2700 - protein, 437 aa, Methylobacterium sp.
MPLEGGVPLDRDAVSDADRRQIVWSSVIGTTVEWYDFLIYGTASALVFSKLFFPSFDPLVGTIAAFGSYAVGFLARPLGGVIFGHFGDRVGRKAMLSLTIIIMGLGTFLIGCLPTYAQIGIWAPILLVALRLVQGIGIGGEWGGAVLMVVESVPPERRGFFGSLVQLGYPLGVVTSIGAFALAGLMPEAEFLAWGWRLPFLASALLVAVGLFIRLRLHETPSFRRVKQRAATAKLPVMEILTEHPRTFLKAVGLKVSEIAYVSIVTVFSISYVTGQLGLSRSVILNGILIAAVIELFTLPLFGWLSDRYGRRPLFVAACLFSIAFAFPLFTLLDTRDPTIITLTVAVALSFGQGIMFGTGAAWMSELFDARLRYSGASLGFQVGAALSGGFTPLIAAALLTWSSGATWPISVYLIALACVTLLATLAAPETARRAID

SEQ ID NO: 2701 - protein, 176 aa, Methylobacterium sp.
MPRTLTPAATALACLLVSLALLPRAALAADAAVNLPWGDWLVALAQTLQAVLTPMLIGLVTGLIARFAPLLSYVVSRGMVEGMVARVTDYALNAVAGAAKGRVLTVPVGSAVIAAAVQRAADQVPGFVIRAAGGLPGLAERVFRRLDLEEGATAANTLAPALDAVGRPVGRGRAAR

SEQ ID NO: 2702 - protein, 401 aa, Methylobacterium sp.
MAPIITTIEDLRRVAGRRVPRMFYDYCDSGSWTESTYRANEADFAGIKLRQRVAVDMSDRSLATTMAGQPVAMPVALAPTGLTGMQHADGEILAARAAEEAGVPFTLSTMSICSIEDVAENVTKPFWFQLYFMRDRAFNDRLIDRAKAAGCSALVLTLDLQILGQRHKDIRNGLSAPPKLTLGTTLNLLTKPRWCWSMLRTQRRTFRNIVGHVEGVRDTRSISAWSADQFDPRLDWDDVRRIRDRWQGPLILKGILDAEDAEKAATTGAEALIVSNHGGRQLDGAPSSIAALPEIADAVGSRIEVLMDGGIRSGQDVLKAVALGARGVFIGRAFLYGLGAYGQAGVAKSLAIIRQELDTTMALCGHRDIRAVDRSILRTPPVREVGPDAQIRAPLQRSAAS

SEQ ID NO: 2703 - protein, 447 aa, Methylobacterium sp.
VRLAHRLRAILGPRSLQRRLLISALGLVVAALVVAGLSIGFILDRFVRGQIDGRLDDRVLALAERQGEPAPDPPPFDRPRSGWYWQVRQGDRVLRSASLEGRDLVLPEREPGPRRDGRPRPAEGTGPWGEALILRVLVRPAAGGGSPSVVAVSAPRAALRGPVREALQALALSLGLLGLFLSAGAVAQVRLGLRPLARLRRDLAAVRTGQRTHLPADQPAEVAGLVREINALLDQNAANLAHARAHVANLAHGLKTPLATLGMAVADRDADPDGALARLVADMDRRVRHHLRRARVAAVAGPSRTRVPLAPTVADLVAVLVRLHADKGVAIETAIPSELVVACDSQDLDEMLGNLVENACQWCRRTVRISAAAEGAHVRITIADDGPGLTRDEAATVLARGRRLDESLPGHGFGLPIAQELAELYGGHLELGRADLGGLAVRLTLPA

SEQ ID NO: 2704 - protein, 403 aa, Methylobacterium sp.
MLDRRDLIRRAGLTALAGLGGGTFASLRTLAGDNATLPFGNGERPLVAYPGKRPLLQMTARPPQLETPFSVFDEGAITPNDAFFVRYHLADIPTEIDPETYRVAIKGHVEREVSLSLADLKAMPTTEIVAVNQCSGNSRGFFEPRMAGGQLANGAMGCARWTGVPLKAVLDKAGVKAGAVEVAFTGLDGPVIPETPDFAKSLKLDHARDGQVMLAWGMNGQDLPWLNGYPLRLVVPGFYGTYWVKHLESISVLDKPFDGFWMQKAYRIPDNDCACTEPGKAADKTVPINRFTVRSFLTNLTDGAQVKSGRTPLRGIAFDGGSGIKAVAVSTDDGKTWTEARLGQDLGPYAFRPWTLDTDLSPGTHAIRVRATANDGASQPMEPRWNPAGYLRNVVETTRVRAA

SEQ ID NO: 2705 - protein, 395 aa, Methylobacterium sp.
MSVASWSGSLLAWERELTALKDRIGLCVRRRELRTSIGYYLDGLLSGVERKTGWLLAERAGEARPHRLQAVLGRGRWDAEATRDLVRAYVVEALADPDAVLVVDETGFLKKGVHSIGVARQYSGTAGRIENCQIGVFLAYASRYGQALIDRQLFLPEAWAADQARRAKAGVPEAVAFATKPTIARALIAAALDAGLPCAFVLADALYGSDKRLRMMLEARAQPYVLGVRSNERLMTMEGGFATQDASAIADALPASAWHRHAAGEGAKGPRLYDWARVRLARLQAPPWDHWLLVRRSLREPSERAYYVVFAPMETPLAELAGVAGLRWTIETCFGTAKGELGLDHCEARSWDGWHRHMTLCMAGLAFLARLRTTLVRGAAGKPNERSPDTVAEAA

SEQ ID NO: 2706 - protein, 109 aa, Methylobacterium sp.
VTTMTRITLALAAALALATGAALAAPKSYAVPEPTAELRAPKAGTHAEGFEAAQANCLVCHSVDYIAMQPPGKGAAFWESEVTKMVKVYHAPIDEAQAKAIAAYLADTY

SEQ ID NO: 2707 - protein, 156 aa, Methylobacterium sp.
MLRLALPALVLLAGTLPGHAIEVQKSADLPAHPDKVWQTIGDFCGIADWHPAIEKCVASEKDGQKIRTLSLKGGGTLVEQQVSRDDKVMSYTYTILEGPLPVSDYRSTLAVAPEGSGSKVTWQGSFGAKGVPDTVAQDVISGIYDAGLKGIAGKVK

SEQ ID NO: 2708 - protein, 114 aa, Methylobacterium sp.
MRSERGRRALVDIRENAATALAFVDDMSVAAFEADRRTLYAVVRCLEIVSEASRRLDPAVIDHYPHIPWRQVADAGNVYRHAYDNVSPRMIWQTVHDRMQEIIAVCDAELGRLP

SEQ ID NO: 2709 - protein, 411 aa, Methylobacterium sp.
LSATASVRAAGLVAELRPLAPFFCLYVTFGATLGFLSGGAPLILRSRGMELAEIGLLQLINLPVGLTFLWAALLDWVRLPFLGHRIGWITLTLGLTVALLAVLSLGEHWPLGVLLALAVLAAACIATMDIALEALVVETVPARRRTYVASAKLCGASLGGILGVGVLLGSYDTLGWRGAVLACAALDALCLLPILAYPEARLRGAGGAPPRWAGSFARLGGLVAPILALGAYFAAAYLVSGPNTLALLDLGVPLAQVGFLTGTVLPVVNLVMAVLAAPLTARFGTVRLILAGGFGVLATGGLMALACASGAAGLAVGATVLNFLCGGILGVPVFNMIYRWAQGPQPATDYALLFGAAFFAAMPLRVAAPALAGWAGWPGYFAGAMPVYGAAVAWLALVVARTLRADPADAR

SEQ ID NO: 2710 - protein, 98 aa, Methylobacterium sp.
MDCATALQILRTHESDLRSRGVRHAGLFGSTARGEAGPDSDVDLLIEIDEDRVRDVYAYVAVVQFIEGLYPRRVDVANRAALKAEVRPHALRDVIDAF

SEQ ID NO: 2711 - protein, 93 aa, Methylobacterium sp.
MQSAEKISITMTADQLRAVRESVTAGEYASTSEVLRDAVRLWLRQRREDAERLDLIRARLRRSLDDPRPSLSGEEVRDSLEGLFAQARRDGTS

SEQ ID NO: 2712 - protein, 470 aa, Methylobacterium sp.
MRRHRYAKIVATVGPATNTPEMLKALFLAGVDTFRLNFSHGVQADHARVHAAIRALEAEVGRPIGILQDLQGPKIRVGTVRDGRLDLASGERVRFVLEGSDGGKDAIPLHHPEIFAAVVPGQDLLIDDGRVRVRVVGMDAAMIEAEVVTGGVISNRKGVNLPGTLLDLSPLTAKDRADLAFGLELGVDWVALSFVQKPSDVIEARGLIGDRAGIMTKVEKPQALERIEDIIRLSDAVMVARGDLGVEIPHEDVPGRQKELIRACRLAVKPVVVATQMLDSMVTAPAPTRAEASDVATAIYDGADAVMLSAESATGRYPVEAVAMMDRIIRSVEGHKLYHSIIAALEPGEEETPPHAVATATATLAEAVHARAIVAYTESGTTAARVARKRPAVPILALTPNIATSRRLSLLWGAHSVRTDDVDSYEAMTANACRHAQEEGFAKTNDIVVAAAGIPFHTTGNTNNIRLIQI

SEQ ID NO: 2713 - protein, 518 aa, Methylobacterium sp.
MNLDGMRLYAGTDPVDAVVIGTGAGGAPVLARLAEAGLKVVALEAGPNFEPGRFAFDETLADEIYWTEERLSGGTTPEAFGANNSGTGVGGSTLHWGAFVPRPDARDLALNAETGEGCDWPVGLEELVPFYERVERFIGVSGANPYPWDPGRRYGLPPVPRNGPADIMALACGRLGIGAADAPAAVVSRPFPQEGGPEREACINCGYCHQGCRNGAKASMDVTYLPYALRYGAEIRPGSIAHGLERDAAGRITAVIYRRDGIDHRQRCGAVFLCAGAVETPRLLLNLGLANSSDQVGRNYMGHVATQVWGSFPDPIRMNRGYPSSLITEDMVRPRDADFAGGYLVQSLGVQPLTLANAVARTRGLWGPALHACLDGYNHLAGIGINGETLPCDENRLTLSDETDALGLRKAHISFGYGENERRLDAHATALMRDLWEAAGARDIWVLERVAHTIGTCRMGRSGDAAVVDPYGRSFDIPNLWISDGSTFPSSLAANPALTIMALALRSAEAFLKRAGDA

SEQ ID NO: 2714 - protein, 397 aa, Methylobacterium sp.
MSEHLSALKIPHIVLERSRIAENWSSMRWDSLVANGPAWHDRFPNLTFEDVHPDAFPNKDRVAKYFNDYAAMIKAPIRTGVDVKHVKHSQGRPGYTVTTSDGIFEARRVVAATGPFQVPSFPSIVPADAAVDQLHSSTYKNPGQLADGAVLVVGCGASGSQIAEELCKAGRKVYLSVGEHYRPPRAYRQRDYCWWLGALGLWDEVKSKRKKRHVAFAVSGYEGGRTVDFRRLAHMGVTLVGVTRSYENGTLHFENDLVRNVAEGDEAYFEVLRDADAYVERKGLDLPPEPEAWQRFDDPDCLKEPILSLDVKDSGIGTILWATGFKYDFSWLDVDAFDEQGMPLHKRGVSAENGIYFLGLPDLTNRASAFIYGCWQDAKHIADHIVIQRNYDAYTRA

SEQ ID NO: 2715 - protein, 107 aa, Methylobacterium sp.
VTRLPVAYRPEAREDLAAVFRAVLDVSRNADVAERFVRRIFERCERIGDAPHGGRPRDDLEPGLRTVPFERSAVIAYRVEGDRALVVNVFYGGRDFEALYRDDRGET

SEQ ID NO: 2716 - protein, 191 aa, Methylobacterium sp.
MALEERLAALMRAGQAGDADAYRALLRACLPVIRTAVRAQGLRGEAVEDALQDTLVTLHRARASYDPARAFLPWLRAIAQRRAIDSLRRAGRRPREVHDPAAYEGEPDARPEPGEDLEARERAAELARAVAALPAGQRQAIEELALRERSLEEAAAMTGRSKGALKVNLHRAIKALRASLTTGPGAGRPGA

SEQ ID NO: 2717 - protein, 279 aa, Methylobacterium sp.
MPHPAISPGRAAVVTGAASGIGLAAAKAFAQAGMNVWLADLPGEALEAARAEVAALAAVEVRAVPTDVGRREAVEHLRDAVARSGPPAIVMLNAGIEAGGRLFSDAETWTRILDTNLWGVINGVQAFAPGMIAGGQPGAVIVTGSKQGITTPPGNTPYNVSKAGVKALAEALAHDLRGRENCRTSAHLLIPGFVYTGLTRARGVEEKPAGAWTPEETVRFMLERLEAGDFYILCPDNETTRAQDERRIAWAAGDIIENRPALSRWHPDYAEAFRAHMER

SEQ ID NO: 2718 - protein, 149 aa, Methylobacterium sp.
MSSESGDPPPDPSRDPPCTCTALRRAARAATASYDAALAPVGLRVTQFAILRILARLGPLPVTRLAEEAALDRSTMGRNLDPLERRGLVRLAPDPRDGRARVARLTGEGQAAIAAALPHWRAAEARLGGRLAPGALAALVAALAPAPHA

SEQ ID NO: 2719 - protein, 161 aa, Methylobacterium sp.
MPPAEAAGPARARAETVKKAGGAPLIPSPCHCLAIRQAARHMTQFYDRFLAVSGLRTTQFSVLAVLDRTGPLAVNELALHLVMDRTATGRALRPLARDGLVEIGPGRDGRTRSLSLTPTGRAKLEAARALWRRAQTAFEAQYGAAEADILRLSLARVVGRA

SEQ ID NO: 2720 - protein, 750 aa, Methylobacterium sp.
MEVRVQRSLSELAAPLRDVSRWNRLLSLPSDRRSGYLSFVEPACAVRDALSSGERVALREPVLALRDDWSSAAPGLLGAEEAARRLRRLDDLARDIDEETGVSPLMLGLGLVLWRDGERVRVAPLMLCPVVLDGLPEAPSLRRAGVPVGNPVLFDRLGIDPDRLRPDPLTWTAEDLAGHGVVSVTPVAVLGLFDVVRYRQWQRLDARRDPRLVRDPRILGLLSGGREGSWRQLAEPTSAGATRMVASLDRSQELVVQASRAGLDLVVQGGPGTGKTQAIVHILGNALRDGRTVLFLSGRQSAFRSARERLKRFVPEACWLALYGPECSTSVVAGRLGVAPGETVLDTARRATRRPPLVMATPTSYAAHLPADWIFDLLVVDEASLVPLAEALPAVAACRQIVICGDSQQMQKDPPLWVLFDPDNPYVPAPTLLDAAEAAGAPRTRLTHHYRSLHPTLMHYTNRMFHRGLMRMSVSPVADRERGLRLVTLDGTFDGRALTNAAEAEAVIDELARHVATGSTASVGVIAMTMQQRDLIRRRIAERGLDLEPVSRTAPVLVADYNGVQGEERDVILISLTFGRRPGNGAWPTSYGALSLPGGEKRLAVIMSRARERMVVFASFPAESIDASLAAGHSALLTYLMSAARQHEDDPRPYKGVLSGVLDRNSWQGFDLGNAIKVVSGRTGRTLAAIYVTGVIDALTERSEIAQYRNAGWLVLEVDIAEAEAAAADDKHLAALCSRLWRQQRTPVAT

SEQ ID NO: 2721 - protein, 222 aa, Methylobacterium sp.
MKVLLVEDDAPLAAEIAKVLRAEGFALDQAATGEDAQHLGETEAYDAVVLDLGLPRGDGLSVLQAWRGAGRTMPVLILTARDGWSDKVAGFKAGADDFLVKPFRVEELLMRLRALVRRAQAGGAARVVCGPLSFDPGLGTFERDGLPLRLTGLEWRVLSCLILRREAVVPRSQLIERVYEGDADVDSNSVEVIITRLRRKIAPAGIESARGYGYRLVPADGA

SEQ ID NO: 2722 - protein, 213 aa, Methylobacterium sp.
MSNETANDSAAPARTVKPGRHKRRLLAAAAVPLALGAAGLSLAQTSTLTAPLTPVAVSALAPSAAVAAKGEVAEIFGNKFVLQDGTGRALVETGPAGESGTLVKAGESLTVQGRFENGFLHARQITRADGTVVAVGPAGGPPGGLDRLRERVGLGAQPDAEALTGQVQRQGYTDIRFLGRGPRHFDVVAKARDGRERLLHVGFDGTIREKPSL

SEQ ID NO: 2723 - protein, 46 aa, Methylobacterium sp.
VLDALARERLGRQLQALYEPVLDEGLDPRLAELLRQLDRDRQGEEG

SEQ ID NO: 2724 - protein, 237 aa, Methylobacterium sp.
VSQPQQSTVRNRLLKALTADDFALLQPHMELTPTELRQPLIKPNEPVKQLFFPEVGFSSITTSGSEGKVEVGIIGREGLVGVIPILLGSDRTPHDHFIQSPGEVLAISTEALCAAMSRSASLHKLLLRFAQVQYVQTAQTAFVNATFQIEARLARWLLMCHDRLDGDEVRVTHEFLSLMLGVQRTGTTLAVQALEGHRLIKAQRARITILDRAALELVADDGYGLPEAEYARLIEGA

SEQ ID NO: 2725 - protein, 258 aa, Methylobacterium sp.
MPVISSAHGGDESAIPRQSEVRNRLLRALDPADFARLAPHLRPVPLPLGYSLIAPNDPITVCVFPEAGFVSVATAHGQQRVEIGLVGREGLAGAAPVLLADAATPQAHVVQMAGSGLAVATPALRAAADESASLRTTLLAYVQTQLLQVGETAYAHAALNLGSRLARWLLMCHDRVEGDELALTHEFLSMMLGVQRAGVTLALQSLEGAALIRNRRKRVLILDRGGLEALTHGSYGAPEAAYARLIMPPLTPRPAASR

SEQ ID NO: 2726 - protein, 213 aa, Methylobacterium sp.
MAHDHHDHEHPHDHPHGSDLTPVEARVRALESLLVEKGYVEPAALDALVEMYETQVGPHNGARVVARAWTDPAFRARLLTDATPAIAELDIGGRGGEHMVVVANAPGEHNLVVCTLCSCYPWPVLGLPPVWYKAPPYRARAVIDPRGVLAEFGLHLPETTRITVWDSTAETRYMVLPERPAGTEGWDEARLAALVTRDAMIGTGLPKALEQAA

SEQ ID NO: 2727 - protein, 293 aa, Methylobacterium sp.
MELRHLRYFVAVADRLSFTAAAESLGVSQPPLSQQIRDLERELGTPLFRRTSRRVALTEAGAVFLDHARAILAQVHQAAEAARSVGEGRTGVIHVGLTGSVLTGPLGGVIRTFEALFPEVEVRLHQAPPEEQRAALHAGRIDLCLMRGPPEDPELAAVPAWSEAVGVALPAAHPLAARDSLVLRDLAGERYLSLRRADSHFANMLWAACLAEGFVPLLAHEVVEAQALLSLVAAGLGLALVPEQVGRLAHPGVAYRPLRGSAPAADVSALHRSPASPRVANFLAVLRAETGGA

SEQ ID NO: 2728 - protein, 494 aa, Methylobacterium sp.
VTIEQAIAARGGEPYPAPVLCLPRGGLRHWHLRLAEGLRAAGMHPRVAWTETEPAPAGMETLFALERLLRPRPGPRPSERAPAAGLPEADGSGVRIVLPGAAEGGAALGILFDGHPGEAGLLQALLRGGAPLVEIVDGGAVLAQGRPSLEAAANLCEAYETVTMRLAPLLVSALLRPAPAAPAAPRLDRGRPLAAHTLRRLARILARRLYHLCFYAPHWRTGWRFSRGATVWDAASLGGEPWRVLPDPGHRFYADPFLFHRQGRTHLFVEDLDHRTGKGVISAVAFGPDGPLGAPRPVLEEPFHLSYPFVFEHGGTVWMIPETSQNRTVSLYRADPYPDRWVRERDLLTGIVASDATPIRFAGRWWMFATLHDGAGAHSDMLGLFLADDLFGPWRPHPANPLLVDAGAARPAGAMRVRAGRLWRPVQDCTRLYGGALALAEVTTLTETAFAQTVRTRLAPGPAWSGRRLHTLNAAAGLEVIDGSAAPLRLFHRP

SEQ ID NO: 2729 - protein, 279 aa, Methylobacterium sp.
MQARSFGATGISVPVIGQGTWRMDGTERAASVAALRAGIDAGMGHVDTAEMYDDAESIVAEAIAGLREEVFLVSKVVPGNATRRGVVRACEASLRRLKTDRLDCYLLHWPGHHPLEETIAGFEDLRRDGKILSWGLSNFDVDDLDAALRIAGPYRIACNQVIYHLGERAIEHAVLPWCTRNGVALVGYSPFGSGEFPDPSSAGGRVLAGIAEAHGTSPYGVALAFLTRLDNTFTIPKTVRAARAIENAAAADLHLNAAEIALIDAHFPRGPRPRTLPML

SEQ ID NO: 2730 - protein, 210 aa, Methylobacterium sp.
VFPEAFIDGYPKGADFHIVIGSRYPEGRREFAAYASRAISVHGPEVTRLGRAARSAGLYLVMGVIERDGGTLYCTALFFGPDGRFLGKHRKTMPTAAERLCWGFGDGSTLTTVPTPWGPLGAVICWENYMPLLRTAMYGKGIALYCAPTADDRDTWAASMRHVALEGRCFVLSACQYLTRDRFPSDMRNRIPEENGELLMRGGSLIVDLT

SEQ ID NO: 2731 - protein, 334 aa, Methylobacterium sp.
MTDRTPLPRRRGRLVPRRPLRRGLLAGLLAVALAATLGHPALAEPVFPAAGSLGLAPPPGMVPSTRFAGFEHTSGASVILVEMPPEAWDQIDGRFTPEALAATGFRVRGGREALPVAGGAGFVLRGTQSANGLTYAKWVAVVRGEPGTGLVTVQVPETAAKQVPGAAVEAALRTIAFRPKASLADQVSALPYAVGDMAGYRPVAVFAGNGLLLTDGPKDVDPAREQPVVVVAPSLGQAPVPEGGEIAFARKVFTAQKDLTDAAVTEEARSTRGGAVVVRLRGTGTDTRSGRTLGMTQTMVFAGARYLRVIGFADPARADALDRAERVAASVAMR

SEQ ID NO: 2732 - protein, 757 aa, Methylobacterium sp.
MSQPARLAALASLLVVGPAAAQQSVELNQISVEATKPKARATGPRVRARPQPVEPGSGGGDIVSGGPVGPGADSAATSGGGGGPSGVVGYTAKISPTATKTNTPLIETPQSVSVVTREQLNDRNVQSLNEALAYTPGAATNVFGFDPRFDAFYIRGFEVTYNGIFRDGLRQSAVGFAVPRIEPYGAEAVTILRGPASGLYGLGSPGGIVDVTTKRPSFTRFGEVWLQAGSFERFQGNFDIGGPVEGTDNTLAYRLTGVVRQSDTFLPGPGVTDDRVYIAPAFTWKPSADTTFTVLSEFQRNNVPGNATFFTFPKSGFLVSRVYSGDGALNNYQTDQYRIGYAFEHKFTPDLIFRQNFRYYGINADFPYVQVDNVEGLQAQRSTGLLRQSLYSYSIDNQIEGHVRTGPVAHTIVAGLDYNHFSWFNKAGFGLAPDLDLTTLNYGRQFIPRPAYDRFSRQSQDQIGLYLQEQAKWDRFVLTLTGRHDWVFSDTTGNTRGTPTTPVDQTDTAFTYRVGLNYELAPGLVPYASYATTFTPQVGTSTATGNAFRPATGDQLEAGVKLLVPGTNIQAGIAGFEINQSSILRPDPGSIANQVATGAVRSRGFEMEAIANLAPGTNLTLSYTHLDFRFLQQTSLLVPGRVLDGNRLSGIPGDSFAGFLTYLFPPASPLRGLTLGGGIRFATNSFADDENTQRNPTVTLFDALVAYDFSAIDPRYKGFNAQVNVQNLFDRDYKNCFAGLCYRGAPATVIGSLIYRW

SEQ ID NO: 2733 - protein, 327 aa, Methylobacterium sp.
MTVGIRDVARAAGVSTATVSRALGRGPVSDALREQVEAAVRATGYRPNLSARRLRSQSAQTIGLIVADIRNPFFTAVSRAVEDAAFAKGMRVILCNTDEDPAREAMYLRLMEEERVTGVIFAPTGAAADALRAEPPAFPVVLIDRAGPPGAHDSVVLDNPAAGGGLVDHLVDRGFARIGGLFGSTSSTARERRAGYEAAMARHGLEPHVRAVAPNAAAAEAAAARWLAEPDRPEALVLSNGLILMGALRAARTLGLRVPGDIALAGFDNEPWTDLVEPGLTVVEQPVDEIGAQAMRLLFERIAQPDQPVRKVVLSGRTVLRGSTRRG

SEQ ID NO: 2734 - protein, 234 aa, Methylobacterium sp.
MLEIRDLVCGYGHVTALKGLTIEVREGQLVALVGANGAGKSTTLRAISGLVSPRSGTIRFEGRDIAGAEPRRILAEGIAHCPEGRRVFPQMSVAENLAMGAYLRRDRAGIVADLERIYGEFPRLAERRDQAAGTLSGGEQQMLAIGRALMGRPKLVLFDEPSLGLAPNIVERMFAVIRAICDAGTTVLLVEQNAFAALELCDHAYLLETGRTVLEGSGQALIADPHVREAYLGG

SEQ ID NO: 2735 - protein, 240 aa, Methylobacterium sp.
MLEVSGLSAGYGQIEVLHGLDFAVPKGQVVALIGSNGAGKTTTMRALSGMIRPRAGSIRLNGREIGGLESYDVARFGLAHSPEGRRVFPTLSVEDNLTLGAFPRLTGARPKGDVAADRDRAFELFPRLKERRTQLAGTLSGGEQQMLAMGRALMLRPEILLLDEPSMGLAPKLVEEVFRIIRQLKADQVTMLLVEQFAMAALGVADHAYVLENGRIRFQGPAQQLRSDPAVRAAYLGGGH

SEQ ID NO: 2736 - protein, 421 aa, Methylobacterium sp.
MAELDIVVVGGGMVGLASALALGERGLSVALVDPGEARARTSYGNAGVLSRGSIFPMAGPALWPKLPAYLRNADSALRLRHAHLFRVVPWGLHFLAAARESRWRRAAAALLPLTTAAYPAHERLAERAGTRARLRRSGWLKLYRTEAAFAGAALERAILAEHGVALEVLDGAALRDLEPALVRPFARAMLLPETAALSEPGALVEACERLFAETGGQYLRGTVTGLIPEAGGWRVAHAGGEVRARQVVVAAGAASAEILRPLGYRFAFAAERGYHRHYALHPDSPPLTRPVLDTGAGSIIAPMGEGRVRVLSGVELNARHAAPDHRQIEAAAREATGTLRLGGPLDNQPWMGSRPSTPDGMPVIGRAPRHPGLILAFGHGHIGLSTGPVTGELVADLVTGAEPAVPLAPFTPERLLRWPRP

SEQ ID NO: 2737 - protein, 217 aa, Methylobacterium sp.
MSETQLRPHDRLVEDLVARLEPVHPLPSPGRRALAWTGAALALGLALFGVLELEGLRGPRPAETPFVLLGAVLTALAAAFAAFATSVPGRSARWALLPLAPAALWIGASGPGCLRALAGPGIEAPHALPGCFTFLLGVSLPLSVLLVLMLRRACPLRPNLTAALGGLAVAAAAAALLMPFHPQETTATDLLVHAATVLGVIGLNGMAGGRLLDRSRG

SEQ ID NO: 2738 - protein, 76 aa, Methylobacterium sp.
MPVPNPSAVLLELANEIVELRLQLAEVQDQCVEMAVDSGELQAELVALRAELTVVRRERDGFREHLRRCGADRVAA

SEQ ID NO: 2739 - protein, 75 aa, Methylobacterium sp.
MVLEHQGDHASRYGAIRSIAAKIDCSGETLRNRVRRAEREQGQRAGPTTDEREQIEALERENRELRQANEILRKA

SEQ ID NO: 2740 - protein, 455 aa, Methylobacterium sp.
MTEFVHPVRVEPSVLAARLSDERAPDIVEALNAEAPEVAAAILLGLSIERAVEVLDQPELACAADIIEMLPRDRVAAYLTGMSADRVTDVFREIEEPGRSDLRARLDAETRGAVDRLSAYGEETVGSLMTTEFVTVPGTWTVAQTLAHIRQVERTRETIYAIFVLDPRTRALTKAVPLRRLIAGEPEDSVLSVAPERRPLSVTPTASREEAARLISKYDLLALPVVDAVGHVIGIVTVDDIIDAMVAKQTQDVQRFGGMEALPEPYMEIGFLTMIRKRAGWLCALFLSEMLTASAMQGFEGELERALVLTLFIPLIMSSGGNSGSQATSLLIRALALHQIRLRDWWRVALRELPTGLVLGAILGTIAVARIAIWQEAGFYDYGPHWILVAATVGAALVGIVTFGSLAGSMLPFLLQRVGFDPATASAPFVATLVDVTGLVIYFSVALVILRGTLL

SEQ ID NO: 2741 - protein, 365 aa, Methylobacterium sp.
MTRPDPTPFLKVQGLAKSYGAFQALDGIDLAIPRGAFVCFLGPSGCGKTTLLRIIAGLDRQNRGRIEMGGVDVSTAPPAERDFGIVFQSYALFPNLTVADNVAYGLVNRRMKRDRIRARVTELLALVGLPDQATKYPVQLSGGQQQRIALARALATAPSLLLLDEPLSALDAKVRIRLREEIRALQKRLGITTIMVTHDQEEALAMADRVVVMNHGRIEQVGTPEEIYRSPATAFVADFIGAMTFLDATVAPSQALRVGTVDLVCEDGRGFVPGSPVRLGVRPEEIRVGGVAAGDVNAIEVRVKSLEFLGSFYRARLEPSRDLGGSLVADLSANLFGDLRLAEGQYLYVALPPRALRAFPQVAAA

SEQ ID NO: 2742 - protein, 367 aa, Methylobacterium sp.
VTPRPTPAVRLDGVVKRFGTVTALEETWLRVEQGEFLTLLGPSGCGKTTLLNLMAGFLEADAGEIFIGDDLVTATPPYEREIGIVFQNYALFPHMSVAKNVGYGLRMRGLPKREITERVAQALALVKLTGFADRSPRQLSGGQQQRVALARALVIRPKVLLLDEPFSALDKNLRGAMQVELKEIQRRLGVTTVFVTHDQGEALSMSDRIVVMSAGRVRQVGTPDQVYRHPQDRFVAGFIGDVNRLPGRIEFRTGERATVAIGDLRREVEAEALRDCAAGAAVDVFVRPDHLGVRPAGEAGTLPAQVAALVYQGSHIDLHADLHPDLAGSGRVVVRLPGHGALATYAPGTPVGLLVPQGGLVAFPPEP

SEQ ID NO: 2743 - protein, 118 aa, Methylobacterium sp.
MNAPPSDRARLLRQRQTNAESQLWRVLRNRALNGWKFRRQCPIDRYVADFACVEAKLVVEVDGATHGTAAELAGDRIRTDALVRSGFEVLRITNAEIRADIDGVRETILAALERRVTI

SEQ ID NO: 2744 - protein, 256 aa, Methylobacterium sp.
MKLQNKRALVTGADSGIGRATAELLAREGADVAITYNTDADGIQETRARVEAAGRKALVLQLDVGDPASVRAAYDTIASRFGVLDILVANAGQAMSGMAVADMEDARLEQILRVNLMGPLFTVRPFIHLRRTAGGRGKVVFVSSVAQHLPTPESAPYGMSKAGLGSLCRSLARELAEDRINVNNVAPGLIETPMTADRFENPDKLEKSLERIPWHRAGQPEEIAQAILYLVSDEADYVTGHTLVVDGGLTMQWGGA

SEQ ID NO: 2745 - protein, 241 aa, Methylobacterium sp.
MRILLINPNTTASVTDLVAGHVRRIAPEATFVPVTGRFGARYIATRAAVAVAGHAALDALAAHVAGCDAVYLACFGDPGLPALQEVSPVPVVGMAEAACEAAAADGRRFGIVTGGVNWPAMLAEFVTLQGLGGQLAGIRAVAPTGGEIARDPDRALAQLAAACRACAEADGAEAVILGGAGLAGLAERVQPQVPCPVICSVEAGTRAVLAAAGSAARRSAADPVPSLGLAPPLERLLLQAP

SEQ ID NO: 2746 - protein, 287 aa, Methylobacterium sp.
MSAPARPEIVRERAGPPGGTVVEKPLSTLELLYNQGWLRKVLILAVLALIWESYGRYLDNDLLFPTFTATLGAFFRGVADGTLPLRAWGSVKILLVGYGIGIVLATVLTGIAIASRIGTDFLETMTSMLNPLPAIALLPLALIWFGLGNGSLVFVLVHSVTWAIALNTHSGFLSVSRTLKMVGRNYGLGGAGLIRKILIPAAFPSILTGLKVGWAFAWRTLIAAELVFGVSSGSGGLGWFIFENKNMLDIPNVFAGLLTVILIGLVVENLIFQTIERHTIQRWGMQA

SEQ ID NO: 2747 - protein, 290 aa, Methylobacterium sp.
MNQHVLPPIRPEYDRALAPFVEAPVARALPFATRLWQQGWLRKGLILAALALAWEAAAAWQNNDLLLPGFRATLSALAEGLASGELLERMRISLQVLAQGYLIGVLLAFGLTTLAVSTQTGRDLLSTLTAMFNPLPAIALLPLALLWFGLGSASLTFVLVHSVLWPVALNTYAGFQGVPETLRMAGRNYGLRGLPYVWQILIPAALPAILSGLKIGWAFAWRTLIAAELVFGAASGKGGLGWYIFQNRNELYTDRVFAGLLLVIAIGLVVENLVFATLERLTVRRWGMVR

SEQ ID NO: 2748 - protein, 410 aa, Methylobacterium sp.
MSTLANTGWAVFRNGDFRLFGAARFLTGLAYQMQAVAIGWFVYDLTKSALALGLVGLAGFLPAMLAALITGHVADTYDRRLVAAISFGVQAATSFGLLAYALSGAQAVWPVYALVILVGTGRAFANPALQALLPTLVSRELFGGGIAWNASLWQTSSVLGPAAGGLLYAAGPAVVFGGAGASFTLAALLVAAIRFRPAPVSERPPVSWATLSAGLAYIRSQPVVLGAISLDLFAVLFGGATALLPIFAAEVLHVGPLGLGALRSMPAAGAVAMAIWLAYRPLRRHAGIRMLRAVAVFGLAIVVFGLSTSLPLSMLCLFVTGAADMISVYVRQSFVQGETPDAMRGRVAAVNSVFIGASNELGEFESGLLAAALGAVPAVVAGGAMTVLIAVAWGRLFPALRDRDRLLREA

SEQ ID NO: 2749 - protein, 206 aa, Methylobacterium sp.
MAVSFENSQTFAVGRGPVAVTSADLNGDGHADLVSASFRDNAISVLLGNGDGTFQVQKTLAVGPFPRKVTGVDLNGDGRIDLVSTNSGDGTVSILVGNGDGTFQAQQTLAVGSDPRAVTSADLNGDGHTDLLGGNYGDYGDSSVSVLIGNGNGTFEQASGDRISLGGQTYTLSRAQNGDAVLLLSGGGSVELTGIKAEQVNTGFFG

SEQ ID NO: 2750 - protein, 385 aa, Methylobacterium sp.
MTGTTSPRPVQGKTVRYAFVGLGDITQEAMLPGVRHTGNSEVTALVTGNPEKARRVGEQYGVTDTYGYDEFGALLASGTIDAIYLATPNWRHAEFAIPALKAGIHVLVEKPLEISSEKCREIMAARAASSAKLMVAYRLHFEPATLATIDLIRSGDLGQILTFTSTFTQMVSPENHRAKSGVAAGPIFDMGPYTINAARYLFGDEPTEVVSAVGVRHPEAGFGDFDDTVAVTLRFPGNRLAQFVLSYYGNVLDTYAVVGTKGSVEVNPAYMYGKPLERTVTIGDEKHHDSFKNTDHFGGELKYFSDCILNGTDPEPDAEEGYADLRVIEGILKALESGGPVRLEPFTRTKRINLSGQLQQLPAQAPPDLVDASNPGRGKDKSPLN

SEQ ID NO: 2751 - protein, 90 aa, Methylobacterium sp.
MMERVSREDTKPDPDDSDPPFAPGSGPAVAPPPEGSADREETDAITFEQIRERAYELWERNHRPDGFEIQFWLLAERELKAERERRRGGP

SEQ ID NO: 2752 - protein, 563 aa, Methylobacterium sp.
MNLLSRVRILHKIAAVIALIGLIVGACIWHASARMGAIGESYDRFIAHDARAAANARRINRHIYEMYYAVYRTIAETEADQIRQASAQFEASAPGLRQLFAEITADMPTFAGRIEEVRARAESFMSSVSEARSLGEANLNAEALALVHRDVDPSFTALTGSASKLGADIAASMEAGAQSLARESASTRLGLWLFSGLGLLAGMVAAALVAILGISRPLGRLVAVLQRMARGEIEAEIAEARRGDEIGAVGRAVEGIKAMVAQKAAEQAEIRRIADAAAAEERRRTMVELADGFERAVGGIVGTVSSSATELQATAQTMSATAAETAGRSMTAATAAEEASTNVNTVAAAAEELGASVGEIGRQVDGSADLARRAVGEADQAAALVQALNGSVARIGDVVALISQIAGQTNLLALNATIEAARAGEAGRGFAVVAAEVKELANQTARATDEITQQIGRIQGATGEAVGAIGAITGRIREISGVATSIAAAVEEQGAATQEIVRNVSQASAGTGAVTRNIAGVAGAAEETGASAAQVLAAASELSRQSEHLNAEVGRFLATVRAA

SEQ ID NO: 2753 - protein, 256 aa, Methylobacterium sp.
MGLTDALLQVDGVTLQYKTPHHLITATYRVGFDVLPGDRFVLLGPSGCGKSTLLKAVGGYMTPTEGEIRLKGRPVTGPGPDRMMVFQEFDQLLPWKTVRQNVVFALEASGRLTGRAAEERAMAYIDKVNLTKFADSYPHMLSGGMKQRVAIARGMAMEPDILLMDEPFAALDALTRRRMQDELLMLWEETRFTVLFVTHSIPEAIKIGSRILLLSPHPGEVKAELNSAGSPGEQAQLESRIQQMLFSEEIEEAENV

SEQ ID NO: 2754 - protein, 265 aa, Methylobacterium sp.
MGRTDPLLQIAGVSLEYRTPERVVRATHRIDLDIYAADRFVLLGPSGCGKSTLLKAVAGFHEPVEGEIRLDGGVVRGPGPDRIVVFQEFDQLPPWKTVLQNVAFPLRAAGLAGRREAEARARHYIDKVGLSRFAESYPHQLSGGMKQRVAIARALATQPKVLLMDEPFAALDALTRRKMQEELLALWEEVRFTLLFVTHSIEEALVVGSRVALLSPHPGRVRSEVNSHDFSLGDIGSRDFQAAVQRLHGRLFEVSPESETPSAPQ

SEQ ID NO: 2755 - protein, 232 aa, Methylobacterium sp.
MSGEAHGAAFGAASEAIRGGLRVIALAVQKGGTGKTTLAASLAVAAAQAGERVTAFDLDPQGSLAGWGAMRPKGNPVIDRIRPWEIGQMAEILGQLAADGGTLAILDTAGSTAGDAALALRLADLVLIPIRPSRLDLMAAQPTIRAMATQGMRERVGLVLNQCPPPPSPRAALYARQLAGLGVLAEPTMIQRVDHQDALALGAGVTEHAPAGPAAEEIRALWAWAARRIGRA

SEQ ID NO: 2756 - protein, 376 aa, Methylobacterium sp.
MTGMRATLLAGLALGLLTAGSAQAQLKIAVGAPITGNSAAFGAQLKNGTAQAVEDINKAGGVKGQKLELSVGDDASDPKQGVSVANKFASDGVKFVVGHFNSGVSIPASDVYADAGIVEVTPASTNVKFTERGLWNTFRTCGRDDQQGAVAGAYLTQNFKGKKVAIIHDKTPYGKGLADETLKAFKAKGGKEALYEGINPGEKDYSALVSKLKQNGVDVVYFGGYYTEAGLIIRQMRDQGLKAPLMGGDGMVDKELVAIAGPGAEGTLTTFPPDARKNPNAKDVVAGFKAKGIDPEAYTLYAYAAVQIYKQAVEGAGSADSKKVAAFMREGKPFQTVLGPIAFDKKGDITKPDYVMYTWKKNDKGVVDYAGNEVTQ

SEQ ID NO: 2757 - protein, 485 aa, Methylobacterium sp.
MPASENSPDLLVCLHFLGGSARTWEPVARRLAGTMRCVALDLPGFGAAAATMGYDVAAMADHVAAAIRDLRPVRFALAGHSMGAKVALVLARRAEDGDPDLAGLSHLVLVAGSPPSPEPIAEERRRTMLAWIGADSETRAREARAFIRQNVGAPLAPEDEDVAAADVLRAAPAAWRAWLESGANEDWAARIGVLRTPALILAGSKDADLGPAGQAALTAPHLAHARTEILDGAGHLLPLERPDTVAAAVTRHLSAPPPADAEPARIPEAYAALIASERVNLRLRAALAERARADDPAYAPAALDPVELALLRAVVARVLPDAGFDIAARLDARLASGAGDGWRFARLPPDAQAYRAGLRSLDAAARADGPPFLARDGEAQDALLRAAQAGRLAVPEAARPRLDAEQMVLWFEDLRADAVRAYLAHPATLARLGFSGIGAGGTGTPDADGLARGLPGFVRTGRNEPEPWEPEPVRPDGRDGGEAAR

SEQ ID NO: 2758 - protein, 279 aa, Methylobacterium sp.
MRLLLFLLAAAAILYAVGVGALALIQRRLIYPGAYADAVHPNERVVPPGTAAIRVGTADGERLYALWRAPRPGCGVVVSFHGNASMPEYHAERFAADPWRAAGWGVLAPAYRGYPGSTGAPSEDGLIVDGLAAVAEARARAPGSPILLHGHSLGAAVAVAVAARLPRAEAPAGLYLEAPFDSMVSAARVHFPAAPGWLLRDTYRSDRRIAGLPGPILIVHGTDDPVVPAALGRRLAEAGQARFAAIPGDHVSILGARDAEAAALFGARACPDAAAVEAR

SEQ ID NO: 2759 - protein, 243 aa, Methylobacterium sp.
MTNLRQVKKLVAPLLARNPDLILSDYRTWGYELCLLPVDHVLRHVWIKRASMSPSFSVQFHVTEMFRPEPCERFTFGWCFDLVGRSPLTHPPGTGGNWVWADPTMAADFVVQIEEQVLSMLRPLDTVEKFVAYARQHREWSWCGDFSRALTEMVLGNLDEARTIWAAEAKHFVPSKRPEGGADDYPTFDRLCALSAALLADDRVELARLLHAWEAEWVAVRKLSAHWRPTPFPLERGLKPVRG

SEQ ID NO: 2760 - protein, 329 aa, Methylobacterium sp.
MATLTLAEAEALAAEALTRCGTAEPAARSVARALVAAEADGLRGHGLSRVAPYGAQVRAGKVVGDAAPRAERPRPGLLAVDAAHGFAYPAIDLALAELPGMARGQGIAAAGIRRSHHCGAAGRPVEALAEQGCVALLFANTPAAMAPWGGHRAVFGTNPLAFACPLPGRAPIVVDLALSKVARANIVGAARRGEAVPEGWALDADGRPTTDAKAALAGTMVPLGDAKGTALALMVELLAAGLVGARFAGEASSFLDAAGDPPGTGQLILAIDAAALSPDAPERFAALARSIEGQDGARLPGSRRLGLRRRAAEAGLDLPDALVAEIRAL

SEQ ID NO: 2761 - protein, 126 aa, Methylobacterium sp.
VSALQGILFEEESIWLFGLVTVLMGGWAAWMAARAIARAWRPFPYAALALLLVAAAVRFIHFALFGGTLLSAQYYLVDAAVVMLIGAAGYRYTRTRQMTTQYRWLYERTSPLTWRERPSGAPPGRS

SEQ ID NO: 2762 - protein, 265 aa, Methylobacterium sp.
VSVAGINVLVEETRARQAQAGQPLLAVENVSTYYGSVAALKGVDLTVGRGEIVTLIGANGAGKSTLMMTIFGAPRARSGTIRYAGQDITRLPTHEIARLGLAQSPEGRRVFPRMSVFENLQMGASLHGGRFLAEDLERVCALFPRLKERLQQRAGTMSGGEQQMLAIGRALMSRPTLLLLDEPSLGLAPLVVKGIFDAIRDLNRQDGMTIFLVEQNAYHALKLAHRGYVLVNGRVTMSGSGRQLLDDPAVKAAYLEGGHGAAATA

SEQ ID NO: 2763 - protein, 301 aa, Methylobacterium sp.
MSALVSSPPKTAARIDASAEAVLSVAHLTMRFGGLIAVNDLSFEARVGEITALIGPNGAGKTTVFNCITGFYKPTEGMLRLAQPDGTVHLLERLPNFAVNRTARVARTFQNIRLFPGMTVLENLLVAQHNPLMRASGFTIGGLLGLPAYRAAERAAIEKAKDWLARIDLLARADEPAGALPYGAQRRLEIARAMCTDPVLLCLDEPAAGLNPRESAELNDLLRLIRDRHATSVLLIEHDMSVVMQISDHVVVLDYGVKIADGTPEEVRADPRVIAAYLGVEDEEVEAVEAEVGIAHPGAGQ

SEQ ID NO: 2764 - protein, 459 aa, Methylobacterium sp.
MAQARAPGLPDVLRDAGLYALVAFVLCVPVVSYRTEAGPAGLELLPRWPLVALLCAGIFVLRLIQRLVLARRDARRALTPAPSQATESVHAEPAAGQKISGLALWAFLGLALTLPAVAALASGGLGPARYWIDLGILILTYVMLGWGLNIVVGLAGLLDLGYVAFYAVGAYTYALLATTFGLSFWVCLPLAGLFAGLWGMVLGFPVLRLRGDYLAIVTLAFGEIIRLVLINWTDLTGGAAGISSIPRATFFGIPFTADEDGFAARFGLEFDSMYRVVFLYYLILVLALVTNLVTLRLRRLPIGRAWEALREDEIACRSLGIDTTATKLTAFALGAAFGGFAGSFFAVRQGFISPESFNFLESAIILAIVVLGGMGSQIGVAIAAVAMVGGPELLRNLGFLRAVFGEGFDPNEYRLLLFGLAMVTMMVWRPRGLISERQPSVSLGKARGISGAHVSEGHG

SEQ ID NO: 2765 - protein, 305 aa, Methylobacterium sp.
MEVFLQQLINGLTLGSIYGLIAIGYTMVFGIIGMVNFAHGDVFMVSSFIALIVFLILTAWLGISSIALALLIVLVVSMVLTGLWGWAIERMAYRPLRGSFRLAPLISAIGVSIFLSNFVQVAQGARNKSTPPLLSGGITLMESESYSVFLSYKQCLIMAVTAVLLTGFWYLVQRTPFGRAQRACEQDRKMAALLGIDVDRTISLTFVLGAALAAVAGVLYLLYYGTVSFSDGFVPGVKAFTAAVLGGIGSLPGAVLGGLIIGLIEVFWSAYFSIEYKDVAAFSILAIVLIFMPSGILGRAEVEKV

SEQ ID NO: 2766 - protein, 184 aa, Methylobacterium sp.
MSGGHGAVEGSNKRVALLISVLALFLAFSETLGKAAQTEAIGANIEAANQWAFFQARTIRSTVLKTADEMVALTPPGPNQEAVQAKRAEWAKTMARWDSEPATGEGRKELADKAKANQEKRDLSLHRYHHYELASAAFQIGIVLASAQVITGIVALAVAGGLLGAAGAVMLGFGFLAPHALHLF

SEQ ID NO: 2767 - protein, 411 aa, Methylobacterium sp.
VVNEGSRVSNKLTAKQVDTIRAPGIYEDGQGLRLVIGQGGSKSWIFRYQLNGKRRQMGLGSFPIVSLKAARDAAVAYRAQIAQKVDPLDAKRAAEATQQQPERHVSTFRECAEEYIEEHKPGWKNLKHADQWVSTLKTYVYPHIGDRPVSDIDTAAVRAILKPIWHKTPETASRVRGRIELILDAAKANDHRSGENPARWRGHLDKLLPARSKVRKVVNQPAMPREDVPAFMVALAAHRGAAARALQLTVLTACRSGEILNAAWSEVDLPGRVWTIPEKRMKGGRAHRVPLNDTMMAILQAQLGHDRQWVFPGRKYGRPLCNMAMLKVMRDMGLGHYVPHGFRSTFRDWAAECTSFPREVCEMALAHAIENSVEAAYRRGDLFEKRRGLMEAWAAYALPDLRQGPIQQISA

SEQ ID NO: 2768 - protein, 289 aa, Methylobacterium sp.
VHAEHRATWKNEKHAAQWISTLNRYAVPHLGNRPVDQIGTPDVLRVLAPIWLTKPETARRVRQRIGTVLDWAKAAGHRSGDNPVEGVAKGLPKQGERNEHHAALPYAEVPAFVARLRTGEAGEVARLAFEFLILTAARTGEVLGAEWREIDEAQALWVVPAKRMKAGREHRVPLSERAQEVLMRARALSGSSTLIFPGRSGANPLSNMVFLMTLRRMEVATTAHGFRSSFRDWAAEATNLPREVAEMALAHAIENRVEAAYRRGDLLAKRREMMEIWSIYLSSGRNRKS

SEQ ID NO: 2769 - protein, 395 aa, Methylobacterium sp.
VQGKLTALGVAKLKTPGMYGDGGGLWLQVTGKGAKSWIFRFTLRGKSREMGLGPVSTFTLAEAREKALACRKLTYEGLDPIEARRAQQDEARLEAARAMTFRQCATAYIESHKAGWRNAKHAAQWTATLDAYAYPAFGDLPVQAIDTGFVMRALEPIWTTKPETATRVRGRIESILDWATTHGYRRGENPARWKGHLSNLLPKRSRVRKVEHHAALPYSQVAAFMADLATREAVAARALEFAILTAARTGEVIGARWSEIDLDAAEWTVPAERMKAGVEHRVPLSEPALTILRRLAETSTGEFVFPGGRRGQPLSNMGMLMMLRRMGREDLTVHGFRSTFRDWASETTHFPSEVVEMALAHTIESKVEAAYRRGDLFRKRRELMDAWAAFARLKC

SEQ ID NO: 2770 - protein, 394 aa, Methylobacterium sp.
MTPASRSTTRLILVLAVAGFASTFAGRSVEPLVGVLARDLASDPHSVALLSTAFALPYALIQPVLGPIGDALGKERVMTACLVVLAGALAACALVSQIDLLFGLRMLAGAAAGGVVPLALALLGDRVPMERRQVAIGRFLVAIVLGQLSGSTFAGLLEAEIGWRGVFATTALGAVAAVCATGFGFERGLAGAARRPDFGTALKRYRAIIANPRARILFSAVFIEAIAVFGIFPHLAPLIEARGEGGPREAGLVLAGFAVGSLIYSALVGLLVRFLGLRMLAAGGAICAAALVTIGFAGTWQADCAAMLAMGLGFYMLHNTFQVQVTEVAPQARASAVALHAFSFFCGQALGVALIGGALQTIGQIWALAACAGAILLLGLATAHLLAKPAPRTA

SEQ ID NO: 2771 - protein, 421 aa, Methylobacterium sp.
MHVLVLGGGVVGVTSAWYLARAGHEVTVVDRQPGAGLETSFANAGQVSPGYSAPWAAPGIPIKALKWLMMRHRPLVLWPRLEPRLYGWLARMLANCTEEAYHRNKGRMVRLAEYSRDALRDLRRETGIAYDHREKGTLQLFRTQKQLDHVPDDTRVLDAYGVPYAVLDPAGCIAAEPALAHMSGRFVGGLRLPDDETGDAHIFTQRLAALCEGHGVRFRYDTAVAGLRREAAAVTGVVTGTGEVLTADAYVAALGSYTPALLRPLGIDLPVYPVKGYSLTLPVANPGAAPVSTVMDETYKVAITRLGDRIRVGGTAELAGFSHALRGPRRETLARSLADLFPNGGDPTQARFWTGLRPMTPDGTPIVGRTAFPNLFTNTGHGTLGWTMACGSGRLLADLMSGCSPEIAADDLAIGRYRRAA

SEQ ID NO: 2772 - protein, 418 aa, Methylobacterium sp.
MRAIAVDPDFCEHLFAELLAFSRDAPGVTRAAYGAGEERAHALMRATGLSLGLEPETDAAGNLFLTMPGRDPARAAWMVGSHVDTVPHGGNYDGAAGVIGGLAALAALRRAGIVPPRPVTVAVFRAEESVWFPASYVGSRAAFGLLPPEALDLPRADSGRSLGAHMAELGLRPEAVARGEALLRPERIHGFVEMHIEQGPVLEAEGIPVGFVTAISGSFRYRKALCLGRYGHSGAVARSERSDAVFALADLIAGLDALWGRLEAEDRPATITLGEVATDPAQHAFAKIPGEVRFCLDVRSTEPAVLDRIEADLAGLVAGIEAARGVRFALGERTGSTPARMSPGLVEALAGHARRLALPFRTMPSGAGHDTAVLAGRGVPSTMIFVRNQNGSHNPDEAMRIEDLCAAATLVAHLVAEA

SEQ ID NO: 2773 - protein, 416 aa, Methylobacterium sp.
VSRQDAIAARILDEVAELSRDTAGVTREAYGPGEERAMQAIERHADGLGLVHERDRFQNLWLRLPEDARTAPPVVIGSHLDSVPQGGNFDGLAGVLAGLLVLDRLRGRAGTAPPLRVLALRGEESAWYGKAYTGSLALLGRLPASALALRHRSGTGTLGEAMARSGVDVDAVSRGEALLAPGEIAAYLELHIEQGPVMVARGWPSAVVTGIRGNIRHTRIRCLGEAGHSGAVPRWLRRDAVLAVAELLSGMDEHWRVLLQMGVDLVMTAGICTTAAESHAVSVIPGEVAFSFEIRSQDPETLERFYGLFQESCRQIAAARGVSFAFDAPLHTAPAAMDEGWIGRIEAAGRARGTPVERIPSGAGHDAAVFAGAGIPAGMVFVRNANGSHNPHEAMERGDLLDGVALLLGALTGESG

SEQ ID NO: 2774 - protein, 545 aa, Methylobacterium sp.
MSMTEPVVRIENLTLALPKGADRPHAVEGLSLDLMPGKILCVVGESGSGKSMSAYALTGLLPRALKVAGGRITFEGRDLLGLDERAWRELRGRRIAMIFQEPMTALNPVMRIGDQIAEMFEAHGLLTPAERRARAVALAREVGLPDPEQIVRAYPHQLSGGQRQRAMIAMALALEPSVLVADEPTTALDVTTQAQILKLIRELQQRRGMSVLFITHDFGVVADIADHVAVLQRGKLVEAGPARTVLENPQAPYTRALLAAVPSLTPPERPSVAANPVALSVAGLGKTYTTRGGLFGKPRVVAAVKEVAFDLRRGETLGIVGESGSGKSTTARLAIRLVEPDRGTVRLGTLDFTALGPAALRAERRRIQMIFQDPFASLNPRRTVEQIITAGPIAHGTPARQARARARELLELVGLQPSAAERYPNAFSGGQRQRIGIARALAMEPDVLVADEAVSALDVSVQAQVLRLLEDLKQRLGIAMLFITHDLRVAATICDRIAVMHRGAIVEEGPTAALFAAPEHPYTRSLLAAAPGSGSVLARAQTALA

SEQ ID NO: 2775 - protein, 532 aa, Methylobacterium sp.
VAVAVRDLRLALPLGGDRPNAVDGVSFDLMAGEILCLVGESGSGKSMCAHALMGLLPKAVTVASGSIRLGDTELLAQDAAGWRDTRGRRIAMVFQEPMTALNPLMRIGDQMAEMFEAHGLLAPQERRARAVTLAREVGLPDPEGIVRSYPHQLSGGQRQRAMIAMALALEPAILVADEPTTALDVTTQAQILKLIRDLQRRRNMAVLFITHDFGVVADIADRVLVLRQGRVVEEGPAAALLGGPREAYTQALLAAVPAMNPPARTAPEGPKTIEVAGLSKTYVTGGGWWRKPRTVAAARDVSFALRRGETLGLVGESGSGKSSVARLVMRLIEPDLGSVRLGDTDLTQLRGEALRGARSRIQMVFQDPFASLNPRRTVGQIITDGPVAHGVSLSDARERAVRLLGLVGLDVRALERFPHEFSGGQRQRIGIARALALEPEVLVADEAVSALDVSVQAQVLALLEDLKVRFGLSMLFITHDLRVAAQICDRIAVMRRGEIVELKTAADLFARPEHSYTRDLLTAVPGRAREAA

SEQ ID NO: 2776 - protein, 304 aa, Methylobacterium sp.
MAQTGSAPTRRGVAGWLGAGLALAASAPLRAAGAQDPAARLAALAARVGGRVGVVLRDTGTGETLLSLRAQERFPLCSTFKVLAAAAILARVERDGERLERALPLGPDDLQSYAPVARKRVEAAGGRTAMTLEEACAAALVWSDNTAANLLLDALGGPDALTAFLRAQGDATTRLDRREPELNTALPGDPRDTTTPAAMAATLDRLLLGPGLAPASRTRLEGWMVGCRTGLKRLRAGLPADWGIGDRTGTGDNGTANTVALLHPPGRAPLVATVYITGAEGPVEARDAAHAEIGRIVTARVAGF

SEQ ID NO: 2777 - protein, 252 aa, Methylobacterium sp.
MTTSIGAVAAGWTVAEPAAGAGVTIWLVDLALSSPALTACDAVLSADERARANRFLRTEDRDRYRASHAALRLVLGRALGADPRNLAFAAGPNGKPELAGAVREAPGFNLSHSGRLALIGLSACRPIGVDVEMIRPLPDALRIARGHFSADEAEALAAAPERERVAIFFGLWTRKEAVVKALGAGLALPLDHFSVTLPPAAPRLLRMADGLGGWTLIDLELGPGYAATAAVAEDDVPVVLRALPAGWPSHLL

SEQ ID NO: 2778 - protein, 253 aa, Methylobacterium sp.
MMLPAPRYAALFGAMVLALAGACSAPTRAEPARGEPLRAVVELFTSQGCAVCRGADPVFRELAGRPGIVALTLPVTYWDYLGWKDTLAQKPFTERQHAYAGLHGIRQVFTPQAIVNGAASVVASDRTGLERILGREAAQPGGLPVPVRGEERGDRIVIDVGAGGQRGEVWLLSVLRRRPVAIERGENRGRTATYLNVVRGMQRIGTWSGQPVHYEVPLPTAHVADADSWVVVLQGASNGKPGRIWGAAKGPGL

SEQ ID NO: 2779 - protein, 322 aa, Methylobacterium sp.
VRAPRLVLPRGNFSDIRAAAPAVPVSPRAEADPQARWRDLVDRRLPEAARARPDWPVRLDHGFARILLDNACGGPWRESVRPPAWANMPPERLALAIELGEALLAGRAELDLLNRRSLLWRGKRRAPPAPDELVAPGGLLLRRWRRSDDGPFANLNADPAVMAHFPSLRSRAESLNEARAFDRRFEADGFGPWAVEEAGRFVGFVGALRMMRPMPFRGGERPGEGVEIGWRLARDAWGRGIATRAARATLADLFGRCGVPAVVAYTAEGNGASRRVMERLGMRPDATFAHPAIPADHPLSRHILYRMDARDLRERDLPGGSA

SEQ ID NO: 2780 - protein, 539 aa, Methylobacterium sp.
MNRVRSALAALAMLTVAALPASAAPLDRAALAADLCGDAAAQARGAEGVVRAAADASAEDLRAAGQLLAALAERRLACGSAGALLLDGAGAPVGRDALTGATRPAAEARAPVLGLRQRALVETARAAVALLTAESAAARAAGLATLERRAGAVPDTVLARARDAESDPGLRASIAGAAQAAALSSADPEKRRAAIAAVAAAPSGAALSRLRALRSEPAAASDPAFAWALDAGIASVERAVRIGDCLAILYNGLSFASILFMAAVGLAIIFGLMGVINLAQGEFIMLGAYATFGVQEAFRHLAPGLLDLYLIAAIPVAFGATALVGIAVEALILRHLYRRPLMSLLATWAVSLFLVNLVRVAVGTQNLQFAMPPYVSGGVPLYADFVVTWNRLFAILFAAATLALTLLVLRRTPLGLDIRAVTQNRDMAACLGLPTRQVDRLAFGLGSGLAGLAGVALCPIYSVNPGMGSGFVIDAFMVVVLGGVGSLAGTLVAALGIGGANVLIEPLSGAVAAKVIVLVGIILFLQRRPEGLFAARRRR

SEQ ID NO: 2781 - protein, 528 aa, Methylobacterium sp.
MIRILIFLTLLGLSAPVLAQDAPPADAYTRLASDSYGDIEAGIAGLAASGDPRAGAVLGALAEGRLLYRPADKTLFIKQGNDLVDARTGRAAQAEGLKPVRANNKIRRALEAAQGQLNLTSPDPAKRREAAEAVFKARDPVGLPAVERALTAESHPDVKRVLAAARAAVLLARPETPENERLAALPSIQARGDGDAIAILRNVAANDPSETVKAAAARGIQAVETRLAVAAAAQNVWYGISLGSVLLLAAIGLAITFGVMGIINMAHGEMVMLGAYTTYLVQDAIRAHAPGLFDWSLAISIPCAFLVAGAVGVAIERGIIRFLYGRPLETLLATFGVSLILQQSVRSIFGPTNREVGSPGFMSGAFDVAGLSITWGRMWIVLFALGVFLGLLFVLRKTSFGLKTRAVTQNRRMAAAMGIRTPWVDAMTFGLGSGIAGIAGVALSQIDNVSPNLGQGYIIDSFLVVVFGGVGNLWGTLVAALTLGVANKLFEPYFGAVLAKIALLVFIILFIQKRPRGLFALKGRAVES

SEQ ID NO: 2782 - protein, 365 aa, Methylobacterium sp.
MSGAVQTGLAAPARPRRAPRDPLVTVLVGLCLAAALGLVLGRPAPYLVNAVGQLAAFAILAVSLDLIWGYLGILTLGHGLFFAIGGYVCAMHLLAHGTVVTGTLPDFVQFMGWKGLPAYWAGLEHAPYALLLALGLAGLVAFLFGLVAFRSRVNGVYFSIISQALVYVAMLLMYRNDTGLGGNNGMTGFPLLFGWPMGSAGAVTGLAVAALLVLAAVLAGTRLLVGSAVGRRMLACRDDETRLRTLGYATTRLKLQIWCLSAMIAALAGILYVPQVGIINPRVLAPDLSIEIAVWVAIGGMGRLGGAVIGAVLVNALKFWLSAAMPEAWPFLLSGLVLLVVLVLPNGLLDIAGLRMRPTWARGAR

SEQ ID NO: 2783 - protein, 382 aa, Methylobacterium sp.
MTRTRLIDPKGWIFLGALAAFCLVVPLLNLGVAEGSGLHLPTYLVSLFGKYLAFALLALSLDLVWGYCGILSLGHGAFFGLGGYAMGMYLMRQIGPRGVYGNPVLPDFMVFLNYKELPWYWLGFDTFAFAALMVLAVPGLLAFVFGWLAFRSRVTGVYLSIITQAMTFALMLAFFRNDMGLGGNNGLTDFKDILGFPVQAQGTRVALFVATGIALALGYLVARFMTVSAYGKILIAVRDAESRTRFLGYRPEHYKTLAFTVSAMMAGVAGALYVPQVGIINPGEFAPTNSIEAVIWVAVGGRGTLVGAALGAVIVNYAKTVLTGAMPDAWLFALGALFVVVTLFMPKGIVGSLIERFGSPRARAKLPPEPEIAPKLAEEGQG

SEQ ID NO: 2784 - protein, 408 aa, Methylobacterium sp.
MAHLTRRGFIGSAALLAAPAIVRPAFAADTVKLGCLFSSSGTMANIEGRLNHVVRMAADEINGRGGVNGRRIEVLTSDPASDWPLYAQIGRQMLQQERVAALFGCWTSVSRKSVLPVVEQNDGLLFYPLHFEGDENSKNVVYVNSPPASSVLPAVDYLMGPDGVGAKRFFMIGSDYVWPRTINKQLKGYWKSKGILESAWREEYVPFGFSNFQTLVNQVRSFASQPGGQPIVVLTVVGSSIPDFLREFANQGIAATDVPILGLDMVEADLEGLDTGKLVGHLNCWAYLQAAKGERNQTFLTDWAAYVKAKSVPFSADTVIDPMVSAYDSVHLWALAAAKAGSFAVPEVRKAFAGLSFADPSGYTLTMTGENTYVSRGVFIGSVNERRGFDVLWQSPDAPKPVPFSPYG

SEQ ID NO: 2785 - protein, 413 aa, Methylobacterium sp.
MALASLSVGTARAQETIKVGILHSLSGTMAISETTLKDAMLMLIAEQNKRGGLLGKKLEPVVVDPASNWPLFAEKARELIAKDKVSAVFGCWTSVSRKSVLPVFKELNSILFYPVQYEGEESERNVFYTGAAPNQQAIPAVDYLMKEEKVERWVLEGTDYVYPRTTNKILEAYLKAKGVKPEDISINYTPFGQSDWQTRVAAIKSFGSAGKKTAVVSTINGDANVPFYKELANQGIKATDIPVVAFSVGEEELAGIDTKPLVGHLAAWNYFESIDTPENKAFIQQWQAYKKNPKAVTNDPMEAHYIGFNMWVKAVEKAGTVDPDKVIAALPGTEQKNLTGGTSTMLPNHHITKPVYIGEIKDDGQFDVVNKTEGLIPGEAWSKQLEGSKDLEADWVNLNCGNYNTKTKKCGGA

SEQ ID NO: 2786 - protein, 540 aa, Methylobacterium sp.
LSGLSGGFAIIKVDQVSAIGAALARQVEAVTLLGDLARLSQQLRALTALQHYSPSETQRSAYEREAEEGRVAFSKAWGDYATLIEGARETQLAETLRNAWQHFLAIEEEILILDRAGLNETGTAVLQGDMLSEAANFYTAVRAVQAYRQQEVEIATAAAQEIRASARFWIVSALACLLTLCTLAGWLLTMTISRPIGRMTGVMGRLADDDIGVEVPDQRRSDEIGLMAAAVQVFKDNMIRNKALEAEVAAQRAGAEAQRRIAMRELADAFDQSVGGIVTAVSSAAVQMQTTARQLSVSAEATSVRAVAVSAAAEEASVNIHSIAGAAEELDASVTEIGVQVERSSAMSQAAVRETEGMTALVRELTGVAASIGDVVDTIAGLAGQTNLLALNATIEAARAGEAGRGFAVVATEVKELANQTSRSASEITAKIEAIQSSTGRTATAIDGISASIRSINETATAIASAIEEQGAATREIVQAIAQASSGTGEVTANISGVASNVEETGTGAAQVLCASGELAQQSDLLRRQVQSFLDTVRAA

SEQ ID NO: 2787 - protein, 239 aa, Methylobacterium sp.
VPSLRSVCFNAYWAAWTALFLAPLLAFAASGAPARPIRAATRLWARGILFGLRGIVGLRYVEEGRERIPAGPCLIVANHQSAWETLAFLILVPDVAIIAKRELVAIPVVGWFLRRSPMIIIDRANGTQALRTMIDESRAAVAAGRSVLIFPEGTRSAFGAPVQFKRGAELLYGKLGLPVLPVAVNSGLYWPSGSRSRPGTVVVSYLAPLAAGLSAAAFMEGTERAIERELDRWRPVVAA

SEQ ID NO: 2788 - protein, 532 aa, Methylobacterium sp.
MGVNSMRHLALRFALATAMTGVLSIQTASSASAKTLRAVMSSDLRILDPIMTTAYITRNHGYMIYDTLLSMDSSFSVRPQMADYTISDDNMSYTFKLREGLKWHDGQPVTAEDCIASLKRWAARDAMGQLLYKHVAEVKASDDRTFTLRLSDKYSQVLESIAKPSIVVPFMMPKRLADTPADKPIPEQIGSGPFKFVASEFKPGVQAVYVKNTDYVPRAEPQSWAAGGKVVKVDRVEWVAMPDPQTAINALLSGEVDFVEAPPVDLLPIVASEPNIIIEGLNPLGAQVFGRMNFLNPPFNNPKLRRAAMLAFDQRDFMNALAGDPAYFKLCAAMFACGTPLETPVGGEMLTSGGNLAEARELLKEAGYKGEPVVILQTTDVSYLRSSPVVAAEALKKVGFNVDSQAMDWQTVTSRRTSQKPVSEGGWSLFFTTQVIADVMNPLGNTMVSGEGKKGWFGWPDVPELNQLKLDYSRAKTAEDRKQIATKIQKLAYDNVVYIPVGQYYNQSVYSKNLKGVSKGPAAPYFWNIEKD

SEQ ID NO: 2789 - protein, 301 aa, Methylobacterium sp.
MFAPSPTMLLETRGSPARQATLAAAFERLGPGLHTGRRAKVRVSPAAAGSGILFRRRFEDGRSADVPALWRYRESQPLCTALRSPEGVLVRTVEHLLAALSAHRIDNALVEIDAEELPIFDGSALPWCAGIREAGRVEQDAPRRAVRVLRPVEVRAGERCLRVEPCDVLRISAHLALAHFPAMDWTGPVDPETFDHDLAPSRSFGRLKWAVPLKIYSALTGKPVLRGANLHTTAGILGSRVVGGMRVPDEPVRHRALDLVGDLALIGHPLLGHVTAAHTGHELNHALVARLMAEADAWELL

SEQ ID NO: 2790 - protein, 391 aa, Methylobacterium sp.
MNAAARVPHPLLLGCGLMLVAFNLRPALTTVGPLLAAIRGETGLGAAGASVLTTLPVLFLGLACVLAPAIGRRLGPDRGILLATAVVAAGLALRALGGLGTLFAGACIAALGIGLANVLIPGLVKREFPGRAGLMTGLYTMTLCLGAAAGAGLTVPLQGLFGGDWSLALAAWAAPALLAALAWAPLARPATPVPAALPRRSIWREPLAWQVTGFMGLQSSLAYILFGWVPLVLHDRGLSTVDAGFVAALMSVGQAPAALLLPTLAAKLRDQRGAALGIVGLTVACYLAVVHGPVALLVPATLALGFGIGGCFGLGLTIIVLRARDTQGAAALSAMAQGVGYTIASLGPLGFGLAHEAFGGWAASSLLFCALAAGAAVCALGAGRARQVGFA

SEQ ID NO: 2791 - protein, 400 aa, Methylobacterium sp.
MRALVLAALIGLSGLQTAAAAPDRAALCAAQGGAAQARPESGAADGVPASLVGRLARGFNLTGWIEGDDPRAPDPALLRRLLARGLTHVRLPFDGEHLMPAIGTAGRAERLARLDAALRQLLDAGFTVSLDMHPGDRFGALHRAEPERALAMLDAAWAVLARRYASLAPDRLLFEVLNEPPNAQAWAGQLPRAVAALRVHAPTRILVVSPGGPQRVEALAALAPLDDPRLVYAVHFYDPMAFTHQGNDWGGADDPLRFLGGLPFPAAAGDPAVRAVTDRLAREGRRAAAAELAGQIRQPWTAEAIDRQFAPVGDWIARHRRPVIVNEFGALDTAAVPDRARWLAAVRGAAERRCIGWTHWDYADAFGFVDRRDGTERPVAPLLDALIPPKAAPGSATGRD

SEQ ID NO: 2792 - protein, 111 aa, Methylobacterium sp.
GKRVVIALQYIHGIGPKKAEEITGKVGIPAERRVNQLTDAEVLQIRETIDRDYIVEGDLRREVSMNIKRLMDLACYRGLRHRKQLPVRGQRTHTNARTRKGKAKPIAGKKK

SEQ ID NO: 2793 - protein, 342 aa, Methylobacterium sp.
MTARSIIRLVGTVAALCGALGAARAEVSTVRLAKQFGISYLPLTLMEEEGLLEKQAKARGLDVKAEWLRFTGGSGMNEALLSGNLDLAAGGVGPFLTIWGRTQTNIRVKGVAALNAMPLWLVTVNPDVKSIKDFGPKDKIALPTAKTSIQAITLQMAAEQAFGAGQQGKLDPLTVSMGHPDAQTAMMGGRSEITAHFGAPPFQEMELKDPRARKVLDSYDVMGGAHTFNLVWASSRFVTANPKVTEAFLAALEDSLRLIRDDPERAAALWIKAEGSKLSQGEAVAIIRAPQNEWTTAPKRMLDYLAYMNRAGLVSAKAGAESELFFPAPEAAKAGGPKEAAR

SEQ ID NO: 2794 - protein, 343 aa, Methylobacterium sp.
MRLRLSLFSRPRIAAMLGGLTLIGAALSPVAAGEGQLRIAKQFGVVYLLLNVAEDQKLIEKHGKAAGLDINVEYLQLSGGSAVNDALLSGNIEVASAGVGPLFTLWDRTRGRQNVRGVASLGNFPYYLVSNRPEVKTIADFTDKDRIALPAVGVSVQARILQWASAKLWGDKDFAKLDPISVAVPHPEAAAAIIKGGTEITGHFGNPPFQEQELAENPKARVVLSSYDVQGGPASSTVLYAAERFQKDSPKTYLAFVDALDEAAKFIAANPEKAADIYLKANNSRIDRDLLLKVIKNPEVTFKVEPQNTLGLGQFMHRVGAIKNQPKSLEDYFFVNPRIAAGS

SEQ ID NO: 2795 - protein, 382 aa, Methylobacterium sp.
MPAFRTGQRLNRRVALAALALAALPLGPLSGSLFGSLPARAREMPETAAGQAARKPNVVVLATGGTIAGAGADAANSATYQAAKVPVDKLIAAVPAMSTVANVRGEQVFQIASESFTDAQLVQLGKRVSALLKQDDVDGVVITHGTDTLEETALFLDLVVKSDKPIVVVGSMRPSTALSADGALNLLDAVTVAGSKEAVGKGVMVTMNDQIQAGRDVTKRVNVVPSAFQSQWGPLGMVVEGKTYFFRSSVKRHGKSSEFDIDQIDSLPLVAIVYGSGTMYPGAYTAAVAAGAKAIVNAGTGNGSVAGYLVDTLKDIRSKGTLIVRSSRVGDGIVLRNAEQPDDKYDWVVAHDLNPQKAKILTAVALTKTNDTKELQRIFWEY

SEQ ID NO: 2796 - protein, 103 aa, Methylobacterium sp.
MEPMKPMKPMAPMKPMKPMEPMKGTDPWWPEDLGSPASSGAQNGLRYAFFPDKHRLLVERDGRTTTYDSGDHQISGVQQQSGGSVSFASQNGAVDLASLKQID

SEQ ID NO: 2797 - protein, 132 aa, Methylobacterium sp.
MDATRLSYSIDHVHLRSRDPVAAAGFYVTVFGAREDGRIGDPVSRVVLDLGGLRVFIEQAPADIAPAAVPPHSGIEHIGLRVADIDAALADLEARGIPLAIPLTQVNPALRTAFLDGPDGVLIELLERGGKA

SEQ ID NO: 2798 - protein, 201 aa, Methylobacterium sp.
MNEPAQPGGEPIEARLRRALGTRSIVLVGLMGAGKSTVGRRLAQRLGLIFKDADHEIEAAAGLTIPDIFAIYGEPSFRDGEERVIARLLRAGPLVLATGGGAFMRDATRARVGESGVSVWLKAELDVLMRRVRKRGNRPLLETEDPEATMRALMEARHPVYAEADVEVLSRDVSHDRVVDDVLEALVAHLDPSAPPAVAAQ

SEQ ID NO: 2799 - protein, 434 aa, Methylobacterium sp.
VNGRRVLALALPMTLANITTPMLGFVGATVIGRLGDAAALGAIALGAVIFDAIFWSFGALRMATAGLTAQAVGARDAAEVDRTLARSLAAGLLAGLALVLLQLPLAWLAFAISGASEAVRAGLATYFHIRIFSAPFVLANFAVLGSVLGRGRTDLGLLLQVAINGVNIALTLLLVLGFGLGIAGAALATLCAEACGLALGLLVLRRLGARPFQVPLSEIRDPAALRRTLAVNVDVVIRTLALVAGIVLFSALGARQGDATLAANAVLWNLFLIGGFFLDGFATAAEALCGQAIGARDEADFRRASSLSLRWCLGFGVGVSLIALGLGHAFVDFVTTSAEVREVAYRYLPLAALAPFVAALPFAYDGIYIGATWTRAMRNLMLGALAAYCATLALVQGLGLGNTGLWLAFLSFLAARGIGQALAYPGLARRTFPA

SEQ ID NO: 2800 - protein, 315 aa, Methylobacterium sp.
MLIKQSRGWEIPESRATPESVFLNRRALLGGAAGLAAGAMLAGRPGLAAEGAPYPAPRNEAYALDRAVTPERYSGDYNNFYEFGTSKSVMPAAEALRTSPWTVKVDGLVEKPFEIGVDDLVRKLGLEERLYRHRCVEAWSMAVPWTGFPLSKLVALAKPASGAQYVRFETFLDKAMAPGQRAFFYPWPYVEGLTLAEAGHDLAFVVTGIYGKPLPKQFGAPIRIALPWKYGFKSIKSITKVSFVAERPKTFWEGLQASEYGFWANVNPAVPHPRWSQASERVLGTDQRVPTLIYNGYGEQVAGLYKGLEKERLFV

SEQ ID NO: 2801 - protein, 190 aa, Methylobacterium sp.
MTRPDLAPGAPLTPDAEMRDMLLGAIPALRAFAFSLTYDLDRSDDLVQDTLVRAWIKADSFRRGTSLTAWLFTILRNLFYSEQRKRKREVEDVDGSLAARLGSLPEQEIRVEMEAFRGALERLPLAQREALILVGAQNFTYEEAAEICGVPAGTMKSRVSRARLRLIELLGMDGTGDIGTDAQTRAALGD

SEQ ID NO: 2802 - protein, 62 aa, Methylobacterium sp.
VREEEDQVRKAPTHEIGQALDALSVDDLAERIDLLRREIARLETARAAKESARGAADAFFKR

SEQ ID NO: 2803 - protein, 116 aa, Methylobacterium sp.
MADAARQLDQTGEADVVRRLIARPIRLEHTRHLAEVVAPEPAAEETEDAPSPNEARDVASLEAELALLKAVLDAERREAASLRARLSDPATADAADGVAVRERWAALVDDLLLRLR

SEQ ID NO: 2804 - protein, 265 aa, Methylobacterium sp.
MVSVDLGAAAADRVQLAAGLAERFRSRLTGVAARPVPSLMPVGDMLEVERVYEDEERRAKEELDEAGAVFEREAGAAPKTAWFSALAEPLAYLVEQARTADLVVVGRQGPADGDTGLMAVPTGALLMEVGRPVLVVPPGIERLAAKRIVVAWKDTREARRAIHDALPVLGHPERACVVAVGPDAHHAGAEGAAEYLAGHGIKATTHLLPSSAIGPADELLRFTQREDADLIVMGAYGHSRLREWIFGGATRDILQTTPVCCLMSH

SEQ ID NO: 2805 - protein, 299 aa, Methylobacterium sp.
MPARTSPPLPWLDRAGRLSALKLLCFLLVLAPGLYLAQGYARDALGAKPITALIHGTGEWAMRLLLATLAVSPLRRIADWPRLINLRRMLGLSALAYALAHLVLYVVDQNVDLAKVVSEIALRIYLTIGFVALAGLVALGWTSTDGAIRRMGPAWNRLHRIVYPIAALGLLHYFLQSKIDVTDPVFWTGLFGLLMGWRMMHRLSVPTRPWSLLLLALGTALLTALVEAAWYGLKSGVPADLVLGANLDFSGPIRPAWWVLGIGLLLPLVSAVRGRPESRKVAARPAPGLVPARAMPQKP

SEQ ID NO: 2806 - protein, 418 aa, Methylobacterium sp.
LTVSDARQHARAARRLVQSANGGRLLALRIVIVLVLLMAAQAYDGSLHQLSHWVILALYAGSSVWFALAERGGGRRADSYAWAGTLLNAGLAVYVIVEHLLAGADSEGAADAVSRLPAFLLLLQTALSVRVWHTALYAGIVATVWGVALLMAATHPTGMLGPHVDLSEQVPALLTFTAASLVVIDGTSRLRGAVAEALRLEHERTLLARFVPEDVAEDLAREGGLGAVRRRHACLMILDIRGFSRLSAEHPPETMVEALLAFRALAQGAIAEHGGLVDKYVGDAVLAQFVMGPPEEQARGALACARAVRTRVAALNRARAQAGRFPLRVAVALHAGELLVGIFDDGVRAEYTVLGPAMNTLARLESRTKAANLDIAASGEFLRLTGPILPENLTVAPVEDGGNPILFAVGEGRHRIPA

SEQ ID NO: 2807 - protein, 114 aa, Methylobacterium sp.
MRTILAATVAALTLITPVGLASAQPYGYGDRDYRDRGDYRDRDYRDRGDYRRGRDDDYDRPSRGGRNRGDYAFDEREYLRCNPDVRRAIVNGQMTSGLAHYRTFGQREGRRLSC

SEQ ID NO: 2808 - protein, 163 aa, Methylobacterium sp.
MGPTRRELWLLTLLPLGPACAAGAADAPAEDPAAILALRGYDAVSYFLPGGPRAGDARFELSWGGRAWRFASAGNRAAFAAGPEAYAPRLDGHDPVGVLDGRLVDTDPLVFALLGGRLYLFRDAERRARLVADPGLADRAEACWPDLARLIEPLPRSSPRSLP

SEQ ID NO: 2809 - protein, 326 aa, Methylobacterium sp.
MTELALDPTETRQPRTAAQGKPPGRPLRRIALASALGVAGLGAFAAASAFLSDLTGSRSTARPPAVAKQSAADWPDLMKDGLPALATGSLPEAGAPRQIALPAADAASTRITAGPAAEPVPAAAPKPLAAVEPAVALPASTPAAATEATMPVVSKPAVPKPAAPERAAAKPAPTIENAPVIAPARQAGVLPPPNRTAPTVAARPAETVRARTASTSFAALPPAPDKAAAEKPAARAVPAESRKDPAKPAEAKAEAAEQAKKKPEKTVAARKPQPTAVASAGPAAPAEPEETEVFGIKVPTLAATGRRIGASVEALGDAVKGLPDKF

SEQ ID NO: 2810 - protein, 66 aa, Methylobacterium sp.
MSEPPDDNLDHYALGFYALGKGVARAECPYAAGTRAEADWHAGYDAAARGDSEPAPEAPRGAQSPM

SEQ ID NO: 2811 - protein, 387 aa, Methylobacterium sp.
MLRRLVAVVFLGLTVSAAAEEPLRFEVDPAWPKRLPNDWIMGQAAGVAVDAQDNVWVVQRPRTLTDDEKAASLDPPRTRCCKPAPPVLVFDQAGTLIRSWGGPGEGYQWPQNEHGIHIDHKGFVWLAGNGDTDGQILKFTPDGRFVLQIGKQGPQTDSRDTTRLGKPAGMMVDPEANELYVADGYYNHRVIVFDAETGAFKRMWGAYGRPPTDEKLGPYDPAAEPAAQFRNPVHCVQIARDGLVYVCDRTNNRIQVFAKDGSFVKEMFVERNTRANGAVWELALWPDERQSYLLNADGANNEVRTLSRDTGEILGRFGRNGRMAGDFHWVHNLAVDSKGNVFTTEVDTGKRAQKFLFRGEMVLRKRAALPEGTALPQGPALSEGAGR

SEQ ID NO: 2812 - protein, 153 aa, Methylobacterium sp.
MAALKPILLVEDNPNDIELTLAALESSQLANEIVICRDGAEALDFIYRRGAHEGRQHQDPAVVLLDLKLPKVDGLEVLSKVKGDPATRGIPVVMLTSSREETDVVRSYNLGVNAFVVKPVAFDEFFAAIKEIGVFWALLNEPPPHRGGWPSNA

SEQ ID NO: 2813 - protein, 68 aa, Methylobacterium sp.
MRRYLVTFHRVVLDDTGHDRRTLQRQVVVTALSDATAIEVAKAMFCEAAGIGDWRLRADACEVTELVA

SEQ ID NO: 2814 - protein, 194 aa, Methylobacterium sp.
MIRRVLPLLPALVLLAPGAALAHPGHGEAVGFAHGFAHPVGGLDHVLAMVAVGLLAALRGGAARWGLPIAFMAMMAAGAGLGVFGIALPFAEAGIALSLVAFGLAIVFAGRLPLPALIGLVGVFAVFHGYAHGAEMPETASGLAYGAGFLAATALLHAAGLGLGFLVSAERRRAAPAMGAAVALSGLTLLAGAF

SEQ ID NO: 2815 - protein, 98 aa, Methylobacterium sp.
MLAPALASPITSARIRAGRGLLRWTQGVLASRAAVSVVTLTMIESEQVRPRSRTLEAIRRVLEGEGIRFIGDADAGYGVLLRPHAETGPTSSSGEAGL

SEQ ID NO: 2816 - protein, 95 aa, Methylobacterium sp.
MKPVLLVDDSPTILASMSDILSRSGYAVERAPHAEAALDKVRAGLAPGLVITDYHMPGMDGVRLIGELRKLAALRFTPMLVLTTESQQEKRDAAR

SEQ ID NO: 2817 - protein, 103 aa, Methylobacterium sp.
MTTGKIASATAPAGENGEIGLARGERLALRMWRDEPPNADKPTSVSAHETVGYVLKGRAELVLAGESVLLEPGDSWLVPAGIEHTYRILETFTAIEATAPPAV

SEQ ID NO: 2818 - protein, 89 aa, Methylobacterium sp.
MARARTALLAAALVVGAPAAALAFGGNSDAGSGLSPYAALNGNDRSAGVNNGNYRPPRFDPYVQTYGYEDEPRVYRRAPTRRPAYGYPY

SEQ ID NO: 2819 - protein, 53 aa, Methylobacterium sp.
MDLGPHAGFILASYAFTALVMGALVLNAVRDRRAQTRALRGFGALRGSGEERR

SEQ ID NO: 2820 - protein, 573 aa, Methylobacterium sp.
MDVAAPLRILHLEDSDLDAELIEAELDRLGPAVRIVRVMSREAFAAEAVPGRHDLILADYVLPTFDGISALGLASGQCPDIPFVFCSGTLGEEVAVEALKNGATDYVTKQRIDRLPRTIVRALAEARIRSEKRAAEAALQALNRTLEARVAERTRELAEANAALEAQIEERERVEEALRLAQRLEAVGQLTSGVAHDFNNLLTVIAGNIEFLERAVTDERSKRRLDMMRGAAARGANLTAQLLAFSRRQRLEPTPVSLNRTVASMHDLLTSSIGGAVRIEIALHEGLWPALVDATQVELVILNLAINARDAMAVGGRLTIETANMTVRAPPTRPEHPQPGAYVMVSVSDTGTGMPPEVLARVFEPFFTTKAVGKGSGLGLAQVYGFVKQSGGGIRIDTVPGEGTSIKVYLPRADEAGAAAPVPDAAIDCARAHPPGAQPALLVVDDDGGVREVTATRLVEAGYHVREAASGLQALAALEADPCVDLVVLDFAMPGMNGAEVAIELRKRWPHVPVLFVTGYADTAALRQAGAVGAEGIVQKPFRDGELERKVAATLAAHPVPRLRLVSQRDRSA

SEQ ID NO: 2821 - protein, 169 aa, Methylobacterium sp.
MSYERAVLAGGCFWGMQDLIRRQEGIVTTRVGYTGGDVPNATYRNHGTHAEAIEITYDPTRTSYRRILEFFFQIHDPTTPNRQGNDRGLSYRSAIYYVDAAQHRIAEDTVADVNASGLWPGRAVTEVEPAGPFWEAEPEHQDYLERHPNGYTCHFVRPNWRLPARSAAE

SEQ ID NO: 2822 - protein, 117 aa, Methylobacterium sp.
MNRAAALSVDDPVRDCPVPPETLGRIARAEPESLDEIVEGIPEAVRARLAVYLYGRSHTHELGIRIAATCEGTTLRRAAGLVGNMLHDLSRRPYAPPSHGLRSAARISLGGPAARRA

SEQ ID NO: 2823 - protein, 49 aa, Methylobacterium sp.
MNIERQREIASKGGRSVPAEKRSFSQDRELASSAGRKGGQSTGTGRAGE

SEQ ID NO: 2824 - protein, 76 aa, Methylobacterium sp.
MMTKDQLAAELKRIATSQISDITRAVKEGQKSIALNEVRDMAHRLNLLADAFHPRAVQSQLHPQPGEPAAETPQAA

SEQ ID NO: 2825 - protein, 189 aa, Methylobacterium sp.
MNAAPLEPAAFAAPAVLLSGPVDHDMYRDFRRQLAAAAERDLVVVELSTLGGDPEVARMMGEDIRFHSALAPGRRFVFLGKAAIYSAGTTFMSFFARQNRYLTRGTRLMVHERKLNKQVKLNGPLTTCVAAVKAALHEIETSIAIQNEGFANLVAGSRVSLEEVLRRAPENWYVEAEEAQRLGLIEAVL

SEQ ID NO: 2826 - protein, 200 aa, Methylobacterium sp.
MRYLLAGLVAGLLTAFSPLLSGPAEADDTFARLRGTVETRTNGTLVVRPYAGGTVTTALNPKTRIMIADRGNLRDIKPESYVSVLSAPGENATGVVIYSPSERGFEAGRQSWDAKPGATLTAGWIIARDGRDPVRIRLGHPGAEEQFALPVATPTTRIAPGEKSLLVPGAHVVVFARTDASGVVNADTIVVGRQGVRPAL

SEQ ID NO: 2827 - protein, 294 aa, Methylobacterium sp.
MTEIRPRRSVLSMPGSNARALEKAGGLPCDVVLIDLEDAVAPEAKAEARARVAAAVSDRRFGHREVVVRINPLDGDHGEDDLAALAPAAPDGILVPKVAGPEALVAVGSRLRRLKAPPGIRIWAMIESPLAILNLADIASAARDVDVRLAGLIVGPNDLAKAARVRLGPGRAALMPWLMGVVAAARAYEIDAIDGIYNTFTDAEGFAAECAQGRDCGFDGKMLVHPSQIAAANAAFGPTPEEVAEAEALIAAFAAPENRGRGAIAFQGRMVERLHAEEARRVLTLAEAIARQGA

SEQ ID NO: 2828 - protein, 291 aa, Methylobacterium sp.
MIAPARALDSDAVQAFVLVADLGGFTRAAEALGTSQAAVSLRLKRLEERLGHRLIERTPRRVRLSERGEAFLPAARDLLAAQERAWQQVVPTPPRRLILGISDHVAGPELPVLIGRIAAQDPGLLIEVRIAGSRDLVAAYARAEIDAAIVRSEDGSPQRGEGRLLARELFGWFAGPGFRHRPGEALRLATLAGSCGVRETALRCLDAAGIPWTEVFVGGGVLAVGAAVSAGLGVAALARRVAPPGSVEVGERLGLPPLPTADVVLHARTREPRAGAALRLVGAAFRAAATV

SEQ ID NO: 2829 - protein, 164 aa, Methylobacterium sp.
MDRPSLYDDDIVAWAEEQAAALRALGARGELSNAVDWENVAEEIESVGRSHIRAVEGLLIQTLAHLLKRVSAPLAPASTHWREEIVTFQTTAWSAYEPSMRQRLNWARIWKVALTAAEAGLGAYGNELLPGLPKTCPIDPDDLLAEHFDVDRTLRTLAASVASR

SEQ ID NO: 2830 - protein, 93 aa, Methylobacterium sp.
VRTLRLITGGCVVGLSTLIVGFVSADRLSHLAPPPVVRAAVPEPSATGSIAVPKPAAPVAPQKVAAPKVPSGFDTERLNALMRGDPILPAGRR

SEQ ID NO: 2831 - protein, 437 aa, Methylobacterium sp.
MASFSESDRGRSKVATVLRVTSGNFLEMFDFFLFGFYATHIAKAFFPGGNAYASLMLTFATFGAGFLMRPLGAIFLGAYVDRIGRRQGLIVTLTIMAAGTILIAFVPGYQTIGLAAPALVLIGRLLQGFSAGVELGGVSVYLAEMATPGRKGFYVSWQSGSQQVAVMAAAIIGYALNHSLTPGQMGDWGWRIPFFIGCAIVPFLFYIRRSLEETQEFLHRKVRPSTAEIFASLGQNWKIVVLGMLLVAMTTVSFYTITVYTPTFGKEVLKLSDTDSLLVTFCTALSNLFWLPVMGALSDRIGRKPLLIVFSALTVLTAYPALAWLVGHVSFGNMLVVLLWLSFLYGSYNGAMVVALTEVVPAHVRTAGFSLAYSLATAFFGGFTPLISTWLIERTGDRAAPGLWMAFGGACGLLATLMIYRASATRARAALGVGAAG

SEQ ID NO: 2832 - protein, 95 aa, Methylobacterium sp.
MKVAADLCIVPMGVGPSVSPYVREIKALIEASGLEATMHPNGTNIEGELSAICSLAEACEARLAELGVQRTFFTLIFSTRRDKEQSMADKLDAVS

SEQ ID NO: 2833 - protein, 93 aa, Methylobacterium sp.
MEAKVVRWGDDLAVRLTPAEAEELGIREGETVEIVSKPEPQQWAGRRYLDGQPVYTLEEMVAEMRRLGPDFAPPTVDWGPDVGSEIIDDDDPR

SEQ ID NO: 2834 - protein, 238 aa, Methylobacterium sp.
MSAASEWRAARNVKARARLERALPTVFPAPVLRHALGRPLTPPTPRLAVESYWRAHVLRADRLARGLAARSGTPEGWVWRAGPEAAAGFRMPPAPFREAEHARGPGACCVCGQPVYRFGWHRDLWGTGTPNRNARWHAACVAAWKFWVAPSDQVKLLKARQRHRCAASAKRLLRTAEVDHRVPLYRVWREHRERPWPELLGFWGLPNLQVVNRASHAAKCHEEATERASVRRALLPLP

SEQ ID NO: 2835 - protein, 206 aa, Methylobacterium sp.
MDEGQGSGPDRAAIRAHYGQPTPRSQVKLLDRIDGHARAFIALSPFCVVASADAAGRCDATPRGDAPGFVAVADAHTLLVPDRPGNRRVDTMLNVAENPQVGLLFFVPGLQETLRVNGRAEIVTDPEVLAPLSAQGKMPCAALRVRVEEAFFHCGKAVIRSDLWTRGAGPRPDFPTLGQIFADQIAGTDAAENDRSIEDGYRNRLY

SEQ ID NO: 2836 - protein, 329 aa, Methylobacterium sp.
LESVRAEGGAEVRLAVEGQPEAPVIRVAAASGRGAAVEAVLARAEALTAQDAGVRRIRVEAADAVTRHLITLGAARRGADGVEILPALLWQCAARWLPEPRPPFPEVHTVTEGRRHPLRPEAPAGTVYARRIPWLGRTLTFRTLSEPGDAALFSRWMNDPRVAEVWAETGSLAEHEAYLARLGADPHQLTLFGCLDGVPFGYFELYWARESRLGAHYESEPYDRGWHVAIGEADIRGRAHLSAWLPSLMHYLFLDEPRTRRIVGEPRADHAQQLRNLAGSGFGPLATVDFPHKRAVLVALTRERFVRDRLWVPGAAAADARPRPPDVEA

SEQ ID NO: 2837 - protein, 233 aa, Methylobacterium sp.
VRRVSAAVAAAGLLVGFGWALGRGLQESAMDARHYGQGRRVAVQQHLDEAPANFVFLAGDSQAELQSPAQRPCGLELVNGGVSGANAAAYADFLDGLRFPHRARAAVLAIGTNDLIAKNHPGLPAQEAQFEATGERILRTLMRHAEKVVVAAVPPIGRELDGRLDAGSVAPYTARLRAVCARLGCRVTDPYAALRDGETGFAKPGAMGNGLHVAAYRPAMRALEAEICGPVGQ

SEQ ID NO: 2838 - protein, 429 aa, Methylobacterium sp.
MPTMPRSARLTGLLLAGLLLPLGPAGAQQAPSGTPTPGSADGSAPKPAGAPAPAQDRGSALYGRPEGGDAAKLAPIAGPPLPTPAARLPLDKLKVPDGFKIEVYASGLANARSLAEGDKGTLFVGTRSLDRVYAVRTVDGKQQVKVIASGLHRPNGVVFHKGALYVAELSKIWRFDDIENNLDTPPKPVLVSDDFPKDEAHGWKFIAIGPDEKLYVPVGAPGNILNPPDTHAQIRRMDLDGKNVEVVARGVRNTVGFDWNPRTQQLTFTDNGRDWVSEDIPNDELNVLSEPGRQHFGYPFCHQGNFTDPEYGWGRSCAEFTAPAGLLGPHTAALGMRFYTGAQFPAAYKDAIFIARHGSWNKTQKLGGDVVVARLGADGKMTGLEPFLTGFLQDNRYVGRPVDVLVARDGALLVSDDYNGAVYRISAAR

SEQ ID NO: 2839 - protein, 751 aa, Methylobacterium sp.
VSRANDVAQRIDLSACDREPIHVVGSVQPHGFLLALDARSLIVVQASANAPAAASVGTALESAYPDLAALASRYRDAGDQEDGAAYLRTVTLGAGSTRQAYEVAAHRVDDLLVLELEETDDASGDAGLDALTARLRAFVQRLHAARSVEDLCGLLARDVRHVTGFDRALVYRFDRDWHGTVVAEDGNGVLPSYLDLRFPASDIPAQARELYRRNRLRIIPDAGYAPVPIRPGTTPAGRPLDLSQSVLRSVSPVHVAYMRNMGTMASMSVSILVDGALWGLVSCHNEGPKRVPLQARNACDFLTQVFALQLSAKVRGEQAEQRLALGAVQARLLGYMAEEDSFVDGLLNNPDDVLALVNASGAAVVTADRCRLLGATPPERAVRALYDWLSARGEADDVFVTEALAEAFPRAEGFADLASGLLAISVSKRYASYILWFRPEVVRTVKWGGNPVKAASPDPEGGPDRLHPRKSFETWKETLKGRSLPWSLPEVEAAKDLRASVLGIVLRRAEELAAMSEELQRSNKELEAFSYSVSHDLRAPFRHIVGYANLLRNREGPSLSDKGRHYVETIIEAAFSAGTLVDNLLSFSQMGRHALNKVPGDMGALVEEVRRKVLRDVDPGRAVRWEIGPLGRAYADPAMLRLVVENLLSNAVKYTRGRPEAVIAVGRLPPRDGESVFYVRDNGVGFDMAYVDKLFGVFQRLHRVEEFEGTGIGLANVRRIVERHGGRTWAESTLGAGATFYFTLPVREEAH

SEQ ID NO: 2840 - protein, 513 aa, Methylobacterium sp.
MRQGFRQSMAWLHAWSGLVVGWVLFAVFVTGTASFYRTEISQWMRPELAATETDPDRAAELGAAYLQRQMPDAMGWFIALPTPEKPAIAVMWWKSMEGPFHQALLDPGTGEPTVARGTKGGDFLYRFHYELSMPPTLGRWIVGACTLVMLVALVSGIVTHRRIFADFFTFRRDRSAQRGWLDAHNVAGVLGLPFHLMIAYTGLTLLATLYMPWGVRTAYKGDEIRYFVEAGLMPDLRWAAGKPGTLAPLGPIVAASVARGGEAPEGLSVWNPGDAAATVVAIFEEPHGLSHHHPQIAFEGQTGAVLGQTGAVGAATGTGTVMAGLHMGHFAGPALRVLFFLCGLMGAATVATGLVLWAVARAPKGAAAAGPGLRLVRALNLGTIAGLPAGIAAYFLANRLLPVGLTERASWEIGAFFAAWVLAALHGALRPGPRAWAQALGLVGALYLAVPPVAALTTGLYQPGGALRFLGFDLTMLVLGLGFVLAARKAAARAEAPLRRPARGMTGEEPLRA

SEQ ID NO: 2841 - protein, 371 aa, Methylobacterium sp.
MSERTEILVFAHVGDLHLTDPGARNADDYQAILSEIGETGGLDFVFLPGDNADHGRAEEYALVRAGLRRLRLPAHVITGDHDMEGGSLDAFYAGLGAQRLPYGVTVSGTRCLFLDMCGPGTGGLDFRLGSEQIAWLERELAGAEAEGGICALFMHSYPADLKAEGEASRVAELVHRGPVRLVEMGHTHYNELANDGRTVYAACRSTGQIEEGPVGYAVAALDRGTVAWRFREVGRSWPFVLITAPADRRLAHADDRTVAGDTEIRAVVLGSVEIVECVCRIDDGPWHPMRRGADERRHRARLAWPSGARRIAVRARDRAGGLDEDVVEPASAGAAPLISRGIGSDADAVGSWPEKGLLGSQLGPNRNGRQW

SEQ ID NO: 2842 - protein, 221 aa, Methylobacterium sp.
MNGAQDLGGMHGFGPVRPEPDEPVFHADWERRVFALALAMGFTGTWNLDGSRAARESLPPAEYLASSYYAIWLRALERQVAAHGLASPEEMARGVSEAPARPVARVLTAEILGPRFRAGFPSDRPAPGPARFAVGDAVRARNLHPVGHTRLPRYVRGRPGRVERVHGAFVLPDTHATGAGENPAWLYTVAFAAAELWGPDADPNQRVMVEMFEPYLDAVAA

SEQ ID NO: 2843 - protein, 106 aa, Methylobacterium sp.
VSAPEPGPFAAPWEAQVFALVVSLRDAGVFTWAEWAAALGRAIRPGDDLEAAADYGRWLVALEALLAERGIAAPEGVDARRDAWLRAAAATPHGQPIRLENDPLRA

SEQ ID NO: 2844 - protein, 444 aa, Methylobacterium sp.
MTATTDQPVGDDILGIGFGPSNLALAIALETEARHGPVRPSVRFLERQARFGWHRAMMLPGADMQISFVKDLVSLRDPTNPFSFLNYLHRKGRLTAFLNLKTFNPSRVEYNDYLAWAAEHFADSVAYGEGVEAVHPEIRDGRLAAFRVAGRTASGAVRMRRCRHLVVAAGGDPWIPEPFGRLRGDSRLVHSSWYLPGIAAALGAPSLDGPERRVLVVGGGQSAVEIAVDAGARYPRASIDLAIRAPALKPADDSPFVNEIFDPAAVDRVHGAPEPVRAELIAAHRDTNYAVVDADLIQSFYQTLYEQEVSGETRYRLLRSTRAVAVAPGPDGLAATLRDDVAGTETRQGYDCVICATGYTRAAVPAMLDPLRPFMAGETVDRHYRLPLAPAEPRLSLHLQGFAEASHGLTETLLSILPIRAGEIAATILDLERAARGAIRPAAE

SEQ ID NO: 2845 - protein, 369 aa, Methylobacterium sp.
VADLVLITGGAGFIGRHLAAALLRRGYRVRVLDSLIEQVHGVGAGTALPPEVGFVAGDVRDPETVARALKGADHVVHLAAEVGVGQSMYAVERYVSVNDCGTAQLFQGLIEQPVRRVVVASSMSVYGEGLYLAEDGQTVEDAVRKPRRPGEPWDPLDAQGRPMRPVPTPESKRPALASVYALTKYMQERLTLTLAPAYGMEGVALRLWNAYGPGQALSNPYTGVLAIFAARIHNGQRPMVFEDGAQRRDFVHVEDVAQAFVLALEHPAAAGQVYNVGSGQDRSVTEVAELLAAAMGREDLGPEITDQARLGDIRHCIADISRIRAELGYAPRRDFSEGLAELAAWVAEQQAVDRVAEARRELEMRGLVA

SEQ ID NO: 2846 - protein, 233 aa, Methylobacterium sp.
MTERLRLFTSPSAFPNPQRVRLFLHEKGIADRVDEVIYDMAPGGQQRQWPHLKMNPWGETPTLQLPDGTYLAETTGIVRYLDTAFEGRRITGTDALEQGLDAMWDSRIWVHVLYRITTMFHVMHQGLGPKLELTSNPQWGEHCRKEALAHAALVDRHLADGRSWLLGGDAPTLADITLCTAIAFSKFPVNATPLDERFEQIDAFWKRWKARESFRKAYADGGSGLDELSELKR

SEQ ID NO: 2847 - protein, 96 aa, Methylobacterium sp.
MIFDWDDAKSARCLLERGFGFDHAARIFAGPVLERIDRRKEYGELRIQAIGKIDGCLYFVCFTDRVVDGESVRWIISARRAHEKELPQWLGNRWTT

SEQ ID NO: 2848 - protein, 153 aa, Methylobacterium sp.
VSALDRTDLKILRLLQADGRMGNAEIAKRVNTSAATCHRRTQRLFAEGYVRGVRAQVAPETVGLGALVIVGVVLDRSTPESFAAFEAAAKAMPALLDCHLVAGDFDYFLKLRVRDMADFNRLHSATLIALPGVRQTRTFFVMKEVVDNAPLDL

SEQ ID NO: 2849 - protein, 45 aa, Methylobacterium sp.
MFLACSQEARQMLKRMILTGMAEFMAFGLLSVALVAWGVALAPVN

SEQ ID NO: 2850 - protein, 89 aa, Methylobacterium sp.
LRECARLVLLAALAAGPTTFPTHAADGTLGQARSRVEIGAEVWRLRPSQTGAPMPAGMPVAATRKGQVAEIPEARRSVRMVYPALVEAR

SEQ ID NO: 2851 - protein, 563 aa, Methylobacterium sp.
MTMSRLRTIGAKVGLCLALIFGLVAALGAMAVHELRAVNGEAAELRDTHLPATQILGKVQVLVLRQRVNGVRIITADTPELRADVQATIDKRDRELTELRTAYRALPATGEARGLFAAYEREWETYQGLQARIAAMAAAGDRDGAQKIYITTMSTGIGKVLGELQKLVDLNDGYAGASGDRARAVYERGLTLTLVLVGLVVAVIAAAILGLVLHVGRPARRITDAMNRLAGGETGLAIPGADRRDEIGAMAAALQVFRDNMIRTRQLEEETALARAGAEAQRKATMQEMADGFERAVGGIVATVTSAATELQATAQGMASTARETAGQSVSVAAAAEQAATNVTTVAAAAEELGASVSEIGRQVDGSAGLAGAAVGEAEQTSALVQELSSATARIGDVVALISQIAGQTNLLALNATIEAARAGEAGRGFAVVAAEVKELANQTARATEEITGQIGRIQASTGQAVGAIGAITGRIREISGAVTSIAAAVEEQGAATQEIVRNVTQASAGTSEVTSNIAGVAGAAEETGAAASQVLASASELSRQSEHLSAEVGRFLATVRAA

SEQ ID NO: 2852 - protein, 102 aa, Methylobacterium sp.
MRRLPWTLLPLLAALPVAAQAPGAAPPIGDAVPVCESLVALRQLAARAGEDRARAAAAVSGQPGCRLVPRGAIGAVERRAMVGGAPYECLAQATGGCLWVMP

SEQ ID NO: 2853 - protein, 495 aa, Methylobacterium sp.
MRIVTARLNHETNTFSPLATPLEAFRPLWGEEARAAAEGSATALGAFLAFAKARGATVAVPVSAHANPSGPVADAAFETLSGAILAAVSEGCDAILLDLHGAMVTESLDDGEGELLARIRAVAPDVPLGVALDLHANVTPGMVAAADVIVGFKTYPHVDMAETGAHVARLVGRMLDEGLVPHQAWCHPPQLAHTLRMDTRVPGPMADLVAAARAVEERPGILGATLFGGFSLADLPEAGASFLVAAESAEQARAAAAELGGALWDRRAEFVYEEEPLAASIERARTAAAAPGTGPVLLLDHGDNCMSGGTCDVMDVLAACLEAGLDGIVAGPICDPASVAALFAAGTGAAAEIRLGNTVALPGFPVQAPLALSGRVASLGDGSYVVTGPTYTGQRFSMGRAAVLDTGRARVLVTEQPHEPWDLAIFTQNGLDPRAARFLILKSRMYCRPVFEPIARAVVECASAGVTSSDYQRFPFAKLARPAYPLDPDAAWGPR

SEQ ID NO: 2854 - protein, 453 aa, Methylobacterium sp.
MTRCAVTITANKDMRDVTADTRGGADLSEIERRVLDRIDEAAWLDLACALIPAGQPEAENPLDPDEPPAREEGAALFVADLLRGMDIPTELVAKRPGRPNVVGVLPGADPAAPSLILNDHLDTYPAGDWSAWTMTGGHPFRPTRHGGRLYARGTSDTRGNLACTLLAVRAIREAGIRLGGTLTCAYTADEEKNGPDGSIFLLDERGLAADYTIVCEPTGWTNPDGSWGMGVAVANGGHALVEIETRGVKTHLWRPDTGVNAVATMARLLGALESMTFTHRPARLAGGTPPRTAILRVSGGLPREMQFTPDTCRAVIAVVGILPGMSLEGVMADIDAVIAAAAAADPGLRATARPYPGALFVDGTLEQDEAAQPTAALARAYGRLLGEAPRIYRKNAFNDTIRFAERGHAAITFGPGEDGWPPVNEFIDIAKAVAATRVLALTILDLLGAEAGP

SEQ ID NO: 2855 - protein, 244 aa, Methylobacterium sp.
MIEEVSARVPASLAAYRGGVAAGPGGPGARPLASLRDPAVFDATLAAFGAGVGAPQAGLERRALVSYWSQFYLAALATPALTALVRLGRPLPLAFERTSLELDAAGRPARLLVDPATGCGGSCRDGTREPPRPGLAGLVEDHLRPFVELCCAQCGLAPRVIWGNAAVILDYVAGELEPDDAPACAEVAACLGRRGGTACTRTPLAQALCAGAAGCRRRTCCLRSRLPGIPSCGALCPLERCGGS

SEQ ID NO: 2856 - protein, 395 aa, Methylobacterium sp.
MARSRLYKVTRGTLRLLSRPVRRAQGRGGIVLEPYRGYGSGDEIFLIGRVFRQSRPDPDADRDSLRDLWRDVRRRIARRAVKGGAVTARFGGSEQRVATDRDGYFRVHLKPRTMPDCDGPWYAVDLTLDADPPVEARGEIYVPPALARFAVISDIDDTVMHTGVANKLVMLWRLFVEDAESRVAFPGVATLYRALHDGAGGERNPMLYVSRAPWGLYDVLSEFFARHAIPAGPVLFLREWGLSWTHPLPRRAEDHKRILIGNMLALYRDLPFVLIGDSGQHDPEVYAEVVAAHPGRVRAIYIRNISADAARIAEIEAIAATVTAAGASFVLAADSVAMAEHAVGLGLIAPDAVATVRAEREAAPPEPATGPLPGMLRPSEAPPTVVIEPEGGRRL

SEQ ID NO: 2857 - protein, 155 aa, Methylobacterium sp.
MPERRIDAIDRKILAELQRDGRITVQDLAGRVGLSPSPALRRIRMLEEAGILRGYVALVDQAKVGLPISVFASVKLERQREEELDRFAEAVARWPEVVECYLMTGRHDYLVRVVVPDLAAYERFLKDKLTRLDGVGSIESSFALGQVKYTNVLPV

SEQ ID NO: 2858 - protein, 105 aa, Methylobacterium sp.
MSACMSLLGGAWTPEIIWNLSEGARRFSELRRAMPKISAKVLSARLKDLEERGVLVRSVLATTPPSVDYALTDLGEELIPAIRAIVEVGSKLHLRVMSAGAGRAA

SEQ ID NO: 2859 - protein, 109 aa, Methylobacterium sp.
MHYLYLLLAIVAEVVATSSLKMSDGFTRLVPSLVTVVGYAAAFYCLSLTLRAVPMGIAYAIWSGLGIVLIAAVAWIFQGQRLDAPAVAGMALIIAGVAVMNLFSKTGAH

SEQ ID NO: 2860 - protein, 151 aa, Methylobacterium sp.
MIDRTIDGCDAGGCEPAPAQAGFSLVELLVVLAIIGMIATMVTPQVLGYLGRAKGETARIQVKNIAQAVELYYLDLGTYPTSQQGLQALVQPTGPGWRGPYVRDARGLTDPWGQPYLYRSPGATGLPYEVYSLGGDGKIGGSGEGTDVASN

SEQ ID NO: 2861 - protein, 680 aa, Methylobacterium sp.
MTLPGWRDWAFSIKTFGAAMLALFLALWIDLPKPYWALGTVYITSQVLAGATRSKAVYRVGGTVLGAVVTVILVPNLVDAPELLVLAIALWVALCLYVSLLDRTPRSYLMMLGGYTAALIGFPSVGEPGAIFDTAVARAQEITLGILCASLISSVVLPQSVVPVIAGRLDLWLGDARAWVRDVLGRAGPAEDTQAKRLRLASDAIAFDALATPLRYDMTGAERSAEAMAILRQHMLMFLPIVSAVADRIETLERAGALPPRLRGLLDEMVAWIEAGITDPAEAARLRAAAGALAPALGARPTWNDLVMASLLGRLVDFIDLRQDTRLLQRHMADGTPVREHLAFRYTAAARTIRHRDHAMALLSAIGVFLSILLTCAIWIATGWPDGAGAPMMAAVACSFFAAQDDPAPSIIGFANSALIGALGAGIYLFGILPRATSFEMLALALAPGLLLCGVFMAQPKTAPLAMGAAVNGPTLIALQSSYSADFAAFTNSAIAVILGMWTAALFTRLVRSVGAGWSARRLRAVNRRSLARAARRHGAQNGLELAALMLDRVGLIAPRIAALPPDDAEWTADLLAEVRVGINVVELRRDRRRLSDPARVAVERLLADLARHFEGGADAPPAELLDGIDAALDAVCRDAGRAVGRAALMGLVGIRRGLFPDAVPYRMSASTAARPELAA

SEQ ID NO: 2862 - protein, 791 aa, Methylobacterium sp.
MTAQSLPDPRLPYLAELERKALWLSTWMIHNANHVRPNHDGMKVGGHQASSASLATIMTALYFGVLRPEDRVAVKPHAGPVFHALQYLAGRQTREKLENFRGFGGVQSYPSRTKDTDDVDFSTGSVGLGVAQTLFGSLVRDYVRAHGWGLDRPEGRMVALLGDAEMDEGNIFEALMEGWKHGLRKTWWIIDYNRQSLDAVIREGLYSRFEEIFRSFGWDVVVLKYGSLMDAAFAEPGGARLRAWIDTAPNQLYAALTFQGGAAWRRRLTQDLADDADALALLDRRSDDQLAELMGNLGGHDLVNLLKAFEGADNDRPTVFIAYTVKGYGLPLAGHKDNHSGLLTPAQTELFRERSGVPAGREWEPFAGTRLPEAELRRFIDRAPFFREGPRLRDAARLPVPQDFPCPRQPTLSTQAGFGMILNELARSDAPITERIVTTSPDVTVSTNLGGWVNRRGLFAREELRDLFRAERIPSTFTWDFSAKGQHIELGIAEMNLFLLLSGLGLSHRLFGERLIPIGTLYDPFIARGLDALNYACYQDARFIIAATPSGVTLAPEGGAHQSIGTPLIGLSQPGLASYEPAFVDELSVILAHALDYVQRDGEAGGSVYLRLSTRGLEQPHRALSAELADSVVAGAYWLREPGPNCEVVVAYTGAVAPEAIEAVGRMAEDRRDVGLLAVTSADRLHAGWSAAQGAREHGERGAESHIEALLGRLPRHCGIVTVIDGHPATLGWLGSVHGHRTRALGVAQFGQTGTVADLYRHFGIDARGIVAAAQGLSPERPIRQLSLVAG

SEQ ID NO: 2863 - protein, 445 aa, Methylobacterium sp.
VRTSDFRDVADAVAAEIASGALKPGDRLPPQRDFAYARRIAVSTASRVYAELARRGLVTGEVGRGTYVRSDLNGPGPIQSEPPPAAIDLQRTHSRLPEQEAMLSETLATLARGGGAEAALTHFGPVGTPVARRVAAAFLARDGYAPEPADLLFTGNGRQALAAALAALAPPGERIGCEPLTYPVVKGIAARLGIGLVPLAMDAEGVRPEAILQAHRATPLSGLYLQPTLQNPLGATMGPGRRAEIAAVLARTGLTAIEDTVYGFLSDARPIAALAPARTILVDSLSKRVMPGLTIGLVASPPDLVDRLAASVRQGGWSATGLPLAAGVQWMGDGSAARLVAAKRADAAARQVIARAGLAGLAVAGDPSAYHLWLELPETWRAEAFAAAALRRGIALIPAASFAVNPGHAPNAVRLALAVPPRDALATALADLRRLALAGDDHAVE

SEQ ID NO: 2864 - protein, 280 aa, Methylobacterium sp.
MPLIASTYGKARVRVMRLVRDGDHHTPRELDLTVMLRGGFDAAWTGADNRACIATDTVKNIVNVAAARNVGADAEAFAGALATLFLDTYPQVAEITVEARETRWLRRAIDGAPHGHTFTLDGNGTGYVRLTAGREARALRSGLRGYTFMKTTQSGWSNFFGDDYRTLPDTDDRIAATSMDATWTWAFAPVDYPAANAAVLDTLIRVFGTTYSASVQDSMYRMGEAVLAAIPEIAEIGFAMPNKHYIPIDLRPFGLDNPGTVFLPTDEPHGQIEATVGRGV

SEQ ID NO: 2865 - protein, 170 aa, Methylobacterium sp.
MADSKRIVDALVRARRGGLAAGAALGGLALVGSIAWHALRGASATGTPTPDFRDVGEDEARLMLRAMVAATLADGVIDAGERQRLDTAVAEAGIDRDGRAWLDRELESPAEIDEIADAVDAPEAAARIYAAARLAIDLDTVQERQFLKMLGEALDVSAEAAERIERELAG

SEQ ID NO: 2866 - protein, 45 aa, Methylobacterium sp.
MDTTSAPRYPALLWRRLVWFASLWAGSVLSLGVVAGILRTWLKAS

SEQ ID NO: 2867 - protein, 261 aa, Methylobacterium sp.
METRKMVGTKPMPFGELVRSGTTYGTFVGLGSTVAAEVCALAGFDWLLFDLEHGAGNERDLIGQIAVARRHGVGTAVRVETPTRIRCGRVLDLGVEAVMAPRLDSAEEAAAFVSHLRYPPQGDRGVATYHSAAAFGLDPGYLGRANDAVVAIVQIETQPALSDVERIARTPGVDVLFVGPRDLAAALGTTPSLDAPDFAAALRRVVSACRGAGIGAGVLAGDAASAARYVQMGFAFVGIGSDSAFIAQGGRQAIRAAKALT

SEQ ID NO: 2868 - protein, 254 aa, Methylobacterium sp.
MDVLTNRFKAALKEGRQQIGLWCSLASPISTEIVAGSGFDWLLLDMEHSANDLRDIYGQLQAIMEGEAHAMVRVPSDEPITIKRILDTGAQSLMIPNIDDAEQAHRAVAATRYAPRGVRGFSQAPRAARFGRIPDYHARCEAEIFVAVQIESRRALDNLEEIAGVEGVDGVFVGPGDLSTSLGYLGQQNHPEVVAIIEETVARITRTGKLAGILTANEDLARRYIAAGTRFTAVGSDMGLLARSTEALAARFKG

SEQ ID NO: 2869 - protein, 89 aa, Methylobacterium sp.
MAMFDLDATLDLLDTPALPADDDAVWAARDRDHGRAALAAALDDGLLSEEVDAILGGRRVVEAFPVRWGESPPAYATRAVAEMMAAYLR

SEQ ID NO: 2870 - protein, 107 aa, Methylobacterium sp.
MSEVLAAARPKRAPTHPGAILREDVLPALGLPITQVADHLRITRQQLHRVLSEQSGISPEMALRLGKFCGNGAALWIRMQEAFDLWQAKNKLGDEIDDIPTMPFAPA

SEQ ID NO: 2871 - protein, 136 aa, Methylobacterium sp.
MKRAALAATPLALALAMGAGLGPPATARAQTVEDGSGARIGPADTRAVLDLVGRTLNSPEARVTELRRAEGGAICGSVDVRNRQGLYSGPRGFVVDLARAEFGRVPDGPELLSPARGEDREAMERVRQLYFRLCLD

SEQ ID NO: 2872 - protein, 415 aa, Methylobacterium sp.
MTLTEPTENRPTDPEAAEAMRPVRAAPGRHPTLVLLALAVGGFAIGTTEFAAMSLLPAFAPELGIDAPTAGHVISAYALGVVVGAPLIAVLAARFARRTLLVGLMLLFAVGNALSALAPDYGWMLAFRFIAGLPHGAYFGVASLVAASLVPRERRTQAVSRVTLGLSVATIVGVPLANGIGQVVGWRWSFALVAALATLTAILVQLFAPLGQPVQGASALRELGALKRGHVWLTLMTGAIGFGGLFSVYTYLASTLLEVTHASPVVIPAVLAVFGLGLTAGTFVCAWAGDRALMPAIGLTLLWGAGALALYPLATGNVWTMVAAVFLIGSGGGLSSLLQARLMDVAEDAQTMAAALNHSAFNTANALGPWLAGLALAAGYGLPTTGVVGMGLALSGFAIWAVSYLLDRRAVAVRR

SEQ ID NO: 2873 - protein, 256 aa, Methylobacterium sp.
MKTAGNTILVTGGGSGIGEALAQRFHDLGNTVIVAGRRTATLEAVAAGRPRMHAMPLDIADAGDIAAFARRIIAEHPSLNVLINNAGIMRFEALDRARDLSDAEATVTTNLLGPIRLTDALVEHLAGQPDAALVNVSSGLAFVPLTATPTYCATKAAIHSYTIALREALRGRVEVIELVPPAVRTELTPGQATREGYMPLAAFIDEVMMLFRVQPTPREILVERVAFQRNAEAEHRFDAALTTLNEAARKAREAQP

SEQ ID NO: 2874 - protein, 215 aa, Methylobacterium sp.
MGDKLIRQNVIDELDFDPSIDAAHIGVAVENGIVTLTGHVGSFTERVAAEKAAQKVRGVRGVVEEIQVRFGGETPPRDEDIAQRAVQMLDWSVTVPKGAVQVKVQNGWVTLSGKVDWQYQREEAYRAIRRLVGIAGIMNTVEVAPKASAPDVRSKIMAALKRNAELEADAIKVTVKDAKVVLEGKVNAWYERELAENAAWSAPGVRAVEDHLKLG

SEQ ID NO: 2875 - protein, 556 aa, Methylobacterium sp.
MKIGTKLLGLVGGCSAVTLVVAALGIGSLHTLNAAIGDTRHAATRALNGANLNRLASEVTMDSRGVYASADRAEARKYADGIARGLAAMEALLKAWAPIVGPADRALFEAVSRDAAAFARMRTEIARAGTEDAPKAAAALGFNEANQGNRRAFQAGIAELVKRGRDEVEAIDAATDALYSQRMALLLALALGGTLGCLLIGGLIGRRQIARPLAAVSDAIRALAGGRHDLPTVRPTRDEIGAIWASMQVFADAMRTAESLRADQARAAAAARTARQAEMGALAERFEGSVGELVQHLAAAATEMEATARSLTTTAEATSRRSETAAHRSGETAGSVEAVAAATQQLAASANEIGAQVARTAEAAAGAVAGTRRSREQVEILARSAGGIGEVVGLIASIAGQTNLLALNATIEAARAGEAGRGFAVVAAEVKELAAQTARATDQITAQIATIQDATRETVSAMGEIDATIGGVHQIALGVAAAVEEQQAATREIARSVAGAAENTRAVTGSMAEMRGDAQAAGAGAAQVLSAAGELARRAGDLGVQVDGFVAEVRAA

SEQ ID NO: 2876 - protein, 307 aa, Methylobacterium sp.
VQTTSLRYFLTVARTGSIAAASSQLNVAASAISRQIANLEAELDCVLFERRPRGMVPSPAGERLAQHAQHVLLRAEQVVAEIQELQGVVRGLIRIACSEGFALDLVPKVMAGFHARYPGIRFELTMLPPGQVTQVVAAGEADIGVTFKLASTPPVAVVYETQVEMIAVSAPDHPLAGSPGIRLPELAAFPLALPTRDTTVRLVFEAACYAEGIAIEPALTANVLSALLPFVRYSKGLALMSALTVQTPLHLGELVQIPIRARSSLLRGIQVQTMRDRRLPRAVTVFLHALIAALPASGSRALPEGRL

SEQ ID NO: 2877 - protein, 505 aa, Methylobacterium sp.
MLRQTLAALLLTATALTAPALAGKANDTLVYASDSEPENVSPYHNSLREGVILARNVWDTLLYRDPATGDYKPMLATAWTWVDPVTLDLTIREGVRFHNGDPLTPEDVAFTFNYVLTPEARVVTKGNVDWMKSAEVTGKNSVRIHLKAPFPAALEYLAGPTPIFPAAYFKKVGLDGFSKAPVGSGPYRVVGVENGRGVKMERFEGYWTGGPIAKPKIGKLEFRVIPDGDSRMAELVTGGIDWIWRVPTDQAEQLKAAPGVTVLSAETMRVGFLQFDVLGRAQANSPLKDARVRQAISYAIDRKAMVDNLVRGGARVMNSVCFIDQIGCTDAGLPRYAYDPAKARALLKEAGYPDGFEIDLAAYRERDYAEAVIGYLRAVGIKARLNYLRFAAFREALRGGKVSIGFQTWGSFSVNDVSAFTGVYFRGGEEDLTKDPAVIALLQAGDTGTDPQARKAKYAEALKRIAAEAYALPMFSYPSNYAFSQDLNFTAQADEVPRFYAASWK

SEQ ID NO: 2878 - protein, 304 aa, Methylobacterium sp.
MLGFALRRILVAISVAITVSVASFLLLHLSGDLATAIAGPEATGEQIAAIRQQYGLDQPLLVQFADWAGRALQLDFGNSFYFRERVSDLIASRLPVTLTLGVVALCVALFVAIPLGVLAAVRRDTWIDRTALAVSVLGQAMPSFWFGLTLIMIFSVNLRWLPVSGNATWKHFVLPAVALGYYAMPAVMRLTRNGMLEVLASDYVRTARAKGLPPRKVLVRHALRNAVIPVIALAAVQFGFMLGGSIVIEAVFSLQGLGQLAWESIARNDFPVVQAIVLVLAMIYIALTLAADLLNALLDPRLRS

SEQ ID NO: 2879 - protein, 72 aa, Methylobacterium sp.
MPVFESKTLDAEFDGQALLAAILQPTRSARSQALVNGRRRAKRGIMPAGSATLTAREPAAVDIVAPATLSAR

SEQ ID NO: 2880 - protein, 198 aa, Methylobacterium sp.
MAQEAILIIDDHALFRSGIVSMLSTAFDSVLIRDCASLHEALAADDVVPTVVLLDIQLPGIGGLEGMGLLRQRWPAARIVVVSALDLPDTVGAALAQGACAFLSKTDRPDRMMTVLREMLDRPSASPSVGAVVCPSLTPRQAEVLILVGRGLSNKVIGRHLGLSEHTVRGHVQGLLSVLGVTRRAEAVFKAQQLGLIR

SEQ ID NO: 2881 - protein, 473 aa, Methylobacterium sp.
MSRTDAVALAERHYDDGTFRAVLQDAVGRPTESQASGQVPQLRAYLSDFVAPLIARLGFESRILDNPDGVHGPFLIGTRHEGDDLPTVLVYGHGDTVRNYPEQWRAGLHPLEIVVEGERWYGRGTADNKGQHVLNLGALEAVMRARGGRLGFNVKLLVEMGEESGSPGLREICRQEAEALRADLLIASDGPRVSAERPTLFLGSRGGFNFELVVDLRAGGHHSGNWGGLLRNPGTVLASAIASLVDGRGRIRIEALRPPPIPEGVRAALADITVGGDANAPEIDADWGEPGLSPAERVFAWNTLEVLAFKCGDPDGPLNAVPPSAKATLQLRFVVGTDWQGLIGAVRAHLDASGFPMVAVQPCRSEVFRATRLPVEDPWVGWALASIAESTGKRPALLPNLGGSLPNDAFSEILGLPTLWVPHSYPACSQHAPDEHLLGPQTREALGLMAGLFWDLGETGPEVLARRRAEQGA

SEQ ID NO: 2882 - protein, 318 aa, Methylobacterium sp.
MTIQPASPPAAPGLAPEMLIPAPAETAAPLAPARSPTALALRRGLHHGGFLIGAGILGLIVLAALAAPLIAPHDPYAQDVSRRLIPPVWHAKGSWEHVLGTDKLGRDYLSRLIYGSQISLLIGLSAALISGIIGTTLGILAGYFGGRVDALVSYVVTTRLAMPVVLVALAMASLVGGSLKVVVLVLGLLLWDRFAVVTRAATRQVRGQDFVAAAQASGFGTARILFQEILPNIMNALIVVATLEMAHAILLEAALSFLGLGVQPPLPSWGLMIAEGKQYMFFQPWVITIPGVALLVLVLAINLLGDGVRDITAPEGRH

SEQ ID NO: 2883 - protein, 376 aa, Methylobacterium sp.
MIRDLADMTGASSRRSGLATTLLAAALAAAVCATARAGDAVPRAEPWKVSGKLYGEPDKDRPGDFAASDKADDVSGIACATASGFPRVCLVADDEAQGAQIVILRDGSLRAGSFIRLIDAAHDGVPLELDAEGVAYADGAFYVIGSHGRPRRAAGKPEAGTVARAEATRHLFRIRFDPSAVDPETGVLAGKPEIAEMGALARLIREDPVLKLFHDRPLEEGGVTVEGVAVRDGRLHVGFRGPVLQGGDAVMLSVSLDGLFGGEPSAATVTRLALGRDSHGTARGVRDLAAVPEGFLILAGPMLDPKGDGVEPGDYAIFRWTGTDAPVQALALDGYGRKVKPEALLPLDRTGDRLRALVLFDGPKEGAPRTVEIPLR

SEQ ID NO: 2884 - protein, 311 aa, Methylobacterium sp.
MTLTILAALVPIALLIGLGAALRRRGFLAPAFWPQAERLAYYVLLPSLLVHGLATARLDGVPVLELAAVLVLSTACVAMVLVAARPLFRLDGAAFTSVFQGGIRFNNYVGVSAAAGLYGVQGVALAAVANAAIVPTVNVLCMLVFARYGTAERAAPGVILRQIALNPLVLGSLGGIVLQTAHMPLPPGIEPALKALGQASLPLGLLCVGAALDFGTARAWIRPVAAASLFKFGLMPVATVLACLALGLNGPAAMTALLFQALPTASSAYIMARQLGGDAPLMAGITATQTVLAAAVLPLVMIGLGALAGLG

SEQ ID NO: 2885 - protein, 145 aa, Methylobacterium sp.
LVFVDTNVFLYARDDRYPGKQQAAGHWLATLARRDALVVSPQVIGEIHNAILRGKIDMDAEAMRLMAVELQAFSHGATDLDLITQAWTIRKETAFQWWDSVILASAIQAGCRYLLSEDYQHGRTVRGTTILNPFTVGPEAVMTEH

SEQ ID NO: 2886 - protein, 158 aa, Methylobacterium sp.
MDLSTWLNLVAVPLVAKICLVGMFPPSALDKVVHWDEAMEQARSGPLPFPALLLALGIVVETVTPVLIVIGWYDRLAAFVLMGFCAVTAVLFHRFWEHPGFWSRNGEGRAHFWDFLKNFGLVGGLLLVVIGGSYAPASEVARHPLSSGPYAAETPATP

SEQ ID NO: 2887 - protein, 217 aa, Methylobacterium sp.
MSPQMIDRLSQAFFDTLFMVGVSAGIAVLAGLPLALFLVTSGPGGIFPAPRANRVVGTLVNGFRAVPFIVLLVALIPFTRLVAGTTIGVWAAIVPLSVSATPFFARIAEVSLREVDAGLIEAAQSIGCRRRHILLHVLLPEALPGILGGLTITVVTMIGASAMAGAVGAGGLGDVAIRYGYQRFDTTVMLTVIAILIALVCLVQFAGDTAVRRLRAR

SEQ ID NO: 2888 - protein, 383 aa, Methylobacterium sp.
MAGLAFDNLRDAGAWIARGASRRAAQDARAGQDVRQAGGRGAGTVRFEGVTKTFQAASGAVRALDGIDLAIPAGAIFGIIGRSGAGKSSLLRTVNRLEEPSAGRVLIDGEPIGTLDTAGLVALRRRIGMIFQHFNLLAAKTVRQNVALPLSVAGVSRAEIGRRVDEALRLVGLETKAEAYPSRLSGGQKQRVGIARALVSRPEILLCDEATSALDPETTLQILTLLRDINRRLGITIVLITHEMSVIREICTDVVVLEQGRAVESGPVWRVFGAPEHPATRALLEPLTRGLPDDLAARLRPNPAPGAEALLRITCSSAAPDLSALTEAAGAPVRLLQAGIERIQGRAVGRMLIAVAGTEAAERLAALNDGIAIERIGYVAADD

SEQ ID NO: 2889 - protein, 292 aa, Methylobacterium sp.
MAADPAPGPGPDAFTGPAPRRFIDLPGFPRIAWAEAGSGPPLVLVHGALVTLDDMWLGPMAALARHFRVVAIDRPGHGASGHGRLADASLWRQADLVLALADALGLERPVVAGHSFGAAVAIACGLAAPERIRGVVAISPIAFPEPRLEQVLFGPRAVPFVGPPLSRGLAPTDALLLPLLWRAMFLPRTMPEAFARDFPFDLAGRPDRLVADGENANLLWTDLARSAALYPACRAPVHILAGSGDIVTNQTLHGRGAALLIPGARLHWLRGEGHMLHHARQDVVAEAALALA

SEQ ID NO: 2890 - protein, 31 aa, Methylobacterium sp.
IVPVAMEEKLRFAIREGGRTVGAGVVAAITE

SEQ ID NO: 2891 - protein, 31 aa, Methylobacterium sp.; identical to SEQ ID NO: 2890

SEQ ID NO: 2892 - protein, 521 aa, Methylobacterium sp.
MQDHYDIIVIGSGPGGGSLTARLAGTGKRILLLERGDYLPRSQDNWNARTVFVEGKYQAAETWFGGDGRAFHPGLHYYVGGNSKVYGAALLRLRERDFEAVRHVDGVSPAWPVSYAEFEPYYAQAETLFAVHGNRGEDPTEPWASGPYDHPAVSHEPRIQKLSDDWARHGLQPYHLPLGIKLDERNGRPTPTSICIRCDAFDGFPCLLNGKADAQVMTVDPTLAAHDNVTLLVNAYVSRLETDPSGKSVTGVRVTREGREERYSADIVVVACGALSSALLFLRSASDVHPNGLANGSDQVGRNYMRHNMSVLMALSKEANDTVFQKTLALSDFYFESKAWEYPMGLIQMCAKTHPDQIRGEEFPKWTGFLPDAPFNMVARHSMDFWLQSEDLPHPDNRVGIDPDGRTILDIRENNREAHDRLRAKLSDLLEPAGAYTYLFERSLYLGKNIPLSGTAHQAGTLRFGTDPRSSVLDLDCKAHELDNLYVTDASFFPSIGAVNPTLTIVANALRVADRIAERIG

SEQ ID NO: 2893 - protein, 295 aa, Methylobacterium sp.
MFDFSQLRCFVAVAEELHFGRAAARLNMTQPPLSRQIQVLERVLDAQLLDRTSRSVRLTAAGRSFLPEAQRILRLAETAAHVTRQVATGRAGVLKLGFTAASAYDFLPRLVTACRASLPDVTLSLREMVTKDQLEGLLAGQLDAALVRPMVTHPDLETARALAEPLVAAVPAEHALADRSALRPEDFRGAAFITYAPHEARYFHDLVAGLFAEAGVQPRVLQQLTQIHSILALVRAGIGLALVPAAAERLRFEGVAFRPLVLPRAHPAELMLTWRRDHDNPLVDALRGIVDDLVH

SEQ ID NO: 2894 - protein, 228 aa, Methylobacterium sp.
VQTPPQTTILSSATASRVAGALADLGAVRLAAGQPFIYTSGWASPVYVDTRLLMSDVEARTRVMDSAARHLRERVTGLDAIVGAESTGIAFGAWIAERLGLPFLYLRKKPMGWGSAARLEGHLPPGARVLFVDDVTTDGRSKIAAAAALRESGTRVADVLVVLDYGIYPGSAARLADEGLTLHALTDWPALLAALRGRAAAPPEALANLDAFTADPVAWSVANGGVGA

SEQ ID NO: 2895 - protein, 116 aa, Methylobacterium sp.
MTMIPADPTFSAGDLILVEFGPVRGTEQDGRRPALVVSEAIMNTATRRVIVCPITSNTEPWPTKVMLPAGLRVGGAVLTDQVRSIDQRARILRRLGTAPDTVLAEVRHQIAKLTGL

SEQ ID NO: 2896 - protein, 69 aa, Methylobacterium sp.
MTGEFDLYGVYVPSLAAWMLIAFAIGLPIRRALAGLGLYRLVWHRPLFDLALYVLLLGAVVAVAVPLTS

SEQ ID NO: 2897 - protein, 310 aa, Methylobacterium sp.
MPRLLALTFRLLVTLAMVVAAVVVGLALWDYYMEAPWTRDGRVRADVVPVAPDVSGLVAEVLVEDNQVVRRGDVLFRIDPDRFALALRQAEAVVEGKRASAEQAAADYVRYTKLSDAAVSQQKVEAARAANLEARAAYDQASADRDLAKLNLTRSTVQASVNGRITNMELRPGAYVTTGRGVMALIDSDTLRVEGYFEETKLPRIHVGDRASVRLMGETVTLAGRVESFAGGIEDRERTAGSNLLANVNPTFAWVRLAQRVPVRIALDPAPEGVRLVSGRTATVAVEPGGSAPGFDPLRLLRGASATAPR

SEQ ID NO: 2898 - protein, 84 aa, Methylobacterium sp.
MPRYFFNVRHRPGPNGLAEDHEGDELADVAAAREHALSVARDMIARARHVMIRDWMVCSFEILDEDGQHVLTVPFSDTVSEDED

SEQ ID NO: 2899 - protein, 166 aa, Methylobacterium sp.
VAARDLRQIRRAYTQTLLLAGRRWRRLADMAAEAHGISEAKALPLVLIARMGGAPRQNALAEALGIEGPSLVRLLDQLCMADLVRRREDATDRRAKVLSLTPAGEAVVARIEADLDRLREAVFAGVSAADLEAGLRVFAAVQATVRGQEDGRQDATADRISDGAAG

SEQ ID NO: 2900 - protein, 326 aa, Methylobacterium sp.
MTLFRALIGCAAATACLMGAARAEETDPGAIVAAQFAAGGNHTGVRASGAKGVCLKGAFAPAPGAAALSKAPHFGKTVPVTARFSMGGSNPKVSDKAKPVTRGFAMRMEDPAGDMVFVVISAPVFSTKTPAQLLEFLQVRAPGPDGKPDAEKIKAFSARNPETTRQAAWLNARPVPASYAGVDYWAVHAYTLTNAKGEAKVAKLKFVSADKTGLSDDELKAKPDSFYADELKERLAKRPARFDLVAILSEPGDPTADPTASWPEENRKAETLGTLSITAIAPDAACDARTFDPVAELPEGVAGPTDDPMFAIRSPAYAVSVSRRAN

SEQ ID NO: 2901 - protein, 266 aa, Methylobacterium sp.
MRVPRLIAVAALVLGAFAARAESLTVGVVPGAYADAVNVAAQEAKAKGLDVKVVEFSDWTTPNVALDAGDIDVNFFQHRPFMENAERQKGYDFEIVGAGILQNLGLYSLKHRSLDQIPVGGRVAIANDPVNQGRGLLLLQKAGLIKMKDGVGFLGTLDDIAENPRKLKFTEVEGPQLVRITGDVDLAQGYPHFIVAAKAFDPKSGLIYSGIEDKLFAVSFVTKAKRKDDPTIAKFVALFQKSEAVKAQIHKSFADSDKLYLLAWLN

SEQ ID NO: 2902 - protein, 635 aa, Methylobacterium sp.
LPRTHLRRRRQTVFFRRIIPHDLRQRFGQREILRSLGQATPGEARRMAQRLWDGTETLFTLVRFNRSLTRADIVRLAEQYLESESFKHDGLIATIGHYPELEDLPPSESAASEDDIGDSSAPAKGDPKGTLNDPAQWVSLYKIRLKGLKRDRSLNNFISVRDTAKDLAASNEIDLDSYPHANALCRALLDADITITQEKLTYLRDVVLPHHPLHKATRRRSTPAPISEPKTPAPTMLRGARQLFSESWETYGRDRVASGDWKASIERQARSTARLFVEICGDKPLGDYGPADAAEFKRALLALPANYDKSTEWRTIQRRSGIRGLIEHCKGKPGIDRLKPQTFNRHLAALSGIWPWAQANEVVARGLPSIFDGLHVNLRRIRGRHHQARDERPMWDHAELAAVLSAPLFTGIRSRRSWKTVGPYVPRDERYWGILIGCHSGMRRGEIFQLRVRHVVQDAETGIWHFNLREKTLELKAEGSARWVPLHQNLLRLGLIEALVQGRRENDLLLPEGEAGVEEADDLDDGDDAAYGSAFGKWFQRFKSEYGVRKDVVFHSFRHSVTTLLCNAGVQQEFVEELIGHESQARRSEMKRYNKGQTLMMLKDVIDRLVLPIDIERMVDAARGGEPRPAFRPRR

SEQ ID NO: 2903 - protein, 252 aa, Methylobacterium sp.
VASIANVVLRGRSFHFRRRVPDGLRPGPRLDELVRSLATSETRTARLRAWQLYLASKRLFTAFRATPMLTDDRIAHLVRDCCDLILMDENAGRLIRGPLPAGVRGARVTRAATMPGRGRDALARNRLDEAAFTAEMMLKRQGIVFGDLAPAEAARAKQLFLTAYTQAFSRIASTALPMRTSHASACSARCCAACTRSSAARTRCSAAERSASVLASLARAWSRSWLISARSSFTCRSCAEAWAASRRSRSWA

SEQ ID NO: 2904 - protein, 146 aa, Methylobacterium sp.
MARAYSHDLRIRVLDAVGAGLSRRAAALRYRVGIATVIRWAAHATTTGETRAQRQGRPLGSKLDAHEAFLLALTEEKDDITLTEMQERLRAERSVSAGLGTLWRFFARRAVTWKKSQRTRPSRLARTWPQPARRGLRASPTSIPSA

SEQ ID NO: 2905 - protein, 237 aa, Methylobacterium sp.
MSAGAALRLDDVHGFYGKSHILQGVSLEVRPGEIVCLLGRNGAGKTSTLRSASGLLPPRRGRVTFGGAEITGWAPHRIARAGLSLVPENRGIFGLLTVEENLRIAVRKGSPWSLPDVYRIFPRLKERRRNGGAQLSGGEQQMLSIGRALLNGPKLLMLDEPVEGLAPVIVEEIVAQIRLIRDAGVPILLVEQNLAVCTSLADRHYILELGRIAYHANGPDFVRDEAARDRFLGVKAH

SEQ ID NO: 2906 - protein, 155 aa, Methylobacterium sp.
MNAIPFDTLKFVRALRDKAKLPPEQAEGFAEAIAEAVQSDLATKADLQATRADLKSELQAVRTELKTEIQTVRTELKTEIQIVRTELKTEIQIVRTEIRETELRLEAKIESVKADTKAQIEASKAEILKWMFGTVGFQTILILGAVAALARFARP

SEQ ID NO: 2907 - protein, 374 aa, Methylobacterium sp.
MESDDAVSQLVDSFYEAALRPELWRPTLETAARVFGAEGALMLPGPDAPLELACNPFLDAAIADGLDQGWLAHNPRVLRGIPAMRDPARVLTEQHIFSPRELDHLPFHAEYVNAHGLRHFAGCYLVPAGGRSLILSLERAPRSGAFTPAEIEAVERVVPHLQRAGRLALRIAEARAGSALEAFDLLRCAGLLLDGAGAVLRMNGRAAALMGAGLNVLQGALIAQHGPSNAALGRLIGGVVGPRRGSLGPVCRPVAVPRPAGREGAPPPLVVHAAPLPGAAGDLFQQARAVLLIVDPAEAHPPAEGLLRELYGLTAAEGRLARMLADGRDLGEAADGLGVAVSTARTQLKAVFAKTGTRRQAQLAVLLAGLGRGP

SEQ ID NO: 2908 - protein, 149 aa, Methylobacterium sp.
MSEPTPPTMPYWHVYTDDAGVSRQERFELTAFQFQGVGPGVAPQWNDKMDPAKAGVTFTVLPVGWVGDWHENPKPQWIAVLTGRWFVETMDGKRVEMGPGELMFGEDQNTRARDGRKGHLSGTVGDEPCTMIVTGLDVEPTVNRPGRFR

SEQ ID NO: 2909 - protein, 231 aa, Methylobacterium sp.
MSATAVQGYWQDYWLGWQEDLLTYGPGFLSATLLVLGVTVASILLSWVCGLLGALGKRSHLPPFRALANFYVWFIRGTPTLVQVFIVYFGMPQIGVKLSPVAAGIIALGVSSGAYVAETIRAGLAAIPRGQTESALALGMAPRIMMMRIVLPQVFRMILPSLTNEAISTVKNTSLLSTITVVELTLYAQLMIATTFRPFDFYIAAALIYLCLTSVLSQLSAFFERRYARLS

SEQ ID NO: 2910 - protein, 218 aa, Methylobacterium sp.
MSFDFLSILAQWPLLLRGAAWTIGLTALATLFGATLAVAGAWARSQGPRPLGWLVGAYVELIRNTPFIVQLFFIFFGLPELGIRLSPGVASVCAMTINLGAYATEILRAGIEATPRGQIEAAQSLALSRAQIFLHVVLPPALKTVWPALVSQIVIVMLGSAVCSQISTEELSYATNLIQSRNFRAFEAYIVGTLGYLGLAILLRHLLNWAGPRFLFGR

SEQ ID NO: 2911 - protein, 130 aa, Methylobacterium sp.
MPFDLSSLIYVVDDDLAVLHSTRFLLESEGHQVETFCGGPELLAAFPGPSPTFVLLDQVMPVMDGLEVYVRLREIDANVPVVLITGHPDPGIRTRARAAGVPMVEKPLAFDALRGLLAGEMAVPGSTLQA

SEQ ID NO: 2912 - protein, 286 aa, Methylobacterium sp.
MFLRCLLVPTAPGLDATRRLDAALRLGRRLQAHIGVAFIAPGPEHVMASMASLVPMDCATVEAIERGVREAAAEGKAALQAWCEREGVAFMPTGGRLDATFATWTELSGEVEPLLTLAGRVNDLVIVDRRNPDEPFTGRALDTALFSIGRPTLMVGESVPYDLLDHVMVAWNGSLEATRLIGQSITLLHEAARVTVVHARTERFEEARAADLCAYLRWHGIVAESATLQVEGGTSVGAAILAEVERRSASMLALGAYTHSRVRELLLGGVTRHVFEHARIPVLMAH

SEQ ID NO: 2913 - protein, 558 aa, Methylobacterium sp.
MDSPPLFDSLLDPQAGGFFQVEAEGAKVIERRYRQDSNVLDTVLASGAGRARLTESLNSSTAGRLPWCEFARRIEVLSGTMTFRVRAVFGTRGDTASPWLQPNPNGCVFHVGPVLGLFRCSDNVRVTEEDDRTIAATVTLAEGERATVALLAGEDEPLGVPTMEEIDHRIDVSDEAWRRWAEGLRYDGPHRDEVRRSALALKLLLYSPSGAIAAAATTSLPEGIGGEKNYDYRYAWIRDAGYSVNAFLRVGAMPEAKAAFSWLMKRLDRHGPRVLYTLCGEVGPDERALELPGYRASRPVLVGNAAALQHQHGIYGDIFETAALFVADGNILDQRSATVLSALADQAADRWRQKDAGIWELREPQHYTMSKISAWQGLARAVELAEAGHLPPTCVPRWTRERDRIAAWIEEHCWSEARKAFVLHPGTERLDASLALAVRFGFDGRDRLSSTLDAIREELGRGPFLYRYSGAEREEGAFLACSFWLAEALAELGRQEEAEQVFTDTIRALPAGVGILSEMVDLRTGDFLGNTPQGLSHLALIHAACTLRGDRTRPVRAA

SEQ ID NO: 2914 - protein, 95 aa, Methylobacterium sp.
MSNVVRFPHGRRIPAATIPREEFERLADLALDVVDRIVAILDQADGDPDAEDGGDAEPSLGAPEDHASQIGWLRGTGRDLELDLSPCPAPAADRS

SEQ ID NO: 2915 - protein, 80 aa, Methylobacterium sp.
MARFFIDLHDGANFVRDGIGFDLADEAELRAKLVRIMAKIAQGLAPGPDRQDYLAVVRNDRREVILRAHLSLDIERVDTP

SEQ ID NO: 2916 - protein, 78 aa, Methylobacterium sp.
MPRYFIDLHDGAQPVRDEVGFDLPDLDAARGKVTRIMSAIVRDMLPDVERQDYVACVRDVAGAVVYRARLSLAVEAAE

SEQ ID NO: 2917 - protein, 660 aa, Methylobacterium sp.
VAWVEARNAETLARYADAAFARDRDIAQGLLDRPDRIPHAQRYGRHLYNFWKDADHPRGLWRRIDEAGYRAGSSDWTCVLDLDALAAAEDEDWIWAGATILPGTHDRALLRLSRGGSDAVVLREFDLVNLAFVPNGFVLPEAKSSAAWLDRDTLLLSSALGAGMATRSGYARTVRLWPRGADPQHLAVLFETAPEHMAVWGSVDRSDGTERVVVAEHTGFFDAEVHIGDRQGAFRRLDLPADAGVQLHRGRLSVRLRRPWAPDGTVHVADTVLTIPLAEFLAGSRDFTMLWVPDARSALQHVFWSAGRLFIHALDDLRPTYTFCESRADGWSTRPLGGLPVLGSASVWPLDGDPEAADGALLAQVEDPLQPPTLLAFAPELGAPTVLRATPAAFDARGLRITRHDAVSSDGTRIPYIQVGPSTTTGDAPVHLTAYGGFRVSLLPTYQAVLGKLWLERGGTSVVVNIRGGGEFGTRWHEAGRREGKILAHDDFAAVAADLVARGVTRPGRIAAQGGSNGGLLIANMLTRYPERFGALFCTIPLIDMRRYAKLLAGASWIAEYGDPDKPEDWSFLATLSAYHAAETGRPYSPILLATSRRDDRVHPGHARKMAEKLRVLGYNAAFYEPATGGHGAGKNSAEMATFLALGLAFLRRSIGWDET

SEQ ID NO: 2918 - protein, 256 aa, Methylobacterium sp.
MSGLDFDRLRDAHIAALTGGLLDGVETGPDGAGYVWSRAIPDPTLNFAFGVRTAAQFTWAGAVALGRGRPPAFLARDAAEEAGLRILFEPAAIFPACWMVARACAGPRLPESLRLVEHEGPRPPAAFEAVFLRLSEDERVRAHLRRHYLPVLRAARCRSGTAALHLVLEDADGPVACASLYLRAGLAGLYNVSTRADRQGRGLGGRMSAAALGVAHRHGAREVFLQCPAGGSIERLYARAGFEARCLPALICTSLP

SEQ ID NO: 2919 - protein, 417 aa, Methylobacterium sp.
MTRRLALAALALLPLTAAPLAAAEPDPTVLAAVKAQDRPLRATLAEIVNVDTGTGQVPGLNTVEAILRKRLEAVGATVEARPAPAFGGNTLIGRIKGSGTAKLMLLVHYDTVYGEGEAAKRPYTERDGRAYGPGVADAKAGIAIILHTLAALQQMKFTGFGEITVVFNPDEERGSRGSRDVIREVAAGQDAVLSFEPTFADEAVDAATIATKGINYASLTVKGRSAHAGGAPESGRNAVTELAHQLLQLQDLGDKQRGTSLNWTVVSGGTKPNIIPDQAKAEGDMRYFEASEYDRVLAQARKITETHRVPDTQVTFDLAKGRPPLPVNPATRKLGEEAQGIYREVGGDLKLVEIGGGTDAAYAFQPDSPAKPVVLESLGVVGGRYHSPDEFAVLDSLTPRLYLATRLVMQLSGKAAR

SEQ ID NO: 2920 - protein, 278 aa, Methylobacterium sp.
MSDEIASPEGAALHAPVARLLRPLVRLFVARGITFPALTNLLRELYVNVAEYDFALPGKEQTDSRVSLLTGIHRKEVRRLRGAGAPVSTVPAVVSRTSRIIARWLADPKFTDGRGRPLPLPRSGPGEAPSFEALVAGITRDLRPRAVLDEWLDRGLASLDEADRVVLAEAAYVPRGGGEPQLYYFGRNLHDHIAASVANIVGEAPRFLERAVHYDGLSEDLARRLEARAREIAMEALQQANREAHAACQTDPGGDHRWNFGLYVYAEAAPPPAAPGPR

SEQ ID NO: 2921 - protein, 505 aa, Methylobacterium sp.
MSIHANELAPPGAAVPDVPGGTHDAVIMKPSYDPNLVNEDLAPLRKQTWGTYNIFAFWMSDVHSVGGYVTAGSLFSLGLVSWQVLIALLVGIVIVQIFCNLVAKPSQVSGTPYPVICRASFGVKGANIPAIIRGLIAVAWYGIQTYLASAAFMVVALRFYPELAPYADLTRYGFAGLSALGWASFMFLWVVQALVFWRGMEAIRVFIDWAGPAVYVVMIALAGYLVWRAGIGNVGLTLGEVKHTGWAALPVMLNAVALVVSYFSGPMLNFGDFSRYGSSFAAVKRGNFWGLPVNFLGFSLLTVITASATVPVFGHLITDPVETVSRIDSTFAVVLGAFTFMVATIGINIVANFVSPAFDFSNVAPKRISWRMGGMIAAVGSIFITPWNLYNNPAVIHYTLDILGAFIGPLFGILIADFYLVRKEKIVLDDLYTMSPAGTYWYENGYNRAAVTALIPSALVPALCVLIPSLGVVANFTWFIGCALGFVIYIGLMRRQPAMSAQPAE

SEQ ID NO: 2922 - protein, 419 aa, Methylobacterium sp.
MVGQRITKRLVDSLEPRAAEFTAWDSALTGFGVRVRPTGAKTYIVAYRAGRGRSAPYRRQTIGPATKLSPDQARQEAERILAGATLGSDPAAEIAAAKETLAEERKAPRVRDVLDRFVAEHVDVRLKARTAYGYRQIIETVLKPEIGDVRVRELTPATVADLHHRRRKTRTYADQIVRVLSSAMSLAEQWGLREPGSNPCRIRKNGSRRRERLFSDMEVARLLNAVDKLESDAGVTPFQALGIRLLFATGCRIGEICALEWSFVDFEAGLITWPDTKTGNLTKPLTSEARALLDAAPRIEGAVSVCPSRNLRPMRVETLEGAFEKAMAHAEVVANENATTHLVRHWFCTKIYSDPTIPLPDQMRICGHKSVATAMRYAQLQLEEVKRAAEESSQKRAAALAEARKKLAASNVVRLRAGD

SEQ ID NO: 2923 - protein, 572 aa, Methylobacterium sp.
MSTAETPSPAARRGGLRGSGPMRREDLLDNLGFADVADADASGIMAPGALRGAARGRDLDSLTRTLFLRIYPVIAAVVLLTQAGIAWVNYTDQFRLYTDRANLLASLTVAAIARPGWEQAPEIFGPQLQALTRDPAFRYAALRDGAGTLVGSAGEQPHGRDWNRVQVSAQVGTQAGTAPDAAAAQAGSLTVVLSAEELRDNAERQALLALGTSLVLMLAFVATLTRTVRRHVVAPLKRLLVAMRKVEHKHWTTVDLGGAYRPSNEIDAISQAFNSMVEGLRSGDEAKRLLQALEQAHAALERANTQVIESIGYARRIQASVLPERGALGARVELAVLYEPLHLVGGDYYWLEEVDGLSVIVVADCTGHGVPGAFLTLIVATALDRLLHERGLRSPAAILAGLDAMVRAQLRQDGRGAESDDGLDCGICVWDPAERSLLFAGAGLSLTAIRDGTVAQIRGGRRGLGYPRTGREALPEADTRVPVEPGTTFYLMTDGVTDQMGGQISDRASGASGGRPKLLGPRGVAERLLARAADGLDAQLAGLEQDLAAYRGGQPRRDDMTLVAFRLPELPA

SEQ ID NO: 2924 - protein, 286 aa, Methylobacterium sp.
MPGIRAAALKRAQEAVLGPAGDPARDDGFSLFDAEEAIIGRADVMLTRLSEMADGVQELAGAYRRGTREQRRLVRMSDRMQLELQRANQRMAEQQRELQALNAALSSEIEHRTRLEAELRRLVDTDHLTGALSRRRFLEVAELIWPRDTGRACLLMLDLDRFKHINDTHGHAAGDTALVSFAATCRAVLRPGDALGRTGGEEFAILLPETGATEGLALAEDLRRAVADTAVPAERGTLAISVSIGLAASGRAEPLAEALKRADAALYAAKNGGRDRVRAAAAPGPV

SEQ ID NO: 2925 - protein, 129 aa, Methylobacterium sp.
MTRIQLAATERSPEVDFDLAAGRLSLRGESYPEDAASFYGPLLQALRGLLAEPGQAPLTVEVGLAYFNSSSAKALMNLFMPLEDAAAAGRPVTIRWLYADGDDTIAEAGEDFAADFEHAAFELVMEAQV

SEQ ID NO: 2926 - protein, 184 aa, Methylobacterium sp.
VLAQDFLSFHEASRRNGVILSFGGDISENVLFSLGEVLKLRMRQEDTDAGVAKRVFSIFVEQAQNVIRYSADRIQPEAEPRPGRVSGGMIVVGTEGERFFVVCGNEVGNAEVPRLRERLDHIAGLTGEELKRFYREKLRQAPDEGSLGGSIGLIEIARRSSAPVEYDFQAIGTDRSLFCLKAYI

SEQ ID NO: 2927 - protein, 1054 aa, Methylobacterium sp.
MAAIQIQAPDGSLVEFPEGTADDTIVRVMRDSFPSQSAAPAQAEPPSALSRAASGVGDVVQSAGAGIIRGAAGLLDLPQTLYGLAETGADYAAQGAIRALGGTPSADRTPVVRGLVPPPSDLPKVGEGAVRGLEAATGKLYEPQTTAGEYARTLGEFTVGAGRTPARLLAFGAAPALASETAGQASKGSAAEPYLRAVAGIGTTLGAGAVAGPKLYERMAARAAHGATPEQFEQAEELARNAPFPLMASEAIQAATGGATQMGRMQRLAESTEGGARVLDPIMAARPERMQTATNAALNSLGPRNPLPTELGQQVQAAARGAVMESPEGRALSAALDASGPRTTPGMAGAVIQPDLRGTRDLREAARSSRANVDYRLAREAPERIGVERQITVERPGEPVTTVTYPEGRPQFAPDAARPLEPYQRGVAESAEAGTESLARFVARNGGLRLDGDVTATDLQRFNIPGLGNVARENGRGIDDFWREHLIEHGYFRPDADGGAARDISSELLRKLQNEQRGLPSYPIGYERGAATRSVTRQADEYAETLATHEARLAEDLANAGVPPESLHPDIRARVLGSLMRGETSDPIAAYEHVVGSMREPPAPYVKTTPTTIEEQIPDVRFGQVNPQNAVDAIDSLQQTAKGDVSGALAGVRRNLHGPDGQTDLSVAGNLRTRERLDFDIAAAQEVGDATKVRDLTIARNAIDAELKRVPEVAAADANFTRNSIPLQPFSGQHPLARATARDDLTGRMQMPAEQVPGHLTQPSAAREFGQIAGPGARRAFDDYLTTQMLDAAPDAYRVNADRLRTGMRDSADLMAEAPTVRDRLSRVLAAREGLAPVEATPVGRMAEKDTLRGQLAQILAEGASPTETRQTMRALSKQDKPAARGLVREGASRMADRTVHAPDSAGRPDQFGGAKLARDYQTPGEGTNLQAAITATLGDDQRINRLMQALGATGWRERVGSRTAFNAEDLKDMKQGGYIGGLMKLGSGPMHTARDTVERFLLGRSSEGLAELLASGPVGVRRIQELQRENSRAALIAALAASRAEQEPALPRR

SEQ ID NO: 2928 - protein, 209 aa, Methylobacterium sp.
MYQPPHFREDDPGALAALVRAHPLGLLVSAGPGGLQANPIPFLLDADGAHGTLRAHLARPNPQWRELAAVEECLCVFQGPQAYVTPSWYATKRETGRVVPTWNYATVQVWGRPRVIEDADWLRRQIEDLTAAREAARPEPWAVSDAPEAFTAAQIRGIVGVEIAITRIAGKWKMSQNRSEADRAGVVAGLTGEGGPGDPVAALVARAGR

SEQ ID NO: 2929 - protein, 213 aa, Methylobacterium sp.
MVDFTLWDILRNLLLAARWTLLLSLIAFVGGGVVGLALLVLRLAGRPGTGRIVGAYVQLFQGTPLLMQLFLLYFGLALAGLNTSAWLAAAVALTLYASAYLTEIWRGCVAAIPRGQWEASASLALSFGQQLRHVILPQALRIAVAPTVGFLVQVVKATALASVIGFVELTKAGGLIANVSYEPLLTYGCVALLYFAICFPISQLARLLERTLR

SEQ ID NO: 2930 - protein, 504 aa, Methylobacterium sp.
MKGSSRLLPALGLCAAAITGHATGARAQSAAQADGNLGVGIPATAVSPLLRQRAARRPPPRPDGQGFGGADSAAGAADTLGQTATPPTLPPGTLDLGNGLSFLANYTGQGAINPVGGIRQGSAWAGQLFFGIDGDLQRLAGIAGGSFHVAVTNRHGRSLANDVIGNNTSVQEIFGGGQTTRLTLLSYQQKLFDNRLDIEFGRLVANINFLNSPIYCNFQTNSVCGNPTFVFKTSNFTFWPVSSWGAHAKAWLTDTVFVHAGVYEVNPLHQQPGDNGLDFSLKGATGAILPFELGYSTTFANDLLPRNYGIGGWYDASDYADPVRDVTGRAAVLTGLTPATRFGRSGVYARFDQMVWRPDPTGIQGLTLFGVAMAGTSGRLIEDYFLEIGALQTGTFAGRPYDTVGFVINTQRFSPLAQQNIALAQNAIGLNRSLPTQQIMMELNYGIQVTPAIRLTPNLQYIVNPDQTRFPYRNRNIPDAFVVGAKLSVDLFTLAGLARGPGSP

SEQ ID NO: 2931 - protein, 72 aa, Methylobacterium sp.
MFALTVPAAAAERQERPRLCPEDAPEGVRLPPRPGCGREAARTGAPAGFRDLGNGVKVRIGGRVGADYDVRR

SEQ ID NO: 2932 - protein, 268 aa, Methylobacterium sp.
VQRFTLIQGGYAVGPAAGAGWRIDLKGAPGVDAEAVAAWRALLVRNAVLDPRTDPDYLLTAARHLAGGDQIAFALAWEQGPDPALRGVVPLAIAEPLFRASRARPWWPPGLNPRSLVDPGRGAAIHAAIAAHLRALPRPVAYDPEARAGTVPVLRRPVPPESVLGVRPEGYVPPSATVETVREPERVRDAVEAFLALDARTARHPIIAAPQEAAMVRVVTRLFARRQQLAVVLASRAGGLVAGTISLGQGAGTIAWRHAGGDAGALPA

SEQ ID NO: 2933 - protein, 331 aa, Methylobacterium sp.
MQSEVAETDFSQIEDDAARREAWIRAISPIYVAEIDKAVPVPRTVRFRSWRLGTVLFNEMCASAQAVERTPSQIAMQGVDHVVLRLYTSGRTGIDTAAGEAEIPTGGLVLFDLSQRARSVTHEMTGLNLAIPRRLFDSRVGELSDLHLGVFRKEAPLIRLLGNHMHQVRNSIDGLDERQRSLISSATVALCNAALTPASDSAHNRPAVAAIEIRQFIEANLARADLGIETLCARFGLSRTPIYALFEPDGGVATYIRNRRLARAMRMLSGVEAGPPRISGVAYACGYENLKSFSKAFHARYGVNPRGVGAGHRTDAHWESGTTLLSWIKEL

SEQ ID NO: 2934 - protein, 321 aa, Methylobacterium sp.
LEDERQRREAWIQAISPVFMPTLDRDTPVPREAGFRCWNLGRILLSAIQASPQTIERTPSQIATQGVDHVILRLYTSGRSSLDTAAGDATIAPGSFVLFDLSQRARSISAGMTGINLCIPRRLFDGRVGEVSDLHRGLFEQRGQPLLRLLSDHMRNTRHCLDTSDTAQKALLASATVALCNAAFAPPSDSAHNLPAVAAIEIRQFIEANLGRVDLGLEMLCARFGLSRTPIYALFEADGGVMTYIRNRRLALAMRLLSGVEEGGPQRISGVAYACGYENLKSFSKAFHARYGVNPRDVDAAFRIEARRETGATLLSWIKEL

SEQ ID NO: 2935 - protein, 746 aa, Methylobacterium sp.
MSSITLSSATRQNLLVAQDTASLLSTTQNRLATGKKVNTALDSPSSFFTAQGLDNRAGDLSNILDSISNGVQVIQAANTGITSLQKLVDNAKSVANQALQATIGYSTKSNVSTTIAGATATDLRGTTSYANAQASSNVLFNGTAGGTTAATGTTTLGGTAGTYAGTSVDDNASADITTSTLIYGATGALTTQATTKFTDGDTLNVNGKTITFKSAATPGAATLTGSQGLLGASGNAVTDGSGNSTVYLNAATTVGDVLNAIDVASGARTAGTPSSGVSTLSGSGSSITAGAISLKSSTGSDLSLSGKADILNALGLSAATGSGTTSVSAVRSTSSTSLAALITDGSTLNVNGKTITFKDAAVPAASSTHTGVSGNIETDGNGNSTVYLRGGSINDVLKALDLASGVQTATLSASGATVATATGAVNSSVGPTGALKISTGSLSDLNITGTGNALASLGLAGNTGTDTSFTASRSSTPGGLSGKTLTFGSLNNGTAVNVTFGDGTNGTVKTLDDLNAKLALNNMQAALDASGKLTISTTNDYASSTIGSTADGGAIGGTASALFSVAQAPVEDVNSQNTRKSLLSQFNQILDNIKTTAQDASFNGVNLLNGDTLKLTFNEKGSSTMNLIGVTFDPAGLGLTKLGQNGLNEFEDISSANKVISTLTQASTALRQQASTFGSNLSVVQNRQDFNKQIINVLQTGSSKLTDADLNEEAANSQALSTRQSLTVSALSLANQAQQSVLQLLR

SEQ ID NO: 2936 - protein, 91 aa, Methylobacterium sp.
MDARAIIGWNLRRLRVEQGLSQERLALAAGIDRAYVGRVERGSENVTITTLEAMAKALAVPIADLLTEPEPDAPRPTPLRAGRRARREPAA

SEQ ID NO: 2937 - protein, 96 aa, Methylobacterium sp.
VGKSDLAKVDAHVITAEEYEELPEITDEMLDRADFRVGGKLVRRGRPPKPDAKEAVSLRLSPDVLSHFRAGGPGWQTRINAVLLDAVAREKAGSRR

SEQ ID NO: 2938 - protein, 832 aa, Methylobacterium sp.
VTATKERARALVLLLHQLANPVVYLLAAAGALSFYFGDWQEAAAVFAVLAVNTGLGFFTELRAARTVEGLRALGMRSARVRRDGHVRMLAAVDLVPGDVVLVEGGDAVQADLRLVEASNLGADESTLTGESVPVDKSADPVAAEARLAERSSMLFRGTLVTRGSGTGVVVTTGAGTELGGVARLVEQAEPDSSPLERRLERLSGQMVWVVLIVVVLLGGLGVVTGKDLRLMTEASIALAVAAIPEGLPIVATLTLARGMWRMARRNALIERLSAVETLGATTVILTDKTGTLTENRMTVRRLSLPSGELDLSERASERAPEAERLLRVAVLCNDASLGQGPGHGSGDPMEQALLQAGRACGLDRAAMLLDQPLVRKHAFDAANRMMATVHASGPRYFVAVKGAPEAVLAAARSTREGERDQPLDDVTRLLWQRRVEDLGTRGLRVIACAERRVDAAACHPFEELSFLGLIGLEDPAREDVPEAVAACRAAGIRVVMVTGDHAVTARSIAHAVGLAGPGDRVAEGVPSGDLPGGLEAVAVFARVSPAEKLSLVRAYQEKGEVVAMTGDGVNDAPALKQADIGVAMGRRGTDVAREAAAMVLLDDAFPTIVGAIREGRVIFDDIRRFVAYLMACNLSEVMVVGLAVLTALPLPILPLQILYLNVVTDVFPAFALAMGEGRDDILERPPRDPREPILGRPQWSRIASHAALMTAATFGALAVAEFWIALDRASVVTVTFLTLAFAQLWQVFNMRAPGSKPFHNEVTRNPWVWAALLLCTVLLVGPAHMPSAGAVLGLVPPDLGMWVLVLSASLAPLLLVQLWTMGASAWRRVGQT

SEQ ID NO: 2939 - protein, 479 aa, Methylobacterium sp.
MDSHDAITDLGAVALAAAIRTRQVSCAAVMGAYLDRIERLNPRVNAIVALQDRAGLMRQASACDAQLARGEPTGPLHGFPLAVKDLDPVRGLPFTQGSPIFRDRVAETDSIMVARLRAAGAIFVGKTNIPEFGLGSHSFNPVYGATGNAYDPALSGGGSSGGAAVAVALRLTPVADGSDHAGSLRNPPAFNNLFGLRTSYGRIPAESPDLFTPSLGVLGAVGRSPADIGLMLSVIAGYDPRVPLSNHEDPARFAAPLERDFSGTRIAWMGDLGGHLPFEPGVLETGLAALDTFRAIGCTVEAAFPAYDYEALWRDWLTLRAWTVAGNLRPFYENPVTRARLKPEAAWEVERGLALGAEAVTRAQEGRTRWYRTVLRFMETYPFLVAPSAQVFPFPIDRRWPDTVAGRPMDTYHRWMETVIPVTMSGLPALNVPAGFGPGGLPTGIQIVGPNHGERACLELGAAYDAASGWVERRRPPEA

SEQ ID NO: 2940 - protein, 737 aa, Methylobacterium sp.
MSITPAPAAPTAAEPPVQSQAQPQPPQPRPDSGLSALALVSSFHQVPCDSAQLGHELGVGERPSSAIDIVRGAKLLGLKARILKNQKPSRLESIPLPAILQTKDGRFVLIGRRHEDGTYRIIDAATRQVEQPKAADFASETWDGTIVLVARRARMTDTPPEFGLAWFRPSLWRYRKPLMSVIVASLFVQLCALITPLFMQITIDKVLVHKGYSTLVLVVVGLILIGFFNVAIQYLRTYVLVHTTSRIDVELGTKLFDHMLRLPLAYFETRAAGQTVARVRELEAVRNFLTGQGLSSVLDLVFTGVFFVIMFMYSATLALIVLASIPCYVLVAALLRPLLRDKTKERFNRGAESQQFLVESVVGIQTIKAMAVEPTLRTHWEERLAAYVRSSFEGVMLANLGQNAIQYINKVASALVLFFGAQAVIAGELSVGSLIAFNMLMGQVTAPILRLSQLWQDFQQVRVSVERLGDVMNAPVESRAMAQASLPPARGGIQLRNIVFRYQPGGNEVLKNVSLDIPAGQVVGIVGPSGSGKSTLTKLMQRLYQPEKGQVLVDGIDIAQVDPTWLRRQIGVVLQENLLFNRTVHENIALANPAMSRAQVVAVARLAGADEFINRLPLGYDTRIEERGGNLSGGQRQRLAIARALAINPRILIFDEATSALDYESERIIQENMRHIVRNRTVIIIAHRLAAVRDADRIIALKDGALVEDGSHAELLAKPTSLYGRLWRLQSGETIAA

SEQ ID NO: 2941 - protein, 203 aa, Methylobacterium sp.
MARYDAACPAPSVASIQDAIDAADVVGHWDWDIPADRLAADALVALLFNIEPDLAEAGVPLAAFGAGIHPDDRARIVRLIEEHAWSGRSYLAQYRVCSADGVTRWVLARGRFSRDGAGRPLRGRGLIIDVTRTRINEDASAVACSDTAGSPLERAARSFLEGYKLLETMQDQPQLRRLAEVLLFETGRALAAQVDRARRTGMN

SEQ ID NO: 2942 - protein, 136 aa, Methylobacterium sp.
MAESEQFQKGLAVRRAVLGEAYVDEGLAKADDFMMAFQRITTEWCWGYAWTREGLDRKTRSMLNLAMLTALSKPAELKLHVKGALANGVSVEEIKEILLHATVYSGIPAGLEAFKAAHEVLKAEGAVTGEPPGPTA

SEQ ID NO: 2943 - protein, 429 aa, Methylobacterium sp.
VIAPPTPQTLLSGHALPAAVLRAEPTVWRNPHRRGSAAVLPGLALAETDMRAAAARWHRFAPLLARLFDGLEGGRIDSPLAALPPAVAESVLGGAPGAVWVKADHDLPVTGCIKARGGVYEVLAYAERLAETAGLLREGAWYADFATPPFRDLFARHTVAVGSTGNLGFSVGVMGRALGFAVEVHMSHDAKDWKKRRLRELGARVVEHPGDYGLAVATARDAFRDRGDAHFVDDEDSADLFLGYAAAALDLQRQLAAAGIAVDAAHPLVVYLPCGVGGAPGGVAFGLTLLFGDAVRPVFVEPVAAPCMLVQLAAGLDRPVSVYDVGLDNRTAADGLAVASASMLVARTVGELIEAVVTVTDDALFRWLRALWDGAALRLEPSAAAGFAAVGPFVAAAAGADLARATHVVWTTGGAHLPDAEFEAALARG

SEQ ID NO: 2944 - protein, 432 aa, Methylobacterium sp.
VGRDHRPSRRLVLGLLAGAAFLPGRPPAQEAPIRDQGIGGTGARPTDTPGEGDRGIGGTGVIGTIRRFGSIVVNDLRIAYPDDVAVRIDGAPARASDLRVGHVVRVVARPEGGGLATRRIDVTSEVVGPVEAVGRNSLTVLGQRIATGMAGGTWTVGQRVAVSGLRRPDGVVVASLIEPRTEGADRVAGPVRRGPDGAMRIGDLRLNGAGHLPAGRRAALAGRMRDGALAVTDAAEAGLPPGIRTASIEAYIGRRKGGMTLGSGLPVAGIPGADLPRSGAVRAVLTTQVAGDGRLTVERLRVEDRLAPVRDPARAPGRFEGPDFQRDRLDLRGLPGHGSGGVPGRDGVGPGPGLRIDTRPPGGFGGPGGRGAGPGGNPGGFGGPGGTGAPGGGFGGPGPGPGPGPGPGFGGPGFGGPSLGGAGPGGFGGGRR

SEQ ID NO: 2945 - protein, 382 aa, Methylobacterium sp.
MPGRFTLTTAILLALAATGARADTIRIGVNEPLTGPFAASGTYVVNGARIAADEINARGGLLGKKIELVVEDNKSNPTEAAAVAEKLITSDKTPVLMGAWGSSLTLAVMPKLADYEVPMLVETSSSGKITTSGNPFVFRISPPSALEAETFAPMVAKLGMKKVDFLVLNNDFGRGAATDFGKMLKEKGVQVGLVETMDQGAQDMSAQLAKLKASDSDTIMITSSVDQLVLLFKQMAALGLKKRVITTGGSQNPDQIIAQAGSAADGTMHLTTFLPWIPEKTPDPKATEIFIAEWKKRGFAFAGVTESFRGYDGIRAIAHAIEKAGKAEPAAIAKAFWSVDFTGLNGPIRFAKSGPAGKESGQSKPDVYLIEIKDGRVVVPTL

SEQ ID NO: 2946 - protein, 188 aa, Methylobacterium sp.
VAAAREAWFAGQPDLDPERLIFIDETGLSTRMARLRGRCARAQRLRSGIPHGHWLTTTFVAGLRLSGMSAPMVLDGPMTRDWFLAYVEQVLAPTLRPGDTVILDNLPGHKGAAIKAAIEARGARLQFLPPYSPDFNPIEMAFAKLKALLRKAAERTVDRLWTAVGDLLDAFTPAECANYFAAAGYDPE

SEQ ID NO: 2947 - protein, 175 aa, Methylobacterium sp.
MCEDLQVASAQETEVPPPASPSSSPRPWPLHERPGFLARRMHQIHVSLFSERCAAFRITPLQYSLLSLLRDLREADQTTLAQAVALDRTTTTGALKRLAARGLVSRATSPTDRRAQVCRLTEAGEALHDAMEGSVREAHALTVAALTTPDQERLTELLRRVVSGHDHRRGQADIA

SEQ ID NO: 2948 - protein, 266 aa, Methylobacterium sp.
MVAVDDGRHARTRIRLAAELAHRLGARLVGAAACMPDYPQGYGETAVPMGMVIEEIRQAALDRCAAAEQVFRQGSCLNDRVEWRSDIAGPVPFLAGQSRAADLVVVGRYAEDEGVRPGMAVDLGDALMGLGRPVLVVPAGIEHLEAKRIVAGWKNTPQTRRALSDALPLLRRAEEVQVLRVTDTEDRAEVDDVVRYLALHDVNANGHLAARSGWSVAEDLQKAVRAIDGDLIVTGGYGYSRLREWFFGGVTRDLLSETTVCCLMSH

SEQ ID NO: 2949 - protein, 278 aa, Methylobacterium sp.
MIILSEEHGEARRLASLEAENRHLRALMLAGRRAEVERRHGARLGRAEAERIRAETEAREARYRHEIAELKQGADRQSLLMQEMAHRVKNTLAMVQAIGAQTLRTAPSLDAARAALDARLLALAKAHDVLLQDAWTTVPLGRIVASAVALHGGEAGRFAISGPEVALAARAGLTVALLLHELGTNAAKYGALSAPAGRVAIAWTIDRGAIEERAEAARFRFRWEESGGPPVSPPRQAGFGSRLIERSLVHGFGGRVDLAYPVTGLVLAFEAPLAMLAA

SEQ ID NO: 2950 - protein, 529 aa, Methylobacterium sp.
VSTATAKAPGGHNPWAIALVVALATFMEVLDTTIANVALRYISGGLAVGPDEAAWVVTSYLVANAITLIASSFLAKRYGRKAFFLWSVALFTLASVLCGFAWSLESLLLFRVLQGLGGGGMAPLAQSILADSFPPAKRGQAFALYGVAIVVAPVIGPTLGGWLSDNASWHWCFLINGPIGVIALGLMYWLIEDSDAAKRERRDLRKKGVRFDRVGFLLVALFLGSLEVILDEGQRKDWFGTSTLMNVFGVLTVVSFCAMIPWLLTRKNPVIDLRLLNSRQFGSCFVVMLFTGAVLIATTQFIPQITQEYYGYTATLSGLVLGPGGLVTVAMMALVGRLSSFVQPKWLIATGGAIVAAGMYDLTRIYGDTAFWFFAWSRIYIGIGLPMIFLSVTSASYEGLPKDRTDQASALINVARNVGGSLGVSLAQNILAYRSQFHQSRLVESVDPSSPAYQQTLAQATRYFQQHGYAGPDAQNQAIAWIGSQLSTQVAYWAYIDVFWVLGAMTACLVPLALILKDVKLGGGAPAAH

SEQ ID NO: 2951 - protein, 570 aa, Methylobacterium sp.
MTSSSQRLRSLTAKVILLAGAAILLTIGALLTATSHSLWRQVEAAQEEEGGTHIRTLALVLAGRVPGAAATLDGARLGRVTAPDLGGLADLSVVDDVTAYVGGTATVFAYETATDRFVRRITNVRTETGARAVGTALAPDHAAQASIRAGRAFAGTVTLFGRPFYTVYHPTIDAAGKVNGLLYVGIPIERYLARYTATLNTTALAAGLVALAALLIMVPVALRMFRPLQAIAARTEALAAGDLDGEIPSRARRDEIGAVARALATLRDVSRRARTLEAEQSASGAGERARRLRVDAEVERFRGAVSGALRAVDARTAELRQRAAAMSAASGEARGAVEGALAGSRETATTIQGVASAAEELSASVTEIRDRLDRAEAEVSGTVQEAAATEAQVGELASSAARIGDVVALISQIAGQTNLLALNATIEAARAGEAGRGFAVVAAEVKELANQTARATEEIAAQVGRVQGATGSAVEAIGRMTTRMGAIGVATADIAGAILAQGAATDEIARSVGETAGTSAAIARELGTVSDAARQTADTAAAVEQAAGSVETVAAGLEAEISRFLTAVAA

SEQ ID NO: 2952 - protein, 257 aa, Methylobacterium sp.
MTYETILTETRGRVLLITLNRPKALNAINRQLTGEVIEAVTAADANPDIGGIVITGSEKAFAAGADIKEMQAATYAEMYAGDRFADWERFTAARTPIVAAVAGYALGGGCELAMMCDFILAADTAQFGQPEIKLGVMPGIGGSQRLTRFVGKSKAMEMCLTGRMMDAAEAERAGLVSRVVPAAELMGEAMRVAEIVASMSLPIAQMTKEAVNRAYETTLTEGVRFERRVFHAMFATQDQKEGMAAFVEKRPARFTHG

SEQ ID NO: 2953 - protein, 262 aa, Methylobacterium sp.
MRLSKRGLLLALALTPLLAGAAVAQNQLATITETKVVKIGVPTDYPPYGFVGVDLQPMGLDVDVANLIGAKLGAKVELVPVVSANRIPYLQTRKIDLIVSTLGKNEERQKIIDFSVAYAPFYQGIFAPKGTSIKSFDDLAGKTVAVTRGAMEDEMLAKVAPAATVVQRFEDQAATTAAFAAGQTQAIATSVSNIGVLSRKNPNLGADYKLLLRDSPCFVGIAKGEDALRARVNEILLAAKADGTLEALAQKWLKRGTGDLPL

SEQ ID NO: 2954 - protein, 116 aa, Methylobacterium sp.
VARPGRIRLGSCDLLGDLSGDRPLLPVLAGGQHLLLVRDAGRILAVERACPHEGADLAAGRCGAGRLFCPRHLASFSLRDGSVSPGWSFRPLRVFPVAVAADGLWVETGPGPHRPR

SEQ ID NO: 2955 - protein, 279 aa, Methylobacterium sp.
MSPILSVDHVGVRFGGLIAIADLHFDVHPGEIVSLIGPNGAGKTTAFNVMTGFLKPSQGAVRFRGTDLKGLQPHEITRLGLARTFQRTSVFPDDTVFDNVMIGLHRQGASGAPGIGRAPLLDALLGRAGASERALRERAASLLDWVGLASRAGERAGALAYGEQRLVGVALALATEPAMLLLDEPVSGMNASETRVFVRLIRQIRERGITILLVEHDMPMVMEVSDRIVVLNYGRLIAEGPPEAIRSDPAVIEAYLGQGSAARRAAAEALSSVSEAAHA

SEQ ID NO: 2956 - protein, 313 aa, Methylobacterium sp.
MVGFLLKRIGATIPVMGFVAVFVFLLLHLTPGDPAAVIAGDNASPEQLERIRLSLGLNEPLPIQFLHWGWNVIRGDLGTSLISQVPVLTMIGQRLEPTLSIALCTIIVAVGIAVPLGVLAAWKHGTWVDTLVMSLSVVGFSVPVFVVGYVLIKVFAIDLRIVPVQGFRSIGNGVGPFLERAVLPTSALAFIYVALIARMTRASMLEVIGEDFVRTARAKGISEGQVLVRHVLRNAAVPIITIIGAGFALLLSGVVVTESVFNIPGLGRLTVDAVLARDYPVIQGIILVTSFVYILINLLIDVAYTLLDPRIRY

SEQ ID NO: 2957 - protein, 202 aa, Methylobacterium sp.
LDEDDEAAVERCNQACDADAEASKALAEVLPTTPAGLIALVAFYAEDGEGTDTASLYLDRLLAVLKHPDSGRLFAGSNPKIATPDQGLGRVIPQAGFEVLRTMPGPSDIEAAWHGLPAETRDRIGIIAVDMVFQGFVYGDVYVVNGTPEDRAVSDEAIRGAAAEAEDRRLNELHSVVEAVLPDLFGPEGENPAWCENPGPRP

SEQ ID NO: 2958 - protein, 168 aa, Methylobacterium sp.
MHDTSPKPERPDPGYSQEDWDEVSDNPELTDAELAEMRPAHEVPEVYNLLPKRGRGRPKLADAKVNLTLRIDPALLDAYRATGAGWQVLMHEALAAGRPEMDEAEAIDQAARRTAKQKAADARATRSGSYEVVGPRSGTVASGKSSTRAGALSSSSTAPGKRPGKKSA

SEQ ID NO: 2959 - protein, 105 aa, Methylobacterium sp.
MPKPEHAPGYVPNAAYTQADWDAVSDNPALTDAELGQARRGTDGMPPAIAAAFRRGGRPRSEQRKVPVTIRLDAEIVEAFKATGPGWQTRMNDALRRAACDLDAA

SEQ ID NO: 2960 - protein, 144 aa, Methylobacterium sp.
METADREPEGGFAPLAPELDVTDLDASLRFWCGVLGFRVSYARPEDGFAYLERAGAQVMLCRRNGNWDTAPLERPFGRGLNLQIAVAALDPLLELLRAAGWPLFREPHAARYRVGDGAVFLRQFLVQDPDGYLLRFSERLPPQP

SEQ ID NO: 2961 - protein, 77 aa, Methylobacterium sp.
MKNVTVTMSEALLQRARVAAARDGKSLSKFVAEAVEQRVGRPMTQLEAIERFLAGPPLHLLDENGKAPTRDQLYDDE

SEQ ID NO: 2962 - protein, 97 aa, Methylobacterium sp.
MSNRSLSWNAALRSLHADRVAIPAGLAGARAMVQTFARTRAPLVVAGRFDRKAIMAHAAAAAKLHQGRYGSTWAEAMSVALRAAWQAAHAARRATAH

SEQ ID NO: 2963 - protein, 446 aa, Methylobacterium sp.
MSDTSHTARTEEAVVGELHDLIAWLRQRLRGEHTVRASVLNVEPNGPDSHLILLGEAETRLTNDPPRLKARLDAAELGDIRAAHGLDFDPVSLVNRTVTLTLRTSLRQRFGRGAGVQAKVMALRSVGQVPLEADLERERTLQRLRLEGRRFGPDTWNEPDDPRHIALVVSEHGDVRRDVEHVLQPLEEAGLIQIHRVWAMFEGAGAERSLAEAFAQVASLQREHGLSATLVCRGGGPVEAFRPLNAFVTANAAAAAEVPNLITGLGHAGTPRTALDAVAARSEPTPTAAAMLVRGLVERTGIRAERALASLDAAIEEELEVAGRITLARVAAAFDTALRDLADRADERLRQLDRGVERSLFANLAVAAAKAEPPADAAETDGLGAIEDDVLLSDALSLVVAAESGRVVVTAEQARAETDLLLHFPDGAVPVRVEPHIAIISPATMH

SEQ ID NO: 2964 - protein, 430 aa, Methylobacterium sp.
VHELRDLIGWLRQRLRGEHSVRACVLTVEAAGPDSYLLLLGEAQASLSYDPPRLKVRLDAPELNRIRTEHGVDFDPADLVNRTIEVQLRTGLRQRFGRGAGVQAKLMALLSLGQIPLEAEIERECTLQRLRLEGTRFGPDSWVEPEDLHHIALVVSEHGEARRDVEHVLQPLEAAGLLRLHRVWTNFEGAGAERTLVEAFTRVASLHAEYGLSATLVCRGGGPIEAFRPLNNYAVARAATADRLPNLIVGLGHAGTPRTALDAVAARSEPTPTAAAMLVRHLVERTGIRAERALAAFDAAIEEDLGAAGRIALARATTAFDMALQNLVTGAEARLRQLDRAVEQSLLLGLSAAVGGITRKEPDADPVEVDPLGDTEDDAALSAALVLVIATDTGCIVTSAQDLSAGLPLLLQFRDGAVPVRVEPFSFTAH

SEQ ID NO: 2965 - protein, 172 aa, Methylobacterium sp.
VTIIGDVTEDSVVDAIEAAERAAQFVIVDLEGTASLMVSNAIGMSDLVVIPVQGSSMDAKGGAKTIRLIRNQEKMSRRKIAHAVVLTRTSAAVTSRALRNVSEQLQAGGIEVFVTAIVERAAYRDLFDYGGTLSGMNASQVSNLDKAIQNAREFSGEVISKLKATTNPRAAA

SEQ ID NO: 2966 - protein, 411 aa, Methylobacterium sp.
MLDDQRQAAPADASARRSEADDARDILDLQPTGRKPGDAGREAAPDGTGQSAEGQDGDADDADETEARRPNVLRRHPWWFVLGGLAVLALGVATFFYWQIYLHPYETTDDAFVDARSFTVAPKVGGYVVAVAVTDNQHVKPGDTLFQIDPRDYRVALEQAEAQVQAAEAAIQNVDAQIAAQRAQIEVAKAQVETAQAALTFAEEDAARYKALAERGAGTIQQSQSSTSTLQQRQAALASANANVVAAQKQIGSLQAQRASAEAQLAQAKAQRDQARLNLGYTTVTAAQGGRVVRLTGGVGEFAQAGQSLSMFVPDEIWVTANYKETQVTDMRPGQPVAITIDAYPERRITGRIASVQPGSGTAFSLLPAQNATGNYVKVTQRIPVKIVVDNWPTDVSIGPGMSVVPRAHVR

SEQ ID NO: 2967 - protein, 171 aa, Methylobacterium sp.
MQKSLIGMAAALVLVGCPMASAGDVSTTGAVGENGTLNQQDFKILTDARIGVLKAVLQLTPEQQQYWPGIEQAIRARAEARYSRLSTLVGRLNQVSDADPLAAIRARADSLNQRAAGLTKLADAWQPLYQTLSPDQKTRMRVITGRLIGGLRQAVENRRRDLLDDDYEDEG

SEQ ID NO: 2968 - protein, 316 aa, Methylobacterium sp.
VPTHHEIPAMPETMVLGYFDAALAPVLTVESGDTVTLHSHPAGGRESLHPDPSRVPAELTAALDTLKPGPGPHFVTGPIHVRGAEPGDMLQVDILDLKFRLDWGFVAILPLLGTLPDEFTDYETVHADIDVARGVCRLPWGTELPLDPFFGILGTAPPAAWGRVGTPVPRAFGGNMDNKEMRVGTSLYLPVFNPGAGFYAGDGHGVQGDGEVCITALETGLTGTFRLTVRKDLPGAWPFAETPTDLMSIGLHESLDEAMRQAVREMVRLVCARTDHTRNQAYMLCSLAGNLRITQTVDGNKGVHMLMPKAALARNA

SEQ ID NO: 2969 - protein, 205 aa, Methylobacterium sp.
MTVRMIGRDPAPADTSPQVHIAEEIRRRRREQGLSLEALATRSGVSRSMISKIERLEAIPSTVVLSRLAEALGVTFSRLMTPSTEREVLLIPANRQPILRDEESGYLRRCISPVLPGRGIDWVLNILPAGASTGEFTAHRRGVAEYIFVLRGRLRAVIGERAVVMEAGDSLYFEADAGHAFTNVGPEACEYFLVIDPSHARWSRS

SEQ ID NO: 2970 - protein, 306 aa, Methylobacterium sp.
MAQDRQDPPLVRRIVAVSRTVADLGRTEAFYRDALGFAAIAPPEPVPEPIRAALGLTGTAARRLRMRLGRQTLAFLCVDPPGAPYPAAAGANDPVFQHVAIPVRAMEPAAARLRAHHPAPISAGGPQTLPASSGGVTAFKVRDPDGHPVELILFPGGAPARRWRDAPGLFLGIDHSALSVTDLDRALAVFRDALGFRLAERGLNRGAAQARLDGLPDPEVDVLALEPAGAGTPHLELLHYRRPAAPPGPAPYGPRDRATSRLVLAVRDLDAAADALAGAGCPVRRADGIAYAVGPDGHGLLLVPEA

SEQ ID NO: 2971 - protein, 300 aa, Methylobacterium sp.
MDGFEFTQSRFKSFVLPNAPLETLAEGFRWCEGPVWFADRDELLFSDLPNDRVMRWSEGGGPSVYRAHAGFENGHARDRQGRLLSCSHRLRRIARTELDGSVTVLVDSYEGKRLNSPNDIVCKSDGTIWFSDPPYGIQTDYEGGKQVSELPANLYRFDPRDGSLTVAAGDFEGPNGLCFSPDERRLYVAETGLQFAENPTRHIRVFDVGEDGRLSNPRIFHTVSPGMADGFRCDEEGNVWSSAGDGVHVIDPGGALIGKIKTPTTVSNLCFGGRFRSRLFLCVSHSLMAIYVNRRGAALV

SEQ ID NO: 2972 - protein, 345 aa, Methylobacterium sp.
MSRLLPLALLAALVALPLALGTEPYLLNALIVTGILTIGAMSLNLLLGFTGQLSLGHIAFFGIGAYVSALTSLGFDIEIGFGLRVVHEPWPAAVGFLLAVVAAGLCGYLIGRLSFRVRGAYFVIVTISFAEVVRLVALNWVELTQGPLALTNIPAITLGLPGLGSWTLRTKLQNYYLVLAVGTLCWLVVARLVGSRFGRAMRGLKENESLALSVGINATRTLTIAAVISAAMAGAAGSLYAHYLRIIDPDVFLFSTTVSMVIMVVAGGKGTLMGPVVGGLIFGLLPVALRPVMAPEAQWIVYGLVLIGILFVMPRGIVPGLAALLARRRPRPAAPVLDASPMVQR

SEQ ID NO: 2973 - protein, 290 aa, Methylobacterium sp.
MDQLIQHLVNTLILGGTYALLGIGLTLIFGIMNVVNFTHGALYTVGAYLTYLAVAGLGLDLFLALPVAILGGLLLGALIEIVLLRPLRGQDIDTTMLVMIGAGIVLQSGTLWIFGGVAKAVPSPFPEAPLQIGPASVSWLRLFVLGAALLLIGLTYALINRTKLGLAMRAAFQDSDTAALMGVNVRVIYTATFAMGSALAAAAGALLGPVYVVHPQMGGLAELKAFAIVILGGLGNVTGAAIGGFILALAEELGAGYISSGYRDAMGFLIIIAVLLYRPTGLFAKAERIG

SEQ ID NO: 2974 - protein, 432 aa, Methylobacterium sp.
MVDSHPDPRRYDLVLRGGRVICPASGIDGIRDVAIRDGRIAAVEETILPSAATEVVDVSGKLVLPGMIDTHGHVYQYVTGRFGLNPDMVGVRSGVTTVIDQGGPSCMTLPGFRHFIAERAETRVLAFLSAYLVGGLEGHFYPNLYSPDGVDIDATVKSAVENRDLVRGIKGHAEIGGFARWGIKVMEMAAEISRRADLPLYVHFGQLWGLPESGANGEDADTIVERVIPLLRPGDVLAHPFTRHPGGFINEAGEVHHIIRRAMDAGLKVDVGHGSHFSYRVARASLPAGVIPYTLGADMHGYNTEVPEAPKPAGTPDEHHDDENHPFLGQARFSLTQAMSSMMALGIPLEAVVPMVTAHPAEMLRMSDSLGALKVGRVADVSVLHDDRGRFLLRDNEDTKVVAERLLRPAFCLRAGRRFDADSPILPQAVAA

SEQ ID NO: 2975 - protein, 172 aa, Methylobacterium sp.
MLVVLAASVVLVMVTILVLYETLRLTSEHLAELPVPPRWRIVAVVLAAFAGHTVAVWIYAGAYWLLVLKLGLGAFSGVPIETFEDCLFVSVVAYSSLGYGDHAPVGHARLLTGVEALNGLLLIGWSASFTYLAMERYWPLHGKAHVRRAAKARHPADEELGRERLFPPANGT

SEQ ID NO: 2976 - protein, 132 aa, Methylobacterium sp.
VTLTLARCPEHPDGSAGRGYDIVAPLGPDGRLDPVLWHETRDRCRVRRFWTGDRDRHGRLVHRAGGEGGATWLIDYEDRTTDDDELGYRLGTHALVEGEYVSIREAGDEEYHTFRVARVTATGAGGHAGGSA

SEQ ID NO: 2977 - protein, 347 aa, Methylobacterium sp.
MTTNQHKATTPLLDIAYEAGGPPDGFPVLLLHGWPDDVRTWDAIVPALRAAGFRTLAPYLRGFGPTRFRGPELPRSGQLAALGADLLDLADALGLGRFAVIGHDWGARAAYIAACTAPDRVAACIALSVGWGTNDPGQTLTLSQTQNYWYHWLMALPRGEALVRDDRHRFTRHIWTIWNPGWPVSDAAFAATGAAFDNPDWAAVTLHSYRVRWGHARPDPRYAELEARLAADPVIRVPTLVLHGGADPCNDPATSENRDALFAAAYRRVVLPALGHFPQRQAPEAVLAEILPFLTRAVGRAVPASVTDPDAEGAVPVQPGGPARSLLSAFADLLSAKPPSLAMRGAG

SEQ ID NO: 2978 - protein, 286 aa, Methylobacterium sp.
MRIQDASREGAVHRPADGQGAPRRAAQARLGRSGLVLAAGLALTLAAPARANPLTEVPGARAAPEEAPPPRDAEAARAEAEEARAANPSANAIIRALAPFADGNPGAPARPLAVAPDDGGPTVRVDPARSVDLTVFFAYDSARLTPEARIQLEPLGEALRARDLAGHGFLIAGHTDASGGLAHNRRLSLARARAVKAHLVETYGLAPERLRVHGWGPARPKNPAAPLSRVNRRVEVSLIAPARSGDLRFVLPVAGQACAGLADPRARVALDLDDFDAGPTPRPCAE

SEQ ID NO: 2979 - protein, 173 aa, Methylobacterium sp.
MAEKSDEPGTLTRASTFLFLHTEHAIYAILGLLLAVTALLALYDAGRLTLEAIQAQGRAAQLLEVVDRLLFLLMLVEILHTVRVSMRSGRLTCEPFLIVGLIASIRRVLVVTLQSAEVMHSKDWTPEKQALFQASMIELGVLAGLILAIVLSIFLLHRARHDNRPAGEESAEA

SEQ ID NO: 2980 - protein, 147 aa, Methylobacterium sp.
MKPPLADDLYEADFYAWGRAQARAIAGLELPALDIENLIDEVETVGRGQRAAIEAHLRVLIIHLLKFRCQPERVTVSWRVTLSSQRLSIGRLVARSPSLADYPARILDEAYGDAVRGAAREVGLPESAFPSACPFALAQILDPGFVP

SEQ ID NO: 2981 - protein, 160 aa, Methylobacterium sp.
MSNPVFAQPGTADLYETDLCLWTERQAALLRAGRWREVDALHLAEEIESVGGSQKSEIRNRLVVLLLHLLKWEFQPEKRKYGWRASIIDQRLQIAGVIEVSPSLRGWPDHVVAAAYRQAVVGAASETGLPEKAFPATCPYAISEILDIGFYPGLPEADVV

SEQ ID NO: 2982 - protein, 129 aa, Methylobacterium sp.
MTRHTIRTDRAAAAVGPYAQAIRVGDLVFASGQLPIDPATGAFPEGIEAQTRQVLANLAAVLEAGGASLASAAKTTVFLKDMNDFAAMNAIYAEHFPGEPPARSTVEVARLPRDARVEIEAVALATEAA

SEQ ID NO: 2983 - protein, 181 aa, Methylobacterium sp.
MVEAFAHPAGAAAAQVPGGATGWSGTLLHIHIAPAASYEMEELPEGLCVAGRGIEGDRYFLGAGTYSPKPDVREVTLIEQEALDALNRNDPPLQEGGLRLMPADHRRNLTVRGVPLNHLVGRRFRVGEVILRGGRLNFPCRYLEELLGMPVYLPLYNRSGLNCGIERGGTIRPGDTIELVD

SEQ ID NO: 2984 - protein, 293 aa, Methylobacterium sp.
MTDLAIARTPPRHSSTLVRIMSRKPWAFAAGIVLATIAASAILAPILAPHDPLTLAPSLRLRPPSETYPLGTDAYGRDLLSRVLYGSRISLAVGIGAATLSTALGLLLGLLAGFFRPLDATLMRMADGLMAIPAILLAVAVVSLSGASLASVLIAITLPEIPRVMRLVRSVVLLAREQPYVEAAVSLGTRTPRLLRKHILPNTIAPVIVQASFICASAILTESALSFLGAGISPTTPTWGNIMADGRTFFQLRPSLIFWPGLFLAVTVLSINIIGDAARDLLDPRMKQRETGL

SEQ ID NO: 2985 - protein, 307 aa, Methylobacterium sp.
MKQLTRSLPAALLLIALAAPAAAETKFTLLMSEVGDPLLDSLQAAVLNTATSKFSASVDVAQAAGNGGTQVVQGRAALDAKPTALIVNPVDDASARTITEMAAAAGIPVVFVNKRPSGPAAHRMAIVSANHLVAGRVQMRLLAQGLGDRGNVAILRGKDSDNAAQERTAGMKEILGQRPGLKLLAEASADWSRRRAQDQVTAWLRSGLKPDAIAANNDEMALGAVAALKAAGLSGKVLVGGVDGTSDGIAAVKSGELLVSVLQDAPMQGAQAVNDAVKLARGEYVQPYDWVPHRLILPASGDLANGR

SEQ ID NO: 2986 - protein, 292 aa, Methylobacterium sp.
MSAQASRREPDRPDPVVTDGDFAKFRDFFYRKTGIMFADNKRYFVDKRLQERMLAAGQPGFRDYFNTLRFQASGAEFQALVNLMTVNETYFYREEYQFRCLVRSILPEIARAKRPGEPVRIWSVPCSTGEEPYSIAFQLLDNWADVDRYDVEIVASDIDTTVLDQARAGLYGDRSVQHVPKPTLERFTRRRRGGYEVIADIRDSIAFTRVNLSDPLSTRQFRDFDVVFCRNLLIYFDDESRREAAQTIYEALNPGGFVCLGHSESMSRISSLFAIRKFPEAIVYQKPLSAEA

SEQ ID NO: 2987 - protein, 114 aa, Methylobacterium sp.
MTTFDEREQAFERRFVQDEEQRFRARFRRNLLLATWASERMGLGKDAAARFVEDFTDRGVLIADEPLVAELQADLKATGVEETLPALRTEMERCAAIARAEQRVGLALDQGRPV

SEQ ID NO: 2988 - protein, 85 aa, Methylobacterium sp.
MSHELTEPVHWQGRQWAVTGYGIEALDGMYHVPFSDIPDADAAPPRWLDDLCRRYGTDRDDLAAALRVARAVRPRAEGTSAKSAA

SEQ ID NO: 2989 - protein, 372 aa, Methylobacterium sp.
MTREAGLASLVAITDRLGPRYAAERNTAPGPDADTTTSALSPYLRRRLITEQEVVAVAREAHGAAADKFVSEVFWRTYFKGYLETHPAIWADYLRLVAEGEQQLAASSGLRRTYERAVEGQTGIAGFDDWARELAETGWLHNHARMWFASVWIFTLRLPWALGAAFFLRHLLDGDPASNTLSWRWVAGLHTRGKHYLARAENIRRYTDGRFDPAGLDEQAAPLSEAEVAPAVPLAPADPVPAGPVALLLHLDDLHPESLPLESVQVTRIGGLLAHAPGASEAARAADAAAMADALARAGAHFSCPAGLADAGWSGDLPVVSAWAPIGPSAAALPAGVLQLRRTWDEASWPHATRGFFKMRTAIPRILDTVAA

SEQ ID NO: 2990 - protein, 402 aa, Methylobacterium sp.
MQAGRPDEARTEVAIVGGGLAGSLAAAMLGRAGRDVVLIDPHTVYPPDFRCEKLEQGHLEVLRRTGLAQAVIRASTHADTLWIARFGRVVDKVPFDQYGLAYDGLVNTVRAEIPPSVRIPRTVAQRIEPDPLRPHVHLPGGGSIEARLVILASGLNWTLREALGIRRDLVSACHSVTIGFDLERTDGQAFAFPGLQYNPERYDQGLAYLTLFRIGAGMRANLFLYQPLRSPWLAQFRAAPDAALHGLMPRLAGLIGAYRVASPVKVRPTDLHASHGIEKPGIVLVGDAFATPCPATGSGSLKVFTDVERLCNHHVPAWLATPGMGVEKIGTFYADPAKRACDALSVAKAFDLRALSTGSGVAWSLRRWLRFCLRLARWNLRRAVRVRPVRAERTEVRGADVT

SEQ ID NO: 2991 - protein, 760 aa, Methylobacterium sp.
MAQPDRPDPASDPSLLGHPHIRVDGLGKVRGAALYASDRRFPNRAHAALVTSAIPLGRVSGIATDAATALPGVLGIFTHRDFAGAIRPVKHLMAGGHANSSHLPLGSDRIAYAGQIVALVVAETVEAAQAAAARVDVRYEPEAFAATLDAPGAEPVRLADLKEKHRDPRRGDADAALFAAAHRVSALYRTPVQHHNPMELFTTTCLWEGERLTVHEPTRYVGALRHGLAEQLGLDADTVRVVSGPIGGHFGSKLALSQHTALVALAARRLGRPVSLVPTRRQCFTIANHRPETRHEVHLGADRAGRFTALVHEADMGASRFDPFAMEGTDVTASLYACRAIRTEERAVRLDRNTPGPMRAPPEVPYLFALESAVDEMAGLLGLDPIELRRRNDTDTDPVSGKPFTTRPLIRCFEAGAQAFDWGRRRAGPERDGPWRVGLGCASAVRPVKISPAAMRVAIAPDGAVTVETAHHEIGNGITTLLAMGAADWLGVPVASVTVRLGDTDLPPAGLSGGSSTTTSLMNALDQACRTLRERLAARAAAEGGALAGCDPAGIRLAGGSLSAPDGRRVALGRAVAGHGPAGIETVAQFVPDGGGPDDLAAVRAGHIALGTGGGAALSWAFGAQFAEVRVHEETGEIRVARLTGAFAAGRVLNPLTARSQLTGGMIWGLGSALLEETVVDRGTYPNADLAEYLVATAADAPPVIEAILVRDDDAGVNALGVKGLGELGIIGVNAAIANALHHATGRRLRRLPIRCEDLL

SEQ ID NO: 2992 - protein, 232 aa, Methylobacterium sp.
MSRLNKRQRLKVRRQRRAERLAARAAGIFPATSSSTARRATAAEPIRGRASEVIDTTLLWHMARTAPRMGERARRALREIEVATFLPRASEVVVRRGRRVIRHTPLIIRTVFIGVRDEAHLAEVRSQPGIAEIVSHPETEGGPAGNVQQIVRRPARLDPEDLQRFVDALAAGEIVQPVGVRVKSAVVVMTGPFASFPAIVEAILPGDRLRVAVSIFGRPSRVELGMADVQAV

SEQ ID NO: 2993 - protein, 175 aa, Methylobacterium sp.
MSLYALDGHAPVLADDSVWVAPGAHVIGQVHLGARASVWFGAVLRGDNEPMRVGVGTNIQDGAVLHSDPGFPLTIGDGVTVGHRAIVHGCTIGDGTLIGMGATILNGARIGRGCIVGANALVKEGAEFPDGSLIVGMPARSVRSLDEAGAADLRRLAEHYVANARRFAAGLVRQD

SEQ ID NO: 2994 - protein, 315 aa, Methylobacterium sp.
MTARLIMKLRVAEAVPTTPDVVHLRLVHPSRPELPAWTAGAHVDLRLPDGRVRQYSLCGDPADRGCYELAIKRETAGRGGSAWVHGNLGPDATAHVSAPRNNFPIVPEARRHILVAGGIGVTPLLAMARQLAASGADFALHLCARSAAEAPLLRAAHAVCGRRLTCWFSAEGRRFDPATIGEPADGTHIYVCGPQRLTDAVRSALTARGWPDGRIHSEHFAPLDDATFKPEPFEARIASTGQVLHVPAERSLLDVLRGAGFAMPSSCELGVCGSCECGYRDGLVIHRDVVLPPAKRQDRLMPCVSRARVAVTLDL

SEQ ID NO: 2995 - protein, 358 aa, Methylobacterium sp.
MKTYTIAAIPADGIGIEVIAAGIEVLDALAEKTGSFSFKFDHFDWGSDYYKKHGVMMPADGREQIRNHDAIFFGAVGAPDVPDHITLWGLRLAICQPFDQYANVRPTRILPGITSPLRHVSGPELNWVIVRENSEGEYAGVGGRVHQGHPNEVATDVSMMTRSGVERIIRFAFKLAQSRPRKLLTVVTKSNAQRHAMVMWDEIAAEVARDFPDVTWDKMLVDAMTMRMTMKPETLDTIVATNLHADILSDLAAALAGSLGIAPTANINPERTFPSMFEPIHGSAFDITGKGIANPIATFWTACQMLEHLGEQPAADRLMRAVERVTADPNLHTPDLGGRATTRQVTDAVIAAVQGDNE

SEQ ID NO: 2996 - protein, 619 aa, Methylobacterium sp.
MKQLGRLNEENRRKARTFAKQQKAAERIAAATAQLASGVAEASSAAEELRRAMEQIAAGAEQAASASEQSQRAVTVVSEAIGTARSEAEVSRQKSEGLQELIAGVGQQIAASIMSISTAADRQAASVTMIVELERQAANIGDIVRAVARIADQTNLLALNAAIEAARAGQHGKGFAVVADEVRTLAETSEKSAQEIQELIGRIQADVKMIADGINRSAESTLQEVEKGKAITAQLGSVRSAMVEVMKGAESIARTAVESEKAAIEAQKGVESIAAAAEEQSSACQESLKTVEQQTTALGQSEQASGELSALSEELRNSTDIAKSSEEVASAAEELSSAVEEINRAAAQIMTALDQINRGAQQQSAASQQSAAAIAQIEKGALLSQERAREALERGDLITTQLQENRQAVDELVRGVGHSLDETNKSREQINALEGVSRKIDKIVDAITTVAIQTNMLAVNGSIEAARAGEFGKGFMVVSTDIRNLARDSSENAERIKDLVKAIQDQIVFVRRDLEEISGAAAAEVEKNKAITQNLLTAAEDMGAVLAGNRQILEGTSLIVDNLGEAKKGVDQISAAAQQAGQAAVEAQQAAREQSKGAEELAAAIEEIASLADELQNQD

SEQ ID NO: 2997 - protein, 368 aa, Methylobacterium sp.
VSPRPYILMSADALGGVWPYSLDLARALRERGLEVTVAVLGPAPTPERAAAAAAATGARILPTGLPLDWTAGRPEEVRGAAATLARLAGAVGADLVHLHAPALALADFPVPVVAVCHSCVATWWEACGAGPMPADLAWRARLAAEGCRAADALLAPTEAFAAATARAYGLALAPRVVRNGRDRPTAAPEPGLAAHAFTAGRLWDGAKNAAALDRMAARLPCPVLAAGPVAGPNGARVHLAHLRLLGRLDEAGIAARLAGRPVFVSLARYEPFGLAVLEAAGAGSALVLSDIPSFRELWDGAALFVDAEDDAAAAGAVAGLMAEPAPRAALGEAARARAARYGVAAMAEGVLAVFRDLLAGGSAGRSAA

SEQ ID NO: 2998 - protein, 510 aa, Methylobacterium sp.
MSHDPHSPAEPGDRSAASATARQFVTFLIDRETYAVPLAEVQEIIRLPEMVDVPLAPQNLAGLANLRGTVLPVTSLRRVFGLPEREHDDATRVVVVSQGTPFGFVVDRMASVVTSESSEIDGTEGLQSTVDTDMLSGIIRRAGGMVMIIDPARLMQRGAGSRLSERRAERADIAAEAGSTRSATAVSDEIQLVSFGLAGQEYALPIEHVQEIVQVPDLVSTVPRADASVIGVINLRDRLLPLVSLRTLFGLAETGLCEQSRIVVVSWGTHGAARSVGIVTDTVKEVLRVSRAIVDPLPDLLSGGGALREVEAICRIDQGRRLVSILSAERLFDAATRLDGSIVDQTETVEGERMSQKAEDEEQFVVFRLAGEEYGVPIDAVHEIVRVPEQLTRVPRTPHFIEGVVNLRGAVLPVVDQRRRFQLPDTERNDRQRIMVFLIEGVRTGFIVDAVSEVLKIPRAAIGPAPDLGQDGGGAVERIANLAEAKRIIMMLDVARLLSRSEVADLRQAA

SEQ ID NO: 2999 - protein, 216 aa, Methylobacterium sp.
MTDKDLRRNVLDELDFDPSLDAAEIGVAVSNGVVTLTGHVGSYAEKVEAENAVRRVKGVSAIAQEIQVRYAEAKKIEDDQIAARALAIIDWSVHLPKQAIQVKVAKGWITLTGTVTWQYQAMGAEAAVRKLSGVVGVSNLIEVKPEVRPTLVKDKILEAFKRGAMFEADGIKVRVEGDKVTLEGAVTAWSEREAAERAAWSVPGVRAVVDHIVALS

SEQ ID NO: 3000 - protein, 848 aa, Methylobacterium sp.
MLAPTPTFSPRLLVRLGAQPASKEAAIREAAQLLTAAGCIDAGYGESMLAREAVANTYLGHGVVIPHGMVDDRHLVRESGLAVLQVPGGIAWHDGQTAHLVVAIAAQSDTHITVLRRLTRLIQDEARLAQLRTTAREADIAAALSEDAAAPGAAGPATDLRQRFDWTVDYPTGLHARPAAHWVEVAKTCPARIQVRHGAQVADAKNLIALLQLGLRCGDAVTISAEGDDEAGALAKICAAVTGLSAGEKAAAQRAAEAAARAAAPVAGWNPSDKPHTVAGIGASPGIAIGPIHVLASAEIAVPDEPEPLTTGADRLHRALSATADQLRALADDTERRLGKQDAGIFRAQGELIADTDLITLACQLMVEGHGVAHAWHAAVERLAGQLAALGNPVLAGRAADLRDVGRRVLAQIDPALKTGHDLPDVPCILLAADLAPSDTAGLDPARVIGLATAQGGPTSHTAILARTLGIPALVAGGRGLLALANGTRAIVDGTTGRLYLDPSAADIASAEAWRERQRAQAEAEARERALPAQTRDGHRIAVGANVNNPEQVAFALDQGAEGVGLMRTEFLFLERGDTPSEDDQYETYSGMLRALGGRPLIVRTLDIGGDKQVAHLRLPHEENPFLGVRGARLLLRRPDLMEPQLRALYRAARDHVPADAPAGKDAPLSIMMPMITSVPEVLRLRAVAERIRAEIGAPPVPLGIMIEVPAAAIQADAMARHCDFFSIGTNDLTQYALAIDRQNTELAPEADSLHPAVLRLIHMTCEGAARHGRFVGVCGGIAGDPFGACLLAGLGVHELSMTPRDLAGVKARLRAADMGALRALARRACEQEDAAAVRALDDKGGAA

SEQ ID NO: 3001 - protein, 304 aa, Methylobacterium sp.
VSPARSDADGTAGEAGFVLLTVLAVLGVVSAVLVAAILQGRSGAALTGARADVARLQGMADGLARLTAYDLGVRRTYRLAGLDLPEDGTVVRCRLDPQRTAFLSLQDQGRLIDLNATPRPMMEEAFRLLGVPDRTALAIAAEIVDYRDPDDVPEPGGGAELPQYRARGLSRGPRNAPFVSPDEIERLPAMTPETAAILRPALTVHNQGGRFDLAALIRRVRPAAVPSLPEAGGPVPSPRQYFRVSVVVAERRTRAGRSAIYGLGGTRTGTDFLDWLPTVAPEPASVTDHPACPTIAAALGTAGP

SEQ ID NO: 3002 - protein, 324 aa, Methylobacterium sp.
VLRHSARLLALVAGTLLPLSAAVAQEPAKAAGPAAVKADPRESPLVSTEWLEKNLDARKVRIVEVSVEPGVFERGHIPGAQNVVWHTDLVETVSRDIAGPEKFTALVRRLGIDRDTTVVLYGDNNNWFAAWGAWVFAQYGLVDNVKLLDGGRKKWEAEKRPLDTRSAEVAASGFTPAPASPALRARFGDVLAVARKERDEQILDIRSPDEFSGKVIAPAGVQELAIRAGHIPGSVNVPWGKAVNADGTIKSPAELKALYAAAGIDGTKPIITSCRIGERSSHSWFVLSRILGYQARNYDGSWTEYGNAVGVPVVNLAGTVWGGK

SEQ ID NO: 3003 - protein, 411 aa, Methylobacterium sp.
VTDRLAEGALPLPRTYAPAGSAARALPRRLVPAAIAAGLAGAAWWLAGEPGGTRLALSLTFGALFGFVLQRSRFCFYCLGRDFLVAGDPRGLLGILSALAAGLAGYAVVLGAWMPDPGGTRLPPDAHIGPVGPVLVLAGAVFGAGMAVSGSCISAHLYRLGEGSPTAPFALVGTALGFVLGFATWNPLYLASVSEMPVLWLPRHLGYAGSLAAALGLLAVLAWALLRHLPEPEPRPAVRLSPVRAVFTGRWPVWLGGLAVGAIGTLAYLRVGPLGVTAEIGGRSRQAAGALGLLPERLEGLDSFRGCATAVRDAVLTPNGLFVGGLVLASFAAALAAGQFRPARPTGGHVLRGVLGGVLLGWGAMTGLGCSVGTLLSGIMAGAVSGWVFGLAMFAGAGLTLWLGRRTGLLA

SEQ ID NO: 3004 - protein, 158 aa, Methylobacterium sp.
MPGEGARAPGRARGAGAGGAAGFTLVEMLVTLAVLALALTLASRSLGGIAAGQRPARLSGAIAGEIGLLRAEALRTGRSASLVFDAAGGRFLSSRPGAAPIPAPLHVTVEAAGREPGEIRLLPDGSSTGGRIVLRDAAARSVVSVSALTGRVRRDETR

SEQ ID NO: 3005 - protein, 129 aa, Methylobacterium sp.
MAARDDTGGEDGFTIAEVLVAFMIAALGTILALEIAGMTAGGVQRLERRRIAADESEGVVLRRVAAGALRPGLTRGRFSDGTAWMLGVSDARPALGLGRAPPLWRLRLTQDGPSGALLYTTLVPGDPDG

SEQ ID NO: 3006 - protein, 200 aa, Methylobacterium sp.
MVEERQAGFTLVEMLVCLALAALIGTLLVNAVRITGTASAAMSRAAAAEEVQSVRDHLRHTLGSLARRRAEGARPALLGGPGALSAVIGPDRSVERPAELVVALAAIDRADGGYDLVERRAAPDAPPEDAPDARREVLLERVAGLAIRYFGAPAEGMRPGWHAAWASPDRQPTLLEIEVTFAAADRRRWPPLLVALGDRP

SEQ ID NO: 3007 - protein, 159 aa, Methylobacterium sp.
MPSASWPAWLPVLLPLPLTLAAAAIDLRRRIIPDLLNLALLGLGLAVAAWADPDPPALVGRLAEVALAFGLFWALRALHARLRGRIGLGLGDVKFIAAATAWIGLVGLPLLILTASLAALAGVLVAHLSGGRVDRATRLPFGPFLALGLHAALAAERAL

SEQ ID NO: 3008 - protein, 444 aa, Methylobacterium sp.
MSASALSAADEADDPEVPSPAVGPSKPRLLRVLGPGLITGASDDDPSGIATYGQAGAQLGYGLCWTMPYTLPLMAAVQMVSARIGRTTGHGIAGVLREHYSNGLLQGVVLLLLSANILNLGADLGAMADALNLLLPGPRWLYVVLFAGICAFMQLVLQYTRYVAVLKWLTLSLFAYLGVVIFARVSWIDLGVAMALPRIDLSGGGLTTLVALFGTTISPYLFFWQAAEEAEDLHAYPRRRDLLHAPEQGGAALHRIEVDTLVGMAFSNLVALAIMVTTAAVLHPRGITDIQTSAQAAEELRPLAGPFSATVFALGIVGTGLLAVPVLAGSAAYAVGEARRWPVGFGRRLLEARAFYGTVALATLVGMIISLGAVDPIRALYWSAVVNGVIAVPVMAVMMLAATRSDIMGAFVVRGPLRLLGWIATACMLLAVLAMLATAALPLI

SEQ ID NO: 3009 - protein, 387 aa, Methylobacterium sp.
MNANVNLNDLEVGFDVPALPGMRMDDIQTPCLILDLDALERNIRKMGDYARAHGMRHRAHGKMHKSVDVLKLQMELGGAVGVCCQKISEAEVFARAGIEDILVSNQVRDPVKIDRLARLPRYGARVIVCVDDPANVVDLSEAAQRHGTTIACFVEIDCGAGRCGVRTTEAVIEIARAVDAAAGLRFAGLQAYQGAMQHIAGFEDRKVKLDAAIAQVREGVDALKAIGLDPELVSGGGTGSYYFEAGSGVYNELQCGSYAFMDADYGRIHDKDGKRIDQGEWENALFILTSVMSHAKPHLAIVDAGLKAQSVDSGLPVVFGRDDVAYIKCSDEHGVVEDLGGVLKINEKLRLVPGHCDPTCNVHDWYVGVRNGKVETLWPVSARGKAY

SEQ ID NO: 3010 - protein, 231 aa, Methylobacterium sp.
MKDGPVVAAVAALLGDPARANMLTALMDGRALTVSELAACAGIALPTASGHLAKLDAAGLIAAERQGRHRYYRLTGHDVAEVLEGLMGLAQRTGAVRARTGPRDAALREARVCYDHLAGARGVALMQGLVRRGWIDDPAAPALTPEGRAGLAGIGLDVAALERGRRPLCRTCLDWSERRAHLGGALGAAILDHVLARRWARRGAGRAVAFSPAGAAAFAEICGVAEGPDPR

SEQ ID NO: 3011 - protein, 129 aa, Methylobacterium sp.
MPLIRISLRAGKSAPYRAALSEGVYAALRATFGVPEDDRFVLVQEHGPDDFAYGAGYLGIARSDDLVIVQITCNDTRDLTQKRALYRRIADNLTHDPGLRPEDVFINLVEVKAENWSFGNGLAQYADRA

SEQ ID NO: 3012 - protein, 68 aa, Methylobacterium sp.
MRVAVLLFGVVLGVATIVWFFYLVPLGCAMNTTGCRERFTVWSGIGLLHFWAPFLVAISAVAYGAGRS

SEQ ID NO: 3013 - protein, 151 aa, Methylobacterium sp.
MRRSAPDPAIEARRRGEVPAETDPRIEALVHDIIGKVADKWTLLILEALEEHGTLRFTQLGRAVGRISQKMLTQTVRQMERDGLVRRTVHPVIPPHVDYALTPLGRSLGAAFCGVWIWAETHHAEIERARQAFADAGRSEVGPAPAETGGA

SEQ ID NO: 3014 - protein, 712 aa, Methylobacterium sp.
MPRQAPVPIPWRAARAAARLLGAARLALVLPILAIPILALPILAGPARAAPEAAPFADNADSVAVVIGNRSYKQTVPVDYAHNDAEAIRAYLVERLGYRESNVFVLKDATLNEFNQVFGTERNPQSGRLWRSVREGRSNVFVYYSGHGVPDLATRQPFLLPEDGNPNQGESGYSLETLYRNLDLVKRRIGPERQLVVMVDACFTGETGRKGESLLAVSAPGFAPARPKAESGIVRVVATSGATPANWDEPNKLGLLTSRFLMGVSGLADARDQQGDGDGQVSWAELKRYLAREVEEAARRASGRAQVPEVDDAPIVLKASLPVEAVSKGVASVRDEAAWRRAETLGTREAIEAYIGGCGETCAYRPQAMDRLLAGRRRDAAAIDQENWAKFGHTRQYQAYLDSCGEVCAYRGLAEGYLGGQNPSADPRVKRCDELAAGTDDPDRPNGVTGVRLGRIEASAAIEACRGASAAYPQLRRLAYQLGRAYDRADRSKEAFAAYDRAAKAGSVSAMNNLATLYENGQGVKRQQAEALRLYRQAGEGGNVVALANAARMLEYGNGVPKDEAAAVALYRRAVAGGDVASISKLVPHYATGAHGFPKDLRQGFDLFRQAADKGDPVAMATVATLIDNGFGRYFPGVRAADMVLRALKRGELGAASVSATDTAAQKLKPDTIRTVQRAVKEADYYTGALDGRFNPVFVRALDQYARANEVE

SEQ ID NO: 3015 - protein, 102 aa, Methylobacterium sp.
VSPGALAAPARAGRRALRVLALLVWLPALLFASGFALAHLTGCRVSEATTYPCEVGGLDIGGLLYALLMMGWLLIPLLPFMGLTLILVLRLGLRALYRAWRA

SEQ ID NO: 3016 - protein, 342 aa, Methylobacterium sp.
MRRMGRLDSIDDLRVFDAIVRAGSLSGAAQELDVSLTVVSKRLKRLEAQLGVRLLQRTTRQLGLTEEGQEFLGRCRMALDAIQAAEEVCGDGASGVVRVTATAGFAQRQIAPRLPRFLARHPDISVQILTSDDVLDLVERRIDVAMRQAPLADSRLIARAFVPDARVLCASPAYLAKAGTPRDPFDLAGHACLTVGDPAPSQWRLWRGEESVEIPIRSVAGGNDGEICHVGALADLGIAMKAAWDVADDVRTGRLVRILPDWWGGTDRWVRIVYPARLHQPRRVRAFIAFMEDEMTTSLAESADLGLFEAAALAKLQPRIDAVRRRPEPRRAESGLAEAKPA

SEQ ID NO: 3017 - protein, 90 aa, Methylobacterium sp.
MRRALPRLAPACLVLLPLAAPARAEDFTGFYAGVNAGYAFGRDGSRGLSLAPGAPGAAAPGNDLPPSAAGAARQMRSAPRAASDAPRLPR

SEQ ID NO: 3018 - protein, 514 aa, Methylobacterium sp.
MAEATEIRHSLEKIPLGGMVEAASGEAKVLFVRDAEGVRAFQAKCPHLGAPLAKGEICGGRLYCPWHKAAFALTDGGLEEPPALEALTRYPVRIEGEEAVAVLEPLARFSPAPRGEGTHVLVVGTGAAAVACVTSLRRLGFAGAITMVGREAHPPYDRTKLSKQFLAKPTPAEKTLLEPDFHAAHRVEHVHGTVARIEPEARRVTLEDGRALVADALVIATGSRAVVPDFPGADLDGVHTLRSLDDAVGLSAAAEGAKRVVVIGAGFIGLEAAAFLTKRGLSVTVLAREAVPFAKRFGEAVGAALKRYHAGNGVQFAQGTIARIAGAGRVEAVETEAGERLPADIVLIGAGAAPETGAIAGAPLREDGGVAVGPDLRLAPNVWLAGDIAAFPERASGESARIEHWRLAQQHGTHVARQILDGTGPFAGAPFFWSNQGDKRLDYGGYAPGFDRVVLRGSTDDLDFIAYYVRGERVTAACSIGRNPEFTAFLHLLGEGRAPSAAEIEAGTDPRALI

SEQ ID NO: 3019 - protein, 297 aa, Methylobacterium sp.
MIEAVMLWNEPNNKSHWDPELDPDWLLFAEMVKGAARAIRAVNPSLPRVLGGISPIDPVFIRHMAARGVLDHLEAVAVHGFPLDWNLWQIHEWPGKIAEIRAVTALPVWVSEVGVSSFGAEEVQAWGCGRTAELLKGQAPRIHWYSLYDLPREWEATTRHKEAEGSSYYRHFHMGLLRQDGTPKPALEEFARHTPDLGLCQWFHFEDHRLDAAVDWMKRLGVTHLRTGLSWADSFRPNALDWFDRQMAALRDFSVTLTFCFTPEHRGISPHHTSPPLDPAEYAAFCAEMVRRYAPAG

SEQ ID NO: 3020 - protein, 261 aa, Methylobacterium sp.
MSAAAPSPGDDRGALAREIAALAPWFHNIAIDGIATAPDHFLGDYPAVKWARFAHAIPQDLTGRSVLDIGCNAGFYSLEMKRRGAARVLGLDSDARYLAQGRFAAARLGLEVEFRNLSVYDVGALAERFDVVLFMGVLYHLRHPLLALDLIREHVAADLFVFQSMLRGSPAIEPLAEDYDFWEMDPFERPGYPRLHFVEREYAHDWTNWWIPNRAGIEAMLRASGFRIESRPEAEVYICRSAPLPYAPGAVYPARAAEGAR

SEQ ID NO: 3021 - protein, 200 aa, Methylobacterium sp.
VRQVFLLRHGSHDRLDRILCGRMPGVRLSETGLAEARAAARLVASRLDGGARPHLLASPLERAQETAAAVAEALGLTVEIEEALHEVDVGAWTGRPLAELHGEPAWGHWNAARGSARPPEGESAAEIAARMGALLDRFREDGPPVILVSHAEPIRVAGLALLGLGLDAYDSLALSPAGLCEVALWPGGGRLVAWNERSPA

SEQ ID NO: 3022 - protein, 365 aa, Methylobacterium sp.
VSIMARAPIRVGIVGVGNCASALVQGLRHYREAGPGDDVPGLMSPDLGGYRVGDIAVVSAFDVSASKVGRDLAEAILAEPNNTHRFCEVPETGVTVRRGPTLDGIGRYLEEIVPEAPERPGDVVEELRRTGTEVLVSYLPVGSQAATEHYAEAALAAGCAFVNCIPVFIASHPEWAARFREAGLPIVGDDIKSQVGATIVHRVLANLLRERGVRLDRTYQLNFGGNADFLNMLERERLESKKLSKTRAVTSQLGAPMPAENIHVGPSDHVPWLTDRKWAQIRLEGSGFGGVPLNIELKLEVWDSPNSAGVVIDAVRCARLALDRGIGGPLVGPSSYFMKAPPEQFTDAEARARTLRFAAGEAEPS

SEQ ID NO: 3023 - protein, 865 aa, Methylobacterium sp.
MNDLLAQFILEARELLELAGTGMLELEKSRSPDALNDIFRAVHTLKGTSGLFDIAPLTHLVHAAEDLLVEMRAGSLDLAPEIVDGLLDSLDLVGHWIDALETRESLPTDAEATMVARVAALRRWLAPEAGADASGQSTRSADAAPAWIAELPEAERRACYRAALVSGAPLAAWRYRPDAACFFRGDDPAHLVAGSPGLLAVAARTREPWPDPASLDPFVCALEFHALAAATPEALAEHLRYVTEQVEIAAIRPDDLAVPVGRTDPAEMFSDFSMQARALLAAGDRTALVQSAGALLAIVADDTRQASALRWLAEAVEAGGDADLLAHLVAAVGSLADEVAPRPAREPAAASGLADETALRILASQAEMLASPVEPGLVAGRLESALTVLRRCLPHLGEAGAALGPVIAAAARDGDAAALLAALAAITAATAVPETGRPELVSGTAAAEAPPARLEPASLASTPVPGSAEAADGKGPTRMLRVEQGKVDALMNFVAELTVAKNGLAYLAGRAEQVSGSRQLGREIKEQYAVIDRIAQSLQVGVMAIRMMPVSQVFQRFPRLTRDISRKLGKEVELVIQGEDTEADKNVLESLADPLIHMVRNSLDHGIEMPADRRQAGKAPHGTLRLSARQENDNVIIEVADDGRGIDPAAVRDKALRVGLITPDQAAQMSPEELVNLVFAAGFSTKEQVSDLSGRGVGMDVVRSAVRKAGGDVWLASRLGQGTCVTVQLPLTMAVTRIVTVEARGQQYGVAMEAVAETVKVPRGQIHRIKQRETFVLRDAVIPLVRLAGSLGLPAQAFEPPDEEAVMVVRIGRERVGIVVDGFRERMEVIVRPLDGLLSGLSGFSGTALLGDGRVLLVLNLPDLV

SEQ ID NO: 3024 - protein, 366 aa, Methylobacterium sp.
VSAGEAMPGGDRPVLITGGAGFIGANLADRLAGEGRPVVVYDALARAGVAANLAWLKARHPGRVTAVVADIRDAGALARAVREAGACFHFAAQVAVTTSLADPRADMEVNIGGTLNLLEAVRALPRPVPVLFASTNKVYGGLPDIVLREEADRYLPEDEAFRVQGVGEARPLDFYTPYGCSKGAADQYVLDYARSYRLPAAVMRMSCIYGPRQMGTEDQGWVAHFLIRAREGRPVTIYGDGRQIRDVLHVRDAVNAYCAALGRIGAVAGRAFNLGGGPANAVSLLAFLDHVERLTGRPVARAFRDWRPGDQRYYVSDTTRLRAALDLPPFTPWREGVADLFRWLGETRSAAPARSRTAAALAGAAE

SEQ ID NO: 3025 - protein, 431 aa, Methylobacterium sp.
MRVALVNPSWDYRNSIYFGCREPHLPLELGYGAALLEAAGHETLTVDAHLEGLSHAEAARRVAAFAPGMTVVATAPTYLFWRCAPPELRVPRDFLDALGTAGGRTVAVGPHGSATPGPTLAKLGCDAVVRGECEEILPRLAGADDLARVPALAYRRADGTPALTGGPHASRFTDLPALRWPEAWIARHRHHHHRFDVEPDGPGAEVEASRGCPYTCSFCAKIDFRDRYRKRDLGILLDEIDGLIRQGATYLYFVDEIFLPQAPLLDALAARDIRFGIQTRIDLWKPDLLDRLGAAGCVSIEAGVESLTEEGRAALDKRCRASTDDLAERLIHARRTVPFVQANLIAVAGDDADMVAAWRERLRAQGVWANDPVPLYPYPSSPDYRRLWGEPDDEAWERAHAHYLGQFERFSDIQAERPLPLRELEAACGCQ

SEQ ID NO: 3026 - protein, 376 aa, Methylobacterium sp.
MRIAYFTHSLESCWNHGNAHFLRGVLRELIGLGHAVEAFEPEGAWSLANLLADHGPAGLDAYRAAYPELAATRYGAVEPVVERAAGADLVLVHEWNEPALVAALGRARAAGARFTLLFHDTHHRAVSAPHEMRRFDLSGYDGVLAFGETLAEVYRGWGWGTRVFVWHEAADTRLFRPPPDESAREGRREGLVWIGNWGDGERTEELDAFLFGPAREAGLPLDVYGVRYPESALATLVARGARYRGWAPNAAAAGIFARHRATVHVPRRFYVERLPGIPTIRVFEALACGIPLASAPWSDAEGLFTPGADYLVARDGAEMTRHLRALRADAGFRAALAAHGLATVRARHTCRHRAEELLAIVAGLRLPAPRSLEATA

SEQ ID NO: 3027 - protein, 371 aa, Methylobacterium sp.
VRIAFYGSSLLSAYWNGAATYYRGILSALAGHGHRITFYEPDAFDRQSHRDIDPPDYAEVVVYPATEAGLRRVVAAAADADVVVKASGVGVFDTELLDGLLAAANPGALLIFWDVDAPATLAEMRADPGHVLHRALPQLDRVLTYGGGPPVITAYEGFGARACIPVYNALDPATHHPVPPDPRFAADLAFLGNRLPDREARVERFFLVAAARLPERAFLLGGSGWETRGLPPNVRAIGHVGTRDHNVFNTGPRAVLNIARDSMAAVGFSPATRVFEAAGAGACLITDAWEGLDLFLKPDAEVLVARDGRDVADHVAALTPERARAIGEAARARVLAGHTYALRGVEVDKILRAAAAEKAERGVLSLERSTA

SEQ ID NO: 3028 - protein, 351 aa, Methylobacterium sp.
MTKLLIVDDSALMRKHLRTVFEEAGTFEIRTARNGRDALEQIGAFEPDVVTLDVNMPEMDGLTCLGEIMTSAPRPVVMVSSLTSESAAVTLEAMQLGAVDYVEKPGGTVSLNIDAIRREMVEKVRVAARAKPRRARGLLDRVRRTRTAPPAAPRRTAALGRTEGLVLIGVSTGGPRTLEEILPELPADLPWPVVVAQHMPGSFTGPFAQRLDRICALDVAEVAGPTPLTPGRVYVGRGDADVVVERKLGRHVVTCVPTDPQMRWHPSVERLVRSARAAFPPEALVAVQLTGMGNDGAAAMAELRKAGGRTIAESEETAVVFGMPAELIRLGGATVTLPARAVPAQILSWLS

SEQ ID NO: 3029 - protein, 569 aa, Methylobacterium sp.
MAQLLAVVGGADLPTHAVLALEALRKAAGRRNQPIALELHGANSGNPLPETAIGEARAVLLVGSGDLGEGRFGPLATARAAIEEVLADAGAVLDRALAGAPASAATPAGTRRIVAVTSCPTGIAHTFMAAEGIQAAGRALGHDVRVETQGSVGARDALTAAEIAAADIVLIAADKGVDRARFSGKRVYAAGTKAAIRDGKGLIATALAEAQMQPAGGAAETEGPARPAAAEARAGAYKHLMTGVSFMLPFVVAGGLLIALAFAVGGIDAMAPGNAGTLGYALAEIGAKAAFALIVPALAGYIAYSIADRPGIAPGMIGGMLAANLQAGFLGGIAAGFIAGYTAAFLNRHIRLHRNLEGLKPVLILPLIATAITGLLMIYVVGVPVAAVLAALTGWLKGMQGASALVLGLILGGMMAVDMGGPINKAAYASAAALLSSGVDAPMAAVMLGGMTPPLGLALATRLFPARFTAPEREAGGAAAVLGAAFITEGAIPFAAADPLRVIPAMVAGSAAAGALALSLGVTLKVPHGGLFVLPIPNAVTNLPGAVVALVVGTAITAVLVGILKKRAA

SEQ ID NO: 3030 - protein, 316 aa, Methylobacterium sp.
VSPILTLTLNPALDQTVVLDALVPGSVHRAQAVRTHAGGKGVNVACCLADWGLPVAATGVLGSDNAAPFTQLMAQKGIADRFVRIPGETRTNLKLLDESSGDTTDINLPGLAVSPDTLDTARAVLLDMAGSGSLAVLAGSLPGTLPPETYRDLAARLRARGARVVLDASGGPLAAALAAPADALPYAVKPNRHELEEWAGRALPTLADLLDAARGLRDRGIPVVAVSLGPEGALFLTEAGAVHARPPATRITSTVGAGDALVAGLVAGLHEGLSPENIARLALAFAAAKLAREGASLPPRAEVEAIAATVGVEALG

SEQ ID NO: 3031 - protein, 216 aa, Methylobacterium sp.
MTRLDRQQHVLDLLVPQLEEDGYSVFIQPPRSLLPKFMAEYRPDAVAMGKPKNLAIEIVQGEAPAARLGSLSERFAGRPDWELRVYYYQPDRDDEALPPPGREAIEAAAATVEGLVAAGQPEAGLLIGWSALEALGRFLLPQKLRRPQTAGRLLESIAQAGVVTPDEAERLRALQAIRTRVAHGDLGASVRPEQVADLVAILRAALAEAGPVEAAP

SEQ ID NO: 3032 - protein, 97 aa, Methylobacterium sp.
MSWQAKRAAAKLRWKEHVREASSVGLPDGHFATEGRLAVTLFYFPAAREGGDVDNIVKLVLDALVGHIYLDDAQVERIVVQKFAPDLPSPSSRRMAS

SEQ ID NO: 3033 - protein, 290 aa, Methylobacterium sp.
MRFSSKAKPGADLAALRAEIDRIDAEMHALLIQRGTIIDRLIAVKGTTASGSAFRPGREASMMRRVAERHRGLLPLDTVEGIWRVIIATFTYVQAPFSVHADVSAGDPAMRDSARFHFGFTVPYRPHPTCAAVIEAVAASRGDLGIFRFESRAPKGAAHPPKGEAWWEGLIGEGRPKVIARLPFIERPTHPAGTPVFVVAKPLDDPTAAQRDWVLYAVRAEAWPDEAERALHDLYGEVVGRAKPRGETERLLLALPGGVGARQLREALDRAGAGVTTLDETGSHAARFRV

SEQ ID NO: 3034 - protein, 122 aa, Methylobacterium sp.
LSETGGLARTLRHRQTAAEARLWSALRNGRLNGWKFRRQHPVGGAVADFACVAARLVVEVDGATHGTDAERSSDARRTEMLMRCGFEVLRIDNDDVAMNLEGVRETILMERGSPLPCGRGTG

SEQ ID NO: 3035 - protein, 203 aa, Methylobacterium sp.
VKRDASAVPPPPSAGEGGPRRGSGEGNPASSKDAARDDGRPAKSAPHLRAFAREQRQLRTKAEDAFWQQVRGGRFRGLKFRRQVPIPPYIADFLCASARLIVELDGAPHEAAGRRDRDAARDAWLRAQGFEILRFPNDLVLGNLGTVLDAVGAAVAARQGRDLSDTVAPLSAGLRPGRPGLTAGPPSPAEGGGKARRAGSPLP

SEQ ID NO: 3036 - protein, 203 aa, Methylobacterium sp.; identical to SEQ ID NO: 3035

SEQ ID NO: 3037 - protein, 432 aa, Methylobacterium sp.
MSSSITLSAATRQNLLSLQDTAALASTNQGRLSTGKKVNSALDSPVNFFTAGSLTDRSSSLTGLLDGISNGIQTIQAANTGATKIADLMKSLQSTIAQAQSEAAANRPTVTGSALATAAQAKAAGTSLRTTVMNMALGGTKADPSESAAGSVGIAGDKVAVTLTDGENTFTKTLDKTATVGDLVNAINASGLGSASVDDAGKLTVTGNSDTLKVGIGGGADAAAALAKAKDGDGNDELGLTAAAYTTGLSSNKTSAARTSLATQFNDLRDQVDQIAKDSGFNGTNLLGGDALSVIFNEKTGSDQSKLTVTGRKLTADSLGISKAVNGTAGAGEFDIQTDKGLAAMQDTLKTALASLKSLQSSLGSNLSNVQVRQDFTKQLSDILNTGAANLVNADMNEEAANSQALATRQSLATSALSLANQANQGILQLLR

SEQ ID NO: 3038 - protein, 243 aa, Methylobacterium sp.
MQRTLPAALAGLAALTCAAGAADLPRRAVPPPLLPSLPVFTWTGLYVGVNAGYGFGGGGGFTDPAYGTVTGGGGRGGFVGGGQIGYTYQLAPGAGWVLGVEADIQGTAFGKADAAYLGTTPYYGVRPSLDTFGTVRGRVGYAFDRVLIYGTGGFAYGDGARGAHAAAYPATLPERFRTGYAVGGGVEYAFTEKLSAKIEGLYVNLRRSFSGATFYDAGTAAYYGGGRDPGAFGLVRAGLNYRF

SEQ ID NO: 3039 - protein, 149 aa, Methylobacterium sp.
MIAAVTDRPVRGINTIVLSDGWEIHLDDVATSAEGQAILDDVDQGIDAIERQLTSGTGPNDPDWRRRAELALKRKRRSRPRIQQRIGELRRAERQAAPLPSGTTSPADGKRKAFVKAAYEVLGHEVCTEVWARAQEMRPEIFTDGQVPA

SEQ ID NO: 3040 - protein, 88 aa, Methylobacterium sp.
MTTTTKAVILMLVGAGLLGAAHPVRAEEAAPRGNQEFVGVDLDTGGVYYNGRNSGRYCLYRTVDVFNRYTGYVEARRVRRCGRGLYLP

SEQ ID NO: 3041 - protein, 95 aa, Methylobacterium sp.
VSDEARLLAEIHAARALMRAGARAEAAARPGHAALWAHATRAPGAPIDLAVARALRSDADTARRYRLMLGAQALAHAPLAAAASDGALARRRVGP

SEQ ID NO: 3042 - protein, 403 aa, Methylobacterium sp.
MTLRTILIVVPTTAGPLRLRSLAPRPGLPAPAAFADGDYRPLPWSGDYARLCAAGGPLSRLMTEGALPPHELRLTGSFDAGRSWEVPVCLAHGLVARGYRLAAEPARADLILWATGAVDLDLAVLPGDYALIDKIERSRTLLAEAPDAALMVLLPEGPERSRAEAAFRALGRVPHVLPAETVPAALAAALASLARPAAASPSVASMLRRRPRLALSAGAVVGLGLAAVVALGARHAPVSGPAGPPAGEPRPSDAAEPPPPPRPSEPARAAAAAAPPGTDPAGPPGIRVEELRATSGSSCRRVAFGADPPERRPVPVEAGERLVPTRLAPDLCGLAVRATGMRVTVGPELRAAALPPVRLADGADAYFLREGARQNLVYAVQALPEAGADAGTPGSRLVHALTR

SEQ ID NO: 3043 - protein, 330 aa, Methylobacterium sp.
MTPIRPRAPNAAVAAGLLVALAAAGPARAQSVGFDPADYGRAQLPSRQTTGDAAAYVDQNKGAFEPIAELDPKDGLAALARPIGRVDIVLKNARTGQQVGASCTGALLPGDYVLTNHHCLPQGGDLTPVKASILMDYLTLDGKGSRRFAIDPKPVEHDARLDYALARVAGNPAATYGTARLSGEAVPGNRSMLVIHHPLGRPKVMSRFRCFALKEQAEGVDLRHRCDTLGGSSGSLMFDASVAGIALHKEGGLDPKDPTSFNSATRLSAILGRSPILARIAAAQGRPVAAADPAPQPGPRPGQPPGPPPAAQPADGPLDPGRMNAILRGR

SEQ ID NO: 3044 - protein, 325 aa, Methylobacterium sp.
MPLVRAPAFRAAILAALLSAGLACLAGASPVQAQARGSAKPNIVVMGEDADEDSVPRGNRIFQRVITELAETMNLRGYNVYDETAVAMGFTQANRVRRRDAELIEVARAVQNPPLDVVAVFQIYAAASKSAYSDIVRPEVRIPGRLLNVRTGQSLGAFEVAGVQLPPLPQGCDRECLLERVGTEAKTVAGDVAAALSAKLDGVIAPRRADAGAPPPDTAAPTPAPGAVAAPGEGCGGLPSAYVVRLNGFSAQEVQAAEEYMAAFRCYEHHRPVRSSGAGAEYWYETRSDSARLGRNLRLMLEHMSAPGQVQFSGNTFVISRVATR

SEQ ID NO: 3045 - protein, 322 aa, Methylobacterium sp.
MTDLTRRHLAAVAPLALLGASTRAVAATSGLEAATHYRFALGAFTVTMLLDAAGLIDGPWPIVGEDRPRAEVEQLMRENRLPPDRFQPGFTPVLVETGRERVLFDTGNGAVGFVPRPAGGRLAARLRAIGIEPETITHVVLTHCHTDHIGGLMEEGRAVFPRATLVVGAAEFDFWRAPERLGVSPEDYAYRSAQVFRSHLLPLSERARLVADGAEIVPGIRALAAPGHTPGHLAYHVESGGKRLLVWGDCAHHEVASLARPGWHALFDMDKAEGARTRERIYDMAAREGLLVAGYHTSFPSLGYVVPAGTGYRWIPVTYQLL

SEQ ID NO: 3046 - protein, 368 aa, Methylobacterium sp.
MRLVVLGLSLSSSWGNGHATTYRALLKAFAARGHDVLFLERDVPWYAAHRDLAQPDFCSLALYPDLDALARHRTAIAEADAVIVGSYVPDGIAVGDRVLAWAGGTRAFYDIDTPVTLAALEAGTCAYLGPRQVASYDLYLSFTGGPTLARLERSYGSPAARALYCSVDPQAYPALQRAARYDLGYLGTYSPDRQPALERLLLEPARRAPDLRFAVAGPQYPADLVWPDNVARIEHLAPADHPAFYAASRYTLNVTRADMVRAGWSPSVRLFEAAACGTPILSDRWDGMADVLEPGHQILTPEGPDAVLEILRARPETERTAQADAARARVLAHHSAACRARELEDHLAGAPRRAAGPARPADLACVPG

SEQ ID NO: 3047 - protein, 259 aa, Methylobacterium sp.
VRAGGAAVTARVIAVSNRKGGTAKTTTVVNLAAALGSRGARVLVVDLDSQGHAGLGFGVRAAPGDTTVHDLFQDPGTSLADGVRRSAYANVDVLPADRSFAGVSAVTPPLGLARALAPLGPSYEAILIDTSPSADALLVSALAAADHVIVPTLLHHLAVDGVGQFARSYLRVASGLNARLRGLSLLPVQVDLRVTMQREAHAQLAARFGTERMLTGIRPDVALAEAFGQQQPVKYYRPRTRSAAEFESICDHLRDVILH

SEQ ID NO: 3048 - protein, 140 aa, Methylobacterium sp.
VLVAEPQALPGMWLEDVLADAGCAVSGPYGTSQDAAESLDRKPPDFAVVSVDLNRGSGFPLACALRRRGIPFALIAGNARVPGAFSDVPMFDRLFDARDMVSAVAGRCRVPGCPRTCPMLGRIAAGEEVALDQCPTACRA

SEQ ID NO: 3049 - protein, 237 aa, Methylobacterium sp.
MTRATAPAALAVEGLDQHYGSAQMLRGVELAIEPGACLAVLGRNGAGKTTLLRCLTGLIPASRGAVRLDGTDLTRLGPDRRARAGLAYVPQGREIFPDLTVAENLRVAARAHGLERTDAVDESAALFPALRDLWGRPGGNLSGGQQQQLAIARALATRPRALLLDEPTEGIQPSIVAAIETVIAGLKGRITVLLVEQYLDFALSVADAVVVLSRGSVVERGARGTLSHADLSRHIAV

SEQ ID NO: 3050 - protein, 113 aa, Methylobacterium sp.
MRRSLHTDEEIAFLLGEAERGISIAEICASAHVSLGTFYRWRRRLGGLKPAGVARLNRTEQENAALRAEVQRLRAALAARSSPADRTSSPRPGPRHRGAEACIGRFAFVRTAN

SEQ ID NO: 3051 - protein, 236 aa, Methylobacterium sp.
MSALVVDALTVAFGRFRALDALSLAVDPGEVRAVIGPNGAGKTTLLDVISGITKPVSGRVMLGDRLDLTRISEAAIARAGVRRKFQKPSVFPALTVRENLAIGCGPELRPDQRAARIAAVLGEVGLGSRAAVPAGTLAHGEKQWLEIGMVLAAEPRLLLLDEPVAGLSDAETHRTAELIGRLRRPDRAILVIEHDMGFVEAVADTVTVLHEGRTLYEGGMRGAREDARVIEVFLGR

SEQ ID NO: 3052 - protein, 66 aa, Methylobacterium sp.
MAGERGDPETTVPEEADSEKTGGDTESGMARPSLWKRLKPLHDRIAARPSSGLLADKAFYDSLNDE

SEQ ID NO: 3053 - protein, 164 aa, Methylobacterium sp.
MPTIYEAHSFAALAHAGQLDKRGQPYIRHLERVANLALARAGHARSVDRLDIDPQMVMQVALLHDVLEDTPREAADLRAAGFSEAVVAAVRVLTKPAARIPYAERIDGVIARGDLAAILVKMSDNEDNLAPDRALPEAGFLRERYAASFARLKAAAGALGYTGR

SEQ ID NO: 3054 - protein, 59 aa, Methylobacterium sp.
MEPDEAAPGTVEAWEAIAPIRPDTAHVRAPRFLDVAGELLVGFLIVAGGVLAYGHLPVA

SEQ ID NO: 3055 - protein, 85 aa, Methylobacterium sp.
MATPPLAPRPAKRRPFTGFYAAPSPTLMPDEAAPGTVEAWEATAPVRPDTAHVRAPRFLDVAGEMLVGFLIVAGGVLAYGHLPVA

SEQ ID NO: 3056 - protein, 264 aa, Methylobacterium sp.
MTYRKSLAAALVATTVLGGAALAADQAVAPAAIHETAAQKAAGTEAGKLSKDGAQAFRDMHLARVAIFDADPSQAKDLIGKAQAALTKAKTDEAVFMKAEADLRSPADMHAAAKGATNKAAADAAGQPAAKDKVAWLPVDAQLTLGEDFVATPEKAAAVTDANTSLRKGDKQAALQKLKLAGIDVNFTMAVLPLDKTTADVNQAATLIGQGKYYEANALLKTSEDRMRFDVVDAVAVPKATAQATGTKTAPDKTGTTQGGSPAK

SEQ ID NO: 3057 - protein, 69 aa, Methylobacterium sp.
MTNREMVKGALEHGDAGQHPNDKALPPMPAPEDSPTPTTREEPIDSPQPNASAKRRPPEAGEMGLTTRR

SEQ ID NO: 3058 - protein, 425 aa, Methylobacterium sp.
RATAALTPFLDAVAACAGRPDLTLAVVGVEPGQTALSREQAEEVRLAVESRLQATGRVKLAAAADVVRIKALSEGTTGLSGAEAEAQIRAAFSGDASVFLVEARRAGETAALRLQALTRSASCKATSEPVIVPIRVGAGVADVDAVMEGAVEAFGQAAPGAGAVEVCPFVAEGGHSTCAGALTDRLLIALDAEARSANRVLKGARLDVRRSPPGTACTGPVTARGRFLTDRDRRSWMEVEFQRDGAVIAPTGRRRIGIEGLGCDPTPRPFLDHLAATARTDAGRLAVAAAATPFAPGQRLDLRIESRARQSLYCWVVAPDETAFVALPVRGNGASLAPLKPGEAKRYPRGYGLDEIVAGEPFENLFACFGVEGGLPPELAARWLAAAPGADGEARLLQPPDVLDLLERIRATPGVTEATARIVVR

SEQ ID NO: 3059 - protein, 462 aa, Methylobacterium sp.
MSGGYDERCAADLAGVGEGRDLSRADRAWLARVVAGAVRPNRDKPLWDLAHALAGLARATGARDGRGLVTLALDPNLATAGAVEARFAGSDAADARGLVLDGGWRTGWAGLARLLALAEFVLTAEDLAQFAAVTGWLDELAAAPDPEGAAFLAKRLARHLAAYRNAHLPLAPLERRFRALLWFLGGRRAFADDDILAFWRAEMAAGERPGFRTVAEHFVTFEAGAQLLGGLDGLAAPASLDAHAGWEERLDAALADLVAAEPAETLAGLLADWPEGPKILTGAEREDLADFLRLDPFHRTRPLTTLRAASFGRVQSGIANRLRRGGGGADIAERATCAEAESYAALAARAGALAVHLGRMLRIAAALRVSERDGLGPEARAVLDAAEADLRRVRRAGFEDRVALAAGFAAAEAALLRVAAEAERLDRALGVLGRQRPLDAAFAADRAVFAESLAAAYAGEAA

SEQ ID NO: 3060 - protein, 182 aa, Methylobacterium sp.
MSVDVGERLRFVRMRQGLSQRTLAKRAGVTNSTISLIESNRVNPSVGALKRILDGVPIGLAEFFAVEPARERKAFYAAEELTEIGKGKISYRQIGETLFGRQLQILKERYEVGADTGRILLSHEGEEGGIVLSGRLEVTVGDERRILGPGDAYAFDSRRPHRFRCVGPAPCEVVSACTPPSF

SEQ ID NO: 3061 - protein, 197 aa, Methylobacterium sp.
MALVRPKLDRVAPTASPSVPTLDAASAAARRQAARARAADPGAADALAARLGVESDDSVREALLAALGTLGTPEAVAYLFALLDSEDVWLRNAAIETLQGLDAAVLDALERSLEHPDSDHRIFAVNVLTSLRHPAAADLALRVLERDAHVNVCAAALDVLAEIGRPEMAPAIAGAVERFADEPFLRFAAKAALRRIA

SEQ ID NO: 3062 - protein, 123 aa, Methylobacterium sp.
MARILVVDDATTVRMYYRDVLEEAGFAVDEAANGFEGLEKAMEQAFDLVLVDVNMPKMDGYAFLRQGRAMSELQAVPAVMISTESGPEDRARAYAVGANLYLAKPVRPDTLSRVAALMAGGTR

SEQ ID NO: 3063 - protein, 128 aa, Methylobacterium sp.
MTAPSPRRSGTLALGSLLAAFVGSPVMAGGIEDHRVRGWTIATQLCSQCHVIGRGSQAGEFSGPAFLRVANMLSTTGPALAVFLQCHHERMPSLRLDRDEMDAVTDYILSLKGPQPHVRESGTFTERP

SEQ ID NO: 3064 - protein, 79 aa, Methylobacterium sp.
MADVHVAEELWTTGMLPEGIVERWLVADGARVKAGEAVAAVRIGEALHDIVSPASGRLAVLAPASEVVDPGCIIAEVHA

SEQ ID NO: 3065 - protein, 96 aa, Methylobacterium sp.
MRGFALGVLLAASPAAAQPRPDVTAMTCAEAGALVARSGAVVVTTGPATYTRVVRDVSFCVIEKSTRPDFEQTRDVPNCFVGYRCVDPFSEGRDGP

SEQ ID NO: 3066 - protein, 69 aa, Methylobacterium sp.
MTMTRTPEMTAAPATLSFLTAVKRIEALTQEIRREGLSAFEKAETAYAEVQDLRAILNARIADLRRRNA

SEQ ID NO: 3067 - protein, 69 aa, Methylobacterium sp.
MSNEDTGTMSHPPETSSFLAAVKRIEALTQEIRRDGLAAFEKAEAAYAEVQDLRAVLNARISELRRRSA

SEQ ID NO: 3068 - protein, 499 aa, Methylobacterium sp.
MMPTPSPAPRPILDTIRTGSGRALVGFLWFNAALVAATNLAWGSAQVPTTLGGAVVLAGLPTWHYLRNPTGRTTRIASSIALAGLVAMLVAAFRQEGGGQTLQVDLHMYFFACLAVLAAWLDWRALVAYAAVVAVHHLGFSLLMPSLVFPNGGGLGRVALHAVILVLQTGVLVWLVARLQAGLAASEALQRSESDRSEAEVLREEAEAAARREAERGAQARQRIEAFRVAVAGIVGAVEGALAALEASAAGLGGFAERTGQEATRATDGTVRAVATIAATTEACRNLVQAVDEIGRHLAATDAITRAATEDARRTGETVAALTGAVERIGSVVATIRSVADQTNLLALNATIEAARAGEAGRGFAVVAAEVKELAGQTARATEEIAGQIADVERATASSAASMRSFAGRIHEIEGSAAAIVAAVDRQRGALRDMDAHVAATAREAEAASGHVRAVSGVLHTTSEIAGSVQDATGAVRGQVESLRGVTAGFVRDLDGLAA

SEQ ID NO: 3069 - protein, 279 aa, Methylobacterium sp.
VSAAVFAAVLAAACMHAGWNALVKLRLEPILTMALIAAAAGLIALPALVWLGLPPPAAWPWLCGSIVLHLGYYVALTEAYRQGDMGQVYPIARGSAPLLTTLASLIVLGEPVAPLAAGGVAILCLGVGLMAFGSRSRRLEPRALAFAGLTALMICGYTLVDGIGARVAGDAHAYAAALFVVDGIPLAAFVLWRRGTGVLRQIRGVAVPGLVGGLFSLGSYWIAIWAMTVAPIPLVAALRETSVLVAALISVTILREPLLAARAVAALVILVGIAALRLG

SEQ ID NO: 3070 - protein, 342 aa, Methylobacterium sp.
LRDIALFVEVAKRQSFSQAAAALDMPVSSLSRRITQFETAIGLRLLDRTTRKIALTAYGAAYLAQATRVVEEAQRSFDELVAQAKGPSGFLKIAVPTDYWAVRHLSEIVSAFAQQHEHVHVHLDLRASQVDLVRENYDLAIFTETPREASLIVRKIAVIENGLFAAPSYLQARGRPEEPCDLARHEILMPTAAESTTWQFRRGTETVPVTVSGRVSCNSLSVARRLAITGRGIAAVSVVNVERDLDRGRLEPVLPGWSIPPTSVYIVTTSRLIPAKVRRFIDFLTQSLSALFSEVPSLADRIAPPSAAGIRAAAAGAQGWPAARRSHRPLGATECRTASRSD

SEQ ID NO: 3071 - protein, 329 aa, Methylobacterium sp.
MGGKRALITGVTGQDGAYLAQLLLQNGYAVHGVVRRSSHAGIFDHRLRWLGIADGVALHDGNLLDLSSLARIMQDVQPDEVYNLAAQSFVTASWQQPLLTGHITGLGAVNMLECVRMLRPKARYYQASSSEMFGLIQERVQSESTPFYPRSPYGVAKLYAHWMTINYRESFGLHASNGILFNHESPLRGVEFVTRKVTDGVARIKLGLANELRLGNIDAQRDWGHARDYVQAMWMMLQQDEPGDYVIATGRTTTVRRMCEIAFRHVGLDIDDYLVIDPALFRPAEVDCLQGDPAKARAAFGWQARITLEAMIEEMVDADLARLRSGQSH

SEQ ID NO: 3072 - protein, 210 aa, Methylobacterium sp.
MTTLSILDLDAVRAAPVAREPYAWTLGQNVLRPDAIPAIRDDFPDIAKPGYLTVDEVALKGRFKALIDELESDDFSRILGEKFGIDLVSCPRLTTIMRRSQPKYGSIHTDGPSKVLTLLVYMNDAWDAPAAGRLRVLYDGKNYEPFAVEVPPTMGTMFAFLRADNSWHGHEPFEGERRVVQVAWLKDASELERKKKRNRTAQFLKGIFGR

SEQ ID NO: 3073 - protein, 85 aa, Methylobacterium sp.
MPAMNDPSPSPLYIPDHPAAVRLPRALERAGLWTIGTVGGLATCGLLVFAVATQSSADAERIAANSDYAAGLVAALATAQARGGR

SEQ ID NO: 3074 - protein, 402 aa, Methylobacterium sp.
MSHLANIAAKVLNRPLLLHPGKLAVVAAVLEGRIGIDAAGLAPDASRFVGSAVDADPATGTRGGLPYRRTAEGVAIVSVLGSLVNRGAWIGASSGLVSYEGLKFQLATAATDPRTKSVLLDIESPGGEAIGAFEAADIVRQAAARKPVVAVVNGMACSAAYAIASGATRIITTPSGISGSIGVVMLHADVSGALAKAGVKPTLIYAGRHKVDGNPYGALPEGVKAELQAEIEQFYSAFVACVASGRQNLSAAAVRGTEARTFLGAQAVAAGLADAVGTFESALADLTAGRITTTTSQVHPSMSTPTRAQGASASAMWDDIAAEINAKLPPQAVFAQQGAPGVAAGAMQADQATASHAAPEHRPTAGQPPSSGAIDWADIAAEMKAKNPNAVQFSRAEPPYHG

SEQ ID NO: 3075 - protein, 225 aa, Methylobacterium sp.
MPVTIHAVPGGSLSEAEVARWRAVPVAVAADLARGADQIDPAIRPLNPPGRQPRLFGRAVTALCEPPDFGAVLHAVERIGPGDVLVIAAGGRAETAMIGEIVGGHLRRRGGAGLVCDGAIRDVGVLAGWTELSVFTLAITPRGPASAERGAVNAAVVVGGRLVAPGDLIIGDDDGLVALSPATVRARIGDAEAKLAREAEWEASLAAGRSVCETFGIAAAIGGAA

SEQ ID NO: 3076 - protein, 188 aa, Methylobacterium sp.
MPPTYVTASGMPRYNGIAQALHWLTALLVAAVLPLAWVATSLARDAPAKGDMFVLHKSVGLTLFALVVVRIVWRILHPAPPEPRMPTALAVLGRINHWLLYAVFLIMPASGYLLSALAGRATPYFWLFTVPGLPKDEGLQKIFQSVHLAGQWAVYLLVGLHILATVWHVAIRRDGLHERMMPVQDQVG

SEQ ID NO: 3077 - protein, 334 aa, Methylobacterium sp.
MERLSMNPADLAAHAHQVLQEADIAELPNRYRGKVRDNYDLADGRRILITTDRISAFDRALAAIPFKGAVLTRTARFWFEHTTDICPNHVLAYPDPNVVVAKRLDILPVEVVVRGYLAGTTSTSILTRYRAGERTMYGHSFPDGMRPNERLPQAIITPTTKAFDGGHDEPLTEAEILEKGLLTAEQWRTVSEAALALFARGQALAAERGLILADTKYEFGTDADGRIVLADEIHTPDSSRYWFAESYPERLAAGTSPESFDKDFVRNWVVARCDPYRDPIPEIPAEVVLGTAAVYIRAYETITGDRFALPDPAEIPLERVRRNLAAAGLLGEPA

SEQ ID NO: 3078 - protein, 336 aa, Methylobacterium sp.
LPDEAPPVPVTCDPQAIAEARNTLTELEPFFAIVDLQLRSIVAQTEEAAEGLLTQLRTLDDALADATAFIGTTRQRMGGLVEHGDTAYAALAAALQAYLATRLAETRSEREHLAAIADQMKELDGLTHVLEQVGNATNMLALNASIEAARAGETGLGFGVVARELRTLAQRSRTAVADASGKVSAMKDSIEGNLLAARTEARTKAEQASIERLLAEVAALSEAFAAVGAAQAELGAIDDRNHTITLQIMQAVGRVQFQDVVRQQIEGIGVAMGLLHRILDDQRDALTGMQTARSATPAMLMERVRSGYVTQIQHENDLRARGQMSDAAALPDIELF

SEQ ID NO: 3079 - protein, 322 aa, Methylobacterium sp.
MPNALLDRRVVALAYDGLCTFEFGIAVEVFGLERPEMGPDWYRFTVAGVEPGPLRATGGIRIAVDGGLDLVAEAGTIVVPGWRGADAPVPEPLCAALRAAAARGARVISLCSGAFVLAAAGLLAGRRATTHWRYLDALARAAPDAVLVPDVLYVDEGAILTAAGSAAGIDLCLHLVRRDFGWEAANMIAHRLVVPPHREGSQRQRVARPVPTAREGARLSPLLDRVRTRLDRPHTLVTLAAEAGMSPRTFLRRFRAATGTTPAAWLLAERLASARALLETGAQPIDDIAAACGFGSAATLRHHFRTRLGTSPARYRAGQVPA

SEQ ID NO: 3080 - protein, 124 aa, Methylobacterium sp.
MSQAGMRTTPTSGWGRDEILIGAIEHAAGTALVLAAWVLVFADQGPAAFSALLPGLLILALTGVNQIRFRPTFERAVALAGAWTILAPWLLGFAANDAATWAHVTTGAVAMAAAVTRLRIARAS

SEQ ID NO: 3081 - protein, 98 aa, Methylobacterium sp.
LTVHATETARRGDVAAMIRDRKPDGSDAMSSTTDKIKGLANEAAGNVKQGIGKATGNEKLQAEGKAQELKGETQRAVGGVKDGVNNAAQKAADAVKGR

SEQ ID NO: 3082 - protein, 159 aa, Methylobacterium sp.
MRTRPRCAPLAGHLSGLAAVLLAGASAVAPAMAEEGAPLYLRIRPPEARTTETGTGGSVRDDGAAAPDGAPPHALTDAEAIRRARSAREAVWERSNARARVVIASVCTGCMKPMPPAPVSADPEPATAPRPAEPGAAGALAALTPDPAPHRSQAQEDSP

SEQ ID NO: 3083 - protein, 259 aa, Methylobacterium sp.
LYEPAAPREAALGPLWHVAGAHTLFAGPLRYNAAHQHGAPVFLAGLYGPFRIRVWGQDWARCRTALVPAGLLHELDVGGEPLGVLYLEPGATGPDALAALLGGTTESGGALLGADGAVAPLRALWEARDAPRWAGDALADLTAFSGRRRGAGARDARVLRVVASLTACPDADQSAARLAQAVGLSESRLQHLFTREVGVPFRRYRAWARMRRAIEAVVAGANFTGAAHAAGFADQAHFAHDFRRTFGAPASNSLLDIRR

SEQ ID NO: 3084 - protein, 558 aa, Methylobacterium sp.
VSRVWRMTDERPRAYSYIRLSSDRQLKGDGERRQTELRDAFVDRHGLVLDDTLRDLGISALDGSNRHKGALGIFLKKVEAGEVPRGSYLLVESLDRLSREHVLTALRLFLTLIDAGIVVATLGDDRVYSEESINNNWTELIVSLAVMSRAHEESARKVQRLRAAWVRKRERTDVKMTARCPAWLELLPDRRSFKPIDERVELVERMLEELAAGIGRDKIARRLNAEGKRPWGHGREWHGGTVTKYTDNPALIGFFQPCRKEITVANGIRRERRIPVGDPITDYYPRVISDDLWQRARRASDKRARQGVANPGGRKGTVYSNLFSGLAVCDACGKPMNYRDRGVRSTPVLRCSGNRNGSCTNTAYPRYAPLERAIMSWALLSDRSPQAPVPADDAAVAAAVDRRDRVRALVDNLIDAIEKGAALDDRLAIRQAELARAEEDLVVARREASAAPPISTPEVAHGILSAIAHLDGMPADERYAARAAAAQELRDLLTEIRCHADGSVTAWVGDMGFRIHLKGDEAQIEGGFEIKPGECLVMRWETRSGVVTQPSLPMRNHA

SEQ ID NO: 3085 - protein, 73 aa, Methylobacterium sp.
MSDIPAFPYKLLWGERSVRSVANLTREDARTFFETVLQAGIVTRTRTYSLAEANAAIAAHRSGTLHGAAVLVP

SEQ ID NO: 3086 - protein, 66 aa, Methylobacterium sp.
MTLVLRTTYIQTVRRVRVPVGLARRDDAGPRFIADGCRYRSIGSLQALALAIAASAVTPALLWLAL

SEQ ID NO: 3087 - protein, 261 aa, Methylobacterium sp.
MLLYEHPLSSYAQKVKIALREKGLDFTAALPEDFGTGRREGPFAEANPRAEVPVLDDGAVTLFESTVILEYIEERWPEPPLLPREPAARARARLTEEVCDTQYEAVNWGYGEVLWFRRAAGDLADRLKARAARQTAELQAWLTERLGGSDWFGGSDFGWADAAAAPVVNRSVHYGLGPVASSPLARWHARIRERPSVAATFAEFEAAAARMAAASEHYTTGGRRREYRDHRLEWMVKSGGVEVVLAGLRDGNIRFSWPHGD

SEQ ID NO: 3088 - protein, 446 aa, Methylobacterium sp.
VARRAAVTGRPPAAIRAALPLARPSTAAGVNTAPAGSLDTQSAAPQWGVLGNFGGVRDDLFRAGIRMDGSFDYQTSTNLQGGPYQSLRGAGQLAVRSAVDMDRLAGLAGGTFNVALTYRFGRGLTADQHFGVLQQTEEIFGRGRFPRLTQLSYTQRFGEFIDLKFGRLPVSSDFAGFACEFQNLTFCGNQPGNLVGNYWYNWPVSQYAARLRLGNTSTGYLMAGVYQVNPRDLQDGFNFDPSGAAGALAIVEAAAFPTLPPFAYPGSYTVGAWYQTGGGPDLFLNRAGLPLALAGGVPIADRERSGLYGVAVQELYRPNPANPLSSLSAFVRVTMANSSTSFIDRQETIGFVYKGFWAARPFDWIGFGIGQSHASHGLAQSIQLANLLDGGARPIPGYERALEVFYSLALSPDVVVRPNIQFINRPGGVAGRTDIVVFGVKSGVTF

SEQ ID NO: 3089 - protein, 461 aa, Methylobacterium sp.
MDRSTNRSVGIAESESDTNLTGRRAAWQARSLDGETRDLLARDARAFLHQSVSTPCLNAVAKAEGIWIEDVAGRRYMDFHGNNVHHIGYGHPRLKRAIAEQMDALPFAPRRYACASAVALAERLGAITPGDLGKVLFTTGGSDAIEVAVKIARAATGRHKTLSFWDAFHGAGTGASAMSGEMLFRSGPAGPLVAGALHVAPFGGYRCPYGTDGAEASGRACARMIDYVLARDTDVAALVAEPTRAVPYIPPSGFWAEVRRICDRHGVLLIFDEIPTGLGKTGRMFSCEHDGVVPDILVLGKGLGGGILPIAAVVADRRLDVGGDWAFGHYTHEKNPVTARAALETLAIIADEDLVGNAARVGALALERLEAMKARLPAIGDVRGRGCLIGIELVRDRATREPDSDLAEAVLYRALDAGLSFKTTMGNVLTLTPPLVVSEAQMGDALNILEAAIADAAGGRA

SEQ ID NO: 3090 - protein, 161 aa, Methylobacterium sp.
VRLCRWAARLLPAVLALAAPAARAEEGLAPYTIVGDAIPESLTGAPGDPARGRAIVADRTRGLCLLCHAGPFPEERFQGNLAPDLAGIGARRSAGELRLRLVDGRALNPDTIMPSYYSLTGLARVGRAWQGRPILSAGEIEDVVAFLATLREPEGSPEEQP

SEQ ID NO: 3091 - protein, 156 aa, Methylobacterium sp.
VERTGVLDRRQVLAGAAGTVLAVALRPAAAAALPHTETTESAIRRFAGDNPIRPGRVTLDLPPLVENGNTVPLGVTVESPMTPEDHVRRIGVFNEKNPQPNVVTVHLRPGAGRAQVATRIRLADTQRITAIAEMSDGTYWSASADAIVTLAACLEG

SEQ ID NO: 3092 - protein, 106 aa, Methylobacterium sp.
MARTLINLPKTARAGDVIAIKTLISHPMETGFRPGADGRILPRNIVTEFVCRFEDEEIFRAELFPASAANPYLTFTWVATRSGRFTFTWRGDDGFDQTELAAITVA

SEQ ID NO: 3093 - protein, 263 aa, Methylobacterium sp.
VTRRPGSPLPAVLLALLLTGAPSGAEPIAPADRRSGFDQMGPEIQAMQRDDDANPGMLAVADGAELWTKPPPSGRQACAGCHGEAAASMRGVAARYPAWDARTGRPIDLQDRVNACRREHQGADPLAYESPDLLALTAFVAAQSRGQPIAPPDDPRLEPARAQGRALFQARQGQLGLSCAICHDDHWGRRLGSAVIPQGQPTGYPLYRLEWQGLGSLQRRLRNCLTGMRAEPFGYGAPDYVALELYLATRAAPLPLEAPAVRP

SEQ ID NO: 3094 - protein, 447 aa, Methylobacterium sp.
MTPEPPQVDARLAHDTVRTVTLRLMPLLGLMYLIAYIDRQNISYAKLQMVGDLGLSESVYGLGASLFFLGYFLFEVPANVILERVGARLWFARIMFTWGLITILLGFTRNTTMFYGLRFLLGVAEAGFFPGVLFALTLWFPQAHRARMIGWFMIASAFANAVGAAIGGALLDLDGLLGLKGWQWVFVATGLPALILTVVVLRILPDGPERAPWLSPDGKAWLSARLAHERESGGQVEHHNPFGALLDRRVWMLASVYIAFPLAAYGLSYWLPTVVKGFGASNTANGFINIVPWLVTAFALWWVPRRAARTGDQLWHVVVPGLVAAAALVLSVVLPGAALKFACLCVAAAGVFSAQPVFWSLPPTFLKGASAAAGIAAINSVGNLGGFIAQNAVPFIRDRSGSDLAPMYFLAACLGLGAGLMFVVLSALRRDAARRGAPVEPVAPRPA

SEQ ID NO: 3095 - protein, 402 aa, Methylobacterium sp.
MKGTTITRVSTLRSALQPNLLWVEIEDADGVVGLGETFSLAETVESYIHEGAADYLLGKDAGDIAGHWTTLFRQRGRSGIGAETRGAAAIDIALWDLLGHRTGLPLWQLLGGRSRERIRVYNTCGGPNYVRAAAVAGRQYTGDFVRDPYDDLWGFMNEPERLAESLLAEGVRHMKIWPLDDISVVNQGLHISASELRTALAPLARIHKAFEGEMEVALEMHARWTVPVASKIARAAEQYQPMWIEDPVKLDNLRAIDEVCRATTIPVLVGETQGSRYPYREILERTGVGIIMSDPCWTGGVTELRRIADLAATYQRAFTPHDCTGPIGLAAGAHVALHAETAIFQEFVRAFYHGWYREVSEGLPLIENGWLTAADRPGHGVTIPEEVRKRPEWSARTSRKGA

SEQ ID NO: 3096 - protein, 181 aa, Methylobacterium sp.
MIFVTNAAGKAIYIGREWTDFTGQTLAEAVDYGWIRVLHPEDRAVVRSIVAEAIRREEPFSVRYRLLNPAGHHIWVLGGAVPSFGPPGRCFLGFLGAIARIPDPDEARARGTIGSFDPSQDRALETARSSLEMAADHLIAAHALLDRPGGAHLLTGLRTVLYQVGLELARSDGADGSDQVH

SEQ ID NO: 3097 - protein, 430 aa, Methylobacterium sp.
MHDIESHALIGGPTRLRPGVLRLLVAGMVVLAPQAGQAAYRLAPGDSLAIEAVSVPEMKASSVISVDGQVSMPLVGQVQVAGLTLAEAQSKIQALLPTKEFRRRTNEGREFPVILSPSEITVTVDEYRPVYLNGDIAQPGEQKFKPGMTVRQAVSLAGGFDLLRFKMDNPFLQLSELREKHNRAWVQYARRQAMIARLRAELDGKKDIDDRALKDTPLAPSITAELLDVERGILKTKNQDVSREKAYLTAAAQKEGDRVRVLTEQEGREKEGVQADADEFKRSQDLYERGTIPTNRLTESRRSLLLSSTRALQTTATRAATEREKDTFDYRLQRVDEARRLEVMKELQDANVQLAEARATLQNTSEQLRYTGMVKSQLVRGLDGDPAIVIVRKDGKQVQRITASNDTELQPGDVVEVALQFGETADVPTR

SEQ ID NO: 3098 - protein, 466 aa, Methylobacterium sp.
VFTMQVAIIGVGYVGLVSGACFADLGHTVRCVDRDAERIAALRAGRMPIYEPHLDALVARTVAAGRLSFGTDLAEAVRDAEVIFIAVGTPARRGDGHADLAHVYACAREIAGALSGYAVIVTKSTVPVGTGDRVEHILRGLRPHGAFAVVSNPEFLREGAAIADFKAPDRIVIGTQDERARAVMHALYRPLEAGTRILFTGRRSAELVKYAANAFLALKIGFINEMADLCEQADASIHDVAHGIGLDRRIGARFLQAGPGFGGSCFPKDIQALIKSAQDLGAPTRIVETVAAANEQRKRRMARRLIEACGGTVRGLTVGVLGLTFKPNTDDLRESPALSIITALLDEGAAVRAYDPEGMDQARALMPEIACVPDAYAAAEGADALALITEWDAFRDLDLRSLRRRMAGDVLVDYRNLIAPEAAAEAGFRHIGIGCRPAPPAVRARVARVRGGRRGARVGALAAAPA

SEQ ID NO: 3099 - protein, 312 aa, Methylobacterium sp.
MTDQNVPSSHEPDRALAPTGLWVRAQVRQSRRHQDGLLLALEPLDTHRPGRLSAVLTGEFIRQVEAASGVLLDPHRLVGEHTLLLTLVVDPLLGLTGQVLGFERGSFLQAWLEQDADVKASLEAHGLWGRQRSLPTPKKLRRVVLIEPDDGAPHPLGGTLARWYDQGIIELIRLPVAYEEPGSVAALHEAFGSAFDQWEWGTLDTVVVEPGLGFAHRALSDESLMRRIAVLPVPVLFRRAGAPTLLDGMAFRACDTAEAILTVLTEILRGEIRAGGQPRLEAIAREIGAAPAATVSEAPSDLEASRQGPLFD

SEQ ID NO: 3100 - protein, 306 aa, Methylobacterium sp.
MTHHDLPADADATACALEPDGLWVRATASRPRRHRDGWLFDLQALDPTRSGRLTAFMSADFTDQIEQASGILLHEEDLVGDHTVLLTLTVDPLLGLTGRIVGLDRGLMLRAWAERDARVREALDANGLWERQRELPMPRRLRRAFLLEPDDGAPHAIADGLARWHELGMIALIRHPLAFEEPGSVAALHRALDAALDQYEWGTLDAVIVEPGTGFAFRSLSDPGLAQQLCEFPVPILTRRTRPVTLLDGLAFRSFDTAPELAALLIEILHRELREADRPRLEAIARELEPAPAAEDRPVNGAALFD

SEQ ID NO: 3101 - protein, 250 aa, Methylobacterium sp.
VPRVGLGGLPIAVHGRREATALLVDLALDRRDRVEPPAIITSANGQVLSLCARDPEIRHLFEASDLIHADGAPLVFASYLRARACRLPERVATTDLFHDVAREAVRLDLSFSMLGSTREGMALAEANVRARYPTLRLLGAHHGYLDAAGEADQVRAIARARPDILWIGMGVPREQRFALRWRAALAGVGVIKTSGGLFDFLSGARRRAPDWMQRCGFEWAYRASLEPRRLLPRYAVTNPHALYLLLTRRG

SEQ ID NO: 3102 - protein, 280 aa, Methylobacterium sp.
MHRNAVIAPERPRAAPRFARLSAAATIGLALLAAGAASAAPLTLPLPEPLPAVRVLTLLVGLHLVGLCFGLGGATMLDFWILRWMRWGSLPSEIARIFLFISKVVSVGIGLLWVSGLGFLMVYALESPEKLQNPKLWAKVTVVAVLTLNGLVIHALVLPGVLRDVGRPMLDGISGTRTGVFLVSGAVSGVSWYTAFALGLMRELNGSVAYGLLIGLWIAGMVAASLGAYMFWLHLREWSARRRHRPPADAPAVRARAPLAGAQIPVSQLVPIHGPSAHQA

SEQ ID NO: 3103 - protein, 418 aa, Methylobacterium sp.
VASVAEGPLDIRHIVIADREGYPSASNGVHQVARSLALEQVRAGDASRIIFASDDPSGIAVPDGIRLDHIPLTGPSFLGRVVALGASSREALLADVGPRTVFHLHGARKPLLVALTHHLRARRYPYGFTLHSCFSHLFNRDGRVLKPLVVLYATLFERAALTGARFVHVLTDLEQAELGRIAPRARAHLIPNGAFSSAGSQIPPPPERVGRTDGNPVFGFCGRLAVFHKGLDLLVDGFALHCRRNGRGRLVLMGPGTSSSSLTARADALGIADRVSVLEPRYGRERDAVIREWDYFAAPSRLDHWPTAALEAALLGVPSLASHETGLHSVIARYDAGLPIADLTPEDVAETLAQAERIEPARWRTMSANAYRMAREIADWSVAVARFRGLYQGRTEGGSAIRTVASEPSAVGRSVKGR

SEQ ID NO: 3104 - protein, 452 aa, Methylobacterium sp.
MIEPRRRRARARLSRFGLLPLSLAVGGVRPLDSTKASYRGEPLDIRHVVIADREGYPSASNGVHQVARSLAFEQIRAGDASRIIFVSDDPSGIAVPDGVRLDHIPLSGPTILGRVVALGASSREALLCDVGPRTMFHFHGARKPLLVALTRHLRARGHPYAITLHSCFSHLFDREGRVLKPLVALYVAIFERAALTGARFVHVLTDLERAELGRLAPRARAHQIPNGAFSSAGSQIPPPPERVIGTDGSPVFGFCGRLAVFHKGIDLLVDGFALFCRQGGRGRLVLMGPGTDGGSLAARAAALGVADRVTLMEPRYGLERDAVMRGWDYFVAPSRLDHWPTAALEAALLGVPVLASHETGMPDIASRYDAGLPISGLTPEDVAETLARAARIEPARWRLMSANAYRMAREVADWSVAVVRFRSLYQPEAEARPDTRAVVSGASAGGRHVQAR

SEQ ID NO: 3105 - protein, 77 aa, Methylobacterium sp.
VTYSIVDCPDGRFAVVAVSASGAAYRRDGFMTLADAESCAEGLSAIMAVCGTPLTRQDSRGPSTCPGFPSRPIWRSF

SEQ ID NO: 3106 - protein, 115 aa, Methylobacterium sp.
MIAVIFEVWPAPGRTGDYLDLAAALREDLSGIDGFISVERFRSLTEPDKLLSLSFFRDEAAVRAWRERPGHRATQAKGRAGIFRDYRLRIAAVMRDYGLTEREQAPADSRAAHPA

SEQ ID NO: 3107 - protein, 226 aa, Methylobacterium sp.
VRRQNPARRIGCARRLVDTLETAVKSLTASILCLALSLSTPALAQTAPTRDPARIQGGTYIVDVAHTQVGWRVSHMGFSNYAGGFSDVSGSLVLDPKNPAGSKLAIKIPVASVATTSAKLTDELKGDQWLDAGKYPEMTFVSTKVAPAGKDKAKVTGDLTLHGVTRPVTLDVTLVGAGTNPLNKKVTVGFEATGTLMRSDFGVKTYVPLIGDQLHLTIAGAFERQD

SEQ ID NO: 3108 - protein, 491 aa, Methylobacterium sp.
MFAARKTLQARAKLAALDRVQAVIEFDLDGRILSANDNFLALMGYTLPEIAGRHHEIFVEPTHRASPEYKAFWQRLRAGTFEAAQFRRITKDGREVWIEASYNPLIGRDGRPYGVVKFATDITRQKQEDADRAGQIAAIRKAQGVIAFDLDGTVLDANDNFLAAVGYDRDEVVGRHHGIFVDPRERTSADYAAFWARLRGGVYQSAQFRRLGKGGREIWIQAVYNPILDASGRPYKVVKFATDITEQIRLLESLRTLIDRNFGEIESAVSHSSTAAATATRAAHTTSGNVQTVAAAAEELAASVSEMSQSIVRSQGATDNAYACVQAADGYTKRLAETATAMTGIVGLIQTIAGQINLLALNATIEAARAGDAGRGFAVVASEVKALADQAARATEQINTEISNVQAVSHEVVGALGSIRGSVSVMRETVVATAAAIEEQSAVTRDLAENMQSASGAVTSITGSIGAIAAAVDQVSAAVSTTRDAAKVLAR

SEQ ID NO: 3109 - protein, 152 aa, Methylobacterium sp.
MPDLDDTDRRIIRVLRMEGRISNADLAERVGLSPSACHRRVRHLESSGVIRGYAALIDALPGDGNLIVVTQITLDRQTEEFLNRFEAAVRRCPEVRDCYLMTGIADYLLKLEVKDAGDYERLHKDVLSRLPGVARLQSSFAIRAVVNSARHA

SEQ ID NO: 3110 - protein, 82 aa, Methylobacterium sp.
VDAVQRVGSYLQVQDEEGCRHLLRVTAVQALSDTDPLRNETFITAAGRTIRVPQSLDAIVGLIAPGERLAADGEPPDAVWPF

SEQ ID NO: 3111 - protein, 106 aa, Methylobacterium sp.
MRLARSIGPVTVLLLAALPAAAQDNKPAAIRQPGPPQIVPPGTPPGATIIPDESGNSGPAATGTRAPTGLGATTMNTDSAAAGNAADPERGVPKVGGGGGDGGGGQ

SEQ ID NO: 3112 - protein, 1636 aa, Methylobacterium sp.
MAMDTHPDPAQGSVAQGSVAQGSVQEPALETATALASAAAKSARSDLIEAAAGAAEGRGEPGGFVRDLFGRVPPEDLAPYPAAALAELAARARAHLAEPHRPGEAASVRLHDVTVIRDGRPRDLTLVEAVNDNRPFLLDSCLAELTGQGLVPLLVAHPILGVERDEGGALRRVVGETTAEAAGGLARESLIQIHLDRLEGEPRRRLEAGLVATFTDVAVADADRPAMLERLEALAASYGERPTPLPADEIDEARAFLWWLLDGHFTVLGLREHGLSADGTETEAEGASLGVLRDPALAVLRRGRELVGLSPEIRAFLAEPQALIISKASVKSRVHRAAHLDYVGIKLFSDAGALAGELRVVGLFTASAYTAPAREVPVLRRKVAAVVARAGLDPTSHAGRGLIAVLETYPRDDLYQIDVERLTRFALAITDLADRPRVRVLSRIDRFGRFVSLLVYVPKDRYDTRVRARIGAYLAESYGGRLSASYADMPEGPLARLHVIVGLSEGAPERDPSVLEAGVGALVRTWADGLRAALTESRDGAEARRLFGAYAEAFGAAYRENFSPEVAVSDIAILERLSEANPRAADLGRREADPDSQVRLKVFSRGAALALSDRVPALENLGFRVIDERTYRVTAPDGARVWLHDMLLERASGAAVDFAALERPLEEALIAVGEGRAESDAYNRLVLEAALPWREAALLRALGRYLRQLRIRYGQDYLAATLSRHPAIARGIVALFRARFDPGLAGDREAAQRALREELETHLAEVTSLDEDRILRRFVNLVEAAVRTNLYQAGPDGGPRETISVKFACAAVSGMPLPRPFFEIFVYSPRVEGVHLRYGYVARGGLRWSDRPEDFRTEILGLVKAQQVKNAVIVPVGAKGGFFPKRLPPASDRAAWLAEGTESYRVFIRALLELTDNIVDGQIVPPADTVRQDPDDAYLVVAADKGTATFSDIANALSIARGHWLGDAFASGGSQGYDHKGMGITARGAWEAVRRHFREMDVDVQTDPVTVAGVGDMSGDVFGNGMLLSESLRLVAAFDHRDIFLDPDPDPATSFAERKRLFGLPRSSWADYDPGLISRGGGVFSRSLKAIPLSPEIRRVLDIDRAEAAPAEVMQAILRAPVDLLWFGGIGTYVRAGAETDADAGDRANDAVRITGAELRAKVVGEGANLGLTQRGRIEAARAGVRLNTDAIDNSAGVNTSDVEVNIKIALMTPERDGRLGGEDRNSLLAAMTDEVARLVLRNNELQTLALSLAERRGAGEAAFAARTMQVLEAEGRLDRAVEFLPDDAVLAERLRRGEGLTRPEYAVLLAYAKLALYDALLAGPAVNDPYFDRELQRYFPGALREKFPDAVKGHRLRREIIATALSNIIVNRGGISLVTRLADEAGAEPASIARAYAVTRDAFGLMELNAAIDGLAGRIPGAAQLDLYAAVQDLLTGRITWFLREIDLSGGIAPVVARYRDGVSALVAALPEVLDAEARAALEARRAELLGLGLGEAAAGRLAALGRLTAAPDIVRVAETSGRPVAEIAATHFALERAFRLGDLAAEARAAPVSDTFDRVALERAVAGIARAHRALTAEVVGDGGAGPEAVEAWIAARGPGLARIRAAVSGIAASGLTVAKASVAAGLLGDLARA

SEQ ID NO: 3113 - protein, 77 aa, Methylobacterium sp.
MARIAILVGTPAGTRLLAASTEREAAHRVERLLIDLDRAALPAPLWVQCADAALAERLSAYLAGFQAELTAAPADGT

SEQ ID NO: 3114 - protein, 76 aa, Methylobacterium sp.
MKPVQMRMARAALGWGVRELAEKAGITANTVTRIENGADAKQSTIDALKLALETAGIEFIPQNGGGPGVRLREPQA

SEQ ID NO: 3115 - protein, 266 aa, Methylobacterium sp.
MTGPDPGAEPPKPSDSYLQSFARGLAVIRSFNASAPAQTMAEVAETTGLTRAGARRILHTLQTLGYVELEGRHFRLTAKVLDLGFAYLSSLPLWNLAEPHMEDLVQVVQESSSVAVLEGAEIVYVLRVPTSKIMTISLGVGSRLPAYCTSMGRVLLAALPDEEVLVRLRRSALVPNTPRTVTEIDDLMRIIAEVRQQGYALVDEELERGLISIAVPLRGQNDKVIAAINVGCHARRGTAHRIRTEFLPPMRAAADAIGRKLRQVSR

SEQ ID NO: 3116 - protein, 318 aa, Methylobacterium sp.
VSRLPPLLRENLALPVIASPMFIVSGPELVIAQCHAGIVGSFPALNARPAAMLDTWLTRITEELAAARAADPAARIAPFAVNQIVHASNDRLAQDVETCVNHRVPIVITSLRAPDAVVRPVHGYGGLVFHDVTTVRHAEKALEAGVDGLILVCAGAGGHAGTLSPFALVGEVRRFYDGPLILSGAITTGAAILAAQAMGADLAYMGTRFIASAEANAVPAYKDMIAGASAADIRYTPFFTGVPGNYLGPSIRAAGLDPDALPVADKSQMSFASDRAKPWRDVWGAGQGVGTIPDVRPVAEIVAGLTREYRAARAGLAA

SEQ ID NO: 3117 - protein, 266 aa, Methylobacterium sp.
MRRFALSFMLAVFAAGPAAAEQDLLLGADMSSPAMTKAEMSRADVEAMIQDANGKPIDLHDKALSGLDLSGLNLRGVNLRTARLNKANLRGADLSGANLEQAWLLKADLSGAKLADAKMFGITARDANLSEADLSRSMPIGDFKGANMSGATLVDLKGGADIKNQSMGLMRAVFTSVNLSGANLRGANLGRSRLEYANLKDADLTGVVLMGSDLSGANLTGATVTGADFKNVDVSGARLINLKGQSEAKDWAERVNIDRAVTQASN

SEQ ID NO: 3118 - protein, 404 aa, Methylobacterium sp.
MPSFAYRAYAADGRARSGKIEAESRQRAVAALRAEGLQVFAIEAAAAGPVAFWNRDLFGRDRVNDAARIAFLREFGTLLGAGLTVDRALRLVERQASAALRPVLSDLLERVVGGASLSRAMAAHPQAFPRDMVDIVRAGEATGTLTDVIASLTGSIERRDAVRRHLVSAMIYPGLLVLMAIGTVAMIVGVLVPALAPLFEGSGQAPPLAIRAAAALGDGIARWWPGLLAGIALGFLVLVRFWPAPAFAAFRARLALRLPLVREIVVGIELGRICRVLGTLLQAEVPIPDAVAATRPIAGNRVFRDALAQAGRRLTEGGSLASGLAALRPHAPSTLNLIASGEQVNRLGPVLVHAAEMHETQTRQRIDRLLALLTPLVTVVIGGLIGGLIVSVMGAILSVGQLAQ

SEQ ID NO: 3119 - protein, 88 aa, Methylobacterium sp.
MERLCDLLGRRLIIACMPCGRRGHYDLDRLRHRFGQHACVYEVYVRLTQTCQYQHPIGARRPNQYGRACRAQLDTDEIGHSRTPPSRT

SEQ ID NO: 3120 - protein, 28 aa, Methylobacterium sp.
MLKGGLLWLIGIPLPIILLIYFFTNWLH

SEQ ID NO: 3121 - protein, 492 aa, Methylobacterium sp.
VRGGPLAGAARAAGLGMALAALSAPASALAPGARAESATPAGCPAGAVRVPPGGPIQRAALSAGPGGTVCLAAGLYRMQEVAPLAGQSFLGEPGTILNGARILTGFERAGAHWQVSGIRPRTGGPGQCRSGTLCLQPLALFLDGEPLRRVASRAELGPGRYLVEAAAARVTIADDPTGRTVEVASARFAFRGQAPNVRIRGLVVEKYDSPVQEGAIEATGPGWRVEATELRYNSGAGLGVASGSAVRDCAIHHNGQLGATAGGTDILFENNRIYANNTADFDSAWEAGGLKITDSRSVVLRGNRVDRNGGPGLWCDMDCRDVLIEDNHAEDNRGPGIFYEISYAAVIRRNTLRRNGDPRATWFWDADIQIAASEDVEVSDNDIAVRPDGHAVVLVDQARERAQGGLYRTAQNRVHDNRFVFLGAGSAGGVSDAEPESPNFKVIQTGRNSFDRNLYAYPAATPPRFIWGHDIIDFAHFRAAGQERAGMMKAEP

SEQ ID NO: 3122 - protein, 1014 aa, Methylobacterium sp.
MPIAQAELEAVVAELARRPGHEKVRALLYRLLTGALDARSEQIAFERALPEVRGRVDALLGRTLIEIKADLRREAAAAEAQLARYLPEREAATGQRYVGLATDGARFVAYEMRTGTLVPLGACDARPTDARDLTAWLEGVIAVRDWLPADAVGITNELGRRSVAFARTHALLRIAWAAVATDPEAALKRQLWERHLGFVYGKAVGGDDLWLQHTYLVILAKAIAAGAMRIHGHSPEDLLDGRAFRDAGVHGAVEEDFFGWILRAPEGPAIVASLAGHAARFDLGSVDVDLLKVLYESLIDPEQRHDLGEYYTPDWLARKVVRRALDAPAAQSCLDPACGSGSFLFHAVRLKREALAASGMPAGGVAAACCATVTGFDVHPVAVIFARVTYLLALGEALLARGGDISLPVYLGDALQWNVQRDAAEQDLVIEVPRAPGRRGGGPVLRFPLALCADPGRFDRVVGAMHDASEAGRDPDAFQRQLVGYGVPTGEAGTLRATYAAYDTLRRAGRDHVWGFVARNLSRPVALSDGGRVDVVLGNPPWLSYRYMSAAMQARFRDTARRLGVWVGPDEARLVTQTDLAGLFFVRCAELYARPAGLGRRGGRLAMVLPLAALSRGQYRAFRTGDWAGVSVAFTEAWSLDNRAIAPLFRVPTCALFAEVAGAARPTPARVTVFSGHLPSKDAPEALADRHIRTADAPAPRVAGPAASPYRGRFRNGATLYPRILCLVERAEQARIGINPRMPLVRSEACARKGRWREVAPLRGPIEAPFLRPVYLGESIAPFRVLGPAEGIVPVTDEAALLDADEAGERGLNGLEAWLRTAERHWSALSSERTSLRQQIDHYGKLSGQFPIAPVRVVFSKSGQLPAACIISDDAGVIDHALYWADIASTLEARYLVSVLNSDTVRRRIEHLQARGEQGARHFDKLMFTLPIPLFDGRLGLHTDLAAAAAEAERVAGAVAIEPRTPFVRARRAIRDALREAGVAERIDALVAELLGPDPFAPAPAPAVPELEEA

SEQ ID NO: 3123 - protein, 277 aa, Methylobacterium sp.
VPSLGDPTPKAAPMNMHPTFLEAQALAPAQAGLREIADGLGYSSDWNWAWENYKPMVLALAQAHGLRRHIEIGGGRDPLFTPDELGRHGFAVTLNDISEHELMLAPPAFAKLRCDIAGPDTVATVGRERFDFAYCRMVMEHVPDVARMWRNVHDILAPGGVALSFFPTLFAPPFVLNELMPERLSRTIVHTLFPDRHDDGDNPKFPAHYNLCRGSEAPLVPLLREIGFRDVIVLPFYGYSYFWKIPVVRQVDAAFTRLARARDWRTFTSFAYVVARK

SEQ ID NO: 3124 - protein, 574 aa, Methylobacterium sp.
MSDAAITLPLPDAGAPAGIRRRVPETAVAAGLVAALCALLVLIIALPLGALLIKSFEGADGGFAGLANFRIYFATPTLVEALVNSLVIAALSVALVVPLAFGYAYALTRTAMPFKGLFLAAALLPIFAPSLLSGIALTYILGNQGVLRGLLFGHSVYGPIGIVIAECLYAFPHTLIILTTALALADGRLYEAAAAMGTGRLRTFATVTLPGARYGLVGAGFVVFTLVVTDFGIPKVIGGQYPVLATDAYRQVVGQQNFPMGAVVGLLMLVPAVLAFGVDRVIQRRQSALLSARSVPYEPKPRRLRDRLALLYAIAVAGVIVGTYGVAVWASFIRYWPYNLALTLDHYDFAATDADGWQPYWNSLAMAASVAAIGTVVVFSGGYLIEKLKVFPAGRMLAQLLAMLPLAVPGLVLGLGYVFFFNAPWNPLNVLYGSLALLAVNTLAHYYTVAHVTATTALKQIDPEFEAVSASLKVPFWRTFTRVSLPICLPTVLELAVYLFVNAMTTVSAVIFLYGPDTKLASIAIVHMDEAGTTAAAAAMASVIMATALAARLGLALIGWGVVAHLQRWRRREA

SEQ ID NO: 3125 - protein, 188 aa, Methylobacterium sp.
MIRQGVELSLDRLEAQGAPVDYSTDLGRLIQGLGSVSDRLRAVEQAPALRQGADQIVQNFERQARVLELIDGQIAARFASARERRQQTLWLGGAGAAGVMLGLLLTLFLPRVLPFSLAERMAATVMGQAPWAAGISLLQFADPAAVERIAAADRLVKANAPAVAACRSAAVQAGKEQSCTITVPGSRP

SEQ ID NO: 3126 - protein, 187 aa, Methylobacterium sp.
VLAAAPAYTPRMPRTDKPFSVRMTNAGPLGWVSDRAGYRYQPHHPETGAPWPPLPPTVLRAWTELAGYAAPPEACLINLYAPDARMGLHQDRDEQDLAAPVLSLSLGAPALFRYGGLGRTDPTRSVRLQAGDALVIGGPSRLVFHGIDRVLAAGDLLDPGEAALPDLPPGWRLNLTARRVNPPAPTR

SEQ ID NO: 3127 - protein, 80 aa, Methylobacterium sp.
MVSALAVAAAGAPAELPTQRLAEALAVLMVDLVGAMPLGDRCAVLERLANRLDDRGRVAGGSEAAALLGAVGGALMRMEG

SEQ ID NO: 3128 - protein, 529 aa, Methylobacterium sp.
VRDFSRPGRSPVYAANGAVATSHPLSTLAAIEVLRSGGNAVDAGIAAVAVQCVVDPLMTGIGGDCFALYTPRGAAVPEALNGSGRSPAAATDAWYLENGVTITPTSPHAVTVPGAVAAWATLLERHGTRTLGELLQPAIRYAEEGFPVQPRVGWDWARSVERVSHDPGAAATYLFDGRAPAIGASVRLPRLAATLRRIAEDGPRGFYEGPVARDMVGRLRALGGLHTEQDFAEAAPEWVTPITTRYRGYDVYECPPSGQGLAVLMMLNVLSPFDVAALSALDRAHLLAEVCKQGYHHRDALFADPGLHRVPVEHLLSDAWRASARGAIDMTRARAPEVYPEIANEVAHRDTVYLSVVDRDGNALSLINSIFQGFGSGILAPESGVLLHNRGYSFRVEPGHPNTIAPRKRPMHTIIPGMLMREGRTVAPFGVMGGHYQAMGHIQLLSNIIDLGLDVQEALDAPRSFAYDGVVEMENAFPDDILAGMRDRGHKAVPAPLPIGGGQIIWIDHRTGTLVAGSDPRKDGSALGY

SEQ ID NO: 3129 - protein, 523 aa, Methylobacterium sp.
VGAGGAMVAGHGRRARAASRLLAGALCAGLCAGVSACAVGPNFVPPEDPPVTRYTKEPLRNPSAADAIATRQGGSADQSFVSGADIPGAWWKLFRSKALNRLVEEALANNPNLEAAQASLRIAQQNVLAQKGTLFPTLSATPQVQGARAPGLDLQSPLQNDNRFLYSLFTPQVAVSFNPDVFGGNRRQIEALEAQAENQRFQLEAAYLSLTANVVTAAIQEASLRAQIDATKRVIQAQTEVLDLYNKQLRLGQIAGAEVVQQQAALSLSQQLLPPLEKQLAQQRNLLTALTGRLPSEEVSQTFTLAQLRLPTKLPVSLPSRLVQQRPDVKAAEALVQQASANVGVAVANRLPQFTISATGGASAVRIAQLLNPGAGFFTVIGQAAAPIFDAGTLYRRQRASEEALTQAQAQYRATVVGAFQNVADALRALQADASAVAAASAAEKATGESLGLIRKQFEAGAINATQVLIAQQSYLSALVTSASARATQYADTAALFQALGGGWWNRADVAVPPPETDPAKFL

SEQ ID NO: 3130 - protein, 62 aa, Methylobacterium sp.
MTTVAAQATQMLAAAFSQQMGVAVARQQITAERAVAELVAGAIQPAAPPAPPGQGRIVDTRV

SEQ ID NO: 3131 - protein, 91 aa, Methylobacterium sp.
VLAAFLALACGSVARAAEMRPPPGTSSCTGCHAEGAAMGVLDGRPAAEIAGALEAFRTGARPATLMNRIAKGFDAQESRAIAAWFAAQGPR

SEQ ID NO: 3132 - protein, 421 aa, Methylobacterium sp.
MSRIPSAPTRRALIGGAAAAALARPALGGTPPRVVVIGAGFGGATAARCLAAGGVDVTLVEATERYVACTGSNAVVVGLRGIEAQTFGYDALGRAGLRLVRATASAVDPAARRVTLGDGTVLGYDRLILSPGIALRFDAVPGYDEAAAEAMPHAWKAGAQTVLLARQLAAMPEGGTVVLSAPANPYRCPPGPYERASLIAHFLKTRKPRAKLILLDAKDTFSKQKLFEAAWAKLYPDVLEYVPLAAGGQVSEVDPAAMVVRTDFAEYKADVACIIPPQRAGRIAAQAGCADRSGWCPIDPATFESRLVPGIHVIGDAAIAGAMPKSAFSANAQAKVCAQAVIDLLAGREPEDPRLINTCWSLVAPGYGISIAGVFRPHDGLLADIPGAGGVSALDAPDAVRAQEAAYAESWYRTITRDVFG

SEQ ID NO: 3133 - protein, 265 aa, Methylobacterium sp.
MAAECAGVRRYLFASSCAVYGGGQGMDLGESAALNPLTVYAETCARAEEAVLARNSRCFTTAALRNATVFGLSPRMRFDLVVNQMTHDALEGGRITVGGDGTQWRPLVHVRDVARAFLSALRAPRRAIGGHAFNIGWKNYQVDSVAHTVRRAITVPTDITYLPGSPDRRDYHVSFAKAERIFGFKASLTVEEAVVEIAQAIQGKRLSNTPACHTVQWYMRLLAERGPGLRLPGTAPMHMLAEAPSSDAIIARDAGAGLPAVARVQ

SEQ ID NO: 3134 - protein, 326 aa, Methylobacterium sp.
VGRAIAHEFARHGWNVGLIARGEAGLRGAADDVRRAGGTPLAFAVDVAEADQVEQAADEIAAFFGGIDVWVNNAMVTVYAPVRETPPEEFRRATAVTYLGQVHGTLAALKHMVPRDRGTIVYIGSALAYRSIPLQASYCAAKAAVRGFVDSLRSELLHDGAQVRLTMVQLPAVNTPQFDWARSRLPRQLEPVPPIYQPEAIARHVYRAAHAAPRELWIGASAWKAIVGNMLIPGWIDHYLARHGYHGEMTDMRAAKNRPDNLYEPVDTDPGAHGRFDERSRDAVAAASPRWLKLGLVAALGAVAGATLFATEAHGRSEARRRLERR

SEQ ID NO: 3135 - protein, 420 aa, Methylobacterium sp.
MSAPIATAQRPSLPRARGLDSSLALLREGYAFIPNRCRALGSDLFATRLMLSPVTCMTGAEAAARFYDGHRFTRRHALPAMSFGLIQDQGSVMVMDGQAHLCRKAMFLGLVGIPALERLAAITVRHWRAAAERWTRANSVVLLDEAHRVLTAAICAWVGLPLDPQEVAARATEFAAMIDGTGAIGPRNWRGHLRRARTERWARGVIREIRAGRREVPEGAARAIAEHRERDGRPLDAAVAAVELINVLRPTVANARYVVFAAMALHAAPAWRAALAEPEARCRFALELRRFYPFIPFIGGRVREPFRLQGHAFRAGDWVLMDLYGTNRDPRLWSEPERFDPDRFRDVQPGAFALVSHGGGTAAEGHRCPGEGISQILLETLAGELARLAYRVPEQDLTLDLAHIPARPRSGFVIRDVRAG

SEQ ID NO: 3136 - protein, 250 aa, Methylobacterium sp.
VEQYLTSTFLLSLLQIIWIDIILSGDNAVVIAMACRGLPERQRRIGVFLGAFAAAGLRILFAVIISQLLAVPLLKVLGGLILLHIAVKLVRGEDEGEEHVQASSSLPKVVWTIVVADAVMSFDNVVAVAGAAKGHDELFIIGLALSVPLLIVGASLITRAIDRFPVLIWFGGALLGWVAGEMIATDRLVVQYVAEALPASLQGVFHYGVAALGAAIVIAIGMLLRRRSDRAVAREQAAAVGRAEADVLGS

SEQ ID NO: 3137 - protein, 248 aa, Methylobacterium sp.
LRHIFAGSPFDVVASADRLDDVEPAALASEALVILLSIDPERQQDLERITEARMRCPEAAIVCLCTGCGETQVLPMLESGVAAILLRTVAAETLVQTLELALLGQRVVPHLSIPAPREPAPAAPAEEGGPLEGPERPEPGDTFRPNAREIKIIACLVKGESNRVIADRLAIAEGRVKGHVKAILRKIQVKNRTQAAIWGMKHLAGTEAPASGDGRFDASAEAACEELDEDALPAAPRPAWRAEPLHVR

SEQ ID NO: 3138 - protein, 436 aa, Methylobacterium sp.
MRRSWNPGPPAAARGGGALRHRIGGHAGRLAWPLIDQGIASIGTFGLTILLARALPPAEYGVFALLLGGLMILHMVTSSLVFYPLSVRAAAAGPEGGAALMRASLDLLGLLFLPAGAAIALAALAAGRADLILPALAYFLLWQIQEAFRRYLFAELRFAAAIPGDAVSYLGQVALVLWLGREGHLTLGGALCAMALTAGLGALLQAGRAGLGRRGGPAPRLPAILGDFWRLGGWSLANNLLGTLRGQVLFWLLAVLSGAALTAQLQASQNLVNLMNPLVIGLCNIIPQTAARAHAGGKAEAWRAARPFALSGVPVALLFFGVLFAVPEPVLRLVYGSASPYLGLVGPVRLLALAAVAAYATDMVCSYFHGVEAARHALVVNAAGTVAVLAAAVPLTLRFGLGGACAAMVLASLVRLLISQLLLRRLIAADAPLPAA

SEQ ID NO: 3139 - protein, 350 aa, Methylobacterium sp.
MARQPRVVGEVESLKGLLARLSLETKLLRLEEVLRRKDWADQPRAPAGQSDGGRWVSGGGSGVSRPQASGDASAPESNQTQEQTVADDGTRVLSIRIRAGRGDFDTQHAVTAPDGESRLFQTASANQVIRDGVSGEVLSRSTFTAHGPVSDAIVQPAFLAAVPATIARTLELATALFTVLSARKDGFGTVLGMTVQEYKPSPKGSPVTVTWVGQPSLSDFNAACPRNGYVMALTDRVTARVKARGHNMSMQALGTRIHFEIAQEVKNLNDPNFKSELFIPKTVMPNRPASLGSVRLDLFERVRPGVVCIYDYKVGISGLDADRARDLALMAKHQFPETQQIMVIQVRPRT

SEQ ID NO: 3140 - protein, 224 aa, Methylobacterium sp.
MTDAQKVERWIDRFPLLQALSPAHLQIARGTVHFPVLDAGAIAYELNGECANYLMCLEGRTRIFRMSEGGREVLIYKVGPGGTCALTTQCLLSGGTFPAQSVAEERTELAALPDSTFQHLMGDSAAFRSFVMDDYTRLMSGLFTLIDEVAFAPLKQRLAQRLLAEADPRGVAAVTHQKLADDVGSVREVVSRILAQWAEAGLIELRRGAVEIVDRTRLEAAGRR

SEQ ID NO: 3141 - protein, 175 aa, Methylobacterium sp.
MRAEPEILRLSDPAVSAAAARRLFAQVRAELAAALPQEAEIEHVGATAVAGCLGKGDLDVAVRVPGGRFVACRTVLGRRYADNAGSVRTPDFAAFCDETAEPPLGIQLVALGSELDVFVRFRDRLRAEPDLVGRYNALKRAHAGRSMSAYRAAKGDFIATVLAGPPGAGPRDSPG

SEQ ID NO: 3142 - protein, 575 aa, Methylobacterium sp.
LAIYHCQMSVVARGSGRSAVAAAAYRAGERLENARDGQVHDYTRRAGIAHAEIVLPTGSDAAWANARPALWNAVEAAEKRVDARVAREFVVALPHELPAEERLLLTRAFAQALADRTGAAVDFAIHEPHPQGDVRNHHAHLLMTTRVVGADGLGVKTVLELANKQLVPRGLPTTQAQLVEIRQTWEALANAHLARVGLDLRIDHRSHAERGLEIAPTQHVGVAATSVRRRGGTVERRRLDPEASARNAEAIRARPELVLELVTDERSVFDRRDVARALHRALEADALDFQSAFQAAFAAVMASKDLVELQPERTDPETGAVTPARYTTRAMLALESGMAEAAARLQGTHRHGVDPGRVADAIAAQDAAIRASTGEASAGLSPEQRAAVGHVTGPERIAAVVGFAGAGKSTMLAAAREAWEAQGYRVHGAALSGKAAEGLEASSGIASRTLASWDLGWRNERGLLGAGDVLVIDEAGMVGSRQLARFVDAAERRGAKLVLVGDHEQLQAIGAGAPFRAIAERIGHAELADIRRQRTEWQRAASVAFATHRTGEGLAAYHAHGAIAFAADGEAARGA

SEQ ID NO: 3143 - protein, 434 aa, Methylobacterium sp.
VVLAHRRADVRALNDGIRAALQARGALPEGEAAGERAFATNDGERLFAPGDRIVFLENDRALGVKNGMLGTVEAVAEGRIAVRLDGEGERRVSVATDAYQALDHGYATTIHKSQGATVDQAFVLASATMDRHLTYVAMTRHRDGVRLYADRTEFAGERPGNWVSAAAAYDGLAARLSRSGAKETVLDYAPSFAARRGLAERLGIRGGIALAPERAVAEPVREAPAAAEPSRRELFDGPGLSREGPVPAPAVRTVPAASAPQAGVRNPETPRGRAFAGLKLRAAPAPKPPPAAESPAPVPDRLAERIRSLSGLEGALERYAQAYGAAERQAEAGLPRLAGQRAALAAAEFGLDAVQAGTRATLQAALQHDPGLRQALLAPSGTGRVSDLMAGLERERERQAQAELVAQQAERLEQARRLERRQEREQSLDLGLGL

SEQ ID NO: 3144 - protein, 401 aa, Methylobacterium sp.
MLRSVLLAGAIGALTMGGALAQTAVKIGVLGDRSGVYSDISGEGSVVAARLAVEDFAKVDPSVKVEVVSADHQNKPDVGAAIARQWYDRDGVDAIMDGVTSSVALAINQVTREKNKVLIDSGAGTADLTGPQCTPNTVHWVYDTVALANGTGSAMVKRGGDTWFFLTADYVFGQTLQRDTAAVVTKSGGKVVGSVKTPFPTADFSSFLLQAQGSGAKVIGLANAGGDTINAIKQAGEFGITGGGQALAGLLVFSSEVHALGTKVAQGLVLTEPFYWDLNDGTRAFSERFSKQMNGRKPTANHAGVYAGTIHYLKAVAALKNEAKDGARAVAKMKELPTDDPLFGKGTIRADGRKIHDMYLFEVKKPAESKGEWDLYKTLATIPGNEVFRPLGEGGCPLVKG

SEQ ID NO: 3145 - protein, 169 aa, Methylobacterium sp.
VATSVRGCTMTVLTDRQRIELALPAYLLFALSRLPGVFAPSDPALAERAEADIAVLCEDLHIACLEPLADLAPRKQQAVLRRLDRIGKDVMVGWTDQSSLSLVLMLWYFLKDLVDREVLILWQGSAMDRAVHTLLPMFEHGFEEQKRDAAAQEQAVRLLARLRAEGLYG

SEQ ID NO: 3146 - protein, 132 aa, Methylobacterium sp.
MIVLDSSAIVAMLLAEDEEAAFLKVLGSKRALVGAPTLVETRMVLDARLSAAGDALNDFLRDGAITIVPFDAAMFAAAAEAFTRYGRGRHRARLNFGDCLSYAVASVMRLPLLFKGDDFVHTDIVPACSPAP

SEQ ID NO: 3147 - protein, 318 aa, Methylobacterium sp.
MLTTLAVVLPIFALILAGWLARRTGLLGPHAMAELNRFVVWLALPALLFDVMARSVGPEIWQPGFLATFGLSSGALLALTAWLARRRGRPLADAAIDGLNASYPNTGYMGFPLALAAFGPAALGPTTIAVILTVCVVFAGAIVLIEAGLQGGDRSGQRRGPVARTVALALLRNPLLVAPFCGALVPLLGLGVPAPVEAFLKLLGGAASPCALVALGLFLAEPRRGDGTGRDRRATAWLVGLKLVAHPLLAYGLGRFVFDLSPLALHTAVLMAALPTGTGPFMLAEFYRREAALTADTVLVSTVLSVVTVAAYLAYVAG

SEQ ID NO: 3148 - protein, 412 aa, Methylobacterium sp.
MTHPRPGFGRALAAALIAAPLVASPAAAQAISDGAVRIGILNDQSGVYAEFGGRSSIEAARMAIEDFGGSVNGAPIELVSADHQNKADIASGIARQWYDRDKVDAIMELTTSSVALAVQGLSKEKKRITITTGAATSDLTGKQCSPYGYHWAYDTRALAVGTGGALVQQGGNTWFMLTADYAFGHSLEAEVTRYVTSKGGKIVGGVRHPLAAQDYSSFLLQAQGSGAKVIGLANAGLDTSNAIKQAAEYGITQGGQRLAALLFTLAEVHGLGLQVAQGLTLTEGWYWDLNDETRAFGQRFMKRTGKMPNMVHTGTYSAVLQYLKAVKAAGTDETDAVNAKLHALPVEDVFAKGGTVLPNGRMVHDMYLFEVKKPAESKGPWDLYRLLATIPGSEAYAKLEESGCQLTAARTP

SEQ ID NO: 3149 - protein, 90 aa, Methylobacterium sp.
MRGGAVGSLFAQAFHLSDAERKTFLVAGSAAGMTAIFGTPAAVLLAVELQLFAWRSPPPRAGRGVAARPSPSRQPRSFTAWAGAPCPPEG

SEQ ID NO: 3150 - protein, 372 aa, Methylobacterium sp.
VSGGLAAPDADIAARLHAFRSLGGNCEFGFVQRYGGAEPSGLLRFSYTPLADLLHALDTDFSDLGAPGDLHLVPAESGTYYCASRRYGIWSNTARTVGQVDPVALLEREYGRVAHLKQRMLAELAEGSKILVRKVGPEDGADDLDRLVRAIRRHGPSPLLRVAATGPDWVPEPARWIAEGVMEGRVRRFAPQEVAWDVDLEPWLRLCDSADRLCRGLSDGPGLPPARPVLAVRGSRPRCHVTRGGADGISSFRQALDARGLARGPIHTVSAWIWLPADFAGAQVFAALDYERLAWAEADTGRRECWQRVWVSARIPDGRDGIRIGLVARAPRGEVFWSAGWRLDEGPLPPAEPEPVHPPPSGLGGWLARLRR

SEQ ID NO: 3151 - protein, 815 aa, Methylobacterium sp.
MARIRAVDGVPPLPVGGPWQLATTPPGACTRPDDLAGLDGWIPARVPGTVAAALREAGLWSEAEPAPIHDRDVWYRTTFPGTGRARLAFEGLATLCEVWLNGAPVLASRSMFRAHAVAVDLAGANDLVLCFRALKAELDRPAKRGRWRPRLATPGSLRHARTSLLGFMPGWCPEIDLVGPYRPITVTPLPADVPELVAADLRAGLDGETGHLVARLRVEGPVERATLRCDGRAVALARTAPDLFEGELLLPGIAPWWPHTHGEPRLHAVTVDLDGRTHDLGRTGFRSVTLTRPFAEGLGLAVNGVPVFCRGANWTPPDLVGLGCGAEDARPLLDLAREAGMNMLRVSGITLYESQAFHDLCDQMGILVFQDLMLANFDYPHDDPAFREELEAEIADLLNRTQLSPALCVLSGGSEVWQQAAMLGAPQAVWADAFAGERLPMLAGAVRPDLAVVPNSPSGGDLPFSTTAGVTHYYGVGAYRRPLEDARRAEVGFATECLAFANLPDEASLAAMGLGDMEAPRWGAGIPRDRGADWDFEQVRDHYVGLLFGVDPAALRRADPERYRDLGRAAVAEVVEATFAEWRRARSATRGGLVWFLRDLAPGTGWGIVDARGQPKSGWYALKRAFRPVQVTLSDEGLNGLHVHLHNETAAARDLTLRLAFTDAAGRAVAKAERAVTLPGRSSQTLSSAELLGRFFDATDSYRFGPPAHTLGHASLCDSAGAVMAEAFHFPGGRRIEPAETGLAVAVEGAAIRIRAERHALGVQVEAESARPDDTGFHLAPGAERLIAFPGTLRLPRGRVRALNAVEVVAFGPED

SEQ ID NO: 3152 - protein, 71 aa, Methylobacterium sp.
MGQDLDSTDGSGRMVTFLGRGLALRSHARLTLLVCPLCSQRNGDRMAVKGTCEWCAYEPAERDEEPCGPDR

SEQ ID NO: 3153 - protein, 514 aa, Methylobacterium sp.
MFKTILTGLALTFASTGAASAQTPGGVANVVIQPEPPGLMLGLVQNAPAQTVAGNIYEGLLRYDFALKPLPGLAERWSVSEDGRTYTFNLAANATWHDGKPFSAEDVVFSVEFLRQTHPRARGNLAKVTSVTAPDAHSVVFTLSEPFGPFLGIFEVGSLPMVPKHIYAGTDYKTNPANNHPVGTGPYMFKEWKKGSYIRLVKNPSYHVAGKPYLDEIYWHVIPDAAARAVAFETGKVDILPGGSVENFDIPRLSQAKGVCVTKKGWEYFAPLSWLWLNNRGGPTANKAFRQAVSYALDRDFAKDVIWNGLGKPAIGPIASSTRFFNPKLAKYSYDLARAKALLKESGYKGETLRLLPMPYGETWQRWAEAVKQNLEDVGIKTELVATDVAGWNQKTSDWDYDIAFTYVFQYGDPALGVARNYVSSQIVKGSPFNNVEGYANPAVDAGFAEGAATLDPAKRQAAYDGVQKIVIEDAPLAWLLELEFPTLTRCKVHDLVTTSIGVNDGFRDAWIER

SEQ ID NO: 3154 - protein, 414 aa, Methylobacterium sp.
MEDTPMNAPTCPPGSAAPEAKPSAGFVWDDPFLIDDQLTEDERAIRDVAQAFAEERLRPGIVEAYAEEKTDPGLFRQMGELGLLGVTLPEEYGCAGATYVAYGLVARAVEAVDSGYRSMMSVQSSLVMYPIHAYGTEAQRRKFLPKLASGEWIGCFGLTEPDAGSDPAGMKTRAEKIDGGYRISGAKMWISNAPFADVFVVWAKSDAHDGAIRGFVLEKGMTGLSAPALKGKLSLRASLTGEIVMEGVEVGEDALLPNVSGLKGPFGCLNRARYGISWGAMGAAEDCWHRARSYTLERKQFGRPLAQTQLVQKKLADMQTEIALGLQASLRVGRLMDAGKMAPEMISLIKRNNCGKALDIARTARDMHGGNGIMGEYHVMRHAQNLETVNTYEGTHDVHALILGRAQTGLQAFF

SEQ ID NO: 3155 - protein, 664 aa, Methylobacterium sp.
MIGVNLSGAEFGSGRGTYGKDYIYPGADTLAYYAGKGVSLVRLPVTWERLQPQLGGPLDPAELSRLETFLRSAESYGIDVVLDLHNFGRYDGVPIGSGSVTVGAFADLWTRLAQAVGGHPNLHGYGLMNEPHDMGDAAIWPAAAQAATDAIRTVDTRTTVIVAGDAYSGARNWAAHNAGLDIEDPAGKLLYEAHVYFDRDNSGVYNAPYAESGASPLGAATALQSFTDWLAARGAQGFIGEFAVPRDDPAWLPVLDTFLAAMSASGLSGTIWGGGPWWGDYKLSIEPVAGTDSPQLDVLSRYFAEEARPTQVTGDAGANLLIGSAGDDTLAGGAGADTLLGGTGADRLDGGSDGDLLYGEAGDDLVEGGAGDDTQYGGDGDDVLGGQGGNDVLQGGAGNDRLYGDEGDDVLGGQGGNDLLDGQSGNDRLWGDEGNDTLHGGEGNDMLEGGLGDDLLKGEAGADTLLGADGNDVLDGGLGSDLLYGGTGNDSLRGGDGADLLYGEAGDDLVEGGAGDDTQYGGDGDDVLGGQGGNDVLQGGGGNDRLYGDEGDDVLGGQGGNDLLAGQSGNDRLWGDEGNDMLEGGLGNDLLTGDAGADTFVFGRSQGRDTVSDFSFASGDRLWLQGQGYTVSQAAGGTLVTLSDGGSVLLQGIAASSFQGSWVV

SEQ ID NO: 3156 - protein, 122 aa, Methylobacterium sp.
MAGTGTSDSILARLSAGEFVVNAAPAAKHCTLLEQIKTCSIRLPAFAEGGLVGGGRGGPTGTAAAPDNIAIAPSITVNAAGGTREQNTDLAQQTAKAAEGMIRSIIVSELMSQRRPGNILAG

SEQ ID NO: 3157 - protein, 194 aa, Methylobacterium sp.
VTASEGRAGAFPDLRRVLDASGIVGTWDWYVTRRAVLYDEGAASLLAGDPGLAGRELQGSVATAGIHPNDLDWVMAEMRRAVEAGGLILAEYRVRRPDGSVRWVLSRGRAYRDAEGRPVRAHGVLIDITEGRDEGQRYVTHAALSPAAAADRLMDLSVELRALAEAMPSSTLSLLVDLMLLEIGGATAEPGARH

SEQ ID NO: 3158 - protein, 313 aa, Methylobacterium sp.
MSPSDLTGRLIVQEVATRDGFQIEPVFVETAEKIRLIDALAAAGFGRIEVSSFVSPKAVPALRDAAEVFAGLTRRPGTVYVALVPNPKGAERALQAGVDEINLVASVSETHNRANMGMTPAASIEGFARIMETVRGSGLSVNATVATAFGCPFEGDQPDDTVLAQVERYRALGVDGVTLADTTGMANPRQVARLVARALPAVGADRLTLHFHNTRGLGLANVLAAYEAGARRFDAALGGLGGCPFAPGATGNICTEDLVSMAHEMGLATGLDLGALIDLSRDLPRLVGHDVPGQVAKAGRPCDLHPAPPPKAA

SEQ ID NO: 3159 - protein, 96 aa, Methylobacterium sp.
MAWYEAEDYSRLRAMMQDADRLPAHYEGWAISAEQLEREVTRSGVAVVRVRLTPDAFLTWCAARDLPANGAARARYASEAVARADEGQPAALDRRG

SEQ ID NO: 3160 - protein, 694 aa, Methylobacterium sp.
MEEAGVVRQELRGTVAVLTLSNPPVNALGYDLRSALDAALSRALADDAVRAVVIAAEGKVFVGGADISEFGKPPRAPLLTDLIERLDGAGKPVVAAVHGAALGGGLELAMACHARVVGPAAKLGQPEVKLGLIPGAGGTQRLPRLIGAETAFGMMLSGEPVGAERAVAAGLAEALEPGDLVAAACAHALRLAEAGRPARVRDRAERMDEAARAAFEARAAEALKKAPGQPNVAALVDAVRAGFEQPFDEAVRTERACFLALVDDPRSKALRYAFFAERETGRVPGIAKDTPRRAIASAAVIGAGTMGGGIALCFANAGIPVTVIETEQDALDRGLARMRATYASSVKRGSLSAAAMEERLARITGAVGLERAAEADIVVEAAFEEMGVKETIFSALSRIAKPGAVLATNTSYLDVNRIAAATDRPADVLGLHFFSPANVMRLVEVVRAERTAPDALATANDLSRRLGKLPVTVGVCFGFVGNRMLARRSAAGERLLLAGALPHEIDAAVTDFGFRMGPFAMADLAGLDIGWRTRKATGGKAPVADALCEAGRLGQKTGRGFYLYPEGARTGARDPEVEALIAAESERRGIARRSFSADEIVARLMLPMVNEGARILEEGIAARPGDIDTIWLNGYNWPAWRGGPMHWADGLGLAQVAADLERFAEEAGDETLRPAPLLARLAQTDRGFSQWDAP

SEQ ID NO: 3161 - protein, 393 aa, Methylobacterium sp.
MLFDPDDLPLAGIRVLDLSRVLAGPWCAQVLGDLGADVIKVEHPERGDDTRDWGLRTGPSNTSYFDSVNRNKRSIGVDLADPEGLALVRDIARQSDVVVQNFKTGGADRLGLGYAALSAENPRLIYCSVSGYAADGPEGTRPGYDLVIQGESGLMALNGEAERPPLKFGLAAVDLFTGQFAAQGVLAALYQRERTGRGRLVELALFDCGVALTSYYGLEAMVQGRDPARYGNAHPSIVPYGVFEAGDGPIVLTVGNNAQYRRFCEQVLERPDLCADPRFATNLDRSKNRAVFVPVLEAELAKWTRADLLVRLASAGIPCGEVLGLHEALTSERARSAGLVIPQGAGAEAAHVLAPPYRLDGARLPVRHMPPPLDGSGADIRAALPDRPATRTV

SEQ ID NO: 3162 - protein, 123 aa, Methylobacterium sp.
MPCAVAKLLPLLGYAACLLTLAAMTGINLYAGPRIATAQVPMQWSLSGEPTWFAGKIVGLWFPVLIALVVGASLLLKARQGGAPSGGWADGADWLVLLGACSLLLCVHAWHVSAVMAWAAKQS

SEQ ID NO: 3163 - protein, 306 aa, Methylobacterium sp.
MPVAATLSRRFLSDVDHRTTGEVLDHPGFAQMRQPYITATMASYKTASFPGGCQSTAYRVATIGVIVCLYAAYDVEDRATWPTLARLKQTVTAFGLSSARQVDDFVARLVRTDNLVLERAPADGRLRLLKPTDKLLAWDRHVLAPYYDALQSLYPEPGYVPTRDPGFHLALRRASVRYLGPVAGFMRENTDLLPFHIMYQGVHMLMTLVNLSVAEGARAPHEPDLGAFQEAFGISRTHIRNTLLAAQQAGLLTWSGRVEKIIALTPRGLAAIDRFIADTLASHDLGYRLALGDLGHPVTPPKRRAP

SEQ ID NO: 3164 - protein, 30 aa, Methylobacterium sp.
MEVVVMVAGVLGAAGTMLCMMPSLDSFFEW

SEQ ID NO: 3165 - protein, 105 aa, Methylobacterium sp.
MNVTSASASALSPSSRSAGTGGAGAARSESGPVSGGTETEFLKYARMSPMERMRAGILKGMDLTEDQLAALPQDARTKVEDAIKDQMKTMMGQSDRKGQLIDLSA

SEQ ID NO: 3166 - protein, 290 aa, Methylobacterium sp.
MDLDIGEFEEVCRDLYVRALKILPPDIKAGFSELQKSETSATGRAILDTMVENVAVAERTKNILCQDTGIPIYNIRIGRDVAFDGVELKAAIRRGCERATKEFSLRSSVVHPITRTNEQTSCGIRVPIIHVDFDDSPETVAVEMIPKGSGSENGSFLQMLLPSDGIGAAKRFVIDRVIELGGRVCPPTIVGVGLGGTSDLCMHLAKVAATRPLRSVCPDPEGARIEAELSRAVNELGIGPQGLGGRSTSFAVHVELAATHITQNPVAVNIQCHSARRARATITPGGIAFA

SEQ ID NO: 3167 - protein, 137 aa, Methylobacterium sp.
MGERSQEHILVLLLDAVRDGGRLVGRTLELARVETDGNIRALAGLAAKVLAITVLVVSAFLVFLDAAVKMLAALIGSEAIGALIVAVPFLGVAAILGLMGLRRVALHNLEPWRSMREAERIAALAPSVLSRPAPSSR

SEQ ID NO: 3168 - protein, 226 aa, Methylobacterium sp.
MIRFYYNLSPNPMKVALCLEELGLPYEPVPVDVRRGEQFDPVYGAINPNGKVPAIVDGDVTVFDSNAILLHLCEGAGRFLPEGEAARGAMLSWLMFVATGIGPFSGQCVHFRHFAPPGQDYAVERYTFEARRHWGVLDAHLADRPWMLGDAYGIVDMAVWGWARNVPFILGEGAFADLPNVKRLLDAVNARPAAQRAEALKTRHSFKAEMDSEARGFMFRAIGTAA

SEQ ID NO: 3169 - protein, 76 aa, Methylobacterium sp.
MLLSEWMRREGLSDADVAAAVGLSAEAIRKLRFRARGTSLRVAARIEALSAGQVRAHDLQPRQDKHQAAPQPEAVP

SEQ ID NO: 3170 - protein, 275 aa, Methylobacterium sp.
MSATLQAAPAPTARPVPRGDAGAHTQVGAPILRITALRKSYGAHEVLKGIDLDVARGEVVAIIGKSGSGKSTLLRCINGLEVFQQGSLIVDGRHLLHDNPKAMRELRQGVGMIFQSFNLFPHLTVGQNVMLAPHLVKRRGRAQNAERARALLARVGLSEKFDAMPDKLSGGQQQRVAIARALAMDPAIMLCDEITSALDPELVGEVLRVVESLADEGMTLLMVTHEMSFARKVADRVIFMHQGLVHEMGAPETIFGAPQTPELRQFLGLMEGSAA

SEQ ID NO: 3171 - protein, 325 aa, Methylobacterium sp.
MHVLILGAAGMIGRRLTAALVAAGRIGNDPLTGLTLVDVVRPEAPAEFAGRVRVEAADLSAPGAAAAALAERPGLVFHLAAVVSGEAEADMDLGYRVNLDGTRLLFEAIRRVSEAEGYRPRVVFTSSLAVFGQPLPPVIGDDFIPAPASSYGVQKAMGELLLADYSRRGFLDGIGLRLPTICVRPGKPNKAASGFFSGILREPLAGLPAVLPVPDTVRHWFASPGAATGFLLHAAGLDLSGLGTRRTLTMPGISATVAEEIEALRRAAGESAVALIRREPDPAIMRIIATWPEAFDTRTANALGFVADASFDAILAQHVAESQRS

SEQ ID NO: 3172 - protein, 427 aa, Methylobacterium sp.
MRSQILAVLLTSAALTVGALAQGAQPGETKGRTDDLEKLQAFKSTGTEPAPEVPQTGRRADAIRKTLSKITLPPGFKIDLYAVVPDARSIAVGPNAGVLFVGTRKSKVYTVTDRDKDRVADEVRAFAPGIGFKVPNGVCFSRDGVLTVVEQNRVLAFPAAEFFYENPDVAAGIVVRQGELIPAGEESYNHTARVCRVGPDGKTYIALGQPYNVPPADKLDLYAKTGIGGIIRVDADGKNREVFATGIRNSVGIDFAADKSLWFTDNQVDGMGDDTPPGELNRAAKAGENFGFPWYGGGAVRTNEYKDQTPPAGVVAPQAELPPHAADLGLTFYGGKQFPKAYQGGLFIAEHGSWNRTTPVGARIMFATLGADGKVASVKPFAEGWLTKDGEYLGRPVDVAVLLDGSLLVSDDTAGAIYRIAYEGGDQ

SEQ ID NO: 3173 - protein, 116 aa, Methylobacterium sp.
VRGPNRALGLALAALVLGALILDALPAAAGADAAAGRKRAAACQACHGLDGLSKLPEAPNLAGQVEVYLVKALREYRDGTRRNAVMNVVAKDLSDADIDDLAAYYGGLQIEVLPPG

SEQ ID NO: 3174 - protein, 1152 aa, Methylobacterium sp.
MRILALDLERYGPFTDRTVRFREDARLHVVLGANEAGKSSALAAVTDLLFGIEERTRYAFRHDMPSLRLGAEIRAADGRSLRFRRRKGRKNTLVDVADAALPDDSLAPFLGGLSREVFCRAFGLDSASLRAGAAEMLEAEGELGASLFAAASGLRGYRALQGRLEEEAAGIFMPRAARDRTFYQALGRYEEARKAIRQGELRTGDWRDLNEEIAEAGTRLDGIHAERRRIAGEQARLARLKRVAPLIQAVDAAAEAAAEAAARDEGPDRPDSWTDSWTDTLGARIVAEAAAREATARAAEALERAEQELAALPLDEGLLARAEAVLEAFRGIARHDKDAQDLPRIRAEADGLGQDLARLAARIGLPDAAALKLRQPSDAARIRVEGLVREGRALAAEIARLTRDAAETRAGPEAGRPEPAIDPAPLRADLRGLAGLRAEVARRDEIDGTVRREAGLLWLQAGRLDPPVPDLAALAQVPFPAPETIARHRQAFAALERRRERAAERQEAARQAAAATRLRLRLREGADPLPSPADLARLRAERDALIEAGPAGEAALRRCREAVAAADRAADALVRDAARAAEQAADRIRLEAETEEVAAADRDLAALADAQAEAEAAWQAAWAPAGIRAAPPAEMAAWLGEVQTLLDALASVETQSIEQRRLAERVEAARPPLAALAARAGLDLLPGLDPGLMLARIEERVAALGEAWERAREAEGRARAAAEQAARRAADLAEARAREAVWREAWARALPAIGLDGAAGPDEADSALAAWAAVPAALAALEHQQRRITGLSRDMEVYRAGADALVAAHGPDLAGLPATAAMKALHDRLGAAQERRARRTDLARRRREAAEALAAAEAACGAASAALAEHLTEHLGEHPNERDEDPAALHARLTARRGLRLELESRRADLVRISDGVAEAELRADLAGTSPDAIEAALRGLALEEEALDQRGKAAFADRDRAERRRADLEGGTGAELALAQRKAAEAELAGEARRWAVLRLAGLLIGTAIGRQRAGQQDPLLTRAGALFSGLTGGAFAGLAQDYDAGDEPRLTGRRAGGELVPVDGLSEGTRDQLYLALRLAYLEDYAGRAEPAPFVGDDLFLTFDDARTGHGLEALAAVGDRVQPILFTHHRHVAELARARLGEAADVLEL

SEQ ID NO: 3175 - protein, 416 aa, Methylobacterium sp.
MSRFTFIHAADLHLGSPLSGLAARDPEIARRLAAAGRQAFEDLVSEALARDVAFLLIAGDVYDGDWADNTIGLFFARQVARLDRAGIPVLLVRGNHDAESVITRAISLPASVHTFPPTRADTHRLDHLKVAIHGRSFPNRAVPENYALTYPAALPGWFNIGLLHTSCTGHAAHETYAPCSVADLAAKDYGYWALGHIHDYAELAREPWIVFPGNLQGRSIRECGPKGAVAVAVEDGRVAALERIIVDRARFHRLAIDLAEAADERDAVARVEAALRPLAAETAGRLAAVRIHLTGETRAHDRLAADRDGLVAEIQAAAHRVHEDIWLERLKIETRRPRGPAPAPAGLAAAIDPAGLLADIDRDPDFRARARAALAEIAAKMPATLPSEEADLAAELDALCAEAEALVLGRLGGRHC

SEQ ID NO: 3176 - protein, 74 aa, Methylobacterium sp.
MLRIIQPGRLPVIHAHPIRRPARRSRRLILPVQKGGAYDCTVGLRRLGPWLVVDDNLACGGMNVTFRGVYRRRP

SEQ ID NO: 3177 - protein, 723 aa, Methylobacterium sp.
MDRVNVGGLAVARVLHDFVVEEALPGTGISPEVFWGGLGAVVRDLTPKNRALLARRDDLQARIDAWHRARAGKPADPAAYEAFLREIGYLLPDPGPVQVDTRNVDAEIAEIAGPQLVVPVSNARYALNAANARWGSLYDALYGTDAVSEEGGATRGGGYNRTRGARVVTRARAYLDRLVPLAGGRHADVVTYAVEDGRLVANLNTGETVPLARPETFAGYRGRAGMPSALLLRHNNLHIEVVLDRTHRIGRFDASGVADILLESAISTIMDLEDSVATVDADDKVVVYRNWLGLMKGTLAAAFEKDGRTQERRLNPDRHYIAPAGGEVVVPGRSLMLVRNVGHHMDTDAVLDAEGNEIPEGMLDAAVTAMIAIHDLKGDSGLRNSRTGSVYIVKPKMHGPEEVAFAVELFGRIEAMLGLEPDTLKMGIMDEERRTTVNLAACIKAAASRVVFINTGFLDRTGDEIHTAMEAGPVIRKNDMKATAWIKGYEENNVDVGLACGLLGRAQIGKGMWAAPDAMADMLMQKGAHPKAGASTAWVPSPTAATLHALHYHETDVRARQLELARRPRSALAEILEIPLARSNFAPDDVQQELDNNAQGILGYVVRWIDQGVGCSKVPDIHDVGLMEDRATLRISSQHIANWLHHGVVDEAQVMETLKRMAKVVDRQNAGDPLYRPMAPDFDGPAFRAACDLVLKGRAQPNGYTEWVLTARRREAKAEGRPA

SEQ ID NO: 3178 - protein, 312 aa, Methylobacterium sp.
MVARLETFGGDIRDVRAFCAVVDLGTVTAAAASLRETKGSVSRRLSRLERALDARLVARHPRAVSPTPEGLAFYARAKEGLGLLDEAAESARDSHTVPAGHLRVTTSVDFGIEVMPEIVASFRVLYPQITVELLNTDGVLDLAANRIDLALRLGGEAGDMGYRASTMAALAIGLYASPAYLKRRPAPAGLLELAEHDLILAREKLAPSAQRLSPGGRIEPIPLRPAILASDFAAVLRLTLAGAGLGQIPTLVAARAVEGGDLVRVLPDWSAGGGALRAISLAGRELPARVRLFREHVRGALASRFAVETGAH

SEQ ID NO: 3179 - protein, 368 aa, Methylobacterium sp.
MDSAARRAGAVLTVDVGAVVENYRFLRRRAGGAVCAAVVKADAYGLGADRIAPALARAGCRDFFVATLDEGIALRDILGPGPRIAVLHGAPPRAEPDCLAAHLVPVLNGAEQLAAWHRLARDRGRSLPAILQVDTGMARFGFSEADLARLLAAPDPFEGVALGLVMSHLACADTPDDPANAAQRAAFRSVRARMPGIPASLAASSGIFLGPAFHADLVRPGAALYGVNPQPGRPNPMRPVVRLQARILQLRDVATGDGIGYGHAAVAHRPMRLAVVAAGYADGYLRSASGRGTAFAGPHPLAVLGRVSMDSLILDVTDALPEDVPLGGFVDLIGPGHGVDALAEAASTIGYEVLTSLGARYHRIYREA

SEQ ID NO: 3180 - protein, 305 aa, Methylobacterium sp.
MSTTPQTGRAAVIGLGSMGAGMAGSLLRAGFSVTACDVNPDAVARFEAAGGRGAASPAQAAEGADVVVCVVVNAAQTEAVLFGPNGAAETMRPGAVFVSSATMDPAIARDLAARLEETGRLYLDAPMSGGAARAAEGALTFLASGSAAAFATARPALDAMAGRLYELGDAAGQGAAFKMINQLLAGVHIAAASEAMSFAAKQGLDLAKVYEVITASAGNSWMFENRMPHVVDGDYSPKSAVDIFVKDLGIVQDMARAERYPVPVAAAALQMFLAASGAGMGRDDDASVARIYAQLSGANLPTAKA

SEQ ID NO: 3181 - protein, 84 aa, Methylobacterium sp.
MVSLEDIRNILARNEALAPIAGEISEDDNLFDKGLDSFGSVQLMLALEEHFDVEFPDHLLSRKSFSTIRSIRETVSSLVQAEAA

SEQ ID NO: 3182 - protein, 321 aa, Methylobacterium sp.
VSAALDLSRPGPAPAYIAHPLHAADRHWPETNCYVDLWIELLHGRGLVPEALLGFTLRQDFEGDQFTFFKPPSADIDRLYGLEILELAVYDGLERHALVQAARGCPVLVEVDALYLPDTAGTTYGRGHAKTTIGILALDPAARTLDYLHNAGRFTLSGADYEGIFGPCELPPYAEFVKAGAPPLPEAELPGAALDLLRRHRARAPAKNPVLAFQAALSRSADALVERSLAVFHAYAFNTTRQLGANFELLGSHLRWLDGHGAADLADAAAAAEMLAQEAKTFQFQLARAFHRRSAQGLGARLDKAAAQYDAVFEALDRALV

SEQ ID NO: 3183 - protein, 604 aa, Methylobacterium sp.
MLTDRSDPAAETMVPAQPVRLGDLFGWFSTGASRRGVLLCGTFGIEQLNAYRSWGRLAARIAGAGCPTLRFDYPGEGDSGESTGSDRVTEALAAIDRGIRFLREEAGAQEIVLVGLRLGATLAARAAEAGGVDRLVLLAPFASGQAYLREMTLQARLIDRLPDGTPLPQEPGALSVGGFRLDPGTVAALGTLDLAGTVRAPAPEILMLGPKTAALADRYRSLGAAVTAGAFPELAPLVSDPLFAPYPERTFEAAAGFATACAVPGPAPDRRPVPAGALGGAGWCETVSEFGSGLVGVLCRPETQQPGAPTVIVVNSGLNARSGYGRQTTALARRLAANGIASLRFDPRGIGDSADRDDDRSPFYAPDAVTDVRAALDHLAAVQGGPVVILGTCSGAYLAFNALCADERLRAAVLVNLYCFDLKPGTDIETMVRDTFRHGQGYLARARQRGSWRRILSGEIRLGQVAGALRRDGSALIGRWTARLSRLLPGGESTGRRVARLRRRGARIAMVYSADDPGLATLRAHLGGASARVGRRLGYPVAILDGTDHNLSRPADHERIFATVQRVAHDAAQADRAAAATARQRTPLAREPNGLHLRPSETLP

SEQ ID NO: 3184 - protein, 428 aa, Methylobacterium sp.
MLRQAMILCGGLGTRLGALTAETPKPLLPVAGRPFLDTLLFELGRHGFEEVVLLAAFRSEKIEAYIRANPVAERFGMRLRVCIEPDQAGTGGALAHAAHLADDEFLLLNGDSWFDCNLLALTPLLAREPGAAIALMLRPVPDAARYGVALIRGECVTAFLERPPAPGPGLINAGVYLVRRALLAEIDGPCSLERDVLPRLAAAGRVAGLVRSGYFLDIGVPESFARAQTEIPRQRVRPAVFLDRDGVLNHDDHYVGSRERFRWVPGAAEAVAALNEAGAFVFVVTNQAGIARGLYAEADVAALHAAIRAELRAAGAHLDDVRYCPFHPEGTVPAYARAHPWRKPEPGMLLDLMAHWPVDRAASRLVGDRESDCAAARAAGVRPHLFPGGDLHAFLAEAGILPRPAADPAERSTDDAPSGAAPRRFEEA

SEQ ID NO: 3185 - protein, 397 aa, Methylobacterium sp.
MPGPLSGIRVLELGQLIAAPFAARLMAEFGAEVIKVEPPGEGDPLRKWRKMHEGTSLWWYLQSRNKKSIAVNLKSPEGLDVVRQLAKSADVVIENFRPGGLEKLGLGWDVLSALNPNLVMVRISGYGQTGPYRDRPGFGAIGEAMGGIRYTTGSPEAPPARVGVSIGDTLASLHGVMGALMALLRVKMGQGAGQVIDVSLVESVFNVMESLVPEYDLLGEVRTRTGGALPGITPSNTYPTRDGGYVVIAGNSDPIFRRLMTMIGRADLAEDPAFRSNDGRSRQAAMLDGVIGDWSAARTVEEALEALDAADVPAGRIYSVADIVADPHYQARGMILSAGLPGGQEVKMPGIVPKLSETPGEVRWQGPALGEHTDSVLADLGLDAEGIARLRDRGAVA

SEQ ID NO: 3186 - protein, 552 aa, Methylobacterium sp.
MPKGSDLLVQALENEGVDRVFGIPGEENLDIVESLRTSKIELVLTRHEQAAAFMAATYGRLTGKPGVCLATLGPGALNFSTGAAYAHLGAMPMIIITGQKGILSSRQARFQIVDVIASMKPITKMARQIVSASSIPTIVRDAFRVAMEERPGPVLLELPEDIAAEEAEAYTVPSHPIDIPVAHPKAIERAVEMILAAKRPLVMLGAAASRPRSTSDLGGFVQRTGIPFFTTQMGKGTVAHGTRLYMGTAALSERDYVHEAIDEADLIIAIGHDTVEKPPFFMGQANQKVLHISYTPANVEQVYYPDAEVVGDLGPTLKLLADRLEDRLPNAGALLPLREHILSRISDRADEDRFPVTPQRLVRDVRRVIPEDGIVCLDNGMYKIWFARNYRTYVANTLLLDNALATMGAGLPSAMMAALLYPNRRVMAVCGDGGFMMNSQEMETAVRLGLNLVVLILDDSAYGMIRWKQAVDEFPDYGMTFKNPDFVKYAESYGATGHRVGAVEDLGPTLERAFQAGGVHLVAVPIDYSENTRVLVKELREKVKPSQPDATA

SEQ ID NO: 3187 - protein, 134 aa, Methylobacterium sp.
VTRYLLDTNILSALVRSPRGLVAEQLRRVWESGVYTSVIVAAELRFGAARKVSDRLTRQVEAVLGALPVAAWQAPNDRIYADLRLGLEQAGTPIGANDLLIATQALADGSVLVTDNTREFARIGGLTIENWLRP

SEQ ID NO: 3188 - protein, 94 aa, Methylobacterium sp.
MKRDSKPAGGPDDAELVHIQLNSLDREFDSDLGCPIYETVFSCSGPEGHAEAFITVVAAEVTTLDIVPQAMSDLHRLFAVLAEQTRAWRIDPKV

SEQ ID NO: 3189 - protein, 119 aa, Methylobacterium sp.
MVGRSHSIPTSGAEFEDLAETVRDELLAMAELLRAIGPQLRRPRSDTLNGSRHANMKELRFDADDGVWRVAYAFDPERRAILLVAGDKSGVASKRFYKTLIEKADARFDRHLVRIRSDR

SEQ ID NO: 3190 - protein, 115 aa, Methylobacterium sp.
MGRRTKKRNRTNRTKKRLGRLPPTPEFRTFGMRFHQDIDRLHDTLEDAAHAAMRNFKGEERRRLRDFIGQILESDLSPDELSKLWDLTGSDVRFLDAKGFRDLLAFVHDQLRKGL

SEQ ID NO: 3191 - protein, 305 aa, Methylobacterium sp.
MDTMRRNLLFSGFGALTLLSGTVIARALFPGGPSVELGGRTIRRWGCQYQNIRPDSVAASNLDLVVLDPIVEGQPLRIEAEAPLRRKPDGARRLVLAYLCVGEAESYRAYWQTAWREAPPAWLGPENPRWPGSFAVKYWHPDWETLLLGPGGALDRIVEAGFDGVFLDRVDAYGDWPLRGQGAQRDMVALVGRLAAAARDRKPGFLVVSQNAEHLLADDGFCAVIDAVSKESLLYGLHGPNVANRPDETAWSLNYLQKAQARGLPILVIEYVSEPDRIAQARDHLARLGFVPFFGRRLLDELPGS

SEQ ID NO: 3192 - protein, 306 aa, Methylobacterium sp.
VLSPRHFLRQLDLGTLELFVLICETGSIARAAERGQIAPSALSRRVAELEAAVGGSLLDRHARGVRPNFLGEQLRHHALNILVEVEQLRSELGEFANGVRGRVRLSASASAVEQFLPADMAAFTRAHPEIRIDLRQRGSQGVASDVASRAADLGICSACEPVGALQALPYRTERLVLVMHPDHPLADRDSLPYADALDHEQIGMRGSSTVQVHLARAAREARRGLRQRVEVDSLSAMCRMIECRMGIGVMALGAFQALGERRLHGAVLTDPWAVRTLNIYAIDFARLSQPAGRLVSLLLSSQAPLA

SEQ ID NO: 3193 - protein, 98 aa, Methylobacterium sp.
LSSDAHVINRAASVGASDRFVRWLGWIATVTGVLMFVSYLDQIQLNLAGQKGSVIQPLATVVNCGLWTTYGALRRDWPVSFANAPGIVLGAVALITAL

SEQ ID NO: 3194 - protein, 253 aa, Methylobacterium sp.
MERSGDGQAGSGRGAAGGAVGFRPLYRQVYDTLLKRLADAVWQPGQILPSEGQLAAELGVSQGTVRKALDALTADSLLVRRQGRGTFVADHDDKQSVFRFFKLRPDGEGTGMPTSRVTAIAEAAASADERGRLDLARAARVVRIERVRLIDGRLCVCETISVPAALFPGIAELALPNTLYSLYATRFGITIATANERLKAVALGPREAGLLEVAAGTPALEIDRVAVDLEERPVEWRLSTCLTQDVHYLSVLR

SEQ ID NO: 3195 - protein, 117 aa, Methylobacterium sp.
MQTSSSEVPAGPTDRFEDRLARSGGPNARRRRGALRPGEAGRRGLGWKAWLAIDAVGLALFLAVIVAWPPLSACREKARAYGLYAGDTIEKCTRRGLAERFERADQRVKMLIRGSGG

SEQ ID NO: 3196 - protein, 1018 aa, Methylobacterium sp.
MIPVLNRPADALPLYAAFCAELSARGFAGDLTLSEADRTVFATDNSIYQVEPGAVAFPRDRDDLVRIGTLLDDPRFREVVMRPRGGGTGTNGQSLGPGLVVDCSRHMTRILAIDPERRTVRVEPGVVKDQLNAALKAHGLFFAPELSTSNRATIGGMISTDACGQGSCLYGKTRDHVLALTCVLADGTVLEARDRDAADLAAVKARDDRAGAIHRAVDAVVSENAALIAARFPKLNRCLTGYDLAHVRGARGGLDLKSLVCGSEGTLALIAEATLNVLPIPRAAALVALSYVDFDAALRDARALLPFGAASVETIDSTVLGLARNDPGWAGVQAFFPEDPAGRRVDGINLVEFVGAEESDVEAALGRLVAMLEDDPSPTRIGFTIARGAAIERLWTMRKKAVGLLGAVKGDARPIPFVEDTAVPPERLADYIAEFRALLDGKGLRYGMFGHVDAGVLHVRPAIDLKDEGQERLIREVTEGVVALTARYGGLLWGEHGKGFRSEFVPGVFGPLVPALEAVKRAFDPGDRLNPGKIASAQGAALTAIDAVPLRGERDRTIPRDVRAAFDEALHCNGNGACFSYDADEAMCPSWKATRERRHSPKGRASLMREWLRRTAAAGIDPAASLREERPGWLGPLAASLRAALRPAPRSEDFSHAVKEAMDGCLACKSCTGSCPIKVDVPSFRAKFLALYHQRYPRPLKDHVVAALEPLLPLAGRAPRLSNLLSRNPLGQAVLRRLGLVAIPAFSAPLAPALAGLGVRTATPAALRALSEAERACAVVVVQDAFTSHFEAPVVADLCVLLIELGFRPWLAPFRPNGKPAHVHGFLARFRKTAEANARMLRALEATGVPLVGVDPSMTLTYRSEYVGALGTGNVPRVQLVQEWLAARLDAIAARPAGRSLRLLPHCTERTNAPAAVKDWQALFAHLGLPLEIPAAGCCGMAGTYGHEAANRATSEVIYGQSWARRVAESPEGTLLADGYSCRCQAKLIDGRALPHPVQALLAHVRAHAPVDAPKLAA

SEQ ID NO: 3197 - protein, 320 aa, Methylobacterium sp.
MRGAVRLLLTLLLLTAPALAGELRVTLGTATPGGGFPAYAEALISALREADPGLVIEPRSTGGSVENLDLLRGGVLDLALVQGEHAYPALADDAPPRLTVVAPIYPTPGLFVLPARSPVQQVRDLRGRPVALGTRDSGLTAMGRAVLAASGLDPERDIVPVVLARAGDGPDRVRAGTVAALWGGGLRWPGFTALAGDPGGARFLAPAPEAVARLVAERPSLRRMRVPAGTFRGQDEPIDTVGSWSLILARPGLPPGTAERLVRAMDAARDALARTTGQGTGSDPRNLAEAVPAAWLNPGTTRALADLAGGPQPPPSEPAR

SEQ ID NO: 3198 - protein, 140 aa, Methylobacterium sp.
VSAALALSGPQQLVASWRAGVLSLPDDRLPCPGLIWLEPGPRGRSGVWAGVRTMMLRFVEHWGEEAAALGWSTESLFGVHRLAGAMRADSTGALVTLYPRKVVALDERTVTTERNGVRQVFRGMPNPAESIPLWRFNLSA

SEQ ID NO: 3199 - protein, 298 aa, Methylobacterium sp.
MLADLASEGESGAQPRPGRTLGYAQGRFHDLAYVEWGDPASPHTVLCLHGLSRQGRDFDPLARALVGLGYRVICPDIVGRGRSGWLADPELYGLPQYVRDMAALIAHLGVDRLDWVGTSLGGLVGMMLAGAQNTPIRRLVMNDIGPFLPWAALRGIGNRLREAPRVHHSLATAEARLRTALRDFGTLTDAQWRAMTRHSFYPEPGGTWRPHYDPAIAVAFRPGRVYNVTLWRDWDAVHCPVLLLRGETSDLLLPQTAAEMTRRGPCATLVEIPGCGHAPALFDDDQIRIVTDWMGRAG

SEQ ID NO: 3200 - protein, 280 aa, Methylobacterium sp.
MRSGRSRRGGGRRGRAPAAASLALLCALAGLMPGPAAARLTQAELARVAVAPPPGARAPLALAFTDAAGDRPVTLGEAAGGRPVLLLPVDYTCGNVCDPMLSLSAAALAATGLAGERDYGFVLVGLDPRDDAAAARRMLSETLGSAPSPTRPRALVGSADAVAALTRALGYGFVPDPGTDSIAHPAAAILLTPEGRVARVLSPLALNGRDLRLALVEAGEGRTGTLSDRLALLCYGFDAVTGVYTPLVRRILAVAGGATVLGIALLVLLLARAGRARTAP

SEQ ID NO: 3201 - protein, 47 aa, Methylobacterium sp.
MRTKVVLALTLFVLLTTGKTPGFRELRNPDAEHHGGRAAVALKRDRL

SEQ ID NO: 3202 - protein, 594 aa, Methylobacterium sp.
MATTGIRAEASQLARIDVQLLLWLVVGFSVLTLNGSTDLWDTITRLRVADPDDAMRLVGVRDLLAGQGWYDNTQYRFLPPGGVPSHWSRLVDAPIAGLILLLTPLAGRALAEGLTAVLWPLLLFGLFCLMVHRGVRRSFGPRAAVLAVFAATQTFGILVQFHAGRVDHHNLQILATFGLALCIVRGGLRPGLVGGGLAALSLAIGLEALPYIALGGLFLAGDWVLRGRAALPAFLGFGLGLSAAFPLFAAQTAPGLWGTSYCDALSPPWLWLAAGGCATALVCAGLDRRLATAGARLGLAFLCGGLLLAGFAALFPACLGGPFPGMTPLVREHWLHTVNEMSSVPKFLAWRQWEILAFYPILVVAAAAATGLALRGPERRLFGVAALFLWPGVVLGFFQLRGIYVAVAFVPLVAGPLIDRALAAAPSLRGARLWGAFALSAGLIGSCWTALALLAGALTPAAGNGRDPTGAVNCHADAAVAPLAVLPPGTVLASIFLGPSILLRTPHSVVGAPYHRAIPGLTAVIEGLGGTEADLLRHVRAHDVRYLATCPTRPGDDLQAEPAFATRLTRGEVAVPWLEPVELPGSALRVWRVR

SEQ ID NO: 3203 - protein, 508 aa, Methylobacterium sp.
MSHHTETLVIGAGPAGLTAAYLLSKHGRSVTVLERDPAQVGGISRTVSHNGYLFDIGGHRFFSKSKAVVDLWDEILPDDFIERPRLSRIYYQGRYYAYPLKAFEALRNLGLLTSTACVLSYLYARARPIETPRSFHDWVRNQFGERLFSIFFKTYTEKVWGMSCDAISADWAAQRIKGLDLGAAIRDALMRSLGLRGRPKGGGKAGGKTGEPVIKTLIESFRYPRRGPGMMWEAAAAKIQAQGGRVLLDRGVDGLSYDPATGIWTVSVLLGDGSRETYTARNLVSSAPVRELVDAIRPRPLSTFHARALQYRDFLTVALIAKSDRTFPDNWIYIHDPSVKVGRVQNFLSWSPEMVPEEGHTCLGLEYFCFEGDGLWNSSDADLVALAKAEIGKIGLIDPADVVDACVVRQPKAYPVYDETYAANVAMVRMELERDFPSLHLVGRNGMHKYNNQDHAMMTAMLTVENILAGQRRHDVWRVNEDAEYSEAGVSGAEAALGSERLVPRKVA

SEQ ID NO: 3204 - protein, 318 aa, Methylobacterium sp.
MKTCLILDDYQDAARHFADWDRLRNRVAVTVLRETITDPDALVARIGAAEILVVMRERTPFPAALLARLPRLELLVTSGMRNAAIDLAAARRQGVTVCGTASHPAPPAELTWALILALARRIAPESAALRAGGPWQSSVGTDLAGARLGIVGLGKIGTRIARVARAFDMEVAAWSPNLTEARAEAAGVRRAASKEALLAESDVVTLHLVLSEATRGIIGAEDLARMKPSAFLVNTARAGLVDQAALVRTLAENRIAGAGLDVFETEPLPIESPFRALPNVLALPHLGYVSEGNYRTYFSEAVEDIEAWLGGAPVRVLG

SEQ ID NO: 3205 - protein, 173 aa, Methylobacterium sp.
MIELRPLRPAGSRSGAAAGDEDGRRRDRFWAAHGSCGPDRACPDRGRSVPAAHNRSIAMIIWSGWGVLSALITVLAFVGGVVLDLQLPKLGIPAPTGLVLAWIAAAALNWVVGRRLNGRPGREMIDARTGQRVLLVQNHTLFWIPMQYYSVLMLLLGALVVVSSLSRVPRPPV

SEQ ID NO: 3206 - protein, 394 aa, Methylobacterium sp.
VSEPAEPAGPGRRASFPLLVAVTMTGTLALHIFVPALADAAADLGTTPAAAQLTITLFLVGLAGGQLVYGPLSDRYGRRPVLIAGLGLYLAGLLLAIPAPNITVLVVARVLQALGACSTLVIGRAMVRDVSGSADAARRMALLTMAMTLTPALAPALGGLVDTWLGWRAVFGVLALLVGVLGALVVFTLPETNRHPVALPGPSAMAAAYLRLLRIPVFRAYLVAGACAGTSLYAFLAVAPFLLVDRLGRSSGEVGLDCLIVVFGMVAGAVAANRLAGRVPIRLLARAGNLVCLAGAGALLAIDQAGLLGVVSLILPLIVYAVGVGLVGPNAVAGLMNVDPRAAGAASSLYGFTQMTFGAVFTVAVGLWHQGSATPVAATLLGAATVAGLALRRA

SEQ ID NO: 3207 - protein, 398 aa, Methylobacterium sp.
VPDARDGGEDAMRTIDHGQHQDIRDAVRALCAEFPPEYHRKVDEARGYPEAFVDALTKAGWMAALIPEAYGGSGLGLTEASVIMEEINRSGGNSGACHGQMYNMNTLVRHGSEAQRRHYLPKIAAGELRLQSMGVTEPTAGTDTTKIKTTAVRRGDRWVINGQKVWISRIQHSDLMILLARTTPLDQVKKKSEGLSIFLVDLHEAQKKGMAVRPILNMVNHETNELFFDDLEIPAENLIGEEGQGFRYILTGLNAERALIAAECIGDGYWFIDKVTAYAKERTVFGRPIGQNQGVQFPIAESFIEVEAANLMRYEACRLYDAGEPCGAQANMAKYLAAKASWEAANACIQFHGGFGFAAEYDVERKFRETRLYQVAPISTNLILSYVAEHILGLPRSF

SEQ ID NO: 3208 - protein, 380 aa, Methylobacterium sp.
MTFGLTEDQVAIREMAAGFAAEHIAPHALDWDERKHFPVETLRAAAALGMGAITVREDVGGSALSRVDSAVIFEALAEGCPTVAAFLAIHNLTAGILDRFGSEAQRRAWLPRLATMETVASYCLTEPGSGSDAAALRTRAERDGDHYVLNGEKQFISGAGASDLYLCMVRTGESGPRGISAVLVEKGTPGLSFGANERKMGWNAQPTRAVRFDNVRVPVENRVGQEGEGFRIAMAGLDGGRLNIAACSLGGAQAALTKALAYMEDRRAFGTKLADFQALQFRVADMATDLTVARTFLHHAAAALDAGAPEATTLCAMAKRHVTDVGSRVADDALQLHGGYGYLAEYGIEKIVRDLRVHRILEGTNEIMRLIIARALVGRR

SEQ ID NO: 3209 - protein, 490 aa, Methylobacterium sp.
MPETEILSLKDPSLLVDACLIGGEWSKSGSGSIEVTNPATGARIARVPNAGVEETRRAIAAAHAAYPAWRARTAAERATLLKKLAALILENHEDLARILTAEQGKSLAESRAEVAMSAGYVTWFAEEARRVYGDVVPSPWPNRRILVTKEPVGVVAAITPWNFPSSMIARKLAPALAAGCPIVIKPATQTPLSGLVWGLLCERAGFPAGLVSILTGSAKQIGGELTGNPLVKKITFTGSTEIGKLLMSQAAGTVKKVSMELGGNAPFIVFDDADLDRAVEGAMLAKYRNSGQTCVCTNRVLVQDGIYDAFAEKMAAAAKALKVGNGAEEGVMQGPLIDHAAVEKVEAHIRDATAKGARVIAGGKRHALGGSFFEPTVLVDVVPGMEVAKEETFGPLAPLFRFRDEAEAIAMANDTEFGLACYFYTRDLGRVFRVSEALEYGMVGVNEGIITTEVAPFGGVKESGVGREGGYQGIEDYLNTKYVCVGGLGA

SEQ ID NO: 3210 - protein, 309 aa, Methylobacterium sp.
MPLDASARGVYPIAPTPFHPDGRIDVESIDRLTDFYVGCGATGLTVLGVMGEAPKLDHAEGIAVATRFIRRAGNLPVIVGVSAPGFAAMAGLARASMEAGAAGVMIAPPNSLRTDDQIATYYRQAAEAVGADVPFVIQDYPLNFSVVMTPGVIRRIVQENANCVMLKHEDWPGLEKISQLRAFEADGTMRHISILCGNGGLFLDFECERGADGAMTGYAFPDMLVDVVRLSQAGERDAAHDLFDAHLPLLRYEQQPGVGLAIRKYVMARRGLIASDAQRRPAGGMSATARAEVEYLLARLVRHDPRAAV

SEQ ID NO: 3211 - protein, 418 aa, Methylobacterium sp.
MQIHLDAIGGMAGDMFAAALLDAFPEHEAGVLASIRAAAAGAACELVAHNDGVLQGRRFVVAERGAAGAHDHHHTHDHHHHHHHGAHDHRHWSQIRAGLTAADLEPRVRDHALAIFGHLAEAEARVHGIPVAQVSFHEVGALDSIADIVAAAHLAAATGATGWSVSALPLGAGRVRTQHGVLPVPAPATALLLEGFATIDDGVPGERVTPTGAAILRHLCGTGGRASGPRTLARSGIGFGTRTLPGLSNCVRALVFDEAEAGDRAGGRHRDLAVIEFEVDDQSAEDLAMGLDRLRAHPDVFDAVQMPVFGKKGRMMTHVRVLARADALEAAAEACFRETTTIGLRHRIVSGIALERTSRTVAVGGHDLRVKTVARPGGVTAKAEADDALAHEGHAARESLRRAAERIALAERADEERA

SEQ ID NO: 3212 - protein, 271 aa, Methylobacterium sp.
MSASLESLLAGMGPLAVAVSGGVDSLTLATLAHRRLGHDGMLAVHAASPAVPGEATARVRAEAERQGWRLRVIEAGEFADPRYRANPVNRCFFCKTNLYAAIAQATDRQIVSGANLDDLGEYRPGLDAAREHGVRHPFVAAGLGKAAVRALARAMGLGDVAELPASPCLSSRVETGIRIEPETLAFIHAVERIVGRALAAEGAEARVRCRVRAEGVVVELDPRCLALLDTGLRADLGSAIRERAPAPALAGPVRFEPYRNGSAFLLNGAAR

SEQ ID NO: 3213 - protein, 421 aa, Methylobacterium sp.
MTLALGCVADDYTGASDLANTLTKAGLRTVQTIGIPADDLALGAADAVVVALKSRSIAPERAVALSRAADAWLRGRGAAHVMFKICSTFDSTDRGNIGPVLDALRKDAGEAIALVTPAFPETGRSVYQGHLFVGAVPLNESPLKDHPLNPMRDSDLVRVLARQSAAPVGLIDVATVARGADAVRGRLDALAAEGAGAAIADAIFDTDLEILGRAALAHRVSCGASGLGLGLARALAAPSAPDPAADVLAEAVGGLSACLAGSCSRATLEQIAAAEDRMPVLRLDPERLIASPDGLAEAVAWAGDRIGRGPVLIASSADPEAVRALQARHGVEAAGHAIETGLARLAAALVERGVRRLVVAGGETSGAVVDHLGLKAFRVGPEIAAGVPVLRTTSGEPMLLALKSGNFGGRDFFALALDLMR

SEQ ID NO: 3214 - protein, 338 aa, Methylobacterium sp.
VTIHQTPGRLVTIADVAREAGVGESTVSRVLRGQGSFSKRAGERVLEVAARLGYVPNRLAGSLAGNADSAGSQLVGVVIPSLANIVFPDLLRGLTGALDGAGFQSVVGVSDYDPAREEALVAGLLSWRPAALVLTGLEHTELTQTRLRAAGIRIVEMIDTDGPGLDIVVGFSNRTVGHASARHLIGRGYRRIAYVGHDLGRDLRAAKRLAGFEAALAESGLALHARELVADRSSASAGRAALEALMGRVPDTDAVYFSNDDMALGGYFACLGRGWAVPERVALFGCHALDITEAMPQPLSTMRTPRLAIGRAAAEALGAGGPPGTIDLGFELSEGATA

SEQ ID NO: 3215 - protein, 223 aa, Methylobacterium sp.
MNASESRLREEICRYGRSLFERGLTPGSSGNISVRLDDGGWLVSPTNASLGFLDPARISRLDAVGNLVSGDKPTKEIPLHTALYQSRREARAIVHLHSTHAVAVSMLPEIDPKAVLPPLTPYYLMRTGGTALVPYFRPGDPAVADAIRGLAGRYSAVLLANHGPVVAGESLEGAVFATEELEETARLYLLLRNLNPRALSPAQVDDLVAHFGLTLPDHRGGCG

SEQ ID NO: 3216 - protein, 376 aa, Methylobacterium sp.
MRARRPDPSHDRLIMISGPALVVDRTHLGRRASGIERITEELFSASALAPLPVVGWDGAGSKPSMVLNQRLRIPAAALAHKSKLWLFSGYPPSPWMTWMPERTIFYVHDLFLLTRQAELNRSAKLYMVRPFRTALARLRYFLANSQATVDALRTAVRPEATILPYRPAIRNVFGLSDRRPAAADDRPLVVGAMGTIEPRKNFVGAARLCESLGHVLGRRVELHIIGRSGWGEDASILERQPHVRLEGFLDDAAARAVIDGFDLFLCSSHDEGLGLPLLEMQFAGLLVVAPDKPVFREVLGTSGLLVDMADPEGAARAIAGRLAEPGWRARAQGQASANIARWNRQAAQDRDAVIAFLEARLSALDASAATHCVQQA

SEQ ID NO: 3217 - protein, 76 aa, Methylobacterium sp.
VSATRNEQTKLLATAINNVAVAFAVLGFVTPVVAVSFGAASAPILRTDSALFMLVWLCAGFTLHWVARRTLRSLEP

SEQ ID NO: 3218 - protein, 327 aa, Methylobacterium sp.
MMSEDAASVSLPSYGDVARAAERIRGAAHRTPVLTSRTADARTGGQLFFKAENLQRAGAFKFRGAYNAIAALPEEARRRGVIAYSSGNHAQAITLAARLLDVPATIVMPLDAPAMKVAATRDYGAEVVTYDRYTQDREALGRSIAAERSLSLIPPYDHPEVIAGQGTLALELIEETGPLDILVACLGGGGQLAGCALAAAELMPEARVYGVEPEAGNDGQRSFREGRIVRIPVPQTIADGAQTTHLGARTFPIIARHVTDVLTVSDAQLVETMRFFAERMKLVVEPTGCLAAAAVLAGLVDVRDKRVGVVISGGNVDLASFARFIGG

SEQ ID NO: 3219 - protein, 161 aa, Methylobacterium sp.
MSDGRKPPGAPDRPGGLIQAILSGLAPKRPPAPEPEPAHWPEAPRAGPGYETEDVDVRRTGLVMAGLAASALVAVGLMLWLMHAFAAGQRRELPSLTPQQTAVLKPPPPNLQADPYRDIARERAAERARLDGYALTEGGRARIPIGRAMELVTGRPLDPAR

SEQ ID NO: 3220 - protein, 103 aa, Methylobacterium sp.
MRNPIHDLSPEDRALLRRHMRKPVLTFLALLALLAVNVALGATVPFAHTWALELIVVTVMVALILLVSMEVTKEPPLVKLFSVLGFFWVAILVGMTLTDYLAR

SEQ ID NO: 3221 - protein, 122 aa, Methylobacterium sp.
MRTIENRTEDTVLNTLNALLGVILLSTPWYLGVANETAAALNAFVCGTAIAIIAVLALSKSYDWEEYINLAIGLWVSIAPWVLGFAETGASMWAHVVIGLAVAALAAVELWRLYVSPEARSV

SEQ ID NO: 3222 - protein, 294 aa, Methylobacterium sp.
MNIGFIGLGIMGAPMAGHLIAGGHSLFLKSRRSVPDALLSAGGTACTTAAEVARHADVIILMLPDTPDVETVLFGEAGVAEGLAPGKTVIDMSSVSPIATKDFAAKVARAGCDYLDAPVSGGEVGAKNAALSIMVGGAEAAFARAEPLFHLMGKTVTHVGESGAGQVAKVANQIIVALTIEAVAEGLLFASKAGADPAKVRQAITGGLATSRILELHGARMIERTFQPGFRIDLHRKDLNLALEGAKALDLALPGTALAQQLFGACAANGAGGLDHSALVRALEIMANHPVAEG

SEQ ID NO: 3223 - protein, 296 aa, Methylobacterium sp.
MSDRPRSPAFYALAAFFVLFVAFLYGPTLTILVLSFQGPHGGLTFPMNGVSTHWFGKLWAGLGIVDIWGALWRSLRLGFVVMVLTVGIAFFAGLAFRKRFVGEGALFTVAVASLIVPSIVVSLGIGLEFRLLDDAVKWLAAETGWGWLQEHGTLMGLYTSALGAHLTWTLPFGLLIMFAVFNRFDPAYEEAARDLGATGPQTLRHVVVPILGPSLVGVALFGFTLSFDELARTSQAIGGRNTLPLELQGLTTTVTTPEIYALGTLTTGLSLAVIGAALGASLYLQRRRARRGLRLG

SEQ ID NO: 3224 - protein, 314 aa, Methylobacterium sp.
MTEAALPALADAPTVPVAASLTAKTRRRRALAYLQAAPMALVFAVFFLVPLLLTLMVSFWEYNEYEIIPSFTVQNYRDVFEGCLDVQNACTTLRTYLSTLKFCALTWLFTLLIGFTVAYFVAFHVRSRNVQMALFLVCTIPFWTSNVIRMISWIPLLGRNGLVNDTLMGLGLIARPIEGLLYSDFSVVLAFVHLNTVFMIVPIFNSMARIDRALLEAAYDAGASGWQTLWNVVIPLAKPGIAIGSIFVITLVMGDFVTVGVMGGQQIASVGKIIQVQMSALQLPAAAANAVVLLGAVMLMIVAMTRLIDLRKEL

SEQ ID NO: 3225 - protein, 424 aa, Methylobacterium sp.
MTTTIKLSRRTLLQGAGVAGLALGAGPITGFPNVIAAEPVTLRYLGTAVNQSGDIARKVKEDLGITIEYIPVVTDEVTKRVVTQPNSFDLLDTEYFSLRKLIPSGNIQGMDARRIKQADNITPVFTRGEVAGKKIGDQGTAPKKVFYLEGQNSKNFAGSATEWITLIPTTYNADTLGIRPDLIKRPITSWRELLNPEFKGKASILNIPSIGIMDAAMVIEATGDYTYPDKGNMTKAEIDRTIKVLIEAKRAGQFRAFWQDFNESVNLMASGETVIQSMWSPAVTKVRSQGVACTYQPLKEGYRAWASGFGLPKTLTGRKLDAAYDFINWFLSGWAGAYLNRQGYYSAVLETAKAQMEPYEWAYWMEGKPAEKDIKGPDGSVLEKAGATRDGGSFETRMGGVACWNAVMDENTYMVRKWNEFIAA

SEQ ID NO: 3226 - protein, 330 aa, Methylobacterium sp.
MDVELIRLTKRYGSTVAVDGIDLKVRSGAYCCLLGPSGCGKTTTLRMIGGHETVSSGDVVIGPRAVGDAAPAERGTAMMFQSYALFPHLDCRDNVAFSLKMRGVGKAERRARALAMLDLVQMAHLAERMPAQLSGGQQQRVALARALVTGPKVLLLDEPLSALDPFLRVRMRTELKRIQAELGLTFIHVTHSQEEAMALSDLVVVMNGGRIEQAGDPRTVFERPATAFVARFIGGHNVVRLPDASEIAVRADGMRLGPEAGAEAVPARVVSIEYQGTSVHVGLEADGLGGREPAALTAIIGDGAYADRPLALGQTVPLGWDAAAAHRLSA

SEQ ID NO: 3227 - protein, 473 aa, Methylobacterium sp.
MADFDLAIRGGMLVTAADTLRADLGIRAGRIAAVAERITDAARTLDASGLLVLPGGIDSHVHIAQASGPGIVMADDFASATRAAAAGGNTCVMPFALQPRGASLREATHAYRALAKGQCHIDVAIHLIVSDPTPAVLGQELPALIAEGYTSFKVFMTYDDLVLNDRQILDVFDLARREGARVMVHAEGYDTIRYMTEKLERAGQTAPYGHALSRPELVEREAAHRAIAHAELVDLPIVIVHVSGEQAMEQIAWARGRGLKIHAETCPQYLTLTAEDLKGRGAADPMAGAKYVCSPPPRDSASQAAIWRGLETGVFEIVSSDHCPFRYDDPSGKLNPRARDSFRYVPNGIPGIETRLPILFSEGVSKGRISLNRFVELTATNHAKLYGLYPRKGSIGVGFDADLTLWDPNRRETITQANLHHGADYTPWEGFGVTGWPVMTIARGAVVAEDGRVTGAPDRGRVIDRTVQAVPPR

SEQ ID NO: 3228 - protein, 368 aa, Methylobacterium sp.
VSSTRPTITPADAVAEVSALGRRLAEGAKLFGEIRDADVQIATTPKDLVWSQDKVSLYRYRPLAESKGLPPVLIVYGLIGRYTMADLQEDRSLVRNLLNLGLDLWVVDWGNPGRAERFVTIDDYVDGYLAECVDVIQERTNRETLNLLGICEGGVFTTCYAALNPDHVNAMVLTITPIDFHADQIDNRPGHGFINLWARSLRPEDVDRLIESQGSLPGAFMGSVFSMMTPMRTLTKYNLDLLDALADRKKFLNFLRMEKWIADRPDHPGEAAKQWLKDLYQENKLVESRFELSGRTVRLSQITCPVLNVFAKDDHIIPPATSRALGAKIGTQDYTELGLPGGHVGVFVGGKAQALLGSGIADWLSARG

SEQ ID NO: 3229 - protein, 369 aa, Methylobacterium sp.
MERRSFLQGAVLGAGLAGAGSAGAAVNAPGLPQTRPQDPADLPFVADPGEMRGEMLYRPFGRHAEKISAIGMGGFHLGKNAVSDAEATRLIHAGIERGITFMDNCWDYNEGRSELRMGEALSQGGYRDKVFLMSKMDGRTRDEAMRQIDTSLKRLRTDRIDLVQHHEILRYDDPDRVFAEGGAMEAFVEAKKQGKLRYIGFTGHKDPRIHLQMLEVAAERGFQFDAVQMPLNVMDAHFRSFGHLVLPYLVQNGIAPLAMKTFGDGVILKSDAPIKPLEYLHFSLNLPVSVVITGIQNQRDLDQAFEAVKTFRPMDKARVAELLGRSRAYALEGKYELFKTSATFDGTAKNAAWLGEDVPGVQKLAPTME

SEQ ID NO: 3230 - protein, 223 aa, Methylobacterium sp.
MSLAEEFVLDFARPERIGMEETVYAAGKSAEQIDAILTAAAERGARLFLTRLDADKRAALAHELDYCPVSRTAVFGGPNRVAGVASVAIVAAGTSDVPVAREAERTLAYTGIAATLIADVGVAGLWRLQRRLDEIRAHPVVIVAAGMDAALPSVVGGLVPGALIAVPTSVGYGVAEGGRAALDAVLASCAPGITVCNIDNGYGAACAAMRVLHAARALRELSP

SEQ ID NO: 3231 - protein, 262 aa, Methylobacterium sp.
VAHELRAVAAAARPDLAGIDRAELARTRTDLAACFRMAARYGLEEGICNHFSAVVPGRDDLFVVNPYGLAFAEIRASDLLVCSLDGHVLEGEGQPEATAFFIHARLHARLPRARAAFHTHMPNATALSMIAGQPLAFAGQTALKFYGRVAVDDAYNGLALDFTEGDRIAATLGEADVVFLRNHGVIVTGPTVAEAWDDLYYLERAAEVQLKAMASGRALVPVPEAIAARTAAQTREGDPESARLHMESIRRRLAREEPDFSG

SEQ ID NO: 3232 - protein, 249 aa, Methylobacterium sp.
MEGTDLAWRAEEACRNAWPAPREAHLDGWLLRAAGGPTRRTNSVNPLRGPRAAPEAAIAACAAVFRGLGRPALFRVVSLAPELDPVLARRGYAAEGASLTLVADLAGRGQAQDPVHLAEAPDADWLAFRAAINGADPEAERAYRAMHAAILLPRACAALRVEGAIVAQAYGVLDGPLVVMESVATAEACRGRGYAHRVVAALMRWGRARGARAACLQVVADNAPARALYAGLGFDREVSRYHYRRAPGR

SEQ ID NO: 3233 - protein, 446 aa, Methylobacterium sp.
MTASGTESAAGAATSLDAALTRIGTGRFQARLLGIFGLVWAADAMQVLAIGFAAPTLARAFEIPVPQAIQVGTVFFLGMMLGAWGFGRLADRVGRRAVLIGTVLADAAFGLASALAPDFTSLLVLRFLTGAAVGGTLPVDYAAMAEFLPAARRGRWLVLLEAFWALGTLALALVSWAAAAWGGPDAWRWIFAATALPALVGVALRFWVPESPYFLWRQGRLDEADRVLARMAAANGRSFSAGTLRRDLETGPQPSLLAAPLRQPFLLILAVWLLVSMAYYGLFVWLPAQLAASGLGFLRAQGFLVLVALAQLPGYALAAHGVESWGRRRTLIGFLLTAAAGCSLYVATADPLVIAGATLLMSFAMLGAWGALYAFTPELFPTTTRATGMGAAGALARVGGLLAPSALGLVVAVSFAAAIGLFAVLLALAAIAVAGIREETRGRVLT

SEQ ID NO: 3234 - protein, 440 aa, Methylobacterium sp.
MSAGIAVSDARRSRVRISIVLMLFVATTINYADRATISIAGPALSKDLGLNAVQMGYIFSAFAWSYVLAQIPGGWLLDRYGVKWVYAAAIFLWSAFTLVQGAVGFFTGATAVALLFALRLAVGLTEAPVFPANARITAAWFPAKERGMASAFFNSAQYFATVLFTPLMAWVVHHFGWHHVFTMMGALGIAFALLWTQLIHSPKDHPGINQAERDYIEKGGALLDMDGQGSARQANVGKTLKQLLANRMLLGIYIGQYCITTLTYFFLTWFPVYLVKERGLSILQAGFAAVLPALCGFVGGILGGVISDMLLRRGYSLTAARKIPIVGGMLLSMSIIGCNYVQADALVVGLMALAFFGKGIGALGWAVVSDTSPRESGGLSGGLFNTFGNTAGITTPIVIGYIVQTTGSFNGALVFVGLNALVACFCYLVVVGEIRRVELR

SEQ ID NO: 3235 - protein, 398 aa, Methylobacterium sp.
MSAHTKPRPLDGITVLSLEHAIAAPFCTRQLADLGARVIKIERPGTGDFARAYDERVRGMASHFVWTNRSKESLTLDLKAPQAAGILDRLVERADVLVQNLAPGAAARLGLSYEAVSQRNPRIVVCDISGYGDDGPYREKKAYDLLIQAEGGFLSVTGSPDEPAKAGNSIADIAAGMYALQSVMAGLIQRDRTGRGARYDVSMLECMAEWMGYPLLYAFEGAEPPPRAGASHATIYPYGPFPTGDGRTVMLGLQNEREWTLFCSRVLRRPELTADPRFSSNARRSAARVELAGIIEQAFAGLDRAAVMARLDAAGIANAGVNSMADLWAHPQLHARGRFGEIGSPVGPLPTLLPPGRTEAYAPRLDPVPALGEHSAAILAELGYDGAAIDALRADGVI

SEQ ID NO: 3236 - protein, 284 aa, Methylobacterium sp.
MDASPLDLDHLRTWIGRTETAEDQLTEQTVRAFRATLDQDPGNPETGEVAPLAIHWCLSPPIRPLHELGPDGHPARGGFLPPVPLPRRMWAGGEIVHRDPLRVGDRVRRLSRIGDVQVKHGRTGPLCFVAVHHDFETARGPAVSERHDIVYREMTPGRSGQPPEAAGGVPEADLSETVEPGPTQLFRYSALTFNGHRIHYDRTYAREVEGYPGLVVHGPLQATWLLHLAARLAGRIPETFRFRGLSPVMDGAPLTVSARLTGDGSGEAWTLTADGRVGMQATFS

SEQ ID NO: 3237 - protein, 566 aa, Methylobacterium sp.
MSDEPHGLDRGLTNYGDRDFARFLRRSFARSMGISPGLLNRPVVGIAMTPSGFNNCHRSMPELVEAVSRGVLAAGALPRPFPTVSLGEVFLNPTSMMYRNLMAMDTEEMIGAQPMDAVVLIGGCDKTVPAQLMGAASADVPAVQLVTGPMSTGRHRGQRLGACTDCRGFWGRYRAGTVDAEEIAEVEGRLSVTAGTCAVMGTASTMACIAEALGMSLPGTAAIPAVHSDRLVAAEESGRAAVRLIETRIRPSRIITEKSVENAIRVLMALSGSTNAVVHLTAIAGRLGIRISPERFNAISDETPVLVDLKPVGQGYMEDFHAAGGMGALLRELRPLLHLDTRDIEGRTLAERLDEPAGWIDRSVIRPASDPISPVGGLVSLSGTLAPDGAIFKRAAATSDLFESEGRAVVFTGLEDLSRRIDDPELDVQAGDILVLQNAGPHAAGMPEAGYLPIPKKLAQAGVKDMVRISDARMSGTAFGSIVLHVAPEAAIGGPLAAVRDGDRIRLSIREKRVDLLVAPEEIARRMDGFQPPPAPKRGYKALYRRTVTQAPEGCDFDFLAGGIAV

SEQ ID NO: 3238 - protein, 300 aa, Methylobacterium sp.
VAQTIGFIGLGNMGGPMAANLVKAGHTVRGFDLVPASLEAARAAGIAVVGSAAEAAQGADAVVTMLPAGRHVIDVWGGLCESVPAGTLLIDSSTVDVESARRAHALAEARGCPSVDAPVSGGTGGAKAGTLTFMAGGGDAAFARAEPILRQMGKAVFHCGAAGAGQAAKICNNMILGISMIGVCEAFALGEKLGLSRQALFDVASVSSGQCWSLTTYCPVPGPVPTSPANNDYRPGFAAGLMLKDLRLAQAAAAAAGAATPLGAEAAQLYALFDALGHGGEDFSGIIRMLRGTTAGDAGR

SEQ ID NO: 3239 - protein, 298 aa, Methylobacterium sp.
MKVAVAGAGSVGCYFGGLLAQAGHAVTLIGRAQHVAAIRARGLVLETAAGSETVPLCATTGMDGAAGADVILVCVKSSDTEAAGRDLAPVLTPDAAILSLQNGVDNPERLAAVLGRDVVPAAVYVATEMAGAGHVRHLGRGDLVIGPSPVSEAIAAVFRDAAIPTTVSPNAIDALWSKLVLNCAYNALSAATRLPYGRLVGVAGIEAVMADIVAECTAVAGAAGVRLPDDTLARVLALAETMPGQFSSTAQDVMRGKESEIDHLNGFIVRRGAELGVRTPVNRVLHALVKALETGGAA

SEQ ID NO: 3240 - protein, 188 aa, Methylobacterium sp.
MRRLAPPALCLLALLTAPALAESAAERLPACLACHGEGGTSASPGVPSLGAMPADYVVTQLYLFRERQRVADPMNAVAEGLSDDDLRALGDAIARLPAPKPEPNPDPARMEAARALAAKHQCGSCHGADLAGQDQIPRVGAQREDYLLATLRAYKSGARAGYDPAMNEVAQGLSEDDIAALSYYLAHR

SEQ ID NO: 3241 - protein, 198 aa, Methylobacterium sp.
MGAPAHRPATYADLEAVPEHLVAEIIDGVLETHPRPHPRHAAAASDLSTLLGPPFRHGRGGPGGWIFMVEPELHLGRDVVVPDLGGWRRERLPAEVMKAAFIETPPDWVCEILSPSTTRIDRGPKRRVYAEAGVGHLWLLDPAAGLLESFTLTESAWRLDGTVQRGETVALPPFDAVPFPLDDLFAFDDPAAPSPTET

SEQ ID NO: 3242 - protein, 381 aa, Methylobacterium sp.
MADATGLGALDTPCLLLDEARLRANVARMRGRLTGLGVAFRPHLKTAKSREVARLAMAAPEGPAIVSTLREAEYFCEAGLRDVIYGVGIAPDKLARVAAVRARGADLAVILDSPEQAEAVAAHAARNRDPLPVLIEVDADGHRSGVAPDDAETLVAIGRRLVGGGVSLRGVLLHAGDSYALSDPEALAEAAEAERVAAVTAAGILRAAGLPCPVVSVGSTPTARFARDLTGITEVRAGVFMFGDLFQAGVGAVAPEDIALSVLATVIGHQRKKGWIITDAGWMALSRDRGTARQAVDQGYGVVCDLAGRPYPDLIVADANQEHGIVALRRGSEAALPDLPIGARLRVLPNHACATGAQHDRYHVLDDAGRVAKVWPRINGW

SEQ ID NO: 3243 - protein, 148 aa, Methylobacterium sp.
MTRPHSVDALVPGRSCGQCTACCRTLEIEALAKPAGILCHHSSGVACTIYPERPDACARWYCLWRRIGALPEELRPDRSGVVFALEKASPDAGAHQGACIVGRAVDGEQAFERWEATEAFAMFVREGSLPVWKATARSATLMHAGAAL

SEQ ID NO: 3244 - protein, 523 aa, Methylobacterium sp.
MLSDLEAPPRPVGDAPRTIRVHPDDNVAIVVNAFGLPAGTVFPDGLTLTEFVPQGHKVALADVPKGGHVVRYGEVVGIALRAIPRGSWVEESCVETPVAPALDALEKSTRVPAALPPLEDYTFEGYRNPDGSVGTKNILAISTSVQCVAGTLDVAIRRIKQELLPRFPNVDDVIGLTHAYGCGVAINAPEAVIPIRTLQSLARNPNFGGEVMVVGLGCEKLVSERLVPGRQGTDEDPANVVRLQDERHEGFGSMIDSIMAMAEARLRVLNRRTRETCPASDLVVGLQCGGSDAFSGVTANPALGFAADLLVRCGATVLFSEVTEVRDAIHLLTPRAATPAVADALIREMAWYDAYLEKGGADRRANPSPGNKRGGLNNIVEKALGSVAKSGTSAIAGVLAPGERVRERGLIFAATPASDFVCGTLQLASGITLQVFSTGRGTPYGLAQAPVIKVATRSELSRRWSDLIDLDAGRVATGEATIEAMGWELFRLILDVASGVRQPWSDRWGLYNDLTLFNPAPIT

SEQ ID NO: 3245 - protein, 302 aa, Methylobacterium sp.
MLAPAILRRLDLTTLRLFVAVCEEGSLTRAARHAAIAPSAVSKRLVELEQTLGVQLLERGARGMTMTPAGETLLHHARRMLRNAEQIALELAEHAKGVRGIVRMLANLSAIVQFLPEDLRAFLASQGAIKIDLEERPSGRVVRGVAEGAAELGICAGSVPAPGLDSTLYRRDRLVVVMRRDHPLAGRGALAFADTLDHDFVGLHAESSIYGSVQAEALSAGRPLRLRVHVPGFDAVCRMVQADMGIGVVPQGVFGLFGGATDLVDVPLSDPWAHRTLQIVTRPGPLTPAASLLRRHLAAPPD

SEQ ID NO: 3246 - protein, 253 aa, Methylobacterium sp.
VKVQGIAAIVTGAGSGLGAATAKVLAAAGARVALLDLNAEAASATAREIGGLALACDVADAGSAEAAVARAAAEQGPARVLVNCAGICPAAKVVGRDGPASLDAFSRVVQINLVGTFNMMRLVAAGAAGLEPLDGGERGVLVSTASIAAYEGQIGQAAYAASKAGVVGLTLPVARELAPLGIRVCAIAPGMFETPMVQGLPQEVQESLGAAVPFPTRFGRPDEYAQLVMAIVSNPMLNGETIRLDGALRMQAR

SEQ ID NO: 3247 - protein, 376 aa, Methylobacterium sp.
MPTGIRRCTEIEGACAIHEAPPDIRVHTDLLYVPVECGALWGLYADGVRIDREAPLDADAARQVAELRVSAPRIDGRFYYLGDVVEHFGHFVVGSLSRLWALPAGADTPLLYHGAQDIERLRGLGFLEPMLGSLGLGLEALRHFRVPVRLAEVTVAARAFRENRSASRAYDGLCKAIGRPWLAGVAADGDARPAYLSKLKLPPGSLHKLENEAELVRELERRGVDIVFPEELDIRAQVRLFAERRHILGLTGSALHVSLFAAPERRILGLNWCRRLNANLPLFDALNRNRAHYYFADGVTWVRNDAYAAEGDFFLRWSLPDPASVAAALVERAADFDGIAERDAREDAARAGGPFARSVAAAGRRARAGLRRILSP

SEQ ID NO: 3248 - protein, 89 aa, Methylobacterium sp.
MIVCSCNVLSDGAVRGCLNPGPACPRTPAQVYACLGCSPKCGRCARTIRSILRTALADAAEADAHACSASCASACSLKQFQTADEELAA

SEQ ID NO: 3249 - protein, 513 aa, Methylobacterium sp.
VARGARGTQRAAAPEAEALSAARFSHLLAAELRLVLRERLTWAILAALLAALCLAARTGAERTEAARAAVAQATEDGARTVRDARAAHARYARPSPITVNYWQDPTDAFGYMTYFMAAHAVKPPTPLGLLAAGQSDVQPAVMRISFGFSTVFDDTAYELGSAARLRLGAFDLAFVLVYLVPLAVIALAGTRLSAEQDAGILRLIAAQPIGPRRVAAAKFGAVGLVAVAGVLGGTALALLMAGGTGPLAGWGGVLALLGASLAAYTLFWVAACALAASLWRGAVAALAVLVLAWAGLTVALPTALGLAVDLLAPRPSRIAAIDASRQAQAAFYAGETGTRVASAWLAARVPDAAARPGLSEKPEIKRLARDAFYDTALRETRAALAAHARELAAWSGRLALLAPASALALALETAAGTDAARHAAFLAAATGYRGSLRAFFEPRIVAQALDPVPVCAGCPGRLDFDAYDAVPAFAPAPALAAARLQAWLSLAALLAGTLALAVLAHRRLRAWPA

SEQ ID NO: 3250 - protein, 464 aa, Methylobacterium sp.
VRRVAAELALILRDARLRWIGAVLVLLLALAGLAAWREAAAYGAEIQRVTAAERARWLGQDAKNPHSADHYGLWVFRPSAPLAVLDPGTEPFTGRMVRVEAHLFNDAVYRAVQDAGPLARAGLGSVADIVQLVVPLAAILLGFSAFAADRERGTLRLALGNGVPPGRLFAGRLAALVLALALVVGLPLLGLGALAADSLGAEGWQVWPRLLAWVAAQLAYAGAFLLVAMLASLVARTARGALAASLAAWVLLCVAAPRLAGAGVELLQPALSYREVRARIDAGFRAHRTAEANDVRVREVLARYGASDPDELPVDLRGLMMSENESHNFAVYDRELGAFFASLSAQERATAWAGIVSPRVALQALSQTLAGTDFAAHAHFVWAAERYRRTISERMNAEIRDHPQGGGRVLVSGPELWQEIPPFRHAPLPLARALADAGVPALILALWLGALAALSVPLLRRLKP

SEQ ID NO: 3251 - protein, 242 aa, Methylobacterium sp.
MANDGPVLALDGVVKRFGQRTALAGLDLILRSGEVFALLGPNGAGKTTTINLILGFLRADAGTVRVRGVDASADPVGARAHVAYIPEQVALYPTLSGLENLRYFATLAGLDLGKAEARALLAEAGLGGDAHDRAAGAYSKGMRQKVGIAIALARRAGLLLLDEPTSGLDPGASAEFSRTVRAAAERGSAVLMATHDLYRVREMADRVGVLGGGRIVEEIDPRSLDHVALERLYIERLSESAA

SEQ ID NO: 3252 - protein, 338 aa, Methylobacterium sp.
MRLFSTLALALALAGSAAQAAERTKLTVYTALENDQLGPFKTAIERAVPEAEVVWVRDSTGVITARFLAEKDNPRADMVIGLAASSLLMFEKLNLLAEYKPAGADALKEAFRDPKAPYTWTGMDAYLGVVCFNTAEAARDGVKTPQRWADLLQPGLKGKVVMPHPASSGTGYLMVAGWLQSMGEEKGWAFMDSLHETIAAYLHSGSAPCVQAARGERTAGLSLDMRGAAEKTKGAPIEVVVPADGTGWDEEAMAVVASSKNLALAKKVADWGATKAASELYAKSYAIVAYPGVSSAPANYPANAEAGMIKNDLGWMAENRDRILAEWSRRYESKAARK

SEQ ID NO: 3253 - protein, 458 aa, Methylobacterium sp.
MYGAVLAGASSDAAARATPGNVILIRGGYVMTMDAVRGDLPGADILVRDGRIAEIGRGLPAPEGADIVEAAGAVVLPGFVDAHTHGAISQMRGLYGNTPETAFFPVTNRLSAHYSPEDTYIGMLLSAVESLASGITTTADFFDAVRDREHAEAGLRALRDAQIRARLLYGMTSKTAAAPIDLAHVEEWQRGWADRSAGGRLSLGLAWRLPQDLDDARAWAIKQGEWEAARRLGLPVQVHVSGTVPGRAEAMFDALIARRMLRPGLQVIHATDARDDQLAALEEAGAGLVVTPLTEHRVGYGLTRIDRFAGIRRLGFGIDGSALAGSTDMFALMRLTALTQAGAARDETAVSPRRLLELATVGGARAMGLDAEIGTLVPGRAADLQIVRLDTWNLAGFKGGDPSALLVYSARPEDVATVMVGGRLVKHDRRLLFDDLMLLDQARLSILGICRRSSQVGP

SEQ ID NO: 3254 - protein, 105 aa, Methylobacterium sp.
MSSHAASGAGRRKPHLLAHSPDDNVAVAVIEGLAADTAAFGVITENDTTFEIHVRHDIPIGHKVALTDLKAGDTAIKYGQDIGRVIKDVAKGEHVHVHNVKTKRW

SEQ ID NO: 3255 - protein, 428 aa, Methylobacterium sp.
VMMFRQAAQLEHEIATPFAGGAPDQFATQALQAKRASEDYRAATFMGWRRENGRVGVRNHVVLLPLDDLSNAACEAVANNVKGTMALPHAYGRLQFGEDLALHFRTLIGIGSNPNVAAVVVIGIEDQWTNRVVEGIARTGKPVIGFGIEGHGDIATVARASYQAKRFVQWATELAREECPISDLWVSTKCGESDTTTGLASCPTVGNMYDKLIPHGIYGVFGETSEITGAEHLCRERAASPDISDKWYAMWKAYQDDVIEAHKTDDLSDSQPTKGNIAGGLTTIEEKALGNLEKIGHECRYIDALQPAEAPAKGPGLYFMDTSSAAAECVTLMAAAGYVVHTFPTGQGNVIGNPIVPVIKITGNPRTVRTMGEHIDVDVSGVLTREMTIPQAGDALIDMVVRTANGRLTAAEALGHREFVMTKLYRSA

SEQ ID NO: 3256 - protein, 313 aa, Methylobacterium sp.
MSKVVISEFMDEAAIAAELQGFDTLYDPGLVDRPEALAAALDGADALIVRNRTQVRGPLLAAARDLKVVGRLGVGLDNIDVAACRERGIAVYPATGANDGAVAEYVIGTAMLLLRGAYGATAAVAAGTWPRNALMGREIAGKRLGLVGFGSIARETARRAAALGMTIAAHDPFVAPDDPAWNPAHGPVVRSARDALIAESDVLSLHVPLTDETRGLVGAAAIARMPRGAVLINAARGGVVDEAAVAAALRSGHLGGAALDVFDREPLDAGAGAVFTDVPNLVLTPHIAGVTIESNVRVSAVTARAVRRHLTER

SEQ ID NO: 3257 - protein, 74 aa, Methylobacterium sp.
MVPTAAEGTGATERNGAEPGRIRVFARDRRGSTAMEYAMIGALIFAVAAGTIKLYGSKMNDVYARIGTTAAQIE

SEQ ID NO: 3258 - protein, 328 aa, Methylobacterium sp.
MADTAALDPAPIAAARPESRDDRTLHRRVFLGIALALVLAPLVLYPVFLMKVLCFALFALAFNLLLGYGGLLSFGHAAYFGMASYVSANAAKHWGLTPELAILAGTLVAGGLGLVFGALAIRRQGIYFSMITLALAQMAFFFSLQAKFTGGEDGIQAVPRGHMFGLVSLADDRVLYAVVALVFFGGMLLIYRIIHSPFGQVLKAIRDNEPRAISLGYRVNRYKLAVFVLSASLAGLAGATKAIVFQLASLTDVHWTMSGEVVLMTLVGGMGTVFGPIVGALVIVTMETYLAQFGAWVTVIQGVVFVLCVLLFREGIVGLLARRIGRPL

SEQ ID NO: 3259 - protein, 46 aa, Methylobacterium sp.
MLQIRDLRAEEFEAALDGSKSPQQALDDAVARGNAVLRLFQRRTAR

SEQ ID NO: 3260 - protein, 181 aa, Methylobacterium sp.
MRTGYALALLALLALLPAAARADAVDLAGSATVGALRREVSLRVACEPKTRAVSLDLTVPGFADLEPVFDFSGLEGPSGSTAMLSEFRVVGAAGVRTARARASGAVAAEPATSFRLTVAPARRGETPANGIAVALVEPGARLVWTQASPRKDDAPLIASVTVPEAETGPLRTALTPCLSGP

SEQ ID NO: 3261 - protein, 547 aa, Methylobacterium sp.
MHRTPLTRRSVLAGGAALAALGPAGRAFAQGGASAGASGGPSGSLTYGISMTDLPLTTGQPDRGAGGYQFTGLTLYDPLVAWELDVADRPGKMVPGLATSWESDPADRKNWIFRLREGVTFHDGSAFDADAVIWNFDKVLNKEAPHFDQRQAAQVRPRLPGVASYRKLDAATVQVTTKSVDSLFPYQMLWFLISSPAQYERVGRDWAKFAFQPSGTGPYKLAGLTPRVRAEFVPNERYWNPKRMPKLARLTLACVPEDLARVNALLSGNVDLIELPAPDAVPRLKAAGMRVVGNDTPHVWNYHLSMVEGSPWRDLRLRRAANLAVDREGVVQLMGGLAAPAVGQVQPSSPWFGSPSFRIRTDMDEARKLVAAAGYSVKNPLKTTLVIPTGGTGQMLSLPINEFIQQSWAEVGIQVAFRTVELEVAYTGWRQGASDPSLKDVTAGNIAYVTSDPFYAMLRFYDSRQIAPNGVNWSHYRNAEVDALCDKIRNSLDTAEQDRLLARMHEIVVDDAVQVWVVHDTNPHALSPRVKGYTQAQHWFQDLTTLA

SEQ ID NO: 3262 - protein, 83 aa, Methylobacterium sp.
MTKTKLLLAASLTLLAGSAFAQGGSPYNASGSQAGGPLGGLERRSGAPGGAPAVAPGAVDPSMAPAPAPRKRTMKKRRSHRSR

SEQ ID NO: 3263 - protein, 539 aa, Methylobacterium sp.
MKPFVWNQGYPSLRMPIFGRNVVATSHALAAQAGLKMIWRGGNAVDAAIAAAAAKTITEPCSNGLGSDAFCILWDGEQLHGLNASGGAPAAWTPDYFRRKYGEAARPPMRGWDSVTVPGAVAAWAALHERFGRLPFGDLLEPAIEIAERGYLAPIVVQQKWAAAARVADLAGQPGFAEVFLPHGRAPEVGERVRLPGIARTLRAVAETKGRAFYEGEIAQAMARHAAAHGGAMTVADLAAFRPEWVTPTGKDYRGYTLHEIPPNGQGIAAQIALGILEDFDLASLPPDGPESQHLQIEAMKLAFADTYRYVADPSGMTVTPEEMLDPAYLKARGRLIDRARAQDFGPGNPASGGTIYLTTADSSGMMVSFIQSNFMGFGSGVVVPEWGLSLQNRGHGFHLDAGSPNVVAPGKRPFHTIIPGFLTKDGAPVMSFGVMGGNMQPQGHVQTLVRMLDHHQNPQAACDAPRWRVNEGLSINTESTMPAETVQALAERGHQVEVINDSYQDFGAGQFIWRMGDPDADGYVAASDPRRDGQAVVC

SEQ ID NO: 3264 - protein, 157 aa, Methylobacterium sp.
MAKATPATRALDKLGVPYSLHAYTYDPEAPRIGLQAAEALGVGPDRVLKTLMAAVDGKPVCLLVASDREVSMKRVAAAFGGKAAAMLKVPDAERLTGYHVGGISPLGQKKAVPTVIDAGSLATDAEIHVNGGGRGLQIRIRPDDLLRALGARTAELA

SEQ ID NO: 3265 - protein, 579 aa, Methylobacterium sp.
MVIGTCSAAAWLDCPGLDAEHEPDFYNSAGWAPPPKEMPHPPSEYDFMAVVLTLRAVLPDDALWKLGYDDLAGHRKALEECCERIDRAVENLLHWNRRYGIPAFVANFFIPQHGAIGNLLPRYDLRNVAFFIEEINRHLERSVRRFSNAYILDMDRIAASYGRRRMQDDGYLLTSHGSNQWELPIDERIEPMGPLSAHFDFMSQREFISALWAEMVSLHRTLTKVDAVKLVVIDLDDTLWRGVSGDIADVGIHMYEGWPTGVVEALMYLKKRGIMLAIISKNDESRIREIWPSITDNRITLNDFATIRINWRSKPENMAEILSVVNVLPSSVVFLDDNPVERSAMQQAYAEMRILGRHPWYFRRTLLWSAETQVDVITTESGSRTEMMRAQFEREGQRKRLSRTEFLTSLSLEVELYEVHRGDPRWDRAFELLNKTNQFNTTGVRWTAEALLTRLEAGMRAFAFDVRDRFTNYGLVGVCLVDGAEILQMVMSCRVNGLDVELAALSRLTTLLRAAGAKDISAALVETKLNLLCRDLWSRCGFRDDGGLWRLGVGDAPPEPEFITIRSDPRPRPDRSGRD

SEQ ID NO: 3266 - protein, 434 aa, Methylobacterium sp.
MSSATGPGGADIERVAIDDAGLGAFYRSMTPPERHTFWACAAGWALDGMDFMIYPLVIGTIITLWQVEPGTAGLAATVTLLASALGGWLAGFVADRIGRVLTLQITILWFSFFSLVCAFVQNFEQLLVARALLGLGFGGEWAAGAVLMGETIRAQYRGRAVGSVQSGWAIGWGMAVLAQAVLFTWLPPESAWRWMFVIGALPALLVFYLRRYVREPEVAAESRARAAASGDRPRIWEIFSGPILKTTILASLASAGCQGGYYAITTWLPRFLTTERGLSVVSSTGYLAALIVGSFAGYLVGAWLADRLGRRPLFLIFSLGAIAVILAYTQLPLSNAVLWVLGFPLGFFASGYFSGMGAFLTELYPTRLRGSGQGFCYNFGRGIGALFPALVGYLSAQIGLAAAIAGFAAAAYGVFFVAAFALPETRGRVLHADA

SEQ ID NO: 3267 - protein, 360 aa, Methylobacterium sp.
LFAQASDDLGTETSLDVVRRIMSGNPTSVLAFARREGFDCAAPRAEGVIAWLPLTASGHAALLDGTFNVPDPDPAHLSAQHEPSAAIYVWAIYAPGLAGGVGIAFDQMSSPLHRHADLYARAASTSGRRLITGLGFEPLDTVVPMSAPGLYVFRKPGSSLGRPLYDSYPTPGQHYTFTVVRTHDDLAKVMAIRSAVYIGEQACPFEEEFDGNDFSSTHLIGYAGDEPAASLRVRCFATFAKVERLAVRQEYRRSRLAPLIVKAAHELCRMKGYARVYGHAQKGLVNFWRRSGARPFPGAREFAFSDHEYVEMLAEIEPHPDAIAVGADPYVIIRPEGRWHASGVLERSRLRPVTRPGSAR

SEQ ID NO: 3268 - protein, 87 aa, Methylobacterium sp.
MADGTQGLSDKALSIFAFAAYHRLLSGERVASVIRKDGAGHEADPDGVAELEGRGLVTASETSIDLTEEAQRFTETLVEAMRRTAGA

SEQ ID NO: 3269 - protein, 494 aa, Methylobacterium sp.
VQFGVFEELHAFVSRHGVSDLFMLFALMGLAMFGASVRKSLLLRAALRERDAAAREAESIARHDGLTGLANRRLFHEAVEAERAGAGALPSHAVLLLDLDRFKPVNDIYGHAAGNAVLCAIAERLRRLIPTSGVAARLGGDEFAVLVPLDGGSDGLVRLAQAMIAAIGEPVLWCGNALKVGGTVGIALVEADMADADAVLHAADLAMYQGKKDGRGTYRVFKSTMDLELRARAQLESELRDAIQRGEIEPFYQPVVALPEKTLIGVEVLARWRHPVRGLLTPNHFIGIAEETGMIGDLSYRLLRQACLDARDWPAHLLLAVNISPQQFQDRWLCERVLSILTETGFPPSRLEVEITESALVQDLEAARTTLTSLQNLGVRIALDDFGTGYSSLYHLRELKFDKLKIDRSYVDTITMSDERAKLVDAIIKLSASLGLVTTAEGIETDASVDWLSGQGCDFGQGYLFGAPMPKTELTALLAAPDAHGMSAALKQVA

SEQ ID NO: 3270 - protein, 517 aa, Methylobacterium sp.
MSPPLTRRRVLAGAAALTLARPGISRAADRPALSHGLQSGDVSGDGAVVWARADRPARAVIEWATTESFGDIRGGVFVDALPESDLTVKTALQGLPPDQDIHYRVRLQNLAEPTILGEPVTGRFRSAPMRARDLSFCWSGDTAGQGWGIDESRGGMTIYAAMLRNRPDFFLHSGDTIYADGPIQAEVRLPDGGLWRNLVTEEKAKPAETLDEFRGAYKYNLLDRNLLAMNREIPVLAQWDDHEVTNNWWPGEPLTRAEHRRRGYTEGNSLVLAARATRAFHEYMPMRFEPAEPGRVYRRVAYGPHLDVFLLDMRSYRGPNGANDETEASARTQFLGPVQLAWLKRALKASKATWKAIAADMPLGLVVTYDTDERFGSEGVAQGDGPPLGRELEIADLLRFIRDQDIRNTVWFTADVHYTAAHHYDPNRARFQEFAPFWEFVSGPLHAGTFGPAKLDDTFGPQLRFVKAPPDGRQNLSPAEGYQFFGHVAIAGATGQMTVTLKDAADTNLWRTVLDPA

SEQ ID NO: 3271 - protein, 273 aa, Methylobacterium sp.
VAILRHPGAALGLVILAGAIGAALLAPVLYPASPWRMVQRPFIPPFTLDRVPLGTDALGRDIAAGLMHGAGVSLVVGLVSTLAALLIGVPLGALAGYLGGRVDDALMRFTELFQTVPSFALAIVLVAILQPSLGSMILAIALVSWPPVTRLVRGEVLSLRSREYVQAAIVTGQTTFTILRREVLPNTLSPIVVLASLMVATAILLESSLSFLGLGDPNRMSWGFMVGAGRTVIRQAWWITAFPGLAILLTVLALNLIGEGLNYALNPRLSRER

SEQ ID NO: 3272 - protein, 518 aa, Methylobacterium sp.
VSEPMNGAESLVRTLVAGGVEVCFTNPGTSEMHFVAALDRVAGMECVLFLFEGGATGAADGYARVADKPASTLLHLGPGLANGWANLHNARRARSMVVNIVGEHATYHRQYDAPLTSDIAALAATVSAWTRTGTSAEAVAADGAAAIRAARTAPGRIATLILPADTAWQPGSGIAPVPPIPERARASDEAVAAAAVALLSGEPALLHLGDRAVRGAGKRIAARIAARTGAKLLAMQANARIDRGTGQVPVERLPYPIDQAIEVLKPYRRVVLVGATRPVGFFAYPGKPSVLTHPDCETVTLATPEEDQIEALERLAEAVGAPDDIDVVQPPRPELPGAGRLEDDAIGRVLGALMPEGAIVCDESLTTGRNFFAATHGAAPHSWLQLSGGSIGVGIPMATGAAVAARDRKVINLQADGSALYTAQALWTQARERLDVVTLIWSNRAYAILRGELANVGAHNPGPKALGMLSLDDPPVDWVSLARGYGVEARRVETLEVFTDVFAHALARRGPFLIEVAL

SEQ ID NO: 3273 - protein, 468 aa, Methylobacterium sp.
MTDTPTDLSLLSAKALAEGIAARSFSPVDAVDALLARVDAQDPKLRAFTEVYAADARLAAEGADRAIRSGHAVGPLHGVPVALKDLVDLDGRITMGGSAAHRARVATGTATVARRLIAQGMIVLGKTHTVEFAYGGWGTNQHLGTPWNPWDLETPRTPGGSSSGTGVAVAARMAPWGLGTDTGGSVRLPASFCGLSGLKVTVGRISTHGIVPLSTTLDTPGPLARTVEDAALLYRAMSGPDPLDPTTRGVEPHDPFPTLYRGVRGLRLARMPDAERDGVDAAVLAAYDRALDTLADLGAEIVTIRLPFRFADLFALSAITNAEAYFTNGALAEDPASPLGDAVRARILAGARLSAQDYLATIRRREAMKRALGAALEGFDALLTPTTETAAIPLDSVDEDHLPSRFCRFGNLLDLCGLALPSGYTQAGLPLSLQIVCRGYDEATALRIGQAYQGATDWHLRLPPGISG

SEQ ID NO: 3274 - protein, 412 aa, Methylobacterium sp.
MPARGTARGTDAEPENGSAAMKPFTFQTTPNVLFEAGASKKLPEIVAGLKAKRVLLVTDRGVREAGLTAPAETALAEAGIEIDVFDDVKADPPASIIETAVARAREAGTDLVLSIGGGSALDTAKLVAYLAKSDERLDDIYGVGIALGERLPLILVPTTAGTGSEVTPISIVTTPTTEKKGVVSHKLLPDWAVLDPELTLGLPAHVTAATGIDAMVHAIEAFTSKNKKNPISDQLAKQALALLSGHIRTACSEPKNLEARSGMLLGSMLAGMAFANAPVAAVHALAYPIGAIFHVPHGLSNALVLMGVMRFNLSHAQGLYAELAAVLDADAVNLPEDAAAARFVESLAAICRDCKVPASLAEVGVKPDDLERLATDAMKQTRLLVNNPREVTHQDAYAIYAEALDGKVQQAA

SEQ ID NO: 3275 - protein, 395 aa, Methylobacterium sp.
MTDAVIVATARTPIGRAHRGALNLTGGADLAAHAIRHALDRAGVEPGAVEEVVMGCGYPEAATGGNVARHASLVAGIPVQSAGATVSRFCASGLQAIADAAKRIRLDGVPVAVAGGVESISLVQPQVRRELTRNAWLEQNLPQIYMPMIETADIVAERYRISREAQDQFALLSQQRTAAAQGAGLFDAEIVPIEATMAVTDKATGETRNVGTRLTKDEGNRPDTTLDGLAKLKPVRGEGAFITAGNASQLSDGASASVLMSAEEAARRGLKPLGIVRGFAAAGCGPEEMGIGPVFAVPRLLERNGLTVDDIGLWELNEAFASQSIYCRDRLGLDPDKVNVNGGAISVGHPFGMSGARLVGHALLEGRRRGVRYAVVTMCVAGGQGCAGLFEIERE

SEQ ID NO: 3276 - protein, 393 aa, Methylobacterium sp.
MDLRFTPEETTFRQEVRAFFRSEIPEEIRRKVSEGRALAREDYVTSQRILNAKGWAVPHWPKEWGGQDWDPIRRYIFMEELMQAAVPLPLQFNCFMVGPVIAAFGNDQQKARFLPRIANLDDWWCQGFSEPGAGSDLASLKTRAVRDGDTYVVDGQKTWTTLGQYADWIFCLVRTDPAAKKQAGISFLLIDMKSPGISVRPIITIDGRHEVNEVFFDSVRVPAENLVGEENRGWDYAKFLLANERTGIARIGLTKERVARVKRLAKETPAGAGTMWDDADFRARVATIEIELKALEITQMRVVAAQGRRDPSKPDPASSILKIKGSELQQAATELLVELAGPLSLPAPVANDVDALGWEAFAAPTYLNTRKVSIYGGSNEIQRNVIAKAILGL

SEQ ID NO: 3277 - protein, 384 aa, Methylobacterium sp.
MDFDLTDEQSLLKDSIARWAASRYGSLEQVEAARRRPQGFDEGAWAQLAELGLLGLPFAEADGGFGGGPVETMIAVEALGRHLAPEPYLASVVLGGGALRLAGSAAQREALIPGLAEGSHRLALAHGERQARYDRADVATTARREGGSYRLDGTKCVVLNADAARTLVVSARTAGGRRDAAGISLFLVPTDAPGLTLKPYPTRDGGRAADLVLEGVTVPADALLGEADAGLPVIERVLDEGIAAVSAEAVGVMEALHALTVDYLKTRKQFGSPIGGFQVLQHRAVDMLVSLEQARSMALYATMMAGSADAAERGPAVSAAKVQINRSARFVGQEAVQLHGGIGMTLEYLGAHLFRRLTTIEYLFGDTPHHLRRVSDAGGLLGAA

SEQ ID NO: 3278 - protein, 271 aa, Methylobacterium sp.
MSEMAEAPIDSDTDEGGPKEDRHFVTALARGLAVLACFGRERRLLANHDIAEACGLPRSTVSRLTYTLTKLGYLHYIEESGKYRFGMQTIALSSMALGGLDVRQIARPILRGLAQTTNASVALAVRDRLSMRYIDCHRGPAAISLNIDTGSRLSMTRSAIGRAYIAVCSERERAGLYDELEAYDPLAWPALRERLDKAVAEHREIGCCTSFGEWQETASAIAVGFHPGAGLQPMSVSCGAPTVITDARYLMEVARPKLIEAVRGLEGVMGA

SEQ ID NO: 3279 - protein, 48 aa, Methylobacterium sp.
MAAARSVLNRVRTYLRYRDTVAQLSRLSDRELADLGISRYEIRGLARL

SEQ ID NO: 3280 - protein, 390 aa, Methylobacterium sp.
MVMAVTTSGALVETLDKLVGFETVSARSNLALINHVEDLARAHGAEIDRVPAPADDKAALWITIGPRDVPGYVLSGHSDVVPVDGQSWSSDPFRLTERGGRLFGRGTSDMKGFVAVCLALLPEMAAAELARPIHIALSYDEEVGCLGVRPLIARMRARGLRPLGCFVGEPTEMGVVVGHKGKSAARLTFRGRACHSATAPQGVNAVEFAARFIDHVRLSAERLARDGARDPLYDVPHTTGLCSVVRGGTALNIVPDTCTVEFEYRAIAADDAGALAGAAITYATEVLGAEMAARDPACGVAVEPLVDYPGLELDPQADLARLAKRLSGRDGHAKVSYGTEAGLFQTLGDVPAVVIGPGAMARAHRADEYVTRDELESCAGFVRQLIAASR

SEQ ID NO: 3281 - protein, 133 aa, Methylobacterium sp.
MSSTADKPNPFDPLGIAAVMGEWSCLLKAAQELRDVDAEMMDTLLDVNVAGPAPLGPEAAAKVRSIANLMRSLNLDSTALRRREPETMRELEAACLGCKERGRCARELWAGTAARSYPDFCPNAVRLDRLRGA

SEQ ID NO: 3282 - protein, 105 aa, Methylobacterium sp.
MHSEHVTHVQAPPPTDPAEVIKSGFGAWRAFAIDLPLRIAAETMRFAGHRFQTQADHLTALAKCGSLKNAVELQTAFLTKGVADYQTETATLSHEVSEPALAKTA

SEQ ID NO: 3283 - protein, 371 aa, Methylobacterium sp.
MPVSHDDLLELVDAALAADYTRVRRVGSKIAGDLDDENVARALRTLIRRKGVPLRASGYAESLPVDGKSRLPLIEELSWPTTPVFLSDAKGPMVTTFIEDVRNADLLSSKGLATRLSMLLSGPPGTGKTLLAGHIAAQLGRPLYTVRLDSVISSLLGDTAKNIRSIFDFVPSREAVLFIDEMDAVAKVRDDRHELGELKRVVNTVIQGLDSLDDRAVVLAATNHPQLLDPAIWRRFPYKIDLGLPDADTRSDMWRHFLFEGADGAQPLQVLATVSEGLSGADIRNIALSARRHAALGGGGIDAGAVVWAVLRTREGQLTLPSRQGVSAEHRKEFALRLNDISVRQAEIARLLGVSKPTVGAYLKEPGHAAG

SEQ ID NO: 3284 - protein, 75 aa, Methylobacterium sp.
TRRKVLLGALVLQRLEAGHDPAFTQRLGDWLRRELPGFLIRDADRVLFADLIGPPADIASVQASVEAAQGQTAAA

SEQ ID NO: 3285 - protein, 105 aa, Methylobacterium sp.
MADALVIEDEEALALARDLAERRGTSVDEAVLSALRTASYEEIRARPETQARPTPPLILTPDEMNPEQRARYERLRALTKRASALKKPGATSDHSDLYDEHGLPI

SEQ ID NO: 3286 - protein, 275 aa, Methylobacterium sp.
MSYEIPNAVQGVVLDWAGTVVDFGSFAPTQIFVEAFGAFGVAVSLDEARGPMGMGKWDHIRTLCNTPQIAARFSETFGRAPTDADVTAIYEGFMPLQIEKIAEHSAIIPGALDAIAALRARGIKIGSCSGYPARVMERVVALARTNGYVADHVVATDEVPNGRPFPAQALANVIALGIDDVAACVKVDDTVPGILEGRKAGMWTVALTCSGNAMGLSYEAYRALPAERLAAERARIAALFADSRPHFLIDTIADLPGVIADIEGLLAAGRVPQAC

SEQ ID NO: 3287 - protein, 365 aa, Methylobacterium sp.
MAPLLERALGTLVMGGILLDVFLTVLYARIGTGLIAERAARLAWIAFRRAAEAAGARRGTVLSFCGPAILLLYVLLWAFGLTLGAGLIIHPGLGTGVQAGDGPTPEDFLTALYAGGSSMAIVGASDFRPTSDAYRVVYLVNSLIGLSVTSLVLTYVMQVYGALRQRNALGLQLHLLSGGTSDAGELLARLGPRAQFSAGYTHLATLGDAMAAMKETHHFYPVLFYFRFRQPYYSVSAQAQLALDTVSLIRSTLAGEDTAWLKDAAAVEALWRVAQMLVVTLETAFLPGDPVVARTIDPRERQRWRAHWERAVARLAEAGIPVAKQEMAAQAYLDLRAQWWPHIARLAPAMAYRSEDIEAHRSENS

SEQ ID NO: 3288 - protein, 447 aa, Methylobacterium sp.
VTTVTLRLRTLLATAALSLCLPLGLVASAETEPAPVQKKDVDTPQAVEAPKTAPDPAIERGRYIAVAADCVACHSNPKSGKPFSGGYGLETPFGTLLSSNITSDPETGIGRWTEAEFTRALREGLGKDGQHLYPAMPYTSYTKMSDQDVHDLWLYMKTVPPVRNAVVTNQLPFPFNIRALLMGWNLLFFEQKRFEPRADQSAAWNRGAYLSDALGHCGACHTPKNVLGGDKTSKAYHGEVLQSWYAPDITTSKTGGIGDWSKGDIVQYLKIGSNRMAVASGPMAEAVTNSTQHLTDADLAAIADYLQTLPPGPATEAPRTAATGAVMAQGKRVFDAQCKACHASDGTGIRHMTPSFPGNTAIQSHEVAGIVRTVLAGARGAITAENPTGAAMPSFAWNLSDQQIAAALTYIRNSWGNRAPPVTAEAVAGTRKSLNLNAVGRAPHPAH

SEQ ID NO: 3289 - protein, 105 aa, Methylobacterium sp.
MTSHAHHEFGRPPHPQVEDEDWYDDGYDARPRRGVFSRLFGLLKLAVFLTPLGIFLYGYFVADCRSGGGTGLGQIVQAGVCARGQIVDSAGSLGDGLRLIRRVIE

SEQ ID NO: 3290 - protein, 531 aa, Methylobacterium sp.
MPMKNALLAAGLALGLLGGSSLAQAQNVFRFAFQGDIKSLDPYSLKESFTIGMHGAVYEALIMRDKDMKFVPALAESWETPEPTRWRFHLRKGVKFHDGSPFTADDVIFSVQRVRAPGSNFQTNVPADAEFVKVDDYTVDMKLKTPNPIAIAQFPTWYIMSKTWAEKNNAVQPSPPTATSPSYATLHENGTGPFIVTEHQPGVRTVFKKFPGYWGKVESNLDEAVFTTIGNSATRVAALLSGEVDWIDPVPLQDQPRVESSGNAVVMAGPELRTIFLGMDQTRDELKDSSVKGKNPFKDKRVREAFYLAIDEDTIAKRVMRGQATPSAILIAPSLYDRSGEFKRPAYDPKKAKALLTEAGYPDGFSLTMDCPNDRYVNDEAICQAVVSMLARVGVKVNLNAQPKAKYFAKVLAPGYDTSFYLVGWTPSSQDSHNILYEIAGCRNDPKSGRGGWNLGNYCNPKIDEIADKVEQETDKAKRDALIKEGFDTISADWGYIPLHQQALAWGVSKKVTLTQRPDNYLYLYWVSKKP

SEQ ID NO: 3291 - protein, 326 aa, Methylobacterium sp.
VLAFLIRRLAQAFVVLGVVGLIAFAMFRFAGDPVNQIVGPDTPVSERAEIRKALGLDDPMLVQFGRYAGNVLRGDFGISYQFRQPVTALLAERIPATLELAFCATLFALGVGILMGVYCALKRDTVLAKLFQAVSLIGVSLPTFLIGILLIFLFSVTLGWLPSYGRGDTVRIGGWTTGFLTVSGLKALILPSVTLGLYQMTLIMRLVRAEMLEVLRTDYIRFARARGLTTRAIHLGHALKNTLVPVITIAGLQLGSVIAFSIITETVFQWPGMGLLFVQAVQNVDIPIMSAYLLLVAAIFVTINLVVDILYTVVDPRLRTSVGRAA

SEQ ID NO: 3292 - protein, 218 aa, Methylobacterium sp.
MIDQTLRDALLAVSPGSLARALARRGLRAHAFAGLEVRSSTPVAGPAYTLRLIPARDEAAGDLARAIGQVPAGAVLVIDASGTGSALPFAAVLAAALARAGVAGLVTDAGVPDDLALPVWGRDPGRSPGGIGLALAGTAEPVACAGAAVHPGDIVVAGPDGAVVVPADMAESVALEAVEQQRLDLWLMREAEKGVGLAALLPPDAETRARFEAETKSA

SEQ ID NO: 3293 - protein, 425 aa, Methylobacterium sp.
MLRAVGTVPREWGLRAPSSLDAAVADLRDLAGSDTRLYRLARLASLWLLPVMLGIVLTGFELGPAPGRDCAGNALGVDFTQVWAAGQAALRGGAGEPYDLPRHLQNLREAFGPECRFAWHYPPVFLLPAAAVAALPPPTAFLAWTLAGTALFALALRFAGGRAALLVGLAHPLVFCNLAYGQNGLFTAGLLTLGALLVDRRPLVAGLCFGLVAYKPQLAALAPLLLLATGRWRCLVACAATVAALCLGAFLAFGSAPWLGFLGTLGETDRIILRQAAAGLDLNASAYGAVRLAGGPFALAWAAQIAASLGALALAWRVWATCPDPLLRAATLLAAAPMLSPYVPVYDLAPLVPATVLLVVAARRAGGLHAHERWLLIASPLTAALRVGAEATGIGFGLIFALATLACLAARALPRAAPRGLGALP

SEQ ID NO: 3294 - protein, 266 aa, Methylobacterium sp.
VSSDDIPSARAIAARRHDEILKRLAADGHISVEEMAARFAVSRETIRRDLKALAGRGQLAIVHGGATRRSDEPALAVRREDNPAGKAAIGRAAAGLVEDGMVVLLDSGSTTLAVAQALAARGLTAWQGLTVCTNSLSIGLVLCRVPGIRLHLLGGEVNGLDEAAFGTEGIAALARFRADIAFIGVGGVSESGDLTDFAVLPTELRAAMLGAAERGFIVVDRTKFGRLTPIRLQPIPAGTSLIVDAAPPAPMASALAARDLRIVVAR

SEQ ID NO: 3295 - protein, 296 aa, Methylobacterium sp.
MSATPDPIPVCPAPDPSPRGPTRYRVPMGAVDTHAHVIGLPPVYPLVPERSYTPPAAPAERYLAMLDATGMAGGVLIQVSVHGTDNRRMVETLRANPERLRGVAVIPLGLPDRELADLKAAGVVALRLNVLFGGGVGFAELEAYGALAREMGWHLQFLIDARQMPPLAARLARLPVPFVVDHMGHMPTAAGLDDPGFRTLVDLVRDGAWVKLSGAFRTSVAGAPYADTVPFARALHAAAPERCLWGSDWPHVAAWAGPPRIGDLLDLVADWIPDEADRHRYFVENPRRLYGFGEAG

SEQ ID NO: 3296 - protein, 335 aa, Methylobacterium sp.
VEHLPVDRAANDLDWHSLRLFLELYRSGSFRACAAALDISVNSLRRRIEALEAALQFPLFIRTVDGIRPTAGGECILTAAEAMEQAAFQVLRARGGISTDVEGEVRIAVTEGLGTAWLTPRLVDFQNAFPNLRVALNCAMNSADVLRMEADVAVQLTRPEAADVKVVRLGYLHTMPFASRAYAGRNGLPTNVEELVQHRLILQIAEQAAHLSIFGDMLPRFPYPPSVPITTNTSSALALAIANGAGIGWLPTYVSSLQAGLLPVDCGLQFRFDVWLTYHRDLEAIPRVRQTINWMKASFDARLYPFFGEDFVHPRDLPTVDRHIPLSELYKGFVP

SEQ ID NO: 3297 - protein, 222 aa, Methylobacterium sp.
MDTLSLVLETFAPIEGRRILDIGCGPGVLAGALVARGAAVTGIDPGEAAIRDAAARVPGATFEQASAEALPFEAARFDGAVVLNALHHVPDPGAALAEAGRVVGPGRPVVVVEPLAAGSFFAALRPIEDETAIRAAAQEAIAAAIASGAFTCARDVTFERHETFPDLAAFLERVTRVDPARRAAIEADRAGIRAAFEGAALRGEDGYGLTQPLRAHVLIPAA

SEQ ID NO: 3298 - protein, 532 aa, Methylobacterium sp.
MTLKRALATLALLGGLGAPAEAQTTLRIAMTASDIPTATGMPNNGFEGMRFLGYPVFESLVLWDLDRTDRPAGLRPGLATRWEQAADDPKTWIFHLREGVAFHDGTPFDADAVIWNLDRYFRNDSPHFEAPAAGITRARVPLLAAYRKIDDRTVAITTTQAASYFPYMAVYILFTSPRSFAAAGGDWSKVAALPAAGTGPFRITRVAPREAVDLARNDAYWDADRRARVERVRLMPIPEANARLAALRAGQVDWIEVPASDGIPSLKAAGFAVATGSYPHVWPWMYNIGAKDSPLKDVRVRQALNYCIDRDGIVALLNGTAEPARGWLKAGDPDFGAPQNRYGFDPGKGKALLAQAGFDASKPLRFGVMVSTSGSGQMLPMPMNEYLQENLKQACGVEVAFTVVEWQVLLTAGRATPDSPSLQGAMALNISSPSSDAGVMARYFASDRFPPNGFNFPNWRDGAFDAAMMQLAGSTDPQAVAAATRAAHERLVDDPPWLYVVHDLNARAMSPRVTGFVSPQSWFLDLTRVGMK

SEQ ID NO: 3299 - protein, 403 aa, Methylobacterium sp.
MRFTVGASALALACALALTPARAADPIKIGLSGPYTGGSSSMGVSMRDGAKLAAAEINKAGGVLGRPIQLVERDDEAKNEVGAQVAQELINKEKVVATVGFINTGVALAAQRFYQEAEIPVFNNVATGTIITNQFKEPDYDANYVFRNSAYDVLQAGLMVDEALAQGHKKIAVLADSTNYGQLGREDIEKYLAAKGVKPVAVEKFNIKDVDMTAQLLKSQQAGAEVILAYGIGPELAQIANGMAKLGWKVPMITSWPSSMQSFIDIAGANGNGVIMPQTFIEDQTLPKRKAFLENYYKTYGVTKIPTPVAGAQGYDSIFLLAAAIKQAGSTDGAKIRAALENLNEKVEGVVTTYDKPFTAKDHNAISRNMVVFGKVQDGKIVYAKPEDAKNAGVVRLKEKTSN

SEQ ID NO: 3300 - protein, 290 aa, Methylobacterium sp.
MAILLQLIASGVAVGMIYAAIAFGYQLTFATSKTLNFGQGEALALGALFGLTLVPFTGYWLMIPLVLVFGFALGAVVERLGVRPAVKIKSEYGWIMATIALGIIFKNVAENVWGRDDLKFPSPLPEEAIQVAGIRILPMELLIVAGALLMMLAVEIFNRKSIWGKAVVATSNDIDAAGLMGINTQRVITLSYSISAMTAAFAGVLVAPVTLTGATMGAVLALKAFAVAIIGGLESGLGVIVGGLILGVAETLTGFYISTGYKDVPGLILLLVVLSIRPVGLFGKAVIKKV

SEQ ID NO: 3301 - protein, 389 aa, Methylobacterium sp.
MLKAALLAAGALFGLIGAVGADPQPATPNVPTAFKPAQREGYFFVGGRYVTVGGKEIATGHMFVQYHAPDQVTQPFPVVLVHGTAQTGVNFLGTPDGRPGWVNRFVERGFAVYVVDQVGRGRSGDNPEVYGPYARLSTGDLESIFTGQERFDLFPQAKLHTQWPSGPGVKGNLAFDQFYLSQVPYIASALKSEELVNPALIALLEKIGPSVVLTHSQAGVFGWAVSDQRPELVKAHVAVEPNGPTFFDIKFKGGSDWYERVGEARARPYGITRVPLHFEPPVSGPTDLTVVQADQPTRPDQIRCWLQAEPARQLPQLAKVPAVIVTGEASFRATMDNCTAAFLEQAGAKPDRLALADHGIKGNGHMMMLEANNHEVADAIIGWIQGKVR

SEQ ID NO: 3302 - protein, 496 aa, Methylobacterium sp.
MPTAANTWHRTRARLTVAHVKAAQKLLASGRIEGRGHEWADEQERGLVLRVGKTGGAWYLKTEARTVRLGDMDLPVAAAREAAQRSRVDLRDGRVPSRANLRVWQEAHRRGLSPADALDAAFPEFLPEQSQEERRRDGPWEWADLVELYLERKLPTLRPRWAGQYEKHLRRSVTDDLARKLVADVDQADLLRVRDDVARERAPSAAADTVEAVKAALDWAKRNEPVRSGLASTPYPWWRDGLNVEWTSRARDHTPTLAELVRTLLLAERHRSLGGTAKETSNGTLAALWAVVLTGQRAGALTGTKRATVRDWPERPGWQVWTWTAEEMKGGKAPRPHAIPVPPEAVGVMARFPVDRSSPFLFPSRVTGKAVYPTVLTQLFGRLQGDPKGGRGGKVTIRPEADLFAANGIRPWTPHDVRRTLGTYLDLEKLGGAGSAILAHKAAARGGADAERELAAAITLRHYIHSQRLDLKAEGMTVWVQAVLDAYEAERASLDG

SEQ ID NO: 3303 - protein, 351 aa, Methylobacterium sp.
MYDTPADARAQLAQQDFTRPQIEMIVGALVPTLTFRPEAGGAALRIGATRIGGTPDLPPGLAWPVRAAPPDAEAIAGRGNVEAAEGMRRHFRAALPYAFFAQVDLAEARGQGGPAADLPEDGRLLFFYDLIAGPWDTGGGAVRVIWDPSPRAALAAQAVPAPLAAAAAAHRAEIAQVNAAFKLPPPKPEAATPYGAPGRPMRLAARLRPPNPHSLEWAGSAKLRAAYAEEEADDFREAYDDLFAHAFDPHYGAANSGRRNQLLGSPLPEQGDPRYEAEVASRFGVQHLDAETRRARWPEIEAGARDWRLLLQIDIADFMQAREEGTVYVLIRAEDLAARRFDRAAAVYQQT

SEQ ID NO: 3304 - protein, 227 aa, Methylobacterium sp.
MAALAGNASTAQAAELSGEMPWEPGQANVPPLPDSGSERFVFFTPAEAEAVGAMADRIIPADDLSVGGREAGCVRFIDRELAGPYGRAATQYRLGRFVKGTAEQGIQSPLAPADRYRLGLAALDRHCRAAHGKGYASLPPDEQDKVLSAMEAGTLDLGEVDAKEMFERILQNVREGFLADPLYGGNKDLVSWRMLGFPGAQYDFRDVIDLKGKKLDFVPVSMIDKSL

SEQ ID NO: 3305 - protein, 291 aa, Methylobacterium sp.
MDLADAGSPEALVKRILQAEPNLPVPVPIQELCARLGIIGIEDLDSDAFEGGLVTDAKRSEGTILVKRGGEPRRRFTIAHELGHFLMAHHVPDQPGRFLCKGADMLRLTANAGDQRQRMEVEANRFAALVLLPPHLLRGAMAAFREPDLQHVRVLARDFAVGKEAAARAYVQYHPERIAVVAAGKGRVQRCYRSLSFPDIICGIGSPIPTGSLYHNGSHRPNSASDIAACPPDLWIDVKRDLRAPALYEQVYLQPNGFAMILLRLAPVPEDSAEERRLEEGWRHRFHSGRR

SEQ ID NO: 3306 - protein, 79 aa, Methylobacterium sp.
MAMGEQVRVRLVRTPDGQRLDIPPGFMLGGDEAILRHDGDRLVLEPVPELSLLAILDRLDDLDEDWPEIVDLPPDIVRL

SEQ ID NO: 3307 - protein, 337 aa, Methylobacterium sp.
LSKRDIIVIGGSSGATVPLKAILGALPGTLAAAVFVVLHVPARSLGLLATVSAAAADLPVHPAEDGMPIAPGHIYLGVPDHHLIVADGRIRLGRGPRENMARPSIDPLFRSAAATYGPRVIGVILSGLLNDGTAGLDAVRRCGGVAIVQDPAEAIADEMPRSALAAVADGLAVPAARIGDVLADLVQEQAGPRLPVPPEIRLEVDIAAGERVDSGLLRRFANPAALSCPHCGGVLSEVRGARPLRFRCQVGHAYTAEAAAKAQEGAVDEAMRVALRIVGERAELVARMAADARASGRDAVAEMYEARAAEYREHTDTLRRAVLRAVESSGGDGMPEI

SEQ ID NO: 3308 - protein, 235 aa, Methylobacterium sp.
MSRSAPAKAMDFIAAFNDPQAAAQYAEGPRRFVPGYEALHRMTAILLAEGTRPDARVLVLGAGGGQELRALAEAQPGWTFVGVDPAPEMLREAARVLGPLMDRVTLVEGYIDDAPAGPFDAATCLLTLHFLEAAERAATVRAIHQRLRQGAPFVAAHGSFPQAEDERPSWLDRYEAYAVASGADREQARKARTAVGAHLPTLSPEQDADILREGGFPDVALFFAAFTWRGWVGRA

SEQ ID NO: 3309 - protein, 235 aa, Methylobacterium sp.
MSLSAPAEAMDFIAAFNDPQAAAQYAEGPRRFVPGYEALHRMTAILLAEGTRPDARVLVLGAGGGQELRALAEAQPAWTFVGVDPASEMLREAARTLGPLMERVTLVEGYIDDAPPGPFDAATCLLTLHFLEVAERAATVRAIHQRLRPGAPFVAAHGSFPQAEHERPRWLDRYEAYAVASGADHEQARKARAAVGSHLPTLSPEQDADILREGGFSEVSLFFAAFTWRGWVGRA

SEQ ID NO: 3310 - protein, 269 aa, Methylobacterium sp.
VRITGASKNTVAKLLVDAGRACAAYHDAHVRGVQAGRVQVDEIWSFTHCKQKNVATAKAAPDDAGDVWTWTAIDADSKLVLAYLVGGRDAEYANAFMLDVADRLNGRVQLTSDGHKPYLEAVEGAFGADVDYAVLQKTYGTAPEAAKGRYSPPVCTGAIKQRIEGKPDDAHVSTSYVERQNLTMRMHMRRFTRLTNAFSKKVEIHAYAVALHFMYYNFVRLHEKLRVSPAMAAGVTDRLWEIADIVSLVEAIDAKPGKRGSYKAKAFEV

SEQ ID NO: 3311 - protein, 369 aa, Methylobacterium sp.
MASSAPILLTPGPLTTTERTRAAMLTDWGSWDGSFNGLTASVCERLVAIANGSGSHVCVPLQGSGTFAVEAAVGTFVPRSGKMLVLVNGAYGKRLARICEMLGRDHSVYETPEDVPTTPEAVDRLLSQDRALTHVGLIHCETSTGILNPLPEIAAVVARHGRRLIVDAMSSFGALPIDARAIPFEALIAASGKCLEGVPGMGFVLAREEALLAAEGNIASLALDLRDQHLYMQRTGQWRFTPPTHVVAALHEALLQYEDEGGLAARHARYARNCRTLITGMARLGLRSFLAPEIQAPIIVTFHAPRDGRYRFGDFYQAVRARGFILYPGKLTQVETFRVGCIGAVEPADMERAVEAVAETFRDLDIETL

SEQ ID NO: 3312 - protein, 293 aa, Methylobacterium sp.
VNLFQLRAFDAVSREGSFTRAAKRLSISQPAVTGHVKALEERYDLILFRRTARSAELTPQGEALAALTRPLFGLVEQAEDLLLANRALVTGRIEVAADSPHVVMPLLARLRARHPGITVGLSLGNAAETYEALLAERASIGVVTEAERRDELHVEELAVSHVWAVLPRDHALATEAPIDLDALDGQPMVLREPTSVTRRTFDRACRARGIEPAVLMELDSREAVIEAAAAGIGIGIVSSLECGEDRRIRTVPITGADLTNRHAIVCLARRRSLRLIRAVLDLAVEGQPIGGRP

SEQ ID NO: 3313 - protein, 86 aa, Methylobacterium sp.
VIVDAAGAAHRATRVVGAAARRLDAQDRLLHAIVAALAPPEAETEGSGFEDLIAVLADLTEAVADVTQAVQALRSDVSARFPTVRA

SEQ ID NO: 3314 - protein, 580 aa, Methylobacterium sp.
VIVGLGWCGSLMAEELTRAGLTVVAIERGPWVETAVDFPPSVDMDELRWDTRRAMLLPPAIETITFRNDPTQKALPARDWNFNEWGYNVGGSGTHWAGMAWRFLPFDFQPYSMTVARYGAEQLLDGLIVQDWGVTYDDLEPFYDRFEKIAGVSGKAGNLKGEKIPGGNIFEGARSDEYPLPPLKTTRLTDLFTEASASLGYHPFMVPAGQTSGAYTNPLGVRMGPCTYCGYCLYYGCGNWSKSTPNNCVVPALMQRKNFSVLTESTVLRANLAPDGTTATGVTYVDKDNRTWEQPADIVVFSAFQMQNVRLMLLSKIGKPYDHATGEGVVGRAYSFQTVSGANIFFENEYLNQFIGAGALSAQVDDFNGDNFDHAGMGFIGGAGILVVSRGARPIGNADFLPPGTPRWGSAWKKAYTHSFQNGTFLFGQGTSFAHKDAYLDLDPEYKDIHGLPLLRLTYDYNENDRRSAKLIEDKSVEIGRKMGAKVVVGTNATNQHASPYQLASDHTNGGAVMGLDPKTSALNRFQQSWDVHNVFVLGASSFPNNAGYNPTGTVGALTLWTAKAIIETYLDKRGPLVAN

SEQ ID NO: 3315 - protein, 324 aa, Methylobacterium sp.
VPTLLREREPLRDRARGRWLSLLPQLGVDARFLTGGKNGPCPMCAGKTRFRFDDKEGRGTWICNNCGAGDGPALAMRVLGIEFKELAERLDPLIAEAPITAPRPGRSAADKREALNQLWRRASMVEPDDPVARYLRARVGLITVPTCLRYVDSLLYRDDPSSYHPAMIAMVAGPDGSAATIHRTYLTQDGRKAAVEVPRRLMPGTVPDGAAIRLFPPAVTMGIAEGIETALAAAALFGLPVWAAANATMLAKWQPPEQTREVVVFGDTDRKFGGQAAAYALAHRLAIHDRTVRVELPREAGTDWNDVWLRQRTDTEARALEATA

SEQ ID NO: 3316 - protein, 326 aa, Methylobacterium sp.
MSDTVLSVRDLRVVFETRRGTLTAIDGVSFDIARGEILGVVGESGAGKSVTGSAVIGLIDPPGRIAGGEIRLRGERIDNLAPEKMRRVRGRRIGMIFQDPLTSLDPLYRVGEQIVETIRTHTDLSAKAARTRAIDLLTEVGIPAPERRIDGYPHEFSGGMRQRVVIALALAAEPELIIADEPTTALDVSVQAQVITLLKRLCRERGTAVMLVTHDMGVIAEAADRVAVMYSGRVAEIGPVESVVRRPHHPYARGLMGAIPTLSDIAERLTQIPGAMPRLTAIPPGCAFNPRCPNVFGRCRAERPEPLPVERTRVACHLYDERGEAA

SEQ ID NO: 3317 - protein, 330 aa, Methylobacterium sp.
MSAGAYVAVEDLRRVFDVSKPWLNRVIERAPRQTLKAVDGVGFTIRRGETFALVGESGSGKSTVARMVVGLLPPSSGEVRIADISMTDPRQAAARRRLRARIQMIFQDPYASMNPRWRVGAIIAEPIRAFNLIHGEAAIRSRVGELLRLVGLHPDDARKYPHEFSGGQRQRIAIARALASQAEFLVGDEPTSALDVSVQAQILNLMRDLQDRLGLTYLFISHNLAVVRHMATRIGVMYLGRLVEVGDTAAIFGRPRHPYTRMLLDAVPDLAHIGRARTPVSGEIPNPIDPPPGCTFNPRCPHANARCRAEVPGLIDGVACHAVEEGRLSA

SEQ ID NO: 3318 - protein, 121 aa, Methylobacterium sp.
VTAYVSGNAVAASALDGLLRDVDQALAGLAQPPAVKISKPSPAEIRASIRPDGLVSFEDGRVYKALRRHLTTRGLTPEAYRAKWGLPVDYPLVSADYSARRSKISHAISRRRETGGRLAAE

SEQ ID NO: 3319 - protein, 140 aa, Methylobacterium sp.
MPKTAALSAKPKQTTETDHSIGNRIALLRSASGMSQTMLADALGISFQQVQKYEAGKNRIGAGRLRAIADRLGVPVSVFFAEDPGPEARVSGLDMLQESGALSLLQAYESIADEDMRREILNLVKAAARISQRTRTDDVQ

SEQ ID NO: 3320 - protein, 143 aa, Methylobacterium sp.
MSEQGRQLAEENIARARAAYLRCVEAGEVALNAFESSAARTAGLMGIGLTADGRDADTPAARGWAAMRAMAQTLLVANDTNVRAGFSFASRLVRAEDARAAVDLQSRYLQEQSERFAHQMLDLQRTALRAAGDVARGTGAGPL

SEQ ID NO: 3321 - protein, 61 aa, Methylobacterium sp.
MARSQQPGRPSVEPCTDKPGTFRWQIRLENGSVVRAPYAFATRGGAELSADLWVKQLRAAA

SEQ ID NO: 3322 - protein, 162 aa, Methylobacterium sp.
LHRIALAAALSASALCASGAVAQSALPSAAEAVRLVRDHRTNGSVTVAQTLAFAARERPESFRLADIRAERRPGEGFARVRICYWLRPPGTRAFPGCGIGFVVTTNPPHVEPEERFAGLGRDLQDGREAFLRGLDRELALIADPQTRTLRTLLDPYDIYDDR

SEQ ID NO: 3323 - protein, 155 aa, Methylobacterium sp.
MNRERLIMIRVFFNIRLDDAYLPERTGQWVEDEAEARDLARIIVRRLVADHGGEQRLLNAELAVTAEGGVSLFDVSFFEALYVPVASPESVEPLRRTGTIRPRSRLGHLLAPWRAEALALAATWRGRLAGLAARLSGRGGAAPRGRFRLGFEHGA

SEQ ID NO: 3324 - protein, 146 aa, Methylobacterium sp.
VLGSVTTIFGGLGARLEQALDAKGADGLALAAAKFFPGGLPALLDGLRAHGHGGAVDSWIGRDANEAVPAEAFARLLPPAVTEAFARDLGVRPERVPVALAQFLPAAVDRESPDGELRPQPQFSTQAMPGTPDTTEATRAAKMAAE

SEQ ID NO: 3325 - protein, 165 aa, Methylobacterium sp.
MTASSSLPGHNAMPRVADVCGDDADVLALSVVRFVAAGYMTSDVACWDAAFDGAERLLGADEGGRFVACAVGIVRALRAERDRDWSFMPATCCRVTGHECALVGLIGRGRRCLWEEVARGAAEITGRAEAPRLVAALRTAAGAINAAADRLGPGLPRRPARSALH

SEQ ID NO: 3326 - protein, 103 aa, Methylobacterium sp.
MTHDTDTEIDDADEVRDLEAEAKAKAENRAERAERAERMAREGAQAMAEHLAQIKVVDERTTRLRALRLAKEAADAQAKAAEEAAKAEAKAAKASAKKAARKA

SEQ ID NO: 3327 - protein, 97 aa, Methylobacterium sp.
MSALDWFGLTLAFLAPLPPERPVPPEPMRGSALAAALVIGSICLVMVLPMVMIWTFHRPEGEFRRHCEARGGLVRPTYLDGSGPQRCDLGSRHPAAS

SEQ ID NO: 3328 - protein, 260 aa, Methylobacterium sp.
MLHAAHRRSDTPRPAVGPAPQVFSAVRSHGSLPQLVAEAATIHGPAPAFAGPEGGASYAELGSALARYARYAEAEGFGRGDTVALLMGACAERHALWLGFARAGARVALVDPGLAGPRLARALAEIGARLIVADPDRAEAIGGLAGSMSEMPAVRWHGPGADFARIDLEAAEYEAGPLAGPDRAGPDDPALVACQGNRGGTPTVASASHRQILAWAQGASLGLRRAGEVCPPAFRDLAEVCGALLRGDTVLPGAGGHALC

SEQ ID NO: 3329 - protein, 92 aa, Methylobacterium sp.
MKMILLAAVAAASLATPASAQAVIETPTGTAVVVPPGAPGVVTRQTGSTGEPGAINVSPTGQPADVISNDSAAAGNAGQPSRVAPQGGGGGR

SEQ ID NO: 3330 - protein, 269 aa, Methylobacterium sp.
MTRATERKGVSEPGGVEARRAAIVAAVRQRGFVTIEALAGQFGVTVQTIRRDLNELSAEGRLERYRGGGGLPSSVENIDYADRRVTLLSEKTRIGRLAASRIPSHCSVFVNIGTTPEAVARELTRHDDLSIITNNLNVAISLAETTEFRIVVAGGTVRNRDGAVLGQLTCDTLSQFRVDVAVIGISGIDADGALLDYDYEEVRATQTILAHARKTYLVADHTKFGRRPMVQVGRIEQIDTLFTDLPPPLPIVALMERHGVTLAVATDDL

SEQ ID NO: 3331 - protein, 457 aa, Methylobacterium sp.
MLADAAQAEARTSSRGLSRAPTITEMKVVPVAGRDSMLLNLSGAHGPFFTRNLVVLTDSTGATGLGEVPGGEGIRRTLEDARDLVVGQPLGAWNAVLNAMRTRFADRDSGGRGLQTFDLRITIHAVTAVESAFLDLLGQFLDVPVAALLGEGQQRDAVEMLGYLFYVGDRRRTDLAYREPTARDGWFRLRDEEALTPETVARLAEAAYEQYGFNDFKLKGGVLAGEDEIAAVTAIHERFPGARVTLDPNGAWSLAEAIRLCKGRGDVLAYAEDPCGAEQGFSGREIMAEFRRATGLPTATNMIATDWRQMNHAIQLGSVDIPLADPHFWTLAGSVRVAQLCRDRGLTWGSHSNNHFDVSLAMFTHVAAAAPGTVTAIDTHWIWQDGERLTREPLQIRGGLVRVPERPGLGIELDWAEVERAHALYRDHGLGARDDAAAMQFLIPNWTFDNKKPCLVR

SEQ ID NO: 3332 - protein, 162 aa, Methylobacterium sp.
MEAAGPGRLLDRLQGESHRGDPFAAAVRATRMPMIVTDPHQFDNPIVFANNAFLALTGYGRLEVVGRNCRFLQGPETDPDAVARIRAAVRAEAPITIDLLNYRRDGTTFRNALYMGPVHDDAGALRYFFASQLDVSERYGLLGEIADLKARLAAAEARLTGG

SEQ ID NO: 3333 - protein, 59 aa, Methylobacterium sp.
MSEFDAIRLQLSVAAALQAIAIVRAERDVPATHAARRHLGEIHGATRLRKRLERDRRAG

SEQ ID NO: 3334 - protein, 86 aa, Methylobacterium sp.
MARRVFCRIVDRPDGLFDVTATIEPDKTFRREGVASLAEAERWIDGLRTLMTALGAPVLRVDAAEGETAADSAQAGTARLDSGSGS

SEQ ID NO: 3335 - protein, 40 aa, Methylobacterium sp.
MREDGMSPELRESRAALILLAVAVVSVLAFGAFTLLTQIG

SEQ ID NO: 3336 - protein, 79 aa, Methylobacterium sp.
MELLLILGAVLACTVVGVIAVRLSAQSRRPPLRLDSELDARDEDLLTRVGPARSPIDRSAEVLDVEPIRPASGRPGEKM

SEQ ID NO: 3337 - protein, 330 aa, Methylobacterium sp.
LSSFCAVLACLGAARAEAQSSDALKEPYRRPSAIPFPEAAPYAPQMATLGKMLFFDPRLSGKQNLSCASCHNPSFGFEVPVPGAIGATNKPLPRKAPTVLNAAWTPVLFWDGRAPDLETQAAGPITADAEMDGKFPEIVARLKATPEYAAWFGRLFPRDGVTQGNILTAIATYERTIVSGWAPFDRWIEGDATAISPAAQRGFALFTGKAACAGCHSGWNFTDNRFHDLGIPTRDIGRAAFEPDNPLAKHAFKTPGLRNLTYRAPFGHAGQFPDLEAIVAFYETGGLARPSKSPLMKPISLTGEERADLLAFLRSLTAEQTRTALPNLPN

SEQ ID NO: 3338 - protein, 387 aa, Methylobacterium sp.
MAHAIALPRLMRIGAGASALLPEVLAQLGLRRPFIVTDPYLAGSGRVEALVAGLAAAGCEAAVFSDTVPDPTVAAVEAALAALRSGEHDCVVGFGGGSPMDTAKAVAVLAQHGGAMRAYKAPHLQDAPGLPIIAIPTTAGTGSEATRFTIVTDAETDEKMLCIGLAYLPVAALVDYELTLTKPRRLTADTGIDALTHAIEAYVSKRANPFSDGMALAAMRAIAPNLRRVWADPGDRAAREAMMVGATQAGIAFSNSSVALVHGMSRPIGAHFHVAHGLSNAMLLPAVTAFSAPAALARYGACARAMGVAADGEGDGLAVERLIAELRALNAELEVPSPAAYGLDAARWRELTPLMAKQALASGSPANNPVEPSAAEIEALYVEVWAG

SEQ ID NO: 3339 - protein, 118 aa, Methylobacterium sp.
MPIPTRTPTLRMPTLFLLVAVALPGAAEAQVTPDLNSWNRSLSYQSDMRSQQLSQTSELNTLRMQAQRNVQFAPAPIVAPGAVLRRGGFSARGPRHSGVRTGRTGLDRSLDTGVCIGC

SEQ ID NO: 3340 - protein, 183 aa, Methylobacterium sp.
VFLAGNSHAEIVAPALARRMPVVNGGIGGTSARGYAAQLDALPFGARAGTAVLFVGTNDILRRADPLSESTRAGFEDAAARIIDWLHAHADAVLVAAVPPLGPEAAAIRDPAAVDAYTAALRSLCGRHGCRLVDPFARLRDGEPGLTTQAAPPDGLHMRDYDTLAVELAGLLQRAGGTEPPAD

SEQ ID NO: 3341 - protein, 64 aa, Methylobacterium sp.
MSSTTDKIKGAVNEAVGNAKQGIGNLTDNDRLKAEGKAQELKGTAQRGVGEAKDTVKDAVGGKL

SEQ ID NO: 3342 - protein, 85 aa, Methylobacterium sp.
MRTYTLAIADDVLFVCLPDEADIGEAIRETTATAYGHGIELEISRGAVLTDRPEADDHVIWTDGPDGELTDAEGRAYRYAVRRKS

SEQ ID NO: 3343 - protein, 94 aa, Methylobacterium sp.
VPRSSLVVLALLALVPSGAHGADLHARPAPAAGRFLATCEDLGRFCFAEGCGRDQIDAAFACRAACPASAVLTVRPTACPIPTPPVRAVLRRGG

SEQ ID NO: 3344 - protein, 112 aa, Methylobacterium sp.
MKQLDAIIAWTPARWAELRPETAGQVAVLPLSDAEGAARRYMMRAGASSSALQALSEEARIARLFIDFQTLVVRDGLDPQAVHRAFLAIDEYRFRIAPDTEGAAFEDPPEED

SEQ ID NO: 3345 - protein, 56 aa, Methylobacterium sp.
LTAASPRSARRLPRKHRLMLLLAFEILVFGLGQAHFNPMKRGVVVDVSTTPNHVVT

SEQ ID NO: 3346 - protein, 72 aa, Methylobacterium sp.
VAPRFYLDLTDGDETVPDEGGLETPDLDTATAHAQAVLREIRMAGRLTGAHGPWEIVIRDARGRPLRRIAVS

SEQ ID NO: 3347 - protein, 135 aa, Methylobacterium sp.
MRRLALALAAVAALSGPALAVENDQKTPTRAPEFTSVPKDAVLSYNLIGLNVVDGQQNSVGEIKDIVIENGQLAGYILSVGGFLGLGERYVAVKPDSVSLGYDADGKKWKAIIGASKDQLKAAPEFKYEGKFNRT

SEQ ID NO: 3348 - protein, 42 aa, Methylobacterium sp.
MKTVALRRARPHDLWQAIPLECFVCAAAVFLAAGLKLAGLMP

SEQ ID NO: 3349 - protein, 263 aa, Methylobacterium sp.
MDPFESVKAMAELWGRSARSVAEAQANMMGAFAAGPAPAADTEAARKAQAAYARAWADAQAVATSFTTSLQDKEGQDPVAAEVLAKVFDPRGWLSATSEVDAALSRMAEGPQFADLFQVERKFAALTAAWTVLRRRNLEHNTLMLEAWTRATGAFSQAVNARAEAGKPLESARDLMALWIETANDVLVETQRSDAFLTSQRDSLKAATDLRLAQGELAEFYSRMFGYPTRSELDDLHKTVTELRRELRALKRAKRAGRMEASA

SEQ ID NO: 3350 - protein, 89 aa, Methylobacterium sp.
MQPAIQHVIRALAEDGRDGAQGIAEYAVDTFAASCPTEGDRALALDILLRDLASLRGVAPHLAAFVGRIEAYVTRLKAVKRPLVVAEAA

SEQ ID NO: 3351 - protein, 76 aa, Methylobacterium sp.
MDVTRRELLERLDTAIAALGPRAPTNFNSSLFGDAALLKRIEAFEAQINVPEKPKVADYTGNMFSRIANRRAAGAK

SEQ ID NO: 3352 - protein, 318 aa, Methylobacterium sp.
VLVTGAAGFVGRSVLAALAEEGGRALLGIGRGQGHGMPAGVPFHSVDLADGSALRAQVRAFRPSHVLHLAAQSSVAQASHAAAETWRTNVVGSLNLAEAIRADAPGATVLFASSSEVYGRSFLSGEPLAEDAPLQPVGSYARTKRAAEDMLADVLAGSDNRLIIVRPFNHTGPDQDERFVVPSFAGQIARIEAGLAPRRLEVGNMSAEREFLDVRDVARAYACVIDGAERIASGTVLNIASGAPRTIASVLEDLRGLSRVSFEVTVSQDRLRRSEIPRAAGDASRLRALTGWAPVIPWGQTVADVLATARLRHGAANA

SEQ ID NO: 3353 - protein, 419 aa, Methylobacterium sp.
MTGTKRAGQPLRRPTGRPMRRLSRPRLGRVLGGIGLGAAILAGAALAEEAPRPPVDGGDPRGAAPAATVAGYFYIGGRYQRVEDKTLMVGQMFVQSRRPAQITQPYPVVMVHGAAQTGVNFLGTPDGRPGWAQRFVERGFQVYVVDQVGRGRSGTNPEVYGPYTRLSARALEETYTAQEVYDLFPQAKLHTQWPGGPGVPGNAAFDQFMASQVPYLANTQQTEELMAPALTALVEKIGPAILLTHGQGGLFGWAVSDARPDLVKAHLAIEPNGPPFFDVRYRGGKEFWERTGEGRARAYGLTRIPLGFQPPVSAPEDLTVVQAKAPAAEGRIRCWLQGEPVRKLPNLARVPAVIVTAEASFRAPADDCTAAFLAQAGAKPETLRLAEAGIRGNGHMMMLEKNSDQVADALVAWIAGRVR

SEQ ID NO: 3354 - protein, 74 aa, Methylobacterium sp.
MCLDPVALAVAALFTAGCATIHALRRYADAVTLVLSLLAYALATVLGSALAGRGGLVVLPDPVHAWGFAAAANI

SEQ ID NO: 3355 - protein, 161 aa, Methylobacterium sp.
MSEQMTSTLITVEHVTLRSPKTFEAVRAALEASVPPLDHAYAGLLRDGKVDAARDLLERQAPLSIFGARDHGGLLLTAGLTRKAVQYDIGNPLTAARMTRHVLSAALYAPIRVLLREDEEGGVAFEYDRPVTTFGQFGNKEIDAVAADLDDQLRGVLAAAT

SEQ ID NO: 3356 - protein, 353 aa, Methylobacterium sp.
LSFKDLNSEQARQTVDVEQVFSAYQASRETFERRFVGAMSWKTVRGRSYLYRKRRDRWESLGPRSAETEAVHERFHAGRESLQDRLSGLAERLDVMAPVNRALQLGRLPLIAARVLRALDRAGLIGHGLTVVGTNALFAYERLAGVQIASAHLAAGDVDLLFDARRSLRLIAPDTAASGVMRILKKVDHSFGPFGRSGFRAVNRDGYLVDLITAAGKDPMRTTPPARIGSDPDDLEAAAIEGLAWLIINGPKVSATVLDMRGYPVTMHVPDPRTFGLHKIWLSERADRNPTKRLRDRAQADLVVDLVRTRLPHLTFDDPALSALPAALRRRAPILGTQHSEPRQGGSRLEPDW

SEQ ID NO: 3357 - protein, 90 aa, Methylobacterium sp.
VIRRQGGARVMTIPPILLASLGADEGTKLAVDVKGGKLVAEPVTAEPAPAPVARRRYTLDELLQGAEHLPALYASVAGALDGEPVGHEIG

SEQ ID NO: 3358 - protein, 69 aa, Methylobacterium sp.
MLSLDDIAAAAAGEERDALWRSLVEDMEEAAGRRRGGRGFVQADRPADLARALGRDRRVQPSRLARSAS

SEQ ID NO: 3359 - protein, 206 aa, Methylobacterium sp.
MRRFAKLLALVMAAMAASAQRVWDGTKWIARAAFGPPVPAGAGIEEAFDDVAQALRPVTPSQPAAEAVTPSAPAPKPGPAKVVEIDPVLARGRVAYAFAHAMLTADEPSTAGLDDAASAWLNSLNASELMKIHQYGAHRVGAHMAGLRPIEGLPLCPSMAEYRNALCAAAQITPQQRRDVAEWQQMLDRAFEEMVEDPAYELKCGI

SEQ ID NO: 3360 - protein, 275 aa, Methylobacterium sp.
MSAARVRGSGRSLEIIRRRPARALGRPRLLFVHGISVGAWIWGEHVLPWFAEAGFEACALSLRGHGGSWGHDRIADWRLADYTADIDQAARSLGGPLVVVGHSLGGAVIQNWVRTGGRPLGMALLAAVPPWGLAVSALRMGLLTPALFREVLAMSLHGARAADPAILRAGLFSEDVAAESFRRFVARIGEESRLIGPELQGWPPFAPLPWEAPRTFVLGGADDRFIPADEVWRTGAYYGCRPHIVPRLAHALMLEPRWEEAMAPLRDWLLTLPRT

SEQ ID NO: 3361 - protein, 195 aa, Methylobacterium sp.
VLIYDPKDPHRIRDLLFITLVLLLLGYVALNAVVPNADIIIAARVLQAAASVVVLYVYGSDAWAAFTRPQPERSDFLILGIWLGFFSGLAQAVYAILFRLAGAPAWMLYMETVAPTVLISVLAAVLHVAAPGGLDGTVPRRNKIALGAMFGLGVVGVGVLLFLRPDLASVIERTPMWLRDFWETGLLMEPGRSAG

SEQ ID NO: 3362 - protein, 840 aa, Methylobacterium sp.
MIKTFIPNDPLFGAQWHLQNTSQTIMGLPQAGGAYRNDIDVTKVWPDYTGKGVIVGVIDDGVQMNHPDLQANLLLGKFYDLDAGKAGTPNGKHGTASIGLILAPQNDQGGVGVAFGSKGIGYVASPGVFNLVAQRMLTDGVAVSSNSWGLVGPEDTTPFKYAEDQAEFDAVLTNLAKAGRNGLGTATLFAGGNERVEGSNTLFDLTSNSAYTIAVAAANADGTVATYSTPGPNVLVAAPGSGNGAGSAAQVASMVTTDLLGTAGYNQAVDGNYTNLSNTGFNGTSAATPVASGVVALMLEANPNLGYRDVQEILAYSARTPEGVATWSTNGATDWNGGGHRHNADLGFGLIDAHAAVRLAETWNKQSTFANIAGATSSFTGTGSVSLAAGQSRQFTASFAQPLRVQHVAVSVDMSMAGGSSNLSAVTLTLTGPNGATTTALIDPASYSEDQKTKMASTLTYTFDSVQNWGELSNSGAWTLSVSNASTGSRLDMKASISLIGDLATGAQTFVYTDDYAYLAGSETARAALEATAAPNVLNAAAVTSDTTVNLAERTATIAGVATRLGESARFASLIGGDGNDRLTGNDAADVLVAARGNDVLQGGGGTDTLTGGQGSDTLMGGADADLIYGNQDADLIYGNQGGDKIFGGQGDDRAFGGQGDDQLVGGAGADTLLGNAGSDLVYGNLGTDVIYGNQGADTLFGGQDSDTLMGGQDTDVLFGNLGADVIYGNLGSDVLYGGQGADTLYGGQGDDVLVGGLGDDVLVGGLGADRYVFASDPGGRDLIVGFQQASGDRIVLGGQGYTLGTARNGDALLTLTGGGVIDLAGIRADQVNASFFAAA

SEQ ID NO: 3363 - protein, 320 aa, Methylobacterium sp.
MHPPIAFLGNLAADEETRYRAALAAALPDERIRPFRALTAAERAAVEVAIVANPDPAEVAQLPGLIWIQSLWAGVERLVRDLKPGTVPIVRLVDPELGRTMAEAVLAWTYYLQRDMPAYRRQQEAGLWRQRPYRAPVDTTVGLLGFGVLGRAAADRLVRAGFRVAAWSRSAPSMSAAGSASAIETWAGPEGLTRLLGRSDIAVCLLPLTPETRGLLDAARLAELKPGAGLINVARGGIIVTEALLAALDAGHLDHAVLDVFETEPLPAASPLWRHPGITVLPHVTAPTNPVTAAAVVAGNLRAYRTTGQIPAAVDVRRGY

SEQ ID NO: 3364 - protein, 166 aa, Methylobacterium sp.
MAARGEEKRGFDVIDAVDRRILDVLQQDATLPVATIAERVGLSPAPCWRRIKKLEASGIITRRVALVDRRKANVPTTVFVAVKAPRHAAEWSEAFRRVVEGVPEIVEAWRLTGEIDYLLRIVVPDIATYDAVYQRLIARLEFSNLSASIAMEEMKFTTAVPTIYMA

SEQ ID NO: 3365 - protein, 174 aa, Methylobacterium sp.
MTPDQPNAARAADLLAALPLSARGTPAAYLDAARRTLQVLMGRPDLLDGVALERRPGGYARNLLFGGGGLSVWAMVWSPGARTTVHDHHCSCCFGVWKGAIREVWFRPIGAREAVATADATRPQGYVACMMPTGPNLHQIVNPGPEEAISIHVYGFDHAVHASSVHREYRVVAA

SEQ ID NO: 3366 - protein, 212 aa, Methylobacterium sp.
MLTLDHLAIVAPSLAEGVAHVRESLDLDIPEGGRHAEMGTRNHLLRLGDALFLEVIAVDAQAPHPGRPRWFGLDDAAAVRADWEAGRRLRAFVARTGDLDGAVARRPGLFGRPARMTRGLLAWRFALRDDGALPLDGLAPCLMAWGPEGNPARAMPDLGARLGAFRLDHPDPEGAAALYREIGLLDPPEIREGPVFRYTAEIETPSGPRTLA

SEQ ID NO: 3367 - protein, 153 aa, Methylobacterium sp.
MARLNVNGVVREVDAEPDTPLLWVIREQIGLTGTKYGCGIAQCGACTVHIDGAAVRACSLPLSAVEPGQKIVTIEGLAPGADHPVQQAWAELDVPQCGFCQPGMIMASAALLAQNPRPSEDQIRQEITNICRCGTYNRVLAGIKLAAERGQSG

SEQ ID NO: 3368 - protein, 730 aa, Methylobacterium sp.
MSIDVRAPLPSRRALLAGAAGVFSLGFHIPFLPPARAATLDAAPSTPEVNAWVVVKPDETVVIRIARSEMGQGTLTGLAQLVAEELDCDWARVTTEYPSPGQNLARKRVWGDYSTGGSRGVRDSHEYVRKGGAAARTMLVAAAAKGWGVPAAECRVERGVITHGPSGRNTTYGAVAEEAAKIEPPKDVVLKDPKDWTIAGKPLKRLDTLPKLDGSQVYGIDLKLPGLLNAAIRDCPVTGGSVKSFDAAAVSGMPGVKRVVQVGDTAVAVVADTFWRAKTALDALPIVWDEGPNAGVSSETIAATLRAGLDAEQAFVGNRAGDVAGALKGAAKVVEAVYGVPFQNHATMEPMNATALWTAERCEVWTPTQNGEAALAATADAAGLPATACEVYKIHLGGGFGRRGATHDWVRQAVLIAKEMPGTPVKLIWTREEDMTHGRYHPVTQCRMRAALDKDGNLTGLHMRISGQSILASVAPQRMVEGRDPVTFQGLNPGGPEAAIGYTIPNILVDHAMRNPHILPGFWRGVNLNPNAIYLECFMDELADAAGQDPLAFRLKLMGNHPKHRAVLEAVAEKIGWDSKPPEGVYRGICQTMGFGSYVAGAAEVSVSDAGELKIHRIVAATDPGHAVNPQQIDAQVAGSFVYGLSAALYGACTVKDGRIEQTNFDSYPVMRMDAMPAVETILMPSGGFWGGVGEPTIAVAAPAVLNAVFAATGKRVRQLPLKDTDLRRA

SEQ ID NO: 3369 - protein, 107 aa, Methylobacterium sp.
MRHSSRPLFLRLLAASAALAVLAPAPAGAQGVGFATGLPGRDPAGEDAIGWGPAYRPETSFSQPGTPPTPGDYAGAAYRARTGRGVYDRGVSARVERAPQRRRHRDW

SEQ ID NO: 3370 - protein, 341 aa, Methylobacterium sp.
MKTFHHPDQALHHPRTYFSRGQMREPQEVPAREQALLAAVRDLGFPVEAPPDAGAAPILAVHGMDYLRFLQDAHADWTALGPDWGGEVVSNIFVREPNALRGVLAQAGRYIADGSAPIGPDTFRAAYASAQCAVAGADALNAGAREAYALCRPPGHHARREAAGGFCFLNNAAIAAERLRARHARVAILDTDMHHGQGIQEIFYDRADVFYISIHGDPTNFYPATAGFAEERGSGAGEGYNLNLPMPHGSDEEVFFAELARALRALALYQPDALVLSLGFDIYAGDPQAKVAVGADGFERLGAAIGGFPAPTLVVQEGGYCIAALTELSRRFFTGFAAARG

SEQ ID NO: 3371 - protein, 54 aa, Methylobacterium sp.
MGSMLKNAIQPPLAGPNQNPVLYGVANGLAKLFPPVEQPENRARAGAQPRPTRG

SEQ ID NO: 3372 - protein, 505 aa, Methylobacterium sp.
MNDLVISRANAIGKAVAVRTAPVTGRMRTYISGSSLLSGRSDDTEFLPAHLEILETPPAPQRIAALWLLCGALAAALLWSCFAKLDIFAIATGRVQVAGRSKVIQPLDPGAVKSIRVENGIQVKAGDILLELDPTVANADKQASSWDIWSLRAEIPRRQAEIKAFESGATAPPKVDFPEDIGPEIRLREESVLAAEFAQYMSAKASLEGQVGENDALKSRLAGSVAARTRLIDVLKERLGMKQELVVRAAGTRAALLESQQALESELTNLAYDKGQMMQAEAAGVSLAKKLEQLQKQSVAEQAQKLTDAQRKLDRFKEDLAKASFRVDRTTLRAPISGTVQQLAVTTIGQVVTTGQPLMVIVPSEGNIEIEALVQNTDIGFVEVGQEATIKVNAFPFTRYGTLDGRVVRVSRDAVDAKDASQTSDAATASRAQNSSIFSSTPAAQNLVFPVVIALNKTSLLVDGKDLPLTPGMTATVEVQTGSRRVIDYLFAPIRETTSTAGHER

SEQ ID NO: 3373 - protein, 238 aa, Methylobacterium sp.
MARTRGAATAVRDQEAERRPSLVDDAYAALKRAIQDSSFAPGYQASEQEIALRLGMSRTPVHEAVIRLQEDGLVRVLSRRGVLICALAPEDMREIYDVIVAVEGRAAELLASLPDAAREAAVSELAGYTETMAQAWQAGDLPVWGQADARFHRALVERAGNGRMTRIIQTITDQSHRARMLTLKLRRELGASVAEHRAIIDAIRLGDSVAAQGRVHDHRLRARDELLPLLESFGLRHL

SEQ ID NO: 3374 - protein, 295 aa, Methylobacterium sp.
MTHGTATALGFGAILLWSLLAVLTAASGAVPPFQLAAMTFAVGGLLGCASWLVRPGGLRALRQPWPVWLLGVGGLFGYHALYFAALRLAPPAEAGLINYLWPLLIVLLSALLPRAGGLRAAHLIGALLGLAGVVALFVGRGTLDFAAGAAPGYAAAFAAAFVWSGYSVLSARVGAVPTDAVAGFCLVTAALSLLCHLAVETTVWPADAPQWAAVAALGLGPVGAAFYLWDIGVKRGDIRLLGVAAYAAPVLSTLLLVATGYAPATPALALACLLIVAGALVAVRASRRLPREAAL

SEQ ID NO: 3375 - protein, 482 aa, Methylobacterium sp.
MDVTRRIFAAGAATLPFVGPGLPRTQAQSTGQDAPIIGNHAVADPLELAVDAYIYGYPLVTVEMTRRVLTNVAAPEGKNAPMGQFANLREYPDAKFRAVTAPNADTLYSSAFVDVGKEPHILSLPDEDGRYYLMPMLSAWTNVFAVPGKRTTGTGPQTYFIAGPGWSGSVPPGAQLIQAPTSLIWILGRTYCTGTPGDYRAVHALQDQYRLIPASAAGRAYTPPPGRIDPSIDMKTAVREQVDRMDATTYFNLLASLMKDNPPALADGVPLAKMASLGIMPGRSFDPASQPPAIRDAIGRAPKEASPRIMGYLKATGRHVNGWTFTTDGGDYGKDYLQRALVTAVGLGCNLPQDAVYPLTTVDAAGRRLNGASKYVMRFPAGELPPVDGFWSLTMYDADYFFVDNPINRYSVSPRDDLKANPDGSVDLFIQTESPGAMRESNWLPAPRGPFVLMLRTYWPKDALLNGSWSPPPVTRSASATL

SEQ ID NO: 3376 - protein, 370 aa, Methylobacterium sp.
MDRDGAENAKAEIFQRAFGYAEVPGAQDVQDGAPIFEAAPDSAAGARIRQARQERTLAQSEQIAVGILRPQDAGRGGRAAEIGLFVQRKRLADHRIVEAARRIARNEVRIVVTGPVRGQAANAGRCRPLRIGASVGHHRATAGTIGCFAICRKTGMVGLVSNNHVLAQSNRAAAGDDVLQPGRIDGVRDGRSLNRIASLGAFVPIDFTPNAPNYVDCAFAPLAGSPGHDGSTIAPLDGSVPNQPMGICEDLIFDRVEVRKVGRTTGPTKGFVQAISVDNLTVQMASGPRPRYALFHRQIAISGVERRFSKPGDSGSLIYIRNGNPVALLFAGAASGGDFGHGVTFANPIQAVLDALEIDLYTGSSGGSHV

SEQ ID NO: 3377 - protein, 492 aa, Methylobacterium sp.
MSRVLRPHQTRIIDRLRESMIAGRRRPMVQAPTGAGKTVVAGAIVRGARAKGKRVLFVVPAISLIDQTVRSFFAEGIHDVGVIQGSHPMTDASRPVQVASIQTLQRRAIPPFDIVVIDEAHRWFEMLGTWMAAPDWAAVPFVGLSATPWTKGLGRHYDDLIQVTTTAELIAAGYLAPFRVYAPSHPDLDGVRTVAGDYHEGDLGEAMNRPELVADVVRTWQQRGENRPTFVFAVDRAHAKHLQGEFERAGVACGYIDAFTKSDEREALFQRFTAGELRVIASVGCLTTGVDLDVRCIVLARPTKSEMLFVQIIGRGLRTAPGKDDCLILDHSDTHLRLGFVTDIHHDALDDGRERQKQDRKRRPEALPKECPGCSFLKPAKSPKCPACGFKPERQSEIVCEDGDLVEMTPKRERANSAEKGLMFGQLRHYARTRGYADGWAANKFRERYGVWPDRYHNAPLVQPTPTTLSWIKSRQIAWVKGKGGARAHASA

SEQ ID NO: 3378 - protein, 99 aa, Methylobacterium sp.
MSAELSEAIGRAARDEGLTAGAWVRRLLLERLDLKSAEDARSGRPVRVPEGHHAALAGALRELASAGAAVRTGDEVEAARALQAARDLLIPLALRRSAP

SEQ ID NO: 3379 - protein, 614 aa, Methylobacterium sp.
MEQSTLSDSTRMPAAQVETRDHAQEARVAALLAAPSIDPGSDGALLALGRELDVAIAAEHDACARADAAVREAGLRKTTRPACLIFGEDDAPLKLRQRYEHPAALVGSPVREADVDWMRRRMPMQHEVLRPIREGERAHIDHPGHKFEIVPHPEAQARAEEIIAAWQAWGEAVERINAECGVPEAEAVAENAGEAASAIAFRIAELPARTAEGLRAKLRALIHYDPNALPIDAPEEPDPGQVLARSIRLDLARIQDEPRATQAPPVAHPDPIFAAIEKDRALAAEHIRLLGISGSKPDEDPSWEPTHDASDALWAHWDDVLLKTVPTTASGCAALARYVNEWSEREGLDLSEAGPKIFDLIGRSPLLQSAAPSDAAEPDPIFAALDACRAPEAERKAFHAVHSVGKTGPGYTFERETALDDAVDAAFGAVFATTPTTRAGRLALTAFIERRIEWSACPDGSPQEGEDTVFADAYRALARVIEAEVPEVAGEGIAEALHRAVDLKALDIKDLSHLALWTESLITMASGLAQRGGRRPLGRFFDQVSNALCDVVVEAQDELRARTPADALEREYRAKTIALPVIENGDADELESLIADLQVEVAYLRQPMTAEAAR

SEQ ID NO: 3380 - protein, 180 aa, Methylobacterium sp.
MTDRSFPPALEAAGIIGTWQTDVAAGRSILDDGAAALMAGDAGLAGKPLTLDVALGRIHPDDRDWVFAQIRRARRAGGPFAAEFRVQAPGGAVRWVLNQGRLPAEGTGGIGYGTYIDTTHRHRDPAEAPDGERRDWLETAADHCIAAREAIDRSGKPFLRLLIDALLLEIGRHLVRRRSH

SEQ ID NO: 3381 - protein, 68 aa, Methylobacterium sp.
MAATTLSPARADAFPARATSARPALLRLWLGRIRARRALAALHPDQVREAGLDPFRLRAEIAKPFWRA

SEQ ID NO: 3382 - protein, 71 aa, Methylobacterium sp.
MPGCRKLDAFPTTPRPADGRVVLSHYVRLRARPPRPANDNRRAAGPALWHWALLVGIGPVFGLIAAVSALI

SEQ ID NO: 3383 - protein, 349 aa, Methylobacterium sp.
VPRNILILGASYGSLLATKLLMAGHNVTLVCRRKTADLINREGTEVRIKLRDEPNHRAIHSRDLPGTLDATPPEDVDVSRYDLVGLAMQEPQYNNHTIRVLMIKIAEAKLPCLSIMNMPPLPYLKRIPGLAGMDLEEAYTNAGVWDRFEPGLVSLCSPDPQAFRPPEEGANVLHVGLPTNFKAATFADETHNRLLRELEADIDAVRLDGQDVPVKLKVFDSLFVPLAKWSMLLTGNYRCITPDEPRSIRDAVHGDLAQSRAIYEHVDALARRLGADPADQVPFEKYAKAAESLLKPSSAARAVANGAPFIERVDLLVKLIAHQLGEPDAEIDRTVATVDRKLGERIIEG

SEQ ID NO: 3384 - protein, 323 aa, Methylobacterium sp.
MAGFIAQRLAKGVLVLAAIVVLNFFLIRLAPGDPALVMAGEAGATDEIFVTQLRQKFALDKPLPSQLAAYLGSVATLDLGYSVRQQMPVATLIGERLPATLLLTGCAFLISIVLGVLLGALAARRAGSLADTAITGLALLFYATPLFWVSLMAIILFSVRLEWLPSFGFETVGAGYTGLARASDIAQHLVLPALTLGLFFMAVYVRMTRASMLEVSRLDFVKTARAKGLSEGVIQRRHILRNALLPVVTLAGLQAGTLVGGAVLTETVFAWPGIGRLMYDALLQRDYTLLLGVFVVSSAMVLIFNLVTDVVYRMVDPRIEAAR

SEQ ID NO: 3385 - protein, 80 aa, Methylobacterium sp.
MLVLSAAQPIARGAFAERRATAIVNANWFRALAWRALRDGQPRGALRAANARAAARIVLRQARRDAQVNSLVMEALADGA

SEQ ID NO: 3386 - protein, 176 aa, Methylobacterium sp.
MTPMLRAATADDIPAIARIYAEAVLNGTATFETEPPSEAEMAHRWSDLVAAGLPWLVAVRGSGVVGYAYAGLYRTRAAYRSTLETSVYVAPEARGLGIGRALLDALIPACEALDARRLVAVIAHPGSEASVSLHAGAGFVPAGCLQAVGYKHGRWLDTLLMQRAIGPGSDGPPSRV

SEQ ID NO: 3387 - protein, 391 aa, Methylobacterium sp.
LAEVDVLLGAVERIDGGAIAGWACMRRPDGSERPAILEVRADDVLVFRFVASAVREDVRARGACGIDRTGFRLDHAFPAGTKIALNSAETGALLGEAPRFVAPPLSPRIGLIAPARDEAPFLMEWLAYHRTRGIERFFIADNGGADATSDLLRRLDRAGVVTRYDYLGRSHFQTDFYAETVARPEVRESCDLLAALDCDEFLVATSGRPIPATLAELFADAAVSAVALNWANYGTAGREEHDPGRLVIEQYDRRAVESNPLNTHIKSVFRPERFRGFRVNVHAIDMDYGLYRAASGAEADWDRTRAARGITRVPDWTNLRVNHYSTKSRSAFVQRKLRGSAADGAATEAFRRHADYFALHDTNDVQEPVVPAVIAETRAEIARLEALIAKA

SEQ ID NO: 3388 - protein, 449 aa, Methylobacterium sp.
LFYEFSLDTHVPVDHLLRAIDRFVDLSGLRAHLRPFYSTTGRPSVDPELMIRMLLVGYCFGIRSERRLCEEVHLNLAYRWFCRLGLEGAVPDHSTFSKNRHGRFRDSDLLREVFEITVQRCIDAGLVGGEGFAVDASLIRADANKQRSADASESVDWDDLARTRRSVREYLDTLDEAAWGAASESTPKFISRSDPAAQWTGAMKGHAFFAYATNYLIDLDHAVIVDVEASRAIRQAEVGAARTMVARTQDRFGLWPARLAADSAYGSAEHLAWLVHERGIEPHIPVFDKSERSDGTFSRSAFTYAPEADAYTCPAGKPLRQRQKVYRTPPPLVDADGMMRYHASKRDCDACALKPRCCPNTPARKIPRSIHEGARQMARDICASEEGRTSRRERKKVEMLFAHLKRILKLDRLRLRGPNGARDEFHLAAAAQNLRKLAKLIPVPQPSPA

SEQ ID NO: 3389 - protein, 310 aa, Methylobacterium sp.
MRCFVRVVERGSLSAVARELGIGQSTVTRQLRELEAALGVRLISRTTRRLAVTDEGGRYYADCLEILRRVERAGEAVRDRSGAAAGTIRISCTAALGVLHVTRLVFAFQDSHPGIEIDLGLTDERIDLVREGVDLALRLGPLADSALRLRTLGQSRRLLVAAPGYLAARGRPRVPEDLAAHEGVRMTNVAGSDTLVLEGADGACHAVAFGGRLRVDHGLAAREAFVAGRGIGPTHHWLVADHLAAGRLEEVLPEYRLPAVPLSLLIVPERAEIGRVRLLVDFLAAAVGTIPGIVTPRPGPAARLATTPLG

SEQ ID NO: 3390 - protein, 329 aa, Methylobacterium sp.
MLPYPVLLADIGGTYARFAILAAPEACPGPIRKVPTAAFPEPIAALQAYLDGPGTPQPRSAFLAAAGRVDGQATRMTNAPWLFDLGDIGVALGLEAARLVNDYVPQAAALHVLDEANAADLARIGPVAAGRGPRLVLGPGTGLGAAALVPVGDRLLVQTTEAGHVGFGPCERDELPWQALMPAEGRLTAEALLSGPGLARLARALAALRGVAAWQSPPEVLEAAKVGDPLAQEAVRQFARLLGRFAGDLALMFSATGGVYLAGGIAPRIVEVLQGEAYNAAFEDKPPFREVMQTIPRFVITRPEPAIDGLASLLRAADRFLFPGQDWRA

SEQ ID NO: 3391 - protein, 478 aa, Methylobacterium sp.
MTAYFITCHASVAYVRDQFRSLYGPEHLLLYHVDAKAPAALHETVRRLAETFPNVVVLPSRHYAWAGYSQVATTLAAIDCALASGPDWSHLVALSEQHCRVLDEAELVAALTPGVSYVDSTPFSAMNPGFQADIAHRFSMDYRELPGIGSFGIAPVAPDPDFLGRLRHGSNWYILSRQACAYLGTAARTAPDAARLRAAVHPDENMLQTLLAADGGRAGPIQRRETTFVAWPHISGNPDMTFRAEDFSAARAGDRLFIRKRPAQLPAPVAALLDDWASLSEAELSERIGAPLELAPEAPDPEGTALARRVASRVVRRGRGVQADLPNLRFGLRNPRFSLRFRTARIPDGIDVRILSQDLRHFRVLLLEAERPEIDFAPRRLHGRPAPLLRIRVPEFDFRREILVLEDPAHGFWTRPEDGSVTGLVRLIELYLRVAEDLAQTRAPEPARGPAAARREMSARARSFAWSLRRLLKRKRPA

SEQ ID NO: 3392 - protein, 262 aa, Methylobacterium sp.
MNVFLVLAHPDPRSLNGAFRDVAVAELRAQGHEVQVSDLCAAGWKSAVDAADFPARAVGERLSVASASQRAFAAGALTDDVRAEQERLLWADAVILQFPLWWFGMPAIMKGWVDRVYACGFAYGVGEHSDRRWGDRYGEGTFAGKRAMLIVTMGGWAEHYGPRGINGPIDDLLFPINHGVLYYPGFAVLPPFVAYRTDRLDAAGFETEAERLRARMRSLADTAPIPYRRQNGGDYLIPSMELRPELGAPGATGFALHLRPET

SEQ ID NO: 3393 - protein, 93 aa, Methylobacterium sp.
MRTVLLIGLVGCVAAASLGHAVTAAEPPAFRAVALVCPAGIEGPDCSRENALDIAVQPVAHETECGLVGQVLASHLTLQPGERHKIACERRRG

SEQ ID NO: 3394 - protein, 415 aa, Methylobacterium sp.
VISGATRGTGRGGALARHLMKDENKAVLIPARALGSPDLAGQLRELVAQCAGGRTDRPVYHVFCSPDPAIADNAAARSRFWNLFEHEFGMTDQPYCGVEHAKGGRLHEHRAYGLVHPTGAVVDLSWDYARREKCARIVESEFGLSPVASKHARAVERALRREGRSDVADWLAASGATVAERPIARLTPRERLIEERTGVPLDDLRRQVLAAWRETADGPAFAAALAARGLVLRRGRVGPVIVDASGTARAATRLVGAAARRFEGTRIRAATVKERLAGLRLEGVDDGRCSGLAAAGRDGGAVAGHPGGPGAAGIGVGGVGLRRPGGGAVGPDGGGGRHGGHGPGAALDRLRAASGARRAMMRRHLAGLDVSLDRYRAAAERARAAAERLDEVADARQRRGMALWGVTDIWGLPLQ

SEQ ID NO: 3395 - protein, 143 aa, Methylobacterium sp.
MVIPARGLGSADLVTQIRELVAISLGGRTDRLVYHVHLDPDVGIANEARARARWWSLFEAEFCLEAQPYWGVEHRKHGRRHEHRVYGLVRPSGSVVDLAWDYARREKCGRIVEFEFGMAPVASKHARAIARHLREEGRAEVAD

SEQ ID NO: 3396 - protein, 272 aa, Methylobacterium sp.
MRRGFRTRLLGISGKLIVGLILAFIVLPALVVTLAAFNDRAILSFPPAKYSTRWFTRALTYRDFQTGLWNSLVVTAWASTIALVVGTGFAIALKRYAFRFKAALEGVLLSPLIVPHFTIGLGLLVLATGIGAARGFPVVVLTHVVVVLPFVIRSVYISLQNIDERLELAAASLGARPGRVLGTITLPLLAPGLVSGWLFAAILSFNEFTASLFVTGQATQTLPVAMYGYVREFADPTLAAVSVIYIAVTALALTVANTFLGLGKVLNVEQGR

SEQ ID NO: 3397 - protein, 388 aa, Methylobacterium sp.
MALGITQIILWGGTFFLIAVVSGPIVASTGWPQGIVVGALSLAIFVSGLPAPLVGRLIRRHGGRPVLVAGSVLVAAGLALMAAAHSLPMFLLAWAVTGIGMAASLYDPLFAAIGQAYGTAARGAMTQIAISSGLAVSLCWPATSFLVDRIGWRGACLTYAVLAVVVVAPLYAWALPRQGRMNAAEPEPATDPAPVAPPVPARLPGERILAATFTTAAMIMTAVSVQLPLLLQALGILGSTAVALTTLIGPSQVGVRVVELAFGHRAHPVWALLMSSASVGLGLLLLAAAPSAAWLAMILHGAGNGMRTVVRGTLPYALYGQREYAAAMGRLARLPLLGQAVTPLACGYLAEWFGPLALLHLLLVVALVNLGLSLLVVRHARRPAIEPA

SEQ ID NO: 3398 - protein, 63 aa, Methylobacterium sp.
MPAPWLGVLRLAIRFGLPMAGLVVIGHAVIISVGGDIERWQFALGALLIASSFAARLVPRGSP

SEQ ID NO: 3399 - protein, 622 aa, Methylobacterium sp.
VSASRPLRSHQRALLALVGAIARGEATGVSDILAAVTPGGGKSLLPVIAAAELIAAGRIDRVVWVVPRDSLRLQAEEAFADPAWRASLGHALSVRAADNEPDPARGLSGYVTTYQAVAAAPALHLAEARAHRTLLVVDEVHHLPVPNAVRGRDGEPSDEEAEAGAWSRAMLPLFRAATLRLFLSGTLERADGRRILGLPYHPASAGRGPEVNIEAPGLAVIGYSRVQALAERAVLPVNFGALDGEASWLEAGQAAGAAPRVGPHRLGGGVRVTTRPALFTALRTGFARDLLGEAFHATRRIRARRRTERGLGPAEPALGLGKLLVVAPDQESARRYQAMIQGWMPGPQAERDVRIATSSAQDAHAALAAFRLLPEPAILVTVAMAYEGLDAPEVAVVAALTHIRSRPWLEQMLARATRVDPNAGAYDGQQALVFHPDDPLFAKFREELETEQGSAPRPREKPRLTAVTPEPVRWRDETPRGITPLESNALGLRYAMLRPRTPAPDAPLRDAAPARDGPPSLTERSLRQRLAAQVAAQAVEDEAAWQAPRGGNLAHRYNAVLKRVTGKDRGSMTLAELEAALAWLERNRLSDHAHLLEGDTRYAWSVRQRRRSWAPAGRRAEG

SEQ ID NO: 3400 - protein, 312 aa, Methylobacterium sp.
MNSTDLMFFVAVAEAGGIGRAAAALNTVQSNVTGRIRALEQALHTPLFYRGTRGVTLTRAGERLLPYATQVARLLADAEQAVLSDEVPRGPLRLGSMETTAALRLPKLLTAYAQRYPEVDIELVLSPTEALIAAVLERKVEAAFVCGPISQNDLASVPVLEEELVLVAGARIRNYNEVVATMASRREARVLVFRTGCSYRFRLEAFLAAHGLVHVRRMEFGTLDGIIGCVEAGMGVSLLPRVVAEPMQQTGRVSIHALPEGTGIAQTLLVYRKDSLLTAAYERFLDHIYEVFGLPSHVDVSPPSHERHVSSS

SEQ ID NO: 3401 - protein, 472 aa, Methylobacterium sp.
MAPDTVALDLPELGKGRHTARLSLIGVIATFGGLLFGYDTGVLNGALSYIADYFGLSPLQEGFVTFSLLIGATLGALAGGRISDRIGRRVTITGLGALFFVGALGCVLAPTYDILIVFRVVLGLAVGGASVTVPVYLSEVAPAEQRGSMIGRNDIMIVSGQFLAFLFNAVIGNVLGGNEHVWRIMLAVALLPAVVLFLGMRRMPESPRWLMAQGRSPEALDVLRTIRSEARAQAEMEEVRVLARLDAVKRSTSWRDLVAEPWLVRLLFVGMGLAALAQLTGINSVMYYGTQVLEQAGFTRNTALIFNVLNGLISIVAMLVGVMVVNRVGRRSMLILGFGCATALHVFIGVIGIVVPLDNPARPYLLTVGMFGFLAIVQGTIQLVSWIMMSEIFPLRVRGLMIGASVAVLWLTNALISLAFLPVVQTLDFATFFLFGGCCLFGVVFTARWLPETRDRSLESIEAELSAGGARV

SEQ ID NO: 3402 - protein, 98 aa, Methylobacterium sp.
MRRAADRRQDSYAIETLSYSPTRMVKLGRRKVAMLFQPAEAGAPWQLYPNPDAFPGLGFEGLPAPLRPEFMSFPDLAAVEVFLGIRGTSSDAAMPLAA

SEQ ID NO: 3403 - protein, 590 aa, Methylobacterium sp.
MSRSQDRRVVAEELRLVLDGVSQSVAVGFLVSTLMLVVLWTPAPRGILLSWYAAFLIERIAAALYARRARHVVDRPDRARRVERIVFLSKIIEGSILGSLIWIALPLQIPAVSILTMSLLGATCSNGVSLLAPRRHLYLALVIPVAMLAAGALWSLGGAPYRALAICSILFVVGQYGQVVLASRRVRESIELRFENMALVEQLRGESAAAHAARRDAERANAAKSQFLAAASHDLRQPVHALGLFLQALSQTDLVGPQRRILQNAQAANVASTDMLNTLLDFSRLEAGVVTPRPRAFELQPLLDKIENDLAHLADARRLIYRTVETDRAIVSDAALLELVLRNLVLNAIRYTDRGGILIGCRRRGTNVSIDVYDTGIGIPEGKREDIFREFYQLGNPERDRQKGLGLGLAIARGIATSLGHALSLSSKEGHGSVFRILVPGTDETVPDVDVLADIPNPSGLAGARVLVVDDDAIVRDAMTALLTGWGCRCWVFEGPDDVGRHPASEPAPDALICDFRLREGRTGTEAIALLRRHWGRPIPAILITGDTAPARLREALDSGIPLVHKPVRPDILQNALLSLIAPGRPTGSL

SEQ ID NO: 3404 - protein, 268 aa, Methylobacterium sp.
MDQARTGPPPLLKIRKLRKSYGTNEVLKGISLDIHEGEVVSIIGASGSGKSTFLRCLNLMETPTSGFMDFERFAFDYEEGARRQPTPQQLCELRARIGMVFQSYNLWPHMTVLENVTEAPIRVRRMPRKEAVAEAEALLQRIGLYEKRHAYPSKLSGGQQQRVAIVRALAMAPKVMLFDEVTSALDPELVGEVLALMGSLAADGMTMLLVTHEMAFARDVGTRTLFFDGGVIAEDGPPAEIIGAPRSERLRQFLRRVLHDPARLGASA

SEQ ID NO: 3405 - protein, 137 aa, Methylobacterium sp.
MPALDGVLETVLYVEDLARADAFYRGVMSLSCIHEDFRMRAYDVAGRGVLLLFPRGGSLEPIEIPGGTIPPHDGSGPQHVAFAIGADTLPAWERHLAEAGIAVEGRTRWPRGGQSLYFRDPDGHLLEIATPGLWRGY

SEQ ID NO: 3406 - protein, 275 aa, Methylobacterium sp.
MSDADLLAPVSATATGRPDDGHAPAQTKRVTDALLYLDDLKVTFDGYRALRGLSLTLDRGEMRAIIGPNGAGKTTMMDCITGKTRPDTGTALFDGTHDLTKLDEPAIADLGIGRKFQKPTVFESHTVADNILLALKGPRSGMASLFGWRNRVAAERIDALLTRVGLIAHRSRPAADLSHGQKQWLEIGMLLAQDPKLLLVDEPVAGMTDAETAETATLLREIARDHAVIVVEHDMHFVRALRCRVTCLHEGAVLAEGSIDAVSADPKVVEVYLGR

SEQ ID NO: 3407 - protein, 231 aa, Methylobacterium sp.
MLTVDSIDLYYGAAKALRGVSLTAEPGQVTAVLGRNGVGKTSLMRAIVGQQPIAKGSIRLGDTVLSGLAPYDRARAGAAYVPQGREIFPLLTVKENLETGFAPCKRADRYVPAEIYDLFPVLKDMLHRRGGDLSGGQQQQLAIARALVTRPRLLVLDEPTEGIQPSIIKDIGRAITYLRGKGEMAIVLVEQYFEWARDLCDTYAVMDRGQVVDAGARREMDEAQVLRWLSV

SEQ ID NO: 3408 - protein, 86 aa, Methylobacterium sp.
MSSDRDAPQDDPLDDASRLHAKIAALEIVLGVLIGRLSEENPEIREDVKRDVSVLLADMAGGSESEEMIVAEVRRAADVLTGVAIG

SEQ ID NO: 3409 - protein, 253 aa, Methylobacterium sp.
MVRSDRPASVRPTLADVLAVPDATLKGNQAYDILRREIVSCRLLPGTRFTEAEVMERFEIGKASCRIALQRLTQDGFVTSMPRHGYRIVPITVKDVDEVFSLRVELEPLAARGAAGRVNRAQLERLEQACRQRVTVDVGNQIDFFLEANRSFHMAIAVAAGNQRLCRMLSGLLDEMTRLVALGFGVQGVRPNIENDHTAMIEHLVAGDAESAAVVARRHVETFRAMTMEKVIASLRDTAVVPAGLARTDGSAR

SEQ ID NO: 3410 - protein, 473 aa, Methylobacterium sp.
MAIIASIPSRILSAVKRSFRQFLTLPLATVISFVVLNALVYLADRSWSGGQAPTGYRWLGALIGDRAALGSLLATLATSIITVTSITFSLLLLAVQQGAAALTAQVTDQFMARKVNQFYFGYFVGLSIFVLMTLVANTSFHRPVLATALALLLAALALCLIIVMIYNTIDQMRPEQIIQLIHDKVLEARGAELGLLGATRREPRPGWAGIASIRSRESGYVVGLDRVRIEKAVAQYAPGNVEIESLVTVGTYRAVEDPVFELRSRPGSTLDADACTGIVDAALAALAYDDGRDLRNDAAYGLHQLATIAWTSVSTSKSNPSPGLTVVRALRDIIARWSRGERDLRGDTRSCIVYRDAAPTIATDALEAVIVVASESIQSQTLTEAVDTLTILLGHVDQQTAERLADVANRALSSLGEHVLTRQLDVALVDLTKALEGRGFVAVAGAVSKASTELAVSLGKLNSRSTRVPGATS

SEQ ID NO: 3411 - protein, 169 aa, Methylobacterium sp.
MGALMSLSGELCIAAIDPGLTGALAFYFPALPERVSVEDMPVVANEVDVASLARRIRQMGPSFAIVERVGPMPRDGCRQAFGLGTAYAAAKATVTLCEVPLHLVSPQRWKRHHHLLGVENGKEAGRALALRLFPASAEHFARKKDHNRSDAALIAAYAASVPDYAGGAR

SEQ ID NO: 3412 - protein, 338 aa, Methylobacterium sp.
VSERIRFGVSPIAWINDDLPELGAGTPLERMFHEAAAIGYDGIELGGAFPREPAALSALLAPSGLALAAGWYASSLLTVDAEAEIEALQPHLRLLRAMGCDVFIAAECSTSIHGLRRVPLAHRPVLDWAGWRRFGRELTHLSEYLAREGFRLAYHHHLGTAVQSVTDLSAMLAHTPSHVGLVLDTGHAVLGGIDPVALIREHPERIAHVHCKDVRPPAFAAVEAAGGSFLDGVLAGMFTVPGDGSLAFGPVLRALADIKYRGWLIVEAEQDPQIADPRIYGRIGLETVRREAIGAGLTTWTGSLARAAVGAPSPGNAPSQSPAATLFPLAELALSGLA

SEQ ID NO: 3413 - protein, 156 aa, Methylobacterium sp.
MPPGFKAPRRGDILSINTNPVAGREMRDRHYWIVLTPEPVNRLGLAICVVVSTAAEGARAAGLTVRVVADGVTGVAICTQVRSFDLMARLQDGSATRASAAPADVVDEIAARIASLIEQAAPATPPAWAQAPKAEPAGTAAGQRAPVNPKGRKRER

SEQ ID NO: 3414 - protein, 205 aa, Methylobacterium sp.
MKLFYAPGACSLSPHIVLRELDLPFALEAVDLKSRTTAAGTDFTAINPKGYVPALQLEDGEVLTEGAAIVQYLADRYAPGTLAPVAGTVERARLNGHLNFISAEVHKAFGPLFDPALASEARTASIANLGRKLDVVQGTLADGRPFLTGQDFTVADAYLFVVLSWAPHLGVDLARWPRLAEFSHRVSARPAVQAAMGAEGLRKPA

SEQ ID NO: 3415 - protein, 223 aa, Methylobacterium sp.
MQFRDAQCLAGARRSAVAGLLAIALVGPVTTAAGLAVPAEATDDLRTLLWPGPDAPARTDHRGRTLAASALRDRIAVVAFVGADCSIVCVLRTLALDKVARELPDALRDRVVVLGIDTDPAGGPGRLRAFADGLVGADTPLRLLRSDAAGTAALAARLRYPAQALPEPPPVVLLFDRRGQIAMTYGSDPLDGPRLLEDVARLETFADGLDRPAEASAGPSPTL

SEQ ID NO: 3416 - protein, 205 aa, Methylobacterium sp.
MSGHLPNKQHAHAERGNDLYETPGAAVRALIATEWLPQRIWEPACGPGAIVRELRAAGHDVVASDLVDYGCPGQAAGVDFLTVQAAPDGIDCIVGNPPYKDANAFVERAIALCPRVMMLLRFSFYESIRRGSILDTGTLARVHCFRKRLPMMHRHGWEGPKAASGMAFAWFVWDRSHRGATLLDRLSWEDFADEAESAPVLAAAE

SEQ ID NO: 3417 - protein, 523 aa, Methylobacterium sp.
MAEASCRAVTVATTAISLVLCSPAAAAPTNEELYAMLRSVQTEQAQLRRENAEAKADLAEARRQLREALGSARLLHRRDPAGLATVSVPAPVPVARRLAPPPAVSGVVGAVEGGAGGFRAGAGGYAAGSLAFPVGRSFGLQADLAMMANGGDLGLGAAGRAFLRDSNKGLIGLYGSVDYASAIRSYGLQDVGTTTGRIAAEGALFLDRLTLDGIAGWQLGERADRFFDQVDLSWYASDDLRLSIGHRYENRIHAVAAGAEYLLPLGSAVGVSVFAEGRVGSNDYRAGLGGLRVYFGQEDKSLLRRQREDTLKVRLIDAFASRPKGFRVVPAIGPQGPAGPQGPTGATGATGPQGLTGATGATGPQGPTGPQGPAGPQGPTGATGATGPQGLTGATGATGPQGPTGPQGPAGPQGPTGATGATGPQGLTGATGATGPQGPTGPQGPAGPQGPTGATGATGPQGPTGSQGPTGATGATGPQGSTGSQGPTGATGPQGPAGPQGPTGATGPQGPAGPEGPPGATGI

SEQ ID NO: 3418 - protein, 278 aa, Methylobacterium sp.
MSLAPPQTIEPFASAAANILAASDQRRPIAPLTEQNQSFSLGDAYRTTAEIRRLREARGERVVGRKIGFTNTTIWDAYNVAAPIWGYVYDTTLHRLADLTGPASLAPFVEPRIEPEIVFGLARAPEPGMDGRELLACLAWVAPGFEVVQSLFPGWRFRAPDTVAAFGLHGALFIGEPVAVTPDSEAVWLEALGCFEIQLRREGAVVETGRAANVLRGGPLAALRHLVEVLAGDPASPVLAVGEVVTTGTLTDAYPIRVGETWDTRIAGLPLTDICLAF

SEQ ID NO: 3419 - protein, 31 aa, Methylobacterium sp.
MAVMALVLQHEGGFSADRRDPGNWTGGKVNN

SEQ ID NO: 3420 - protein, 1041 aa, Methylobacterium sp.
VPASRSLSYIGSIVRPGRFSRDQRRKRSRRAAQIAAIRASALFDAKWYLARYPEIQREGIDPAVHYALHGGPEGRWPHPLFHGDFYLAHSPEVREQAHNPLLHYIEHGAREGRNPNPLFDTHWYAETYMDGGADAANPLAHFLAQDDAAPSPRFNAAWYATQYLGGSARPADALIHYFTIGRELGHYLSPTADPYFVYAKNKVATSGLFDPEFYLSLSPDVAKAGIDPLDHYMLAGAHESRRPHPLFDVDWYVLEQQPKLDVRRINPVLHYLEQGAASGRDPSPWFNTAWYAAHHPDCLTSYETPLSHFLQNGHLGLAPSIYFDSAQYLRENEDVARSGVNPLSHYLTAGIREGRIARLVDPQRHHRSVADAALVCLKAPTEVGPTVALMVTHAPNGRLKGHVERYIRACRAQGIDVVLIAAADRRRTAIPEAVIDLCTGVFVRQNRGFDFAAWAHILLVQGNLLNCDCLILTNDSILGPLDDKDFAALVKGVREDEADLVGTTDNFHYAWHLQSFFLACKRRVLTSYAFAHYLTSIVNLTSKNHVISMYELTFTLRMRAAGFATKALFPMAPTPEAAAIDPPGNRTIFQWDRMLRLGFPFMKASLVVGEHRKIGGEAVRTALAERGFDLDCLEPTYQYPGPKIWADLDSDPASQGYETLAYFGPTDYANGLGVAARSYLRALYRLQRPVNVHATTRDFYVHARVAPDWQVAAFSGMPDIAIVHVNGDGWEPLLDAGQKALVAGARRRIGLLVWETSVVPLSWLPTIDRLDAIWTPSTYCAEIFRSVTDVPIHVIPHVVQNEEPERVDGALKAQVRRAYGLDPKRRIVLYAFDGSSFLARKNPFSLIRAFRAANLHRNGWQLVLKTKHLHVSPDKGRSLFEAVGEGASDIVLIDRPMSDLNLQALFDQAEIYASSHASEGFGLTIAEAMERGKVVVATDYGGSRDFLDASCGFPVRADVVPLTESYGPYLRGSTWGLVDEGELTRVLREGAAAVEQGKAAAIGAAARARVRSRLSSEAVARAMETSLAELEMIWTGEPVRR

SEQ ID NO: 3421 - protein, 258 aa, Methylobacterium sp.
MPANAQASTAPSEEIVQRIRVDLAAAYRLIHRLGLDDSIYTHISARLPGSDHRFLINPYGLRFEEVKAGNLVTVDLDGRVVDDPAGLGINPAGFTIHSAIHAAREDALCVLHTHTVAGVAVSCQEEGLLPLNQWSMQFAGRLAYHPYEGIALDLDERARLVADLGDKSVMVLQNHGMLTCGRSVAEAFKLMHNLERSCRAQLALQSAGAPLVRPSAAVAAKTAGQYARLYDKIETGGTDAEWDAFKRMLERSDPDYRA

SEQ ID NO: 3422 - protein, 408 aa, Methylobacterium sp.
MRARPALALILALVGGAAAAEPAQIGPRPFHLVDGMKPGSLQDRLKACGTERTYVAKQFSISHRGAPLQFPEHTREGVLAAARMGAGIIECDVAFTRDRQLVCRHAQCDLHRTTDILARPDLAAKCTTPFAPADPATGRKASAKCCTSDLTLSEFKTLKPKMDAADPEATTLSAYMNATPRWRTDLHADGATLMSHREYIALVRSLGRRFTPELKAPEVPMPFEGTYTQDRYAQQLIDEYREAGIPPEDVFPQSFQLRDVLYWLAKEPAFGRQAVFLDDRDERMPGFDPMQPESWKPGMAALRDQGVRILAPPLWMLVTTDAENRIVPSAYARAARAAGLDLMAWSLERSGPLKGGGGPYYRSVRPAIDRDGDMLTLLDVLHREVGVRGVFSDWPATTTFYANCVGAE

SEQ ID NO: 3423 - protein, 338 aa, Methylobacterium sp.
MLAGLLYGLIFEIELLVSAIRGAFIGAPVLLYERGLLFQAWRTLVRRAATPIFVVATLATYIAMIAVGNAGAGTILHHAFGYMPNPRVAMLMSEAGLAYALAISALAAFVFRIRDLIGPRVFANLLIGRYHRPISEERIFLFLDVAGSTRFAERHGDLAAQRYLGAIFGALALPVQRSRGSIDDYVGDMALVSWTMEQGTRDAACLRCVFDFAEVIAADAERWLTEFGQVPDFRAALHCGSVVTAEIGLERHKIAYFGDTLNTTSRLESVAKELGVSILVSGDLLDRLGTLPGTIIVEDLGSRTVRGRHEPLRLAAVHDGSRPSSPMQASSMHGTETS

SEQ ID NO: 3424 - protein, 207 aa, Methylobacterium sp.
MMTILIGYARCSTDKQDLTAQRAALEALGVAPERIYTDHGLSGTNRARPGLDQALAAARAGDTLVVQKLDRLARSVPDARAIADGLVRRGVRLALGASVYDPHDPMGRMFFNILATFAEFEADLIRARTREGMAIARAKGKLRGKQPKLSAKQQREVRRMHDVGDHSIGDLAELFSVSRPTIYRTLARSIRMRAGESPAETVTGTLS

SEQ ID NO: 3425 - protein, 137 aa, Methylobacterium sp.
MLTPFHLAYHVTDLEAARRFYGGVLGCREGRSTDSWVDFDFFGHQISLHLGEPFATARTGQVGDHRVMMPHLGVVLPLDAWEALAARIAAAGIAFDIPPVVRFAGEPGEQRTMFFFDPSGNPIEIKGFRDLAGVFAH

SEQ ID NO: 3426 - protein, 271 aa, Methylobacterium sp.
MSAGAAGSAPSGAALDHVVINVLRRMDEAAAAFAALGFQLTPRGHHSLGSINHLMMTPGPYLELVGLPGTGPQRQDVIDSPFGLNGLVLRSRDADATHARLAAAGLAAGPPVSFSRPVTVDGISAEARFRTVRLPAVLFPAGRLYHCEHLTPDLVWRPDWFAHPNGFLGIDALTVESPDPESEAGRYAAACGAPAECVDGTWRIRLGDMAVAIVPGEGARFRDLGLVFAGLDALAARAGSLPGAAWTRLGPDTGALALPALDLRLLCRARS

SEQ ID NO: 3427 - protein, 47 aa, Methylobacterium sp.
MDSRSCVTGEERGRFTSLRQLDEVPGLSGKTDGVSAALTVEGERQEG

SEQ ID NO: 3428 - protein, 315 aa, Methylobacterium sp.
MYIPTLDDMLAARARIEPHIHRTPILTSRILNELSGAELFFKCENLQKAGAFKARGASNAVFGLSEERARRGVATHSSGNHGTCLSYAASRRRVPCTVVMPRTAPQAKKDAVRGYGARVVECEPSTTSREAVFAEVVAETGAEFVHPYNDHRVIAGQATCSAEMIEQVDDLSAVVAPIGGGGMISGTCLTLSNLAPGIEIFAAEPEQADDARRSFRAGHIIADDAPSTVADGLKVPLKDLTWHFVRNHVADIQTASEQEIVSAMRLIWKNLKIVMEPSSAVALATILKHPDVFAGRRVGVIITGGNVDLDKLPWN

SEQ ID NO: 3429 - protein, 396 aa, Methylobacterium sp.
MSTQNPIFIPGPTNIPDVLRKAVDMPTIDHRSPLFGAILQPALAGVKKVLKAPSAEIFVFPSTGTGGWETAITNVLSPGDKVLATRNGMFSHRWIDMCRRHGLDVTVVAQEWGEGIPTDRFAEILTADTDHRIRVVLATHNETATGVRSDIRGLRCALDAAGHPALLFVDGVSSIGSMDFRMDEWRVDVAVTGSQKGFMLPPGLAIVGFSQRALAAVETAKLPRTFFDIRDMARGYASNGFPYTPPVGLLNGLKVAGDMLLAEGLDNVFSRHHRIAEGVRRAVGAWGLRLCAVRSDLYSDTVSAIRVPDGFDANRIVAHALQGYGVAFGTGLGDVAGKVFRIGHLGSLTEVMALSGLATAEMVMADLGLPVRLGAGVAAAQEYYRGSRSAVEAQAA

SEQ ID NO: 3430 - protein, 80 aa, Methylobacterium sp.
VKLAWKHVPSPEFEPATVPGRATTVQVMVKDAMRYSETGGWGFGRFVNGEPVDEAQHQTCFACHEARVKERDFVFTRYAR

SEQ ID NO: 3431 - protein, 559 aa, Methylobacterium sp.
MSQRRLSLGSLSIRYQILLPLLGFLLLAGLMAAITGLVGLRVSADLSALAERTVAANEASQAARDRFRRADAVVARVTAMTDLLDMGPVTAEFRTAADALGGLLGELRASALSERMGAVAQTADTEARQWRTDAEVLLGLRAAREIPTLERMARHSERLRQRFDEAVALAGADARAQIRSTEAAAGRQIWTILGLAGAVILVGSGTAWWLARSLSRPIVDLTDATTRLAEGDTGVVLAEGRRDEIGAMIAAVRVFRDTILRSRTLEAETAQAGAAAERRAMVNGLADTFERRVGGIVGLVGASAGQLQTTAESMSANAQETADKSGRMNRAAGEAAANVDTVAAAAAQLGASVGEIGRQVQGSAGLARTAAAEAGRTAEVVQALNGAAAQIGDMVALITQIAGQTNLLALNATIEAARAGEAGRGFAVVAAEVKELASQTARVTEQITAQIARIQGATGEAVGAIDGITGRIGEISAVAAAIAAAVEEQGAATRAIVQNVAEAASGTRQVSGHITGVAQAAGQTGLAANQVLDAAAGLAQQSAQLKDEVAAFLVRVRAA

SEQ ID NO: 3432 - protein, 94 aa, Methylobacterium sp.
MLLGVIALSLFAPGSLAANPCRPTLADFKSLKHGMSYDEAVTRLGCRGRRISHIQIGGNRRATYSWPGRGSYGANLNLTFRNNRLTSTSQLGLR

SEQ ID NO: 3433 - protein, 121 aa, Methylobacterium sp.
MLKAFEDRERAAEYLFARTEEARFAAHCGSIRALAIFAMAKLGVDGRTAEAYARVLIAAMIEGQHDEDLIARVQADLRANGIEVPRSELQGVVLRAAASQEILSRMGPPDAASASRPADPR

SEQ ID NO: 3434 - protein, 74 aa, Methylobacterium sp.
LLASKSAALAAKEAFTSQYATGRPDRSVGLGLDETGEHWAVKVFAHSPSAAENLPAKFQNFDVEVSVATAAVGY

SEQ ID NO: 3435 - protein, 251 aa, Methylobacterium sp.
VTAPVDHAAVAAGATEALRVRVRRGDGVQDYAVPRRANQTVLDVVTEIQREQDPTLAYRFACRVGMCGSCGMTVNGRPRWTCRTRVAAVAPEGDLLLEPLRNLPVVKDLAVDMEPFFEKWRRAHGFFEPGETPPDDFAAVPPDSPARQEVDAGIECINCGVCYAACDVVAWNPDYLGPAALNRAWTLVNDVRDRGQAARLAAVAGDAGCHSCHSHMSCTEHCPKALQPTFAIAGLKRETGKAALRRLWGRG

SEQ ID NO: 3436 - protein, 109 aa, Methylobacterium sp.
MSPLLYLAQRGTAAILALTVAVHLGTILYAVRGGLTAGEILGRTQGNPGFLAFYAVFVLAAAIHAPIGLRSVLREWTGWRGRSLDLAMLALSALLAGLGLRAALAVYLA

SEQ ID NO: 3437 - protein, 114 aa, Methylobacterium sp.
MSALSVHRRPGFAAALIHRLSGIALALFLPMHFIALGTALRGADRLESFLGLTHNGFVRAAEWGLVCALAVHMALGLRVLAIEWLSYRERTAVVVSGCLAGAFAVGLLFLLSGA

SEQ ID NO: 3438 - protein, 203 aa, Methylobacterium sp.
VAHHVLDMPAAEAEIRALRIGDTVTLRRWLFGIRDATLIHMFDRDRRTRLDLAGHAVIHTAPNVHRVPPSPEAPVGYAPFCIGTTTSMRMERFTDALMEREGVRLIVGKGGMGPATLDAFAERGGAYLAIVGGAAALETTWIERIEDVDMDDLHPESLWRFAIRDFGPLLVGMDAHGGSLFAEVQRDVAARRDAVLASLEAAR

SEQ ID NO: 3439 - protein, 574 aa, Methylobacterium sp.
MTLEEVRTDILILGSGGAGLFAALHAKKTAPDLAVTLAVKGLLGKCGCTRMVQGGYNVALAPGDSVERHFMDTVEGGKWLNDQGLAWTLVTEAQVRIRELETELGCFFDRNPDGSVHQKAFAGQTFDRTVHKGDLTGIEIINRLSEQVWRRDVNRLEDHRALELIPARDGSGLSGVLMLDMRTGEPKLVRAKAVLLATGGGPTMYKYHTPSGDKSCDGLAMALRAGLPLRDMEMVQFHPTGLLAGAGTRMTGTVLEEGLRGAGGWLLDSTGARFMEAYDPRGERATRDIVSRSIVRRIRDGFATPSGGVHIRMSHLGPDDVRRRFKGMVERCADCGFDLAEGLVEVIPTAHYMMGGIQFAADCTTALPRLYAAGEDTGGVHGANRLGGNGVANSTVFGGLAGQSMARAVLGGGSLADPDPAAIEAGLARAFGPLGRPADALPAIREALYETMWNDVGILRDAAGLTRALGALDGLAEAVARAGAPDGDRRYALTWMDRLNLENLVLVSQAIARAALARTDSRGAHFREDHPETSDLATSAYTVVRRQDEAFAIAMEPVAFTHVRPGGSLLDAAA

SEQ ID NO: 3440 - protein, 99 aa, Methylobacterium sp.
MPYFLLRLEPPRPSFPFDATEAEKALFSEHAAYWIDRAERGQAVAVGPVFDAAGTWGLALVEAADDAAARMLGADDPVIRAGAGFVYTLSAVPNLILRR

SEQ ID NO: 3441 - protein, 267 aa, Methylobacterium sp.
MKIAVITPSRLKLSTLAGETDSGLYFLEHAVRSAQAQQLDRPVELRFFVGVDPGTEIPARLAEQPNLTFVHSDRKAQVAALNAALLAVDESWDLVGFLEDDDAWLPHYLSVAIRALEQFDFVSSTQLEVDEAGEAVRINDFPTPSGWLMRRSTFDRVGEISMWSKWHYDNEWLGRLAETGLRRAHLVEATAPATLQDAAQVRPWLANVLRFGGPNSHLLRHGSVLPLVRRLVHPGSGTSQIGGGAVAKQESEAEYRGLAERFGRIPW

SEQ ID NO: 3442 - protein, 504 aa, Methylobacterium sp.
MLRLAAACLASGLALTAPLAAQTSGPTAGPTLRYGLMEDPDALDPTLARTFASRMVFAALCDKLVDIGPDLKPVPQLATKWELSADEKTLTMTLRPGVRFHDGEPVNAAAAKFSIERHLKLPGSQRRGEIAPIDSVDVVDDLTFRINLKQPFAPLMAQFTDRAGMLVSPKAAERLGDKFASGPVCAGPFKFVERVPQDRIVVERFPDYWNKDQIHIQRIEFRPIPDTTVRLTNLRAGQLDLLERLAPTDAPQVARDAKLKLASTYELGFQSVLFNTAKAGSAIADPRVRAAFELAIDRAAISQVVFNGEFLPGNQWVSPKHPDYVKDYPIPKRDVAKAKALLAEAGQPKPQITLMVYANSEAPQVGQVIQAMTREAGFDVKLQATDFTTALDLADKGNYEAYLYNWSGRPDPDGNTFSFLSCKAPLNYPRYCSEGADAALQAERGSVDPEKRKAAWKALADKVLTDRPGVYLMHRKLLWAYGPKLTGFVPYPDGLARFTGLKLN

SEQ ID NO: 3443 - protein, 304 aa, Methylobacterium sp.
MSTGTPLAEAPGIAAPAGQAALVREPGTLAAFWRRLRARPSAVLGLAIVVLLVGVAAFADIVAPYDPTATDWGAVRAAPSLAHPFGGDEVGRDVLSRIIHGARASLGAGLVSVALAVALGLPIGLLAGYAGGWIDALVMRLTDALLAIPFLILAIALAAFLGPSLTNAMLAIGLSATSTFVRLTRAQVRAVAAEEFVEAARSVGNPPWRIALVHILPNIVPAILVQATLTIAAAIIAEASLSFLGLGQQPPEPSWGAMLTVAKNFMDQAPWMAIWPGLSIFLAVLAFNLLGDGLRDALDPRQRT

SEQ ID NO: 3444 - protein, 230 aa, Methylobacterium sp.
MSADMSTDIAEAPGAPLLDVRDLRVVFDAEGGAVHAVNGVSYTLREGETLGIVGESGSGKSVHVLAMLGLIPRPPGRIAGGQVLFEGEDLLALPERRLRRIRGGRIGFVFQDPMSSLNPGMTVAQQIVEPLRIHLGLSARAARLRARELLDLVRIPNAAARLDQYPHEFSGGQRQRVMIAIGLACRPKLLIADEATTALDVTVQAEIVALVQELKCELGMAIIWITHDLG

SEQ ID NO: 3445 - protein, 306 aa, Methylobacterium sp.
AHTAAPAPYPVLSVRNLSKHYPLRAWWGGKASVFRAVEDVSFEIRPGETLGLVGESGSGKSTIGRAVTMLNPPTSGTVAFEGTDLAGLGAREMRRMRARIQTVFQDPYAALNPRMSAGDYVAEVFRLHRPGMGRGERRAAVAGLFERVGLDPRFMGRYPHQFSGGQRQRICIARAIALRPSFIVADEPIAALDVSIQAQVVNLLQDLQEELGLSYLFISHDLRMVRYLCHRVAVLWRGRIVELADSDRLYEDPRHPYTRRLLSAVPLPDPAAERARLAGAVPEAFGAGRPGDLVEVAPGHWVAADG

SEQ ID NO: 3446 - protein, 158 aa, Methylobacterium sp.
MRGALLTWPLLLLLLTAPAIAQKGVPRTHEAAEIEHLVDAAAELLDRRGRKAFEEFRKPDSPWRHDDLYLFAMDLSGTVLFNAAHPHREGRNRLDERDADGKRFHRDFVAVVRTYGSGWVDYMFPRPGSTIPTVKWSYLRGVTIDGTPALVGAGAYVD

SEQ ID NO: 3447 - protein, 310 aa, Methylobacterium sp.
MRVAFIGQQDFGKAVLEAFLERGDTVAGVFCAPEKPGAKPDVLRTAAEERGLPVFQFPSLKSPEAEEAMRGLDADIGVMAYVLQFAPQSFVTIPKHGTIQYHPSLLPRYRGPSSINWPIARGDTETGLTIFRPTDGLDEGPVILQKTCAIGSDDTLGDVYFKQLFPLGVSAMLEAADLVVAGEHVEIAQDEDAASYEGWFRSRESAISWASHAEHVYNVIRASNPAPGAWTTLDGKTLQIFDAKLHPIRRFGDVRGKLGEVVAIGEDSFRVAAQGGQIEVFRVKAEGGRKVSAGEFAREGGLSVGTILGG

SEQ ID NO: 3448 - protein, 269 aa, Methylobacterium sp.
VALATKRRTPEPPSLNDVYEGERQLVGIILAHPEVYSAVARILRGEDWTQNLHRGVFEVVGKLAAAGQSIALDSVLPRVGDVGPDGAPASDYLAELIAAALAPHHAEEIARILAEAARVQHRPCIYDLDLYAWAFDQSQRLRRGQFSALDALNLAEEIEDLGNEIYNKLESALRITLMHLLKWDHQPGRRTRSWTLSIRNGRLDAAKVLEKNPSLKARLPFAIDEAYRRARIDAAGETGLDEDAFPAACPYDLDAIMNRPIPWPPSEDA

SEQ ID NO: 3449 - protein, 183 aa, Methylobacterium sp.
MLVLRYRHRLPADYDMDRVRRRVAERGRLWDATPGLGFKAFSIAEGAGGNVYAATYLWLDPLAAGAFLTDDRFRAVVDGFGRPGVETWLPLAVAAGSSDGAAILERETLPVAETRDLAALRAAEAERSAAALADGACATVSALDPGTWRLVRLTLRRDAAAVGSPQERVLHLAAPGWARLSRR

SEQ ID NO: 3450 - protein, 480 aa, Methylobacterium sp.
MPLPLGPKMQPLDETLLDAAGANAGKLYVVAPATAVLAPNLLHIIRVAAAERPDVGIFYGDEAETDARGQVAAVRCKPSFNPALLQADDYIGFPLVIRGSVLAQVRPVFGWRHRSAAWYRVCLEALTRGIGIDRIPETLIAVPESRPRAEAGARRAALRAWFAENDLPLETAPGRVGDTLQIRRVLKDPPRVTLVVPTRQSRPAPDTLPDGGTEPHIIRLLDSLKRSSYPLERIRVLIGDDEPDEAIYRGRSDAFSIERVVTTRAAGEPFNYAAKMNQLWRRVETDAMVLMNDDVVVRSSGWLEALMTFALDRNVGGVGARLIFPNSTIQHAGMFGGIFGACAHPWYGQDEAAPTYSGWALTQRDCSVVTGAVFATRRGAMEAVNGFDETFSLDFNDVDLCLKMRMLGLRIVYTPFAELWHNERSSRQNNLAPGDQMVHFVRRWADVLANDPAYSPQLRTDTDRVQPRYTAAQWVETHRA

SEQ ID NO: 3451 - protein, 286 aa, Methylobacterium sp.
MVGAHEPEGSLTMASPTPASGLREGLSYAPPHRPSDRLAGETAVITGAGSGVGAETARILHAEGAHVVLNGLTAGRLEALAAELGPRTTVLPGDVTDLAYLERLAEEAQAVGGGRVGVLVNNAGATIRGSLAETTPDNFMSTVELNLNGAVQLTRLLAPAMCEARQGSIVNMASITSLKGLGGAVAYTASKAGMTGVTRALAVELAPFNVRVNAVCPGVIDTPMTWEHAEAQPDPAAHYAMLRARQPMNRLASARDCALAVLFLASPDSAFITGAALPVDGGRHAA

SEQ ID NO: 3452 - protein, 86 aa, Methylobacterium sp.
MISSDPKTREIIMTSRLIAAALLAAAVASPALAQGLDSRHSPYPASAYPGYVAPDASRAAGPGTAASAYRYSGQHAGGPAGALARN

SEQ ID NO: 3453 - protein, 389 aa, Methylobacterium sp.
MIAETDPVPGAPCPCCLPRRGFMRGLAGLGAAAVAAPGPARAAPYAGPVIDCHGHYTTEPPAMLAWRKRQIDALNDPAQSPAPSDLRIGDDEVRASVAGRQLKLQSERGISLALFSPRAGGMGHHIGNARTSLDWSIVSNDMIHRVASLMPQNFVGVCQLPQTPGVSPKNCTAELERCVTQLGFVGCNVNPDPSGGYWTDPPLSDRFWYPLWEKMVELDVPGMIHVSASANRNFHATGAHYINGDTTAFMQFVTSDLFRDFPTLRLIIPHGGGAVPYHWGRYRGLAQDLKRPPLSELMRNVFFDTCVYHQPGIDLLLKVVPRENVLFASEMVGAVNGIDPETGHAYDDTRRYVEAAAISDADRAGIYAGNALRVYPRLAGKLKSAGSGP

SEQ ID NO: 3454 - protein, 224 aa, Methylobacterium sp.
MTFSIVARCASTGMFGVAVSSSSPAVAARCAHARAGVGAVASQNVTDPALGRRALDLMALGADAAETVAVLRRTGGPMAYRQVLVVDAAGGSAIHSGPKALGTWGEARAADVACGGNLLADARVPEAMVEAFLGASGHLGDRLLVAMRAALKAGGEAGPVHSAGLMLVREVAWPVADLRVDWTEDCPIAGLAALWDLYRPQLDAYVTRALDPVAAPSYGVPGDL

SEQ ID NO: 3455 - protein, 81 aa, Methylobacterium sp.
MHKLLFAGIALSALAGLSNAAMAEETTVVRRDSAPSVSVERREGVVERRDITTGSVDCGSKTVHKEDGAGNSKTVHKEGCN

SEQ ID NO: 3456 - protein, 374 aa, Methylobacterium sp.
MRRAIIHIGMPRTGSTSFQEVLAGLRPDLAEAGLLYPELAPPGSHPDLNVNHQPLGEVLDGRRPRGERAVVLGRLDEALRRTGADTLILSYEDFSVQRRRFGVPETLRGILARHGFALEVLMVVKPPFDFLNSAYAHRAQLIRETGSFRDYLAHHWRSGRIDYRALVAPWAEAADGRVTAVPLADRRSAVPLVGRIVAALGLGDRLGTLMGTAAATYRTNRSSGPLAVAASRRLRALRVHRQVVGHPRRIGHALDQAAWARGLDPEPFRGDAPEYRARIDAHTFETRERFAQLAWGQPWDAVVAPGHEGPPNELAHRAIPAETEAQVAALVRETMRRFDVRAPAPLLARPAAWIEDGAMGLARLAGIESRWRVC

SEQ ID NO: 3457 - protein, 202 aa, Methylobacterium sp.
MIRNAHPDTIVSEAALQAAIDASGGMGAWEWNVAEDRARADPVVALLFNLSPAQSRGGVPFEVIARAIHPEDREQISSVIWGCVQEGGSYLAEYRVVSAGGRVRWILSRGRFFLDEQGRPAEGRGVVVDITDADLSTAAFAARAPNETPDTMGEAADLGIKLHGLAKELRSPRLRALTQQVLMEFGRQLAQRESAEQRKGLH

SEQ ID NO: 3458 - protein, 129 aa, Methylobacterium sp.
MDHSERGTKRICPTTGRKFYDLNRDPVISPYTGEVVPTSVATTYTRSAPPAFSRKPVVDEEERETDGPELVSLDEVEAEETDAAGDDTGNDDDLTIEDDTEGNADDTLIEDEDDDSATDLVDVEDDDED

SEQ ID NO: 3459 - protein, 508 aa, Methylobacterium sp.
VQGSIMTAVTNLGALVDRSGDPERPLIIGVRSGAEPDVMSRARLDARADAFARGLLRGGIRRGERIAILSANRPDALAALLGAMRAGVVPVPVNHKFPPATVAQVLADCGARLVLCDGPRRALLDGPAPDLPVADFDADGAEGFAAWLDPGPFAPVEPAPDEAALFLYTSGSTGRPKGVRLSHASHLWVVRTRMAESDLSADRVLVAAPLYHMNALALALLVCAAGATMVLLPQFEARAYIEAISRHRCTWLTAVPPMIAMMLREREALRAADLGSVRAVRMGSAPVNEALAHQIRALLPNARILNAYGTTEGGPVVFAGHPAGLPTPVNSVGYPHPAVSVRLVGPEAPEAGVLQMRSPAIMLGYHNRPELRTPITPDGYYDTGDVFRRDADGFHYVLGRTDDMFVSGGENIFPGEVELVLESHPDVLQASVVPVEDAIKGTKPVAFVVRRPGGTVDEAGVKAHALAHAPPYQHPRRVWFLDALPLASTNKIDRNALRARAEAMVGSA

SEQ ID NO: 3460 - protein, 139 aa, Methylobacterium sp.
MSDTPLTKEQVEALLLRGPFHQWLGLSVVSVGEGEIELKAAWRPEWVVNAERGYTHGGILATLVDLTADWALVSKTGRGVPTVDLRVDYHRAAMQGDLTCRGTVVKFGGQISVAEARILDAEGRLLASGRGVYMTAPAR

SEQ ID NO: 3461 - protein, 338 aa, Methylobacterium sp.
MARTMKALVLGQHGDIDDLKVVGDHPRPEAGPGEVVIRVGASSFNYHDVFTVKGMPGIKVPMPVVIGLDMAGQIVELGADVTGWREGDRVLVNPLNKARGLMGEMLDGGMAEYCRVSADQLIAMPPDVSYADAAALPVAYGTAHRMLITHRTVKAGDRVLILGASGGVGTGCVMLAKQLGAEVIACAGSAEKGERLKALGADHVVNYRETDFSKWAIQHYGKPQRRTYEGGVDVVINFTGGDTWVPSLKCLKRGGTLLVCGATAGHDPKEDLRYIWSFELKVIGSNSFYHDDLSALMDMIQAGTLKPTIDKVLPLEQAAEGLRLIRDREVMGKIVVTP

SEQ ID NO: 3462 - protein, 329 aa, Methylobacterium sp.
LRRTRRAAALLAAFLAALTLPAAVRAETVRIGYWSSGVSLGFGAVLETGKYMEKEGLTVEYVKFPDVNAPTKAMAAGAIDFAIGASAGTAFSVIADGLPLSIVLASQVADLDFVVPEDSAVRTMADLRGKKIGTSPAGSATAVITAAILETNYGIKAGEYQGVPGNDPRLAQFLAQKDIDAAALRTVTIALLPDMKLRKLGSFREEWRKITKSDAPPVLGVGLMRNAWMTENPDGPAKVVAAMRKAYEFGRTDKDAVARALREAANLNETDARAYAALWDSIYTVRMEPADVASIRQAFEVYKSVGAVKGELPASALVTAPYEASKAVR

SEQ ID NO: 3463 - protein, 269 aa, Methylobacterium sp.
VRTPPDLLRAPPRTVLWRGPAAAILRRAALLALALVAWQVGAQHAPSFVLPSPARVWSAWSSLVVQPSFSTDLGITLGRIGAGFALATLVGLPLGLLLGASRALGSFFEPALTVINTVSSTIWAIFALIWFGLSNWTTIFVVFMTAMPLILTNVWQGTRTVSAEHLELARTFRMPRRKVLTKIYLPTILPAFFSGARLAFGFGARVSLVAESLGASSGIGYRLRQAADLVQTDQVFAWTLTLVVLMLGLESLILKPLERHLFAWKKSVA

SEQ ID NO: 3464 - protein, 285 aa, Methylobacterium sp.
LARGALGRSLLVAGALAVPFLPPAARAGIAISAAKITGGELWVLGSTDETDAEISLDQQFTGRTDGRGNFEFRLIYHPASCIVTLRVRQQEQRAVVGECGQQGPPGPAPAASTVAGPPGPSGPAGPQGAPGPQGPAGPAGERGPMGERGLAGERGPAGATGEAGRAGPIGPAGPPGTRGEPGPIGAEGPSGPPGAAGPAGPAGPPGPPGPHGERGEPGHRGEPGPAGPPGPAGRPGPRGPAGPPGPRGAAAAAQPRPAPVRTPRPAEPEPIPIQPPAGSATGVPY

SEQ ID NO: 3465 - protein, 92 aa, Methylobacterium sp.
MPLERYTHGAPHHDAATEGAIRFPMTNGQRVIACEIDADVLRQQFGDDGDDPLDVFLRHRAAIEAAASRAYDRGSFPNDLMELTANDFAPGA

SEQ ID NO: 3466 - protein, 293 aa, Methylobacterium sp.
MQSDEKLKYSAPAAACAADLLLALARADGPMTLAALIERTTYSRSLLYRTLKTLGTRGFVVEEAAPGISGSLHYRLGSAAAEIGGAYQSNVPFEESIRSALRALAQRTGESASVATIEGEDVLYVMREEGRYSVLAVSRVGKRLPAHATAMGKALLARFDDGEIRALYGRGELRRFTGNTITDSGALLRNLAEVRLRGYAVEHSELVQGRCCIAFTLQAGPGPGDLLGISLSTTEARFEVEHDALILEVLSTRDALLADLSRRRVPGDRKVARDLTASLGAISRRSVPAAAGT

SEQ ID NO: 3467 - protein, 92 aa, Methylobacterium sp.
MADLLKFPANSRPRHVRRAYQVHRFVKSGGVLTSCIITARDDSDAKRQAVGLTAGNRTELWASNRLVAVFGAFENPIASAIRLHAERPTTEQ

SEQ ID NO: 3468 - protein, 253 aa, Methylobacterium sp.
MSETAQPEILRTSEPADGVRLLTIDRTARRNALDRATYAVLREAIAQAGTDTAVRAVVITGAGGCFTAGNDLADFRDTTLREGDSPGLALLKVLAACPKPVVAAVEGHAVGIGTTLLLHCDLAYAGAGARFRLPFTSLGLSPEGGSSYLLPLVAGTKRAAELLMLGEAFGAETAEAAGLVNAVVPAGRALDAALERARALAALPPVSIAATKRALRAGHAEIVARTLASEAETFHALRRGPAAQAAFAAFLAR

SEQ ID NO: 3469 - protein, 255 aa, Methylobacterium sp.
VNAVELERVSKWFGRRDGPPLHVLDAVDIAIPQHAIVALLGASGCGKSTLLNMIAGLVEPDAGAVRLDGIPARAFRDWRAMTYMFQEDRLLPWRTAAQNVAFGLEAGSMGRAERARRVEETLALVGLAAFRDAFPHELSGGMRSRVALARSLVTEPRILLLDEPFSKLDPDIRAQMHAELLRIARERAMTLVFVTHDVEEAVVLADHVVVLHPRPGRIGEIRAIALPYPRDPLSEAVSEEVRRLRISLSAARARC

SEQ ID NO: 3470 - protein, 72 aa, Methylobacterium sp.
MGDDTDMRSRSQPAGTPARGAAHEATEGAAITPRDPATGAVRPTDGPMERAGTEAEARARGEEGPFEGRRSG

SEQ ID NO: 3471 - protein, 144 aa, Methylobacterium sp.
MHGRSWFGALILLSAGAQAQDGGKAVIDQLGALPRPAQQGDLDTFALASAHRERAETMQQRTDGLWQSWLVSVCEGCGEARRPFSDREGAEYLRKLRAAQPEQAPSRPRLTYYVPPGDRVPRTDNISADLSNENIDQIRRDPNR

SEQ ID NO: 3472 - protein, 65 aa, Methylobacterium sp.
VRDTMLLPSFVRSGAWAFGASVREDEGLPFGFQPIPAREATAAFGYYLFHHPCETLAPRYARRWA

SEQ ID NO: 3473 - protein, 119 aa, Methylobacterium sp.
MRSALRIAAVTLALASPALAAGPNGGQTTVFDGHPIEFVASDSAVTFYLSDEDGKPVDTAGLSAKAFVQAGGRTDTLVLKPAAPNRLVADLKAPLAAGAKVVLSAKLHGHAIQARFEKR

SEQ ID NO: 3474 - protein, 143 aa, Methylobacterium sp.
MIRVTRLHHTAIAAHDLDAMRRFYTEVIGLDAHPTKTNWLRAGNGFVVHLMPSPDAPASGRIEQHFALEVESLRETAAALLRQGVTPYMASLEYETHAVTDAGDPLDFGIGTLFVADPEGNTIEFVEPDTGIFAEVPLEAQDT

SEQ ID NO: 3475 - protein, 377 aa, Methylobacterium sp.
MTPEHLCERDVEAVVATTPESVFLLSGHLTWLGERMRGWMGGPAGDAAFQAGYAVLTRDGRVGLAARAVTRMAAEAAAPDSLVLYGRACPAADADAALSLLLAEMGLAGRTIGVEWDGAGRGLARSLEPVATRDASLWLRSLRAVKTEAALRTMREAATATEAAMEAVFAAWTADADPRALRTVFRVALAERDCDFDHLVFGAPGGGVCDAARPPEPVTALFFDAGARCGRYYSDTGTTLTRAGFTAADRERHAGALAALAAAERALQPGRPASSAWAAMQDEARRIPGLVAQGHGLGLGIREWPLLGPPSDAVLSDGLGTYPVDAVLAPGMVVNLEAGGHFADGTSVQVEKSFVVGADAAVPLAAQPRDAPIRLPA

SEQ ID NO: 3476 - protein, 624 aa, Methylobacterium sp.
MTRQKTIRLTTAQAILRYFAAQQTRRDGRERPLIGGVFGIFGHGNASGFGHALATGAGGLTYHQGKSEQAMVHAAIGYARAHNLASTLAVTASIGPAATNLVTGAGTATLNRVPVLLLPGDVFASRRQGPILQGLEMAGSYDMTVNDTLRPVSRFFDRITRPEQIIHSLPHATAALLDHGQAGAVTVAVCQDVEGEAFDFPLALFERRVHDLERLAPSETALAAAAERVRAARKPLIIAGGGVRYSEAEASLAALSDACGIPVVESFAGRGAGREARLNAGGVGFIGTPAANELATEADLVLAVGTRLSDTLTGSHTLFQNPDVNFVTLNLAERDLRKMGALALRADARAGLDGLAAALEGHTAPAEWRDRADRAILRHVARVGEIVGTENPRMTGYEAVAEIKDAARREDRVVFSSSTAIGQAHTIWDSRSDAPVDMEYGFSCMGYEIPAALGAAMAGTVKGRILALIGDGTFLMGNTTEIVTAIQEGLAFTIVVVVNRGWQCIRGHQLGSYGEEFGTQFRRREGDARNLTGETLAIDYVANARSLGADGLDVHSRAELRDALEQARRSDRPFLIAAHVEDAPLPIENGAWWEFGIPRADAPEGLRETRAAFEAAAAKHRWFV

SEQ ID NO: 3477 - protein, 366 aa, Methylobacterium sp.
MNARAQLPAIADHRPPQIVPAVGIFGTPDKFEHAQRVAKVFSESALVPSHFQGKLANCLIALNIADRMGEDPLTVMQNLAIVSGKPCWQTQYMIARANKSGVFESRITWSSDGRGEALAVTASAKLADSGEVVSVAVSMAMAKADGWLKNAKYQSMPEHMLRWRSAAMLIRLYAPEVMLGIQAVEEVEDTSAGAARDVTPPRGAPAAIPASPAQRPSGPPRIAQTPPAKPEPASAPEQYAADEEAEACVAQFEQDAQHARSLQDLEECAGIVTPMEEADRLSRAQRDRIETAMEAARQRIAAPTDNGQAEEVEEPEAEIDPANPDYQRGIADRKAGQKKCVISAIRENPERMAAWKAGYDSLEGEV

SEQ ID NO: 3478 - protein, 117 aa, Methylobacterium sp.
MIDDRDAVPLDDVLASLPAERQARIRARGAELIAEELALRDLRQAERMTQAQVAERLGGRQVYVSRLERRADMKLSTLRAYVEALGGELQLMVTFPEGRTVRLADLADEPPVKRTSA

SEQ ID NO: 3479 - protein, 110 aa, Methylobacterium sp.
MLSRTALPVLAALGSTLGACTDEPSEAALRQAVERKLTPSFDREVEQARKLGVQSPARPSITAFTKLGCKPAEAAPGYACTFDGAIDGQNQGPGTRRFFRAADGTLTMAE

SEQ ID NO: 3480 - protein, 274 aa, Methylobacterium sp.
VSVPRQTRDSVLFVTLDSCRYDTFAAARAPALKAVGPLHKAQAPSYYTYGSHAAMFVGFTPGLAHLRQPVLNPKFGKLFKLVGGGHPGKGTEGYALRGRNIVEGFAREGFRTFGTGSVGWFDPATPTGRHLTEPFGAFFYPGDTWSLDRQLAWLEPRLRHPGNVFCFLNVGETHVPYWHAGAPWDRADNPCEPFQSADRAEDCRARQRACLEFVDGRLAPLLEAFSDATILLCGDHGDCWGEDGLWEHGISHPATLTVPLLARVRGMVVDEKAA

SEQ ID NO: 3481 - protein, 294 aa, Methylobacterium sp.
MKKILLASTVLAGLTAAASAADLPRRAAPPPVFTPVPVFTWTGFYAGFNAGYGFGTSDSNRGTLVAVPGSYGLTTAAGPNLIAFQGERSADGFVGGGQIGYNWQLTPGSGVVIGIEADAQYVDFGRDRNRFAIAPVGAVQAPGALIFNPNSLTGLDYFGTVRGRLGYAFDRTLVYATGGFAYGSGGGRDFGLPNASRDEFQTGYAVGGGIEYALPTDSFLNFFRASAVTLKVEGLYVNLDQGNRNNGLFGVNAAGLPVGLSSPGVQLVSGVTNNRRDTEFAVVRAGVNYKFGSY

SEQ ID NO: 3482 - protein, 255 aa, Methylobacterium sp.
MSNRLPSTRTTQALSPAEVSRAEARIEVFHGRLAAHPAHPTRYCVPREKAVTTAERRALSAVGERLVAELAPWSNRGHIDAVVTRLLFGFEQGRPRGEDEDEVLVGEYIAALKGLPLAAIVAAADRVRSGETLIRRNSRFRPQPPEFADEVREGLIPVRTKLVHIRRILDAEVYDPPTEEQRKAVKAAAAAYLKGRGFPGEEGRPVPSPGELAAARDASLREQGAAAVRACDSEAMARLNARLTARGVPENVRVP

SEQ ID NO: 3483 - protein, 300 aa, Methylobacterium sp.
MFTALTAAATAADLPRRAPPPVFTPVPVFTWTGFYAGFNAGYGFDASDRRANNGFTQVTAAGVPVGANPVVQLPNGAFTTAGVLGPVGSSLAYNSGNNEGFTGGGQIGYNWQLTPGAGVVIGFEADAQYLDFGGRRSRFTTNALAINPAFVPVDSVLSTLDFFGTVRGRVGYAFDRVLFYGTGGFAYATGDRGARVAFTNFNNRNDDFLTGWTAGGGVEYALPTDSFLNFFRSSAVTLKVEGLYVQFDRNNRNTVGLPLVGGFQTANGLLPVFANNGVLRRDDNSFAVVRAGLNYKFGSY

SEQ ID NO: 3484 - protein, 280 aa, Methylobacterium sp.
LDGLLIGGVYGVISVGLSLVFGVLGIVNFAQAEFMMIGMYAAWFAWNWLGLDPLLGSIFSFAVGFLLGVLVQAALVRPVMRAPPVAQIFLTVGVLAVLENGALMLFGSTFRSVRTPYQTRAVEIGPLFLSVPYLLAFGAAVLVSGGLWFVLTRTWLGRAIRATAQDEMAAVAFGIDAKRMYAVAFGIGTGLTAFGGGVILPYTSASPVVGTQFVVLMFTVVVLGGLGSVMGALVGGLLIGLIQSLSTLVLPIQMQNLAIFVVFIGLLAFMPEGLLGERRL

SEQ ID NO: 3485 - protein, 525 aa, Methylobacterium sp.
MQETMQAGALGRAAEDIRVALMTAAAVIPEVERKRGPAPMEPHLVERRSKGKAREGGGVTLYIRDGKREISTRLGPDRRGDANTLLDLYKLQKGAKARGIIAPRMVPVVAALAHLLEADRPVEVPQADGKRRPVKGARHIYLMRSTRLATLTKFFGDLAFKDVTTAKCKAYIEWRVTLPDARYKPGDPDAPLAKEASAREDLYELKKAIDLYADEHTLAWHPQVYLPKAGPGRTRWLRPTEIDRIYWAIRGRIWDPATNGWKTETVADEDGNVVTRRVLRGAETIQARRVLRRFVFVGLTTGTRNTAMRELRWHITDEGGCFDLDAGLIHRRGFGVDPTKGKPRYSSRISDRTVATLRRWREADLAAGIDQVIHKLDGTSYASSPDCIWRSTMDDAGLGDDVVPHTLRHTAATMLRVASVDVRKGADLLGMAVQTMVRVYGQWTLEGQEEAAEILADTRGLRKSMPLLALVPMPPQPVVMTTPANDDAARAKATDRRRVDIAAARSGQSGAPMPPRSPAHLASVA

SEQ ID NO: 3486 - protein, 284 aa, Methylobacterium sp.
VTYLFQILNGIGLGMLYFLLAVGLSIIFGLLQFVNFAHGAFYMLGAYLAYTMVERGVSFWLALPLAFLAVGALAALTEAVLLRRIYAQAHTFHILATVGLALAVQEIVIIVWGPIGGNLPPPDSLSGVVILGDFIYPEYRLFVIALTALLAGGLWWLLEGTRLGAIVRAGSEAPETMALLGYDTRRINTAVFGLGAGLAGLAGALAAPIRGVDPFMSVEALSVAFVVVVVGGMGSYAGALAAGLAVGIAQSLMATLWPEGARLMIYLGMAAVIVTMPRGLFGRA

SEQ ID NO: 3487 - protein, 401 aa, Methylobacterium sp.
MLDRRSFLTTSSLALASLAAPPLLRSARAASADLVVGAPLPMSGAFAANGKFAALGAAFAAEEAGTVLGRKVAARDLDTEGKPATAARRVQEAMAEGTRLFAGGILSSEALVMGKEVTNGGGVFFTTAGADEITGKECNRGTFRWSVPTHGAIAQTVRPLIEQMPKARRWYTITPQYVFGEGLLGAAKALFQEKGVEHVGNSYHSLAEKEFSGYLTNAIAAKPDVLLILSFGAQSSDTLRQAVSFGLKKRMTIVLAWASGLEQFEALGPDLCEGVYFGAQYWHGVDTPLNKALVAKVRETRKFSPNYSFAGSYLLTKLLLDGAAKAGSTDGPAVAKALEGLTYAGLTGEEEIRAADHQVIKNYYLLKGKPKAQMADKDDFVDIVSSGKSFLSPEAAGCKMA

SEQ ID NO: 3488 - protein, 397 aa, Methylobacterium sp.
MEVCLRYGAPLPVRWNRTVALLAATLPASVLIGCDAPPPAAVPAPRVTAAAPLVAPLQDSILLTGQMSATASVDLVARVPGFLREVGFADGADVRQGQLLFRIEDESYAAQAALAQANLDQQEAALKSAEAEFARQETLRKQLVATQTTYDSALAARDTGRAAVAAAQANLKVAQINLAYTRVEAPFAGRMGRRLVDPGNLVGSGTPTRLGTLVQVDALYASASINERDLRRLQAAMRERGLTRETLHGVPVQAGLSDEPDLPHRGRLDFVDSGLDATTGTLLIRAILDDPGRRLAPGLFVRLRIPLGPPKPALWVPPAAIGVDQAGPSLLVVDAAGVVNLRRVALGPERDGLQVVTSGLQPADRVVTEGVQHAVPGRTVVAVAGTIGAPTASARAE

SEQ ID NO: 3489 - protein, 238 aa, Methylobacterium sp.
MQEKALRAFAESQAYELVDLIVDAGVSGATRPAEREGFGQVVALAEAKAFSVLLVYKFDRLAREIRYAVTTVADLAEQHDIGIRSVTEPIDTSTPMGRTVFAILAGMAESERFTIRDRTAGGKLAKAGKGGFAGGRAPYGYETNKEGGLRIVPAQAAIVRRIYRERGPSRRPRRTLQAIAEGLNADGIPSPSGKRWRHDTVGYLLDNPKYRGAVEYLFTWTGAEQHVLAEGQHQAILA

SEQ ID NO: 3490 - protein, 215 aa, Methylobacterium sp.
MTDFTDYLVRSRDVLQAAIDCPDLLAAAASAAERIAAALAAGGKLLVFGNGGSAGDAQHIAGEFVSRFNYDRAPLAALALTTDTSVLTAIGNDYGYERVFERQVLALGHAGDVCLALSTSGTSPNVLRAMHAAQDMGLATIGLTGRSGGLMAPFADVLLRVPSDATPLIQQVHMALAHAICGRVEASLCPNLAERFAQQDGARDGIRDAARTRAA

SEQ ID NO: 3491 - protein, 333 aa, Methylobacterium sp.
MFWITKTPLRVSLFGGGTDYPEYYMRHPGAVVGLSIDKYIYIAALRLTTLQKYNYRLSYSQLEHCDRVEDIAHPVVREIIRAFDLSERLDISIISDLPATGSGLGSSSAFTVGFLRAVYAIRGQRPTKIELARQAIEVERELLAENVGVQDQLHAAFGGLNRFDFEGPTIRIRPVQMSSSAVERLNRTMVLVHTGITRRATAAVAAQIEATTAGRIDRELKDLYGLVEVCVDLLEGEGRDWLPELGRMLSESWSIKRSLSRDVSNDALDAVFRAILDAGAYGAKLCGAGGGGFFLALMEPDQVQRLGERIGSSSVVPIRLDVEGSALIHCQTG

SEQ ID NO: 3492 - protein, 267 aa, Methylobacterium sp.
MQKQLRRRGRPKGSGAQQSSGIQALDRALDVLEALAAHDGMTLTQLADHLDQSAATMHRVLATLEGRRYVEIDPKRQEWLIGPETFRLGSSFMRSSGIFERSRPIMRDLMLQTGETSNLGVEQDGEILFISQVETHETIRAFFPPGTKSPLHASGIGKAMLSSFDDQRIEEFIRKAEFRTYTEKTIGSAEQLRGAIAESRRLGYSLDDEERTIGMRCVAACILNVYGEAVAGISVSGPTSRMQDAKVHEIGKLVSSAARELSKRVGA

SEQ ID NO: 3493 - protein, 483 aa, Methylobacterium sp.
MRTLSRVALIGIIGGGAAACSSDTMRLGDPFTNPFASNHASEPAATGSLPDNDLAPAPAIRTGRIQSEALGAPSAPITPRALPAPAPVAMKPAPTAPATRVASTGAAGWSASGGTTITVSQNDSLNQMSTRFGVPASAILSANGLTSASQITPGRQIVIPVYNASGMNPAATPAMSARAVPAAPAERLKAAEVKRQDEQKRIAETKREAVAREAAAKAEAAKEAAKEASKKLAEAKAAKEAAQKAAALEAEKKKHVRPGQTAKSETKNESKPDPKAEAARKAEAEAKLAKAEAAKEASKKLAEAKAAKDAAKAAADKASAEKLAAEKAAAAEKKVAAKPAEKAEPASTGSVAQAPAAPAVPDQNFRWPAKGRVISGYGTSGNEGINIAVPEGTAVKAAEDGTVAYAGSDVKGYGKLVLVRHQNGYVSAYAHNGEIDVKPGEKVKRGQTIAKSGASGNVTSPQLHFEIRKGGAPIDPMTHLASN

SEQ ID NO: 3494 - protein, 591 aa, Methylobacterium sp.
MHAPSGAPCQDGSRPAPKFCFQLRPLDYARLVHPRAPGAVLFGAHLPSTKPRNADGSPKVAWQDRRWSPGALANRAVDLARFKFMSFATYPYHRPGEPKPAKVEANVVSIGASWIDLDFYKATDWKETPPETVLEAVRNICAERGWPAPSYATHSGRGLLVVWLYPVQPAQIVMARHKAIQQTLHEAFRDMGSDPSARTMTKQFRMPATYNENSGLPVSIIWPALVREIERTDFDELCRTVLPFKRLTKAEREAKEDAAKAKRTAARLAARAPREGHYGARLTGTSYWATIRADLERLLDYRHGKQGVVDGVSRNEYGAGRNAWLTSLVYAAAWDMTPEELEAYVIKCADRLGYEHAEAKDKCCSIVLRAKQAARGMRKTYKGRPVDPRYKLSPARFIETLSITPREMRRADLRILVDEARRAENAVARVVASRRAKGVKARSSQQDLRRQVGTQATEMVAEGMTVKAIAELYGASPRWVDNALRDARAIAGIGTVRKEKPTATVEWEAYTEQPVVNVADVADTLDAVPPVTHEVLRGIRKAVGSGVVAGLGVAYPANVTTKGSTLLRPTPAARQPARRALSCPDFVAVGA

SEQ ID NO: 3495 - protein, 384 aa, Methylobacterium sp.
MQIDLATLWYLTIGTLLVSAALTLWERQAHPRRARELGIWAGACAVFALGCVVAMNRGLFPGAVGAALTNLLMVLGYLMVLQGAASLDGPVRVRGSAAALAALALLWALAGTHFEAALWNHVSALPIALACGLTAWTLLRGRTVRGLRSRPVAVAVSGGHALFYLLRALAAPVLVERYGPGLLPVFAKITMYEAVLYSVAMPMAFLALVREEAQAQLLAASRTDFLTGLANRQGFFEEGARMLAERAAGRPVALLAFDLDHFKSINDRHGHAAGDAVLALFARVARDAAGPEALVVRLGGEEFAALLPGQGARAARQVGEDIARLFAEAAAHRDGPGIRATVSVGLAEAGPERGDLSGLLSAADRALYRAKAAGRNRLEVAAAA

SEQ ID NO: 3496 - protein, 115 aa, Methylobacterium sp.
MRAPPPLDSERVRNTTEADIRRHALEDGEDPDAGTEGYIVVPRPQDLRRILAMTQDAFAAFLRVPVGTVRNWEQGRTLPDPAARTLLALVAADPAHALGILGGDGGEPVLDLRRA

SEQ ID NO: 3497 - protein, 137 aa, Methylobacterium sp.
MSKGLLQTADLHFRSYLDTVMPLHESLVEEMCAQAHPPLELATVLEDIGQRYVGLAAKLNEALIRTGRLADEPDADDATDAQLDEFVRGLIANAGVVTFHDGTSVKVSEALSTSPVVFGAIRAAVLLSRSASDATAA

SEQ ID NO: 3498 - protein, 123 aa, Methylobacterium sp.
MMAVRAEARELVEAIAGPLRMGENVKAALSRVARVTGLGDRRVRGIWHNEARSIRADEMDCLREAARDAREMELARDEYRTFASRLTACDAALGLPSADQARPLDHARLGLARAEDRTLAQGE

SEQ ID NO: 3499 - protein, 254 aa, Methylobacterium sp.
LAKLWILSDLHLETLPYPENFRPEPPPFDVLVAAGDIQEGDPGRAFAVLRRLAGTKPVVFVMGNHEHWNGLVDEDLALAQVLAAQAGITLLDGSRAAHAGCQFVGTTLWSDYRLAGHLDPDTPTGEPIDIAHDEHGGSHLITVGDAAALHHRARAALAARIAESDGALPLVVLTHHAPHPDCIAPAQRGTWNAGNSASDLSALTDTVRAALWVHGHVHHSLDLTRPGGTRILCNPAGTGFANPAFDETLVVALG

SEQ ID NO: 3500 - protein, 92 aa, Methylobacterium sp.
MIESFLHKGLKELFETEATAKIAKQFHGRIVRRLDALDNASTPGDMNVPGFNFHPLQGFDPTRYSVHVNGPWCITFEFKGENACRVDFEQYH

SEQ ID NO: 3501 - protein, 343 aa, Methylobacterium sp.
MSTRRDFLHLSAAATAAGVLAGPASAQAPSTDPGRPIPPAGGDALRLVTFTSGADGSPRLGVVRPDGRVVDLTGAALPGFDPRRMVSLIAAGPEALAAVRRAASAGEGLQLDTVRLLAPIPEPTRNIYAVGWNYLEHFEEGQAIRGTQTEYPAHPVFFTKGVNTINGPYDPIPYDATVSTAIDWEVELAVIIGKQGRNIREADAMNHVFGYSVINDTTARDMQIKLHGGQWFKGKSLDKHGPIGPWIVPAGDLDPSDLRLTTRVNGIIKQDATTKQMYFKLPRIIAELSRGLTLMPGDIIATGTPPGVGNARKPPEYLKPGDVMETEVAGIGTLRNVIQAVPA

SEQ ID NO: 3502 - protein, 188 aa, Methylobacterium sp.
MSDIDLYLGDKRQALAARDLRIRRGEASPVPLSARATVEGRSGVRRIAIRRHAVVTDSLPDFAGHDLGPGSPELQLGVLGSCLAHTVLIQAALRDVPVTALEVEVSATFDPRAGTEGFEHIPVHPQDLAYAVRLDSPADPVSVRALHAAVERACPILNLLRLPQAVSGHILHSVPPPGPDAIETEIPA

SEQ ID NO: 3503 - protein, 587 aa, Methylobacterium sp.
MTVDQVLAFGLIAVTVAAFVWDRLPYDVVALTALAVGIAIGLVPADKAFSGFSDDIVVIVGAALVLSAAIARSGAVETLMRPLMPHLTSAGRQVPILVAGVLLLSMVTKNVGALAIFMPIALQLARRSGTPPSAMLMPMAFASLIGGIVTLVGTSPNVIVSKVRTDLTGQPFGMFDYTPVGLCVAAAGFAFLCLGWRLLPRRDGGTRSMEAAFTLERYTTEARLPAGHPAAGGTVAALEAQGDGEIRIATILRERFRRYPASPDFSLKDEDVLLLNGEPDALERFVARTGLTLAGAAPAAEAVVMEGVVTAESDLVGRTAAQLDLERASGLGILAVSRRGRRIEQRLSSVRFRAGDVVVVRGRAAALAPALGTLKVLPLAAREIALGRNDRSWLPAAILLAAMGLVALHVVPVAVAFFGAVVAVLLLRSMTPHEAYQAVEWPVLVLLGALIPISETVSSTGGADLIAAHLTALVQGLSPVAALAAILVLAMAVTPFLNNAATVLIMGPIAAKLATKLGLNPDPFLMAVALGAACDFLTPIGHQCNTLVLGPGGYRFGDYARLGLPLSLIVIMVGVPLIAIVWPLHQA

SEQ ID NO: 3504 - protein, 151 aa, Methylobacterium sp.
MSNLSAETLRVADVMARDVEFIEPHASAQAAAVLMGEIEVGALPVGSADQIVGIVTDRDLLYRVVARGRDPTAVPVQEVASRPVLSCAPDDALRAAMDVMVANYVRRLPVLDGSRRVVGWLTLADIARHLLVNDDALQVSLLALTEGTEAG

SEQ ID NO: 3505 - protein, 338 aa, Methylobacterium sp.
MNEVGPVTRKRPPSSVEVARLAGVSQSAVSRTFTPGSVASPSTRAKVLAAAESLGYRPNLLSRSLMTGRSDIVAVAVGALSNPFHAMTLESFTAGLQRTGRQVMLVQVEDEWALGSAVELLAGYQVDAILSSLPVTEPEVVQALSRFGVPVVTLNSPATTDWVRTVVTDDAWAGAEMARLLHERGARRFGYVAGRSGTMGQERREAGFREGLRELGIDSYARAQGDHKHGGGYEAVRALYASGTGPDGLFCFNDLTAMGAIDGLRHEFGLRCPEDVLVAGYDNIAAAAWPSYRLTTVDIGLAAVTESALALIASQAGEATEALARPHLVERASTLSQR

SEQ ID NO: 3506 - protein, 352 aa, Methylobacterium sp.
MGSIAQRIFPMATLAIAAVVQPASAQQTIKIGAVLPLSGSNAQFGINIRNGLELALADVNAAGGIKSLGGAKVEIVYADVPSPNAAAAATQRLISHDKVVGIVGSFVSSITLAVSEVTERAGIPMLTHSFADQITERGYKYIFQVSPKASRFGQDQLGYAVAVGKRAGTDVKKIAILYEDTAYGTAQAKGLRDAAQKTGIDVVVDEGYPLGVTDVAPLINKVRASGAQVVFPVSYFNDAVLILVKMRQQRVDLPAIGGAAGYIIPEFEKALGESVEGVFSIAPANYDAAPEIEARYRGKFGNFPPHESLMYPAGFEHLVRAIEVAKSTSQNSRAPGALPLHTTAQREFCERL

SEQ ID NO: 3507 - protein, 349 aa, Methylobacterium sp.
MRDDGEPYEIGRLKGECVLAFWRTVDGQRKRQRYRLGTDDEAEARRRAPAVYARAIRPQGRKVKDLWDAYLLDKKGRPVAAVMPFEWKALEARFGEMDAEAIEIADCRAYIADRRAMGRKDGTIITELGRLRMVLKWAVKHKLVAHAPDIERPAAVKRKERHLTAHEVRRLAAACKAPHLELFVHLAYATAGRAGAILGLTWERCDFAREKIDLEDPEILVPHKGRAIVPMTRTLKTRLLAAKAGARSPFVIEWNAQRVGSVKKGLAAAAETAGLQHTHPHLLRHSAAVRMAETGIDMEEIRSYLGHENVATTRRIYARFSPNHLRGAAASLELDEGLEEVAPLATRVR

SEQ ID NO: 3508 - protein, 284 aa, Methylobacterium sp.
MLELTQLLANALGHHLAETYTRMFGSREPRYAEVIDESARLTIERLVGSDALYHDADHTALVALVMQDILRGRFVSRSVGPEDWLHAILAALYHDIGYVRGICAGDSLGRYVVDADGTTVGLPRGASDAALAPWHVERSKIAVRERFGGHDLVDAERVVRAIELTRFPVPNDADHAETATEAGLLRAADLIGQLGDPLYPRKLNALFREFAEVGLDRELGYADPADLATGYPAFFWSKVEPVIGEGIRALDATVEGRRWVANLYAHVFAMEHDRRRMGPDLGRP

SEQ ID NO: 3509 - protein, 343 aa, Methylobacterium sp.
VFTEPSSAGLAPGSSPAHLPGTCLIVQPIHAAGLARLRAAGLAPRFAGSVAATALAREAADCVAVVTRNAGFPAEAVAAAPRLRVIGVHGTGTDPVAVAEATRAGIAVVNTPGANARSVAEHAIGLIFALAKAIPQADRAVRAEDHDFRDRARLVELAGLTLGLVGFGAIGQATGRLAAALGMRVLAYGPTRPDADFAAVGAERVTALPELLARADMVSLHLPLTPETRGLIGRDALAGMRRGAFLINTARGALVDEDALAAALAAGTLAGAALDVVSGDALAPDHPLYTEQRAILTPHIAASTEAALIRAAERVADQVVDVLAGRRPSNLVNPDAWARRRRA

SEQ ID NO: 3510 - protein, 271 aa, Methylobacterium sp.
MTRTLNRRRLLALCTILGGSLLAASSGTRARAAELELIQPGKLLVATEGTYAPFSMRAPSGELDGLEIRVAKEIARRLGLAYTPVVIKFDSLLIGLMADQYDMTSATMDITPARQKQVAFADGWLESGARIITRKGTGIQAPADLKGRNVGAVAASTFGKLAEEQGANLKSYKAVAEAMQDLVGGNLDAVINDAVAGTYAIRDRKLPLVMIETPLSTVQKGMAIKKGKPNLHAAVNKALAEMVADGTYAKLVTPLVGYDPFPKEPIRTPAM

SEQ ID NO: 3511 - protein, 226 aa, Methylobacterium sp.
MKTLDASSYTTRLGARREQSLGQMAYDRLLDMLMRRDLPAGTVLHERRLAEMLDISRTPTREAMSRLETEGLIERQPGGMLVVKEFSLRELIEILHVRRLLERESVTLATGRIPGAVLEDLRARIEDLMAAGDPDAPGNRELDRRFHELIADSSHNALLAKTIKDLRRKTQMFNLSRMPERFEAVHREHLAVLAALRAGDASGAADAIAAHLENFKQGIIRRLSEL

SEQ ID NO: 3512 - protein, 441 aa, Methylobacterium sp.
VPGWIENTLWWHVYPLGFVGAPRSAPEQAEPVPRLRHLEAWLDYAAEMGATGLALGPIFAASTHGYDTIDHVRIDPRLGDDADFDALVAAARARGLRLLLDGVFNHVGRDFPAFAEVLRLGPDAPRAHWFRLSWPRGPGAEPDYACFEGHRQLVALNHDEPEVATYVEGVMTHWLARGADGWRLDAAYAVPPAFWARVLPRVRAAHPEAYLVGEVIHGDYARFVTESGLDAVTQYELWKAIWSALNDRNLYELAHALERHNSVLDRFVPLTFVGNHDVSRIASRLQNPHHLGAALAVLFTCGGTPAIYAGDEQGFVGIKEERAGGDDAIRPEFPATPASLPAEGWPLYRLHRELAGLRRAHPWLHRARIRIDHLANRQMVARSHAESHTLLLALNLDDAPAALPAPGGRAVEAGTGQVIDPGAAGARVLVPSHAWAVLSCA

SEQ ID NO: 3513 - protein, 142 aa, Methylobacterium sp.
MSALVTPIHTGTLGGQPLRFFRAPLPGPHLVWHAPEDLYRCLGLPRDLRRHFQRRLQASEWANDVRTVATAAGIVMIAPHWIAQGMIGSMIEVGRAPASVEMAYAKQAVDAWNALTGDLPPGANIDLMIAAFRNTNGVGGMA

SEQ ID NO: 3514 - protein, 155 aa, Methylobacterium sp.
MNIVELVRLFAEPLDVGVVLTDIDLDRPGPTVLYANPAFLRMSGYESDEVVGRSPRLLQGPGTSREATRQIQRALRLDGRFMGCLQNYRKDGEAYLCEIDVRTVRRRDGTPEAFIAFEREVVRRRGRPARGGNGRYRPIHAAALPLVENLAPLFD

SEQ ID NO: 3515 - protein, 257 aa, Methylobacterium sp.
MILDEDAEAPPPRRIKLSDQIAEDLCRRIARDRMEPGQRLPNERALMQHYGCAKGTIREALKSLEVQGLVTMQPGPNGGAEIRPVSIDAAALQLRRFLHFRQLDFAQVYAVRRSLEVALGLSIVGRIDDDILQQLARNIDACQAAADAGDLARGRVLELKFHDILCDASDNALLAFMCRFLNSLLRDLVEFRSGSATEHEAFGAHNIDSHRRLVSAFRAEDAEAVEAVMHEHMCCAEHFMRRLDAAFNRDLLSGERA

SEQ ID NO: 3516 - protein, 75 aa, Methylobacterium sp.
VSAKGKKDKRQAYLVAVAQRREAARIYAVVAASEAAALAALADHAAENVRLQVVGGLSRDMVRRLKLKPGELRLV

SEQ ID NO: 3517 - protein, 53 aa, Methylobacterium sp.
MQQTEYGRTAANAPAHRVGEDVNDVDQTSSVTLLGLAVAGAVVMLLLVRLVVG

SEQ ID NO: 3518 - protein, 124 aa, Methylobacterium sp.
MGEAVWAWQRARRLVGQPPWRAAASLAEAGERESAETLMLQDIPIWEGALKALDAETARAVRYGLPVPLPLAVPAPVAAALAAHRASVLERALRRRGRSDGGGGGPDLVPPDPGAGPAIPGRGI

SEQ ID NO: 3519 - protein, 238 aa, Methylobacterium sp.
MRWETLNAYVDGELDPQDRRAVAETLARDPVLAARVATLTRLKQGVKQEVKAAAVPPRRAPIARASLGWACAAALVVLVGAGWLALSSRPPADPARAAFTAWGAAGSPANDVRPAGGPNGFPLDLGAAGFRLVYLSPDDGSAGRLAGYEGRHGCRLAIWSGPSRGQAGLEIAQGDSGPRVARWDSEGRRYVLLTETVPAERFALLAEAAALLTTPDRTDRLRLALDRATGLSARPCTG

SEQ ID NO: 3520 - protein, 162 aa, Methylobacterium sp.
MRSIGQHLVDAWPRLFRYALALTREPDAARDLMQQSALKALSTRTTPSEPHAARAYLFQIVRHAWIDRIRRTRLHHEDELLDWPDEGFDDRLIEAIAVRQAFAALDMPCRAVVTCVDVEGLSYRETAERLGIPVGTVMSRLHRARRIMLHRIAGPSDGSEGP

SEQ ID NO: 3521 - protein, 176 aa, Methylobacterium sp.
VSEQGGTGRDHPSPEREAIDRRHRAVAPGRRQVAEVVGQKVLHGFLQNRHQTLMPLSVNLARLAEAERAALARFAAVAAQAGRAESAPDRVRTWLSGAGADAGLLAAFDASLRSPPPLDAVLAALREPETALIAFILCLVAAREAGPAGWAFAEYVALHRALPTTAVRAAERRYRT

SEQ ID NO: 3522 - protein, 66 aa, Methylobacterium sp.
MAAEALPDLSLQVEPNPKDPSRYRWVIRDQDHILRQCLYSLPNEQAAHSRGEAAFEEMTALRRDAQ

SEQ ID NO: 3523 - protein, 474 aa, Methylobacterium sp.
ASSSPRGFTALGDGKILFSAITAANGTELWVTDGTAAGTRLVTDINTVPDSSNPGGFTLVKPPPAPPSGGGGGEPPLVSPNTGTGGSSTSLTTTSDPAAAAGAANQAVQSLPAGLDKAAVGQAVSSFLAGLPAGTSVNVSTFTPTPGAAKISLTGPTDGSQTLVILDASALPPGTPITLNNVGFVVLSGPASLIGGDGAQVVYGDDAAQSMVLGADDDTLRGGGGNDVVGSKGGNDLLYGDAGNDTVFGGAGNDTLFGGTEQDLVYGNQDADLIYGNQGQDTLYGGQGDDRAYGGQGDDRIWGNAGADRLFGNAGADLVYGNLGADVVYGNQGADTLFGGQEADTLFGGQDADVVYGNLGADIVYGNLGNDVLYGGQGNDILYGGQGDDVLVGGLGDDILVGGLGADRYVFGANSGRDLIRGFEQASGDRISQGGQTYTLSTSQGGNALLLLSGGGTVELAGIRAEQVNTGFFA

SEQ ID NO: 3524 - protein, 356 aa, Methylobacterium sp.
VVAQAVSTFLAGLPPGTSINVSTFTPTPGATSISLTGPTDGTQTLVVLDASALPPGTPITLNNVGFVVLAGPASLVGGDGAQVVYGDDAAQSMVLGADDDTLRGGGGNDVVGSKAGNDLLYGDAGNDTVFGGIGADTLWGGTDQDLVYGNQDADLIYGNQGQDSLYGGQGEDRAYGGQGDDRIWGNAGADRLFGNAGADLVYGNQGADVVYGNQGADTLFGGQEADTLFGGQDADVVYGNLGADIVYGNLGNDVLYGGQGNDILYGGQGDDILVGGLGDDILVGGLGADRYVFGAQSGRDLIRGFDQAAGDRISLGGQGYTVSTAQNDDALLVLAGGGSVELAGIRATQVSARFFA

SEQ ID NO: 3525 - protein, 367 aa, Methylobacterium sp.
VQSLPAGLDKAAIGQAVSTFLAGLPPGTSVNVSTFTPTPGAGPISLTGPTDGTQSLVVLDASALPPGTPITLNNVGFVVLAGPASLIGGDGAQVVYGDDVAQSMVLGADDDTLRGGGGNDVVGSKAGNDLLYGDAGNDTVFGGIGADTLWGGTDQDLVYGNQDADLIYGNQGQDTLYGGQGDDRAYGGQGDDRIWGNAGADRLFGNAGADLVYGNLGADVVYGNQGADTLFGGQEADTLFGGQDADVVYGNLGADIVYGNLGNDVLYGGQGNDILYGGQGDDILVGGLGDDILVGGLGADRYVFGAQGGRDLIRGFDQGAGDRLVLGGQGYTLSTSQNGDALLLLAGGGSVELAGIRTAQVSAGFFA

SEQ ID NO: 3526 - protein, 96 aa, Methylobacterium sp.
MKKLPRIKTAEPVIHGVLKLVFLDGYEGVIDLRPLLARGKIFTWLQNPEHFAAVRVEEYGHSIGWVDGSGYEIDLGADSLRRDCERQAEIHKLMAV

SEQ ID NO: 3527 - protein, 83 aa, Methylobacterium sp.
MAVVANVSGVRIMFYANEHPPPHFHAKYAEYHAVIDIQSLTVAEGFLPVAKRRAVLGWASTRQKQLNTAFVRATSHEKVDPIP

SEQ ID NO: 3528 - protein, 294 aa, Methylobacterium sp.
MERIGARGSGGSLALGLTARRAPGLVLPALRGWVGGCLAAEAAQRRLFPWLAVAFGAGILLFFGLADGTPVLAAPLGAAALCLGLTPWLGTRPVILALALALTAAFLGFAAASWRVSRVAGPILARTTIGPLTGLVESLEEREEGARLVVRVARFGALSPEETPRRVRVSFKRAPPVKPGDAIEASARLLPPPEAARPGGYDFARDAWFRGIGAVGSLTGKITVRAPAEPPGLSSRLAALVDAARNALTRRIAEATGGQAGAVAAALVTGKRGLIAPATSETLRAAGIYHVVQG

SEQ ID NO: 3529 - protein, 140 aa, Methylobacterium sp.
MRVHYLARSGATRDALGIYRVELAPRSPGAGLHRHARLTETFEVHAGRLTVRIEGHTLELGPGDFVLIPPGQPHAFANRGDDPVSFTLSFTPALGREGFFEGLAELAAANRLGDEAAMDALMADYDQEPLEGFSGWSRID

SEQ ID NO: 3530 - protein, 199 aa, Methylobacterium sp.
MTNISSLASLSNITRSEGDPKVLRSGPSSRGVPDSLAKGLGWFSLALGLTELFAPHRITRALGMEGKEALVRVYGAREIGSGILSLSVDKNLGLWSRVAGDGLDIATVMTALRPDNPKRDNVVIALALLLGITAVDLIDAQASTARHSRGVGRKRSYRDRSGFPRGVQASRGAARDFKTPPDLRHAPPLAAVSQRPSVA

SEQ ID NO: 3531 - protein, 355 aa, Methylobacterium sp.
MPVGSGPDGASTGGPVEPGPTFSVIINNYNYRTFLTEAVESVLRQTYKDYELIIVDDGSTDGSVAYVESLATDLTLVRTDRRGQARACLEAFRHARGRYIYFLDADDIAFEGLLGAAAAAIADEPAKLQFRLVPVDADGRPFADPTPAITADHDAASQRAEIYRTGMPLAPPTSGNIFHRRVLEAVGDIAYETAIDGITLLAAPFLGAVVSIPDSLGSYRVHGMGHSAHANPLDAGRIARDRERFRGRIAHLNRILRTLGLSASPVREAESFFYFWDCVTLEAAVTGRAIGPRAVLAFVARLLAEHGLTRFTLRKLAWLIIAVAAPGPVKRRYVRARLNPWPRRRVGHPPAIESR

SEQ ID NO: 3532 - protein, 287 aa, Methylobacterium sp.
MRPAIRRRPFLPLFVTPAVLVAVAIVAAMAAILRYSLHAYVPGSLDVGGLTLENFSDLGRPIVLRALRDTVLICFETALITLVVGYPVAYALVRTRSLFLKSVILVTAVTPLFLGEVVRTYAWTVVLGNSGFVNATLRQLGLIERPIQLMFTELGVIIALVHVTLPVMVIMLAAALAHIDRDYERAAQSLGAGPVRAFLTVTLPLSMPGVAAGFTTAFAWTFSAFATPQVIGGGKVGVVSTLVYQLGLSSFNFPVAASLSLAGLVLALGTMWLVRRAARPLEALGGH

SEQ ID NO: 3533 - protein, 93 aa, Methylobacterium sp.
MMRAVFVVGAVALGLAGCNSAQPGRGELFMSGAEVDAKDDALCRSYGAKPGTDVYVQCRMNAGNRRQAFKAAILNDTTCTSNRIGSTVVTNCH

SEQ ID NO: 3534 - protein, 258 aa, Methylobacterium sp.
VSPHRARYWILAILSPLGLLALWAFVTARGLVTPVLLPPPLAVLASLKDMVAQGYSGVDLATHVLASLRRVGLAFAGGAVLGTGIGLLRGRVAEIDALFLVPSELLRPIPPLGLIPLFILWFGIGEASKVLLIFLSVFLIAMVNAQAGARACTLDTLRAARCMGASRWQSFRHVVLPSALPQIMTGLRVAMGTALTILVAAELLGGDRGLGFVILDASSFFRTTYVFAGIVLVGLIGLVSDRAIAALGRRIVHWEGRR

SEQ ID NO: 3535 - protein, 265 aa, Methylobacterium sp.
MAFVEVSFAGRVFRLENRDDMDLVARQIARGAYEPPLPMLMMATLVRSEGIFVDVGANTGVYTVMAGEIAANRSIVAFEPLGPVVEILKRNIEANGLGDRVRLIEVALSDTTGTAKLHLPDPGHGLVETSASLESDFQPAHSACEVPVKRLDDIGIADPVAVIKVDIEGHEHAFLRGARDTIMRDRPIIFAEVVGPARRGAIGAFLHSVDYMDFRLRPDMAIHDGEVMFDDAAWNHALVPRERLSRFKDACDSCNLAMLRRFQLT

SEQ ID NO: 3536 - protein, 471 aa, Methylobacterium sp.
MTAHVPLSSRHPAQDSLAAVVAGLRDRFGARLSTAEALRAQHASTLTWAPSQPPDAVVFPHTTEEVQAVVRLCAEHRVPVIPFGTGSSLEGHVNAPYGGISVDLSRMDRILAVHAEDLDCVVEAGLTRKALNLSLRDQGLFFPIDPGADASFGGMASTRASGTNAVRYGTMRDAVLGLTAVLPSGEIVRTGSRARKSAAGYDLTRLLVGAEGTLGIITELTLRLSGIPEAMAAGHCSFPSVKAACDATILTIQSGLPVARIELLDAVQVRASNAYSKLSLPETPLLLVEFHGTEASVREQAERFGEIAAGEGGGAFRWATEAEARSRLWQARHDAYWAALALRPGARAVATDVCVPISHLAACVAETQRDIAESGLLAPIVGHVGDGNFHAQLLVDPEDGDEVARATGFIDRLVDRALGLDGTCTGEHGVGQKKMRFLEAEHGADALSAMRALKRALDPLGIMNPGKMLGA

SEQ ID NO: 3537 - protein, 260 aa, Methylobacterium sp.
MGRHETFDITTALSTTLTHLGGIDQLGKKDPIFAALDACRAPEAEREAFHAVHSVGTTGPGYTLEREIALDSAVEAAFNAVLATTPTTQDGRLALIAFIARRIEWSACPDGSPQEGEDTVFAQAYHALAQAIRAEQAEPIGLPDLSALSIKQLRNLYDRYVQISDIWNDALNAPWTNHAEGAGFRASNAAGDVIEAEQTRVCALYAGVVAEISRRTPSGKGFEPDWQLETLIRHELMCNGDLREAPELRAKIIRQWGAAA

SEQ ID NO: 3538 - protein, 167 aa, Methylobacterium sp.
MSRWPASTADLFDADLAAWTEAQASALREGRVDAIDAAHLSQMVEALVAERAAELQARLGVILTGLLRWAEQVDLRGHSWAATIDIQRFQVDDILRENPSLRRSVAELIAAAYPEAKARAVLESALFEESFSESCPFTDDEVLTVGFLPDPYGDDAIRGPGWWKRSP

SEQ ID NO: 3539 - protein, 123 aa, Methylobacterium sp.
MPTIRPLWRALLTVFLTVMLVGVSVANAGHGHAGHAPIGPAASAHHDGVPEQVGDLSNHAERTGDDGAAGPCGCCCHQASIVRWDSPAVPVSWRLARTLVGIRAIAFDSVAPETLPEPPRTFA

SEQ ID NO: 3540 - protein, 90 aa, Methylobacterium sp.
MAITFDPAKRDRALAERGLDFQAAEAVFAGSVYEFEDTRADYGETRMITVGLLAGRMVIVGWTPRGADRHVFTMRKANDREQARYSDLLR

SEQ ID NO: 3541 - protein, 45 aa, Methylobacterium sp.
MGRRWIVAAALAALVAVAGWRLRDFLAQDACLDAGGAWRGGICQH

SEQ ID NO: 3542 - protein, 124 aa, Methylobacterium sp.
VRFVIDMNLSTDWAAYLQGLGHDAVHWSSIGPQDTADEDIAAWARAEDRTILTNDLDFGTLLVSTGAAKPSVVQLRTDITLSAHVGPLVAQAIDRMEAGLVAGALVTIETGRLRIRSLAPDSED

SEQ ID NO: 3543 - protein, 81 aa, Methylobacterium sp.
MTRSFKDFPRITVDPAVMGGKPCIRGMRVTVGMILGNLGSGISVEELLAGYPYLEREDVLEAMRYAAALARVRELEIEPAA

SEQ ID NO: 3544 - protein, 93 aa, Methylobacterium sp.
VPDFPASLLWVDQLRWCLAVMDADDPDLGFAASLLSHAVDKGGLTEKQGKYASRIVQRVQALWLAEALACQRRPSAPVPPPPALSEMATKGEA

SEQ ID NO: 3545 - protein, 39 aa, Methylobacterium sp.
MPRVASCISSRSGCSCSISATRSATAAPVRRRRFQLTIL

SEQ ID NO: 3546 - protein, 51 aa, Methylobacterium sp.
LATVKSPRSSTCETRWNIAPDGSGTTSGGRVQGFGAHMASPWMRSGSCAQA

SEQ ID NO: 3547 - protein, 28 aa, Methylobacterium sp.
MSKFFEERVVSVHHWTDTLFSFRTTRDP

SEQ ID NO: 3548 - protein, 41 aa, Methylobacterium sp.
VVRPEVRLSGQDEDGRMGTKRHKPEDVVAKLRQADVLIAQG

SEQ ID NO: 3549 - protein, 110 aa, Methylobacterium sp.
VSVWDRDDLCEIEPGDDRLDVPPVTMIDRLIRWHEKRAGADGRLALSLEAEGLTIAADTNRQRSLAHRQTATCLKVLRQRCCESEGAPQQAFRGHLKPKPRPRAEVRAPP

SEQ ID NO: 3550 - protein, 182 aa, Methylobacterium sp.
MRWYLKAMRGYAVFRGRSPRAEFIEVWGALFLLILIAQGLDREIFGGDGQRHTLLTHLVILAHVVPVLAVTARRLHDMNWSGWFTLLNLVPFLGFGMLLLACPRGTPGPNRYGADPIGAATGTEPPQRATEQAVPPAPQARSAAHDLLVELERLAGLRASGALSDAEFEVLKAKTLAQAGRA

SEQ ID NO: 3551 - protein, 493 aa, Methylobacterium sp.
MRLPAERATRPVDLARDPVVPLVLRLAGPAILGISAHALQMLANGWFVADLGAAAIATIGIAYPVTLLVAALGYGAGIAAASVLSRALGRGDRRLADAAASLGFWLALPPGLALTGLILLHPPFWLGLLGADADLAAAAAPYTALASLGTCLMLAIVVGGFVVRAQGLARLSGVVLVGSFGLNVALDGLLIRVLGLGTAGAGWAAILAQGAGALAYLWHFRRARGAARIRFRPPWRLFGLSGRPAGPLLREMLWLAAPATLSSLLAAAAMALFVQAGAAYGAAAVAGLGLALRIVLVAALPLLGLMAGAQAVIGFAHGAADRPGQRARRDRALGFVAAAALAYGFSAAALMALFSEPLAGLFAEDPAARAEGARATAAFALALAPVGLQLTAATLFQAVGAPRRAAAVSLAAQGLALIPPLLILPRLYGYDGVLASRIVAEFAADALGAALLLAWLRGEGRRAGPEAGADARSVEGREAMEVSAPHQPAHEGA

SEQ ID NO: 3552 - protein, 277 aa, Methylobacterium sp.
MEVRETLLFFFRLFDREVIALLLTLPRVYAFMAASGLLVSTAVPRVARVAVVLALSILPAGINLAHVDAFDRQVTTYAVYLAKEVAIGFLLGYLVGWIFWAVQAAGALIDNQRGSSMASSIDPLQGQETSTLGIAFSQVFLTYVYVAGAVLPVIGLLYRSFAIWPATRALPIISERFPALMLGVFDHAVRYVLILAGPIVAIMFLAEFALAMVSRFAPQIQVFVLAMPIKSALAMFVLIFYFSTLLPHAASQTVLVQGYLDALYTLLRFGAAPGAAP

SEQ ID NO: 3553 - protein, 96 aa, Methylobacterium sp.
MTPADAVHQITEAMMLVMLLSMPPIVVASVVGIAVSLLQALTQVQEQTLSFAIKLVAVAVTIAAMAGFLGNEMFTYTLKLFDNFPKYTHVAKEPRR

SEQ ID NO: 3554 - protein, 213 aa, Methylobacterium sp.
VVDPLNLIFVLGAAAFVPFLAVVATSFIKLSVVFLLVRNALGVQQIPPNMALNALAIILTGYIMTPVIVQTYDILSAGQFTYTSVEGLKAAYEAGREPLAGFLNRHAAEREKLFFLEAARSLWPPDLADRLGADSIAVVLPAFTVSQLREAFEIGFLLYLPFIAIDLIVSNILLAMGMMMVSPLTISLPFKLFLFVMVDGWSRLILGLVKTYV

SEQ ID NO: 3555 - protein, 461 aa, Methylobacterium sp.
VNRPLPPPDGAAVARERAERIRARLGRVLPEVATRAAAFDPYAVTGRVRKVVGTIIHASVPDVQVGEIVELITRQTGLRLFAECVGFLDEEALLAPIGETQGVSPRTEVRRTGRVQAVAVGPGLLGRVVDGMGAFIDGKDLPFEPETHYPVYQDPPDPMRRRVIDTPLSLGVRALDGILTCGEGQRMGIFAAAGGGKSTLLSMLVKGADVDVTVLALIGERGREVREFIEHDLGPEGMARAIIVCATSDRSSMERAKAAFVATAIAEYFRDQGRRVLFLMDSVTRFARAQREIGLAAGEPPTRRGFPPSVFANLPKLMERVGMNDRGSITALYTVLVEGDDMNEPVADETRSILDGHIVLSRKLAAANHYPAIDILASKSRVMGAVTTPEHRAMAGRLNAWLAAYADVELLVKVGEYKRGNDPDSDLAIAKYKPINAFLQQRTDEFDSFETTLQKLRALTR

SEQ ID NO: 3556 - protein, 274 aa, Methylobacterium sp.
MPVRRTHHRPSLIGLALGLGLLLAGCQAELYSNLSEIEANQMLAVLMSNGIPAQKVGKGKDGFTVSVDERDMLRSIALLSDRGFPKSTRESIGKVFQKSGIMSSPFEERVRYIYALGEEVAQTLSQVDGVVTARVHIVLPDTPQLGQAVKPSSAAVFIKYQPGVDLDFFVPQIRRLVSSSIEGLDYAAVTVVLSEAAPTRAAITVPQSATVEVLPGLSVRDTDTARFWQIFYGGLGLIGLLLAGLGAGAVVWLRKRAGPRRGSEALPVPLVEPS

SEQ ID NO: 3557 - protein, 708 aa, Methylobacterium sp.
MMKFLNALSKRNDLLLAFLLICIVFMMILPLPTAIIDVLIALNLCLAAILLMAAVYLTDVVQLSSFPSILLLTTLFRLALAISTTRLILIQADAGHIVETFGRFVVGGNLVVGLVVFLILTIVNFMVITKGSERVAEVSARFSLDSMPGKQMSIDSDMRAGMIELDEAKRRRNKLEKESQLYGAMDGAMKFVKGDAIAGLIIIAVNMIGGIAIGTMQRGMPLGEALDRYSLLTIGDGLVSQIPALFVSITAGFIVTRVASEDNADLGSDISSQLVAEPKALMITAVILTVFAFVPGFPTTVFLILAALTGGGGWLIVRRRGRGAAETRSLEMPALAPALAPPGKAPSLPGGEADSAPVEAVSFALTVPLIVDIAASVRNAIRPDKLDREVARVRRALYFDLGVPFPGIHLRLNENLKEGEYRILVNEIPVAVGAARPGYVIVRETEANLRMFDIPFERGEDFLPHTPSYWVSTKHLPVLERAGIQVMTLSTMLTFHLAHVLKGHAAEFIGVQETMYLMNQMQKNFAELVREVTRLLPTITITDVLQRLVGEEISIRDMRTVLEALVTWGQREKDPIVLAEHVRSALSRYITHKFSGGQGIIPAYLISKEIEDTVRGAIRQTSGASYLALSPDVHRQLIGAMRAAVGAPAQSAVPPVILVPMDIRRFMRKIVERDFPNLAVLSYQELTASANVQPLERVKLTAQLNNAA

SEQ ID NO: 3558 - protein, 87 aa, Methylobacterium sp.
MHDNRALSRFELTEQGLTAYADYRRGPQGLVIAHVYAPPPLRGTGAADRLMRAVAEQARAEGVRIVPLCGYAGAWLRRSPAHRDLIA

SEQ ID NO: 3559 - protein, 319 aa, Methylobacterium sp.
VKTVFSTGHVHPRDRFDFWHDVARKDVADHTSTPKCRNTFQAELRAGSVGSIGLVLFQNSDMSVTHARCHIDLTNTDELFVCRQFGGRLALDQDGRQVVLEPGHITLLDPRLPYQGRFSEDSQVLVLKIPRQHLEARLGQTRELTARAIEPSTTENSLLSQSLAMLPAHTQDLGSTAGILLETHLLDLITLSVGLAMGGEKARTTSARSLVRVRLRAAVEARMADRNLDAATVARAAGVSVRYANEVLAEDSTSIVQLIQAKRLARCRQALEDPSQMGRSVSEIAYGWGFADMTHFGRRFKAAYGVLPSEHRRRARHDS

SEQ ID NO: 3560 - protein, 317 aa, Methylobacterium sp.
MASTSQTATAPRPPCPITGEPARRLVQWVGSRFLTDLWRYAGGVDVGHLLRPAGRFGLWESPTGLIFFDPMVPGDEAFYRAFYARIGAHEKLAGPRTQRLEFVAAARHVPDGARVLDVGCGHGGFRAYVPGARYTGLDPNFAAEDPTGAILAESVQAHAARVGPVYDVACAFQVIEHVADPLGFARALAACLRPGGTLLIGTPLWPSPNTTIPNFIMNAPPHHLTWWTPGALEALARRLGCAPVGVEPIGMDRHDALIHWMARTTPVRCRGPYFRPHWSWYGAQALSYGAALVLDRLLPLPARTRPNTLLLAARKPG

SEQ ID NO: 3561 - protein, 290 aa, Methylobacterium sp.
MTTRALKSAALPEAERFAAIRRGPGPIARAVDTTLGRGLIQAAAVAVFFTAWEIAVDAGWLTEFLVGAPSGIWRVFRASLMDGSLAVDTWYTLIEAILGFVIGTLLGSLAGLGLWYSVLVARVVEPFIVAINSVPKIALAPIVILWFGTGFVSKVALAVSLTALVALIAAYQAARDADPDLQALMASMGATKNRIFRSVIVPSTLPAIIGMFRINVGFALVGAVVGEFISSQRGLGHLIYTASSLYDLNTVWVGLFVLMFVGFVLYHVIDLVERRILPWRQVSTGGGIQV

SEQ ID NO: 3562 - protein, 281 aa, Methylobacterium sp.
MDPMPTPDSPADPKAAPVQLALRGIRKSFPAKSGPVPVLDGLSFDIHERDFVSIIGPSGCGKTTVFNVIAGLLEPDVGTMLFRGRPVPGLRGRVGYMMQKDLLFPWRTVLQNVTLGLEMKGTDPREAADTARRYLAQFGLGGFENAYPKTLSGGMRQRAALIRTLILDPDILLLDEPFSALDYQTRLYLEGVLLDAVELFGKTVVLVTHDIDEAVALSKRVVVLGGRPSRVKNVHTIALGDRSPIGARSDPRFSDHFHTLCGELDIQTRAGSASTARAEAA

SEQ ID NO: 3563 - protein, 320 aa, Methylobacterium sp.
MKPLRSTLLAALLACTSPLPALAADLKATVSQAFQSMLYLPLYVAMDEGLFEKAGIDVTKETAGAPSVALSAVISKSAQFSIHGPEWTAVAASKGAPVNVVANVVNGAAVWIATAPDFPWTDVKSLKGQTIVTGLMPTTSTSLFLKLLKENGMSKDDVTLTQVALGTEPGPFLAGQARVAVMYEPGLDQVVAKGMKVVLGFPEKYGPYAFSAVSARKDVDPAVAQAFVNGMQAAIRLMHAEPAKAVAVAKKQFPTLDPAVVEAAVKRMMTEKVYPDSVDITKEAMALGLDTQIALGNLAAQPDYATFVRRDFITKATAGN

SEQ ID NO: 3564 - protein, 50 aa, Methylobacterium sp.
LDAQHALSIGNTKFHELVKEGKLKLVKIGSASYVPDESLRAYVASLMEAA

SEQ ID NO: 3565 - protein, 473 aa, Methylobacterium sp.
MRPGLRVPASSREAEPFIGIPGGTLPSGTLEGDLVASLMHRHEIAAERLIGWLRVAIGACVFVTVIVTGAALRHQTGVPFDVFERNAWIASLGFVAIGAISIVLAVPQRWCHVFAYLFMALDVGLVLAIACLAVGERALPGNALPSAPIVWAVPLVLAVGALRYDVKVQLSAIALLALGLVGIAVGLEHRLVMDAAGRNAPIWPQLFSMPVNVMRFTLLLLAGAATALGIVRSRRLLASAVKDAVGRASLSRFLPAEIAPRLAAGDLDLRRGRRQRAVIVFVDIRDSTGMAEGMDPERLSQFFTAFRTRILTCVRRHSGVVDKFIGDGALILFGVPDEGSDDAARALLFARDLAGRVETWNTTHELPHPVRIGIGIHVGEVFCGIIGDEERLEFTVLGDAVNVASRLEQATKRYGEVVLASGAVVEGSFERHAWLEIGREPLAGRKEAITIFAPARAPTRQMASFGDLSAEPG

SEQ ID NO: 3566 - protein, 304 aa, Methylobacterium sp.
METAPDDPRRPENRLAYRAAVDRPRLTLPGGRRVAMWPVVNVEHWLIDNPMPRQILVPPTAAGLLPDLPNWAWHEYGMRVGFWRLLGAFAARGLRPTLSINGSVCTAYPRVAAAARDAGWEFMAHGFHQVPAHRVADETEMIARSVGTIADFVGAAPRGWLGPGLTETLDTPDHLRAAGLEYVGDFVVDDRPCRIATRTGPLVALPYSVELNDIPLLAIQHHRADEFVERALANLDRLSAEAAGEGPLGGAKVMGFAIHPYITGVPHRIGLLERLLDALLARSDVAFMQGSEILDWYLGTGDDA

SEQ ID NO: 3567 - protein, 186 aa, Methylobacterium sp.
MPSHAEINFAYAHWAERLVHEGWTPYLLTFMFENLRGPSHEVARQMEREVERVYATLLPRIVRNPTRPAMTGRLPVWFCASDRPVFKRAKQSLRDVMINDGRHVHAVAFLPPWSRLLEDLAAHVEAYRALYLRPEFPLVRLDVVPITQRAGYGVEYARKYTGRSLIGEDAGFVLPRALSEVRDQAA

SEQ ID NO: 3568 - protein, 202 aa, Methylobacterium sp.
MARIRTIKPEFPQSETIGALSRDARLLFVQLWTIVDDAGRARASSRVLASVLYPFDDDAMHLIEGWLQELEDQGCIRRYTVEGKPYLDVPKWLEHQKIDRPSKSKLPEFVEASRGIASNREGSMLEYRSKTMDHGTRTVDQGPRTREQNLAAGSEYGGGSHAYAPAREARDPTGDDAFGDPDPAAWDDPGQFGRDRSTGGSR

SEQ ID NO: 3569 - protein, 33 aa, Methylobacterium sp.
TNPGKIPLELIEVQVGSYTGEDDIIRVEDIYGR

SEQ ID NO: 3570 - protein, 33 aa, Methylobacterium sp.; identical to SEQ ID NO: 3569

SEQ ID NO: 3571 - protein, 136 aa, Methylobacterium sp.
LIVVDASVVVKWFVAEKDSSAALAIFHRGDALLAPSHAIGEIGEVLLRAYRRGVVSLDDVQRANDVVATRLVLRSPSGLVDRAIGIAVDAAVSFYDALYVAAADLWALELVTADAKLVERLRPTRWGPRVTLLGTD

SEQ ID NO: 3572 - protein, 338 aa, Methylobacterium sp.
MPTTPKPRAIGLATAFLLIHAGAASAVELPEAVRAWFATDRSIVCVDPDGNDRRCAIDADTHLELRRSPDASTALAFVTYLPDPTGNSTVTTAATFRAGETGWRHVRTLSEVRGPLAGKVTFGDRTATFAVAVPRRGDSHCCPTGRKAYRVALPRETPAVVGGKTDASPSRQAALDPARVIAEQMRLEKRGDMTGLFSKSLKAAYDAVPKDEPNVGLTILGGGYDVPRKVLGTSAPQYDVADPKRASVTATLHYTNEDAPEPSFDRSIVVVFIAEDGRWRIDDVHLIDPKGRRTGREVGMKRAFGRLTEERARTMVERHAPAPRAGRNEMPDNRRSVP

SEQ ID NO: 3573 - protein, 119 aa, Methylobacterium sp.
MTTAHQIASGFDRAGLSLAGVAAGCLADARARQVAVDEEQAYRNLSAAQRTVRAAVRQRAELQAAVDENAALRAEVARLQRALAASQSQTATAQAETGRMRQRALHAEGVLLRQARTMA

SEQ ID NO: 3574 - protein, 154 aa, Methylobacterium sp.
MATMDTTLDIRGRLSAIRAGWYAGAPAVSPHGRRMYSGGLVYHMTAHQEMRQPPPSHEAGQAYLRALLRDWRTAHAPLAEWDAANGGALRRCLVAAGVALRDQTDDGRERADFLVRQACLCLSTTTLAKLDAKIAKLAKVPVGPWRIGGGLAKV

SEQ ID NO: 3575 - protein, 126 aa, Methylobacterium sp.
MPPRVAARPRPEEWTDDELLTLPEAAALFWPDGPITTNTLRTAGRDGTLAITKVAGKFFTTPMAIRRMGHDETGEPLGREAAVPEASSPRTLFEARLEEARRQGRDRKRRQRAAKRSVAPQEGAGR

SEQ ID NO: 3576 - protein, 143 aa, Methylobacterium sp.
MGSRTGSRVTETPPAPAAEAQAHFSRRLALETDCDDVHAALEGGAPDFVLLDARGPAAFARGHVPGALNLPHREITPERMAAWAPGTLFVVYCAGPHCNGADKAALRLARCGRPVKLMIGGVTGWLHEGFALAEGLALASGLA

SEQ ID NO: 3577 - protein, 196 aa, Methylobacterium sp.
LFANRFTALIDACTLAGTLKRNLILSLAEAEFFRLRWSGTILDETQRAIAGILAAKGEAAAADHAARARGVMEAAFEEAMIVGFEPFFPMCPALPDPDDAHVVAAALKTRAEIIVTENLKDFPADLLEPLGLDVRSSDDFIADAIALDPGKAVAAIRRMRERLKRPAKTPDVLLRDMEAAGLTETVNVLRPYIDSL

SEQ ID NO: 3578 - protein, 161 aa, Methylobacterium sp.
LSVARRRFALMTMPASAIGIGGRLPSAQEREAANQLRQILAAQAAGEAKLSVLEGGKKPTEITLTPGLSDLLMELLRHVGSGDAVTLVPVNQMLTTQQAADILNVSRPFFVGLLERGEIAHTLVGRHRRIRAEDLFAYKNARAAKRSEALSALAELDAEAF

SEQ ID NO: 3579 - protein, 376 aa, Methylobacterium sp.
MDHTRHIPDPTSDRDRPLDPATVASLLACMRDGLVRRRFRLRLVGAQAPEDVSEITDRRDVAIADVGRPLQDDTAPARSEEARRCAARENLNARMRPILLALAQNAALDPAVWRARIDAPMPLTDPEIVRALSEVFASDAFRDARAACRDLTLLPPEQRAFAEAPFDLGFHRSPPAKILADYPCWDLPFSPAARAPERWTISDAADWMREWPPESGELKHPIDAWDASTADLWLRRHKLFDGQEADKTDPLVAFREGRSRKSPLTVLAGLDDDALLVLTDAVLCERLRREVMSGLMQDRADLIHVGMDMVACGYLSLDDVRAAVAAHDEAREETFRDAFADNDDWMGEWIVDWSRRLIGLYDWPLRYEFRAVSKGE

SEQ ID NO: 3580 - protein, 146 aa, Methylobacterium sp.
MSDQAFALFVLALVPLGWAFYLLPAIVAFRRQHPNRWLILAVNVMLGATGIGWAVALVWAFQAAHRAGEPGGSHGGESGLNLFVNDIRTVRVLHAADTPVVAPASGATLGTPAQRIERLNQLRAAGHVTEAEFTTLKAAVIHHPNI

SEQ ID NO: 3581 - protein, 381 aa, Methylobacterium sp.
MDVGFISEFTENDRVFRFTDGETLRSPIAVGGSDPLRQSFCHYVAAGLMPGLLHDAREDPVARGLPATDALPVGAHLSVPLRYADGTAYGTLCCFSFTPDRTLTGRDLNVLRLCADVVSAVLQKDRRASLDLEARRARIAGILEARAIDIVYQPVYRTSDGRLMSFEALSRFRAAPERAPDVWFAEAAEVGLLEELEFLAVGLALRGLERLDPSIKITLNLSPSSVLSPAFARAFAGVPLGRIVVELTEHAEVPCYAALRAALAPLRAGGLRLAIDDVGAGHATFRHVLDLSPELIKLDRSLIAGIDRDSARRALADALTIYGRRIGAEVVAEGVETWAEYAVLKEIGVTRLQGYLLGRPQPLDAARTLPLTLAALGEAGG

SEQ ID NO: 3582 - protein, 319 aa, Methylobacterium sp.
PLPPPDPPALVRAAAAPCDAATRARILAPAAPGAESVALTCSLRLGPETHVTKRIVLEGAAASGITLDCAGATLGQAEPPPAPDAFALAIRSRPLPGGGFERPSGITVRDCRILGHVRIWGMGVNGQGAAVRDSSRAPGHTERAQAAAPTEVAILGTTITALGHIPLYLGPGVTRVTLQGSRLDGRSRSTALYLDAESAENRIVDNDIATETGRELVAVDGSARNRITGNRFALRGQGGVRLYRNCGEGGTVRHQTPSDNAVTGNVFQGRGLFGSAPIVVNSRGGWRLYCGEDRGYPFGSSADDGDNGTGNVVEPNRVE

SEQ ID NO: 3583 - protein, 309 aa, Methylobacterium sp.
MSVSVIMSTFNRERYIAAAVESVLEQSHRAFELIVVDDASTDGTPDILARLAARDDRLRVVCNAANQGLPAGRNLCLSLARHDLVACMDDDDLMLTDRLARQVAFLRDHPEVSVVTAAARLIDDADNVIGLSVPEIDIARGRAEVRPALFLGLIHPAVMYRKGDVLRVGGYRQVALEDRDLWGRMVTAGYTVAAQPDVLLLHRRHASIMQGDLDALFEQGEYIDFNVARRLRGLEDVTLAGYRRAVAAEPLLQRISRRRRMSAGIAFRKATLFYSRREWRPFLMHMAAAMSLEPIQVCQRIAKKYSPGR

SEQ ID NO: 3584 - protein, 76 aa, Methylobacterium sp.
MPHIVVKLYAGKSEAQKAEIAEALTQALMASAGCSEKAVSVAIEDVAPGDWAERVYRPEIAARVDSLYRKPGYDPL

SEQ ID NO: 3585 - protein, 424 aa, Methylobacterium sp.
MVPSSLSARQRLLVALGVLVSLLAWLSVRPWDLRGWTIGAPFGRDFVNFWMAPRLFLAGEGAVVADIAAYRDAVMAAFALPRDPRLLFVYPPHALLFLTPFAAVPFLPGLLAWTALNLAALAAATRLWLGPAARPGLVLVVCTAPPVGAMVLCGHFGGLIALAGTLAVLESRRRPWIAGLCLAALSIKPQLALALGLILIAAGRWRWMPAALLGTATLAALSAALFGVEAWARFVGTTMPTHSAFITTFQAGWIAHAVTPYFGARFLGMPAALAWAIQGAVTALAFAAAVLVLRRADPDRGPDHTPPLDPAALLVVLLAPVVMQPYASHYELAAVAPGLTLVALGRPAAPLAAAVWLLIPLALVLITLDQPILCALVPGALFATAWRLLAPGSAPSGASARPPAAPGTALVNPSGGYSGAFGRT

SEQ ID NO: 3586 - protein, 3079 aa, Methylobacterium sp.
MARQTFDDSIGASGNPLTIGGYVYALRTNAGATTGTLNVQRELLGDAVLDLNATSGYLSIAQASGTAFNLNSLVIDRDISVLGNTFFVGYRNGLPVISQEVGNLLSIGDQAISFGTQWQNLTEVRLFARDVLDVNVGVGFAIDDVVTTDVTAPLAPTLSAGTTATADNTPTLTGTAEIGATVTIFNGTTALGTTTAGANGAYSFTPTLPLADGSYSLTARATDLSGNVGLASAAVALRIDATAPGAPVFTAGGGLTNDTTPTVTGRAEAGSAVTIYNGTVALGTTTAAADGTFSSTPTAALGQGSYGLTATARDALGNVSPASAALAVTIDAVAPGAPTAAVPGLTNDATPIVTGTAEAGSTVTLFNGTTALGTAVAAADGTYSVTPSADLAAGTYSLSVTATDPAGNVSARSAAATTVIDLTAPLAPTLSAGSAATADSTPTLTGTAEAGATVTIFNGAAVLGTATAGANGAYSFTPTLPLADGSYSLTAVARDAAGNLGTASAPVALAIDTAAPAVPLFTAGGGLTGDPTPTLTGTAEPGATVTILNGTAVLGTALAGADGTFSFTPTDALSQGSYTLTAIARDALGNASPASANLALTVDLTAPGAPVLAPLGATNDPTPTITGTAEAGATVTILDGTAILGTAVAGANGAFSFTPDADLTPGTLNLTATARDPAGNVSVPSAALALTLDLTAPGAPVLAPLGPTNDPTPTISGTAEAGATVTILNGTAILGTAVAGMDGAFSVTPDAALTAGTLNLTATARDPAGNVSLPSAALALTIDTQAPAAPVLAALGPTNDLTPTITGTAEPGATVTILNGATVLGTAIAGLDGAFSFTAPALPAGTATLTATALDAAGNISDPSTLTFTIDTTAPDVPVITTLPGTVADSTPTIAGTAEAGAVVTLLNGTAVLGSAVADANGAFAITPAVPLPDGPLALTATARDAAGNLSPASLGLALTIDTSVPGAPDLAYDSPTNDARPVISGTAEAGATITIAAGGTTFGTGTADANGTFSVPLDRPLSEGNNALTVTATSPGGITSPAAPLNVLLDTLAPPAPEITGVPSLTNDPAPTIFGTAEAGTTVTILNGIAVLGTATADANGAFAFTPTAPLADGTATLTARAGDAAGNLSPASEPVSIRVDTAAPPTPEIDPLPVLTNDATPTVTGRAEAGSTVTLLSDGAIVGTAVADGGGLYAITPTIALADGTASLTVSARDAAGNVSGSTDPVTVVIDTLAPAAPTLADLPDAVASATPVIAGTADPNAVVTIANGGTLLGMTTAGADGTFIFTPTSPLPDGTATLTATVQDAAGNVSPASDAVTVVIDTTAPAAPVITTQPGTTTDNTPVIAGTAEPGTSVTVLDDGALLGTVTADGSGNWSLIPGAALGDGPNLITATAADTVGNISPLAAGITLTVDTGAPAAPALTSAGGALADNTPLITGTAEPGATVAIRDGDTVIGTVVADVDGAFAFTPDAPLGDGSYSLTATATDAAGLTSTPSQPLELTIDTAAPGIPTVTGGGGATQSTTPVITGTGEAGTTVTLLDGTTPVGTATVGTDGTFTVSPANPLAEGVYDLAVQLTDAAGNVGAPSAPVAVVVDTQIDAPPAIAFTVAATADGTINAAEAVATAFTVAGLDAGTVATATFSDGSRTVTVPVGADGSYAANLTGLNGTVTTSLQLADAAGNALTLTGPALSLDTLAPTGTAVADTAGGPEVASFTYQVSFPETVANVGADDFVLTGSGGATGTVTNVSGSGSSYTVTVAGITGSGALTLALSPDSDIADLAGNLATLAPAVRDVTGVPPVQPVITGYADDTGVPSDGITADATPTLTGIGTPGATVTLAAATGTGTVTATGTVSADGTWSVALPTLADGAYSITASLVGADGSPIGTSAPLALTIDATVDTGAAAALAIDATADGVINGQEASAVAFTVTGLDAGTSGTVTFADGVRTASVAVGADGAYSVDLTGFNGSVTSTLALGDAAGNTATVQGDTLSLVTGQPGTPVIAGFADDTGTPGDALTSDATPTLSGAADPGTTIRLTVGTPDGPVSVETQAGADGAWSATLPALSDGAYAATAVALDAAGNASTVSLPFPISIDATAPAGTAAADLSGGIAAQSFTVALDFPEAVVNVSPEDFVLSGTNGASGTVTEVVGTGGSYTVTVANVTGTGTLTLGLAADADITDAAGNLANLAAASRPVAVSPSAAPPTITGFSDDSGTVGDGITNDAAPTLTGTGIPGGTVTVRYDGAPGSAPLTGDVDAQGNWTLSVPTLADGTYVFSVTTTSADGTIASATADALRLTIDTVADALPAVALTVDGTADGVLTPSEAAAAQFTLSGLDAGSAAVVNFTDGTRTVTAQAAADGAYTADLSGLSGSVTSTVAVTDAAGNTASAAGNAVLVGTGTPGGGTGGDGGGNGGGVTPPGGGVGEGSTPPAIPVIGGIQDDTGTPGDGITGDSTPTVVGTGTPGSTVTVSYTDASGPQTATGTVGQDGTWQVGLPALADGSYSLVATAGTVAGTGSAPSQPLQITIDTSAPAAPVLDGVSGTDGSGPIGDASPTLTGTAEAGSTVEVRFDTPAGPAFVNGVTGPDGRWTVDLPTLADGTYTVTLDAVDAAGNRGTASAPVAIVVDTTPGGGTGGDPGDGTGGGVVTPPVGGIGEGDGTPPGSAPALTADADRTLTHAPAISGNLLLNDTGSGLHVTAVRFADGLTVQVPDEGTARVIGDYGTLTVAADGSYSYQAIGANNLPIGFGSREHFTYTATDAAGRTGETSLDIQLEGQAPQASASFDFAFTQAKVGLAGEALVLLGPDGIVRDISGIDTLHFTDGEIQNNDGNRVVDDVYYYARNLDVWQAHVDADLHYAVFGWHEGRDPNAYFQTSRYLAENPDVAAAGVNPLEHYLTSGEHEGRSPSPDFSAEAYLRSNPDVAEQGASALAHYFEFGRAEGRSVLAGESDGPNRAIGSFDAGFYLAQNPDVAATVPAGVTPESYALQHYLNYGAAELRDPNALFDTAYYLAQNPDVAAAGANPLLHYQETGWHEGRNPSAAFDTDAYLARYPDVAQASIDPLAHYIQYGLHEGRLATA

SEQ ID NO: 3587 - protein, 305 aa, Methylobacterium sp.
VRKIMPLNWDHLQVFLAVARNGQMLEASRRLGLNHATVARRIEALEAALRTTLFHRRPTGSALTDAGEQLVPTAERIEAEILTATARMRATEAEPSGTVRIGVPDGLGNLFLARELGQFATRYANLMIELVPLPRSFSLSRREADLAIALDQPTHGRLMLSKLTDYSLGLYAERAYLDRAGPLVGEHDLVHHTAVMGVDDYAYASALDYTAFLQGRTRGVFRCAGTVGQLEAVRAGAGVGILHDFAASGCPELVRVLPAIVFRRTYWLLSHPDSHEVRRIAACRDFIVQRVREERKRFLPRDDES

SEQ ID NO: 3588 - protein, 38 aa, Methylobacterium sp.
LAPPSGNPILSPERRLDDQDQSIRPLSLSEFVGQRAAR

SEQ ID NO: 3589 - protein, 70 aa, Methylobacterium sp.
MRAETAAGYCDEPSVEAFLAKVERGIYSRPRRQQGCMPKWHRAKLDQDIARRHGLAIEGMLVAEDVSELI

SEQ ID NO: 3590 - protein, 412 aa, Methylobacterium sp.
MSIPSAKGGTDTSADRLPLPPARPHLIRDDAEALAVAHDVAAVFAAGAGERDRERRLPWDEIEAFTASGLGGITVPRSHGGADVSHATLAEIFAILSAADASAGQIPQNQFGVLALVRAAARPDQQARIYADVLAGHRIGNAGPARNGRAITQVETRLAPGPEGLRLSGSRFYSTGALFAHWIPTRAVDPAGRPVLVWVRRDAPGLRVVDDRQGFGQRTTASGTVVFEDAPIEERLTLDLAPLAERPGLSGPVSQLVQAAIDAGIARSAVAAALDVLRTRARPYPYTAESVAEDPHILGEVGRLAVDLHAAEEVLARAGRALDRIAAAPVTAESSAEASVAVAKILTTEIALEASERMLELAGSSATREGYNLGRFWRDARVHTLHDPVRWKYHLVGNYALNGALPARHQWN

SEQ ID NO: 3591 - protein, 307 aa, Methylobacterium sp.
MPSEAELTDLVLGAHGFLGRRLVRRLEADGRRVIAIGRDAGDLTVPEVARAALGRAPVARIFHFATRQRTGPSQYDIQAELLAVNARMHLNVLEAWRQLQPQAKLITPGSSCIYPESRAPLTEASFGLGPLHPSVAGYALAKQVLATGCAAYARQYGLRYLHCVLATTYGPGDHTEADRSHFVGALLHRAAGEKRRGATRFTVWGDPATVREVLHADDQIDAILRADAQFTDTILNCAADTPVTVGAVAEAVLRALDWQVPIERPAESFQGTPYKMLDSGRFLAATGWRPRISLDDGLRQLVREAYA

SEQ ID NO: 3592 - protein, 320 aa, Methylobacterium sp.
MTGLPDARALPEAVVLFGASGFVGRNLAARLAGRVGRLVAVNASGTPVPGADTTLPIAALGAVPALPRDTVAIHVAAPRYDAARFATAQADLLAGNVDLANRIYGFCAERGIAEVRMASSVAVYPAGRDLLDDAVPVDLHAPPHPGEAFYAWSKRWAEIAAGLFRERYGINTIAFRLSNPYGPHDALEEAVAHVLPAFVIRALRPGEVFTIRGDPRVERDFIHVDDVVTVFERSLHRRGESLTVNLCSGTTTSLQTLAETVLRLAGVARPIAAAGQTGSAVLARRSTNALVRQAFGDLRFTSLEDGLSPTIDWYRHALGG

SEQ ID NO: 3593 - protein, 310 aa, Methylobacterium sp.
MRILVTGGAGYIGSILVPILLARGDSVTVLDTFRAGGTELAAACAYEGFRPVRGDARDHRLLDELVPQHDVLIPLAALVGAPLCREDAVGATTLNRDAVRDLVARAGGDQIIVYPTTNSGYGIGESGKFCTEETPLRPISLYGVTKCEAEDAVLASGRGVTLRLATVFGMAPRMRLDLLVNDFTHRAVNDGALVVFEGHFKRNYIHIRDVAKGFLHAIDQFAAMRGQAYNLGLSSANLSKLELCQRIKAHVPRFVYIEAPIGEDPDKRDYIVSNAKLEATGWAPDIDLDSGIRELVRGYTMLRNARFANV

SEQ ID NO: 3594 - protein, 44 aa, Methylobacterium sp.
MAGTTMPFVEGAAALVLGTGFFGFFVSRLPRFFSVAMVSLLGMS

SEQ ID NO: 3595 - protein, 65 aa, Methylobacterium sp.
MCPVMQKMITLIVHMSQFPGLLERGQLIDQLTDLEAEGIAQDAPWRTVEAIRAARLKLRVEGLMA

SEQ ID NO: 3596 - protein, 120 aa, Methylobacterium sp.
MHDNGMSGTMRGWFAALVLLGCGALPASAAEPTVRIVGTELRAPPDSHEPQRALVSLHNAGVPAAGLTLACTFQDEGGRPLDTVEAPVRDMAEGASAVTEVIYYGWPRASRAACRLTGRR

SEQ ID NO: 3597 - protein, 409 aa, Methylobacterium sp.
MEPDPAVCIVGGGPAGMMAGLLLARAGLAVTVLEKHADFLRDFRGDTIHPSTLDLMDELGLGEAFRALPHRRVETLAGVIGGRAFRIADFRHLPARNRFIALMPQWDFLDFLARAGARYPGFRLLMRTEATALVVDGSRVTGVRARGPEGERAIRADLVLCADGRHSAMRAEAGLEPVVFGAPMDVLWFSLSRRPDEDAVTAGHFGRGRILVTLDRGTHWQCAYVVPKGGDAAIRAGGLPAFRAAIGELVPFLADRTGEIVSWDAVKVLTVAVDRLERWYRPGLLCIGDAAHAMSPLGGVGINLAIQDAVAAANLLAGPLGAGTLTAFDLARVQARRTRPVRLTQGLQRLIQDRVIARVLDASGALTPPLALRLLDAVPALQRLPARIVGLGFRPEHVAVPERAQAAAP

SEQ ID NO: 3598 - protein, 79 aa, Methylobacterium sp.
MTVQPTDTLPALQASLDGLGTGQALRLTNADCDRLFGVDDALLGRVRNVALGHGCIVVWDDEGLSFCRQPHATGCKPLG

SEQ ID NO: 3599 - protein, 227 aa, Methylobacterium sp.
MIVHVRNVLTPEEVALCRARLEAGAWVDGRVTAGAQAARAKNNLQIPEDAPVARELGDLILRALGRSPQFNAAALPLRVLPPLFNRYDVGMGFGAHVDGAIRMVPGAGIRMRADVSTTLFLTDPADYDGGELVIEDTYGAHAVKLPAGDMIVYPATSLHRVEPITRGSRWSAFFWSQSMVKNDGDRALLYDLDRGITGVRAGLSDDDPAVIALTASYHNLLRRWAEL

SEQ ID NO: 3600 - protein, 755 aa, Methylobacterium sp.
LLRDAGGAGALGLSLVTGLGSFLPMGAVAQDLGADAGPGMAVTLGELSVAGWGGYQPNTLNADTGLSRLPGRVQDTPQAITVVPGEVIRQQQATTLEQALRNVPGITVSAGEGNGGLNGDQFRIRGFQAKNDVYLDGLRDFGVYARDAFNIGDVVVIKGPSSETLGLGTVGGAVNIVSKKALLTDFTAVDGLGGSGPTARGSFDVNRRIDDTTAIRITGVVHQQDIQDRRGVKSDRAGVAVSLGFGLGTDTTWHLNYLYQHSERTPDYGVPTALRPGDRYARPLTEYGLDRATTYARATDRDIADVHLATSLMKWTVTPWLTVTNDTRLSFYDRSFSTTAATCTNAAGPPVATCARDFFAGGNPFVTYSAGGGQTFDQDAWGAQNVTTALAKFHTGFLRHEVVTGFDLFYQNDDRLNYAVIGTRANQRVRNPDQSAAGYALVKNPLNRRVGDGANLGYFFSDRVWLTEQFSLLGGVRVDRFVSTYSATNTANGLFSPTVTAASTGVSPKASAIWQPTPEQTYYVTYARGFSPQGQYVVNSTGIEIPNAAALKPEESDLYEIGGKIGFLDGRLGVAAALFRVDKSNSFDVDPVTGGLILGALDAGEKRRVEGFEITATGQITENWSLLAGYTHLDGTVRSGANRGRAAPYVPENAFTLWTTYDLSPVMRPLWGLPGRITVGGGVTLDDGYFPASDNITRIPGTFSLDALVSYETDTYRLAVNAYNLTDELNYSAAFSTRAVPTSGRTVLVSAGLRF

SEQ ID NO: 3601 - protein, 83 aa, Methylobacterium sp.
MSAHQIASAIEEEATAFCRSRFTNTEAYLEAKDAHCRRVSALVGQLRRAIGTTERLTLRTGRRQSGRHTFDVVARARTVAAEA

SEQ ID NO: 3602 - protein, 330 aa, Methylobacterium sp.
MDDVLSFVDAIIRRVSAGNLLAAGLLLATALLCALIAYLRTAERYSLREFFEFAIPHEVIVHPSARADVMFWITRRVLMPFLMLPAGITFVVAVGYATSTGLGALLGIDQPVLGEPGPVTVVVFTLTMLLAYDLSYYLYHTAQHRFPFLWELHKVHHSAEVMIGITKDRVHPLDELMNRAWDGVIPGICFGIWTLLSLDPVEVTIFGVNVYVMRNILMMDFVRHTHFKISFGALNTVILCPHWHQLHHSTDPRHYDKNFGLLFSFWDRLFGTLCVPKPDEDFKFGIMDRDAAAYQSLSGLYILPLRKMGRHIARRVRRLRGLPDRPRQSA

SEQ ID NO: 3603 - protein, 60 aa, Methylobacterium sp.
MKNPALSIWLSAANRAAGWWIGTATSVARRQQQLALAEMTKAATGRKPARKRRTKPKRRT

SEQ ID NO: 3604 - protein, 258 aa, Methylobacterium sp.
MREQETGPTMSAPFKDHFSSAAPGYAAHRPTYPAALAEALAELAPGRGLALDCGCGNGQLARLLAAPFARVVATDASAAQIAEASPHPRIDFRVAPAEASGLPAASVDLITAAQAAHWFDLALFYAEARRIARPGAVLALISYGVLHLDGEAEAVLRHFYTQVVGPHWPPERAHVEAGYRTLPFPFAELRAPDLAIEVDWSLDDLVGYAGTWSALRGAEAALGTSPLPDFARDLAAVWGPPETRRRVRWPLAFRLARL

SEQ ID NO: 3605 - protein, 28 aa, Methylobacterium sp.
MSKFFEEEVLSVHHWTDTLFSFRTTRDP

SEQ ID NO: 3606 - protein, 173 aa, Methylobacterium sp.
VSAHLAEAVNACAYAHADGPLIYLRRRLAKALKAAFGQPIRLLASIEEDGEGGYVPGKSRVAHLHMKPGLDPAEKSTLAKARAAIRAACGEWTGPRRRRQIVMKPTRDAGWAGYFTKYCRLAAPRMVAFLKIHGAGPRWLPSHAGPVLTMDRETNRAAKVLHEKARQIVWEAP

SEQ ID NO: 3607 - protein, 1136 aa, Methylobacterium sp.
MTALFDPRPLVLGTLQNLSLVLERSTVLSGRPGVSGLTVGGSEARAFGGLEMPITRTGRSVPAKLRYGAITVTPRPQGSAFSGSPGVHPAIERAYDNPGVRFGDRVRGSERPTSSAGETSCHFSQTSVSKTSPIREMIKAARGGRRLTGSRAAAHVLYVERVGAPEQIQRKGEPRLSGEAFGAEIERRGLARSAAAQQAYIERAGAAEGMERKPGRRITDEALDALDEASFGTIGDTLEERTRFWLAVEEAEATPKGDRVTIKPAENSTWWARVAENLDQAPPAAQKPIRDALARADGEPFDVKLTTDKAFALHQWAVALDSEAPIEISPGRGGRTQTRVIAELPHEIDGRERLQIVRDFTQKLAEKGFPYWAVIHAPDANNDARNFHVHIAYYDRPAAKMQKPGGTGEVWDFEIQDHVIYKSKTGGAKRHLTRPYQQNRDRTTHDRAWILELRKHWETVSNRVLDEAGFSKRYNLGSYERMGIDLKPLKHINARTFNKERKGALTEEGPVLARRQWDTVHDRLVKEHEERARKRQVSITNMSDHAARMVAPFPYGAHRVAEVRRLKDMGIKASFQLALLELHQDLTRLVADRIVSRPKLMMQAADEEDRKALRQGASPDAAPQDRAVTGAELFGLKRRSEIATFLTTIYDGALHFDRDNERRSQAARNNVRLIVAELKAWMAEPGRSLHAARRYAPEAVQSLDDPARTERRETSRRALQEGFRKAVEGRSAEILRALKAEVSDRSAPRAAETALAAAPASSASQGRKPAATASPTGSNHATGPSDGRPKPRYTPGRPDSPAPKIGQTGFRPRPEHADLSRFLRRPTVGTGAPCPPEPVRETPRMRQASALPQAEPAFLQAGERSRHGSSTTTLPTNQETLGRSGQPSSGVPRPSHASIAAHEDGGGPPGLLGADPGTRLGTPGPIHVGAPVTVGEHIATSPGAAHAANERGEQAVESCVLKPANVRRDGHRTSPEELESSQRRDSHPARGEGPLATGRGQRRADSAIARTDGAGASSVPASVAIGTVARSEEERRQLGPAAEGPSVSASSGSAGPPVGRRRGPVNKEGRLELVAPNLAVSVDGDEAADRVPSAEPDAAAHKSDLTVASSAADTLRIVGAQRPRKKIRTRDRGWER

SEQ ID NO: 3608 - protein, 171 aa, Methylobacterium sp.
MRTERRPSEPAPTLFNSTIETGIRAVIVLEAMYPRACGLAEMTCFDHLVVHSADVDGPPSLHPDLQPRTGELVVRRGLVGEGLRLMCQMQLVDETHDEHGIRYQASDGVPSFLRPMRAPYTLALRERAKWLADELRDRTEAEIEALANALIARWTLGPRPSSAGQDSGDLR

SEQ ID NO: 3609 - protein, 333 aa, Methylobacterium sp.
MRQDYWRHLRTMGDRDLERFVNDWIARKMTRYAGHQRIGQAGDMGRDVVGYLTDKRMSGPWDNYQCKQLLKQLDLPSAARELGKIFWHAARGEFSLPSAYVFVAPAGVKRDLAVLIDDPDRFQAAMLTKWDTWCKAGIVANNPTLMTPEIRALIEGFDFKAVRVLDAETLVEDPDVVAVLVDWFGHDPGKAPRGVVPEQFQAEEAEFAAELLEVYGEREGKPFPDLNAVAAHPRHGAHFGRQRRWFFDAAAFRRFYRDNTPHRYLVDFDRDMHDGVIDVYERSYPDRLERVNGVMSHASLVKPSGILGIHSEVGVRQGTCHHFVNDGLLSWKE

SEQ ID NO: 3610 - protein, 149 aa, Methylobacterium sp.
MFFLKELPTQKMLQTYQDRFPDTDIRNIEDALRLLRRGSLLMRELEAYFAAHALSQTRFLVMMVIDREPERESLFPSEIADRLDVSRPVVTDTIRTLEKAGLLSIKSAQDGRTKQVLLTPHGRTVLANLLPGYFALITEFMTRGSRPVP

SEQ ID NO: 3611 - protein, 49 aa, Methylobacterium sp.
MNPLKAGLIVLICLILFWLGVRLARRAIDLGIAAGYEAERRRKDDEERP

SEQ ID NO: 3612 - protein, 481 aa, Methylobacterium sp.
MAQPHAPGGTLVPRPHQAEAARAILAARAAGRPGFLLGDMTGLGKTLSVWSALAAMPEAAVLVVCPKGAMPQWRRTIRDAGLAPKDVTLVNYERTKSLMAPPEAIRRRSTRARNNALAKHGSLKRAWPLVVFDESHRLRNPYAQQTMVCRQLADAAAFTVYMSATAGQAPHELGYLGRLLGHAVGSPTETLADFRALMQRLGIGRAKGRWVNWSWSANARDCAVMADLLYTGANAIGLRRRPADIAGWPEVQRDLAPTALKPDERRLYDATWREFRREFGLAGGSTRRPAGWAADLRFRQKASLLRVAGTADFAEILLEAGEQVALSVAFLETGAALAETLRGRGWRVDAIDGTRTGEANEAARLAFQTGDLDAIVFTVTESISLHRNELPGGERTRALVVHDMRHSAIQLAQIEGRCHRDGEAAVIHYAYAEDTVEEAIAATVLRRMAAMDAMAGEDTGLLDAIADCIARPDRTPDTVSG

SEQ ID NO: 3613 - protein, 387 aa, Methylobacterium sp.
MLRRVATAASIALAALCGGQARADEILVGAHMPLTGSLARSGQAYDEGMRVATQMFNASGGKHTIRLQVIDDESTPAKAVSAVEKLVSDGAVAVIGGYGSNIVGPASDAAEKLKTTYITAGAASDELNTRGLKTFFRINNNAGYQNGMVGLVTGLKPASISILASTKESTALLAKGLQKDLTAAGIKVTLHEFDPAITDFKPLINKVKLQDKSEILMMSAYENDYVGIIRAAKVLKPPVKLIVGAWALAVPKLYQEFPDLMNNVVGTSFLPFPVEIKDEEGKRFAEAYRKAYGKDVDYHATLSFVETTILAEAIAKAAEAGTLKSGGLPEIVRATDRETVLGRVQFDGTGYNPRFAVSMGQHQAGKIVLVSPAATATGQIVFPGLPW

SEQ ID NO: 3614 - protein, 387 aa, Methylobacterium sp.
MLRRAVAAASIALAALSGGQARADEILVGAHMPLTGSLARSGQAFDEGMRVAIQMFNARSEKHKIRLQVIDDESTPAKAVSAVEKLVSDRAVAVIGGYGSNIIGPASDASDKLKTTYITAGAVSDELTARGLKTFFRINNNAGYQRGMGTLLESLKPASVSILASTKEAPALLAKGLQKDLAAKGVKVTVHEFDPAITDFKPIINKVKLQDKSDILVMSAYENDYVGIIRAAKVLKPPVKLIVGAWSLATPKMYSEFPDLMNNVVGTSFLPFPVEMKDEEGKRFAEAYKKTYNKEVEYLSTLSFVETTILAEAIARAADAGTLKTGGLPDAMRQTQRETLLGPVQFDATGDNPRFSVAMGQHRAGRIVLVSPPASATGEIVFPGLPW

SEQ ID NO: 3615 - protein, 102 aa, Methylobacterium sp.
MELSEGELGRAVDGDEQVEPSFGRVDLPQIDVEVAERVGLEAGPLGLVAVDLWQSADAVALQATMQRRAGQVRDRRLERVEAAIEWQERVTAKGDNDRLVLR

SEQ ID NO: 3616 - protein, 233 aa, Methylobacterium sp.
MLITRDLGGGYGGRPILKGIDIEIREGDTVAVLGANTAGKTTLIRALTGLLPQVTGQVLLAGEDVTHLPAHQRVTRGIALVPEGRHVFPRMTVRDNLLVGAYRRRDLDLETDLEGCFVMFPRLKERLGQRAGTLSGGEQQMVALGRALMAKPRLLLLDEPSHGLAPLMVAEVHEAIERVTRTGIAVLLVEQNVASALRLVRHAYVIEAGAIALSGTADELAGNDEIRRTYLGI

SEQ ID NO: 3617 - protein, 201 aa, Methylobacterium sp.
MTAAALVLLLAAAQVPARATPSGSARDAPAMAAATTADIDPATGLRVRNYRAPVTMPVRGGTRIDLDAVDRLRTEGAALIDVMPQRGGFDPAGGAWRIVDRHATIPGAVWLPETGRGAIEPRLAAYLAAWLARLSGGDRGHPLIFFCMADCWMSWNAVRRAADLGYRRVYWFAEGTDGWSEADRPLVPAEPPAVPPLTAAP

SEQ ID NO: 3618 - protein, 69 aa, Methylobacterium sp.
MTAEPDNLVLVFLRRIDGKVDRLIDDVNDLKAGVSAVEENLAGVHRRIDRLELRVERIERRLDLADATH

SEQ ID NO: 3619 - protein, 327 aa, Methylobacterium sp.
MAVQTRLTQAFGIRHPIVLAPMDPASGGALAAAVSAAGGLGLVGGGYGNREILEAEFAKAGNQRVGCGFITWSMARDPVLLDLALAHKPAAMMLSFSDPAPFAEKVRAAGVPLICQVHNLEHARRALDAGASVLVAQGTDAGGHGMTTRGTITLVPSVVDLVARERPEVLVLAAGGIADGRGIAAALMLGADGALLGTRFWATQEALIHPAAKARVVAATGDETVRTSVYDIVRNRAWPPAYTGRLMRNRFIETWHGREDELRNLVGAERERVESADRSGDYDVSNVTVGEAIGLVRDLPAAGDLVARLAAETEARLATLPRALITA

SEQ ID NO: 3620 - protein, 338 aa, Methylobacterium sp.
MKKIGFLSFGHWSPGARSEARSAGDTLLQSIDLAIAAEELGADGAYFRVHHFARQLASPFPLLAAIGARTKRIEIGTGVIDMRYENPFYMVEDAGSADLISGGRLQLGISRGSPEQVIDGWRHFGYAPAEGGSDADLGRRHAEVFLDLLQGRGFAEPNPRPMFPNPPGLLRLEPHSEGLRERIWWGSASDATAVWAARQGMNLQSSTLKADETGEPFHVQQARQIRRYRQAWKEAGHTREPRVSVSRSIFALVSDRDRAYFGRGESGDQIGIIDSMRAVFGRSYAAEPERLVAELGTDEAIAEADTLLLTVPNQLGVAYNAHLIETILKQVAPALGWR

SEQ ID NO: 3621 - protein, 253 aa, Methylobacterium sp.
MNNRFTPLFDQISDLRSIAIEARAPANHLALLTEHPVAYESNDHKAPWGTKNDNTRSARFCRALEAHFRRPISAMDLGCSGGGLVFDFLVRGHLAIGLEGSDYSLKSQRAEWRVIDDYLYTCDITKPFDVVDKTSRATHAFDVITMWEVLEHIHEEHLPQLFANVKKHLVPDGLFVGSAALYDDVVNGVSYHPTVKPEMWWRETAQRNGLEFVPKTMFDFADFCRGTGNGPLDPNFAQDPGKGFHFVMRHRAA

SEQ ID NO: 3622 - protein, 468 aa, Methylobacterium sp.
MGYSVLKVFRDQLTGSESKRHGLREMLAFVGANKNAHYRIVFDHLDRFTRNFYDHADLRREIAKLGAILETPAGVLDERSSSRLMENVTVAFADYHRVNNREQTLNRMQARVSNGFAVFAAPTGYAYGRVPGFNGRMLVPKQPDASIVQEAFERYVSRQLESQADVVRFLEEHPLYPKPKNGRIPHQRVGDMLRNPIYAGYVEAPCWGVERRKGHHEPLISYETFQRAQDRLNGLRITYRTDLSQDFPLRGFVLCDDCEAPLTACWSISGSAQKKRHAYYQCFKKGCASYGKTIRRGVIEGEFKAMLKTAEPEPQLFDVVTAMMKDLWQRKQANVGSQTKALKASLVKVEEQIDQTVERIVETTVPAVMRALEKKVQRLENEKLLLREKIDSSTTPQGDFDRRVRTGLAFVASPWNLWSTGRIEDRRAVLKLTFAHRLRYKRGEGFRTPNLTLPFRVLGDFFSGEKGM

SEQ ID NO: 3623 - protein, 347 aa, Methylobacterium sp.
MPLTVDWSVSINGTDYTSRFNPYVMEIEVTDGSGSDGDSCRITLADDGRLIMPKKGVTIAVSILGVKVFEGILKTPRCTTAKGQGGKMVLNATGHDTEDEGKQSQHFAMEETTLGEYLSGLSKKAGYEIKVDPELAKIKQSWIGSEGRSFLEHAQLLANRYGATLKLSGKQAVLARRGKGKTPGGKDLPTVRAVSPGNIINADIEPYVGTAAVRDVRFDFFNRDKARFEEQKADVRLGIGSSKTARRVLPGKAASREDAEDRAKGAAADSERERGSGTVEIDIEPQARAEGTCIVSGVRQGIDGEYRIESVTHTLTAGDGGGSTTKLTLKQPGDEAGSDKRKAGEGD

SEQ ID NO: 3624 - protein, 393 aa, Methylobacterium sp.
MLEALPADALGTPLRDGARGRCHVAVSQDLEALREVWSALEARSGGVFQSYGWCRTWEAAARRAGCRLTPRILTVHQDGRLVLLWPLVVQRLGPLRVLRSFGEPATQYADALLAPGGERAAWLDAAWQAVRAMRDVDAVLLKGVRADAAIAPLVTPRGRFATRGAEAPFCDFRNAEARRRSGRTRNTLQRNLRHLAETGPVAFEVVAEPEARVRTMAEALRLKQAWLRRTGRVSAGYAHPANAAFLQGLAACPNALVLRLTVGGETAAVEAGLVHAGAYASLVQAYEARHAAHGPGRLLFRHMVENAASLGIDRLDFLAPASRHKSEWATGAMPVRDYALPLRLRGWILLAYVRHLRPRAKAWREWIGAVLTGLARRRQGPGTVDQGRAAGRI

SEQ ID NO: 3625 - protein, 301 aa, Methylobacterium sp.
MRSDLNLWDLHHHSVADWQRILAGHPGLAARWLRFAAERGFRSAQLVLGQMLLEGRGVARDPAAAHGWFARAAAIGSLDARNMVGRCHEYGWGVPVDHAAALAQYRRAAAEGHAWARYNVGCLLLYGDVPRDHAEAFRCFAAAAQAPDEAAAGKALGMLGRCHEEGWGTPPDHAAALRCYREAAAAGDGWGALNLGLLALEAGDVSGAASAIERAAALAAPNGLAAIVRALAGRDEPALAALRERVRAGLRPVGGTVPDTAPPRRIAARPLEWRLSAALLAGHLLRRGRAPRARTIPATTG

SEQ ID NO: 3626 - protein, 974 aa, Methylobacterium sp.
VGNLTSSLTLKLIDDGLAAKVKADADAMRKLGASAQDLKKLGGASSHVAKLNKELDALAKKGGKLEALKVNERQLSTLAASYKTARQEVAATAKAVAALGPGVSAKDQRAAERAHKTAMRRMDAARDAALEQARLVKAAHAEALGGSGKGRIGMARAEQQLAAATNATNAALREQVGLVGRLAAKGRAERDVLAGMGLAGRGQGAKIAADRRLVDGMGAPARAAAAAAAAAAKAAVEAEGRRRSSASGDMLRGMGGIGRREHERIAAGRRVAEGMSAAGRRTGSMAGGSLPQAGDAEGAAIFDTLKGVGASAAARRAFDATTSNWATMDEAVRRQRAILDIDEDKQEQLKAQAYQIGKDTRFSNPDVIKGQTRIGSSLPDHLKNPAVIAAITENAKDYALAMGTTLDEGSSAVLGRMLGMRMDLSTTGSAGAASLDAANKLVQWAKASGADHNDVMGYTKFGAAPGNVGGFSPEFQDALSAQLRRIGFEGSMGGNFVRAAATKLAVPTSKGLGALAAAGIDHSDYVQKGKELSAENLNKSLKLKYGKGLTDSQQARIHALMQDETVVGNRDEFIPAVAEIVQETLARKTKKGSINAQDAKSIAKAVGEFLNVSAGAVDIERLMRDVIPLLKGSPALSKYLFGQEHGGRAQALDAATLEKDTESFRNTPRDRAKGVGNITNAGFHGARDRYYGSVETFWTRLGEVANGPLTTFYETLGNSIDRVSGLPDALLGVGTAAASAGAALLTIKGAAGAGALLGLPGAAAVSAGASAAGGVATVAAGGAMATAIANEAIKNKEFAAPYLDGGMLGADPAGYGIGAGIMHAPEALKQMSDANKRRMGSLPPGMAGVPAQLPPRLPGLDGRPKVAPAPAVRPVTLNPGDELPGVASSLEQVSGKADQARSSLEQVNGVKVDPSISTGSLDAMLAKIGQVISGLQQITGLAASANSSIASVNSGAALKGRSFSDGATPGRGTD

SEQ ID NO: 3627 - protein, 78 aa, Methylobacterium sp.
MLRFLGRHAGLLAFGVVAAVVLGPLTVFWPGAGALAVALLGALGALAAHARATALRARCDVLSREVDGLSKRLLRAES

SEQ ID NO: 3628 - protein, 55 aa, Methylobacterium sp.
PPPAPGTQRYITEPPRAPETPGPMPSPAPGRGTGESLSRDLPSEAYRPPPERGGR

SEQ ID NO: 3629 - protein, 65 aa, Methylobacterium sp.
MARRQTATQAAISRAVKGAQAAGLKIGRVEIEGDRIVIHSSAEPVQAAPASDFDAWRAKRDARPA

SEQ ID NO: 3630 - protein, 377 aa, Methylobacterium sp.
MERFEIVGTAERLRAVGPAWSGLWAASGAPVFQSHAWISAWWDSVPDRGRRRLMIVLAWRGTDLVGVLPLATMRRRGLRVLEWAAKACSDFADALVAPDAGADLLHRMWAHLSGAGGFDLAYLSHLRPEARACVLGEARSGGVRLRPNHRTEQNWRVCGPVPSGKAWFDAQPKKMRQNHRRGRKIIAERGALTSRLLPPDAPLDDLLAWFVDRKRAWLAANGLPPGLFYAEGARALPAMVRVLAEAGLLRVFVLDCDGAPVAASINFVQGGTMMAFVTTYDPDFERASPGLVLMIDYIVWAFDHGLHTVDFLCGDEGFKGRFGTHCLTLGSLMGARTLPGAAAHLIDRGGSGLSRRLRARRPAPAGGQNEARDDAAA

SEQ ID NO: 3631 - protein, 364 aa, Methylobacterium sp.
MKPRIALGLQGGGAYGAYGWGVIDRLLEEHIWISAVSGASAGALNGAALVSGLASGSDDGARTALARLWRATADRSPLRAWDWAASLPPGAADWMAPWIEPWVDAWVEPWVEQSLTFTRLYGGHVTPYFPDFRAMRAWREAVTASVDFEALTAPRAIPLYVSATDVLTGAARLFTGAKITEDALMASCCLPELFSPVEIDGRRYWDGGYVANPALDPLVFGGHGATDLIVVQLTPFVTDAVSERADEVVKRASDISFNACLMRELKTLTELQSAVRLAASPSPRLRPILDINIHLLRAPAELASGCVDKYDTRWSTLCGLRDLGRATAEAWLAETGDAIGSASSLTTLDEALTEHAPRGEGVEA

SEQ ID NO: 3632 - protein, 232 aa, Methylobacterium sp.
MAMINGGSLQIFGRINPPRKETVALDEAYTSETDAEGRFAFQLPYLPARCIARLKAGMDARDVVVGYCAPREPERVAAAEPKPAKLLPAANVAKPEVGPRGPQGIAGPQGPEGPQGVRGEKGEAGAAGQTGPAGQRGEKGEPGPRGPHGERGPAGPAGPPGAPAAAGIALRVQVEDCAGGARCVASCRDDEFAVNGTCSGGERPAMDESSIYCVGLGRVPAALRARAICARQ

SEQ ID NO: 3633 - protein, 340 aa, Methylobacterium sp.
MITRRSLLATAAAGAGLIACPAVLRAQSPKILKLSHQFPGGTIDQGDARDRIARRFGQAVEQRTGGSLQVQVYPTSSLMKTLAQFSAVRKGALDMSLVPLSYAGGEVVETNLALMPALVSSYEQAARWRTARIGEELSKTLSDKGVIILTWIWQSGAVASRVKPILEPADVKGVKIRGGGREMDMMFQAAGGIVSTMPSSEMYIGMQTGALEAAVSASTSLISFRLDEMTKNLTAGRGRSFWFILEPLILSKATFDALTPEQQNVVRDVGREMEAFSFEAARADDEEIVKIYGARGAKVHDLTDAHIARWKELARDTAWKDFAGKNARCAELLKLAEQVA

SEQ ID NO: 3634 - protein, 88 aa, Methylobacterium sp.
MTTRFTTAAVAIALSLAAPAAFAQAGNWPHTERAPVSAYDDITTGSIGVARPQVRDGWGAVSSAKAGNANQQNFPVQQYGQTSGGPAY

SEQ ID NO: 3635 - protein, 53 aa, Methylobacterium sp.
MIGLASLASLGLGATLAALAPRAGLRAATCETCGGLFLISGLALLGSCLPLFR

SEQ ID NO: 3636 - protein, 98 aa, Methylobacterium sp.
MSCLWSGIAALALPVAAAMPGAGGPVLVVGAPGAGPAAVAEIVARADGALLRPTVLPWIVLARSDAGDFDARLRRAGAWLVLDGTALAGCAGGRGSIR

SEQ ID NO: 3637 - protein, 325 aa, Methylobacterium sp.
MPVTDAADPKPLILLTNPIHPEAVARLTPHARVVTAPDTGADTLRRLAREAAGMIVRAQLPDDILDHAPLLRGIVRHGVGLDFVPLAAANAGGIPVANLPGSNTRAVAEYAFAALFELRRRLGHLDRTLRQSGWLAAKTLANDLPEIGGTALGVLGLGEIGRAVAGIGRHGFGMRVLGTARNPRGLEGLAEPVPIERLFAESDAVVIACPLTPETRGLVGAGLIGRMRPDAVLINVARGPIVEADALADALEAGRIGGAALDVFAVQPLPEDHRLRGCPNLLLTPHVAGTTATSLRTMGLGAADAMLAILRGERPATVVNPEVYG

SEQ ID NO: 3638 - protein, 78 aa, Methylobacterium sp.
MISVQPYWLVHGEGPASRRHDTKASADREADRLARLHPGQVFVVLESVEAFRKIDVQRVSLRGPEGRVAPGLMDDIPF

SEQ ID NO: 3639 - protein, 29 aa, Methylobacterium sp.
KAFSYGMIGAFVAGLGLTLRGSLGVLAGL

SEQ ID NO: 3640 - protein, 29 aa, Methylobacterium sp.
KAFSYGMIGAFVAGLGLTLRGSLGVLAGL

SEQ ID NO: 3641 - protein, 141 aa, Methylobacterium sp.
MAGGYAPNTFAVLLVEDVPVQMMAAASALRDAGLRVVEAPTVEAATSALAADPELRAMIADIDLGGEPLMGLTLAKAVAARWPDVVLLLISGAIVPETEAMPAGARFLRKPFEPEALAEAVRGLVSAREAGRLAPDGSVMG

SEQ ID NO: 3642 - protein, 198 aa, Methylobacterium sp.
MNEPTKSAPLGHFIGYARVSTDSQELTNQQAALKAEGCTRIFAEKITGAKRDRVELDRMLDHLRAGDVVVVTRLDRLARNTRDLLDIAERLRGIGAGLRSLAEPWADTTSPAGKMILTIMAGIADFERSLILERTSTGRTAAKARGVKFGRTPAMTSEKLAAAKTLLAEPGKTMTQVAAALGVHRATLYRALGAEGDA

SEQ ID NO: 3643 - protein, 756 aa, Methylobacterium sp.
MAETDAQILRLQVANARPQDAGRGIARLGHAALTQLGLREGDVVEIVGKRHTAAIAVGPYEEDEGLNLVRLDGLQRVNAGTASGDHVEVRAASEIRPAGRVVVAPAQKNVRLQGSGEALRRTLFRRPLVAGDVISTSTQSRAAPDPRIPPELRPYLEGPTYGLQEIRLVVVSTQPRGIVFVAEGTEIELRPLFEEPKDGRRADVTYDDIGGLGDTVDQIREMVELPLRHPELFQRLGIDPPKGVLLHGPPGTGKTRLARAVANETEARFFHIAGPEIMGSRYGESEQRLREVFQEAAQNAPSIIFIDEIDSIAPKREQVTGEVERRIVAQLLTLMDGLEPRQNVVVIGATNRRDAIDEALRRPGRFDREIIIGVPDQPGRREILGIHTRGMPLAEDVDLDAVARTTYGFVGADLGALVREAAMDAVRRILPEVNLREGIPAETLEGLSVRRDDFLSAMKRIQPSALREIMIQVPDVTWDDVGGLADAQMRLREGVELPLRSPQAFRRIGIRPAKGFLLFGPPGTGKTLLAKAVAREAEANFVATKSSDLLSKWYGESEQQVSRLFQRARQVAPTVIFIDEIDSLAPARGGGLGEPAVTERVVNTILAEMDGLEELQGVVVMAATNRPNLLDPALLRPGRFDELVYVPVPDAAGRRRILAIHTRDMPLAEDVDLNLIAERTARFTGADLEDLTRRAGLLALRESLDATQVHRVHFEQAARETRPSVTPEMERDYEEMLRTLKQEGPQRQPIGFLAAR

SEQ ID NO: 3644 - protein, 90 aa, Methylobacterium sp.
MPPVEPVSPVLDTLLSLLAEAPPGRDRKAAEHAAERLDRLEYAARWDGAAPETLAAIAGARMLLGLAAYPCPRRPRIAPRHPIAGALLPH

SEQ ID NO: 3645 - protein, 196 aa, Methylobacterium sp.
VSPTRILCVEDDREIADLIAEVLAEEGFAVERAATGPEGLARLRTRPDAVICDIDLPGFSGLDLLRRAGEAGLAAPFVFLTAFGGRRNQIEARRLGCADFVTKPIDFELLVAVLRNVLQRAPVRRTVQEPAVQMTEREREILTLVSRGKSSVEIAQILAISERTTNFHIGNVMRKLNVTSRVQAAVIALSMGLLEK

SEQ ID NO: 3646 - protein, 125 aa, Methylobacterium sp.
MTEHRIVSHSKLRDEMMAVARGQQAAPPNAGGQSFESVEALMRLLTPDNRRLLAMIRDRKPQSIAELAEWSGRAAPNVTRTLAKLEAVGFIRMEENQRRKVPTAVVHKLTMEIDPFSQNDRLEIA

SEQ ID NO: 3647 - protein, 224 aa, Methylobacterium sp.
MITVVGGTKGGSGKSTVATNLAIMLASAGRDVLLVDADDQETSTDFTNLREATRPGGAGYTCVALTGAAVRSGVQRLAPKHAHVIIDTGGRDTVSQRAALSICDAYLVPFAPRSFDVWTLDKVAELVEEARAVNPELRALAFINRAEARGSENAEAAELIRSKPGLEFVPAALGARKAFAHAAASGLSVTELRPQDPKASEEIAALYGHLFDTAKISSRDPKGA

SEQ ID NO: 3648 - protein, 252 aa, Methylobacterium sp.
MRLGYHEYPDQRKTKRTQHVGYMLFMEQGDRASRLKLARERAGYESPRAAARHFRWNENTYKARENGLRDYSVEDAKEYGRAYNVSWIWLAGGEGGIERKSVARIEGLIGAGGEIDTNLSQAYGEDVVEVEVLVPLPPDVTAYEVWGDSMLPKYDPGDIILVRNGNQPADELLGDVALVVTSEWKRYLKRILRGSGDGLYDLESFNARTIKDVRVLQVGAIQMVIPSKQVERVANGKEVERRYQLKSADAAE

SEQ ID NO: 3649 - protein, 384 aa, Methylobacterium sp.
MSAVVYNGPRDVAVQDVPDARIERSTDVLVRITSTNICGSDLHMYEGRTDFPRGGVFGHENLGQVVEVGDAVDRVKVGNWVAIPFNIGCGFCKNCERGLSAFCLTTADRSVVPNMAGAAYGFADMGPYRGGQADLLRVPYGDYNCLKLPPDAEERQNEYVMLADIFPTGWHATELAGLRPGESIVIYGAGPVGLMAAHAAMIKGACMVMVVDRHPDRLRLAGEIGALPIDDSKGSPVDQVLELTNGIGADRGCECVGYQAHDPQGHEHPNMTMNDLVKSVKFTGGIGVVGVFTPQDPAPQDPLYKQGEIVFDHGLFWFKGQTIGVGQCNVKAYNRQLRDLISTGRAKPSFIVSHELPLEEAPNAYQHFDARDEGWTKVILKPAA

SEQ ID NO: 3650 - protein, 199 aa, Methylobacterium sp.
APTQPPFPSALPTLPRAGAAPAATGLVVAPGRVLTAAAALGGCAPRIGAAAARVLASDPAQGLALIEAPGLPASVLPTPRGTPAGVDEALTVVAASAEGSVVAPGAALGSGVVAPLQPGAAGAPVLDRAGALAGIVARYPSTPRLVAGVAPPTSYPILPGEAVLGFLRRNGIAPSAAGGSAGASAGAIAPAVVAVTCAR

SEQ ID NO: 3651 - protein, 83 aa, Methylobacterium sp.
LPIMPVERVAAFRSPRSRRPIGELDVVTVLVSVQTDEGEPIAAGTAGPVVAVWAGGAAFDIEFDEPVLGLATVRSENLERLGD

SEQ ID NO: 3652 - protein, 411 aa, Methylobacterium sp.
LIRTARLAARPVARAVRRHILPRVLPTVRHPFPEQVRNVRVVGLLSSSSGLGESARLCIDSLTQDGCAVSTANVAALFDSDDGVAYPQRESGPPADVAIYHLNPTMLLPSILRAGLPQHLRTYSIGYWAWELETLPPEWIGALRFVDAVMVPSRFCQEAVQAYTSKPVVVVPHPVAQPATAAGAAPRAPGARFRVVSIFNLGSSFLRKNPLAAITAFRTAFGESEAAELVLKISDGARYPAERDRIHAAIAGARNIRLIDAVWDRAELQALLTSADAYLSLHRSEGFGLTLAEAALQAIPVVATNWSGSTDICPPNLCYPVDHALVPFSDPHPAYAGLRRARWAEPDTEHAARQLRRIQADPAEARARAVALRAWLAGYLGQHDYRGALREIAARMPAGAPPAADETVAPS

SEQ ID NO: 3653 - protein, 149 aa, Methylobacterium sp.
MSKRNVEPELTAAQLQELIGMARGNSETLSTMDGNNQALFLLRTFDTADRVYGLWPDSSRPGGYDYNIMKGELGSAAMRRVAKSPNISVTAVFQENENHAELTREIYVGLETTGDAYPETYAEAFHFWINIVPANFEDTKRRIRGYILG

SEQ ID NO: 3654 - protein, 139 aa, Methylobacterium sp.
MHLETAHVLAGLIEAMPEDIPVDDPDDEAEGAPETGSARSARERRDAAQRKRDERARRKAGGMPDPRVVDAAIATAIADICIRADFRGRAKAKGSIKGLSIGLDAIIGQVMQVLVEQRNVGQPQAKKAAMQRLGLTRQA

SEQ ID NO: 3655 - protein, 244 aa, Methylobacterium sp.
VTSSHSAAGPQRVLITGGTSGIGAAIAERCRRDGYTPIILDRVPAASGACIVADLSDREQTARALDEALAGGPITRLVNNVGVVVPSEVDTQPLESLDLAVSLNLRCALQCLQAVLPGMKAAGFGRIVNMSSRAALGKELRTAYAATKAGLIGMTRVWALELGPFGITANAIGPGPIRTALFDRANPPDAPRTRAIIDAVPVRRVGTPEDVADAAAYFLGHRSGFTTGQTLYVCGGMTVGLASV

SEQ ID NO: 3656 - protein, 277 aa, Methylobacterium sp.
MPMRCHIGSALLLTGLACAMPVGAEAGAGPRVRIAYENPAPGEAREIYREVRERRVLEGLRNLLSHLRLPRTLTLRMAACGGEPDAWYAARDRTVTVCYDYVRDVRERAPATVTPGGVTRQAAILGGLAQVFLHEVGHALFDILDIPVLGREEDAADQFAALVVLRLPPEEARRAIDGGAHLFRSFAAEEAVEEAILADSHGPFAQRLYNLLCLAYGSDRRAFAYLVERASLPSARAAECAAEYGQAADAMDRVLHRHLQGRRLGRGQVRRAFRWIF

SEQ ID NO: 3657 - protein, 328 aa, Methylobacterium sp.
MPHLQPSRRAILAGGLAVAALPLSARAQGAYPTRPITLIVPFAAGGSTDVVGRLVAQKLSEVLGQQVVVENVVGAGGNVGAARVAKAEPDGYTILMGTVATHALNPLILKRKPYDPVTDFAPVALLAVVPNVLVVNPSLPAKNVQELIALLKADPKKYNYASSGIGTPLHLSGELFKSMAGVQMQHIPYRGSGPALNDVVAGQVPIQFDNLPSASEFIRAGTLRALAVTTKERASSFPDVPTLAESGLPNYETYTWNALFAPPGTPRPIVDALNAAARKALADPALVERLKTFSAKVQLSTPEELGEHVKAETAKWTPVVREAGIQAD

SEQ ID NO: 3658 - protein, 471 aa, Methylobacterium sp.
MSDLSSNLSPFRELLGEGGVVTDADSLTRYTHDQRALMQGQTPGVLRPRSTEEVQAVVRLAAHLGFGLVPQGGNTGYVGGATPEPGRGQLVVSLERMSRIRAVDAAGFTLACDAGTILADAQAAAEAQGCLLPLSLGAEGSCRLGGNIGTNAGGLQVLRYGMTRDLVLGLEVVLPDGSLFSDMRTLRKNNIGYDLKQLFVGAEGTLGLVTGVVLKLWPAQTRRATAWLQLAENAPIPEIAALVRRETADLASTFELISASSLALVADMRGADLGLAAGPGGAVLLELSASSERIPLDDVLLGTLEALMEAGHVEDAVLAQSERQRREMWTIRETIPEAEKHAGGSVKLDIAVPTSAVSSFLVRAGAVVAAEAPGTRLSFYGHVGDGNIHFNLMVPAGRDRLAFTREVEEGVAHAVYAVAVDLGGSFSAEYGIGRFKRDLLVRYGEPNRLALLSAIKRAIDPHGLMNAGAMI

SEQ ID NO: 3659 - protein, 255 aa, Methylobacterium sp.
MLAAGLAGPVTARASPITDQWSAEAAQTRQGHTYRTVLTFSYDGKVQNGRALWLVDVRCEVRSPGASKVSAVTGSGTAMLAQGGWGGNAPPVGDVYVIEAENDPEGKGRLEVDNPGCASGTPTIKRRPGEATVPTLPKVEPTGRPWMHNGSMVMIDPEAGIIAYREPKASLRPAVGPGTVLFRGTLKPGGGAHGTAYAFKEGCPPAPYAVRGRYSDRDYTLTLRGAGPVRKGCEVVGYSERSPHAVLAFSYLLDD

SEQ ID NO: 3660 - protein, 328 aa, Methylobacterium sp.
MGIAVRAAIGALLLTATSAQAWEPTKPIEIIVPFPPGGASDQMARTIQGAIQKGNLVKQPIIIVNKPAAAGGEAMLDIQKSAGDPHKLITTSSGIYMTPLATKLPVSWKDFTPVAMMAQDAFVLWVNAAKPYKTAQDFVAAAKTAAPPLKTGGNGSKREDHLISVTMEQATGTKITYVPYQGGGPASVQLAGGHIDANMNNPAEEIANWRSGSVKPLCVFSPKPMEYTQKVTADMAWSDIPTCPSQGVNVTYQMLRGMFMPGKVTPEQQAFYVDLFQKVTQTPEWKAYLERNALVPDFRAGQSFVDFLTEDERKHKELMTKAGFIATN

SEQ ID NO: 3661 - protein, 165 aa, Methylobacterium sp.
MAQASPPLPERGLSRRLVEILVALLLTGLAALALWDSYGRGAGWDNGPENGFFPARVAAILAIAAGAVLVGAVRREDSVFVTYGQLRLVAQVFVPLFLYVLAIAFLGIYLASALFMGLFMVMLGAFRWWQVALAVVLTPLVTFWVFELQFRVPLPKGPVEAMLGF

SEQ ID NO: 3662 - protein, 513 aa, Methylobacterium sp.
MDDLNQLLLGFQVALTWHNVLFMVVGVLLGIVVGVLPGLGGPNGVAILLPLTFGMDPTSAIILLSSIYWGALFGGAITSILFNIPGEAWSVATTFDGYPLAQQGRAGEALTAAFTASFIGALSGVVLITFVAPLVAKFALRFGPAEFFGVFFLTFCSFIGMGRENKAKIVASLALGFLLAAVGLDTISGDLRLTFGSPELMKGFDFLVVVIGLFGVSEILLTIEEGLHFKGKRAAIDLGVVLRTWAGLPRYWATLIRSSVVGMWMGVTPGGAIAASFMGYGLAKRFSRRPDGFGRGEIEGVLAPETAAHAAGTSALLPMLALGIPGSATAAVLLGGLMIWGLQPGPMLFIEKKEFVWGLIASMYLGNLAGLLIVLATVPVFAAIMRIPFALVAPIILVVCAIGAFTVESSRFDIWLMLIFGVVGYVFKKLDYPLAPLVLALVLGDRAEDAFRQALLGSGGDLSVFFSNALVSTLMILGLLLLVWGPLGNLRQRLTRKGGIDQPPREIAGSKAS

SEQ ID NO: 3663 - protein, 326 aa, Methylobacterium sp.
MAAEERSHGLTRRTGLALGLSAAAAVCRPFAAAAAPRRYALDPVRIAEGVWTVYGAQEAITAGNGGAIANVTLLDTREGCVLIDAGPSHRFGTALDALARDLTGKPVVRVYLTHLHADHSLGATAFPDTVLRAGPGLRTDLARFGNDLASGMYRVAGDWMRGTGVPKPAMEAREGVEDVGGRRFRLLCLSGHTREDLCLFEETSGLLFPGDLVFLDRAATTPDADLPRWRTALRTIADIPCGLLVPGHGPAEAGRRGIDQTLAWLDAVEAGIGAGFEQGLDVTEIMARPLPAWTDRIAVARYEFARSVMHLLPAIETERLPNLPTL

SEQ ID NO: 3664 - protein, 196 aa, Methylobacterium sp.
VTAKRKYARLTPATWATIEGLWASGSATLSEIAERFGVSPRAIQAHMSQRGIGKGSAAEALAANVRSEVLSRALREPDDLVARAAAIREGAVQGAEKVERLLHAALDAAAADPGKVFALAATAKALALSAQTLERLHKLKRSALGLGDDDTLSDELPTLLIEDLSASDIAAMREDDEEDDGPKARHEEDNEVVLIT

SEQ ID NO: 3665 - protein, 207 aa, Methylobacterium sp.
MTLQTWWLFLGAVFLLSGTPGPNMLHVMTCSARYGLGPSAFAMVGCLSGLVLVLIAAAAGLGAVLAASPLLFEILRYAGVAYLAWAGIRAWRGGGAAPDPATGIARAPSAGGLFRGGFLIGVSNPKLLMFVAAFLPQFIEPARAQTPQFVVLILTFAAAEAFWYAVYGVGGRRIARLLVRPGARRLFDRATGAIFLGFGAALLGGHR

SEQ ID NO: 3666 - protein, 120 aa, Methylobacterium sp.
MQRAAVWRAAIGVLTLYALVLQGLLGGVAATRMSLQATGILCSDHRADASQEPDGQAGHQSCCSTVCRLAGFALAAPEVEAIPATVPALARERHWHAVQAHAPPARTHRSAAPRAPPAAA

SEQ ID NO: 3667 - protein, 34 aa, Methylobacterium sp.
VAPAQVRAPNRPEWPHPLNEEELRALETGWGFVE

SEQ ID NO: 3668 - protein, 625 aa, Methylobacterium sp.
LSAEHRKGLTLRHLAFTGAGKVAYVPFAPGLNLVYGASNTGKSSIAKSLDFMLGGSEWLKSSTENQGYDSGWLGLDLPDGRAVTLYRSVKGANFILYDGHVVEKPDGAGRVLREKHSTKARDNVSVFLLEAFGLGVRPIVKNANGETNTVSFRKLSPYVIVEENAIIDEKSPALSGQRQDVTVEKGIFRLLLTGRDDDGVVAAPDARDLNARTSGKVELIDEMIADLDVALGEAGGDRAGSERQAEALQGTMERWTAVIRTRQADLDAAVTRRREILDEAERAGGHHVELDVTVARYEELDSVYASDLGRLESLEENSFLLKTIRGRECPTCGAPEDCQRHGPGVAEIERFHQATMAEMRKVERDRRDLRGVMETLRAEARGASTRRVELLRQVEGIDRNIERLRGEEAATRADYQALIERSEATSRIAALFEQRDRLVVQRSQLDAPSAGRAQRPSLVVEVDGVTAFAFAKVVERVLHAWGFPGTPQVGWSGPSQDILIDGKDRAANGKGVRAVLHAAFKVGLMLYCHEKNLPHPGFVVLDTPLLTYREPMDEKHGELGEDEVAVKESGLNERFYAHLSSIADVGQVIVLENTDPPPGIEALGEVTRFTKRNGPGMRYGFFPTE

SEQ ID NO: 3669 - protein, 180 aa, Methylobacterium sp.
VARVADLAVDWGMLPMVRLNEIRLGEVAVDLPPATDAGLIFIGTIRTPWTDRLACPRQGRLDGPVCRLEIAEPFVAALAGLEQYAEVEVLYWLDRSRRDLVLQSPRRDGAVRGAFSLRSPVRPNPIGSARARLVDIAGATVRVQGLDCLDGTPLIDLKPDRCAFTPLAPPQPGDFETGPA

SEQ ID NO: 3670 - protein, 136 aa, Methylobacterium sp.
VGALFSILPMLIQFLGPVLDKAIPDAAQRAQVQADFQKAVLENQAALNAAMADVMKADAGSESWLARSARPIVVIWSLVMITWCGVVAPMLGVQKEVLAALQAVPSDLWSLASVGIGAFMLARTVEKVAPAIATRK

SEQ ID NO: 3671 - protein, 417 aa, Methylobacterium sp.
MEQRTAKGPGSASRFETLDALRGVCALAVAFFHMPFAHPLHGAPRFDNVQFCVDVFFVLSGFVLLHGYGGRLASPRQALRFMLARFGRLWPLHAATLGLLVALEAARLVYLTGHPGTPVVTPPFGAAHRPVEVLTHLLFLQDFLTFGEFSWNFPSWSIAVEFYASLALACTVMLAGPRARWTFAGLALLAALALHAASPGTLFAIQDWGILRCLFDLFVGCLAYCLRDAARVPDRWAGRAEALALALLLAVATLVPPGDWAYGAPLVFGAAIALFSHGRGTVSAAARHGLPQTLGRWSFSIYLLHLPVLQVVLTGLHYAVPRSAGLAPDAGVDLGGSLVNLAAALGIVGAATLLAGLSYRLVEQPARARFRMSDPRTRTGRTGRVSQIEKASPPPACGDWSPIGQYFWSRAVLRRPE

SEQ ID NO: 3672 - protein, 285 aa, Methylobacterium sp.
MRVVAILASHNEEVYVRACLDTYIAQGVEVYLIDNDSTDRTVEIARTYLGRGLIGIERFPRAGQFELLPMLRRKEEIADAIRADWYIHADMDEIRLPPRGQGTLARALREVDRAGYTTVNFRNFLFMPPREEPDHFHARFVETMRWYRYMEPSYPNQVKGWKRQKHFTLGERLRRLLFGLEARPGPRSVDLAGTGGHRVHFPGATLCPDDFILKHYPVLSLDHAVRKYVEKTYAETEVSVGFHGWKARAAAVDLRLPSVAELREFRGDAALDIADPITRTLIYAA

SEQ ID NO: 3673 - protein, 540 aa, Methylobacterium sp.
MTLHQHAARAALTLAALSLTTPAFAAPGQTAGLNLTAIVLFLAFVLLTLWITWQAAQRTKSTDDFYAAGGNITGFQNGLAIAGDAMSAGAFLGLTALVFTSGFDGLTYAIGYTTGMPIVVFLLAERLRKLGRYTFTDVVCTRLSEGPIRIFAACASLVVVAFYLIAQMVGAGQLIQLLFGLDYAYAVFLVGVLMICYVMFGGMVATTWVQIIKAGLLLAGATLIVVLVLVAFGFDYGALLARATAVHPKGAAILAPQAASRDPLSALSLGLALMLGTAGLPHILMRFFTVPDARAARVSVFWAATFMNYFYALVFVLGFGALTLTAANPDYVDAAGALRGGGNMAAIHLSHAVGGNAMMGFISAVAFATILAVVAGLTLAGASAVSHDLYAGVIRRGQLDERSEVRISRIATFVLGLVAIGLGLAFKGQNVAYMISLAFSVACSSTFPVLLLALYWRGLTTAGAVAGGTVGLLSALGLTLLGPAVWVKVLGNPAPIFAMDPPTLVTLPLAFATCWLVSRLDRSAQAARDRARFDLQQAAT

SEQ ID NO: 3674 - protein, 171 aa, Methylobacterium sp.
MTEPEQIARLRISLEGIEPAIWRQVEVPLTATLKALHDVIQAAFGWEGYHLHLFQVGEERYGAPDPEWEGLRPIRPEKGMRLAVLIERGVTSFTYTYNFGDDWRHEIVVEAVEAADPALEYPHLVAGARRAPPDDVGGVYRLRGVRPRDDPATPSGAQGHGGVARWSLRSS

SEQ ID NO: 3675 - protein, 91 aa, Methylobacterium sp.
MRNDAESPGWSPDLLSAQALRVQDAALILADECVLLSLGAQMAWLDLWMRPLLQASAEMQVWQERQARTARLMRRGIPGPVAREGLHLLPS

SEQ ID NO: 3676 - protein, 738 aa, Methylobacterium sp.
MQMNAGSSRRPWRILARPAARRPRVAGAFRRLVPVLARLTACLALGAHGAAARTIFVTPTGAGPGYAADGRLVAERTESFSTDTMRTVLPGDVVQLLLDTPDPAATTVYRAHVVLSRKTSLAPAAIVIRGLGPRTRLVGRSVEQVRDCPMPEDGAERACGDLYSALAAAETPDLLAALFGSAAVRATPGERAAGARPAIPIGRTGRLAEAACLDLDRVDGVVVEDLTFQDCWLVAVRALGSRRVTVRRALVVGGSYGLAARGRPGQPADHITVEDVTWVQDASGYDAASLSREGPFRCRDGRETALGCPGLMWRSIPWGVSHHGVYEHFNGALLGGADLAGPVVFRRNTVLSAYNGIRLKASACEDLPASSLSPATCPYNAGLWISENLFSYLRDNPVELETWATDAHVARNRIHNAHAWFSFDDMAGGPVYVYGNRGWFDDMPALAWSGSAPGGAPCRRRPVSAPPDAAGFDPVLDRRFDYLKARWLPVGVEAVDASGRVQRMDVEEQSCEASVAGRVVKLALPPRGAAPDTYRYPTRGPIHLFNNSWYLRAPVTGIGAAANLRHWNNAILFCEPGTPGYAPELCEARPETFDAAACGREFVRADGIGRFPGARGSLPFFDCFRWLPVDERGRDLPDLASTFDHDISSNGFPQGFGGPATFELQGRQGDPGFRAPERGDFTLLPGALARTSACRIEEADDGHLDCRPVPADAAFAGAVAPDGRLYEPPASPRFRPPD

SEQ ID NO: 3677 - protein, 548 aa, Methylobacterium sp.
MTETLKLTEFEALSPFEIKDELIKLAKATSRRTQSAFLNAGRGNPNWIATAPREAFFLLGQFALTESRRVMSHPAGLGGMPQAGGIAARLEGWLAERPDTPGAPFLSAMVPYAVTTFGFEPDAFVHELVDSIIGDNYPVPDRMLVHNERIVHEYLMWAMCGGQKPAGRFDLYAVEGGTAAMCYLFKSLKANRLLMPGDTIALGTPIFTPYLEMTHLEDYALNVVHIRAPQENKFQFPDEEIDKLLDPKIKAFFLVNPGNPTGMALSGETVAKITELVRTKRPDLMILTDDVYGTFVEGFRSLLGELPRNTIGVYSYSKYFGCTGWRLGVIAIHEDNIFDEAIAALPAAETAALDRRYGPLTLQPRQLKFIDRIVADSRDVALNHTAGLSLPQQVMMSLFSLAELMDERKAYQAACMEIVHRRVWSMIEGLGLHLTPNPNFDAYYGLIDFEFWARKNIGDEAVEYLKANVHPLDLAFRLAEVHGIVLLNGGGFEAPNWSLRVSLANLPDEVYDDIGRGVRAVARGYRDAYEASRRTAQTRAEIAEAPAE

SEQ ID NO: 3678 - protein, 99 aa, Methylobacterium sp.
MNTAVFRVSQIAMPCVGLWFGLRTYAWLSAHPAVYDPLSGSVSIGVAVWLLGGALVVALSEAIAKAYADARQTRTRPSFYAMLIAAASLALGVLSYLTK

SEQ ID NO: 3679 - protein, 180 aa, Methylobacterium sp.
TALGDGKILFSASTAANGQELWVTDGTDAGTTLLKDIRTGSGSSAPTGLTALSDGKAVFRATTPTHGSELWVTDGTAAGTTLLKDIRTGSGSSAPTGLTALSDGKAVFRATTPTHGSELWVTDGTAAGTTLLKDIRTGSDNNVMAGFTALGNGKALFRATTATNGTELWVTDGTDAGTTL

SEQ ID NO: 3680 - protein, 131 aa, Methylobacterium sp.
GFTTLGNGKVLFSAYNATDGRDLWVTDGTAAGTTLLKDFNTGFAHSQPTGFTALGDGRVVFSASTATNGQELWVTDGTAVGTTLLKDINTGSDDSQPTGFRALGDGRILFSASTAANGQELWVTDGTDAGT

SEQ ID NO: 3681 - protein, 401 aa, Methylobacterium sp.
MTDAFICDAVRTPFGRYGGALADIRADDLAAVPIRALMERNPAVAWGALDDVIYGCANQAGEDNRNVARMAGLLAGLPVEVPGVTVNRLCGSGLDALGAAARAIKAGEADLLIAGGVESMTRAPFVVGKARSAFARDLSLQDTTMGWRFVNPRMKALHGTDAMPETAENVAEDYGVSRADQDAFALRSQRRAAAAQAAGRLAEEIVPVTIPRRKGEPLVVARDEHLRPDTTPEALARLGGVVGPEGSVTAGNASGINDGAAALLVASPAAAERHGLRPRARIVASTAAGVAPRVMGVGPVPAVRKLLARTGLSLAQMDVIELNEAFAAQALAVTRELGLPDDAAQVNPDGGAIALGHPLGASGARLAIAALRQLERGGGRYGLCTMCVGVGQGIALIVERV

SEQ ID NO: 3682 - protein, 733 aa, Methylobacterium sp.
MNINPAPLRFQAGMRPSPLAFADRRSKTWTITQVVDAAVRRRRTVALVTLACFAIAAAYANLAAPTYTSMASVVLDTKLTPPSPGTVSSETTIDPAVVDSQVEILKSDKIALDVVDRLNLTRDSEFVGSKPSFVHALIGRIMALFEPDAGGAVRTDPRQAAAAALSRKVKVTRAGRSILAEITATSLDPAKAAAVANAVAEAYIQDQLSSRMEASQRTTDWMQRRLAEVRERLDAANAALAAYRAGEDDGKSGVGGTRAEREGARARAADALTRARADLDRSAQLRAAVAQGDPGSETLDQIDRLGDPALSKLVTEQRGAAPGAAVLRTLGERLDARVEAQRKAVAAAELRATLLDKQIQDLRSDGSRSDVPRTDDGRERALERAAQDAQGNYEALQNRVMRVSAFLQQQSMPVTEARIVTTALPPLSKSAPKSSLILLLGLIGGIGAGVAAAFLKDALDRRVRWSRQITHELGQPFLGTLEACPTRAREFRHAADGSPGSDRRLPVPLFIANGSGSPAVLETLCTTKVSIDQALHRETCRVVGVISANAQEGKTTLVTNLAVLLVEMRARVLVIDANLHGSGLAGLVEGDPGPGLARAVTERRALPECVVATPLGFHLLPGSVGPVPNHPVEILGSAALRQLLAEARDHYDYVLIEVPPVLSAVDARVVSDLIDAFVLVVRGGRTKRDEVEHAFTTCPAIADRIVGVVMNRTKSGERPAPASAAPSYLQGAA

SEQ ID NO: 3683 - protein, 309 aa, Methylobacterium sp.
MDLAQLRTLVHVAELGSLSKAAGRLRIAQPALSRQIRLLEDELGARLFDRHGRGMVITEAGREALRHAKRVLAETEELRASVSGPGAELTGHVAVGLPPTLADMISVPLVAAFGATHPRVRLQLVAAYTGYLLDSLYRGEIDLAVLYDPRAPRSLRIRPLMQEALFLIGPGDAGLTAEEPVPFRALAGQRLLLPSTRHGLRNMVEHFADEAGIALDIALEIDSYTALKDLVRQGYGRTILTRAPMHEDIAAGRLTAAPLVDPAPIRRLVLSFQPDRPVSRAAEFAGAAIAAIMAEQLSQGVWVGEMLAG

SEQ ID NO: 3684 - protein, 103 aa, Methylobacterium sp.
VRTLIGPIAADAAFAGLHPARGRPAYAPWRLARVPLLRFREGLGDRRAADAVRARIAWKYLLPTGCGAAPGPSGTRATLAASTMRARASRAASRWPQQRSDTT

SEQ ID NO: 3685 - protein, 462 aa, Methylobacterium sp.
VSLWLQDLSALKDRLEDWRAAGMTDLRTWLRDPEHLLAVQMLIRIERVNRQTLRLYEARDEAELFAHIPAIFDDPRADALVEVLCQLWAGATQARLVTRNRTVAGRVLDVSYAGRMLPGHEASWARFLISVEDITQREEMRRREDALARFAASLFERSPVPTLVRDESGLAAMLADLRAAGVVDLAAHMAAHPDWTEAARASLALVGANAPALALFGAADGDALAHHVAVGLGAEARRVFAEEALALWAGAGHGVRDVLFRRIDGGALHLKAQYAELPGQGDGRRLVQIALTDIGANKRAEARLETLSHTDSLTGLLNRAAYAAHLERLEAERIVPTSVIVADLNGLKAVNDRRGHDAGDALIRRFGRVLAARTPASAHAARIGGDEFAVLLPGTGAEGAAALALRIAEGIERANGGADIPLGVSLGIGTWTGEGPLKAAVTRADARMYAAKRGRRGRVRVA

SEQ ID NO: 3686 - protein, 264 aa, Methylobacterium sp.
MQTVNRLVLLALQIGVGLVGLGIWHVLTVYPILGETRQIQFFFSTPGAVLSRAWSEMLTPEIWGHLWITLQETVLAFVFGAAGGIAFGFLFARNALLAAVFDPYIKAANALPRVVLAPIFALWFGLGIWSKVALGFTLVFFIVFFNVYQGVREVSPVVLNNARMLGMSERGLLRHVYWPSALTWMFSSLHTAVGFALVGAVVGEYLGSSAGLGYKIHEAESVFDVTGVFAGMLILTVFVIVIDALVTLIENRLLVWRPQAGNHG

SEQ ID NO: 3687 - protein, 84 aa, Methylobacterium sp.
MSDEITLVAEQCRAARALIGWSRGELSERCGVAASTLADFEAGKRAPYPRTLADVRRTLEEAGVAFIQASVDGGAGVRLKAGVA

SEQ ID NO: 3688 - protein, 394 aa, Methylobacterium sp.
MTLEEALKVASDFIEAQDPGNALNLYQQIANRIPTHVEARLGMAKAFLLQDKSLQAKSTILNVAIGNATDAAVLSDCAGILEASGFHDEAAAVRQLLVDLGNNVSRILNLLSDDLSMIDLGSSGQAVIQAPNWIAPRIAFTSLDALSVGSNHSRFGAYHPVREVIAPEAGPAVFHERAFLPCSSLLDIDHETFRAFGLQDLSAIVKSHEVVATTLADVLRDARIDRIDYIKTDLEGMDERVVRSAESLVAGAAVVQMELRFLPLFEGEPYLDETVAYMRGRGFEVLHLSTETWRYNTEHRDYTQRGRSIFADTTFIKNFEAYSLIHGKSDETVVRYCLICLLSGNVNYAEYVIETHGALVDPSVRSALKFLIFPLGNAQPAPYRRESLAHVGFS

SEQ ID NO: 3689 - protein, 104 aa, Methylobacterium sp.
MVEDDIFRALADPTRRTIFEKLAGGRMNASALREGMAISQPAMSQHLAVLRGAGLVREARQGRFVNYDVDPEGVALIAQWLAKYRAYWPARVDALKAVLKEMDQ

SEQ ID NO: 3690 - protein, 810 aa, Methylobacterium sp.
MSEVLSFPPPAAAARRGWSQQELAEFYRVEAALVRAGLPIDSEQGLSDEAEPWFVFCRPDGAPIMHFARIGGRYLVASEVLDSPLWGDDFRGLINQVALRHPELLPIRQGGDGTRVTVHPAALLAALVAAATVILSSEDAEAAVLGNAAAPVPAGQLEQAPPPRTGGSAGPAEAEERDSHRMQFEALVVSAMIFAAFAAEEAESRAGLESLADPQVRTATQQDAPADAGSSASLDGAVHRSGPGTQQAQGTAGAVPAGSGSAAQPGAAAGVRPVGAEVGPDGPERAAPAPGGSLAAAEPNGHVVLRPGEAGPARAAGSPASVEPGPERSAASSSAASLGDAAGSPRAGADDTAVQSQPRSVAHPVQDAVSGGTARIERVLHRDADKGATEADEAGRGAAKGIEGEKGIRGEKGTEGAKIAGDGHAGRGPAERPGESSGKSDPGRRDSDDDLDRGGDRGDDHGGPAAARGQHAVASADAPTAEPDAISQDGRGDSRPANGSDKSDPSEHGSGKPGASAESASASHPATQASETHPAQGAEPSGKAAGGAEQSSGHGADAPGSGEHGSEKAAAASAAHAEGGPSAATHSPSSGSGRDGNVPSQHGEDKLAPAGQGEARPGASGEAASASHPHGEPTHADEAPSAGAHGRGSHGPGQTTGLGTDSAAPDPRDAAGKSAAASHLADRPLDVNRKPDAGNLETDAGHGRAADGAVLAQQPDPAVHAPAASHQTPPQTDDGSVQTRNAGAASAQGPGKALAASVDAHGNIVFPSDPGHDSAPAPGHVQVYDGAHAEVGLVGLADHPGQMYHLDLHG

SEQ ID NO: 3691 - protein, 136 aa, Methylobacterium sp.
MDESEIHTLAFLLDFDGRVHWYEQGYFVKFEIKRIEPTKERPHGLRYSFTLHAPEGERMMGFDNAHTIAPGSRYAKRQVEADHWHRDETDRGRPYTFTDAATLVGDFFGEVERILTERGVPLDAVREGTIEERTKP

SEQ ID NO: 3692 - protein, 283 aa, Methylobacterium sp.
VICDLWSEGCNAAAVLDLIGKGAHIRTVEGFHAKTYLYSDRVVLGSANASRGGLGAESEPSTRTETALWCDDAAVLEEASSWFETTWLRGTPVDAVMVEAARDELAAIRDARRISLLHTLAHEPKPFDGLDVYVTLYEDEGVSEEAEQTWDVVRGKYGADDRAAYEARGEWPFYEVAGDQLENCPEGRIYLDFTRGKKGKLTFNGIWKVRTGGHEPVGDTGRFLVLLDRLPSIHGRRIIDAEMKAFAAALASISSEDRAVSSKEIREAARQAFQAAAKQPSGK

SEQ ID NO: 3693 - protein, 171 aa, Methylobacterium sp.
MIYVAPEVHRAVRQIALDEDRSTSEIYVEAARAFLAHRGVALQGHPVPAAKVEPEPSRPIIAPSVTTDDIAGLMDALAHRIEAVLERAVERVGSPSKDDPSPPAGIRTADAMTAVLRMLREAGSDGIGSAELDQALHAARIRSGTAEQAKAVLRDAGLARYERRRWYSASG

SEQ ID NO: 3694 - protein, 260 aa, Methylobacterium sp.
MTQIPDGTALRGKRALVLGVANEHSIAYGCARIFHRLGAEVALTYLNEKAKPYVEPLARALDAPILLPCDVQREGDLDAVFQHLAETWGRLDIALHSIAFAPKVDLQGRLVDSSLAGFGLAMDVSCHSFIRMARLAEPLMTEGGTLLTMSYHGAEKVVPNYNLMGPVKAALECAVRYLAYELGPSDIRVHAVSPGPLKTRAASGLKDFDTLLSEAVERSPIGELVDIDDVGLTAAFLTTPYAARLTGMTVHVDGGLSIMA

SEQ ID NO: 3695 - protein, 108 aa, Methylobacterium sp.
MASQLSLPMPTPGVTSEDEALVRAFVADILPRDVPTYVRRVLGVASDRYGFVARIELPDGGWCDVTITGRLGEGGYAWSFPDGGAPFGWDERRRKWVRYPKLKKADDG

SEQ ID NO: 3696 - protein, 363 aa, Methylobacterium sp.
MRPLRFRRSVVRDLRNRIRFALVGLLILIGLHVASMVAFEHLSLGEAIWLTFTTITTTGYGDFSAKTTAGRAATIVLIYLSGIFLLTQAGSAFFEFRILRRERKRRGEWRWDMRDHIVFVNAPADEPGDYLRRLLDQLHRSHANYASVPSLILTEAFPDGLPPDLEDDPLIVQLKGRFDDPAALEAAGVDQARVLVILAEQEGDRLSDSRTFDIIHRLRERGITARIVAECVDDLNRERLKRAGASAIVRPLRGYPEMIVRAIVAPGTEWIIERLFSSEGDECLRFDVKVDGLTWSRIVPAVLEANFGTPVGYADAQGQPHSNPPPDTTISAEALFILVDETQKPTAAALQKLLSGLATPHVG

SEQ ID NO: 3697 - protein, 54 aa, Methylobacterium sp.
VTAVTARQAWARAATEDEILAAGISLPVALVGADLLAAIRAEAAEDAAAAPEAA

SEQ ID NO: 3698 - protein, 66 aa, Methylobacterium sp.
LPECLTRFLDMPLPGAPAPAAPPRVVQPRAVSRRHPNRALRGTLVWALLYNLIGFTVIAMLWQAMP

SEQ ID NO: 3699 - protein, 96 aa, Methylobacterium sp.
MTRPFLSTTAVLVLAASLGACASKRLDAPRTRGPQAALDTSVPAVPSGAVTTSPLAPPPGVAAAPDEPVAAPGTQVAAAAPPASNVIPEPLASQVP

SEQ ID NO: 3700 - protein, 283 aa, Methylobacterium sp.
LQATGFAPALVLARRDERHEVVLTAPNRNQPYEQAALAEAREHLRLSLGLGQTRFGLRIDAADRPRTALPGVEHHAPWIYAQILTATGATCERLGRLISHFIGVFARRFGLGPGSRLGRGAEPDDGAPHTDAPLYWAHRADLLARWQGRWPDPSRVDALIARRLRSTGHSEAAIAALVSACAPGVPRIGRRVWTGYGRRAAAHAFRDEADSCWAFDRATPAMWAELEQAVKARELPDKPKPIPSPVPPFVGPVPLSPRNEAKLGTTRRRSRNGRGDPDGPGER

SEQ ID NO: 3701 - protein, 237 aa, Methylobacterium sp.
MTSAQSAPRPDPDPAGQAPPPGASAFLTELRDRIGTEVGISAWILVDQARIDRFAEATGDRQFVHVDPLRAAAETPFGGTVAHGYLTLSMLGGTVGEVLPAHPSVRAVLNMAADKVRFLAPVRVDTRIRSVFTLTGVSALPEGKAALRLGAAVQAEGDAGRSVLTAELTLMLLLEEAARETPGSSDRPAVPDRPVAGPDGNLPAPQRSPIRNHQTPECHTASGSRDGDPESMPPLRR

SEQ ID NO: 3702 - protein, 153 aa, Methylobacterium sp.
MQRFVRAKLHGIRVTGADLNYHGSITLDADLCREAGLDPLEFVEIWNKMSGARISTYVLYGPAGSGCCVLNGAAARTCQVGDEVIIASASYGSVDDVIGHKPRVLIFGEGNRVVDRVVYDVFRDDQGRLDMRIIEAETGAEEPPRVATQIRVV

SEQ ID NO: 3703 - protein, 516 aa, Methylobacterium sp.
MAHSWKRDRAAEHIAAKIKDVKKVEIVDFKREMSLGNIPTAKAYRMEAVHIYADILNLDDMLNCTSSEGETCHKRTLRFLDLHGRSVRRILNRTDALRVDFHNQRLHAVVHKPYDSDDEDGSAEARRLHRAVAIAQLVIDVCAATGDDDEYVPAARVRVGIDSGLALVVNNGRNGGREPLFLGDPANHAAKFSAAGSAVGIYLTNNARRAIGLPEVKEPSKTKLTASEVALSQADAELGLDVEDLAEEWRADLAKNPLSNYGFSRHTPPLRTIDISVLTPSNSRRQEAVSVYADIDGFTAYVARHLEAGTSEDVVRALHVIRAELDRVLGVDFEGRRVRFIGDCVHGLLCEGTAQTTDDEETVSTAVLCAGGLRSSFELALEKLDEEGVDVEKLGLAIGIEFGPMTLTRLGAHGDRLRCSVSRGVLASEAEQKRCTGTQTAIGQVAYDTGTQAVRDLFGPSRRFDGLDYNEAVEGLAADGDQTAKAIKAEAFAAAAPAVKRASDQVVTPYVEVGGE

SEQ ID NO: 3704 - protein, 169 aa, Methylobacterium sp.
MNMIIKGTVIGIGSTVLGDVRTNPSGREIWVGVRIRTEDGKSRFLKGMLVEAEAALIINEAVDRGESVELWLSGKPERAYPYAVRTAREGWYYDGYSDYLRGQGLKTLGIGILMLPLLGIGILMMIGSIGYFIASNQFAAQRSRAAFERGYEAAVSSSGSNEGGRLQAA

SEQ ID NO: 3705 - protein, 216 aa, Methylobacterium sp.
VKLLLVDDHALFRDAVRRVLQAGFPEALIEDADSIEAATAALGHRPGTDLVILDLSMDGIRGFEGFMAIRARFPRIPILICSGLQEAPIIREALALGAAGFVPKTSNRAAYLEAVARALEGEIFVPDSVAAAPSAGPRSASAASARMFTLSHAQMNVLILIKQGLSNKEIALCLGIGMSMVKTHATEIMRKLGVRSRTQAVIFASALDFERIGTGG

SEQ ID NO: 3706 - protein, 70 aa, Methylobacterium sp.
MSCRHQPDAPRPGSLQDAPSFARKWRRFPSALPPACNDNHRPGRLRAALLAGSGIAGLLVGLVAVAAALI

SEQ ID NO: 3707 - protein, 349 aa, Methylobacterium sp.
VLAAKLAAVRHHQGRLLGRMEALGLALESEAVFQTLVKDALKTSEIEGEILDQAQVRSSLARRLGLDRAGMVPVERPVDGLVAMLLDATTGFAAPLTEERLFRWHAGLFPDGGHGRREFTVGGWRTDRLGAMEVVSGPLGRERVHFRAPPAERVPGEIAAFLAWFETDDPGLDPVLKAAVAHIWFVTIHPFDDGNGRIARAIADLALARSEGTGRRFYSMSARLRVERAQYYETLETTQKGDLDVTTRLAWFLDVLDAALTDAETTLSAVIRNAKTWETLTTRALNERQTRMVNRLLDGFEGKLTSSKWAKIAKCSQDTALRDIEALIAAGILVKEPGGGRSTSYALAL

SEQ ID NO: 3708 - protein, 257 aa, Methylobacterium sp.
MSGQVHYTVENGVGAVVFDRPEARNAMTWAMYDALGQICERIAREGNVRVVTFRGAGGEAFVAGTDIEQFRGFETGQDGLDYEAVIDRRIGQIERLPVPTVAVVDGWAIGGGLAITAACDFRIATPSAKFGIPIARTLGNCLSIANVARIVAAIGVARAKRMLMLAEVLSAEEAKAAGFVAEIAEPDVLDERVGVMVSKLLANAPVTMRVVKEGIRRVVGEGLPDGDDLVAECYGSRDFRIGVEAFLSKQKPLWTGS

SEQ ID NO: 3709 - protein, 310 aa, Methylobacterium sp.
MTETLVFASAVDPVEPWREALEGLLPDIRVRTPEEIGPQDDVRYALVWKPPTGFFARHPGLRLVTILGAGADALVGRDDLPAVPVARLSDPEMARMMTHYVLFAVLRYARNIPAFEAAQRAGRWHYVHPREAREIRVGVLGLGELGSAAALELARQGFSVAGWSRTPKALPGIDCQAGPDALIPFLARSEILVVMLPLTPQTRRLIGAAEIAALPRGAALINVSRGAVIDEAALVAALRSGHLGGATLDVFETEPLAEGHALWGMENVLVTPHLASVAIPASAARQIAENIHRVRTGHAPEHRVDLSRGY

SEQ ID NO: 3710 - protein, 151 aa, Methylobacterium sp.
MTAPIPILFLNGPNANLYGLDPSGTYGTESFPVLKARCERHAETVRVALDFRQSNHEGVLVDWIQEARGTAAGLAINAAGLTYTSVAILDALLAFPGPIVEVHMSNIWKREPFRHHSYVSRAATGVVAGLGGLGYELAVTALARLVRETRP

SEQ ID NO: 3711 - protein, 374 aa, Methylobacterium sp.
MNAQTSVPGSSSPLGPGDLFPQVAPRTQGRPSFAIDTLAGRYIVLCFFGSAADPQGAAALGTALRERARFDDSRASFFGVSIDPADEAEGRVRDLMPGFRIVLDFDGALSRRCGVTSEGEGPRPYRRCWMVVDPTLHVAATFPLGEAGEAALFGYLDALPEPAAYAGFEIPAPVLVLPNVFEPALCRHLVGLYDADGGSESGVHRAGAGVMDHSFKRRRDCTIEDPALIRQIQQTIHRRVVPEIERLFFMRITRMERYIVGCYAAEDGGHFRAHRDNGQGLTAHRRFAVSINLTGDFEGGAVSFPEYNPRGIKAPPGWAVVFPTNILHKVSQVTRGRRYAFLPFVYDETGAQIRQRELARQAEAAVRAEVAAEA

SEQ ID NO: 3712 - protein, 378 aa, Methylobacterium sp.
LRAFVRQAGAAGQGVSEPSSSRVSEQASETAQSRGSRRLWLHAVAYGLILCIFAADVVTPPDNVSICFAYTVPILLGVYTGPRAAFGLALATTASSLLGSFIRPPSGGIALSFVANRLIATAAQWLVAFLIEQRKRGRAIVQAHLADERRKAETGQRFVRILTHEIASALTAIGGQSARLAKLAPGIEPAEIVARTDKIGQAVARLDALVGRIQLAAEVDGGEIALAPEHTPCMEFLRPLHTEYEAGPELSLTLVCGAETIYGDRGLLYQAVSNLVSNAIKYSHAPAAVTVSVASSDVTAGPMITVSDRGIGIDADEVERVFEPYYRARNSTGIRGLGVGLHIVRHFVEAHGGEIRIASRPGQGTSVSLHLPPEKVAA

SEQ ID NO: 3713 - protein, 455 aa, Methylobacterium sp.
MHKLVATIRRSALSGPFATAFVTRFGSAVLGFLTLLAASRLLSTYEYGVYVFLFSIGSGVGLVAVLGQQNLLLKHYRMDGASAAANGVLVRHNLAWLGLALALLLGTGSVLVLAERNLPEPYDRLHLALAFAAVFAVSEYLQNFFRIHRRFALALLPREIVWRGGCAVMLYLGSLAGVLYGATEAMELVLALFVAATAFQVVHLVRLHGADMRPGRAGAAPSEQGAERAAWRSQSLFFTANNGLHALSLYLETVIVGAVLGMEEAAFYFVALRYATLLLLPVAAIDTVGLPMIAARIQAADWPGVQRLVARLSFASFLISVAGALAMLVVGPYALALFKPDFVAHIDVLSVLCLSSVVGAFFGPGVSLLMIGGGERFLLVSNAVLFGVYGLLLCGLADVLGMLGVAVASLVVTLSYNLLVVFWVRQHWGVDNMATAILRPSTGAAGGLVPRHAAG

SEQ ID NO: 3714 - protein, 145 aa, Methylobacterium sp.
MLRPRDAEAASAALKTFDFAERHPEWVFLRVEAGCRAGRCMTIIARADETSMTPELLLNVGSSVLFNDYSFGLSGLNAWSDIVFDGAGSSAVTVTRRGDHWVVGACSDCNSWAGVKEPEPSLPEPSPPKPERFEDFHRFIDGERG

SEQ ID NO: 3715 - protein, 117 aa, Methylobacterium sp.
VAYLYARGGNIGLRSFGAHEEGSGAVATVKGHRVTIAGGFTRSGKAPSRHLVRKLGGQVFVNTKGKKWRGHMTKVKSGVYIPSEMTSGSTLAAFERVAAAELPAEAAKALAALLPGK

SEQ ID NO: 3716 - protein, 146 aa, Methylobacterium sp.
MPLVCVTRLRVRALRFLPAFALHAVRTARQVRAAPGFRGGAILRDRDWAWWTLTAWDRPEDLRSYMQAGAHRAAMPHLAHWCDESCTVHWDAAELPGWAEADKRMRDEGRASRLRHPSPRHETLSYRPPRLSASAPLRPSPRAAGM

SEQ ID NO: 3717 - protein, 452 aa, Methylobacterium sp.
VAAGGSLTINGTGVETGSTARQGGTTGARPGFGAGIFFEGGPTSGTAATLTFGAGNQSFASQIADLNGAAGNTTTGNGLGGTGGVTALAKVGTGTLTLGAANTYTGGTRLDAGAISLGRLTSAGSGAITFGSGAQTLRVEASGTLGNTLTNFGSDGDTLDLATINPNGATYTLSGTTLTVREAAANGLDSNTFTLNAVPSGFQFVLASDGQAQAGTTVRLQAIPTPPPDPGPAGPTSGDDNLVGTSGPDTISLGLGNDTYAGGAGNDLVYGNPGNDLIYGNQDADTLYGGQGDDRAYGGQGDDRAYGGQGDDRLFGNLGNDVLLGNLGNDIVYGNQGADIVYGNQGADVLYGGQGNDVLYGGQDNDTLVGGIGDDTLVGGLGADLYRFDPNSGRDLILGFNQGEGDRIALGGQTYTVSSAQNGDAVLLLSGGGVVDLVGIRADQVNAAYFAA

SEQ ID NO: 3718 - protein, 161 aa, Methylobacterium sp.
MHAKHPARSGRIPSGRRFGLAVLLGHAAGAYAFCASGILFAALSDLATAEGRAALAPVNWGRLIEGICVFPLVTVVLALWAAVLMVPLTLLILPIAWLAARRLDADAAPTAALGALASLLPAVIAFRGAPVLDLRPYGSAAVAGAAFAGIVWLLCIRPRRG

SEQ ID NO: 3719 - protein, 113 aa, Methylobacterium sp.
VDPTALAGLLRDYGPWGMLALSLLANRMLLGWWRDCMHARIDERGTAAAALERQATANAATAAALDEVREGQMEVAKLVTGAMRGGESSDELLKEILRDIKNRLDALAQRGGS

SEQ ID NO: 3720 - protein, 311 aa, Methylobacterium sp.
MHSDPETLAPPQLSLLVCTRGRSAQLARLFASLESQSLGDFEVVLVDQNEPGVLDDIVARHRGRLRIDHVRSLPGLSRARNVGLARCRAPLVAFPDDDCWYRPALVEEVVRLFAQHPEADALTGRTIDAQGRESLGAFLKSDQAIGRRNVWSAGNSNTLFVRRAAAEAVGGFDETLGVGAATRFRSGEETDFLLRILRQDRAVVFRHALTVHHDQVGNQGRHKRASDYAHGFGRVLRLHRYGLPYLGLRLARFAASGARALLRGDARTALDKALWAAGTAAGFFAALPGSASRVPDGAPSWRFRAGLTRGG

SEQ ID NO: 3721 - protein, 237 aa, Methylobacterium sp.
MSSSTLIRQSLHESLVAPLREMILSGELRAGEKVPEEQLCERFGVSRTPIREALKVLAAEGVLQIMPHRGAIVARITEDQVNELFPIMASLERLAGKLACAVATDADIARVRALHDEMMRLYAVGDEPNYLAANRRIHDAFFVIAGNATLHAYYQQVLTRIHSCRFVMRKTPEHWRAAVLEHEQMIAALEARDGETLGSLLERHVTGTTVGIARDYIRQKAEESGADKTLGARRVSA

SEQ ID NO: 3722 - protein, 432 aa, Methylobacterium sp.
MSEPDTPDAGPDRSSAVAAFQKRRPGATIHLQQDRGASWMAWFFGAIVVALVAGLFLGRFARSESVRGYVSAASGLTRLDARAAGIVQAIDVKQGDRVTRGQRLMQIQVRDQTTGGVSTVTANLRSLRERKANLQRDRERLIAFLDATRGDRSETESNVASVTRAFDEQERALKEGLRQQEEMVARVQSYMNQGYATRESLNGQRRIALDYARQIAELRARRAELKQSTAERLTGQRTTATEKAAQLAATENELSAIEAQLTGYSALERLDIVSPVDGQVAGLFVEPGASVSADQILAIVGDAGAEPVIVLEVPARAIGLAKVGQDVVIKYDAFPFKTFGIAHGTITQIAGTPLRAPAVAMADAGEAVFDPTSLTRQSTYRIDVRPDSRTIRAYGVDEPIRIGSTLSADIVVEKRRLIDWMLDPIRAMRGRG

SEQ ID NO: 3723 - protein, 716 aa, Methylobacterium sp.
MSEWLRGLTGGRRRVRSLVQSETNECGLTCLAMVANYHRHDIDLAYLRALFPLSRTGMSLADIVELADTLGLDAGGYALSNIDELKGVQLPAILHWKGNHFVVLESVRGGRYRVHDPEFGLRLYERADMEQLFSGVVLEFAPRMDLKRVRAERKLTFREVFRATSGLGSTVWQISLVTVAIALLGLAMPVLLQIALDVVIPQVDLDLLHVLAIGLVLLMGFEAIGRWLRDYVTLRASTLLQLQFTRNVVGHAFRLPLNYFELRHPGDFVARVDSIEHVKAFLVGGLVTAFADSATSILIIGLMLYYAPAMAVVTMLTLVAVIGMRFLTFPKLNQATFGSLEARSEERARLLDGLRRVDSLKAHNGTELFAMRWFESFSRFANLDFRARKAGIDAELFMHLVIVLSTVATLYMGIVGVIANTLTIGTLYAFFALRTEFFERVNMLTSNLMHLSAMRVHFQRLDDVLGQEPESGLQDATFHRTLNREVRLENVTVQFGRADEPILRDVNLRIDLAAHETVAIVGVSGSGKSSLMKILASLHEPAEGRVLVDGSPLAQFGKREYRSNLGVVFADDGLFAGTVADNLALFDPAVSRAEMEAALVCVGLRDEIERLPQGYATLVSEEGGLLSTGQRRRLLLARALCRRPRLLLLDEVTANLDPTTEAALVESLKGIRAAKVFITHSERMLDQVDRVLRIEGGRLVEDARAPGAGRRIPARA

SEQ ID NO: 3724 - protein, 79 aa, Methylobacterium sp.
MHWPAAYAAYNVFRRRQYPALRCAVRQDRPVPGFIHGVIWEYGGTVMEERPPEGFQPADAQAATASAGYYLFRAPHGRA

SEQ ID NO: 3725 - protein, 416 aa, Methylobacterium sp.
MVSVKARLSAIISVLSVFALFTSGRDLSSAYERWGRADLVSHLAAANLMLSRGMSDVRFERGAAASALALDPAQMGANLQDIAARRRTVDGGLPQGLAILAADSVGRDAPEARELAERYAAWQRTRVEVDANLTKPVGARDPALPKRLADEAGALTAAAEALVGAMENQIRRRDAGLSNLLRVRELTWAARTFAGNAHLIVNDALAQKRVLTAKETLDFHVLDREAAFAFGIAQKIVESLSGMEPLKRAVLGARDGYFQGPFQARTRALLPALADLSLPRPTLAESRGQSTPALSSIMTVALTAVTELDGAASGIAAEARRDVMVQGIVMALALVLGLGGMVWVVRGVSRPIERMTSAMQRLADGDTASEIPYGERRDEIGAMSGAVQVFRQNLVRTRELEAETALARASAEEQRK

SEQ ID NO: 3726 - protein, 278 aa, Methylobacterium sp.
MDLRGLHAFRIVAESSSMTAAAERLGTVQSALSARIGQFEAAIGTRLFERLPRGVRLTAAGARLLPYAERMEILAAEAVQAARGTGTIGPFRLGAITVVAATLLPPVLARLLADHDRLDLQVATGVSRDLDAALADGTLDAAILGHRSARAGIVSRPLDSIPLALLRPTGVPIEAVGQAFTFAAGCVCRERLDRLLRERRIGARIVELGSVEGILGCVAAGLGVALLPEMLARRDGLAVERVGRLDLFIGSRPEAETQVRALLSAYRACRAAFEREMP

SEQ ID NO: 3727 - protein, 808 aa, Methylobacterium sp.
VTLGSGNDSVSLYTGVVGASAVTVADQILGGANTVTLRAAGDYAAAVFGAINLGVGNNTLSLRGAGTTVGGGAGSTGAAGSLDLSSVTGATAITKSDIGTWTLTKSGTNTNAGTLNVHAGTLALGTANALAAGSSVAVSGGNLSLGANNQSVNGVQVTGGTVGGSATLTSATAIDLQAGTVSAALAGSSTVIGLTKSTSGTATLTGANTYAGATTINDGTLAVSGGSAIADTGAVVVNTGGTLAVNAAETIGSLAGTGSTAAVNLTSDLTVATANGVSTAYAGGLTGAGSLRKTGTGTQTLTGSIANAGIDVAAGALVIGDGATAANSATLLVSSTNSTLRIDRTQAIMLANIVSGSGRLEKAGSGTTTLTGNNTAFTGTAAVTAGTLAVNGTLGDTTNQAATITVGDGTNANTGTLGGSGTIAGSVSIRNGGTISAGNSPGTLSTGNLTLATGATLMEEITGTTAGSYDRVNVTGSVSLAGTLDLRVTGTFADTVGQNLVFINNDLTDTVTGRFDALRLNGASVALSNSNTFSVDGRSYQLSYQAGDGNDVAIRDVTPAPFDPGPGPAPNTPTPGDDLIRGTGGDDRLVLGLGNDTFMGAAGNEIAYGNQGRDSLFGDAGNDSLYGGQDDDDVRGGLDNDVVYGNLGADIVYGNQGQDTLYGGQGNDTAFGGQGDDRLSGNLGDDIVYGNLGNDIVYGNAGADVLYGGQGDDVLFGGQGDDVLLGGLGNDTLVGGVGADRYAFAANPGGLDLILGFNQAEGDRISLGGQTYTLSSAQNGDALLTLSGGGTVDLAGIRAQQVDATFFA

SEQ ID NO: 3728 - protein, 74 aa, Methylobacterium sp.
MQAVQCKMARTALGLGVRDLAAAAGVSADTVARFERGDALKERTVTALQSALEAAGVIFIDENGEGAGVRLRKK

SEQ ID NO: 3729 - protein, 81 aa, Methylobacterium sp.
MPLDLSSDSIVLAGTCPVEEAEPLLEALRADPARPVDLGRLEHAHTAVLQVLMACAPCLIGRPADPVTAACLAGCGREARP

SEQ ID NO: 3730 - protein, 54 aa, Methylobacterium sp.
EDIIEPYLIQQGFVQRTPRGRVLTPQAFRHMGLAVPSADPGRQPGLFPDDGADA

SEQ ID NO: 3731 - protein, 421 aa, Methylobacterium sp.
MERRGRGLGPLRVLGAGVITGAADDDPSAIGTYASAGAKFGLGFLWIAPVLLPMMVVVVYLSAKIGRVYGKGLFAAVRDRYPPALLYPVAAGAFVGNVIEAAANLGGIGAALGLVVPLPVPVIVAGAGLLVLAFQFLGSYALLRRIFRWLALALLAYPVAAILARPDFGAVLRATFVPGMRFDAEFLAMLVACIGTSLSAYVYTWQSNQEVEEQVAEGKRSHRQRRGASDRELAATRRDVVTGMLFSNLILYSIILSTGATLHPAGQTEIESAAQAAAALEPLAGAGAKYLFAAGIVGVGFLAVPVMTTGAAYDLVQALDRPGSLNARPSEARLFYGTILVVTLVAVGLNFLGFNPMRALVWSGIVQGFSVPPLLLLMMLMTRDRRMMGERANGRLTAFLGWTTTAVTVAAALCLVATWIL

SEQ ID NO: 3732 - protein, 315 aa, Methylobacterium sp.
MRFTLRQLEYFIAAGQTGSITLASERIHISQPSISTAIAHLERELSVQLFVRHHAQGLTLTPIGREVLREAKALVEQAEGLYTLASEAGGQVRGPLSLGCMVTLAPMLVPELAHAFTTAFPATQIRYVEGDQEQLITGLRRSETEVALTYDLHVPDDIHFTPLVDLPPHVLVAEGHPLAEHAAVAMTDIVDEPMILLDLPLSREYFLALFMAEGLQPKIAARSAHQEVVRTMVANGHGYTLFNVRPRSDLALDGKRLRRVRLAGTHRPMRIGLARLKQLNRSRLVEAFETHCRAFISDAYIPGMVAPAIERRVPR

SEQ ID NO: 3733 - protein, 589 aa, Methylobacterium sp.
VTALDALLPGLRQRPDPAPKSDVRDPEAGSAREAGRDLGRDLGKDPGRDRDTAFGRELGRLERPQGRGDRGGRTAPADDAPAEAEAEEATERAPVAEAVADPQAALRALFGAARETAPGLAQSVPDQTLAQGAAQGAAQAGAQAVPAQAAALPGQVPGAATDLAALAERAARRAALAEAPVERPTLAVLAQETHFAPVGPSGLPAGPAAAPLAAPGTPSGAAPGARAADGSSAQPPGARAEGAALPGSGSVALRAAATAGPAQEPAPAGPAAGQGAPAAPLAATPAVPAAPAVPAAAAVAAASAASTAPTQAVTGTRAAPAREAERPAAGARPGTHEAPQAGSEAVAPAGARAGTAPDGARTPGQDAGASDRGAAPDPAPGETEEAAAVPGAAGGQAGLPAATLRQLAQAIAAEAPAAAAPAQAARPGPLAEGPLRLLTIQLQPGDLGTVTVRMRLQEGRLEIGLETGRRDTAELLRRDGGALTELLRGAGYQTDLVAIQAGGAELSGGQPGSGQGAGQGAQAAPGRGQPGFPAEGGQAGSQAGSQSGGQGGEGRNPDPSTRRGSEGPRTGEGGHDAYPDARDRRGLYL

SEQ ID NO: 3734 - protein, 104 aa, Methylobacterium sp.
VKRFTLAALAALTLGTTLAAAPANAQYYDDGPRRWDRGYEDRYERRRRDDYYEDRYERRRDFGRRGGSICVTSRGNCPTRPAPFNAPCGCEIPGFGFKRGAIGG

SEQ ID NO: 3735 - protein, 118 aa, Methylobacterium sp.
MTDYDRFDVLTALFPFIDVPVRKPRPVLVLSARSFNALHGHVVAAMITTGAGSRWPSDCAITDLTAAGLGHASVVRLKVFTLAETQIGRRIGRLSEADEVRFAAVLNPALCGANLTSP

SEQ ID NO: 3736 - protein, 115 aa, Methylobacterium sp.
MATTIIRDDILHARHIEGDPDLARRIRVLPDDGTIVLRVEGQPIRFRKVPDELADAVRPDPEDVPVWRALRARCGTLLTVEMAEGGAAPDPYLLSISATLTEWNSPEDAAAYDGL

SEQ ID NO: 3737 - protein, 371 aa, Methylobacterium sp.
VTDRLAILHVVRQFLPNRGGLEDFVANLAREQVRLGHDVRVLTLDRLFSEPGLRLPSAERIDGIAVERMPFRGSSRYPLAPGFLGRLKGADIVHVHAIDFFFDALALTKPLHRRPLVATTHGGFFHTQAHAGLKRLWFHGPTRLSARAYGAVVGCSDSDARQFAAIVPRGVPVIENGVDLAKFAGAASPVPRRTLLTLGRFSHNKRLDRLIALMRALRAQESGWQLRIVGVPSDLAVADLAAQIEAAGLGGTVSVHAGLDAAEVRALIGEASLFVSASEYEGFGIALIEAMSAGLVPVVHPNASFTDLAARHPGIALCDFADPAAAARAVREAHARLAARGRPPAEDLERYAWAGVAARYLDAYAQVRRAA

SEQ ID NO: 3738 - protein, 76 aa, Methylobacterium sp.
MTEADRNTTLVRLIRAYPALREELLDHWCEIVLMELRAAAYPEPDCPPVDEGVTARALERFRALEVEVLARSPQRF

SEQ ID NO: 3739 - protein, 75 aa, Methylobacterium sp.
MARTRIFQSGNSQAVRIPREFRLKGSEVEIFRRDGELVLREVEDRGLAAAFTLLTELPPEIDHRDDMPPQEREGL

SEQ ID NO: 3740 - protein, 235 aa, Methylobacterium sp.
MLKTAAALRHVAFEDLGSFAAVLAAAGYAVEIYDIGVHDLRALDPVTTDLVIVLGGPVGVYETGAYPVLAGELDLLRTRLAADRPTFGICLGAQLIAAALGAEVGPSGTKEIGFSPLTLTAAGEAGALRHLAGVPVLHWHGDTFAIPEGAERLAETGACVNQAFARGRTVMGVQFHPEVDATAGFERWLIGHANELAAVGLDPRDLRADAERHGPRLREAGRAMFADWLGGLEAS

SEQ ID NO: 3741 - protein, 71 aa, Methylobacterium sp.
MPRALPNRRGPRHHLLPHRPARHHAHGRRAHGAEAKTLRTSDLVLALLGVVLLGGLALLAAVALTAGAPAP

SEQ ID NO: 3742 - protein, 78 aa, Methylobacterium sp.
MPHFFFDIHDHELSHRDEEGSEWPDTASAQDQGRRLLADIARDEVFRHDPLHLSVSIRDDQRRVVATCALSLASTPVV

SEQ ID NO: 3743 - protein, 73 aa, Methylobacterium sp.
VLLVHLLDRFGKGWHRRLSLSALGERISTVTGHLAIGQRLLTSLSQRDEACAPEPDITASALYDGSQEPTLRA

SEQ ID NO: 3744 - protein, 266 aa, Methylobacterium sp.
MPAPNPAASPVPRSAGRPVPNASTTRDPLDSPLWPSMAERYLGGLPAIFDDRVAVALPPVTEDQTQVPLTVDARAIGPVEELLVIADLNPFPLTLRLVPKAAQAFVAFRMKIEQGTPIRAAARRDGLWHVGGRYLDAAGGGCSVPPVVEKKVDWPNLGRMRGRVWREADDLRLRLRMTHPMDNGMIANVPLFIVETLTVSDASGRQLASLTLSEAIADDPTLTLLVAGPETEALTVTARNTAGNDFRARAAVPPADAQSAEMQGRP

SEQ ID NO: 3745 - protein, 89 aa, Methylobacterium sp.
MREAVTGWLSRLGHEHMAAAAFLTGGPRGGQVPPMPTFTTFRKIGCVPAEPKPGHTCEFEIAVDGKPAAKDRARFYKAPNGSLEADAAR

SEQ ID NO: 3746 - protein, 87 aa, Methylobacterium sp.
MGLSAKPVRVAKQAPADAVEAFISKGGSVPTGAPDAAPKGAQHPLKFPPDSDLFERLERARAASAVKLPRNTWILQAIAEKLERDRT

SEQ ID NO: 3747 - protein, 309 aa, Methylobacterium sp.
MLQDASPSQSGGIRLIIVGAGASALTLASHLLRQDARAQVVLIEARAEVCAALRRGAYATILRAGLADAQAWLPPEAEAATHPLRLVRELVAHRDRLHVVQARCTGVAPTSQGIAVATEAGATWLGHAAAWAPPLSAVRCVPAGRRLRAVPASRARGRALRLDATDIPLGTGIAYLTRWLRATVRAADRRGIPWTEVLDGLRLHGPEVWRHLTPRSRATFLRHGFAAWNQLTTGLPDEARRASAAGPERGGHVFALHPVDLMPYAAQTNLLDLDIACASLAGRVLRRSTGADHPGALRRGAQPRLRASS

SEQ ID NO: 3748 - protein, 155 aa, Methylobacterium sp.
MRPRHPARLAVPVAWLLAAMGGALAADTAPATDLPDLSAARARIYAGDYGTAAAELGALTATVRHADLYNLLGFSLRKLRRFEEAARWYREALFYDPTHRPALAYQGELFVEMADLAKARNNLKLLRLLCHPAGCEEARRLEAVLAAADPSGTLR

SEQ ID NO: 3749 - protein, 547 aa, Methylobacterium sp.
MTGTIVLLDLAGWVALLLWGIHMIRTGVQRAYGADLQQVLGASLGHPLKALLAGLGVTLVLQSSTATGLMATSFAAGGLVELGPALAVMLGANVGTALIVKALSFDVAKAAPVLVLVGAVAFRRAGGPKGRALGRIAIGLGLVLLALIQLVATLEPFTSAPGLQAVLRAVSADAVIALLLGAILAWAAHSSVAVVLLVAAVAQQGIVPVETALALVLGANLGSSLNPLLASREAAGRRVALGNLLVRLVGCAAALPILSWSAASLTPVAGASRDAVADFHVLFNLALAAVGLPLLRPLSVLVVQLLPDRTAAPTEPPLHLDEGLAEPPSIALGLAARHALRMADRLEVMLTDSTRLLSGEEGSQERIRLAERDIDTRGAEIQRFLAKLDPEALSGAEQRRLAALVSFTVQIGHAADVLARNVAAQISRRHKQAGRPQFRADGDLTTMLDRLSTNLRTAASLLVTEDEVLARRLADEKQGFRSLEETRIASHVASLRDVASFEPLNRVADLDLVRDIKRINDHLVASSAYPILMKRGELLESRLKYAD

SEQ ID NO: 3750 - protein, 333 aa, Methylobacterium sp.
MDRSLLGQAVIEAEVDRLQRHAQFRKSPKLAALLVYLVHESLVGRGKRLKAYTIATEALGRPDDFDPITNSIVRVEMRRLRGTLQRIYAEAEPHQVVVELPVGRYEPVFRHPRTNGSADAAGKPDAHLSAALHESEERYAALVKASAVIEWRAEPNGHITRSLGWSERTGQEEEVYRGMGWLQALHPHDRGRTARSWVALCRAGAAFALSFRVRQQDGHYQPMLVRAVPLEQAGGTCRGWIGTMVEQIFPASGPTKADRGDLQQVLHRESEMARRVLKVAQQTVLDIDRKEIGRARAIIELNTRLRGTGVTIGEADRAAAASTGTSTPEIRPR

SEQ ID NO: 3751 - protein, 333 aa, Methylobacterium sp.
MISPIATPAASPLKEAGRGGRLTGNAAIAAACLALALLPVLLGASNYLLGLLISALILSGVSLAWALLGNLGGMVSFGHAAFFGVGGYTSALLAAKLGLPVLLAVPAGGVVAVVASLAMLPALRLSGPYFALAILAYAQIFRILATEAAWLTGGAAGFQRYPGLPTVFGFDLASRTGSYLLLVGIVALCALAYLAVRRSHVGLALRAIADSEDATRVVGVNSTFLKSLMLLLSAFITGVFGALNAHIIGFLEPDYAFSGIWSLMPIIAAIFGGYRTILGPIGGALIIYLFDQVVAKGLIAVGHQIILGFVLVVMVLAAPNGLLGLVKKGGRDA

SEQ ID NO: 3752 - protein, 523 aa, Methylobacterium sp.
MHKGTAFTQEERESLGLEGLLPTAIETLDRQVERVIGHLGAKPNDIERFIYLQELSNSNQTLFFATVMSDPARFVPIVYDPTIAEACLTYGHIYRRPQGMYLTRYMKARFEKVLRNWPVKEVRFICVSSGGRILGLGDIGANGAPIPIGKLQLYTACAGVPPESLLPIHLDLGTTNAALRADALYTGLREEPPEPGEVDAIVDAFMEAANAVFPGVCVHFEDWKGDDAIRLLKRYKDRYLVYNDDIQGTASVALAGIVTALQIKGEALADQRILFAGAGSAGTGIADMIVEAMRGEGLSEAEARGRIALFDIGGLIENGRKDLNASQKPYARDWKPTEDLTEAVKQIRPTILIGVSTVGGLFTEAVVKAVAKTCERPVIFPLSNPTDKAECTPEQAYQWTQGKALVACGVQFPDVTLDGRTFHPGQANNFYIFPAIGLAVYATKPKRIDDAMFIEAARATADQVSRADRDNGMLFPRQNNILETERTTATRVAESIFERGLATVKRPADIRAFVESLSYTPEY

SEQ ID NO: 3753 - protein, 150 aa, Methylobacterium sp.
LFRLIYKSAARHEAEEMFRPSNLPAILAASRRRNGEHGLSGVLVYTGAGFLQVLEGDRAEVLGVFERLLVDRRHRSVSVIEMGETERHLFGGWSMGFLGASPEIDARLEAAIGPVSGLERDPARRVELLRATLLLLVDAPISLLWREGLT

SEQ ID NO: 3754 - protein, 117 aa, Methylobacterium sp.
MNFQSTRHTDEPQGQATFGMANLRSQRTGLPFIVFISQRDGAQHDVRVKVSPNPKVRNAQMGSYALRPYRFVDGHRLSPGEERALEAWVEKNLDVLVRYWNGDIEYTEDALDLLEAI

SEQ ID NO: 3755 - protein, 109 aa, Methylobacterium sp.
LDDTPEIREQLSQAWRSTLDAAVANGAPPQAVIETMVEVAHACFAEAFGATAAASYLQLLAEQLRAGERCETDELVRGAPDERPSRSFMPADAEALIDPDWLTRKDLFG

SEQ ID NO: 3756 - protein, 264 aa, Methylobacterium sp.
MDIWQRIENDHANIAQLIHETPNALNGPGVVRSRERLLGDLIDELDRHGAALAASLYPPLRRDPSTARLVDELAHEQTAFMRDLRALARRGGGAGWLNRFEDVTYAVDQCLHRHVHELVPAARERLSGDAAERAGHAYVRAKIEALRGRGDLLAGAGLVGGTAAAGAAIAAVAGLALLAWRLAARPRQTSNRASDHRSERAFGGAPGRSGPSRWQPLSDRAADAAPGERRDGEDMRARQERLLDESLEETFPASDPIAPKRITR

SEQ ID NO: 3757 - protein, 514 aa, Methylobacterium sp.
MPGRIVTARVGGRALLAGLAAALIAGPAGAQTLDQAAAAALENSFVLRADRARQDGAEARERGAFDAFMPTVSLLGDKPLSSRFTYGPRIEPTQIGIDSTPRSAPRQYGISADLPLFDGFQRLHTLRSAQALTDAGRFITLSQRQQVLLDAAVAYIAVLRDVRILAAREAQIGAIMRIRDATARQFEVNDATRTDVALTQSRVQEAEAARDRARAELAAARLAFKRVTQIEPERMVPPRFPDRIPRDELAYAELVRAANPGLAAARLDAKSAAFQASATVSAVLPQVNLQVTHASTFGYSPTLDRITDTTARVIARVPIYQPGAFPKIDEASALARQRGYEVQDQELATITAARTAFAKRVAIADQLRRLTERLTFLRATIRGFEVERGAGFRTVLDELNLRAELADAEVAAAAVLTERDALSLQLSAAANLLDVGQSVPADRRFETLAAVRDPLTTAALRRGGAAASVKLASRAGGDRPEPAAPALRGRIDEPAQARFGLVPYGRTGWVALTP

SEQ ID NO: 3758 - protein, 317 aa, Methylobacterium sp.
MTEIDTRIGFLARRIAGLPLRMRRRVLRATFTLSGLMRGFEKSGHARLFQRVLRQSSREARRLEREVNLHNLQTEAEWLALLVRSVPALLRDTRHVAVSDPAALERVAATGRPVILTPLHMGAYVFSLASLMVRFFPGRPLLVLRQRDDMPLETAVIERIREVGVAMRFHQVTDRMGFLEAVRFARNGAVIVNFCDLDPAYGAPAPMPVLGLDTRFAFGTDTLARLTNALVVPLACTMEPEGDLVRVGPTFEVHASAPQERARVAALVRTHIEASLRARPEQWHLWSALQDYLPVTDTVTDAAARTGEADEQIRTAA

SEQ ID NO: 3759 - protein, 409 aa, Methylobacterium sp.
MTDRVAPAPRVTKRYAAKRQAILDAAVGHFNARGVRGTALTDVAASVGLVTNSITYYYRRKEDLAAACYLRGLEWHTALLDAAQDCEAATDPAARLRAFLAAYFRDLAAIEAGTQPPQVRLGDLMALPSPQSDAVFAAYNDLFRRARALFVPERADLGRAERGARTHLVLSVVHTARLWIDRYEPQDYGRVAERIADILLGGLAGPDSRWSAAGPPLVRAPGGPTEPFLRAATVLINEEGYRGASVEKISARLSVTKGSFYHHNDNKDDLVADCFERTFAILRAEQAAAEARGGPGWDRLTACARALVRHQFDPGGPLLRCAAVGALPDGLRSEVPARLRRLWERLAFPIGDGVADGSIRPVDPTIAAQVVSSAIDAACDLGRWCPSAGPDNAPDLFVRPLFLGILTAG

SEQ ID NO: 3760 - protein, 422 aa, Methylobacterium sp.
VTALDARAPYQSRAAHCALMGALLFNAALCFLNTIGLPVTGGTVAGAEACIVMLALAFALDARAGPWLVLAVLAAYAILILVLRGSSDPKMVRDLLIPVAFYNLGLRAPDIRDADRAALAAGLVVVAMGVFEYAALPVYEQLFNVVRYYIARGTMTAAEINGLTGSLFVSGVRPDARTILPFLGPHRVSSVFLEPVSAGNFGAILFAWGLYRPGMRGRALLFGCAAVTIILADARFGAVACAAVAAALLAAHRLPRLLWFALPCAILLALAICGFESTASDRTNNFVGRLLVAADIITGLPVEGVLGISPEKVFVSDAGYAYVLLQIGLVGGLAAWLLFVLMPVGSADAWRLRCAAATYICLLLVISDSPFSIKTAALLWFLLGAADGAGEDPGCSEEEVAASAPCAGALVSPWPGLSGIAR

SEQ ID NO: 3761 - protein, 210 aa, Methylobacterium sp.
MIGEFYVLAPSRQRYLDLLPDFGKTPERKTTADSAGIIGYIIEAAKTAVHWIAESWTGETLSENPDPTTASNESSLVQMAVIDNRQLVLTGDVGPDGLHEAATYAEALVGVLSPTFMQVPHHGSRRNVTPSALNRWLGPIKPQGSATIGSAFCSAARLDEDHPRQKVVNAFTRRGYGVHKTKGRHIYNHHGTQRLGDSLAPEPFSDRVEE

SEQ ID NO: 3762 - protein, 246 aa, Methylobacterium sp.
MRLAPGLVLGALLAPLPVAAEEVAVDAGVWPYAAVGKLNVVLGANRRAFCSATLIAPRLVLSAAHCLWDGPRARWVGPQSVHFVAGWRQGTYNAHAVASSYRTGPGYAFGTTPADLARDWALIVLSEPVDIRPVPLAPAHIDDTPENGRQEIRRAGYSHARAERMSAQGQCAVENQSEPPLLLHDCRAIPGESGSALLRMGEGGPTVIGVLVARRPEGTGARSLAVPVRSFREEADRMRAELSPVR

SEQ ID NO: 3763 - protein, 267 aa, Methylobacterium sp.
MRARSGLRGGARLGHRGAVDSLFRDGLEDAYEPGRLMGSFGDRIAAEYGFTRADQDAFALESLRRALAAQAEHAFARELVGVPSGAAQVEQDEQPGKAKPEKIPTLRPAFSPDGTVTAANASSISDGAAALVLADAAGAEAAGLTPLARFVGTASHAGPPARFACAPVPAIRALLDQVGWGVGEVDLFEINEAFALVPMIAMRELGIPHARLNVHGGACALGHPLGASGARIVATLLGALKARGLRRGVASLCIGGGEATALALEIT

SEQ ID NO: 3764 - protein, 130 aa, Methylobacterium sp.
MRVLLVGYEPEVVDFSDPALPPGLDAGKIRHGIRVALEEMRGRGWTAEDCLIRPDDQAGPALKAKLSSGAFDCLVIGAGIRGWPRHLSVFERVLNAAREAAPTVPIAFNTRPEDSAEAVERVCGGQPTAG

SEQ ID NO: 3765 - protein, 62 aa, Methylobacterium sp.
VAPPQTVEFGRGLSPRDPTGILRGQGISSRHGGIGNMGGGSGRSANTGVGLGGIGANQGARF

SEQ ID NO: 3766 - protein, 333 aa, Methylobacterium sp.
MQRRSFLIGAGAALGLGRTARADVVKVRIGVGGKPLLYYLPLTIAERKGFFKEEGIDAEINDFGGGARSLQALIGGSVDVVTGAYEHTLRMQAKGQDVRAVCELGRLPAIVIGVRKDLAGQVKSVADLKGRKIGVTAPGSSTALTAQFAMIKAGLKATDAPLIGIGGGAGAIAAMKKGEIDAVSHLDPVIAKLEADGDIKVLVDTRTDEGTRLLFGGPNPAAVVYTKQDWIERHAMGTQKVVNAFAKALKWLAAASPEEIADLVPPAYHFGDRALYVQAVKNSLATYSRTGIPSRDGMNSVLELVRTLDPELQGAQIDLGRTFEDRFVKRAME

SEQ ID NO: 3767 - protein, 282 aa, Methylobacterium sp.
MDGSRHGSAERIDARVPQDAAVALRDVTIAFTLKGGKRYVAVEGIDLAVRPGEFVAVVGPTGSGKSTILNAAAGLLKPASGRVDIFGQPLGGLNGRAGYLFQADALMPWKTALDNVAVALEPQGVRRAEALERARAWLGRVGLATFTDRYPHMLSGGQRKRVALAQMLIRDPEILLMDEPFGPLDAQTRQIMGNLLLDLWAQNRKAVIFVTHDLEEAIALSDRVIVLSAGPAARIVGDFPVPLARPRDISEIRLEPRFHDLYREIWSCLRVEVTRAYADGPA

SEQ ID NO: 3768 - protein, 70 aa, Methylobacterium sp.
MANTMNAQCQSCRYFDTHKATQSAGQSGDEGLCRFNPPVTQPGPQEHGLWPVVSASDWCGHYSPEMMAGE

SEQ ID NO: 3769 - protein, 420 aa, Methylobacterium sp.
VSALALAGLASAAVAQEAPPLPRADPAAMGFSPERLARIGTVLNREVAEGRMPGAVLIIAREGKVVFHEAYGFRDKAAGAPMPRDALFNIASMTKPMTAVAVLGLVERGDLVLDDPVSAALPGRFAEQRVASLDLAGKLAGTVPAARPVSLRDLLTHTGGLVYGGRGTTEVHRMLPAGSVAAAKELDGEKFLDALQAAPLLHQPGTVWDYGFGLDVAGLVVERQTGRPLDAHLAETVFGPLGMRDTGFVIPPGSVDRYARALPADPATGKPQVLEPDATRPTKFACGGGCAVSSAEDYLRFALALMNEGELGGRRVLSPVFTRAMLTDQLGPGVRNLIGNADPTRADYGFGLGLAVRTRPGVVRLLGSVGDFSWPGSSGTNWWVDPGRKLAVVFMAHTPGAARWRYRYLINSLVYQALER

SEQ ID NO: 3770 - protein, 87 aa, Methylobacterium sp.
MIRIVKHVIVETTEERDRQVEQVEAAIRARFPDATTEVVQGLLDEDRVVEARLPLRQLAEWHVRRPQLLAEALETDTDHAADIDRQD

SEQ ID NO: 3771 - protein, 130 aa, Methylobacterium sp.
MKRFRPIVMAGTILGAVLGTVLGLGPIERGTTGSAVALAAQGCGPGFHRNAYGSCRPNAYGVPGTYRPYGAYGYRGGYAYRGAYGRRVYGGRVYGGRAYGARAYGGRVSGGRVRAGRAYGGYHGGLRGRR

SEQ ID NO: 3772 - protein, 82 aa, Methylobacterium sp.
MRYRPLPRQTLVLAGALTGLVVALPRPAEAVVCAGGVYRAGCVGPRGGVAVRRGVYGPRRVVVRGGAYRPRTVVYRRGVRRW

SEQ ID NO: 3773 - protein, 275 aa, Methylobacterium sp.
MSESPTDPGARAWSCDRFEIDAVAVCDMPLTAVFEHLRGAMDDGRQVALGFCNANMLLKALCSASYAAALKKLVLLNDGVGLDLCSLLFRGRFFRENLNGTDLVPALLGGETRERTLFLLGARPGVAEAAARNIALRYPQHRVVGTRHGYFAPGEVEAVIAEINAVAPDILLVALGNPDQETFIAENAHRIDARILMGVGALIDYTAGIAVRAPAPVRLLRLEWLYRLMREPRRLGRRYTVELALFLGLIVRLRIAALVRGRTVVAAGGATSSAP

SEQ ID NO: 3774 - protein, 347 aa, Methylobacterium sp.
MRRAEAVPRAAALRLALALAGAAGVPARAAEPACLRGVNLSGPEFGTVPGRHGTDYAYPSTRTIARFGALGLTGVRLPVRWERLQPRLGAPLDAAELLRLDAAVVAAKLAGMRTVIDLHNFAYYGADRIGTGAATAAAFADVWRRLATHFRSEPFVAFGLMNEPHDIPAADWLPAANAAVAAIRESGAPQLVLVPGTIWTGAHSWESDTPLGNNARTMLGLVDPGENVAYDVHQYLDADFSGTSGTCPRGADALGAVERLTGWLAQNRRRAYLGEIGASMQAGCPDQLAAILAHVNAHPQQWVGWAAWGAGDWWPPAYHFRLEPGTGPVTAVIQAAARAAPRCGGRP

SEQ ID NO: 3775 - protein, 386 aa, Methylobacterium sp.
MQVDPVVVASAARTPMGAFQGELKALSAPELGAAAIRAAVERAGLSREGVSEVVMGCVLPAGLGQAPARQAALGAGLPEGTPCATLNKVCGSGMKAVMLGHDMIAAGSADVVVAGGMESMSNAPYLLDKARGGHRLGHGRVLDHMFLDGLEDAYDRGRLMGTFAEDTAQHYQFTREAQDAYALESLARAKRAAEAGAFDAEIVPVSDLASDEGPRKARPDKIPTLKPAFRPDGTVTAANASSISDGAAALVLMRQSAAERGGHTPVAVIRGHASHAAAPAWFSTAPIGAMSKLSRKVGWALDDVDLFEINEAFAVVAMAAMRDLGLPHDRVNVHGGACALGHPIGASGARIVVTLLSALARTGGRRGIAALCIGGGEATALAVERL

SEQ ID NO: 3776 - protein, 294 aa, Methylobacterium sp.
MTKFVLTVTCRSTRGIVAAISGFLAEQGCNIVDASQFDDLGSGRFFMRIGFLSEEGRGAEALAAGLAPIAARFGMETAIHDEAQRMKVLLMVSRFGHCLNDLLYRWKIGALPIDIVGVVSNHFDYQKLVVNHDIPFHPVAVTKANKPEAEARIMEIVRGTGAELIVLARYMQVLSDAMCAAMSGRIINIHHSFLPSFKGANPYKQAYGRGVKLIGATAHYVTADLDEGPIIEQDTVRITHAQSAEDYVSLGRDVEAQVLARAIHAHIHHRVFLNGNRTVVFPPSPGSFASERMG

SEQ ID NO: 3777 - protein, 120 aa, Methylobacterium sp.
LNGERLSEVSRLAGVLADQVLLEPVDGDTSLAKLTALGKAALLLQDYDRPIPDRVVDVLGRALRGTEEDGAAAGGTPGTDAAAGAEEGGGEVATMPAAEDDGGPRRLFPRLIQSLRPLRG

SEQ ID NO: 3778 - protein, 246 aa, Methylobacterium sp.
MLNARCLHRPELTATLASGDRKLDNLTAPHPRTFAAGTTIVPQGTEHGYVYRLRTGWVGRVRALPDGRAQYLMVFLPGDLFAIKSVFVAAHPDAVVALSDVTVERLEQHRLRDAFDTDPEIALRCTWQIVEEERRLHNWVVSLGQGSAEERIAHVLLEFSVRLGAATGTARALQYGIPLTQDQLGNVLGLTSVHVNRVLRRLREDGLVSIRNRVVSIHDAPALERMAEPLRDATLQATARPEVAAG

SEQ ID NO: 3779 - protein, 303 aa, Methylobacterium sp.
MFAPGRLTVGVFFPIEAFQRDQPTMRDQERLAVRAEELGYAALWIRDVPLRDPDFGDVGQVYDPWVWLGWIAAQTREIALATGSIVLPLRHPLHTAKAAASVDRLSRGRFIMGVASGDRPIEFPAFGVLADERDVLFRESIAVIRKVLGEEFPALHSRFGEMLGHVDLVPKPIGRLPILVTGSSRQSLEWIAEHADGWITYPRPLERQAELAARWRATAAGLAPGTFKPFAQSLYIDLHADPHYPPQPIHLGFRSGRKALLDFLVALRSIDVHHVVLNLKYGSRSAGEVLEEIGLEVLPHLNA

SEQ ID NO: 3780 - protein, 71 aa, Methylobacterium sp.
MRALPIRPPALQLRHARQDHAVCLRLAASYRTRLLCGEPDLAERHAEVIEHARRLRRRFAGLSLEARASPA

SEQ ID NO: 3781 - protein, 708 aa, Methylobacterium sp.
MPSCPRLASCVPASEAIEPLSFETMLEVLPVGAMTCDLRTFTIDYANTCSIRLLHSIRDSLGIDPDRIVGTSIDVFHKQPGYQRGLLSDPARLPHKARIRFGDEWLDLHIHALPDSRGRVVRALLVWAIATAEVAKENEEYKLLRMIDDMPVAVMTVDPTSFAITYLNETSKRTLSQIETLLPARPEALLGASIDIFHRNPEHQRRLLASPENLPHRARIKLGPEVLDLQVSAVTGTAGDYIGPMLTWSVITQQVAAEARIHQLAHYDTLTGLANRATFREHLEAALDRAQPRLGLLFIDLDGFKLVNDANGHLVGDALLKRVAERLRDRCGAPGVMVARLGGDEFAILIQDGDDAAATRLAGDLVEALVEPFHVADERRLQVGASIGVAVAPLHGSDSETLLSRADMALYAAKAAGKNTFRLFEPEMERRMTQRVRLEAKLRRALEREDELFLFYQPITDIRTGRVTAREGLIRWHHPARGWIPPGDFIPIAEESGLIEKLGAWVLQRACADAMGWEDGARVAVNVSPRQLGSGRLTQSVLSALVASGLPPQRLELEVTESALLSEHVDCLGELRRIRGFGVRIALDDFGTGFSSLAHLRAFPFDKIKIDGSFVRDATSRPDCAAIVGVVADLGRRLGVTTVAEGVETEAHLALVTAEGCSEVQGYLLGRPQPHPRDAERVARLSARDAAERPAAPPADDESASAAA

SEQ ID NO: 3782 - protein, 93 aa, Methylobacterium sp.
MRNPYDVLGVPKNASEADIKKAYRKLAKAYHPDRNKDDAKAKDRFAEANSAYEIIGDAEKRKQFDRGEIDADGKPRATGFEGFGGGFGGGRGL

SEQ ID NO: 3783 - protein, 491 aa, Methylobacterium sp.
VAEFTGGTGSDTFAGTSADDIIRGLAGNDTLTGNGGNDLIYGNQGDDVILFGTATGSALAGNSTLYGGQGDDSIDYTGSTGRNLIYGNLGDDTLTGGTGNDTLFGGQGDDVLNAGGGNNLLFGGLGNDTLTGGDGNDTLTGGDGDDSIVAGSGDNLIYGNQGDDTIVGGNGAAASDTVFGGQGDDLVDYSTAAGANAIYGNLGNDTLIAGSGGDSLFGGQGDDSLVGGAGNDLLVGGQGNDTIVTGQGGSDVVYGNQGDDSITYGTPAGTAGVDTVYGGQGNDVVDYSLNTAGGNVVYGNLGDDTITGGEGFDFLYGGQGNDVISGYGYLSGGQGNDSITAVGEAGSYLLGGQGVDTLTGSLAGNDTFAFAAGDSGITASTSDLITGFGSGDSIQVQVVGGVVRAENRAAAGRSFDQQRELANEAFANGQANAIFITGAPAADGSTAASGGYLFVDTDGSGTADMSIRLTNGTLGDGDGVVQRYTAPTPDA

SEQ ID NO: 3784 - protein, 39 aa, Methylobacterium sp.
MTKLDAKTLKAVTGGTACPPAKDPCAPACKDNGGKSKKC

SEQ ID NO: 3785 - protein, 39 aa, Methylobacterium sp.; identical to SEQ ID NO: 3784

SEQ ID NO: 3786 - protein, 57 aa, Methylobacterium sp.
MRTCLLLALATGLLGLGLRLVLPVIPADAAFREVVRYYGADRPPGESGNMRETSAPY

SEQ ID NO: 3787 - protein, 57 aa, Methylobacterium sp.; identical to SEQ ID NO: 3786

SEQ ID NO: 3788 - protein, 34 aa, Methylobacterium sp.
MQKTMKAFSYGMIGAFVAGLGLTLWGSASLLAGL

SEQ ID NO: 3789 - protein, 66 aa, Methylobacterium sp.
MSQRIKPDRPIWPSLPETEVRAVPSSGPAEAPRAAPLQGGSGPGAAGPQAQRVATATVEAFGSLAG

SEQ ID NO: 3790 - protein, 162 aa, Methylobacterium sp.
MSDFAGSYLGELRRLVGSRLLLVPGTRVVVSDAGGRILLEQRSDFRLWGLPGGVPDAGEDITACAVREVFEETGLRIRDPVPFGFASAPEHEVWTYPNGDRCHYFTLLYAARAEPGPLRRAGGENLELGWFEPESPPDLMPTMARTLDAYRRWGGSGTFQML

SEQ ID NO: 3791 - protein, 369 aa, Methylobacterium sp.
MEQTLTDGVPASTAGGADLFHVAYPRVLPERKPPGHKPAAPRYTLRWHKPVGTMVSQYHAVQRTDLDLEQRRAFFDLMIGSFAEPDGPCAHEMMTFVDEQGETNAVVASYWLDATAHARWSVRATASRWFADPERQTGPTGCWRETIAVPYDRHETIYSEPHYRIGLARTADAAIVPMTTNGYFGAARDRLPIAAIDPLDSPLASDPPRARTLESRGCHLLASTPHNMTALRSGQFWQAAQAAQLEDYVENMEPKLMRGMDYLSHNKTESGTLSLRVMTNLDDDGREKAETSVLAYFLSMEQLEGWAKSHDTHLDIYRHAIAMNRKFKASREVVTWHELFVMPACSAFEYVNCHPKTGVLPFVAAYRVA

SEQ ID NO: 3792 - protein, 128 aa, Methylobacterium sp.
VAADELRQFIERIERLEEEKAGVAGDIKDVFAELKGRGFDAKAVRQILRIRKKDHAERQEEEAILELYMGALGMLADTPLGRAAMSREFQDARITISGNGIDTIETTGAGIAQATARMELQASVGGRR

SEQ ID NO: 3793 - protein, 308 aa, Methylobacterium sp.
VGFVELGRQSLPAAEHRRAELGARLFGDRRLDADGRLACTGCHDPAQGWTVRTPAAPGQRGRAGRRNPPGLRSAAAATAWGWDGRHRTLAAQVLAPLTDPGEMANPGLAPVLARIGADPGYAAAFAAAFPGAGLTAGTLADALVAYLAGLDAPTRFDRFASGDGAALSDREVAGLHLFRTRAGCANCHHGPLLSDGRFHNLRLSAFGEPAQDLGRHAVTGAAEDAGRFRTPGLRHLRETAPYGHAGLFETLAGVVNLYDRGGGEIWARNAAEAARPLHAPAARLSPHIRPLGLTDAEKASLVAFLETL

SEQ ID NO: 3794 - protein, 171 aa, Methylobacterium sp.
MSDALPAPLAPPQPARPERPRLRTLTIVENGEPVQNAAFCPWCEDLHFHGLPPGQRGAHCVREDSPYRCTGYVLDVQGTVPSAGAAVPDAPRPRGRYLHQSLDQASASLRRVVLRHVLGRKFAGTWGEGKVGRAVVSVCCDHWTPATVPEWVGGEGVFRRKRCPAVGSGAV

SEQ ID NO: 3795 - protein, 103 aa, Methylobacterium sp.
MSASKPRPTLDSLASRFARKDPPAGAPAASAQPEAAEVAAPAPSTAEASPPASKPEKDKRVQILTRIDAPTRKRLRLIAVEQDRTVQEICEQAIRDFVARHSR

SEQ ID NO: 3796 - protein, 344 aa, Methylobacterium sp.
VIRLLTPLFAASVLAASILPGQAAEKLVVSTWGGSFRDLIDEAIASKFKAETGAEVEYITGGTIDRLNKAKLAKDAPESDVTFTTAHVGWLYVNDGLFETLDLAKIPNSKNLVDQARISPAHIGTWGYVYTIGYRADLAPKGMTFGSWADLWDPKLKNSLAAPDFDPSHIIAVSAILAGGDPATWEKGQAKLEALKPNFRAFYTNDANSQQLIATGETPVQVVLTMNAYYMKGQDVPITVVIPKEGGVLGIDTVAINKGSKKAELAYKFINIALDPQVQAKIAELKKGSPTVTNAKVDPETAKLPGVFTTAEQWKTQAINIDPKLRAEKTALWRKWFAENIMAR

SEQ ID NO: 3797 - protein, 52 aa, Methylobacterium sp.
MQDEKKTAAFQVRMRPTVKAAAEKAAADESRSLASLMEYLLIEHLKAKGYLK

SEQ ID NO: 3798 - protein, 81 aa, Methylobacterium sp.
MADQKTTGELRKAAIVTDDEINAAVEALLAKPKTGSYPIGGGYLLDLGVAAEAYLFSRGAPHAGSRAPAKAAHTEHGMASR

SEQ ID NO: 3799 - protein, 160 aa, Methylobacterium sp.
MSITVSVERPGVVTVASPGERMRIVAEPEQIATAAGQRVADLVDEALRLLDGAPDVPPEPGDEIPAAWEAGACLALPVTSLTEEQVARILASVPDDGSEPEWWWIERDGRIEVARVTFGDAHAGLKDPPQPWHAEVVGSERIVWPMEARLVVAVIPLTRP

SEQ ID NO: 3800 - protein, 81 aa, Methylobacterium sp.
MSQTDDPGGEPRTPSPAAPPAPRRNQTLSLAERRIVEAGEAGPHAPGHPDPRPDPGPETGGYDDHSPSRAPDNAKGGYGAG

SEQ ID NO: 3801 - protein, 80 aa, Methylobacterium sp.
VRSMKIIPALLGLFYGKKQRTGISSLPYSVRHRLGLPGGMAIAAMIDDRDADTAFRPRLIPTVSFADVHYALMLERIRKA

SEQ ID NO: 3802 - protein, 277 aa, Methylobacterium sp.
MSDTANTIAGAGFAATTAQAPRARRRPRVNLTGLVLPLAILVLWEASATFGWIDPVFLPAPRKVATAFWKMLTVQNLAQDFLASITIVGQAFLYGSTAAILIGIAAGLSRRVEAFFGPTFDTIRHIPGIAWLPLIVLWLGIGAPAKVLVIAKSVFFPVFLNTLQGIRNVDRNHIELARTLTLTRWQLVRRVVLPSALPSILVSLRYAAGLAWALVVVAEGLSGLEGLGFLIFRAQGLLLTDQLMVCMVLIGLIGFAIDRSMALVQRRLLRWKQGFEG

SEQ ID NO: 3803 - protein, 243 aa, Methylobacterium sp.
MATSALKPVVKLSAETQTLENLRNYLLSGAVKPGARLTEMSLAEQLGVARATLRASLNRLVTEGIVVLTPYTGWRVAALTEGDAWELWTLRASLEGLAAKLAAESMSPDRRTRIEQAMASLVVACGDGDVRSASDADFALHRTIVESIGHSRLERQYLQVEQQIRLYIMTSNALVGDLGQIVSQHEPLVEALLRADPELAAREAWIHNETEGRKLANWLHEQETDRFRAPVKRAMKPKGRHMA

SEQ ID NO: 3804 - protein, 308 aa, Methylobacterium sp.
ETSRSPALRRSREISMTLATLSLVVLASFLHAGWNLLAKRAAHIGPLFVFAYNLVACIAYAPWVLWRLSQGVAGGMTWTWAAVGIVGLSGLIHLAYSLCLQRGYQTADLSVVYPVARGTGPMLSSLGAVLLLGEMPSGRALAGLGLVVAGIGLIATQGRLAAFRKPGGVAGVQWGTATGGLIASYTVVDAYAVKALGIAPVVLDWCNNLLRFVLLAPIVAADPRGAWEALRGFRLVALGVGLLSPLSYILVLAALDGGAPLSLVAPMREMSMMVGALLGMIVLGETAGPWRLVGCAVLIGGVVLLSSA

SEQ ID NO: 3805 - protein, 388 aa, Methylobacterium sp.
MYMPPSFVSGLAFVTVPAQMRESGHSLALIGFQTIVMLPWLAKIVWAPYVERYRLPALGRHRTPAIAAAGVAVVIAMMATMTVLGDRYPVALLACLLVAATAAATVNIACDGFTIDACPAEQRSWANTAQVSGAYLGIALSGGLFLIVAARAGWTATLCGLMVLAIVLPLPFLLLSRRVDLGSVRPHRPDLRSALANPKVRIGLVIVLACSAGSRLSQSMIVPLLVDRGFTLSMVGLIDGVGGVLAGLFGTLCAGFTVRRIGTRRSLVWALAVQVACLATLAQAGYTGTMPAWLLGGAVMLMFGALSFASVALYAELMGYTSSRQPGVDFAVFQCSDAGLGMLAGPVSGFLATHLGYVGCFSIAAGASALAAGSAPWLVSRCRSIPAR

SEQ ID NO: 3806 - protein, 138 aa, Methylobacterium sp.
VTPHYMLDTNICIHIRRARPPAAMRRFAEAVPGTVVMSVITYGELAYGVARSQDPDEARRRLTALVRLIPVLPIEDRVGALYGKLRGDLAAAGRLIGGNDLWIAAHARVANLILVTNNVGEFERVDGLRIEDWTIDTA

SEQ ID NO: 3807 - protein, 226 aa, Methylobacterium sp.
MQASPARALVLSGLILAGTALSGAAAQTVIVNREERPDPWIINGCTIAPNAACPGADLRHADLRNADLGGADLTGANLARADLRGANLRGALLDRANLGGAKLQIAFLQGLKARGASFVGANLDHARAAGADFSGADFTVADLEMVQAKRAQFVGARFVNTDLQETKFYEANLADAVMEGAKIRFAIFQDAWMKGCRGCPETWQQGKPVWDVYPEAGPPPATGSDP

SEQ ID NO: 3808 - protein, 114 aa, Methylobacterium sp.
MNRYDTSSTSPAEMRAHIETAKANREHIEESPDPEAELRGMVRGCDLVWGVWPDRGPGTRLGHGLCIVKGTLMMEAVIEGDLRAQVAITTLWFPTFEAARFAFDRDGDGLLLAA

SEQ ID NO: 3809 - protein, 338 aa, Methylobacterium sp.
MRIMVIGGNGFVGRPLTRMLADGHEVCVLDALRYGPPRFPPEELARLVMVPADITDPAQVAAAMRSFSPEAVIHLAAIHYIPECEQDPVLAARTNVAGTVSLLAACPPGCRFVFASSGAVYAPEARPHREDSSPVAPSDIYGFTKLHGEHYVRHMARQRGLAAVVVRLFNVIGPGETNPHLLPEILAQLIAGHRRISLGNLTARRDYIHVDDAARGFRAAALAGAVAPGDCVTVNLGTGEAYAVGEILSRLRRIGGADFTVETDPARLRAVDRPVLAADIARIRELFGWSPRHTIDTALADLWERPDLPPHLTAKYRPAPAVRPAARAPLAELLTPAS

SEQ ID NO: 3810 - protein, 305 aa, Methylobacterium sp.
VPVPERADRSDADDPAPVPGGDDRPFRLIADPRVAAAMRFAEARLDAPMTTAALAAAVGLSQFHFLRLFQAQTGETVSDYSRRIRLDAAARTLRTSPETIVSIALSVGYGSQAAFTRAFTARFGRSPANYRRGTRRAVAIDAARQRPVPIRSVGTIHCLGRRYLGLRPGEAEPWHDFLSALPPGSAARRDRRLLRVVHDDPRVTPPEQIRIDCCLVGTERAGEDRDLAARGFLPFEIVAGTYAAVGGTESGIGGAGDDLLDIWLARQGRYRLRGGAGRLEFRDAAAQPDAGETLVPIRALGTDAT

SEQ ID NO: 3811 - protein, 130 aa, Methylobacterium sp.
MTDPIERIATAAVPTPAGHYSQGTAWRDLVFVSGQLGPRPDGTHTADEPFETQVRQALANLLAILKEAGCGPERVLRVTAYLVGVENWPHFNRIYAEVFGEAKPARTVVPVPELNRGYLVEIEAIAARPE

SEQ ID NO: 3812 - protein, 232 aa, Methylobacterium sp.
LAWALEQVTQRDDAAEVMTRIVEAAANPADFQDPEHHQRVVDYLNVRLAADGMVLTKLDGRMRCLPISQGSHVTSHLSLAASVFRFDTVQADLKRAIDSADQDPEDAVTAASSLLESLCRSILIEMGRPLPDRKDIATLYKAVREPLGLSAARDDMPPEISDDVRSILGALNTIVQSVGALRTHAGDAHGRERGFKRIDGRIARLAIYTASAAALFLLETWERQTGRALRVH

SEQ ID NO: 3813 - protein, 194 aa, Methylobacterium sp.
VAKKGHDDLLDALAALPASLHWHLTLIGGGEMRAATEARAAALGLGRRVAFRGALAQPAVITAMREADLFVLPTKPAPGGDRDGLPNVLMEAASQDLPILATAFAGTPEFIASGTHGLLVPPGDPAALAAALAHLARDPDLRRRLAGAARARLVADFALDPGIDLIAARLAASAGLAPLPEVASHPARACACAS

SEQ ID NO: 3814 - protein, 793 aa, Methylobacterium sp.
MFRTAHKLVILAPLLLPAAGCLSIAGDACTDPDTTAGIAVVNEKDVTPRNCDGKFLSARNQRSVLYTGEDRPRLWTGEAPREGRDIDVRRVNAPPLGYDRAGSVTGYLGTLKLNYAAADEAVEADVAALQNSLGRRFDPDQKVAVDFRKATLDYVLKQMLGGALGLNYIAPEDLGGSVTFRTEEPVPKAQVLQIVRDILARNGLEMRSINGVFHIGKPELIGSIEATGQAGRVGERTTRILRLRKGAGSDLLALARQIIPPSIELVPTNNPDTILIRATAAEIDQAEKLIKGLVQTGLTEDRVAVIPLRQSAPEKIAGQLTEFFRSRNADPVSIVPLDGQQALLVSSKAPGMIDGVRRLAEAMDTEVRDEVSLRVIPLQHLVADEIAQRLAVIFGTGQGSGGGRPGTLAPPGARVGEALRDPAPLPRVSPASIEDGVAPPPYPYANGPGNGGPRGALPGEAAPGPSGGGIGTGQQATRIVADKTSNALLVYSNYSLFKKVREVLRALDVPPAQVVIEATVVEVELTDQLQTGVQVFLQGAGFVVGSGNIADIGIDGRTAATGSNTGGGTSGVGSTGSIGGGGSNGFGGVAAIGARIGNALRVDAVLRALQGVTKVKVISSPYLTVLNGKQARLVIGDQIPFAQRSQTANNLGNTTVTSEVVIKDTGIILDITPQIHANNSVALKVNQSVSTPVQSALGGALTPVISTRSVESDILLQSGRTVLLAGLIQDRLEQQEDGVPVLKTVPVVGDLFKQKVDNVRRVELILLLTPRVTRNASQIEDLARLLQEQVHTR

SEQ ID NO: 3815 - protein, 150 aa, Methylobacterium sp.
MLTNKGKYGLKAMLYLAGIPEGTRVGVAEIAEANNIPKKFLDAILAELRNAGFVHSKKGPGGGYTLARSAQEIRIGHVVRVLDGPLAPFPCASRSRYQRCDDCADEARCAVRLTMLEVRDGIAAVLDPLTLAAMRGLSGAADDASFFYQI

SEQ ID NO: 3816 - protein, 269 aa, Methylobacterium sp.
MTRGTRLLAALLASVALSGLAASGHAPAGEPAPPADAPLPEHFTLAVPDLPAAGAPDGRIYLDEGFEGDLAALLGEGLGRPLHLAVPTTGAPVPGRFDGVLLRLRPDDPLLASGAAVPLGYRSGLSVAMRSDTAIRRWEDLAGRTVCASAANRDGQRIARAYGAAVVTVRAPAVALMRLRTGTCDASIHDRALLDALFTSRAWAKFSATLPPVEPTLLALVPAATGPGAALRRAAAALDDPLAWRQRRARWGSTVAFEVYRDQVGGDCH

SEQ ID NO: 3817 - protein, 349 aa, Methylobacterium sp.
VRLAALGAVTLGFLGMVPSSRAETLPAINLQLTPWTVVARQKGFFKEAFEPIGTRQVNLIASGAAELLGAEAAAVGGGAIAIAQRMIYPATVHRANGLDGVVIWASEPSNRYRAPILARADNDAIKTVADLDGKKFGSSRISCYWSSPFEILEKAGLPLDSREKQGRVRYTSIDNSAVAISSVLSGATDATTAHLAAGAFTGAWLSGRLKVVGRSPDDGVYVNNAGRVTYFARRDFANKYPEVVKAFLAARERTREWTFDHVDEAAEIVARETRVPLEVAKFQITHAGEWEFMAGEPNADRARNAIRTFQAWYIEHGDDILAERKLTDQQIDAFIDGRFFAGGQYSIYN

SEQ ID NO: 3818 - protein, 258 aa, Methylobacterium sp.
MAAGRLDIRDVSKSYPQEGRPPLTVLSHIGFAVEPGSFVSLVGPSGCGKSTLLRLILGLDPDYTGDILVDGVRVSGPALSRGVVFQDHRLLPWLTLEQNVALSLENARWPASEKARAVREHIALVGLRGFEKAFPHQLSGGMAQRAAIARGLANRPEILLLDEPLGALDALTRVRLQAELQRIWRAEGVTMILVTHDVDEAIFLSDTVIVMGAGPGRVVERVTVDLAGERDRSGTDFLAHRRRILRAMDDAFGHRHAA

SEQ ID NO: 3819 - protein, 198 aa, Methylobacterium sp.
MRTEYLGHGMPNRVPLTLGTAIICLLLCCTVIGILMIPSALLATLSGRAAGVNRRWDREARRRFVGFIGADPHYIDSAVFKYEDGFRGTGIAYHDGKVFMMQAGHAVEVEWRDVRRWSYSVEAPDLLTTSSNDSQVLTHVTSDNLACAYRAAKNSGFTLQVASIDRPTWKFTTSDVSVCERWMEILSQVDERGGRLTA

SEQ ID NO: 3820 - protein, 69 aa, Methylobacterium sp.
MLESLKRRLRAWACPGCDQDCERLARAERLHAISVDAVKAARVKQARRTSDVRVVVQAALRRMDHQGED

SEQ ID NO: 3821 - protein, 208 aa, Methylobacterium sp.
MTARQPHANALRVIVSRVLSHVTLGCYMCRPSSAGLERISRATMEGRVKHSPLALANTFIARHAGGTGITHMKVQKLCYYVHGWWLAFDPEPFLTEGPEVWKFGPVFASLYAALSHHGSRPIILPEKARFDAAAPTVTEQGYLDLVDWVWNRYGQHSAMTLSDMTHAPGTPWRQVAERHQFKVPMHYRLPDDVVAAHFKAEAEALQPA

SEQ ID NO: 3822 - protein, 133 aa, Methylobacterium sp.
MALLHAELISPERTIFVGEVRSMVLPSVEGDMTVLPGHAPVVTALHAGVIFATDAEGTGRRAFIRGGFADIMPTQVTILAERVRPIEELTRDQLDEEIFHLQLERDGSSNPELRAEHDVSISRLESFKASLNL

SEQ ID NO: 3823 - protein, 345 aa, Methylobacterium sp.
MSGSEKSCDPLNEVPLKTEAMHKDDREHPVAKVAVTFPPPGMGRPTAGLRKKLLRASCGLIFVGLTQMLFQRAVREGRAKERPREVVLREIEKQILHELPVHWAGPTLTDAAEKFAAELSPYPTFKAFKDAHRERGRRHAAGEEEQEADKAWITEQKRILRLLGVAALQDECITAEQHKLGDEVRSHEDAWWEGKESRLEERLLLDAKRQETWRLSLPQMVEVAIHGHVHPADLWHTYELSTPMFDAALCAGWCRIGKDGPITLNGASWLAHYLRGRLSLDSTNQGEIEDYLRSRDLIMGAFNEQARTDLYLLQFNLLREVMAGVMQRRPFMIRVPVEMARPRAA

SEQ ID NO: 3824 - protein, 236 aa, Methylobacterium sp.
MLELDAVTVRFGGLVALRDVTFTVAPGEILGLVGPNGAGKTTLFNGISGLTRVRGRILFEGRDVTKLPLHRRARLGIGRTFQIPQPMQHLTVRENLAVAQVFGAGRHDPARIEEILAVMELQAQGDRPAESALALQELKRLEIAKALATEPRLLLLDEVLAGLESQAKRQFAAKLRELHRRFDLTIVIVEHDIETISGLCSRAVVLNFGEIIADGTPAQVFRDPRVIESYTGTAHA

SEQ ID NO: 3825 - protein, 222 aa, Methylobacterium sp.
VAWELWSERRFAEMARRGTGLLYATRLTLGLQRDLAAPCPTPTAKIPIEVRPLRETDLPHLFPEDRGALSRKERVELAARRFHLRAGIPTCYVALDRRTDTPCYMQWLMGASHNRMIQDTFPPRWFPELAPDEALLENAYTPAAYRGQGIMSCAMALIAERAVEIGARRVITFVENTNVPSLRGCTRAGFEPHLARIERRALLDTIRLRRFEPYDPARHAHR

SEQ ID NO: 3826 - protein, 99 aa, Methylobacterium sp.
MLRAALVLLTVLAPAGAIRAEGIKEYQIRRLLMLKTECTVSGLQVEELEGGASRFRAGCENVSHYPDGVEIQCPNTEDDRECRILTARREFPHLRALQR

SEQ ID NO: 3827 - protein, 142 aa, Methylobacterium sp.
VRWSPILATGLALPVGAAAAPAPEAALRPAFAQCRALSQEGERLRCYDRLAAILAPPRFQGRLTMQTEPFAITAPTVLRYESDGPIFVLALKDARGEVVQNLHIGGGGSATHTIAVPGTYALQVSGSESWRIWLDPVRDPTP

SEQ ID NO: 3828 - protein, 229 aa, Methylobacterium sp.
LKVSLRDPVAEEWYDHDQGSLAEIAFFADAGALREGAVVFDLGAHQAVVALQLAVRVGASGRVVALEANPHNAQVAGENILLNGARNLTLVHAAAAAKDGEIEFNESLNGQVDGGAGTHGVIRVPSRSIDSLMAEFGIPDIIYIDVEGFECAVLEGAGGALEQVKHWFVEVHGGVGLEKFGGSVDKLLAHFDAGRFERHFCRTDAGPFTPLEDARSLDGTRWFFIATRT

SEQ ID NO: 3829 - protein, 53 aa, Methylobacterium sp.
MQLITRFLKDRDGATAIEYGMIAALIAVVIIGTLQIIGTQLNAKFSSISAQLN

SEQ ID NO: 3830 - protein, 351 aa, Methylobacterium sp.
MTRRTRTRSTSPRLRAPLALLLAALAAGTARAEEARPPGISLHLPLACEPGRTCFVQHYVDRDPGPGARDYACGSRTYDKHNGTDFRVRTGAEARGEAGRVLAVAAGRVLRTRADMADGRVRGSDAAEIKGAECGNGLVVAHADGWESQYCHMARDSLVVRPGDTVAAGQPLGQVGLSGMTEFPHLHLTLRHGGQVVDPFAPATPPDSCDPAAPGRGGTLWEPKAAAALGYQAGSVLNAGFADAPVSMESVEAGAPRVPGAESGALVAYVRAIGLETGDVQSLVLTDPAGTVVAQSVQPALERPRAQSLLFVGRRRPAEGWPAGAYTARFRVERGGRVALEKTFGLAPRAP

SEQ ID NO: 3831 - protein, 450 aa, Methylobacterium sp.
MIRVLSAIVVPPHMSVSGGARAGEMLSAALCAHCRVDVASMMGSPEDPGPCGRLPVRTHLPPGLPWSRLPNRYRSLFYRSDIPGRVAGYDLVHLHNPMPALEMARIARAARAAGVPYVISTHGFNEVANGGSIYGFGPVRRAVWRGLVHAPVAAAVRGAAGILALSPADFDIVRAMGFRDGPKDGPMSGPMSGLTSGLASGLLEVVPNGVAVPEPDDPAADAALLARFALPEPDPDGPLTLMFLANHTPNKGLPVLLRSLRALRRPVHLVVGGERRPEIDYAGLVGGLPADQRVVVTGRLSDAEVGALMRRADLFVFPTLADTLPLVVFEAMAQGVPVLASAVGGIPYQIDPRCGQLVPPNDPAALAAAIERLAQDRPRLRAMGRHARARVAEGFTWAAAAAKAYDAYGRVLAAADTAAADAAAAAGSAGRRGIPAAAAHGPARRPAAGR

SEQ ID NO: 3832 - protein, 548 aa, Methylobacterium sp.
MVAGAAIPEQVFDAMSGTDRFERTAILVLGMHRSGTSAVTRVLSLLGATLPERLMPRAEGNPVGYFEPMEIVSIHERLLASADTEWSDWGAFPQDWYRSGSREAFLGELTEAVIRNYGDDGLFLVKDPRLLRFVPLWRDLLTGLRVRPAAVLPFRNPIEVALSLKRRDGFPQEHGFLLWLRHVLDAEFHSRDLVRAFVSYDRLLDQKRMATYGLIESLPFDWPRKTSAAFDEIAQFLDGKLRRNTASRDDLSLLAGIPEPVRAAFRAYEALERDPYDRVAMTALDAVRAEFDRTTGIMADTFKALRRQFEADQSEALAMRSEVATYEKRVEARARELLEEVTALKQQHAEVAALHAELQHRLADIDSLHGTVHAMQVEAARQNDAIRITADQRHEALQIEAARHRDEISAARAASGALERSVGDLQEDLLRLRGAAAYADYRREQERRHRWWRREKADPERAALCALVLRSGLFDPDWYRARYLADEPDRDPIDHYLDHGRAQRLSPGPNFDAQWYAETNPDVAASGHDLFLHYLQHGREEGRPPQRR

SEQ ID NO: 3833 - protein, 155 aa, Methylobacterium sp.
MSDTVLDRLAALGLVLPPVPPPRGAFKPYARAGNIIYLAGQICEWDGEVRFSGPVGEVYDLKVGQEAAQLCALNLLASLSLALEGDLDRVVACHRLGGFVYAKPGYPDVPKVINGASDLMFALFGEAGRHARTAVGVATLPAGASVEVDGIFEVS

SEQ ID NO: 3834 - protein, 163 aa, Methylobacterium sp.
MKRVLVGIAVPLLMAAGPQQTRSAPPPAPPLRAGAIPPGDAPGARDASALPRYGGGLLLESKAGAFDEIALPNAKLERRADEVDAHNNDLFLPPEPLTVEGRVTRMSYLLPEGRTALEVVRGYQQTVKDAGGSVLFECSRDECGGSGVTAARSGGSKTGLIHR

SEQ ID NO: 3835 - protein, 46 aa, Methylobacterium sp.
LSSIKIKPACDGTYTLYRDGDAVSSGLTLYQAQELAAVLRCLEPRG

SEQ ID NO: 3836 - protein, 189 aa, Methylobacterium sp.
MLTFSFADPSLSLAAELGDAVERVFAINTYDYLPGLERSNLLASIIIKSVRAPVVGPVFAALENRSITGGIMSGGFHDPRSLPSDLLDEYARVGARAGYSTAARKLLKALPSFVAARARYLSVTAPITLVWGDEDWANLRDRAGVAAALPLPEVITLDQTGHFSALERSQAWADIILARTARPKLSAVG

SEQ ID NO: 3837 - protein, 52 aa, Methylobacterium sp.
LRTPSHKTVQGDAQASAVREWRRSLAELPTATNGFNSDGIAVAIEGLLTLAA

SEQ ID NO: 3838 - protein, 145 aa, Methylobacterium sp.
LILPPFGATLLSTAGAVVSSQTWPARLSAAAGFFVLTGQRFVIEREPRILIHVSPGLTPAEPVMPLYTIDTDDGDLFVAGSLETGIDCPLKARMEAHRVLGSMTRYALPDGEHRVLQAIVRDDIGQEVYVATITSTGEWKIPLGA

SEQ ID NO: 3839 - protein, 61 aa, Methylobacterium sp.
MERRNDREVRWAAERHARESARNQAVLLWSAIRAERRADADPGARLRPILLAAMTDEMQAR

SEQ ID NO: 3840 - protein, 320 aa, Methylobacterium sp.
MTRALLTLALVAVSSILLGLVLDPRGYEVRVLCLVLLTASMAQSWNIVGGLANQISLGHGAFFGIGAYTSTILTIATGLSPWLGAPLGMLLAALAALLLSLPTMRLKGPYFALATLAFAEGCRVIANSLAVTGGSQGLSVPFAGNSWWMLQFRGAGGYVPVFVGLFVLTSLVFALLSNGRWGYLMRALRENEDAAEVAGVDTLRTKLLGSLTSAALTALCGTAFAQLTFFFDPDSVFSPSGISIRMALVAIVGGVGTLTGPLIGALLIVPLEEILSSTLSQYLAGIAPFTFGFVLVAVVILRPRGLASLPGLRWIEGRRS

SEQ ID NO: 3841 - protein, 172 aa, Methylobacterium sp.
MQDPDLLSAHRIGAALSLAGLAVLMLGEAGEPQPLGTATGCLVAALAAFAVDALRRGGSRRTRRPAAGRRRALLPGRQAAPAVPALSPAPAAPEAGPPEAVTAGRWAMPATQRDPRVHAALSMAVARFRSAGPPAADGGPGRGPDAGPDPGQDDARRAALADVRNRRLARRD

SEQ ID NO: 3842 - protein, 57 aa, Methylobacterium sp.
MLLALPFILVALAVLVVGVQILLVVKMADLFEAPRDARRDVRNVHARYPATPAGRYA

SEQ ID NO: 3843 - protein, 234 aa, Methylobacterium sp.
MRVMSQPVGLPEVVESDLVRQVARSLTAAIVQGHLRPGAKVSEAAVARELGISRAPVREAARLLENQGLLRASPRRGFFVRELSAADVDELYDLRICVERHAAVAASRRLTPEARVALRRQLDLMDTIAREDDPSTIVEADYQFHRMICEVAGNGRLLRLFDGLASELRIVIGLIGRLYDDPMKLARAHVPLLDAIEAGRPDAILAEVDHHLGVARREVGLLLQSLSPAKPDVL

SEQ ID NO: 3844 - protein, 311 aa, Methylobacterium sp.
MRCVLLSATFDLRALCPSALDAASDVIEFVDDPADSPETVRLALAWQPADDALTRYPNLAAVCSVGAGVDSLVTCPSLRPDLPVVRVVDPEQARAMSGFVLWHVIGHQRRFRTYAANQLARRWRYLAPPEASAVPVGLLGYGRIGQRVASDLMALGFPVSAWSRTPREGEPGGVAHHHGPEGLRAMVAGSEVLINLLPLTRETRGLIDAAFLRRLPRGAYLVQVGRGEHLVEAALLDALESGHLSGAALDVFATEPLPETHAFWEHPAVFVTPHEACHANERAIARTLRATAESVHAGRRPPDTVDTARGY

SEQ ID NO: 3845 - protein, 347 aa, Methylobacterium sp.
MSGHRPPNYLPVRPDWLAAGYEEPLKPELPIIDAHHHLWDRPGWRYLFEEYLTDVRESGHKVEASVYMQAQSMYRAEGPPAFKVIGETEFANGVAAMAASGLYGPTRVCAGIIGHVDLRGGTAVAAVLEDHLRAAGDRFRGIRHLTTWDPDASLTNPLSACPPGLLGDTAFRAGFACLAFLNLSYDAWLFHPQIDELTDLARAFPTTTIVLNHCGGVLGIGAYAGRREAIFAQWSKAIRRLAECPNVVVKLGGLGMRINGFGFEAGAVPPSSDQLAQAWRPYIETCIDAFGPARCMFESNFPVDKGSYGYGTLWNAFKRLTLQAAEDEITALFSGTAARIYAVPTRS

SEQ ID NO: 3846 - protein, 1088 aa, Methylobacterium sp.
MSSVTSALTSALYASAAQTGTRPDTVTADAFARWPVAAQAALVRSFGTGSPPSILVGQAGQRAIATLNETGTDVDVVQAPASLDTAPADLTREAFERWPGAAQIFYVRANGSGDPCRVDLGGTAPGGSTATLAETYGLANGVVLTDRGAPTAAEDALIKMPVAQLTSADFFTLSPDDQYAYFQKNGTSVSMPSGPAVLVLKLDTQPPNPTTRAILTLSSNGRPFAVEVQASDYPGFAGLTGSKIAQTSPVKASLFAAWPREIQRAYVEGRFTGATDPDTTDAFQPAFYPKVVVFTDGSKIASVTAPGAEVEMIDIPAGFGNGTTGLAAGTFLSWSPAAQLAFAREVYNSTSLPSFTLPGSTGAQALSVTLALSRNGLTLASVGDRATNLAVDPAALDLDLFHLWPIEDRVAYIDAKGGGTPRSLLTGAGTFLLSLGPDALPRLESVPTGFTTTPAALAPATFLGWSPAIRAAYLGQSGLAGVTETTVVDAAGNSVMQRSATIGTAPGPVLTATRIPSGDVVTTGSILAIDPTRGMGLPIPNAGTYGGAGGLDRDPNASSADALFPGLDGTAGRSIENKPAKVAAQFAKAPKDLAPDEFGTWNSVIQLEYLRKHGTASQGYALVIGPGPDGATATTAFMSESGTKVYTVGTLQKTDVGKMSSRDQAVLVTLDAFTKPLTGRAAALELTAGNAALLKAIDDLASAIALDPTPLKGGQTPMPLADRQVFLHQVAILKDKVAGSSIVSASSIQPQIDDLKARFERANAFATALPRKALTADPLKVEYETPALSLGEGIPPATAKISVDPDHNTKIDLSKFLTDQLGSVHPLTADSAKVINYSSPIKIKFYDGAGNQIKVSGSLNAVEISRLQAGVVQVNAPTLSTDGNQALQQCYRNLISQERQLLSLAESRASLAQTGKLAGSTQHLDVPNLVYLFQLQANLTGEAKLRADTEELNQINALVKLYGVAQNMVNRILKDNDSSGKGNISPSGGMTREEKEAGVFFAGGASHPIEIIYSNISHPNDGFGARPYERWGKLSTQLSERVTLINQESQIKMNSVNSSTKAKDRNFDLANNALTKMNEIVQKIAGAM

SEQ ID NO: 3847 - protein, 71 aa, Methylobacterium sp.
MWKLVALVQAQLPNSAHQARVHLLEQLYALEQEALERGADPGTLRSILATQAFVRRSDPLMGRMATPERPQ

SEQ ID NO: 3848 - protein, 414 aa, Methylobacterium sp.
MLASAMPAGLPMMRIDGMLLVNTNPAHGRALEVADAEMLSVAAAETVERFLEHRPDHRPTPLHALPAAARSLGVAAIHVKDEGFRLGLGSFKALGGAYAVIRLVLEEAGKRLGLALGPADLSRQDVRAVAAGMTFGCATDGNHGRSVAQGAQLVGARSAIFVHAGVSEERIAAIAFYGAEMIRCAGTYDDSVEEAARACAVNGWTVVSDTSWPGYEHIPGLVMQGYTALLREALREVPEPPTHVFIQAGVGGIAATLAGHLAVVYGANRPKLVVVEPARAACLIASAEAGKPTKVAHGEPTVMAMLECYEPSLVAWRVLSRAADAFMTVDEDDAVSAMNRLARPETGDPAIVAGESGGAGFAGLVRVVGNAAWRDAVGLGPEARVLLVNTEGATDPGRYRELTGLAPTDVACAA

SEQ ID NO: 3849 - protein, 75 aa, Methylobacterium sp.
MTSALDILTRSGTPSSLGRARLRAERQARDGTCVPAGAVGTVIEILGGGQAFVVEFVDPVQTVLTVRVEDLTGLE

SEQ ID NO: 3850 - protein, 152 aa, Methylobacterium sp.
MNVVNFAHGALFMVGAYVGVLLYGYTGSFWLSLVAAPLAMGLLGLAAEPCLLFLDEPSEGIMPILVEEMLEQFVAMKRAGTTILLVEQNVDLALDVCDRVYIAKADVGGKIATLGGRLMQATSRKLADAFFGTFAAELGTAGDPGVPAPAAA

SEQ ID NO: 3851 - protein, 254 aa, Methylobacterium sp.
LDHRAETHPPTPVWWRDDDAVAATPALDRLLALGETCAAPILLAAIPAHIAPSLGRRLDGAPGVRLAVHGLAHANHAGPGEKPAEFGPHRPLAALVADAREGLRRAREHLPQDALLPVFVPPWNRLAPDLAAALPDLGYAGLSAAAPRQAPPERVGLVRADIHIDPIDWRGTRSLADPDRLVDDLVARLGAGAPVGILTHHLAHDAALWAFLEALLPLLSGHPAVTVLDPRHLFARPPVDAGAAPWSRRPARAS

SEQ ID NO: 3852 - protein, 131 aa, Methylobacterium sp.
TALGDGKILFSASTAANGTELWVTDGTAAGTILVTDVNAATMPSFPSRFTALGNGKGVFVANDARSGFELWVTDGTAAGTSLLKDIYAGPGASSPAGFTTVGDGRVLFSARDASNGTELWVTDGTAAGTSL

SEQ ID NO: 3853 - protein, 1116 aa, Methylobacterium sp.
GGGGGGGIGGGISFGRGGAGGFGGGGGASSGFGGGGGFGGGGGNGGRGGFGGGGGGGGSARVGGFGGGNGGVGSGGGGGGLGAGGDIFVQAGATLVIVGGSLSGGAVSPGGGAGAGQAYGSGIFLQRNAGDPLPSLTLAATPGAPATFADVITDQNGAAGSTAHGAVGLSIGDATTPNTGIVTLSAVNTYTGDTTVQSGTLLVDGQIANSAVTVRSGATLGGSGTTGGVTVLSGGTFSPGNSPGLIRTGDLALTAGSTFVEQIGGATPGTDYDQTRVTGTVDLGGATLDLQRLGAYAPLLGQTFTIIDNDGADAVTGTFAGLAEGQDIVLGRYRFAISYRGGDGNDVALQVSGAPGPVVTASPGAAAFTESDNAAAVPVAVDPGLTVADPDAATLASATVAITGNFTVGEDSLAFVNNSATMGNIVGLYDAATGRLVLTSAGASATLAQWQTALRGVTYTNGSDTPTTADRTVSLTVDDGAFASPAVTRRVTVAAVNDAPVNTLPASLAVGSSGRAALSGLAVADADAGSGVLVTSLTVQAGTLTATSPPGGALVAGSGTASLTLTGTISQINAVLAAPDGLVFQGSPGTTTQLTMATRDGGHAGGPEKTDTDTASLVVDQARYAIAVAPASVSEGTGGPGNALTYTVTRTGDLSQITTVAVGFSGTATLGSDYTVAGTGTAGDGSYAAGLLTFAAGQATARVRVTTVPDGTHEPDETVVATISGPSQSGLVTTASATGTLVNDDAPPPSPGSDPDPVPVPGTWSGGRMTGLVTTIDPAAALAAALRALQGLPAGPDEAAVRAGIGAFLAGLPAGTTISVSAFEPIPGTGDIRIAGPTDGTRTIVILDASATPQGTPITLDDLGFVVLSGPPSLIGGAGAQMVYGDASAQSMVLGADDDTLHGGAGNDVVGSKAGNDLLYGDAGNDTVFGGIGADTLWGGTEQDLVYGNQDADLIYGNLGADSLYGGQGDDRAYGGQGDDRIWGNAGADRLFGNAGADLVYGNQGADVIYGNQGADTLFGGQEADTLFGGQDADVVYGNLGADLVYGNLGADVLYGGQGNDVLYGGQGDDVLVGGLGDDILVGGLGADRYVLGAGSGRDLIRGFDQAAGDRLVLGG

SEQ ID NO: 3854 - protein, 62 aa, Methylobacterium sp.
METRRGADIVARTLEALGGFGACVTDAADLPAALAAAQASRKPARLTVMIERVPARVIRRPG

SEQ ID NO: 3855 - protein, 77 aa, Methylobacterium sp.
AAAVEEQGAATQEIVRNVSQASTGTGEVTRNIAGVAGAAEETGASAAQVLGAASELSRQSEHLSAEVQRFLASVRAA

SEQ ID NO: 3856 - protein, 50 aa, Methylobacterium sp.
MSDDDRKPDDKPANIAPDAVKDPNEKTEGKPGEGPKGGGTQRDETDPGGS

SEQ ID NO: 3857 - protein, 133 aa, Methylobacterium sp.
MGDPPAPLAGLHILLVEDDYLVATELARWLRAAGADVMGPVARIEQACGLIDRRRPDAAVLEIRLEAEPGGGDTVHPLADRLDALGVPCLFVTGDPRLARLPAYGGMPCLEKPLQETDLIGELGRLLDGARAG

SEQ ID NO: 3858 - protein, 434 aa, Methylobacterium sp.
MTQHRRRGNPVRCAAAGIALAVSLGPAAAESGDLLHVGDRLKITVYEVVESADRPGAGEPQEAGTAPPVQAAYPRLDLSGEYVIESSGRVMLPLIGAFDAVERPVEALRAQIGDAFVRTFRRRPDIAVTFVQRAPVYVVGAVRNPGAFPFAAGLFVAQALALAGGDLTNAPPERALEIVRGREQRETARERLKALLVRRAVAKSESEGAALAADEGLIKLVGAETAAGLMNREQRLIKLRAQERSSARTVQERAVATAEEEVELLSQRLANYDAQVKARGDRLRIMEGLFSRQVVENERVVDIRRDYADMEGRRRDIEISLLQSRQRLEAVKRALEQGELDRRLALENEFVRVTGELREAERGFEAATTVASLLARGQGPEASEAAAVTYDILRRNGGGLETLHVGQGEMLEPGDVLRVQIGRPSEGVGKVAGK

SEQ ID NO: 3859 - protein, 324 aa, Methylobacterium sp.
MDLRQLRYFVAIVEQGSFSRAAEVLRVAQPALSQHMRHMEAELGLPLLHRGPRGAVPTEAGARLLTHARAILDRFAEIPDSVRGADRPVTGDVRIGLPGTVSEILSVPLIERVRAEHPGIRLRVAEAMSGYILDWLNRDAVDLAVLYNPAAPKGLVLRHALTEELCLFGRPAGGGDLPDGPVSLARAAALPLILPALSHGLRDLIEEVAEMDGVSVTPGIEIDSYARIKELAARGHGFGILPRAAVAAEVAAGIVRAWPIGSPPLRRRIYLAHAADRPLSAAAAAVSGHAWDLLGELVRAGVWPAELAGPDPARPLTGAAGAAI

SEQ ID NO: 3860 - protein, 145 aa, Methylobacterium sp.
MSAVIERRVLDRLIALGRATGRISSDELRAHLPTATMTAEDIAVVVLELEESGVEVEFEGPLETAGRPSPVRPVAELPPLPTAPAVAASPAPTVRAADPPASTSSAAARSGASWSGGRNTVTRAVIAAGALTVLVIAVVLLLVRR

SEQ ID NO: 3861 - protein, 74 aa, Methylobacterium sp.
MSFALALPVAEASLFTLGCLLIHALRRHADVVTGALACLLVLVTLLLAVAGTPEPVLRAHALALENGEVIQFLN

SEQ ID NO: 3862 - protein, 219 aa, Methylobacterium sp.
MIALRSLMTALPYNPAERRRAWAGAFAPYFDMAPKERDPAPGLLALTRHRFEALTLFEMTAPAQTFRRTPVMAAGQALDHLMVLFWLDGEGRVTWHGGTAAFGRLQGVVLNLAQPATLVVGPVQATGLVLPRALVGDRLPDLAALHGAVLDLASDPVSRLFFTSVQDLAENASAVRDDMLPQVTRAIATVAAAALCRLTAVCPTAIVPAPKRLLEEVPA

SEQ ID NO: 3863 - protein, 72 aa, Methylobacterium sp.
VSREELLGPATLTVWPHSIDAKAVEPREMASLVVALEEAATALRSGEGTPWVITSAGTMLPPDLLRNLLAAP

SEQ ID NO: 3864 - protein, 79 aa, Methylobacterium sp.
MPVLDDGFTYGGLVLGLAALALWLRLASRAVPNFETMLARYQDERVPSDTAPPSGLGRLVACATALALTFSAIGYAIPD

SEQ ID NO: 3865 - protein, 88 aa, Methylobacterium sp.
MTFARSTLSVALLLAALPAAAQTQAPDLTGTGGGPTTTITAPYTNREGVTKPPGDALGPRDMSSAAAERREERAIERIENSICAGCED

SEQ ID NO: 3866 - protein, 278 aa, Methylobacterium sp.
MALNLKQWLAGLFGLMLVLALAQGGLALVKLDAVADRTALLLDDTIPSVNAAHGINATIIRTRLWQFRYVTAESETARGESLAKVSEFTNDRDAQIEAYRARVSSAAEQTVYGDLQTKLAQLKPDWDRLRAFPPERHAEAMAFFRGPMNANYLAVSGAARALVDVNLAAAKTADAKVRAEQASATRATLLMLGVAVVIALGATVFSFLGVSRPIERMTSAMRRLAGGDTASEIPYGGRRDEIGAMSGAVQVFRQNLVRTRELEAETALARASAEEQRK

SEQ ID NO: 3867 - protein, 123 aa, Methylobacterium sp.
MLRVDERPQIQATTRAAPVLPRRPDRPERRTHGYRRAGTTDPFAALDVQSGRVIGRGKWRHRPNAACSRPLSVWSGRIHASIDQTDAEPEPFVWTKSADNILAGIRHFCQRTSHSDHSAGDAT

SEQ ID NO: 3868 - protein, 286 aa, Methylobacterium sp.
MSISIASPLAGIRDVLVGLTEEGRGDEAAASLGYGLTLARDAGAHLTVQSAALRLMTTGLPLCGFADELVGAENGRLAVLARKAAERIREDAEGAGVVCTAESPSLMYHEVVLRLSTRARLHDLTVLDTEPFAAMPDRDLMEGVLFGSGRPIIVVPTGWDTFRARRVVVAWDGSAQAARAANDALPFLRAAEAVAVVCVEETERLLSMVPGAEFAPHLARHGVAVTVDDRPVEVDVAETLRRATEQFGADMIVMGAYRHSRMREWFLGGATQSLLARSSIPLFLAH

SEQ ID NO: 3869 - protein, 200 aa, Methylobacterium sp.
MPMSIRSPLGLSVVLAALVLAQAGARAEPSAGTWTDPPAKSAAKSAVEPPEPPGAGVAQERGARSVGAKSVGAKSAETKSAETGSATPRAEPVKRKPVRAVRAPAPRRTVAARPVRRPEPVVRSATVRPVRVARPLHRDWPPAEPVYVAPRAYDPRDPRLERLWSAEEAGYLAVHGRHVAYPDGRTLRIYRPSRDDEDLD

SEQ ID NO: 3870 - protein, 74 aa, Methylobacterium sp.
VTLTDLVAAMQAREAARAARGEPPAYIVEADATGTSVTWSLPGHGLVRREPGGRCVRLRDGVEIPTTGWGYPAR

SEQ ID NO: 3871 - protein, 162 aa, Methylobacterium sp.
MEPMRKLRWEPPGGIAAEPARPDPLTSLVRLVRGPTARPDAPPVSPEDWTGLIDRVRLAAGRAREAEAHALEREQQMQELMRQVRAEAEAAEARVRAAEIRAAAAEARAETCLREAEARVEQAEARARTAETWLLRVHETIASEFAPVHRDLEPALDREAAR

SEQ ID NO: 3872 - protein, 89 aa, Methylobacterium sp.
MIKAGPFAVLAILAAGPALAQPATTAAPPAAGGTVTTQPNTTGNSPDVVISRGGTGAETATTNSAAGGNAGQPERGVPQGSANGGGGSR

SEQ ID NO: 3873 - protein, 91 aa, Methylobacterium sp.
MNAQAEAQGETLREQLGQKRAAIAAGVAAGGLSGTEAEARVADLLAGRAEPETADLRRLLMEYRDLEARPADEADVRLAEAGEVFAPEDDA

SEQ ID NO: 3874 - protein, 97 aa, Methylobacterium sp.
VTTRRPNPGPGGAVVPDPHAKEAGAMTINLSLIRSHMEVVGPDGSHVGTVDAVEGRRIKLTRKDPAAHGQHHSFDADLVAAVDDKVRLNTTDLAAGG

SEQ ID NO: 3875 - protein, 291 aa, Methylobacterium sp.
VGALLTSHADGPLAGRQPLTYKGQRVLTTELAARAFGASDKQLQDNYQNNADRFEVGKHFHKVTGAELRALKNQPDFVGLVGPQAPHLTLWTERGVARHAKILETDTAWEIFEALEDTYFRVREEARAERTAGPPVETSAREIRLMHKHALAIATAAGLAGNQLLIAANRVTKRGTGFDVLAEMGITHLVAPVNDPLVIPTKLGQDLGGLTPREVNKLLARLGYQWADKDHRDRNLWRPTPKGEALGAQLMDRERSNDTGAAQQLMWPLAATLEVLRAGLRDDAGDDGEAA

SEQ ID NO: 3876 - protein, 257 aa, Methylobacterium sp.
MNLFKQFDIYSLKARVFPALIAGLPTLALLFVIVPWDHFGMSHAIAAAMGAVLLFAFADMARHRGRVVQTRLGTGATPEQWHRGNPDVPEVSKDTFRDYMARQLKRPAPTIENEQADPARANDFYLSANAWLRDRTRDTRAFSLLFSENVTYGFRRNLLGLKMTGLVLNLLVLVFCSGILWFRPPYFAALPNMDEKLTFIIAAVVLHSAYLVFAVGKAAVRDASRAYGRQLILSTEALMKKAPAASKGVTPDGSKAG

SEQ ID NO: 3877 - protein, 146 aa, Methylobacterium sp.
MRCTLTLRTGEDPRPYAVLDRAARDLAAALVPVPSGILLLGAEHGRDVARLGALLAVHEAETGLADGALRIVPVLGTARAVLAAASFADAGPRLAALALDATALAEQALGEAERVQARAMAGLAAAAAGVPLIALARDAAGRLGDA

SEQ ID NO: 3878 - protein, 352 aa, Methylobacterium sp.
MTDRTDQEAESGRQAGRPRAPDDLPTRDENFRLLVDTIPQLVWRARGRGDWVWSSRQWQGFTGQSEAEARDRGWLAAVHPDDRARTEAAWTRAEAEDRLAVEHRLLQASTGEYRWFETRALPVGGSDGEAREWFGTATDIHDLKMAQAQQAHLLSELQHRVRNTLATVRAIARRSAETSESVEDYAMHLEGRLNAVSRVQSAIIRNPIGGLSLPLLVADELFAYRAHEGEDFTIAGPPVVVPARAAERLALALHELATNAVKFGALAQQERGSIAIAWTVEDRQKGPVLILDWTEGGLTLAGTEPQRYGFGMDVLQRMLPHDLKAEVVVAFRADGLTCRIALPLDAATPLPA

SEQ ID NO: 3879 - protein, 92 aa, Methylobacterium sp.
MPVLALAALLAGALVALPTPAATAGLDRGSPFYRAAPYVPPSAATFSAPAEAERFRPVHVHDAPPIPPGGRLPNQRAGPVRDHVVRDICIGC

SEQ ID NO: 3880 - protein, 252 aa, Methylobacterium sp.
MTEETGAPAGLDIRHLVVEEAEQSRMNGVHLVANRLAREQVRLGQSVRIVVLHPPARAVDPGVWDAPVEALPLEGHSLFGHLVQPAPRLVAGLVAGAGPGTLVHVHGARRPLLLAIGRELARRGIRYVVTIHGRYAHVADAGMRRAHRSTSLYLAMFERRILERAWFVHALTVQEAEAVRQIAPRARIAIVANAAYSSAFDAPPPPPARAFPSPDFPLFGFCGRYAAHHKGLDLLIGGLAAHRAAGGRGRLA

SEQ ID NO: 3881 - protein, 437 aa, Methylobacterium sp.
VALKLDRREPGVWISVGTHVAVVAAAIIGISAPALPEAQEGVPVEVITENQFSELTKGERNAEKPLSDAKPRADRQAEKFEEREPENAKVDSPTAPTRTADMKVANADAMALRMSEPDPAEERAKAEAKAAAEKAAAEKAEAAKAAKAAAAEKAAAEKAEAKAKAEAAKAEAEKREELAKLIEREEAEAAAEAKAKAKAEAAAKAKAEAAAKAKAEAAAKAEAERKEAEHQKQMAEKAEAEREKAEAAAKAKAEAAAKAEAAAKAAKAKAMADAKAKADAEAKARKQAEIADKFNAGDIKSLLASKAPSQSTGATGRDVQRVASLGAATGTSQKLSPSMRDALVGMLQQQIERCYSAPPGASQGVILPVLDIRLNPDGSLGSEPRVMRSGQNATDQSIAQAALRAVRRCAPYKIPAQYAPFYNDWKAINAEFEFTAT

SEQ ID NO: 3882 - protein, 92 aa, Methylobacterium sp.
VIVLLAGLWPGLAVALLLGLGIGALSGWPQDRAIPLGLGILALLLAGLATSGLVTGVAGLWLESGALMLAVYAVGCVLGSLARGQRTDPDGT

SEQ ID NO: 3883 - protein, 168 aa, Methylobacterium sp.
MPTIRRASWRPRKMFGYDVESYKTNDNWELELNYQFRNSDITPEAREMLLRLRLDIWFIRLPVEHRQIATLIKIDTHHRTTKELVESLDAAPRVYLTEEFQTRNDTRVGRSDMHGYIRYGTYHYSFVDGRVKEYTNGNQEFLWNAVRDYMYWSTVSRADKAALAAIEF

SEQ ID NO: 3884 - protein, 102 aa, Methylobacterium sp.
MARNTPKDRAAAAAALARIAEFLDVPIAGFYEPVPGSNGGAPADPARQAEIRELIRQFLRLHDPQARGRCLAYVRRVADEAGWQPAPVPGAAEETASRLKGS

SEQ ID NO: 3885 - protein, 489 aa, Methylobacterium sp.
MRTLPEDLPEDLAFAPAVTLLDLLARRAVTARALLELHLARIARFPRINAVIFTDPDAARARADAADAALERGERWGPLHGLPMTVKETNNVAGWPTTYGDPALARHVPARNAVVVDRLLAAGAIIFGKTNVPINALDWQSYNALHGTTRNPWDLARTPGGSSGGATAALAAGLVPLELGSDAGGSIRLPAHFCGVFGHKPTPGIVPNLGNERPGSLLDNDLVVSGPLARSVADLVLALDVIAGPAGPDAAAWRLQLPPPRATGLRGLRVALISDSPVAEVDQKYRDAILELGGRLRAEGAEVVADALPFDDHERHHAIYLQLLRGAASGRLPQAAFDEAVRRSAVADADASPYVSQTFSAYAQRHRDWIAASEVRAQLKRAWSAFFTRFDVVIAPAGVGPAFPIDERRPREERTLTVNGHRIDYNDQLFWAGLATLASLPATAAPIGRIDGLPVGVQIIGPYLEDRTTLAIAAELERLNPFVAPQELA

SEQ ID NO: 3886 - protein, 267 aa, Methylobacterium sp.
VSVAPAVAPEPPVLALSDVRFAYRGSEPPILDALTLDVAEGAFVAILGPSGGGKSTLLKLLAGLERPQAGTMTLAGTPIRGPRREIGMVFQKPTLLPWRSVRDNVLLPAAFASRASDAERARADHLIETVGLARAAALYPGALSGGMAQRVGLARMLMHRPQLLLLDEPFSALDAMTRERLSLELQRIWMEERSTALFVTHSIPEALFLADRIVVLAGRPGRILADMEVPLARPRTLDSLGAPEFARLARELRRLFDDSVAAGDTVR

SEQ ID NO: 3887 - protein, 363 aa, Methylobacterium sp.
MMKSPSRLRFSACLILAGLLGTHIACAQAQDRVKVGLAIPPSVTEGSVQAIAEELRLFGDENLQVEYVVLPGAGALLPQLLQRNITLALPLPETLLSAHKTGEPPLPVSYVYNAGPRNTLEIAVKADSGIKSLADLRGAAIGVGALTWGTIPQTRALLRSVGLEPGKDVQIVAVGVLGAGFHALRENRVQALNFNSTWIDLLEGEGTPARRLAFPPTFRRMIVNGFLAHRATLESDPGLIERFGRAWTKALVVCDANPRACIEAFWRRNPGVRPQGDTAGPLAANVRLLQRWIEPLLRDETGQARVPGAYDLDIIKAYIAEMRANGEFAADDIPVASYFTNALVPAYAAFDREALIARARALP

SEQ ID NO: 3888 - protein, 129 aa, Methylobacterium sp.
LGARIVPRPGSAGRHRRRRCYRRARRHGGAVAPPPETGSRPDLRPILLRPCATDDYLSDKTDILDLIRRRIKERALEPKDIRRTIRGWRPEEHYRVTCGFYDCDISQRRAYQLAAAVGLKRTKRLPFEL

SEQ ID NO: 3889 - protein, 81 aa, Methylobacterium sp.
MRPILLLALLVLPASASAQMMDGPVAGGAFGMSGADYFGDIHDRPPPDREAIRARANRHRLASAAKPRASKPRIPARRAPL

SEQ ID NO: 3890 - protein, 186 aa, Methylobacterium sp.
MLIGAGSLLCRGPATPPPAPRVDAQAFAPAAAAGVPTTPGRPPAALIFAEHFPVTSGAAWEPPVAARPVPAPRVAAAPVRRPVAAQAPARRPELVVARAAERAREPLPEPLPEPLAEPAPAPVAISQPWLVPPAAIPDVEGEEDGLPGLALPFAPAAQAVGEAVGYVRGRAAALGGSVSILVDRMR

SEQ ID NO: 3891 - protein, 83 aa, Methylobacterium sp.
MSLAASPDAGVSFDPFGEKLETPHAVGLPAASRDGAGHRAVAAAFWALALLLVGCRVYLSDYPVAQAVASAGEAVRTHLAAVF

SEQ ID NO: 3892 - protein, 30 aa, Methylobacterium sp.
LSLVIMLAGAVGAIVLTLAALPAADRFLRW

SEQ ID NO: 3893 - protein, 337 aa, Methylobacterium sp.
MNLKPGKIAALAAAAILTVHAPASADWKPERPVEFVAAAGPGGGTDLFARVVQSALSKDKLLDVPVIVTNKAGGSGAETFIHAKTSGGDAYKLFFGTQDAYALPLANKLSYSLKDLEPVAAMTFDPFILWVNPKASGIQDVKGFIEKAKAAPGTIKVGGAKAKEADETLMTLIEKAAGIDLSYIPYKSGSEAAVQVAGGHIQANVNNPSESVEQWRAGVQKPLCVFEETRLTDTTVIADGMSWSSIPTCIEAGLDIKSFAQPRTIWAAKGIPPEALAYYTGLFKKVAQTEEFKGYMARGAQIPRTLTGDELKAFIEQHRATYAGYYKTNGWLKGAVD

SEQ ID NO: 3894 - protein, 160 aa, Methylobacterium sp.
MEISRRTSEIATSAATALIGLIVCYGALENGIGWEESGPSSGFFPFCVGCLIVFGSAVTGAQATFRPAEGRPPFLDRERARAAILFFLPIVAFAALSVWLGLYVAMAIYIVYAMYVPGRLRLATSIAAGLAVAAVNFVIFEKLFMVPLLKGPLLNAVGIY

SEQ ID NO: 3895 - protein, 512 aa, Methylobacterium sp.
MSNISLLLDGFGVALSTHHVLIMVGGVLLGLVVGVLPGLGAPNGVSLLLPLTFSMDPVSAIILLTSMYWGALFGGSTTSILFNIPGEPSSVATTFDGYPMARQGEAVRALTLAFSSAGIGALTGVIVITLLSGWVANFALRFGAAEYFAVYFMAFASFIGMSSGSPFKTLVSMMLGFACATIGADTISGESRLTFDFEQLIGGVSFLVAVIGLFGLGELIMTMEENLEFHGVKARLSLREIGRAVLELPRYWATIVRSALIGCWMGITPGGPTAASFMSYAIGARFAKDKTRFGKGAPEGIVAPETADHSAGSCALLPMLALGIPGSATAAVMMGGLMIWGLAPGPMLFTTRPDFVWGLIASMYLGNIIAVILVLATVPMFAYILRAPFRIVGPMITVVCIIGAYTVASHTFDIWLALIFGVAGYVFKKLDYPLAPFVLAMVLGDKAEDAFRQAMLTSGGSASIFWSNGLVGTMMALGVLLLCLPLISKLLRETGIGFRRKALPQQREIGST

SEQ ID NO: 3896 - protein, 35 aa, Methylobacterium sp.
MQDMTLKLFSYGMIGAFVCGLALTTWSAAGLLIGL

SEQ ID NO: 3897 - protein, 305 aa, Methylobacterium sp.
VTLINLSLPGNLLGGTNVGGLVSIGGNNTSSDTIADIGIAANLPGANIVNGVTSLLTPEGNLLSVAADANVQVGTGAGDLVNGLIGNDLLIGSGGDDRINGGAGNDVLDGGEGGDLIYGNQGNDTLYGRFGEDYLNGGQGDDLIYGNQGNDTIAGSLGRDTVYAGQGNDRVDYSAFSDAQLIYGNLQDDVLIGGSGADRMFGGQGNDQLVGGAGSDTLYGNLGDDILTGGSGADRFVFAGPIAGQNSGADRITDFNAGEGDRIALNGQTATAFDSGGNTILLLSGGGTIQLDGVAAGSVQSGWFA

SEQ ID NO: 3898 - protein, 752 aa, Methylobacterium sp.
MPPDDRRERPLLNPVLTLRKEPVPEAAKGGGPSEKDIVQDRLSTQRRALSARLEAIAASGATAPHAGRIHLAVEMFEDSFAPSWTPRPLFTDGRRARLVAPARNGYLVEAEVAYLPSLARHIRTASAVDARVAISRVRDIRAYGADELLRGREIEALWDRATEVEGGKAFVLWLLPFRDEGARASVVQTLMRFETERAVVPSYSAVEFPLARRDGADALVTIRGDETNLARTVRRYRGAGHARGVVTVPSRDALRTIVLSGSSFRIDPVPRIEATAPGIGAEPTPPVPNASAQPIVAVVDGGLTAQSYAGLEAWRAHDLVPPGMADHVHGNRVTSLAVHAHAWNNRLGLPRLDCRVGTARAVPREGSNYPADPARLVDYLRALARAHPETKVWNMSFNAIEPEAEADLVSFLGDEIRSIAREHGILPVISIGNRRRGGTDQLCAPADCEAALTVGGRDHAGDGIPGGPCSVSLRGPGPDGMLKPDLSWFSRLRMIGGSQQTGSSFATPLVSSLAAHTFANLRDPTPDLVRALLINATELEGHDAALGWGTPWHDHFPWTCAPGSVTLAWRATMRPGFNYYWRDIPIPPEMVKAGKLAGKGQLTAILNPLVAEDGGPNYFATRLQVALQYGTRAGGTGNLLGSMREDRAPEREARADLAKWHPVRRHIRDFGKRGGIAFSGNTMRLHARIYARDLFQFEDVTSHHDLGEQDVAFVLTLSDGSDRSDLYNSMTQQLGTFVESAVVEQTVEIEQE

SEQ ID NO: 3899 - protein, 44 aa, Methylobacterium sp.
MEACIAAAERAHEALARLEEANIDAPVRGWALWGSTDIWGLPLR

SEQ ID NO: 3900 - protein, 103 aa, Methylobacterium sp.
MAASAAIPAVPLLGIDADDPVVASVFEIARKYLKTTDGNWNTETRLEEAQIDSLDFVELVFEIEDRFGIELNFNANEQAVSEMTFGDVVELIRTALARKARTA

SEQ ID NO: 3901 - protein, 396 aa, Methylobacterium sp.
VSAVVVSGLGVAAPCGLTTADFWASLVAGRSAFTPAQALPGSGIIAAEIVESADFSGLPIPVPGACDRNAVLAVAAAREAMADAGLTPGSVAPQRVAVVIGNGGGGLTSLDTQYERLFVENKRPHPFSVVRAMGSSSASWVSIAFGAQGPCFVVASACASGTQAIGVAAQLVRAGIVDVAIAGGTEAPLSRGTLQAWNAMKIMSRTGCRPFSRDRDGLVVAEGAGIVILEREAHARARGRKPEVAVASLGSGADAGDIVAPSADGMARAMRAALAEADLSPADIAYVNAHGTGTRANDLTEVQALRAVFGGALPPVSSTKAVTGHALGGAGGLEAVATVLAMTHALAPPTAHLTDPDPDLDIDAIPLEARAMPILAAMSNSFAFGGLNASLVLRRV

SEQ ID NO: 3902 - protein, 66 aa, Methylobacterium sp.
MSDRATQLARCLMEEGIRFPVGQDGKIAPGSIRTFLADRFPGISQAEVTRGVLIAIELAKLDRGLR

SEQ ID NO: 3903 - protein, 374 aa, Methylobacterium sp.
MAYDVFWFLPTSGDTRYLGTSDFGRAPTNAYIRQIAETADRLGYDGLLIPTGASCTDPWVTAASLATVTRRIKLLVALRTSITGPTLGARQAAALDEALGGRLLLNVVVGGDATELAADGAFYDHAERYAAADEYLTVWKRLMAGETVDFEGRHVRVQGARNFHPAVQTPWPPLYFGGSSPAAHELAAKHVDAYLTWGEPPEAVAEKIADVRERAARRGRSVRFGVRLHVIVRETEEEAWAEADRLISRLTDDDIARAQANYARMDSVGQARMAALHGGRRDRLVVAPNLWAGVGLVRGGAGTALVGSPEQVVQRLNDYAALGVDTFVLSGYPHLEEAIRFAELAFPLIAGKEPVTLRDSAQTGGAFDIRAAAR

SEQ ID NO: 3904 - protein, 548 aa, Methylobacterium sp.
MSVIRLPFMWERAQLTENGPLNAGEIAQMDAVVGYAASRGMQVILEPHNFGSGFGHLIGSAETPNSAFADFWARLAGHFAGRGNVIFGLMNEPHAQTAQQWLGSANAAIAAIRATGARQEILVPGSYWSGAHSWVSSDNDTVTGPGIVDPLNNFAFEVHQYLDSDSSGTHPNVVSAAIGVERLSAVTQWAEATHSRLFLGEFGVAQDATSLAALANMMAYMRAHPVWEGATYWAAGPWWGDYMYTIEPTGLGSGQVVDRPQMDVLELFLGSAAPQGGTATGAILSGTSGADLITLPPGSVTYRGGLGNDTVYGSVDADLIYGNQGDDRVVAGSSPGTLGRDTVFGGQGQDLIDYSNNGLGSFIYGNMGDDTLTGGSGDDVLYGGQGQDLIAVGEGRNLAYGNLGDDTLIGGSGSDTLFGGQGSDVITAHSAPGAGSLIYGNFGSDLLTAGSGNDTLYGGQGADTLVAGAGSDVLVGGLGADLYVLGTGTGRVRIVGFDQSAGDRMRIGGQTFSVGTAQSGDALLTLSGGGTVDLANIRAEQVSASFFA

SEQ ID NO: 3905 - protein, 771 aa, Methylobacterium sp.
MAVPETAEAGSRFEPFAVLSFQARIAEVCQRRLGAALDGYVAATDAANRAWIDAARPLTPLGAWGEAVSYWTDFTQRSLLFWDTLRHRGNDWLAHEAAGKPPLIAFDYEIVADARRYERPANYALARIAAPPDRPTDPDKRPYVIIDPRAGHGPGIGGFKEDSEVGVALRAGHPVYMVIFFPEPVPGQTLADVAWAEAEFLRVVRDRHPTRGKPVVVGNCQGGWAAILMGALEPKGAGPIVMNGAPMSYWAGNDAENPMRYAGGLLGGSWTALLASDLGGGRFDGAYLVENFESLNPANTYFGKSYNLFAKIDTEAPRYLAFERWWGGYFLMNREEIGWIVDNLFVGNRLASGRAEWAPGRAFDLRAIRSPIILFASLGDNITPPQQAFNWVADLYPTTEDLKANGQVIVGLMHESVGHLGIFVSGSIARREHSQIVDLLDYIEHLPPGLYGMKVEEQQVDGAVRYDAVLHEVRVEDLQELQKYARKDEVPFVAVEQVSRLNAAAYESCVRPVVEALVRPETAPVLRALHPLRARRWALSDLNPFLAPLGAWADLVRTHRVRRDEAGPLATAERRGAAGIMAGWDLYRDLRDAAAETLFYAVYGTVSLTARTEVPKAASPDRDTATNRVALDQIDEGGFTDAAVRAGLLVSRLGRNQRRVSTFKRIRALVGYDVGLLAMPTEAAARVVRRQAAIVEHAPDQALATLPSLVSRAEERRRLLDVLKRLASHLDLQPEQRALIPRIEELLGAATEAEAAPDRESVSQPIRRQAS

SEQ ID NO: 3906 - protein, 531 aa, Methylobacterium sp.
VIQSEAEERARIAADLEEAQRKAQRALAQLEARTREAEMSKARLEFMLDEKGHYVGERLPQMLKRYPMPAEEIAVVPVKRGRGRPRKDGSPAQPRSEAERTASRARRSSGNRAWDKRGRSAAFRLRVPAAISDLNDTGNMVTADASTQAAIALVPDRESPGPEPEARGPEVLQPQSVEPVVQPPLAAALILPALTREVGDLLGDVDNPDEDERGQIEAGTISDKVLDIFSAEALAERAKLRDPRRLPAGYDPSWADAWVRDPLAPLPEMVREFITFGTAVDKRPEDLTDEEARLLAGPAMFPIPEDFDPADYRGRPLPPFFTREKDVSAYEWKAEITRAGGTMQKLVARNALYIDEIREIERARRRMWPYAVARRDLIKGLMEGLAVGELSFEPVSMAPADLARSVRWLVFRWADHDWLQLIANADLDLYYTRILDKVPWPEGLSRRALLERFGKGVDLTSPLNMSSQDRPPLFLFEEVEWVYGTGFGIRAADGGRIDLPRVGIAPGPDFGAIDCTVPIERDPDVDPQAWR

SEQ ID NO: 3907 - protein, 33 aa, Methylobacterium sp.
VILLDLPDRPAVMVPEIEAIEQHLARLIDDLLG

SEQ ID NO: 3908 - protein, 236 aa, Methylobacterium sp.
MLETRNLRAGYGHITVLWDLSLTFREGALTAIVGPNGAGKTTLLRALTGLIPHDGEIRLGGERLAGKTWDLAGQGIVMVPEGRLVFRDMSVEENLCLGAYPKRCRGDVSSGLDRVYGLFPRLRERRGQMAGSLSGGEAQMLAMGRGLMSQPKILLIDEPSLGLAPVIVNEVFDIVARLKEAGTTILLVEQNTRVALSVADDVHLLRGGQVRLSVPAAQVDLDRLHDLYFAREAQSA

SEQ ID NO: 3909 - protein, 290 aa, Methylobacterium sp.
MIALILQALFSGLLVGSVYALVALGIAITFGAMRIINLAHGELVLLAAYSAYVIEARAGLDPYLAVPLALVVVAIVCTALFLMIDRIREHRELNSLILTYGIGIVITNAILLVFASDVRTTNSPRLQDATSIGSVYAMNGEIVAFCLSLALMVALWWWLKKSWYGRAVRAVSSNRAAATLMGISPVRTELVSFLVAGALASFAGVALYTMSVVQPALGHALTIKAFIVTVLAGVGSIPGVFLAAILLGITEALTVTLASSALQELAGMVLFLLVLFLLPNGLFGARARRG

SEQ ID NO: 3910 - protein, 87 aa, Methylobacterium sp.
MFHHVAVALLGGFLTIALGWRSLGLGALVLAPLVASLGTLAVAVLLDRRARRAAPAGSWIRDIEAGAPRAVANDRSTDPAALCRRRA

SEQ ID NO: 3911 - protein, 102 aa, Methylobacterium sp.
MGVASDMARATQEGGSAPDTATLLQDADRYDPLRIALRNARDAFDPDRAMRERRAPAAPLIWYIEDTPDMALPRTRAGSDARPRQPDIGAVRGDFDTAAGIV

SEQ ID NO: 3912 - protein, 84 aa, Methylobacterium sp.
MTQDPNSGAPAAPEDVPPPRRGPGRAQRRYRLDPAARARIGRGLRLLYAEALTQPVPERLERLVAQLGAARPACPSEQIEEPPR

SEQ ID NO: 3913 - protein, 263 aa, Methylobacterium sp.
MTQPAAVEILTSAAPAYGITPLLSTNGRLRAAVPVLMTDGSLHGYELEVQASGGRPYVREATLGARLPAFCPMRHINADGSFCLNWEPYESLALEATADGATWWGAVLQFLRLQERARRLRRWPDRREWAHGGAAVHQRKALEAAAAISPRLRDRLFQGRVAAVRSKGCSSRGSAVRLHVDGRTMARIFVKQRRPATLRQACPCGQDERPLTLRRCRDHADRLVEIVGAMQDMATAERAFWKSFEGKACCGTMKGCPLGTAKP

SEQ ID NO: 3914 - protein, 182 aa, Methylobacterium sp.
MQADGATVVGTWMWRCGDCHILDVGAAELLTGASDLADTELPAEALARRVLLADRPAVLSALERMGRERGVVVFEYRVWTPEGIRWLLSHGRVYPAQPGMPAHGHGVLIDITHRKPPPPEPAGPEETTPSALERAARHALGARAAVDEDGSASLRLLVDMFLLEVGRVIARRAGVAGARGLH

SEQ ID NO: 3915 - protein, 104 aa, Methylobacterium sp.
VFETDDPRPSETTGTSKFGTEHASGRPLPAAAQRTLDDVAEALGLATDLLGRIDSAAPNRDIAAASLAEASALLQAFIRIEDAATRQRCLAFVQAAAAEVQGRS

SEQ ID NO: 3916 - protein, 83 aa, Methylobacterium sp.
MNRDTHTAADAERALRALQRDPAASAYGAYLRRKGLIGRPDPGARMKILAILARLLGRGPDDPPPAPAGVIRFGRVLSQGIGR

SEQ ID NO: 3917 - protein, 82 aa, Methylobacterium sp.
MSSHHRAVALALAGLLALPALAAAREAHHGKTAAHQAAKPQSRAAIAASEGFTARMSRLDALMGGQQQQLAPRARSASALPN

SEQ ID NO: 3918 - protein, 117 aa, Methylobacterium sp.
MTEDLAPSRRPTARGLSFRRRSRIVPGPLRPAQTRTGGGVAAGMLTGALLGLAFLAAFTLPFVRVGGSAGEAEHKAARAAVRTSAAQADRGGAGGMAAPERAADRGVPDGPAGGRPN

SEQ ID NO: 3919 - protein, 278 aa, Methylobacterium sp.
VPSLSTRLIPPAMLDVIKRSPTLYGVGRKARFALGSRLGARPVAGIGRAHYNDFMLTSTAPDKVASYMAGAAQFVDILEAAVTEAGRDWESITRALEIGCGYGRIVRQLSRRLPGERIAVCDMIEEGARFTAAEFGAAQVPVMERAEPKPASAYDLVYLLSVYTHLPRAVVHANLADVARALRPGGIVVFTIHGQGSAEQAERYEQFWLDKPAVLAALAREGYYYARYPYYTADYGLTWFSRAAVEALVAEAAPDLEPLSYRAMQLDGHQDVFVYRKR

SEQ ID NO: 3920 - protein, 425 aa, Methylobacterium sp.
MRGLAAGLVGLGLATGWAGPAAAFQPPATVEAAQAGFDAARLEAIAAFVQRDVAAGKIPGMVLLVMRDGRPVLARAFGEQTPGTPMRTDSIHRIASTTKLFVTTAAMRLYEQGRFKLSDPVATYLPELAALTVYAGAESATEGDAPPPVAPQRAPTIHDLMRHTAGFTYWWIGPANAVRRNQRAQNLEGLYDLTGEEMLGKLAQQPLLYQPGSTFEYSIATDVLGHLLERLEGKPLDRIVAEQVLEPLGLWDTVWQVDDARAARLAEPSQRTRETDPLAWVYTWLDLRKAPKRFSGGAGLASTAGDVGRLLQMLANGGAIDGVRLLASQTVRLMLHSDHLAGIKGPRNNVDPGYGWSLVNPVRLGSGPHATPGAAGDVYWGGITGPRYMIDPAERLVVVALFQAPSLRGHYYAILRQMVYGAMTK

SEQ ID NO: 3921 - protein, 149 aa, Methylobacterium sp.
MPEADITRAQFFADDLLRWETRGPGDTANAMRRVAQRAALPFSKLWALRYRPPKAVASHVLAALQAAHAREVERQLRKLAHEVETTARIAPPSDPAVAAAAAALHAAQGEGEGVARPDVEAPRAAPATRSRPLKDHRDLPLWRALDEGE

SEQ ID NO: 3922 - protein, 99 aa, Methylobacterium sp.
VSEQNHFAVRLALAGFPGPYAVRASSEGVIVDRDGRPFEQVLPVFDSTGDRRATAVIACIALNRLCGFPDTAIVQGADHVEVAAVVSLQQTGRPAAAAE

SEQ ID NO: 3923 - protein, 61 aa, Methylobacterium sp.
MSALATYRISGSGGLLRIVTCRPEELMRLMHRIGIASYTAEVTTRPAYREMIDTLRWEEML

SEQ ID NO: 3924 - protein, 99 aa, Methylobacterium sp.
MARFIAIERETGRVYGDTGRFGSVGNVVSPADAVSLFDRQVGRAMRGFGYVKADSDAAQYDVYEIRAGDSGQASATDADARAAVREHGALAASLVTYNT

SEQ ID NO: 3925 - protein, 746 aa, Methylobacterium sp.
MSTPAASPKARLAIIGCGAVVDHHLLPALKRQGWAPSVLVDRSPERLALLAGRAGRRRADIATAADWREVADRFDAALVATPHTTHGPIGLALLEAGKHVFMEKPLATTGVEGEAMIAAASRKGLVLAVGLLRRNLTIAAWTRALVESGTIGTIRRVDAREGFVFNWATSSDALLRRDLSGGGVLMDTGAHTLDILGHWFGPMTPTRYRDDGASGVEADCVAEFLLDGGGEVRVELSRTRNLANTARIEGTHGHVEVALYRNEVVAGSPNALAFTHAGVSGTAMKPQLFPALFDAEMRDFRDAVAGGRAPLVGGEEGLASVRRIEGCYALREPLEQPWDAAHAALVDGLAPGARVVVTGASGFIGGRLVERLVRAGIDVTCIIREIGSATRLARLPVRLVKADLTDPAAIGAALRGADTVFHCAYDPRSRRQNLEGARVLIGAAADAKVRRLVHVSTFSVYEPFPPTPLTEETRDGDRAWIYVKDKLDIEGQMLAAAREGRVPTAVVQPTIVYGPFCKPWTNAPAEELIHGEVVLPDGGAGRCSAVFVDDLVDGMLLAATRDAAVGERFILSGPDTVSWGTFFSEFARALGVPGPTSWPLAEVSKQNQGFVRDVKLVLRNPKRIVQIIVRWPPARSALQAGLDALPKPLRALVDRYYFGSGGPVFGALIVPDPQKTALYTTRATAEIGKARRLLGYAPRFAFADGMRETTPYLVWAYADLVRAARRARGTSAPPAAPVGTPVADAR

SEQ ID NO: 3926 - protein, 37 aa, Methylobacterium sp.
LRVDRQGAARIGRQIVDLAVLAAGGIGLALPLILPLG

SEQ ID NO: 3927 - protein, 88 aa, Methylobacterium sp.
MTSELRATLLAATLLVGLCAAAGAAERPDGTAAPARGSGATGSTTSVGAGGLTGSGATEDGTRRTGGKAPAPATERGGSTAPAAGTTR

SEQ ID NO: 3928 - protein, 246 aa, Methylobacterium sp.
VSVIDYPLNRFTDMASLSDDEQKRLRSLGDAPVPYKRAATIRAEGDPAPCIYLMLEGWVLASMVLPSGGRQVTKVHLPGDILGTPSMALAAAAETLTALTDCVVAPVPLTRLRDLFVTHPRLAALFLMAVQVERIALMDAMAAMGKTDAREQIIGFLLDLHDRLARLGKASDGTFELPMTQEQIGEKLGMTSVHLNRSLRVLDAEGLLTRTGRLVRLNDIETLRGLSQLPRRQLRTDPEWLPVSQG

SEQ ID NO: 3929 - protein, 515 aa, Methylobacterium sp.
MTLLGDDIADLQRLLSEAQAKANAADPHALVRALEQAQQRLDRARGEAELRVVDERLQLAEKAFLRAYHAQRAAERAAGKHLSNGRNLNGESIGNLAMAMVGSDADREGLYKDLIGRTGADALSEKERARLEGAKKLGGDDFKEVLAELAASRGQEATQGKDIRDSRALLDNIKTDVASKLIPAVQSMRDGIIFMAGQGKLTAREISQRVAKAEYDERVGSVRDSYKDRITAQDNIIASIVGVEGMGLLSMTDEQKAQLEAAAKEKLRLERERDKKLKEMSGAYETTKKNIDAAAAAATQVEEQRARQVEVSRSRPGGNLPGITPIAVGGTGASDLFAGVIGQESGGRHCNADGSLVTSPKGARGISQLMPGTMRDPGFGVRPAQDDSREENLRVGREYLEKLQQEFGGDREKALAAYNAGHARVKKAVAKHGEAWLQHMPAETRHYVPTILGRVDSQQLPASHRELAASAGQAVTVNVEPLTVVHQNERGQEIQQPQKLNVTVSQAKPFNGQTR

SEQ ID NO: 3930 - protein, 127 aa, Methylobacterium sp.
MGGKRLHPDAVPTPGPWLVRGKADADATPTAAMLGIEPAANDQPGGWPYLIRQDRLIEPGACPLHLATGIQRLADAKLMAAAPDLAEILLRLVTAPDLRRADLDPHTQEVRTRAWAVLVRVAPHLEL

SEQ ID NO: 3931 - protein, 802 aa, Methylobacterium sp.
MSLVGLGLVLAPPEARAIETPYNAIEGSALAIAAYEASKEQCGYSERLGKAMADLDAFFARRHGYAWTRAKQSGPDMLIRMRNVGRVLGAQSDCVIYGKAIGYVLPAYLNAVDMDPLVMAELSTLLSGKDAAPGNRGAEPVPAPAPGSAAETVAELKRQNPNMNRSAEPEGFRSSLSRVGPNRDRGGAVAQAPAQQPSGVVPPPPGPPPQGQPTASAAERTALPPQGARPGEAPTVAPQGSTGVVANASRAIPLASAAGAATCPINTECRLAEPTFACNVDDATRLAQAGPGAGTQAGLAAVQGGRCETVAAGRLLRFEATASPQVVYATDRGVHVGYLPVGIFAPAGTADTTTCRAPGFCAIRPGPQVQACPTAENLALSTPEARTAAKCVTLSPGQVGEVVSVAAGMGPIAVGFGGNPPFLATYYLGRADLVGIEVQPTPTPASRGWCRPGDWCLIDAPALFCREKDAYERVAASPLGEARRAAIMAESSCRVLIRGNPMKPSALPVPGEGRKLIEVEHPVYRTGWTNAAAFKVVAYAPPIRYTARLSDIRVSAGRTPALTAVSLSAQGTRDASGTFRTGAKERAEFCKGYQSEDDPSALRACLAEPDTSLTVVANCEAKQVKLYGTLYALEERPHDADPDIHVDASRQWLFRDKASREWLDGTTASDEVSVATAFNALCPGTNPDAAFGIAYRDPSARYPRELHGRWFNDRRACLDPRRNEPDYDDYSYTEISAETQRSRGSEDRVNAVRRVGQGAWVIDESSKSQEDTDTFSTSAYALTRNGLRLMMNGNTSEWFRCQ

SEQ ID NO: 3932 - protein, 55 aa, Methylobacterium sp.
MTAPAPSDGRPDRPRLPARAWLLLILGLVLATYPAWRLLVFEPDPPLDALLRLRC

SEQ ID NO: 3933 - protein, 67 aa, Methylobacterium sp.
MEVAVLIFALLFAALGILGALVGLGELGHPVGAHGVQSYGWGLTVNAIALAVYFLFMWTQRYHGRRT

SEQ ID NO: 3934 - protein, 76 aa, Methylobacterium sp.
MPRYFFDTYDGTVVHDDEGRVMPDLNSARLEARHLLRDLLLDAAPEADVSRFRADIRDESGRVVVTATLTLAYADT

SEQ ID NO: 3935 - protein, 68 aa, Methylobacterium sp.
MVVAHLFRILSAVLFAAALVIAPLANPLLVSACLILGGTLAAWRGAADLGLLTGALGLARSAAVRHRA

SEQ ID NO: 3936 - protein, 89 aa, Methylobacterium sp.
MPMRLSGEEPRLDEGAAVCLTFTITDGHILVPCRVGHAALQDAFGPPGGNAMTIFRAHRDAVVDGAIRRYERSGAEGGVVTLAAADLTA

SEQ ID NO: 3937 - protein, 50 aa, Methylobacterium sp.
MNPLAIAVMLGILVAWAGLLAAALYLGNPLLLAIFAVVSVAMFIRWDVFG

SEQ ID NO: 3938 - protein, 124 aa, Methylobacterium sp.
MTTLLRGLALPALLAALLAAPLARPAAAASNTTVGVGSGAVAGALVGGPIGAVAGAIVGGVVGASTERPRRYRRVRARRSALPVRPVAQRAAPAAPRGALTPTVSAEPAPASTGSTGRRWTDPR

SEQ ID NO: 3939 - protein, 871 aa, Methylobacterium sp.
MNPELHLTRDDVRNFYTLCLGRPVESEAAAEGRRHQTALECASSLLLSGEFEAEILRPVLNGRALKHAGISDRTFRKIRAWAAQHGPAVFGQVVEDPAAWHKKWHSLLRGLVTSEPVRADFAARYAEHEAFCEALAEAAAHNEAIVAGVEEINAGRCRGYFVDVTDRSRHFVLQLRINGKTVAGVPVLEFRKELQEKYGGSGHDGFDIRFDDIPEILGLGGGTVDLIEPRTGFVLLEKHHVTFSNAAAAEQNDRTIETLRGYRSYVDGLIDALDGNRPQSVTSVAGYGRNRIFVRPPAAPPTSSRVAVVIDTRGVEPIEDSTAILREDLAALRAQTHQPVAIHLLQDAAQVGAGAEAERGAMSRFDSVARLRETLRAQTDLVVHLRPGERLEPDAIAWLAYAAERPGAHVTYADGEVERARPLSGIALDPIFRSALDIDLLLTSDTYDTPLCLGVSCLDTADLSEEADFRRGVLLGALERHGRCAFRHVPLVLSRGRGGRNAEAAARARATVQAHLDRVGSGAVLEPHVDALAAPLSERSRVRWPVQARRPISLIVPTRDSIDMVLALVSSLKECTRYLSLLRVHVISNNSVAPQTERALDVLASDEIVRISTFEGPFNWAGINDAAIRADDCAEIAVCLNNDMICRTQGWDELLRAQLARPDVDVVGGRLLYANGMLQHAGVAMTGGWMHEAMGDAPGHGLYNDRTRVAHECAAVTGAFMAFERQFYLDSGGFDAATFPITHNDVDFCLRAEKRGARILYDPEQVWIHFESVTRGLDSLDTAKTEMLHESHQALLSRLPRPDYLDLSVNPHFVRDARPFTAVAWPRRDTVLSWIDQQQTRNAAPSIAGIPAADGARDRPDATVETRARTA

SEQ ID NO: 3940 - protein, 399 aa, Methylobacterium sp.
VPMRAPLAWVEIAKGLCIGLVVLMHATLGLEEALGERGYAHAMADFAQPFRMPTFFALSGLFLGRALASGWRPFLERRVFHYLYFYTLWLLIQEVIRFPHLGGGTLAGTLNHVAWSYVEPFSTLWFLYALALFALVTRLVERVAAPAVLGVALGLAGSDVTTGWHILDVACDTYVFFYGGYRLAPQILAFGARMRARPALAAAVTAGWLLVNAVLIFTVVPTLGHTMVAEAPLVALPLGVLGVFGVIALATLLERSVAGPALAYAGYRSIVIYLAAFAPVAALRALMVRYGVPFDVGTASLALTAAGILLPLALERALRGTPAACLFVRPSAGLRAPATILRRGRSLLDTAAVASAASVASVAEAGTSVASALAAPPVHRGALVPAGAPLPLALGPRES

SEQ ID NO: 3941 - protein, 133 aa, Methylobacterium sp.
MKAGERAGLSAPARTVIAHAAYLTVAGLAFLLAPEGVARLLGVTAEPYLVRIIGLLMLCFAAYYGQFARHEDRPLIGASVAVRVCLAAAFVLLVMADLAPMPLLAFALVDLIGAAATALALRGRSTTGPLPAH

SEQ ID NO: 3942 - protein, 42 aa, Methylobacterium sp.
MHALTAQLLVMVAAVIAGVLVAEMIESPVRSWASRLAAGRRR

SEQ ID NO: 3943 - protein, 73 aa, Methylobacterium sp.
MQRRSRTPYSAGFRSETASERARHAVLNRFSYSGGFDGYEGRMTCPPSWRTSAFRDDQDRGARSAARDGSRNG

SEQ ID NO: 3944 - protein, 50 aa, Methylobacterium sp.
MIMIVGLVGMPILLMAVTLAADAMLKPYPSKDDVWRLPKVSSLRAMTFHP

SEQ ID NO: 3945 - protein, 45 aa, Methylobacterium sp.
MTLLAALALLPFAAAVHVSLVIALAKTFDGDAQNTGTAGAVPTLA

SEQ ID NO: 3946 - protein, 62 aa, Methylobacterium sp.
MPDGSDTPRPDETTEPAGDPPAPPRAPEGDPPPEPAAPPAKGGRSDELTKAGDAGDKLGDFA

SEQ ID NO: 3947 - protein, 112 aa, Methylobacterium sp.
MEPTPSSAIAEIDRFIEESRQLIARAEACRQSLIALGAREGHLLMATRTITAMGRIQATLLRQRAMLPQRAMLPEGAAPPEAERVPAVVVVARAARPWWALVGRRKAEARLS

SEQ ID NO: 3948 - protein, 66 aa, Methylobacterium sp.
MSRPALFLAAFALATAAFWLTILTDPPTSEAAPKDLAADAEPVSASALRVRFVPEELCGRFGDCPR

SEQ ID NO: 3949 - protein, 119 aa, Methylobacterium sp.
MRHMILGAALALLLPVAAQAEGDAAAGEKAFAPCKACHNFEKNGVGPDLKGVVGRKAGTYEGYNYSAALKNSGLTWDEANLKEWLKDPKGKVPGNKMVYPGLKDEKKLDDVIAYLKSKT

SEQ ID NO: 3950 - protein, 379 aa, Methylobacterium sp.
VEKSVSDPGRRPDLEWLKALAALEVVVCHSDLAVKHFSGSLIARSWYLPLSGIGVEVFFVVSGYLICLRAPAYANALSFLRARLLRLMPLYALFTGLAVAARLINPAWAWNRWDVSAGTIIGSFLILPQPHYPIVGVGWSLEHEVIFYALVALLILATRLAGEAPVWFGLALFGLGWCGALVGIAPSDAAWYLHPVSVLMTGFAAGWLYRCHEVDGRVGVAWLLMACLAVTVTLSLGTDPANTERSLRLTGASALVILFVALRDTILRLPFADRILFPLGLATYSIYLSHWFTMSALGKAVGRLRLPESAQLPVRLAVIAVAVGVGLLVYRLLERPLDRWLRAGVPIGEAFRQPFRRRRAMGPEPPPEAGIAHPIGAHE

SEQ ID NO: 3951 - protein, 116 aa, Methylobacterium sp.
MTLRPFPTLAVLLALVGPAAAQAPKPPAPPTLEQIERLEAGPRRRDFYLSPEAAESARAAEAKMEAMQRKMDARVRRATRSICEGCAGQAARRRDASAAPRDDVPGMDDPAQAPLD

SEQ ID NO: 3952 - protein, 56 aa, Methylobacterium sp.
MSPLPRLALAALAAAALAACSQAPAAPGPELSPPPPRVDAKTQLEYGGPPPRGPRY

SEQ ID NO: 3953 - protein, 76 aa, Methylobacterium sp.
MPKPRDGRRLPDRRSGRSCERGERPLAIAADRCIAAYEAVLELDDPDLRRLSEMLLLAVGKRLAREDGGALRHLMN

SEQ ID NO: 3954 - protein, 334 aa, Methylobacterium sp.
MTKPIDLADVRARLAAPILGRARTDPFTLDVHHRHPRIAAITFAPGQPIGYALAAHYPDWTDRTALANRLAAMRLFFGRLRDLEPDLAGSCDLWLADIPEAPGLAFSGAGTANILVPDAEFVAAEGYRAFRERVEAGFVDWGARDPALFWRGTMLGDPRKRLPSWRELQRARLCLAAAAPGEGVPLDAKFVGLPGDADRDAPGRREAEGLGLVAGRVPLEAFMGYRHAVDIDGNSSAWMGLFTKLLMGCTVVKVDSPLGHRQWYYDRLVPWIHLVPVSADLHDLAGVRAWLAREPGAAEAVAARGRALAAAITLDQALLDVAPRVIAHIRAPKA

SEQ ID NO: 3955 - protein, 384 aa, Methylobacterium sp.
VALLAWELGAGFGHARRLLTAARGLIAAGFRVRVCQRELWACAEEFLDLGVPNFQAPHHRSQLPPGTAFRARGYADMMAIAGYQSVEGLLPTVLGWDALIDAVQPDVIVADYAPMLALAAHGRVPLVAIGDGFVLPPTHRDRFPVLREGTRMADEATMARHAGLVLVSRRQTAGFSLPELIGGQARVVCTYPESDVYAGQRETPAAGPLTVPGGPLAPAAGGTVFFYLAADFPHTAKLLQALCDSRLPAEGFVRDAPESLRAALRANGIRLHDRPPPLSDALARAGLVVHHGGIGTIESCLAAGRPQLLLPRHFEQTLNAEVLVAQGVARRLPVPFTLAEARAQLAESAHSPDLPARAHALADALAGRLGSLDTLVAACRALAA

SEQ ID NO: 3956 - protein, 400 aa, Methylobacterium sp.
MRTVLLTYEFGAGLGHLNRLIAVAQRLQGCRLVFALPDLPLGVPLVRRTFGEAAEIVQGVVWTAPTAPESRQVPTHTFADVIALFGFAEMARLEALTAKATALLDAVKPDLVVADFAPTLRLASAGRVPTVVVGNGYTIPPGGRLLPPMRPWETMVGPASRAQEGHLLGAVNAVRARRQGAAVDFFADLFQGEHSFPCTIAEFDPYGTARAEPVVWPFNVPVIPEGPPVAERHGPAAFCYFQGNHPALAPTLAAAGSLGARAEVYVQGLDPQAVAARCARNVGVHRKPADFAVALPGTRVLVHHAGLGTAYAGVLAGTPQLVIPHNLEHAITARGLERFGSVVRVGVSPVPEPGTLTRIMKGMLADGDLQARAARAARDLAARRVPDPVGPIAAACAGFL

SEQ ID NO: 3957 - protein, 114 aa, Methylobacterium sp.
LIKRFCLALALAGGLVAAAPAASALTLPTAAGLVGATDSAVVEVRWRRHWRRHHRHRWHRHHHRRWHHHRRHRHALRHHRPLRFSVGQVHAPRVQPWRDPVRPVAGGRLTPRLD

SEQ ID NO: 3958 - protein, 64 aa, Methylobacterium sp.
MVAALKRAVRLRRTMRERDTRVEASGCAKARPLPVGEATILAERGLTARELIRMAQAARRARQD

SEQ ID NO: 3959 - protein, 300 aa, Methylobacterium sp.
LTPLFVPVGIRSADKAALLGRGGHIFLVGGTNRLLTEYVRADEDPVATGTAQAWLTLIERRRATFERLGVRYVQAIFPEKLTVLPEFFPEPVRTPGAILRRIEAGLASKPDLSASYVSTRHALATQPDPAATLLKTDSHFSPLGCWVVFRAILEHLGIVPGLTPAFGTIRAGTGDLAVRFFGIPILDTRTEADLDGLDATFRARAIRTFEYTPPGRFVGSAQSWHNPDAPIDASILVFGNSYCGAAEGHQGQMSWWFARWFRTYHFVWRADVPPGLVEKLKPDIVLCHTVERFLVEVPET

SEQ ID NO: 3960 - protein, 99 aa, Methylobacterium sp.
MRKFAIISAAALTLGTLATTAADARPRGYHGHGYAPHAGYGYGHRGRRGIGTGAAVGLGIAGLAAGAIAAGAARDAYARDGYYGRPAYGYGGPGYGYGY

SEQ ID NO: 3961 - protein, 465 aa, Methylobacterium sp.
MAGIGFELRRLSRRDQLLGPMAAVAHAALIAAGPWLYTILAIFLISAVAGPVVGADATATFRVLLIYIFSLSLVATAPVIMIGTRVLADALHRRHYADIRGLYCATLVGCAAATLALAALVLVGLSGVRAEAALVGIAGAQLVGMLWTALAFCGAVRDYRHITFAFALGLAAGAGLAIGAAYLRLGPVAMAAGVCCGFLIIFLWLTARFLATFPEPCESLGPARAALLDRLRASPALAVGALASAVGVWADKWIVWNGRFGERVDVGLIHAPLYDSPMFVASLTVIPALALFVTSLETSFFESYHAYFRAIERHATLRRIEEHVRAMEAETLRTLVGIMTVQITLCLIVLQTAPMLIQVFNLQFQQIDILRMGSIGALFQFLFIVCTTIIAFFDATRLYVALHLLFTACLIGATALVSSSRMETLALGYMSTCILLGLGSVLPFLHVLRTVNFRVFVGSAVGPKR

SEQ ID NO: 3962 - protein, 512 aa, Methylobacterium sp.
MWFEGLRQASRRLPIAVPAPTADICLVVEGCYPYVPGGVSTWVDWLIRGNPDLTFAIVALVADPSPREIRYALPANVVRFESLPLTVPLDALRWRDRAPPAVEIALADTLVALVNGGGLAALRDLVRLIRDPANHLSLGALMASQLSWRLASATYERLMPHASFLHFFWAWRALFGGLFAVVTAPLPPARVYHTISTGYAGLFAARAALETGAPTLITEHGIYTNERRVEILMAEWICDTVDKGISLQDERVDLRDIWIRTFEAHALVCYQACSRILTLYEDNQRLQRALGAPQERLAVIPNGIDLARFASVAPVGANAPPTVALIGRVVPIKDVKSFIDAVALIRRSVPGLRALVLGPTDEDPQYFEECCLRVAEHALEETLTFTGPVNIVAYMSQIHVVVLTSLSEAQPLVILEAGAAGIPTVATDVGACREMIEGRADEAPRLGPGGEVTRLVDPQQTAEAVAGLLQNEPRRRACGEAMRARVRQSYSSADALAAYARTYAAFLDGSGS

SEQ ID NO: 3963 - protein, 456 aa, Methylobacterium sp.
MTNARLLLLLVLGAVVTAAYLLSSGPEERIAKLVRDGRIGRAIIVAEGVLAQGRATPRMLTTLAGLYDAEGDPERAADLLEIHALVWPGEPDILASLAALYGRSGNAEGHVAALERLVAVRPSRETLARLAALHRLAGRFDAEFTVLDRAGDGDLLGAGDQERLAQLLVQRGRPQRAAELLARAEDRPGGQGERGRMLLFEILLETGATAEAGRRAADWLAEWRKPWLADTLLLRLAPVASAETTLALARTAIRLFPDTRFYLAKRLAEQGHGALAHTIVRGWPAPDAAVTEREIGGYVAVVHASGDPGLLRPAIAALGQAGFEEQAILAEAIEQTHGLPVLAAAWPDLPPEALLRRPLLGVRLARLGRRDDLVLWLVRSADLGALRPGEHAAWLSVLRAACGPFATFEILDRQRRRGELPGGFMAAYRQLAAQVGASDRQRRDLVSIGDGDRQVR

SEQ ID NO: 3964 - protein, 1295 aa, Methylobacterium sp.
LENRDGSTDPAKASYVIAFQSAVALADGAPIFWLNTDQNSNTGYQSFSGAATGAEYYVTLSGGLPYLYDPSTIPATGNAGYVGPITDYKIDAATNTIEFAIPRTLITDDRAGLDLKVFANSGVSLPSDFAATTYRINDPATLPAPGAKAQKIGIVYSATTANQYFGGTEAGQTAYSQLFMAAQNQATAAGVSFDVLSEADLKDVGKISGYDALVFPSFRNVAAGDVDAIQSALTTAVTQYNVGLITAGDFMTNDATGAPLGADPYIRMKTLLDLTRAGGTSTAEPVSVNATGSGFTGYQANELVRDYASMSTSWYGSADGTAPTVLATQTVTGATHDAVVATLTGGKNVHFANESLLGDNNMLQQAIDYVVDPASGPSLSLRMSRGNAIVASRTDMDQAKELSDVRPPSGPGIYDKLLPILAQWKADYNFVGSYYIDTGDGTAANGSTDWDYAKQKYYDPLLAMGNEIGSHSVTHPEDTNLLSSDQIKAEFQGSKNTIEANLKVPVTGAAVPGMPEYLRTSKDIQQYYNYITGGATLVGAGYPGAIGHLTPDDPKVYIAPNMSFDFTLVGFKGLDATQAGAVWESEWNTNTAHSEMPVVVWPWHDYGPTGWPVDPTASNYTTQMFTDFIARAYQFGSEFVTLSDLAQRVASYDASDLTYTYDTAANAVTAKLSSPDSGKFALDLGTGSTIKSVASWYAYDANSVFADRDGGIFTINLGTTADDVTHLSKIADRAELVSATGDGTNLDFTVVGEGTYIVNLKDSIGQNVEVTDKAGTKLAYTQSGDALSINLTGLGSHDVSIKQKTTPLPNLPPTVAQALTASVAEGDQPKTLDLLQGASDPNAGDVLAVSGLAYKLGSATVADAAAAGLSYDAATHTLTLDPRSALFDHLAVGTTETVTASYTIADGHGGSVGQSATFTIAGTNDAPTVANALTASLTEGAAPAQFFLLAGATDPDDGETAKLALRNLTYTLGTGAASATPPAGVSYDPNGYILLVDPGNAAFTPLAAGATQTIMLAYDIFDPAGLAVRQTETLTITGIDTPAPGGGGGGGGGSVPPGPTAGSDVLYGTGGGDRLSLGAGNDTFIGAGGADLIYGNQDDDSLAGGGGADTLYGGQGNDIVAGGQGDDRLFGNSGNDVVYGNQGNDVVYGNQGADTLFGGQGDDVVFGGQDADVVYGNLGADVVYGNKGDDVLYGGQGDDVLYGGQGNDILIGGLGNNILVGGLGADLYRFSANAAHDLILGFSEADGDRIDLQGQTFTLGTAGDGDALLLLSGGGSVQVAGVSTATFGNGAGYLA

SEQ ID NO: 3965 - protein, 80 aa, Methylobacterium sp.
MLGRLIASARSVATGTGAVRALLPSGRPRAPGAAIAPAPETMPDFPPMRPLEPPPARNDDVLQPVHEAVERDLRARGYLG

SEQ ID NO: 3966 - protein, 99 aa, Methylobacterium sp.
MRLGARSILLKLAAVFLLCAGLGVTVAPRVAEAAPLAVPSAVEAPASGLETVQYRHHHRHHGLHRGWHHRRHFHHHRRHFRPHHFHRHHHHHRRGFYRY

SEQ ID NO: 3967 - protein, 402 aa, Methylobacterium sp.
VFGPVADILLCGALAYAAALVAARGLSRAGFPVPAGGETAIDGLRGLLALAVLVHHVAIWIPVARAGAAWTTPESLLLHNLGAGSVGLFFMVTGYVFYPRVLGGLRGLDLGRLALGRLFRLYPALIASILLILSLILWRTGGARASTFHAEAAALLRWLACAGTPPLLGEADSGRMNAHVLWSLRYELLFYILVLPACCAAMDRVRGRAPTWWVPAGLLVGALLLRPFKNALPLIGYLPLFAVGMLAYEVRLREALAARLRGPAAACLGLAALALAATTQVVPGKPAALALYGAFFVCVACGNDLGGLMRARSARLLGACSYGVYLLHGVVLSALFVDLAPLTGAIPTGLLPLLIPAAAMAAVLLAALVHLAVERPGIRAGQALAQAWARAPVLGRLRARAA

SEQ ID NO: 3968 - protein, 414 aa, Methylobacterium sp.
LRLLGPAYRLFYSDPVEISRGEGVILYDSAGRDYLDAYNNVVSIGHAHPRVVEAISAQLRTLCTHTRYIQEGILRYAEDLLGMHQGRVGHAMFTCTGSEANDLAVRIAKHHTGRNGVIVTSEAYHGNSDLTAGFSPSLGDGSPLGTWVRRVPAPDPYRVDVADMGAWMADNVAAAIHDLERRGEGVAAFIADSLFSSDGIFSHPAGVLAPVAEVVRKAGGVFIADEVQSGFGRSGERLWGYERHGVDPDIVSMGKPMGNGYPVAGICVAPELVESFGRETRYFNTFGGNTVAIAAAQATLDVIRDEDLQANADRIGRRIREGLAELAKRDPRIGDVRGAGLYIGVELVRDRDTKEPDAATALGVVNGLRQRRVLISATGFNANTLKIRPPLVFGEDHVDRLLTELEGVLGSIPA

SEQ ID NO: 3969 - protein, 328 aa, Methylobacterium sp.
MLEEEAAGLCRSRYGLDGDLLRFATEKDDTFRVRNGRGEAFILKITNPGEAESEVNLQTDLLHYLAKSSPHLRVPRIIPDLDGNRYAAYVDAAGQRRLLRMMTFLPGTPLSEIEPTSAEREKVGEVLGSLRLAMSDFSHPADCREIAWDIRHLGKLSHLVGHVEDSGRRSLIEGGMRRFREIESDLTKCRMQMLHNDFSRSNIVVDRKTPEFVSGIIDFGDAVRTAVAVDVSTALLNQLSPIPREDLFADAKDVLRGYLRIADLTEDELRLIPHLVMGRVIARALLTTWRARLFPDNAAYILRNTYQGWHQLQWFLDRPFREISNTLA

SEQ ID NO: 3970 - protein, 44 aa, Methylobacterium sp.
METLDGPLPGTLLVQLSRLHRSEHARLAAAEAPSAQATGGPRDG

SEQ ID NO: 3971 - protein, 429 aa, Methylobacterium sp.
MAPPDRAASEPVVGRAILLLLVLLLCLGGVANALRKDIAKGFDEVAHVSYVAQIQREGALWPDLRALRMLDPASLAPTALPNYLNHPPPYYTALARLGPAIGADPSAVLVLRLINVGLASAAMAALLLLAAGLARSRRAFWAYAIPLVTIPTALALNGAVNNDNLAVLGGALAMLGLQRLLCGDRRAWLAAVLAGVVAAGLAKFTALLLVGGCAGPVLLWLVLRGRLPAAVLVPAALALALGAAPYAVLLAQYGSPVPEVPGHLAMMRDGARAAGWDGARLDFPAYLLNFAALFAVQFMPVLAEPGPVETAALALPLALMGLSLAGGAAALARLGTGRAHPLDPLAVAGWAAIGLVLAAHVRFGYLNHLATGWRLDAYPRYYLPLAGITAVGCACLIAGLPEGRARRGILAFLAGAPLAFGLLGAPLGG

SEQ ID NO: 3972 - protein, 74 aa, Methylobacterium sp.
MQLSTYLAPPPTPLRAANEAVPGPEPLRDARPARPDAAVLPFRPLARRHRRPAETHERRGEILLFLGVRYSRAS

SEQ ID NO: 3973 - protein, 91 aa, Methylobacterium sp.
MPPKPARFLLAALLVGLAPLPAAAAPPPGVSPGSGTENIGAGPAPGTPSGVVGFDGPPGGGVNTTGGPGALPPSTPPSNTGLPAGSPASPR

SEQ ID NO: 3974 - protein, 63 aa, Methylobacterium sp.
MNLDAQHDRTALPPAPLPATTHPIQQPTDPAEQGRTDETADRSEGEPAATPTNAFEAFGSFSG

SEQ ID NO: 3975 - protein, 93 aa, Methylobacterium sp.
MSVIESRGTSRAAASVNATPRERRARAVAHANQLRALAWVALRDGAPHGAMRAATARTAARRILQHERRAAVLNRALAQALEALVEEQADLVG

SEQ ID NO: 3976 - protein, 64 aa, Methylobacterium sp.
MPRTPEPEPYGSVEPLPVPRLRGRRTGDAEPPTNEPLDPDERPDVGLSQSGSGEEAIVRRETEI

SEQ ID NO: 3977 - protein, 423 aa, Methylobacterium sp.
MTTLTRRQALAGLGTATLAGAFPAPAIAQNAPIRIGGLTTLEGPFATGGQDAFRCVQMELERINHMAGGRRIAFIRESSNARADVALARARKLVEQDGVDIVLGPLSGAEGIALKDYSATLTGKTIVNGSSAAADTTLRNPSKNFFRFSTDGTQWMAGVGNHVRKTMGIEEVCVVAGDYAFPYAQVFGFSLEYCRAGGRATYLWSPLGTTDFASQIAQIPKSAGALVVVHGGTDGLAFMTQYAQAGGSLPIIGGSIMADQTMMSARGPHRKLMLGMVSGGPIADVNEDPNWNDFVARYRKRWANEGGFQSPSIHGVNYTTNLQGILGALEEVRGDLSGDQRAFQAALAKHRFKNPMGAEVYLDHNRQAVSDIFLTKIEEREGKPVTVAFARAPAINQTLGVPEARFLAHGAPSRNNTGCIAGT

SEQ ID NO: 3978 - protein, 63 aa, Methylobacterium sp.
MTRLLGPPPARTALRRGLAHLCRLAGAGLFLATCGVASYTAGAHYRPEPVRAADPGSAPVCPR

SEQ ID NO: 3979 - protein, 137 aa, Methylobacterium sp.
MSPTRTPPGPACPRAALDALGREVGRALPPPADGLGESLVRRALRETPGDEPDEDRLVVRFGTEWRGFIRRQNPDRLAALDALIDAQIERRALARFYRRVRNAAVAVTIAGFAVAQFGIDRLPVVRQIWRLLRGELR

SEQ ID NO: 3980 - protein, 241 aa, Methylobacterium sp.
MSAAEPQPNQAAAAEDLAPAEVEVLDAAPVAAGSSSEVVTEAVSEPESDETVEALDASAAEVDGVTEPQAGAIAAEPKEPAAVDEPTGETAAQVVSEEGVSQEPAEVAASDVARAEAPDPDSIGAESLLPVSAFAALDAADASEAGAARPAVARTTVRFTFAPVRIDVEGIGVVLANYMHNESVAILSYMRALGAARSPADMIRLNVTAMQRAADASLTCWSDIARRTAQGVPWQREKAAA

SEQ ID NO: 3981 - protein, 70 aa, Methylobacterium sp.
MGKLKPVYLYRLRLLYAAPRYYAPQSINHYLEKRGLIRRTGRALPARRHEEYEITEAGRTAFDAALAAPE

SEQ ID NO: 3982 - protein, 205 aa, Methylobacterium sp.
MIEDVIDGRTIPVSEQISTMISRIAERQQYDAVFIDSRAGLAELAAPAVLGLGATVLLFGTAQKQTIEGYRALFAALQLLAQRDRAQGRDAEWRTRLRPVLAKTSLAPGAVERYLEDMYEIYSAHIYDAETDGEQPPDSLRFAQNDKSAPHWPLIVPFSQNFVDFDPGRIPGQLVQSFYEQTFGPFLAQIQLAMVSDENIGGSQP

SEQ ID NO: 3983 - protein, 92 aa, Methylobacterium sp.
MIRAAAMETESHQRIFRCHLMVTVQAVLSEYRPGASAQMVTDLLARLEALEAKAMAEGAPVATIAAIRGAKVLIQIPPAPRMRHFPIVVSDL

SEQ ID NO: 3984 - protein, 80 aa, Methylobacterium sp.
MALYFFDVHNSQFSARDEDGKECENRDSISAEALRQLCVIAKDDPLLHMNGTIGAVVRDEHDHVVLTANLVLAVVWVGDA

SEQ ID NO: 3985 - protein, 103 aa, Methylobacterium sp.
VCAPVLSGLAAAIQLPALPAGRSGPVRAGPVHPVPAPSPCGVPAPPRPIPPLFLHGIRPALEAAFGTEDAELAPDAIAALVARLHTGPLGPAQAEASPAVAVA

SEQ ID NO: 3986 - protein, 119 aa, Methylobacterium sp.
MSKPVTDNKQTIDRTRRLIAEMREVIEDARLSVLAARDLLKQFPSPEGVGPASPLVEPPADDPSEDLTVRLVDILLDAHSVANLDDDAETRVLLETALLRVGHRLARRAGPRAAGLVLQ

SEQ ID NO: 3987 - protein, 70 aa, Methylobacterium sp.
LTARPRLLAAAALLAALVLAFVRKSPEPQDPCEAHPQAYPCALFATAPTAAAPPQDPMPHGNDPAADGTS

SEQ ID NO: 3988 - protein, 98 aa, Methylobacterium sp.
MSARRLLHTSPEGTRWSLARAGAEVFVLREGGGASERIGLVRFLDGDPAAPERRALLDLVATLAEVGSANGLAAGPVTGAPPEAGAAAAEPSPGESAS

SEQ ID NO: 3989 - protein, 53 aa, Methylobacterium sp.
MPDTSQDPATPRAVAYSERAKRQSFQTIAIIAGLILFIMVVFGFLFGAGRLIA

SEQ ID NO: 3990 - protein, 78 aa, Methylobacterium sp.
MTRPDDTGPETDPGEAPSGARAYGDRPVSGRPQGGRAPGASEPADMGSPEGTDAAENDPGGRERPDDRLEPAGGYRGR

SEQ ID NO: 3991 - protein, 51 aa, Methylobacterium sp.
MGLFVVIACAFLVAAVLEVLAFRRRNELEAEGLVTVVRPETSTYLNPPRPY

SEQ ID NO: 3992 - protein, 135 aa, Methylobacterium sp.
MDALGPLVASGRIVDLILILVAAEAALVALSPRRFGPRAPLLAGLAAGAGLLLALRAGLGGAPWPWIAGALALAGGAHLTELALRRPKTLRRREPSATSAEALALGSVSRRHERMKRRRPPPLPRPCAGEGARGA

SEQ ID NO: 3993 - protein, 112 aa, Methylobacterium sp.
VTTIIRRGRLRPALAAAAPLALLVAATLVAATVSAAAQESCRASLGPSRAAALVARCVAVSPAPVPPALVPPDLLPPCHAANPCAVIEAEIARGCDDLDEDAPDFCLAYRHR

SEQ ID NO: 3994 - protein, 67 aa, Methylobacterium sp.
MKIVSENYAACFARSHEVDTTERLMLDAIACNLRSLYGDAAAAVPDDLLVLAGRLEAPTPPADIRAA

SEQ ID NO: 3995 - protein, 238 aa, Methylobacterium sp.
VLIVNKSYLMEHGTGTLGDLRRNGNVVAVDPVDLKLAPGTRIDADLLIASSRMQDAFFREHFADLTTFYVPHHADLRIPPPGEPPARFGLGYFGALYNAPFREELATAGLCDFHKADDPAETGWMASLPHYACHYAARSWQPFDGFKPFTKGIIAARCGAVVMVDRNPEAEAALGPDYPFYIDDTSLAGIRTGVECARSGFGSPLWETARAAMARLAASVSEEAVAASVLNLSRHVGR

SEQ ID NO: 3996 - protein, 71 aa, Methylobacterium sp.
MVLLYVSAAWTGGILTLAALWQPLGPALALVAAPLGASAVTAGAACLIGLRANVRRGPPPGGVALGWPLAR

SEQ ID NO: 3997 - protein, 160 aa, Methylobacterium sp.
MQTTLLLAAAAGLVLGAGALLYAGIRIGRPRPGEVSPAPGGTPVAARRLVGTWQGRQGYAFAVALSHTGPGDIPIDGIAVLAPAGARISVQPADDDRWTRPGRRHAVRWRAPAGKRETIVQCRLHLPAAAARTGTRVQFRLTGAPETGNQGIHVMLTVDL

SEQ ID NO: 3998 - protein, 89 aa, Methylobacterium sp.
MTQQRDPAPFGTVEAAREYVADLVGGILAHAQVVSIYAETGDDAGLIYAGKCTSAYLRALEAGIQELERSRAVVAYRRSAQAVSMVEEA

SEQ ID NO: 3999 - protein, 143 aa, Methylobacterium sp.
MRTVKLRPEPVLIALRWENPGDAPAETATDPLVPAIHPWIAFLLEPWLQAIEQAGPGTTHWLQETSAAMSACLGEWVDPTPAIERALDGARTASDLLVACINRAGWANADAQRQVARAAMGVLIEALTQAEASESKTELGLGF

SEQ ID NO: 4000 - protein, 97 aa, Methylobacterium sp.
VDSAEIDSAMQPARSDPGAEGPAKILTGDAVLPCRLRPEGSAAARLSLPSAVGIPELFVLSDEASGDERLARVTCRRQGADGARLWVQFLGPARLAA

SEQ ID NO: 4001 - protein, 111 aa, Methylobacterium sp.
LRRIVLAGLLVLASTAADAACRCACVSGRAVAACSSQGEMEPICSQICPEGLTPGALVEPLVPAGAIRLPGPALSDDELGRRGAETTAPNGSFNPAQGLALPSVGGTSQPQ

SEQ ID NO: 4002 - protein, 26 aa, Methylobacterium sp.
MPEELLVFGLSALTFAAYAFYRTARP

SEQ ID NO: 4003 - protein, 399 aa, Methylobacterium sp.
VRALDLAGLRADTPGTAHGIHLNNAGASLMPRPVVEAVKAYLDLEAAWSGHGAAEREAERLAGVYASVARLIGAEPDEIALTESATRAWQMAFYALARGFRPGDRLLVGRQEYGASLVALRQVAATTGARVETIPSAPDGRIDAAALAAMLDDRVRLIAATAIPSNGGLVNPVAAIGALARARGIPFLLDACQMVGQRPVDVAALGCDLLAATGRKFLRGPRGTGFLYVRRAWLDRLEPAMLDHFGAPFDGDGYRLRDDARRFETYEHDHAARLGLGVAVDYALGLGIDRIAARIGTLAGMLRQGIAALPGATVHDLGPDPAGLVTLTLAGQDSATVRAALGGAGISAGLSLHAAAPLDAAARALPPLVRLSPHAYNSEDEIGRALDVLAGLAQGRVQP

SEQ ID NO: 4004 - protein, 80 aa, Methylobacterium sp.
MRLAHVALAAALALATAGPAAAQVLSNPSSTNQALTNQSNSRANQIGTTSQNNAARMEMQRSQSAQPPAPPTGVVGVPRR

SEQ ID NO: 4005 - protein, 59 aa, Methylobacterium sp.
MDRISAGRIGLGSGAPLRAGATRDPRFVAPRSTHPGALWLAAAAPLAATLLLLAARISG

SEQ ID NO: 4006 - protein, 143 aa, Methylobacterium sp.
MAGLDRIRFAKFVKCRALMEGGATAGERAAGAAGAARIAAAAGLSLAEALRLTGSGQPRETRRDAPPRRPRPWETPPLRTDPIGLDEILAQKARTEAHRKRKAARAAEARRADLAAEAAERAALREAQEARDRAWAEARGKTG

SEQ ID NO: 4007 - protein, 60 aa, Methylobacterium sp.
VLRRILISASLYLFVAAAVMAAAFVLDRLEPDADGAVVDLGADPGAEILTTSVTSWTQAR

SEQ ID NO: 4008 - protein, 82 aa, Methylobacterium sp.
MRKLQYDTGTAAEPAGAAHADPNARAALRRLAEICIEAHGIVAREGPEEVRLPLEELLGRIGRQLGAQPENDVAAETAGAGR

SEQ ID NO: 4009 - protein, 90 aa, Methylobacterium sp.
LRVEHVSEGDPQDRPSPGRTAELLAEIAAILRVDPVIFFDGEIQERVSRDLAADELAELLALFRSIDTPNLCEAAHDLIRTLKRDRKPDS

SEQ ID NO: 4010 - protein, 242 aa, Methylobacterium sp.
MVRQRPRPSALSAPQNFISESLARRLYRGHRRVLWGLVAVLGAAGALLGSERVGALRPWSDAPPPSRPPDVPVQELVRQERDLVARLKALDEPTDRAAKPAEAKETELSAPEPAPKEASPRSAPARERDETTASVLPAPAAPEADKAVPRGPDAIPGSDPGPTQTLERAGRYLGRGQYTIARYLYEEAYRAGEVQGALGMAKSYDAAYLRSIGLQAKGDPQRARIWYRRAAGFGDRSRRSTP

SEQ ID NO: 4011 - protein, 121 aa, Methylobacterium sp.
MRKLAAISAAALIGLGTLASTGAEARGRGGAVAAGVIGGLAAGALVGAAASNAYGYGAPAYGYDYGYGGGYPAYGYGGYSDVGYAPTYSRRVVRSYDYGYAPAGYGYSGYSWGGPAYGYGW

SEQ ID NO: 4012 - protein, 96 aa, Methylobacterium sp.
MQIKTIAVAASLVLGLSGAALAQSTQPGAAGASDPAMRSGHGMDRSMNRMDPNTSPGSTGSTGREGGMGNMGGGSGASSNTGVGLGNQGANQGARQ

SEQ ID NO: 4013 - protein, 51 aa, Methylobacterium sp.
MSLVTILLIILIILAFGGGGFLGGGAYRGPGFGLGGILLIILIVLLATGRL

SEQ ID NO: 4014 - protein, 287 aa, Methylobacterium sp.
MDQEQSSRPDLADARHPHAGVFARTACVEADVRHAVRHAGPSGARMPAIARSPAAEAGTLFARAPDFAALGPEARAALEKAAHKRRHAHNGFIYLQDDEATHLYFVVSGHVRIASLMEDGSAVLHAILPPGESFGELGVFDGSTCCDMATAIGPTVTAAISVQSLRVLSERHPEIGAALGRVVARRYRGYVLLTRDLSLKTLAARLAQAVLRLAGHLGTRTRYRDREVGTLGSTVTQTDLGLMARGSRGNVNRVLKTWERAGWIAVADRCILILDRGRLEGLAAEDC

SEQ ID NO: 4015 - protein, 79 aa, Methylobacterium sp.
MDADRSGTEASFGMTDLEEALQGPDRAAVRAEALARLDGALLRVEARLREGLDPRQFASAESIRAALVTARGLLAAAPR

SEQ ID NO: 4016 - protein, 102 aa, Methylobacterium sp.
MAGVGTYGQYGATQATPTDAFTQPYKSYDGFDLIWRQNNLQKQMKDIETDIRNIEQNANLSDTEKMFSMQMAMNSWSAISNLRTNMLKTVSDTLKSVARNVA

SEQ ID NO: 4017 - protein, 394 aa, Methylobacterium sp.
MSGSAEITRQSVAAFNAISPVGAEVMEEARGSYRGEAVTLASDEAKLADAAEEIGMSVAHRADKKALGQRSVRQGQAAYPEALARLREYLDELPDMPREAELVDLIEQLEAFQDLLAGTGEGGAGATKEDVLAALHAFDPDVTHQFAGLEMARAQFEASGADPVFLALLDEARATYETSEVARDVRAGFAAAGIAARAAETLETDPAAVREVYRAMLRDTLHLGQLFDALGRFALLTKFETAVETFMAAAGRDLGSAGPSTDPLFLHGLLTELAKLKKMQSALDGMSDLVRLTERSLPAGQRGADVVALTSRILNFAASTGVGAADARRLLGSFEDQALPVQLAFANGLRGLHGELPDDVMPSLPARLQQVGAIMALLDGIVAAEERAFGEGQR

SEQ ID NO: 4018 - protein, 125 aa, Methylobacterium sp.
MSFGRASLGVVEGFAAQLGLPLRPARDGSVSFAFATTGTLSLTPSADGSRILVGLARPLRAPDSGRLERALACAGLQPATGRVVRAGLSGDDSLHLVLELPEAAFDLPALDVCLQELGALHDRAA

SEQ ID NO: 4019 - protein, 61 aa, Methylobacterium sp.
MPISTISDFIQLYSTGIISRECLEHEIRSWTDADEAQDRTPETEGCIVLYPDASGIWRAPA

SEQ ID NO: 4020 - protein, 133 aa, Methylobacterium sp.
MRSIGRAIAPALALACAAISAAEARQAAPPRNLECRDLRRLSDNFLLDLRIRLVFSRPRHSYVRLENTGRGWQPVAERRYLAIEPTRIVLADNAAFTTYIERLTGDYYHVDRTRTGLSVWGRCALAGGLNRLF

SEQ ID NO: 4021 - protein, 687 aa, Methylobacterium sp.
VAEAASDTVILKILTGMQAGVEVALGPGEYGLGTGPEDDIQLIDVSIRPGHARLRVSGGAVPGGRIALAGAAGALRTAAGLRIEPGSGFHEIEPLDVVTAGTTRFALGHPTSQWATVLEDADAPPPSRQAAPLGGERLRLLAVPLGALALLLAFAGWLVLGGGLTRIAGRMEGTRDDLALTRAALDQFPFGRTVAARQEVDGAVYVTGYVDTPVERRALVGALEKAGVPARTRLWVLQTIRAEVESLIAAQKLPVGFRLSEGGALTLDGLILSEARANRFVELVKDRVVGLAEVQSRIRTAQTLLGEVERLAQAAQVQPYVLLRVGDDLIEATGAIPAEKLDAFVGFLQSYARRFAREIPLRSFVQLQGAGGSERAILVGGTATGSDVALDPDQLAQGGYRPGDIVPGAGGRVAGARATTVVADAGGEGALAARRDAPARAQPDTPPARSGAAANADRDADRDADRVGDRTRDLLRRWREGRLGNDPKARALKEALDALRATDPAAGRGATPPGWYLPVLADAPEAEGAPCWAETRLRPRDAVAALFWLDLLSTSEAVSLTDQERGLQPVLLEVALNPVRAAACARRTPEGERAAAHSVYLREIGRNPAFLRFITRDLAPFGLDLTGVSLVPARYVLTRGGRRLHEGAAPDQTSRVAAIGELGVAVQTKAGLSAVVFEPDLSWKITQ

SEQ ID NO: 4022 - protein, 152 aa, Methylobacterium sp.
MQDVHQAVQALGAAIGMEGVAFDGAGNLTLIFDGAMAINFHAIEAGSFELWADLPDLGNTRDAELLASVLAANHLGEGTGAARLALRPDRSGFVLCQRVGIAGADTSALVETVAAFVASASAWNARDAGRAFAGRDAAATEPGEPGFSMIRV

SEQ ID NO: 4023 - protein, 373 aa, Methylobacterium sp.
VSEGGEKTELPTPKKERDARQKGQVARSQEVVSAGSLMAVIAYVWLAWGDINRRLAALFDVVAQLALGEFRVSAANGLSIVGMECVKILAPIVGVTIVAGISTNVLQFGVLFAFESLAPKLEKISPAAGFKRIFSMKQIVETLKSILKIVILSVLLWYVLRAALGPFAVSIGCGLPCQINLTQTVLLQTLLYSGLAFLIVALADFAYQKRSHIKSLMMSKDEVKREYKESEGDPHIKGKRKQLAQELVMSEGGSAARKGTAVVVNPTHFAVVLRYDETDAPVPVVTAKGRNLQAVHLRAEAEGSGVPIFRNAPLARQLFADTGVGETIPDELFDAVAEVLAWVARNRDRLYAGRLSHGVIDMEAGDHRPPGQG

SEQ ID NO: 4024 - protein, 61 aa, Methylobacterium sp.
VAAMLGRIWEGTKVTLALLAMIAAALISANKLDHGRRDAARPGDVARQAAEPAVTGSVGIR

SEQ ID NO: 4025 - protein, 105 aa, Methylobacterium sp.
MVERIRVVAPPALPPLRDIRPPPAWRGRTPDAARLARLTLCLAALALPVLGSKAADTVHRGGAPGPQQAAVLPTPSGRTAAPQASRRVPAFREAALAHPDAEPIR

SEQ ID NO: 4026 - protein, 50 aa, Methylobacterium sp.
VTTRTTAAGPARSGPRTPDIAEGCGGTRVIDFAICLILAVSVVGLLLAAL

SEQ ID NO: 4027 - protein, 102 aa, Methylobacterium sp.
MPRYFFDVRSGSGLVCLDYQGLDCADDAAALETARHGAGFTSHADCARNPQLTRYRFSVQDAEHRPLFTVPFTELEPDAPPARKRPRGAGRGRAGRSRSFMH

SEQ ID NO: 4028 - protein, 92 aa, Methylobacterium sp.
MIDAVQSAAGGMAAAQARFTEAAVQVARMRAGPSGTGQPTGQAPGTDLPAAARIELSQAAQEIAASRADFAANAAVARAADDTTRRLLDVRA

SEQ ID NO: 4029 - protein, 61 aa, Methylobacterium sp.
MHRTVQPLEGARRQGACAGFAASFRTRYSEVAAEPLPARHVDLILVLRRQERERARGADRH

SEQ ID NO: 4030 - protein, 97 aa, Methylobacterium sp.
MAWCRMISLEDCARDLRAYIRAGNREDLGAAQNLLLRFALDQKDLAARAAALDDLQIELTGYRVPDMTNHQRAFDTAVAGMIEQTRSVVARQIGPVR

SEQ ID NO: 4031 - protein, 42 aa, Methylobacterium sp.
MPDRETSPEGRVEHRALIDDTGGQIEHPQERLDAATRSRKHA

SEQ ID NO: 4032 - protein, 37 aa, Methylobacterium sp.
MIAASRTVILEHREIAGVLASSGLFFAGLLALACLVG

SEQ ID NO: 4033 - protein, 43 aa, Methylobacterium sp.
MVLEAAVNGRADAIVTFNQADFGTVPTSFGIALLGPADVLRRS

SEQ ID NO: 4034 - protein, 85 aa, Methylobacterium sp.
MAAGGHYALRLPASLKQAAETVARADGTSLNQFIVTAVAEKLAALKTADYFAERSKRGDPVAFDRFMNRQGGQPPAPEDQWDPAG

SEQ ID NO: 4035 - protein, 88 aa, Methylobacterium sp.
MRSTALAFAATLALTGAAFAQATTTPGSTVGNPAGSAERNLNNPGSVKSNAEKGMPGRDMPGATGTVAPGSTGTGTTMPPAGTAPAAR

SEQ ID NO: 4036 - protein, 406 aa, Methylobacterium sp.
VVAIMVSVAAMIIILYRSVLHVESADAHWWFLPWLRHILDHGVVQTLSINLPVLVPEANNAGNYTPPYLYLLSVGSYASAFADDLTVIKIVSISGAMFCAASLAYLLSGYARREIALCGAIAYLLLPSVVSNAAAWGQIESFYTGFVLIAIARAGRDDLVSCMIAFGVAVSIKLQAVFIAPFLLYLVISRRASVGLLVIPPIVYALMMVPAWMAGRPALDLAMIYVEQSHAYPWLSMNAPNPWTFVQYFRLIPQPTGMVLGIGAGLVVGLTIAGLGFVRRDSGRRDEGPELLLIALASATLIPYVLPKMGDRYFFMADTLSYALAIAHTRRWSVGAALAIQIGSFGAYLTHFTGYRVGTGLGVLAMTVAVIVICNRVLGLWHLRQGARSFGIRGRVGEGQPVVERI

SEQ ID NO: 4037 - protein, 196 aa, Methylobacterium sp.
MREAAERRIEPALGTAPGTSLGLTPLQRLVAPGDHERIVRIFGAEAAPEATPEVAPAATFEAETEVADPSDPEADLDWPSAIQLIRDAGGRVRQVRAGAEEATRRAHALVGRSAQEAEAAEQRARAAEAAAAAAQRRAEQAEAALAAAEARMRRAEEETAAARAAEAEVRLWLRRLVTCLKTEFAELAEGPDAARA

SEQ ID NO: 4038 - protein, 33 aa, Methylobacterium sp.
MLSKAFTYAMIGAFSCGLIATIVGSADVLMSVN

SEQ ID NO: 4039 - protein, 88 aa, Methylobacterium sp.
VTKTRTIALALALALPSTSALAFSFSYERPQRHAVPSPPYGSPPSAGLGVHDGAHYERCTASSAAEGNANQQTRPVKQYGQTAGGYRC

SEQ ID NO: 4040 - protein, 53 aa, Methylobacterium sp.
MATMISLACLAGGVGLAALSLRRPDRAATLERWSGVCLLAGLGLLGFALQGGR

SEQ ID NO: 4041 - protein, 28 aa, Methylobacterium sp.
MSRFEDLKFLVTLTLVVLCGSGLDALLR

SEQ ID NO: 4042 - protein, 93 aa, Methylobacterium sp.
MAPGYEIALWLEGLGLAGLAVGLWRLRVEEAARVRGLRTVLRTGSDARIAAGARPRADRTRMIPHVTGRGGTRTGTVPSAAAHALARAFARGA

SEQ ID NO: 4043 - protein, 438 aa, Methylobacterium sp.
MQSASPIPAGFAGPGWPALAAGRASAESRLVHLPYWLMLTALTFNAALAFVNGNVKPLTPSVVIALEAALTLGCLLVALLHQKREMNLALAFIVWLFLFMALRSAVVDPATSVKYFRDLLIAPTFFMLGLCTDRRYLNRYVLIGHTIVFLIGALEAFRTDLYSSLFHVKDYFIATRGLSEADFWNTDSDLFVSATRPNARFLSIADAVMANHRVSSIFLEPVSLGTYCIIVSAYVFALWRSLGWKSRAYLLFTNLFLIAACDGRLAFVTFFATLFVCMFWRRWSRYLPVLYLPGILIAAFAFVYVADPVRGNDDFVGRVAWTTDLLESYDVAEYLGMSEAFIEKAVDSGIGYIITTQSIFGLILFWILCSCCSRYETREQICYNHALCLYVCFNSLVSYGFLTIKTAALLWLVKGILEVGQTTPGTGDARPAARSLAR

SEQ ID NO: 4044 - protein, 93 aa, Methylobacterium sp.
MLLFLVAVAVVGAGLSIAILWLPVLLLGILLFLAVLIYMAPTEGIWPALGSGALALLTLQLSYIVAGFVLGRSERAGATSGLFRRAKHAHSKK

SEQ ID NO: 4045 - protein, 213 aa, Methylobacterium sp.
VTGVLIVDDHPVILQGFRRVVEDAGVAMIVEAGDPVSGYRLFHRIRPLVAVVDLAFRGSGLAGLALIKRMRALEPRARILAFSMHRDPVIAARALEAGAIGYVFKDSPVQDFLAAFDAVREGKPYLPHLLATQIAGLGAVPEPSRYDALNAREIQVSILLREGRDYRFIADNLSIGYRTVVNTCASIRKKLGARTQAELLRMIIAVEKLESHG

SEQ ID NO: 4046 - protein, 48 aa, Methylobacterium sp.
MPRWLFVILAAALFLSVAGIVLTFLRTGPTDHQPSAKPSAAAPRGAAP

SEQ ID NO: 4047 - protein, 81 aa, Methylobacterium sp.
MGTGKRYGTDPAADAAEIPGVTLQRIAAALGVPIAVFIEGVAVEPRLHETLELLRLWSLVREPELAQRVLAFLAAVIAEQS

SEQ ID NO: 4048 - protein, 169 aa, Methylobacterium sp.
MRIRIALACLAALMDLSWGLATAAQARPAQARQAQTRPATSYVSFQPQVRGLGCLQPRTRAMVARLTARVGPIEITSTCGGRHAHNSQHYRGAAIDFRPRTASVARTLAVLRGMPEVGGIGSYAGGLIHADTGPRRLAWHGSVRHRVARAHRSYARYAARRGAHRSGSV

SEQ ID NO: 4049 - protein, 94 aa, Methylobacterium sp.
MLNGPFQGLPGSSEGWTAHEAWLLPITDGVAAKAPAASSPADTVRAAARPLFMAANGLALALALLLAAETSTGWMGGQRGVPVAKAPVITASAS

SEQ ID NO: 4050 - protein, 62 aa, Methylobacterium sp.
MTKTDVDTRHASLQRAERAAGEAFGWPETPVEAARRSLLFNPTTIAAATAVTTVAATLTYFV

SEQ ID NO: 4051 - protein, 70 aa, Methylobacterium sp.
MYAPSETQVSASESERRQMDQGESLYGFRPLALPALAAAARPKKRESRPAVPATGRQGILSLVHEDEPLA

SEQ ID NO: 4052 - protein, 97 aa, Methylobacterium sp.
REGAMTDAVANPQHARIRASGDERLLRIAELVGCPVEAFRTPEGDALSDALELVKLWERIDGTGRARLLACARTEAARTGELQPTGPAGAGFHSPLR

SEQ ID NO: 4053 - protein, 349 aa, Methylobacterium sp.
MPADAVGVWNALVGRTGVPLPLRGQAAAVVELAEPPPADALCLDLRLGPDLPLVLRPVAYPFAAAFGADLEVADLPLLPDALRDALLAGLVATYTAAMPDHDLGPVTTRASGPLGDLVRPEAAEGLRWFRAALHGVAPGPVALDVGARLDTLARIFGPLAPRPVWPGIRQVLTREAAVTLGRLVLPLGHLRALAPGSVVVLDARVGPERARLRLGPALFAFEAAGGGWTCTAVTAAAAPPDRPDDTRQEGPMNTLVPTTETREADLDVASDVASDLALDVALDLDIGSITVPLAEIETWQVGSLVALAPETPRDGLEVVLRVNGRAVGAGELVRIDDRFAVRLVRLALG

SEQ ID NO: 4054 - protein, 246 aa, Methylobacterium sp.
MIRTNPPSNPHATADLPTGYPSDNTSNPRRDPFRQRDPREGAPRDGLGREDRPGTEAGFGRSLAFGERMRDAMRDPGSGEGQEDGRERRREDEPRLLAAVEPEPVGVPLGAPVPAPAASVREAGPAETGTAERVARLSERLEAAIRAELSAGAGRTLALRVPLDGLVPGLSAVTVALTPAGLDVTLVRAAGAGSADLAEAAQALALRLRNRFGGRGVRVLERTEAAEPPAGDALAAIGRLLGRSGP

SEQ ID NO: 4055 - protein, 162 aa, Methylobacterium sp.
MIGQMTILLRLKTLKEEQALRALQAKRRQVAEGEAVLDEARLAVSASAATLGSREDAIYAGILGQVVDPGTLDETRGAVVALEKGHARLTDSAERAAYTLHRLTGECEAAAEGHRAATRVRDKYTILRDDLRARAAEEAEAREEGEVEELFGRRRPGPGERP

SEQ ID NO: 4056 - protein, 218 aa, Methylobacterium sp.
VVAYYRLSELGYRLAPGLQVLPPEAFEPVPAAAALLRDAEARAAAIVAEAEQEYARRSAQGYADGLARAELESVERLLREGAQLDAGLKAVEAEMARIVMACVRRLVDSFDDEARTVAAVRGALRQMRRERRAELRVAPAHYAAMRDRIAGIVADFPEVEFVDVVEDPALVPPQIVLESSIGRVETAVDAGLDALEAIVRGAAAGHSDSSADPAGAAA

SEQ ID NO: 4057 - protein, 246 aa, Methylobacterium sp.
VIPAVALDADPAAEVRALGLAAQIAARLVRPIGHFAPGACPLPPLEPDALAALAAHPAFGVPVQRAASHALAAEAAGIDAGLIRRLREAATTRLAALLVVQPLPVLHEAARLLAGAILHRRILALVLKADRERLQAALGPAAFRVATQEAALLHAGLAEAAEPAAQAACLAAGSPDATRGAVVALGLGTLGRFAAAAEPALGRLVALRLGAEPGILTGPPPLGPGACEHVVRLLRRRMDAWSPIIA

SEQ ID NO: 4058 - protein, 165 aa, Methylobacterium sp.
MPALSMHHLGVGSAAGALGDGLREVGGVQRAAFRDAMTRKSATGPALDGPPPTEPASVAQPVVPVQRVGFENDSAARDRVRRTLELDGAVRPNDGDTILGGLQKLRGAFDARHARVGEIMASKSVDTNALLAMQMEVAQYTLLVDVSSKLTGKTTQSLDTLMKGQ

SEQ ID NO: 4059 - protein, 124 aa, Methylobacterium sp.
MFETGQLLDAGDVRLLVEMGFTALSRGRLAEAATIFAGVEAARPREEAGGIGRALVCLHRGAVDEAVRILRVLPPSDAARAFLGLAVARSGDQAEARAILTEVVENASGTASAGLAADLLAGLT

SEQ ID NO: 4060 - protein, 184 aa, Methylobacterium sp.
VRDVLTLPESRMGVLAAGGGSEVGRTTVAAILKAVGEADAVEDAIARLVAQHGAHACEVTELGGSLYARAAAAVAEGRITEALAPLSALAGTPGHRAEALLGLAVCATRLACYEDAKILAEASRGLGPGHPRASCVAGLCELELGNRRAAQEHLATAARLARRDAAYGEDLRVAQRALLLMHLA

SEQ ID NO: 4061 - protein, 132 aa, Methylobacterium sp.
MAHSGGRTGTVRWTSTQDAGDAAEVSSEIEAWLARQPAAADWAGVLGALRDGLLRAGLEPGLARDATAREIIAGLAEAEDLEAIDAALAGLSVRVDALVAPRERAGRGPARPLAELMTEVRGAGQRRDRIRL

SEQ ID NO: 4062 - protein, 126 aa, Methylobacterium sp.
MKIRNFDIGLEAYTRVGPGEDPRLPSEGAPGPSFIPEPAHLDAVLRRPSLDERLPQVLQPPALDADLLEPAVLSEVRRGTRGLFAEAARRAVGQRRRILEEAALILDEDAVLDADVRSALAALLKA

SEQ ID NO: 4063 - protein, 141 aa, Methylobacterium sp.
MSTLPLRPDSGLPVDPGAPNLHPDRRQRDFLLLTIFVLAQQGYVDRAGILAESLHLVGDASAETQLARAVLRFFAGDFAAALAVLEDLDRLAPIERFGSYRLDERQRMRRYLKARCLHEVGEPGRARDAVEIYLRHRADSV

SEQ ID NO: 4064 - protein, 187 aa, Methylobacterium sp.
MPSILDGLPRTQAELQKAHLASAIQFGEIVAQADLTARSRSIIDAMGEGLSLGDVLGITREERDALLVHGFRQLQQGDAAGAQVTLTQLYHIEPMDERVIYALAATYQAQEQYAAAAKLYLCFLAYDATNPQGYLRIAECFLAAREYPEAEAYIEAARVQAAGSACEADVDRHAGALSAAIPARPAA

SEQ ID NO: 4065 - protein, 52 aa, Methylobacterium sp.
MTLLLVVLLAPLVAAIVLAGGRPGPIIGCLCLMGIGCLIACSGLTRLVRQRA

SEQ ID NO: 4066 - protein, 239 aa, Methylobacterium sp.
MTATGTVLTDLSANLFAALLLILLILLQAGADRSDEGPAQPVEAAQLAAREHTPLDAGALVTALYDRRPEAAGLSIDLTEAEPPPLDAVVRGLDPDLPIRLYVFSHRHYSATAALLRKMGRRWQEISVPPVLGDAATGWTSAFCALLARRPAPPQFRADLAHLLGAAAGPPLRGSGGASDPLTSSMLRNPFGGWLGAVLTIATLLLGFAAVLAIEWIVPRRLPCYACRLDAKRYEGPRP

SEQ ID NO: 4067 - protein, 162 aa, Methylobacterium sp.
MLPETAVEEGPEIDPFADLLFALIATVLPAILVLLPVLHLATPRRSAPASAGVAVGGREAATIVAEAAGLRLVSADNRQIALSAVPVDPGLRESLMSLRATETPLLILIEPAGLEAAFLLEPIAASYGPVRIMQLRAATRCVEARDPALAQACALPVRTFVR

SEQ ID NO: 4068 - protein, 385 aa, Methylobacterium sp.
MRPERASVLTREVGRSTERLRVVAYGMALCIAFGLYLLVHGAGQGPTFWSASLLCGAAIAAGLARGGPSARAFRWGAAGAALIAAALPLLPALAEGAPMEAAVRVHPLWPQILVTLFAARALEEVNEQRFAAFWRAPLRTREPVASQSIAAALSLGACFALLFYQGLTLLVPVQQGGGTGLTDLVAHALAGESAIHRAIVVLFCIILAFLCEAVLQHRRDRAALAALRQALAQGHRTTPEDLHGLLAGPLAGFGHTRTVRALAQGLRSGGGAPAEDAFTAAFAAFHGASRRFVRGLLPFLPLLGFFGTVVGLATAMAALPTEGGGGRIDLSGSLSGLALKFETTLLGILASMVAALLLALLEKGEQELAAECALLAAVAERGHAA

SEQ ID NO: 4069 - protein, 395 aa, Methylobacterium sp.
MIGETLGEIPVAVTSTAGVAPGIALTSAGLSRSFGAVLFTGGASGLRPPRNVEDAAILLAEAALMIDAARRAASDARITGATASVRGGLGTAAAQIAVANDALYGVDEAGGGLIDQKAAASSDRDTAVARDVVLGSEVARLEGRIVTLDGEMAVVRSEADANIASLTDDKDAKTAQLASLDTRIAAALSANDAGKVAALRAERATIATAIASINGQIRTTREEANTRIAALAAQRSAATAELAQAKAERAAVRSQIVALDARIAELGIAIIEVESELALGRTALVIAFAQMAVLVQDSGGDRALETMRGTELDHRLDELEEAAKDLRARLLAHFEADARLAGDRRDAQADARVMAVVLGLFTALVDVTDVLRREAIPSSEADDSAGRAQRRRLAL

SEQ ID NO: 4070 - protein, 197 aa, Methylobacterium sp.
MVGRQLSAQLGRGGPELRSKLPALERAGTDSERGAAQQDAGSAALGSAAQERSLSDAQGLPALNAWSPAIGIAAEQQVERAGIIASFILNAATIPGWPPPRPFAAPAPESVRAALIMTPGLSEAGIEAQMRRDGVRRTLLARMRALLARLTHSRRLQVMLGLTILLGAIAAIEAELGDVARDTDTDDIEAGRRKLSV

SEQ ID NO: 4071 - protein, 192 aa, Methylobacterium sp.
MVASDPARRDPFGLDPEESALLASLFVEAAADLGLDGARIYAALRAGQTLGAALGLPDGVVEVLYARAHTWFAAGRSDRAEPLFRVLCALDGACADHWVGHGVCLHLRGADSEATIAFATAAALRPDWAVPHFHAAGLAVAQGGWDRAAEHLFAFRERQDRDTPEALVREAGRLAAALAQRGDRRVANRERA

SEQ ID NO: 4072 - protein, 162 aa, Methylobacterium sp.
MEALSPPGSGTETAALLNGHLRDALGLRSADLAIGLEVARNLLQRGANAEALRVYAGLILCEPANAAFQTGLANCALAAEEYHLALQAASAVVALTPRDPRGYLISGRACLGLGALAEAGEDLREAVARGREARDAVAVEEACRLLDALPDPAREADLAETN

SEQ ID NO: 4073 - protein, 151 aa, Methylobacterium sp.
VSRETFASVAAALWASLGLAPPPNSGTPTLRIDGRAVRLAPSPDGMQAVIEVAVGTLAVVPHRREAQLRQMLREGLGLVLDNRAALTFGADGTVVALAAGPCRVTEVALLRGLIEDALHLAEIHGPTLADAAGPEPDGGLPEDAGSLIFRL

SEQ ID NO: 4074 - protein, 304 aa, Methylobacterium sp.
MAIGSFPTELRSYLPASLLQADGATLKPGIDLAQAEALAKNVQAQASALPPAEARLFLAMVSQADLAPNGQIPADIGKTLAAFEGAASLLARSSGSTLDFLARVMIEQAAEQRKNALDSRLSAREQAKSELMNQAAKMEKAAEESKSAAYQAMITTVVMSSVALAASTTGAVLGGLSAVKQGSAFKDAIASGKTIKEAATSASTGLSAGWTKVGKAADGLGGAQQMGQLGQAGGGYISAQGEAVAKTLDAEGQREAARAQDSQTKADLSKDSQEALNQMIQSIIQFLKDLQEAKAEQMRALTRV

SEQ ID NO: 4075 - protein, 314 aa, Methylobacterium sp.
MSGVMASLSAMMPKVSAQDTDVLLLQITTKLKETTEASEKDKIRADTSNKKVQIEEKQRKMDEAQEKIKAAEDKMKNLSIWDKIKIGFQFLSAIMTIAAGVIAALVGAAAVATGALSPAGVAAIAGGVMMVTAGVLMLYSAIDASVAASREDGLGIAGLIEKDKLMARGKTEEEAIQGGAEKDKLSRTVIGAVTAALAIAGAIAAFPAGGGAAILALASRVTGVVSAISTMATSAGDITTGVLKYKATEEKSEGQLKQADGKRMEATIQVLDGMIDQAMTRLKGAGDRFNAMLDSLTEAIQDRGDSLSRVGLRG

SEQ ID NO: 4076 - protein, 131 aa, Methylobacterium sp.
MSRLPSPHRRRTFGLLALVLIGTSAQAADFDGAYRPRPDFGRGFEEDYGRRPPPPPPPRFPRFSAGPDLAPSPCRVFVKRRFDADGEPVIRRVRVCDEPDDLGPPRRPRFDPPPPREFPDEPRGRWDGPRW

SEQ ID NO: 4077 - protein, 39 aa, Methylobacterium sp.
MLSVLVSQCPAPEQEAVDRDPGLLTLAFALARSLRRRLT

SEQ ID NO: 4078 - protein, 389 aa, Methylobacterium sp.
MRDAGGDTPLPDEPATGPHVLLIQPQAENAGAQAIARMLATALAERGYRTGQIFFYRKTGAFDAEPGIAFCAAERPRTPLAFGRFLVDLVLRLRRARPDAVLCFQHYGNIVGAAAARLAGVPVVIANQNSARDTTPPRARLVDRWLGGFGLYGRIVVNSHDSAGDLADYPARYRARVVHIDHGFVGRGSDLAPAEARARLGLGVPPGGRLLGCVARLHPLKNLAAAVRLLPHDPAWHLALAGQGAERDTLAALADRLGCGARLHLVGELPPDRVGDFLRALDAFVFPSRAETFGLAAVEAAQAGVPVVANALPVLREVLATGAGPCALFVDTEDEAAFAEAVRRLEREPDLAAHLVRSGRGLAGRFPVDAMAGAYDDLLRARIAEARGA

SEQ ID NO: 4079 - protein, 453 aa, Methylobacterium sp.
VRGLALPRLRDLRARAGLRDLALALVLKVGGSGLAFLMLTLAARAMGLHEFGVFAYWFSALSFAAAAVLLGQEAAIMIDWQRGLDAGGPAAARAALRRSSLVVLLAGLAGGAATACAGHLAGAGWLFSGLAGAFAALLAGLVYGTHVARVVAGIAQGDGQFELTWRLFPTAGAALALVAGLPFHAETFFAWAAGGILVALAIQGAGIAAALRGVPAGAGAAGLTRVRAAPDATRAWIARSARLWLGGVLDAANQYVDVFLIGLLLSPVEAGLYYAAARLAALFAIVSAGLHVFSSREIARHAADPAGPGMRAALRLVGAATALAVGGGVLVVATGGQLLLDLFGPAFHAAYLPLVILTVGVAAMALGGPVPAVMRLTGHEAAYARIAGLFVLVRCACVAAAALADGLIGATLASALCSLACAVVLNASCRRRVGIDPSVFGLVGGTRARGTVS

SEQ ID NO: 4080 - protein, 515 aa, Methylobacterium sp.
LPQDRHAVPRAVLEHALFLAVAVALVGVPIVAHLASPAAAIVLCAAGSVVAAVYVRAAIPALLIVAFQFQNLFVSLVSPWLADTPAFNAARGYNFIITASVWLWIVGGHCLAPRARSRQLDALLRPSALALGVIGLYFGLGLARDPYAAVVYLRNAVTPFLVFQLALVIAADGPGDRLRFLRVPVYLLLAYGLAEFLARDALFELIQANGYMTFSLADIARSGEWIETMRRTGRVLRDLQDTQIVSFLNTDLFGFSAIRMYRMLGPNFHAISFGYGLLLAAFLLLRWRRPVLFCLAVALLVLVGAKGALVCLALCCAALLLDRVRPEATLPVFLAVLVLYACAVIVTGRAGGDYHVLGLFGGLHAFLGAPWGAGLGAGGNLAGDATRIDWEKAQAIGRTDWPVESAFGVLLYQVGPGVLALCAAPVCAALAAWRLSGTVPGRDLRRHLRLFALGTLAVTLNGLFQEEALFAPLALGGMLIALADRMGEGLSRLPVGAPEVRAARAPGRSAQGIPA

SEQ ID NO: 4081 - protein, 62 aa, Methylobacterium sp.
MNTDFHRPTAKIYTFPVGGRAGQAARATAPVPAPQACAADSGGYHEAAIQEEAERNRTPRGR

SEQ ID NO: 4082 - protein, 98 aa, Methylobacterium sp.
MDERRRHGRNRTYLGGTLTFNHGQQTLPCHVRNLGTAGARLDFSGAVPLPDEVDLAIPRRGEHHRVRVVWRREDSLGVAFLPRAANLIAFGDARRART

SEQ ID NO: 4083 - protein, 71 aa, Methylobacterium sp.
MSDELWQRAMAAFRESRRLMQEAERTRRSGECLRHTLADTLGEMRDFGARATIWLQVEAARPSAPSPNRRL

SEQ ID NO: 4084 - protein, 78 aa, Methylobacterium sp.
MMSAADTLVATLSKQSGTREELAGIITGLMDQYHISPDRAHMLIDRFGRTQPALANAGSELMARKQGYSERQPGYMAQ

SEQ ID NO: 4085 - protein, 109 aa, Methylobacterium sp.
VITCFIRYAIDPCRTDAFDAYARRWGEAIPRCGADLVGYFGPHEGSATTAYGVYHVENLAAYEAYRARLRDDPLGRENYAFARRERFILKEERLFLRLASGPHAARVAP

SEQ ID NO: 4086 - protein, 167 aa, Methylobacterium sp.
LLHFMRLPKGKSSFELDSYDLAILKLLQQDNAVPQRAIGEAVNLSAAAVQRRITRLQQSGVIERNVAVLNPARVGQPITLIVAVEIESERLDLLEASKASFLAAEEVQQCYYVTGDTDFILVITVQNMLAYEQLTRRLFFENHNIKHFKTFVAMDRIKTSTHLALPE

SEQ ID NO: 4087 - protein, 45 aa, Methylobacterium sp.
MTAPVSPEPAPLRHASLFRSGLGVRLALAAGLVLPLWLAILWATA

SEQ ID NO: 4088 - protein, 41 aa, Methylobacterium sp.
MVRKAALAALTAGLVAGSSGFLAGCSVLPAAGPTARAVVSG

SEQ ID NO: 4089 - protein, 42 aa, Methylobacterium sp.
MAGLFQAETMALSCAALKLASSALLAVSSRAPPLWALLSLQR

SEQ ID NO: 4090 - protein, 96 aa, Methylobacterium sp.
VLSLLLLAGLPATADAEIRPVRPCAAAKLRDPACPAQRYAVQVSADADEPAGESRTLAPRASTRLSADRTPRFAPRTDPVPPSAAARLPERPPRRA

SEQ ID NO: 4091 - protein, 59 aa, Methylobacterium sp.
MQEVPMIAVTARRILTLLALVAPASGWACRDAGPADGRATGREAGGTAIPDAVVFRHYL

SEQ ID NO: 4092 - protein, 63 aa, Methylobacterium sp.
MSRISVRLAGDGTHAVIEGKDPVVSGLTLDEAENYLTFMRASARVRRTRRLPEALRRRGERPV

SEQ ID NO: 4093 - protein, 54 aa, Methylobacterium sp.
MSLKTLSAPLLALALAAGSLSAAQAQSSNATPGAPAGDSGGNASTGSTAAPSGK

SEQ ID NO: 4094 - protein, 31 aa, Methylobacterium sp.
MRKLLLAFLLPRVVSWLRRRYGSPNHRTRPY

SEQ ID NO: 4095 - protein, 48 aa, Methylobacterium sp.
MHHVAIGLGALCCAGGAVAHFIDTTHRREGALGLAGLGFLLAGLFLER

SEQ ID NO: 4096 - protein, 198 aa, Methylobacterium sp.
VANGAAVKRSVDVTVALTALLFLVPLFLAVALLIKAETRGPIFFRQKRYGLNRQPFEILKFRTMTVLESSGAFEQACANDRRVTRIGRFLRRSSLDEMPQLLNVLMGHMSLVGPRPHATMMDDTYAAVVSDYDDRFLVRPGLTGLAQITGYRGPTDTYDKIARRIGRDRVYIRRWSLALDVMIVLQTPIQLVKDPNAL

SEQ ID NO: 4097 - protein, 334 aa, Methylobacterium sp.
MRLMHVDLTRRHALSGLALSAVAGAIAGALPLRPARAADLTYPGVNLSGGEFGDLGRPMGQGYIYPQDSAFAYYASRGMRLVRLPFKIERLQSEPFGALSERDVAELRRCAATAKRLGQLLVLDPHNYGKRDDRPMAADDLADFWKRIAALFRDDAGVAYGLMNEPVAYKPPEWRPIVERVVKTIRDLGSTQLIMVPGAGWTGAHSWISDGNAAAFEGFSDANFMFEVHQYLDANSSGTDLQTYVPGAGEGRLRDFTDWARKRACRGFLGEFGFALPAGRTEASALLAYMAANSDVWKAYAYWAGGPWWGDYAFSIEPDKNGDKPQMALLREYL

SEQ ID NO: 4098 - protein, 508 aa, Methylobacterium sp.
LSGGLARQSAANAVATGSILISGALSTIIVARLLGPADLGVVTYAAWFVSITVMVADLGIPGSLARYLPEVRGSGDASACDGLALYLFKRFVLVVGLAASLLFGLALWHLAAGSTFALHIEPGTYKTSPLFWTLIAAAVLAQSSSAFAVGLLRGHQEFGRMARIMLVSAAAQIGVTVLGSVALGLVGALSAAIVVGLAPSVFLLRKLRGGRAVAPELRTRLVRYCGAIWLAYLLSAVTWARTEILFLERSWGSEAVAFFSVGLTLANLAVQAPLLLTGPLLPVLAQNIAAKQHATAVEIYRTGMRYLAMLVFPACFGLAAIASVFVPLVYGPAFAKAVAPAVMLVVAAAFYALTAVTQIYMNAAERNRFNIVVGIIGAVSIIASGLIIIPTHGLMAAAATRTTVQVLTAAASIWYVHRHLRAPAPIGQILRIVGAAALCGLAAFAVLRAFPGPVALAPAIAAGALVYGIALKLFGCVLPQDLERARAIGSRLFAPLAAALSGAARASR

SEQ ID NO: 4099 - protein, 187 aa, Methylobacterium sp.
VVRAGAGPVRDRWLDALRAGLDARQDALRARPLRRLPPGTGDDRLIGGLDLPATLALGRPVLGRGLLAEADGGVLVVPMAERLSPATAARLAAALDTGTVAVERDGIGARHPARIGLVLLDEGQGDEAVPEGLADRLAFRIDLDGIGLGDLDAGRALPSGDRVPASPADGPRALPPPSAGEGGPCVS

SEQ ID NO: 4100 - protein, 206 aa, Methylobacterium sp.
TLVFFGMPAPRIAKMLPLGSHRYVSGKIELWDGHRQMVHPARIMDAEGLAALPPVEPIYGATEGLTSRAIGKLAIAALERLPVLPEWQDPAWLARNNWPPFAEALTAEHRPREAPPKATDPLQPPPSTPTRRRLAYDELLASQLALALLRARQRRKAGRVNAGDGTLSAAIEAGLPFRLTGAQARAVAEIRADLAADRRMLRLLRV

SEQ ID NO: 4101 - protein, 119 aa, Methylobacterium sp.
MAETRKPAIVRQPSRKYWRGHVAMYRNSVSFCVGLPSGERRCVVLPTARFWSRERREARAESLAHLHLPGTKVPRPANHSYWLTVSVPLVLAEVECRLWRSRQPVRRYPPRPIREVRHG

SEQ ID NO: 4102 - protein, 102 aa, Methylobacterium sp.
MIQSILTSGRRARTGGRRARTLLILAALAAPTGAWAQAQTGTGGGPTSTVTAPNASSVGRVMPRPGAGGAGADAQLDRTERTPQMKADDKIQKGICIGCGAK

SEQ ID NO: 4103 - protein, 119 aa, Methylobacterium sp.
SSPVNGRSCACQSPWRHSLAIYLVHQPLLLGVLTGVAALTGPHPRAGERTFRAEYVETCTRTGGGREACRIAARCTGQVLRREGLWQAQERPFTGEERLRAQALSQACYEAAEGTRGPP

SEQ ID NO: 4104 - protein, 320 aa, Methylobacterium sp.
MLSLRPAAARLGAAFAAVLALSGAPRAHEGHDHGPPPPPPERAAPRAAAVSEDLELVAIARAGTLTLHLDRFASNEPVTGATVEVEAPDGPRAARETEAGIYALPAPWLDAPGRHDLVVTVTAGSDAAVMSLALTVPVPEKPAPAGGFGQTLGQTFAPVLDGLRRHLARQDPTLPATAGAAFLLGALAAGLLRGRRAGIAVLVGLAATLALALGGGALAHEAAGRHGGRVADAGSYHVELVTRGPEVVVYVSDGMQKPVPADGFRGTAILVVQGKPARVPLEPLTGDRLAGRAASDLGAAPKGVVQITAPDGARASGRFE

SEQ ID NO: 4105 - protein, 130 aa, Methylobacterium sp.
VLDRNVSQQKLLVTLDAVMMGAVVRDAPFFRPNREPGDILFPPSAPRPRSSVKLPLPLSGSDARICPFSIREQEILSVLAEGVSNKHIARKFDIAESTVKVHVKHILRKLNMNNRTQAAIWAKSYRPIPA

SEQ ID NO: 4106 - protein, 79 aa, Methylobacterium sp.
LFDALRLRMLDRATETEPTEAERIAHAYRVASGGNAWAALVRVVEDALTDLAEAERRSLRRDRLISHGYVRGRHDGGGR

SEQ ID NO: 4107 - protein, 342 aa, Methylobacterium sp.
MTRLALWLALAGALLFGGLTAPARAQGPERLPIRIGFQSGEVNVLLSHAVAAGLFERAGLAVTLAQFPAGPAMLPALAAGEVDLAWMGEFPAVTGYANGLPIEILFMERIDATNVRLVGNPAAGIAAPADLKGKRVGVAVGSTSHYHLLRALAQAGLRADEVRLVNLTPANMPPAYAAGQIDAAFVWEPNVGALERQGARPIASTRSLGMITGGVWVARKPFVAGSPETLQRFLKAWDAAQAAYAADPAGVRAAEARRIGMSGADFDALVAGQSVAHPSFRQTLTADFLGAPGQEETSRLMRHLHGIAAFLVAEKRIQAPPADWSGLIDTRPIQTYLAGASQ

SEQ ID NO: 4108 - protein, 304 aa, Methylobacterium sp.
MARAYASTIIDAPVETVWSLIRDFNGLPSWVPGITDGEIEDGLDADVVGCVRAFRLPGGILVRERLLSLDDHRYSFSYNFETPAFPVTDYLARVTLIPVTNGDGTFAEWEATFDERPEDAGKYASIIAEGVFKAGWDALKAKIARERPPTPAGAVRWRGLPPHKVFCSSVVDAPVAAVWATMRDFAGMADWHEDIARMHMLGGVRPDKVSGVRDFLFGEGHLNEELIQLCDRTRSYTYRITKSPMPWLHYVSGLRLRPVTDSDRTFATWFGDWTAAPADDLVLIPQVHHGVYQKAFDTVAARLA

SEQ ID NO: 4109 - protein, 212 aa, Methylobacterium sp.
MDAVYVGIDVSKDRLDVHVLPSGEAFGVTRDGSGLADLCGRLRPLAPVAIVLEATGGFETVVAAGLAGAGLPVVVVNPAQVRAFAQAIGQRAKTDPIDAAVIARTLLAELPELGRLDRRQIAALAGHAPWPRQSGQWRGKSFIGGGRASVRAALFMGALVAARHNPTLKAFRDRLVGSGKPKLVAVVATARQLLTILNAMLRSKTPWQLQNA

SEQ ID NO: 4110 - protein, 767 aa, Methylobacterium sp.
MGRGQGAQAGQGAQATGPGRRPAALAQVAHGLRQHQAGDIAAAEAAYREAIRLAPGEAAAHHLLGLCLKRTGRIAEAGAALGRAAAASPRDPDILADLGLALRAAGDRDGARTAFRRALKIRGDHPKAWGGLLDLGGVGTDAVGPLRRLVAAQPARPEGYLSLAGVLSALGEAAGARDILADGLTAGALTEAALQSHGAEAHAAGRHAEALAVFALLAERRPQDPHAQIVHGCALFDRGRIDAAHAAFRSALAADPDNVTAHVNLGAIFSEIRRPNEALEHYRRAVALDPGSTLARHGLVDQQHHACEWADIAENERVLLRLLDETGTRVTPFKLLVAEQASPAAILRAARIWAAGISVPPADILPPPRPASPGRRIRVGYLSNDFFEHAVSMLAIRLFERHDRARFEVFAYSHVRDDGSALRRRLEAAFEHFVDITDLTDAEAARRIRADGIDILVDLKGYTLRARTEIFALRPAPVQVNYLGYPGTMGAPFIDYLLGDAIITPEAHQPDYSERLVRLPDCYQPNDDRRPIAAERPSRAACGLPDDAFVFCCFNNSSKIAPAVFAIWMRILARVPDSVLWLLEANPAAQDNLQYEAGAQGIDPGRLVFAPHWRTDRHLARIGHADLVLDTLPYNAHTTASDALWAGVPVLTCLGATMAGRVAASILHAAGLPDLVTTSLDAYESQAAALAADRPRLDALRARLAANRARAPLFDSARYARGIEAAYAQMHDLRCAGRPPEAFTVPREPFQDGFDPGFDPGPDSGRP

SEQ ID NO: 4111 - protein, 123 aa, Methylobacterium sp.
LATKKIVFVAFAMEDERQRDFLKGQSLHPRAPYEFIDLSVKEAYETDWKDKVRTRIRRCHGVIALVSRNSPQSTGQKWEIACAREEGKKIIGVWAYAGDRTEIAGVRTVAWSDANIAAFIDSL

SEQ ID NO: 4112 - protein, 273 aa, Methylobacterium sp.
MIAFIVAFILCLEGSAQARKEFLADEYWIGKPHSPKEKNLTRLAAMYMLGVKQSYGALYVQALQYTKVTEYFLERDIEPEEIPDWLRRTPIYKLLDKLDPPQKVACDDDGPATAPSRVQPKAALADTTVNTREKQDKRDLHGVDDDADEAVGHDADDCDDEGDCSDENDDDNDASGSGSTDNHSDGPNRVGRRDRTASPEGTRTKNAKRYPFKQDRELAVMAEGYQKRFFDDMKPNEEVPVMIRRLPDEDGWAKFEICGLLSPREYRTTRTAD

SEQ ID NO: 4113 - protein, 397 aa, Methylobacterium sp.
VTALPNRRTLATGREPRPETAIRPSFDGQDPAALLEQIPRHETILPRVDVFTLPGGYIWFGDGVDGIALTADGQLALETATFARGYQSLPPEALRARAREIDEDWVTIVDCGCHNYYHLLMLAMPRLTYARAHLPEAWAAVPAHRPSPDGRPPLLDQLIALSGEGHRIRRVEDGLYRPRNLHVIWTNFINPPALHLVDETFACFDILARNVPPAPERRFPKRIFIERVGDMRLSDPNACRSLDRYLATHGFGKVRLETLDIGDQIRLFAGASHVVAAHGAGLSNIVFGSPQLRVLELNLDLDGRGTLRPWFLLLAAARGQHYQYLNTSACELADLPMGLAFDRLMGTRRQALRLRLARLRGRLDRHLVRAAILARRLRSGRALRGSRFPGRAPPPHS

SEQ ID NO: 4114 - protein, 215 aa, Methylobacterium sp.
MSDGAALLAILGAVLLGAMSPGPSFLLISRISAARSRSEGLAAALGMGLGAALFGTLALVGLGGLLSAVDWLAALLQGAGGLYLLYLGLRIWRGAAAPLPEAGRAGGPPAGGSLARAFGAALLTQLGNPKTALVYGSLFAALLPAAPAPWLPLVLPLLILAVETAWYGLVALGFSAPRPRAVYRRARIWIDRAAGAGLGLIGARLVHEALSGRRA

SEQ ID NO: 4115 - protein, 832 aa, Methylobacterium sp.
MIKVEELHIFEFRGIKKLALTLNRRNFAVCGPNGTGKSGVVDALEFVLAGTISRLTGKGRGDISVKGHGAHVDCQHDLEKASVEAVIWIPSLNRTVRAHRTVKAPSVLKLTPDSPEARAVFRKLEAHPEFALSRREIIRFVLAEPGQRAKDVQALLKLDELEALRLRLQRIANAAALASKRALTDRNAADADLGRAMDIAEVTDPLVLAAANIRRSVLGLAPLSELGSEASLRKGMAAVNDKQASRVTKAVAKVDVAAAAASIRSRVGDDFATLVEEAKAATCALQVDEAMLNAVVRDDFLKTALELYDGEVCPTCDTPKSLEEFGAIIGQKRAKLEEVRSLRDRAERAIAPLSAAIEDDLAFARTVYPHAKLLLDEAELKVLTDHGVALKSAAAQLRAFLPLSLTLGVLEDLASQGAAIEILVRLETLIDELPEPSDQDAAQEYLIAAQHRLEAFRKATAKAEAAEDRAVKARKVFDLFKLTSDSALEGVYAEVQRDFADLYRRINSDDEGAFEAKLDPALGRLGFGVDFYGRGFFPPGAYHSEGHQDSMGLCLYLALMRHLLGGSFTFAVLDDVLMSVDAGHRREVSKLLRAEFPDTQFVLTTHDKAWLKFMGTTKLVEPKDTVHFRKWTVADGPTIWAKGDVWDEIRSLANGDDISGAAALLRRSLEHMASEFCQALRVKVEFSVDGHHDLGDLLDPAINQLRSLYKEARLAADSWKASERIEAIRRLEKAFDDAASLAKVEQWQINPTVHYNEWANLHRDEFIAVVNAFHALCVLFECSACGVPIKVSPSRGSREYIQCPCGEVKFSFMKRPREKPAAPSAPALQTLS

SEQ ID NO: 4116 - protein, 167 aa, Methylobacterium sp.
MSASDRANITLPLPRFQQLGAIAERRGLPSASAVIEAWIGRAIEEGEIPASPPGFMAFKDDDGFLIEICGHMLPLMKPDRARMLAAVLSAAAGDTDPDLPMQFPAGRPVVLDLGEVALVVGKAGRGIRFIVKTKGAAEGEGIHLATSPTFVAGLAREIRAEFTPAAA

SEQ ID NO: 4117 - protein, 33 aa, Methylobacterium sp.
VSIAEIAEAGGFVADRNQTVRPSPWRLGRRDLA

SEQ ID NO: 4118 - protein, 72 aa, Methylobacterium sp.
MSHILSLASASAALTTVLSLLAAVASEPVPAASAARSPQAPAVVAAEAVPVRTIRTIPIDGRYDSTVRPTLR

SEQ ID NO: 4119 - protein, 69 aa, Methylobacterium sp.
MHISPDGLDKLEDLALLRAVLRTNARSAGTAERALPTLADRFGVAPTGSGRRKAEVRLDHAPRKIATGS

SEQ ID NO: 4120 - protein, 30 aa, Methylobacterium sp.
MFPGRSPAELRVGSRFMIARTAISSFGFRS

SEQ ID NO: 4121 - protein, 44 aa, Methylobacterium sp.
MMATTTRTRDMIPTDRIIVWALMAGLAIALLQYAESAALPAHFV

SEQ ID NO: 4122 - protein, 196 aa, Methylobacterium sp.
MTEHLAAGDAPMPGSTHAGSRRDRETDEPAGARRHDQAARAGGAGCGYAAVAREVTQSAERAGITAEQAIGAIQGTIRTLHQSAAAIASTVEEQSAVTHGMLALMQTAAPARLSPGRHHRPVRRSRRPIRPRDRTRQKAPSPQRGVFETIVDLERAIYASIDETDAEPEPFVWTKSADNILAGIRHFCQRNSHSNH

SEQ ID NO: 4123 - protein, 47 aa, Methylobacterium sp.
VRFSVWTSLAAHPPLGNINRARNAPCGHSAAFRQRFDGCPIHEPSGG

SEQ ID NO: 4124 - protein, 29 aa, Methylobacterium sp.
MHARGLVEAVLAIRAGRLAPEAYAAALDA

SEQ ID NO: 4125 - protein, 34 aa, Methylobacterium sp.
MAALILAMILIGVAMVTTLADDQVLVSLHRPRAS

SEQ ID NO: 4126 - protein, 64 aa, Methylobacterium sp.
MREKPLEHRGIYVKPINDPPVPRGGERLSITPTPLHTEEHMRPLMEALVEVRTRQAWGEVSRAT

SEQ ID NO: 4127 - protein, 125 aa, Methylobacterium sp.
MAVIPRDAVQRMPRVASPGLPPVDPMTRPAAFDGARDARMLASVRQAGAGGGARTDGDSMPAGSAGPVDGGDLHGATSSWRSPRTCHGRRRPEAFILDGLASGAPAPVIGETFKLDEIVEAHRPM

SEQ ID NO: 4128 - protein, 364 aa, Methylobacterium sp.
MTSVLTNTAAAVALQTLRATGRNLDATARQVSTGLRIGSAGDGAAYWAIASTLRADNGSLAAARDAIGLDRNTVEATARGLDRVINQLGAIGRTLVSAASAQTDRTKLQGDLRTALDAIRITADNTVMNGANWLSVDSDAPSFSATRNLVTAFSRQDGSVSVGTTALDTSGIVLFDTRAREGGGSAFSLTPATGSIPSLTRDIARAASVASPDGYQIQTWDGPSQRGGETLYLTWNQGLLDTQYYVRDASFGHQPFSIASMDLTSRYTDAKMVQAYVKVVDATRQILLDGAANLGVISALLTAQQDFAGRLMDINASSIGALVDADMEEAATRLKALQTQQQLGLQALSLANGASQAVLALFRQ

SEQ ID NO: 4129 - protein, 59 aa, Methylobacterium sp.
MKPAERAALKSAIKRYTRAKTASKAIALATLVKEGTHTPKGQITVQYGGQRKKKSGSAQ

SEQ ID NO: 4130 - protein, 188 aa, Methylobacterium sp.
VGLKALIRGLPLEPSDKDFDWLGPGVYFWENDARRAYEWAQAKVAQGRYKDPFVIGAIIDLGNCLDLLQRENIDLLTDAYGSLREINRKAGTKMPKNKDPRAVNKGDKLLRFRDCAVIRHVHEVIEDEELNDPDGEHYIAPFDTVRGLFVEGARAYPGGGFFSKTHTQIAVRNPCSIRGVFLPRDASA

SEQ ID NO: 4131 - protein, 80 aa, Methylobacterium sp.
MALDAVPTCCPFIQKLIMLVLDCSSRTGAARKQALFSETLRLEMDAVRARAPEGSLKVIRTIREIAEGALNLPRPLQGRL

SEQ ID NO: 4132 - protein, 94 aa, Methylobacterium sp.
MSTRQHSRRLIDEDTTDYEWSATKLDELLADPEVEGLAADMLSYGFRNGEFDPDPVYRQCREEYRRKEPAALLFFLAARLFERLLATQAARRLS

SEQ ID NO: 4133 - protein, 68 aa, Methylobacterium sp.
MQVALRRIEAPYGDELQVTVDAEALSVPRVVAVVLANAAGEDEADRIGKAVLKALQYAESLTTSTPGM

SEQ ID NO: 4134 - protein, 74 aa, Methylobacterium sp.
MLGAVLGAALPALVRPAQAEGYVARTRPCAPAPCRRPPPPPGFGYGPPRIVSGYLPRNNTLPMYNEPPARPPAW

SEQ ID NO: 4135 - protein, 386 aa, Methylobacterium sp.
VIGAHTPQGVPFVVGSHHLHREFGALGYAATHVPVPLGAEDVFTADHLNFKRIRAVSWQRTMTRRRDAHSDRSVVSLVPWAAVRRFGMARGYRLGYGRMLLPGFGEDDRSPELLIVDHPRQFWLVRQLKPKTLLYRPTDAYSHAGHKDHRVTLEIEGWLLERADGLVLTARQIEERMRQIGGGRLPLPMIVEENGVDLSIFRAKRAVTSRTSARDGGTRLFYVGSLDARFDHAFVAEAARRNPDCTFTIAGPPHADHGATYEEIPNVHLLGPVRHQDLPDLMGRADVGLLPLSDHPFNATRSPMKLYEYAAAGLPVVYRASPELCRRGLPFAFPYRGPDDFGAAVRAAALYRETGGAEMRAFAEAKSWRGIAERILDFARRVGARV

SEQ ID NO: 4136 - protein, 97 aa, Methylobacterium sp.
VLVRSAFLYASHTSALASLGKVALLLLVELPVVTLLVAFVVNGFVLHIIGGRLRRMRPGRMPVGLFARHRSERADELEHYPSHPGGEPSSRQPDHER

SEQ ID NO: 4137 - protein, 92 aa, Methylobacterium sp.
MRTATLILDLASAMLAVGGAAQAQGIFRAAEQGAARGNAVARPIGGLVGAGVGGVNGALGIHPRYRRVHALRGYHGYRHRHCYRHRHHYHCR

SEQ ID NO: 4138 - protein, 72 aa, Methylobacterium sp.
MSARTLPSVWVAATLAIGLIGVTQAAPLGAAQPNVDVTQLSTGLIVKSVTAVGMAHRSARRTARRVGRRHGY

SEQ ID NO: 4139 - protein, 91 aa, Methylobacterium sp.
MFGLTAQIRRAATSVAANIAEGHGRETGGAFVQFLRIAQGSLKELETHIILSGRVGLLASTPVALLLGRCEEIGKMLRALIRALQKPEGGR

SEQ ID NO: 4140 - protein, 238 aa, Methylobacterium sp.
MLRLRRSDPRGRASLLWVLITCALLALVAVLVLRLGNERRSYAEAIRTLETGRAALRQEIAERQAASGSLADLKAEIGRAETRERTVAQSARETEAQVAGLEARRRAAEEAIAAAATLRTDLSQARAKVDGALRESDDLQQQLAASRADRDQLSAAIAALQQKRAELAAEVSALDAERAGRVAELAKLDGLLERTRREVSQAQARAADGHRKALGQVEPSATDPPDASGEEPGAPGTR

SEQ ID NO: 4141 - protein, 43 aa, Methylobacterium sp.
MRAYAGSTGGASAQLLRAARELSHHSENLHREVGVFPAGVKAA

SEQ ID NO: 4142 - protein, 107 aa, Methylobacterium sp.
MRLVPLFSAIGLAAIAAVTVQPAPAKAGPLDGLAGAAVGFALGAMVAGQRPAYAAPRGRRVVYRQAPRRHVAQRSRPVSPRGAAISTVSDPFAGAGGGAKPIPVAGN

SEQ ID NO: 4143 - protein, 145 aa, Methylobacterium sp.
MSRFMTLALAGATALGTSVGAVQTAQAAPLPALSGNQVGGANTAVDHVGWRRGYYGGGYGYRGGYGGYGYRGYGYRRNVGGALAAGAALGLIGGAIAASAAPRYGYYGGGYGGYGGYGYPAYGYAPVGYGYGYPAYGGYYGYGGW

SEQ ID NO: 4144 - protein, 35 aa, Methylobacterium sp.
VAQLMAGADPTLLPSRMERARRAAALYAEAARRVA

SEQ ID NO: 4145 - protein, 461 aa, Methylobacterium sp.
VKSMSESFESVRDPVLSLFQSAVAEVAERIDAKPSGPGARRLERSASATFNDEATAIARRECGRDAGIGSGVRPSSPAARDLSPVDMGKVCVELALRYVRALASGNQTALAEIEDEYRTGTCDVEWVTTLRAYAGYFGPDGKRKPIPYVRPASAGPGTHEIKAGSRLALVSDWGTGARPAIEVLRSIAGVHPDVLVHLGDIYYSGTEKECEDNFLRPITRELRTKRPTLVYTLSGNHDMYCGGVGYYDLLPKLNEESLRQRASFFCLRSTDERWQFLAMDTGLHDDNPRSIADALTHLEDDELEWHCQRIEEFGGRTILLSHHQPFSAFSAIGAKPAQGKRKASNPHLMRAFERMNREGRVAAWFWGHEHSLGIYEPFSGIKVGRCIGHGAVPVSVLDDIYKPLDDLEQTPAIIEGTRLQTRGGVFAHGYAVIDVGVGSCRARYLQVTDAGTEEIFSEEIS

SEQ ID NO: 4146 - protein, 94 aa, Methylobacterium sp.
MARDRADDDALIEELAAIEHERWSHWQRYVHGKAARQPDGSLVLPAELVERWERQFDSQYEDLPEDEKESDREQVRRYLPVLKRWSQDDEKRSG

SEQ ID NO: 4147 - protein, 327 aa, Methylobacterium sp.
MRKALIIGIDHYDRLKPLKGCVADATAVADVLETNFDQSVNFTTPRLLTATDRGNPLDRRQLRTEVEAVFASDPEVALFYFAGHGFVDETGGFLCASDSQDGNDGLPLSEIMTFARQSKAKNRIIILDSCYGGIAGNRAGGGGVAEIAEGMTLLTASTEKEYAYEGGNGAPGVFTNLLVHALDGAAANLVGDVTPGSVYAHIDQSLGPWGGQRPVFKTNVKSFVSLRRAKPPISLADLKKLATLFPTPGHRIRLDPSFEPERERPDTGVAPDPANTEIFAVLQSFVKVNLVRPVGAPHMWHAAMDSQSCELTVLGEHYRRLVAEKLI

SEQ ID NO: 4148 - protein, 70 aa, Methylobacterium sp.
MTKIKGRNDGPGGRNEHYDIGSRKNVPRRNVVAEIKRGEHPGAHVVTVNGREYARDNPDGSTRDNVNRDP

SEQ ID NO: 4149 - protein, 131 aa, Methylobacterium sp.
MKRPRIEAVPKQVDVVTLADGRFATKPGIELERFLDNILDIRDHIVAGRPLPEHYYRRSTGRDYLLETRGWLHLHVGHDIDDDVLLIVEQTPERVIFIGLTDHGIFRERPAGKSFARLGSRIAKAKLPAKR

SEQ ID NO: 4150 - protein, 65 aa, Methylobacterium sp.
MALPKSDREPAARPERPRDGDLIPNETSESFRFVRRALRQGRVVSTQGLSDAEVRAVLLGQRKDA

SEQ ID NO: 4151 - protein, 74 aa, Methylobacterium sp.
MKLRIAGLAAAALVLLPGAASAQWYEREPRHHHHHHWDHHHHHGDRHGDERHHRHGYDRPIHFDRGHHHHHHGY

SEQ ID NO: 4152 - protein, 183 aa, Methylobacterium sp.
MTYLRYAPDIERPAPDEQETIHGIIETAHPVATLRLPRQDAYGPDRVRDFDEVMTFRLDGRAVAEAPVVALPVRGGRVVDLEEELQDAPVTRPGRIEDDLDAFGMRPVVSIGGIRHVATRVPLSPIASDGFVRHWPTLASAGLDRSSRPFEDLASQVIRILVDSDHSLICETALCLHILMTRG

SEQ ID NO: 4153 - protein, 37 aa, Methylobacterium sp.
VTCPHLQSTETLIALDLKDGTLTPAKFQQAITQTCHV

SEQ ID NO: 4154 - protein, 143 aa, Methylobacterium sp.
MTKAPTQAMRGMALALALALLPAPAVAHGDAAPQPIDTKGLPELGDDIRTANPYAGNALAIEIGANGYNQNCARCHGLDAKSGGMAPDLREVEAGEAGDGWFITRVLHGAKKDDRYRMPPFEGILSQEAIWAIRTYVESQPKS

SEQ ID NO: 4155 - protein, 85 aa, Methylobacterium sp.
VSGAVSSLRYGFTAGLPGFNVSDPTDGADCGPGAAVSGGAAGFGGSERAGPGASTDAVPSTRARSAGAARVEEGRSIGFCSVTIL

SEQ ID NO: 4156 - protein, 74 aa, Methylobacterium sp.
VRAPISRPAQGETASGTDTLARAMRLATQAADDTQGAAGSMLAVSDGLGRQSRAIEQQVRGSDALREPRPRAAA

SEQ ID NO: 4157 - protein, 397 aa, Methylobacterium sp.
VIEQAFRVDERDRRRRETVFGLALGTFFYVAVLSIDWITVPDVCELNLVVRLCIGVPVNLAMIGLVARRDCGDAARQWAACIVGLACSLTISAVMALSVSPGAIVYVSVNLVILGFTINLVALRPGVAALLCVVITAIMVAAAAASPFGTPGVVLIYVVLGTMVTIVCVFANWSLQNERRRTFLTLRRDKIRLRQISAQRDLLERLAAIDPLTGLANRRGFDAMLDGDIARASAGMGIGVAMIDIDCFKAFNDTYGHPRGDAVLRAVAAALAEACGPGVRLGRMGGEEFAAVAVGAEPAALRALGERLRLGVETLALPHRRNSAGRVVTVSVGLAWTCSAGTADRAALFGAADTALYRAKGAGRNCSVGAADELCAASPRGPGDARTCTEPVVRKAF

SEQ ID NO: 4158 - protein, 158 aa, Methylobacterium sp.
MKRVLLASSLALGALAMIPAAADARGFGGFHGGGFHGGGFGGFRGGGFGGWRGGGFGYRGVGFGGGWRGGYGGWRGGYYGGGWRRGYGYGLGGLGLGVGLGLAAGGLYGGYGYPGYGYGYAPVGYGAYDYGYGGGCYTVPRVRWTPYGYRRVLVERCY

SEQ ID NO: 4159 - protein, 116 aa, Methylobacterium sp.
LNAAIQREWTVNLGRRTALERLAHLFCELFIRLRAIGHTDGNSCTFPITQIELADATGLTSVHVNRTLREMRAAGLIILKGRQLTVPDLAALRKAGLFNPNYLHLECDGAHLSANA

SEQ ID NO: 4160 - protein, 38 aa, Methylobacterium sp.
VPVHQIEQHLPGNLREAHGRDRGDHVIHLAQDEDVQVA

SEQ ID NO: 4161 - protein, 36 aa, Methylobacterium sp.
MTRLKTRLTAVAVAGLAAAVALAAYAQTLALPTHFI

SEQ ID NO: 4162 - protein, 115 aa, Methylobacterium sp.
MALPLCVVRWLRSARTWIALGIFAPLRMLVMSWTMLNEAITQEAACGVRVDAVRLERVEGVLGGSAAASCAGHSRAFSAYNLHMLRRRTHLSLCIAVGSTLILTTVAAVALCWPS

SEQ ID NO: 4163 - protein, 167 aa, Methylobacterium sp.
VPSRAKPAPVANGPRRSVCGRSRRRSHPRFPLRASTRRPSHGSAWPLERSPPKWTPVRRKRARYNNGSERIDAIIDRLLEVTEQARALTDPSAIEALNVEIDRLATEVVRYAREREREPDGRTMASVSIAIDTAKATVADCRNLVGSPKEQSPLRILRPVRAPGPDA

SEQ ID NO: 4164 - protein, 29 aa, Methylobacterium sp.
MPGCGHFPHREKPDAAAQGIARFLGQVTG

SEQ ID NO: 4165 - protein, 320 aa, Methylobacterium sp.
MLALAAVLGALLPAAAQTSYPTRTITLVVPFAAGGTTDIIARMMADHMSRTLGQSLVVENVTGAGGTTGAARVAKADPDGYTLLMGNLGTQAASVGLYPRLSYDPRTDFAPIMNSASTPMLVVAKKDLPVKDFREFVAYAKANAAKLNYGSGGHGSTSHLTCLFLDTLIGASPQHVPFRGSGPALNALLGGQIDYVCDQTVAIVPTVQAREAKALVVAVKNRLPVIPDVPTSGEQGLPEFQATGWNALFAPKSTPKAMIDTLNAAARAALKDPTTRKRFLELGAELPEEAEQTPEALGNLVRTEIDKWVPIIRKAGVTVK

SEQ ID NO: 4166 - protein, 107 aa, Methylobacterium sp.
MSNEQHQGLPVAGYQAQTSDKVTVVNANKELEERCIRAAESIRDTPGMDGRMAALAITNLQQAFMWLNRAVFQPGRVALPEDAAEPRVPRHDPEAAPATALGGRPHP

SEQ ID NO: 4167 - protein, 312 aa, Methylobacterium sp.
MEMIANAGTNPADPFDWYRAALAGQIHELRLGHAPCGFFRLRRRDGTLEPVAVWPDEGGFRWAKVGRAGEPECLVEPEAEAAFCERVIAHCWRSPVPEEVYFSVVENDAPWPDMPPERTTDYANMPSDPLEALRVELEGERAEAEAWLAAGPIADQAAADRAANWALRFADMEKRAQDGRRAEKVPHEKAAKAVDARWRPVQDDAAALKARLKDAQTPFLVEKRRQEAEARAAAARTGDALPAASNASAGTAGRKTSLRTVRTAVIEDFDAALMALRENPELRELVQKLANRVATSGGALPGCRIVTTDKAA

SEQ ID NO: 4168 - protein, 74 aa, Methylobacterium sp.
MRHDAVPTARYVITATAREGIVQQTRVMAASAVVLARSWQDRGYADVKVIDPKGDPLSPEAFRIKFMDGVKRFR

SEQ ID NO: 4169 - protein, 59 aa, Methylobacterium sp.
LDVRKYFGTDGIRGRANGVITPELALKVGQAAGLVFQRGEHRHRVVIGKDTRLSGYMIE

SEQ ID NO: 4170 - protein, 66 aa, Methylobacterium sp.
VERRHAERGIRVNCVAPGPIWTPPMVPMKRPGQPRGLAPVYVMLACEAASCVSGATVAVTGGKPII

SEQ ID NO: 4171 - protein, 59 aa, Methylobacterium sp.
MERLYRGLETGLLGLGLCLGLAAFAAMSTPRDALMPREAAMPLAVTLPMLTVVTERTPR

SEQ ID NO: 4172 - protein, 91 aa, Methylobacterium sp.
MPSLRHLLVDAAAVALVGIGLTAAASGYLHNLPDPAAASPPAWDEPLTTGSIAPRGAAVETEASAPAEAESPPAWIDPPLRASRLSRHRPS

SEQ ID NO: 4173 - protein, 31 aa, Methylobacterium sp.
MFACAFCHVSPQSPGHGDFAGLRLSTQERQM

SEQ ID NO: 4174 - protein, 173 aa, Methylobacterium sp.
MLVDDTQRAAEPLARVIRKLGVVSFHDEQPGDVHWCAEAQRFEYRDRADPSRVLLEYEEGGFIYYLPVDASSLRPGETPARVRAPTTLMTAGEASEWLNATRDNGDGADVGPDWKPLDIICDACGVAQLQARSTAGRVDCRCPACEDSTAARRPVAAGARGSGFGGIEGSRGE

SEQ ID NO: 4175 - protein, 44 aa, Methylobacterium sp.
VGKGPRFIKIGGRVIYKLSDIEQWERDRRVKSTSEYEGETFQGA

SEQ ID NO: 4176 - protein, 367 aa, Methylobacterium sp.
MHVPLSHQSAMDQLLAAMAAQGIEPTHPLLANGKLERFHVEGDHKGSRNGWACIHLDAAPAGQFGCKKRHGEHKFSWRAAGITKPMTAAERRAQQAEWDRKKAEKAAAERKRHADAAEQANAKWVAAAEATDDHPYLVRKRVKAHGLKVGTWEFTNTDTGEIFTLTDNALLVPICDKSRKIHSLQAIFPDKILGQGKGARDKDFTKGGRKAGLFHVIGRPQQVDGRAVYILAEGYATGATIHELTGNCVLVCFDAGNLLPVAEAIRSSKPDAIIVLAADNDQWTITPIENPGVHHATRAAAAVGGLLAIPPFAWEDGKQDDEGKWSGPSDFNDLRALDGVEAVRRARSQPSSSVVLLATSAMTTPGR

SEQ ID NO: 4177 - protein, 43 aa, Methylobacterium sp.
VSALAALRRDLRTLTPPQVLLVALTPLGAFALGMLIVFPASFA

SEQ ID NO: 4178 - protein, 39 aa, Methylobacterium sp.
MTKLDAKTLKAVTGGTACPPAKDPCAPACKDSGGKSKKC

SEQ ID NO: 4179 - protein, 38 aa, Methylobacterium sp.
MTKLDAKTLKAVTGGTAKCDPTPACPPAKDNGGKSKKC

SEQ ID NO: 4180 - protein, 83 aa, Methylobacterium sp.
MNDDPLLARLDAALREAEHLRLEALRVQREAAVRLAEIRWSGMGLSDAMDRSLALRLGPRPARPGGETAPTRSAIPAGLLPHA

SEQ ID NO: 4181 - protein, 32 aa, Methylobacterium sp.
MEDIPESRIEHVAMMEGILISRATGGSPDRHA

SEQ ID NO: 4182 - protein, 287 aa, Methylobacterium sp.
VTVEIQTFSDAAELEADPLWQEAPITKRVRPMLLARPFRGTRIRPVITNGGDALVLHFATPDPAFGKGTVVSASPTRQIMRRQDRILIVWADRVEVIHRGGSVDFAKRRAVDEAAKDLLAHMYSATARANEVRQQVAVERIRRARVRLTASESLLRAAVEAVDEMEPGDPFLGVAVDHFVACARHLEVDRQMLGEICDRVAIEPGMPDDVVVEMLGRRLEVMTPEVWCGLAAAAGAGAFEPVRIEQHVNRLMEGPDELCLYEQVRVAAEMVDAHTNDAAAGFPARGS

SEQ ID NO: 4183 - protein, 218 aa, Methylobacterium sp.
MARGRAVPHAVRERALDLWALTTGMSGVGIALAVGIRHGTLSTIVARARAAGDARAIHRQAGPILGSKNRAAKPRPERALNLWSTDPGMSAPEIAAAAGMKLAGFLSLLNRARKAGDPRAVYRDGKPMRTPREPGAASTRRQPAFRRGPYRTRSVARALRDDILTSWAEGLDGETCGARYGVTPDYVLQVVARARESDDPRALWRRGMSPTLRALTPA

SEQ ID NO: 4184 - protein, 32 aa, Methylobacterium sp.
MTLLSVELLPIWLLPLAVIAFAMFDFEEGMDP

SEQ ID NO: 4185 - protein, 28 aa, Methylobacterium sp.
MADVCLAYGREVLIARPTTRACPRADAS

SEQ ID NO: 4186 - protein, 56 aa, Methylobacterium sp.
MRDLLKILAAGSLLTVYALAVPALIGDISAAPRRPGTAMVAEAPEPFLPAGAPRSL

SEQ ID NO: 4187 - protein, 164 aa, Methylobacterium sp.
MGEGGWRGSPPTDEPINRRPSIKGEDGRVVFDGLFDFSGANEAAFTLETKLDGDTTRTGTIVLNAETLGRLQARLGFADLSKLTGPDLVRSINAQIEATGETGLRGTLAASLDPGAAARLPPTRPASSAPAPSRRPTRSISAAPSTRAPPGSSTISAPKRSASI

SEQ ID NO: 4188 - protein, 398 aa, Methylobacterium sp.
VTPRTGRITLNAEILDALKTRTKVEALASMTLSRVTPDELVAAINAQIEATGDAGLKGTVRAALDATGRITFTTGDYGLSGAADGTGARTDRVYAASGSERTIEVRSADTSRLFTSGFDIGFGIDRKRDASGQGSWRDGTAALVAGSRAYKASDTIDFSGTNEVAFRLATRLDAATERAGRTGLQGTVRASLSATGRIVIRTTDSLDLGADGTFGGFGKDGDTAYSGVGSGRTLSLQNIDRTAATQTGIDIGFGIDNGPDATARNATRAYLREALEADAGEDDAGVRLALYFSRIGPSIRSGFDILADKALSQVIATVLNLPETTGSSSEAVTARARLIERRIDIKAFQDPRKLEAFVGRFSVMWDIRNRAPSPALSLFGGTGGAEPLYSAMSRRSWF

SEQ ID NO: 4189 - protein, 32 aa, Methylobacterium sp.
MVRTGGIDGQAMTSLELRSVRGPRPDRSADRG

SEQ ID NO: 4190 - protein, 313 aa, Methylobacterium sp.
MIEYGKFLTGGGRMAIKIMEHDWGASALGLVEAWPRALRYTLSGMLNSAFPTYLAWGPELISFYNDAYRPILGIKPEALGRPFPEVWSEAWEQIGPLTDRALGGEASYLEDYTVTVDRHGARERTLWTFAYSPVRDEGGSVRGVLCHVHETTGRARTEERLRSALREIEVQQARFGALIEHLPFAAGLFGADGRALLANPLCRRFLPSGKAPSVDPDARTQWTGFDAEGRIVSPDDYPLAQAIRGEVVRDMSFLHRTRDGDACWMRVSGIPVRQGNGGIQQAIVVLRDVDRETRAEAALRESEERFRRFAEHS

SEQ ID NO: 4191 - protein, 28 aa, Methylobacterium sp.
MATVAPAVSSAAVIVLRMSLFMGRFLVL

SEQ ID NO: 4192 - protein, 117 aa, Methylobacterium sp.
MPRSRWLPGLLLCSLTLSAAHAAPSGGPVAEHDRTIADAALRRQMKAPRLGEIWYRREGRTLCGLVRNTPGTDEAGWRMFMVVLESGQSLVEPSREEERRDKRLVLEKLKLLSAECD

SEQ ID NO: 4193 - protein, 271 aa, Methylobacterium sp.
VIAAALRVARAAEPEAVRQAPAPPVLSFDRVGFAYDGRTVMRDVSFGIRPGEIVALLGPSGCGKTTILNLVAGFLAPTEGQALLDGRPIAGPGPDRGVVFQAAALFDWMSVAENIAFSLRCAGAGRRARRRAAEEMAALVGLAGREDAYPYELSGGMRQRVGLGRVLAARPRVMLMDEPFSALDVQTREGLQEEVLRIRDRTGCTILFVTHSIDEAVFLGDRIFLLEDVSAGRFETFGVDLPGPRERTENRLAPGFLRLRETIYRRMRAPR

SEQ ID NO: 4194 - protein, 462 aa, Methylobacterium sp.
MSLERIHLDFATIRTALAAGVSALALVAESHRRAAASADDGIFTALVPADAALAQAERQQARAAAGESLPLLGLTFSVKDNLHVAGMVTTCNCPGFAIHPDESAPAVTRLERAGAVLVGKNTMDQFATGLNGTRSPEPLCRNAVDPAYIPGGSSSGSAVAVARDLVAFSLGSDTGGSGRVPAACNGIVGLKPTLGLVSTRGLVLNSRLLDCIPVFARTCRDAWEILDLIRGHDPQDPGSRPDADAIARGPVSAEPSVLAVFRPAEMPFFGDDHARAAYEAGLAVLARLGHTFREIPFGPFAEAGRLVFQSALVAERLVSYGTILAERPEAIHPAVRSAIAAGTAYSARDAFEALDALRALRRRAALELAGTATLVVPTVPTIFTIAEMLAEPMARNTQMGTYTYFVNPLDLCAVTVPGRRRPDGLPSALCFVGQAGTDHVVSALATAFEDASRAGSVLGRAL

SEQ ID NO: 4195 - protein, 56 aa, Methylobacterium sp.
MSPADTPEPNGEPTPIGDPSPEPQTPEGDPPPNPPAPQPPGPIPESDLEQVEEQPS

SEQ ID NO: 4196 - protein, 446 aa, Methylobacterium sp.
MPTPRPRPFFPALVAFESGRDTPRAFLEGCLEELTRWEPTVGAFTHTDLEGARRAADAATSRWKAGRPLSRIDGMPVGVKDNIDTDDMPTGNGSPLYDGYRPRFSAASAQALREAGAVILGKTVTTEFASTQPRGTRNPWDLARTPGGSSSGSAAAVAAGMVAGALGTQVVGSIIRPAGFCGVYGFKPSFGGINRGGSLDFLSQSCTGSIAASLEDAWILARAVAAEVGGDPGYPGLGGPLLPPAARAPRRLGLLRTAGWPVASEEARAALEAAAGVLRRAGVAVSTPETSTSLAALEGAVAEALPETLHMLAWEWRWPLNAFVARNAEALSPSSRERAAVARAVTREAYVSLLQRRRKARALFATVMDDHDALIGLTAPGAAPVGLETTGNPICVVPGSYLGGPVVAMPLLRDGGLPLGLQVLGKSDEDEVLFTHASWIRNTLRS

SEQ ID NO: 4197 - protein, 42 aa, Methylobacterium sp.
LINALAAVFTVLAVLLLRAVLKLAILPFRALRSLWRRQTAPV

SEQ ID NO: 4198 - protein, 78 aa, Methylobacterium sp.
MRTIQRLALAALASAAAAGSAMAEDRIDLTPPLYREQARVTAAVRPASELTTTPNLTAAAPAAPQAPRFVAEAGALTR

SEQ ID NO: 4199 - protein, 27 aa, Methylobacterium sp.
MVSSTGPTRVVIIVAYALMKGWGQGES

SEQ ID NO: 4200 - protein, 353 aa, Methylobacterium sp.
MLDERTRKSFPIADPEPSAFGAAAGTRDWVAEFRREQAHLIRTAPGDGASRLLPYGVGGALALALTVALTTVLPTRFPGAAAPGDRAASAPAVPRMPASELAEAREEGLTFDLARARQEAEAARAAHAQDAETLRAAHAREIEALRAAAAEAEAAAEAKGGLLARDLESARAGLAAARRQAADADAQAAESRGRSERLAGQLAEVEARARAERAGSEAALAQAARERDEARTRLAETARATPPPDTDATTVEPAATPQPVDWTLFSLRLAPAEEASATAPLVRDPQRAGSDQKGPERKAARRARASTPVRTDSAPRADRPGRTRAGTARAPAATGGPEPAPPLPGVGLAEPDA

SEQ ID NO: 4201 - protein, 81 aa, Methylobacterium sp.
MPDLLIKDLDDATFRTIAFQAEAMNRSVEDVLRELIRIGLLHDVEGRVAVADRIRSMSRPPPPGTVIEDSTEIIRALRGRI

SEQ ID NO: 4202 - protein, 343 aa, Methylobacterium sp.
MEGFWAREGEGEWPMRSVPVRAVTLLCPAMVTGGPQALHQLAFALNRRGLPTRLAYYANGGRLVREGDAVRCVAPPQNPCLVAYDKYCPVPAERFALTPDHLVVLPEVLAHLHRDYAPAQAAVWWLSVDNAFHERSALRDAGVRAALFANRELRHWAPTFYAREFLRREGVLEIAMLSDHVDDQFTTWRPEGPGPDAVVAYNPRKGGALAEAFFARHPDLTPRPITGLNRRGVWEAFRRARVYLDFSHFPGREFMPREAAGSGAVIFVRNVGAAQHFDDYPLPDAYRFLDAALEDGTLHAKVMSALAEPEPHWAVQASLRQNVRWEAETFDRQADRLVEQLSA

SEQ ID NO: 4203 - protein, 445 aa, Methylobacterium sp.
VIGYGLNEVEGKSHRLFVDAATVTEAEYAMFWENLRAGNYVSGEFMRVAKGGRKVWLEASYNPVRDADGQPYKIIKFASDITSRKNENIRQSMMIDEVPVGVMTADPSDDFKINFINKTSLSTLETIEEHLPIKASELIGRSFDIFHKNPGHQRRMLADASRLPHRAKIKVGPETLDLKVSAIRDAEGRYVGPMLTWSVVTAQVAMVAEVTRVVDALRQAIEEMRSSAKGLNTSADQSSELAASAAAGSEQMASSLQEISSQVGRVSERANQIADQANATVGTVRILAENAVKIDAVVGMIKLIADQTNLLALNATIEAARAGAAGRGFAVVAAEVKELAGQTARATEEITRQVQAIQGITQQAVSAIDTITAAVDELSRLTLTMASSVEEQAASSQEMASNIHGVSSAAGATGQLAESVRQISERLADYPAGLTQSVETFLKAS

SEQ ID NO: 4204 - protein, 281 aa, Methylobacterium sp.
MTKITSLSALLAVLASGTALAADLPRRVAPPPSFNPIPVFTWTGFYLGGNAGYAFTTRESRNRNAAFLIDDRDIGTVGGTFGFNNRGQNGFSGGLQIGANYQFTPGSGFVVGVEADAQYLDAGRRRSGVVAGAGTVLNPNAVFFDPRATAGLEYFGTVRGRLGYAFDRTLVYATGGYAYGGGSEQRYFGATDNAQMRTGWTAGAGLEYALPTESFLNFFRASAVTMKVEGLYVNLERNKGLALLAVNTVTGDVFLRTPDRRSLGDDFAVVRAGVNYKFGSY

SEQ ID NO: 4205 - protein, 31 aa, Methylobacterium sp.
LINAKIESELLSMSILTARRVWRVSIVPMDD

SEQ ID NO: 4206 - protein, 559 aa, Methylobacterium sp.
VRQIILALVVSVVIVAGGLLAGVSQYAGARRALVDDARTRALRFDAVYREASEARLQALRLAAEIVARDTLVIDPLARRDRAELARRAVPLFEQVLKPRFGVTLLGFQGTDETTFLRAHRPEQFGDSVAGRAMGAAVARGRSTVAGLEIGRASGPELRAMSPVVSGETLVGTVELGSSLFEALQIAAQATGLDFGFAMERRAAEALDRPPGPEALQKGDAVYIRFSRPEVRDLLAAAPVDLAEQAPQVVDGAGREIFARTAPVLDVSRQPVVRITLVEDLTDPLAERRGRIVLYTALGTALLLALVLAGLLQFRALRTRLERSFSGRLREVHAKAQAYDRISQSLRDLTAWKLGLLGELVLLIRDPLTAVQGALETAGRAGEPSAGAALAFAAGEVRRLNAAVADHTTMLAMRDRLRRVEAGPVDLAALAEAVAADAGGAPAIRAAVPADLRPVQANAALLRAALRTLVLTLQRGSDAAPIVIEAATEGEGIVGRIAGSGGWSAGPPGLEEVVAFGSAMHQPAGSPLILARLTVEHFGGTLALLDEPGLAGFRLTLKAA

SEQ ID NO: 4207 - protein, 488 aa, Methylobacterium sp.
MGARGVSRPSPALVLPFLTVAGLLLFEDLFNAPLAFLTGIDPETIRRCEAALLVAIAALLAARFVRRDLIHGLLEARAGKALPHLLGDVAGLLVLVLGGTVILTGVYGRDIGTVLAAGGLSLAILGLALKDVILAVFNGAALSAENAFTVGDRIRVGEVDGVVVQSTWRSTTILTKARRLVSIPNVALGTAAITNFDRPDRSEQRILEICLDYDVTAESAERILLAGVIGAAGVVLVDAPRVHAIRLERDGVLYAIRYVIADHDNGLSSDHAVIRSILSHLRDAGIGVAYPKQEVVAAERRVRVADRTFDRRVLVQQCALFRGLEPAAQARIAEALIERNLQAGALFIAAGEVRPSVFIVGEGLIRRTRVRPDQVGFVEERYVATQTFGRRALLSGLPHPAPVRAVTQSLVLELTREALAAVLRAHPEIRAPLAGNLARAPLHDVAHATEVSALESRTERPVAFYLGLLEAVAPEAPPPDGGAGPGRS

SEQ ID NO: 4208 - protein, 53 aa, Methylobacterium sp.
MAEIGRGPPAAERPNGYGHPMLDIVFLAGGLAVFALAAGYAALCERPALCERL

SEQ ID NO: 4209 - protein, 79 aa, Methylobacterium sp.
MTLALAIPVVEAAAFTAGCVLIHGHRHRPEPVTFALLGLLCLVALGGFALVLAHVGPDDPMAATAQLPFENHAAGAIRY

SEQ ID NO: 4210 - protein, 89 aa, Methylobacterium sp.
VAAWFSEEAHRQQARNLASQRAAALVRSKAGSMAIRAMADALMQKGEIKADEIAGLCREAYGGRQCEFGAWNAHWPPTLEQLRSGYIPD

SEQ ID NO: 4211 - protein, 76 aa, Methylobacterium sp.
MSSSVLLRLVRTEITAAEGRASALADAIRGRLKAGADSTDVEQALFHVLDSLTLLRAKQQALHRVAIEQQQGSAAA

SEQ ID NO: 4212 - protein, 58 aa, Methylobacterium sp.
MAVVLDIAKSLHNRHAMIFCGHGSLLGARLAAALRRGADRRYAEQRDRIERTGCAGIF

SEQ ID NO: 4213 - protein, 71 aa, Methylobacterium sp.
MGGGGHAGDAAAEAEPFVARGDDPPQHLDRRAMPLDAVIAGAMAVLATEAERRCPGPMTGWATIPARTGTR

SEQ ID NO: 4214 - protein, 57 aa, Methylobacterium sp.
VRPILDEPVPAGSARTRHRLIVPGPEEPTSKRRQRTSAEPAVLKLRQIEVQMAQARR

SEQ ID NO: 4215 - protein, 522 aa, Methylobacterium sp.
MIDTPALPNAITITWISRGLLVLALTAFGDWLFYDRIVGLSLALFLIALAATVPLTNTVQTDWRARGLAFAVLILGLLPLLEDVGVLAVLFGIGGLLGSMVLMTGGLAPGRLATLGAVRRMLVAGPFQIVTDLTAGMSRQLAAGAPRWRWQPIIGWVTPILLGALFALLFAAANPVIDAWLSAVSWSSLQPRISVGRALTWLILAALAWPFVTVRRRYPARTASPEADAPSAVPVGIAAALGLGPAVILRCLVLFNLLFALQSTLDILFLWGGLALPAGVTYAAYAHRGAYPLIVTALLAAAFVLTVMSPGGPGERLPLIRRLVYLWIGQNVLLVISAILRLDLYVAAYSLTLVRAAALIWMGLVAGGLMLIVARIALRRSNGWLLAANAALLTLVLYACAFANLAALISDYNVAHSRELGGGGGSFDLAYAMRLGPDALPAVDRYIAVATGPNRAAAIHWRVRAARETARTMQDWRGWTFRNWRLARYLAATPAPPPAPTPDVALPGGDGALPDGGAAGPR

SEQ ID NO: 4216 - protein, 345 aa, Methylobacterium sp.
VPERAHPGGRGMRPLKPIPRLHGLRPFGLFIAAETAGLATAMAGSLDMAWLPIGHGLCLAATAAAVRAERSGECTFAVLLLLLAACTGPIGPAGLLLVQSVLTRTRICTNELDAWYRRLAGDTATDPSVTLYDRLLDGRARRTGRGGPDHFPTVLHGDLVRQQALLGLIGLAYHPDYRPILAQALCSQEPSIRVHAAAVSVKLRARALAEFKRAQEAEADGPAAECAGLALRLLDLADGGFLDAEKAGVARTQALALVVGAGRPDVAACDVAARDPIGRRALAGLERWEEAVADPEAAGPVRDPEDLRLRMLCLMRCGQARALHALLGARDARAPTKRGGLHHVV

SEQ ID NO: 4217 - protein, 361 aa, Methylobacterium sp.
MATDKSAEAVRPRRFRLHGLHETALIFLVLLGIEWIAPGPAFLARLSPHPFWIPVILVSVQYGRVSGLAAAALATALASLAGWPAQTPQEDFYTYSLRIWREPALWIIGALVIGGLRSRQIRDRQALEADLQSAEVQRNALGAFCEALQAELSQFERAAATTTAGSVAAALEALHALRSGGASAAVDRLPAALAAWLGETRWSLHLAREGSLHRAAPTPREGGCEVTGALALARLYGIARRTPRTLSVFEERDAEVLDGIGIFACAIRCRYPAGTLGLLVVESVEPGRLSPALGLATSLLADTLGMVLDPARAPAASPVEVPPVDALLADAPSSGGEMMAFAAIDPACRSGRIPEAAACAR

SEQ ID NO: 4218 - protein, 762 aa, Methylobacterium sp.
MAGSMRTGPDQRPAPSPHRLAFVLAVIGSLCAAAPWPLPALSAENGSEEPIPRTLLVLYDGAREPEPADTRVHRYAEAVLNHLGFVVAYRDIRGPLPDPEAVRAYAGLLTWFAAPPAARGRYLAWAETAVRSARKLIVLGATGGEFWGTDARGIQAILGEIGLTHDRRAVEVTLGTRVVAEQRGLTRFERAPDPVVPGYDVVHAAIRAEVDVWLELGVPDRAGGGTSIAVAVTRRGGYAAAGFEFAEDRGLDKARWLIDPFAFFGRILSPDSWPVPDVTTVSGRRLYVSHVEGDGLNDVVGEGRNRMLVAQRFLSDIVEAYPDLPLTFGLTPGDLDPRLGGNETPRALVAQIWGAAQVEPAIASYTRPFDWPFFAHYSREREIARAAAVRHDLPADILRTGDPDPAVQARWSVSRGREFPRQYLARPFDLGTEVDTAADAAGVLLPDGKALRLYLWTGNAKPFEAAVAATRRRHLLNMNGGESRLDADYASVAHLAPLARPVGTERQIYAVAADEVPVEKAWRPIRTGLRGFAPTLANTGWPRRLKGYNLRYHLASLADPEALRIVRGYLDEARTAALAPVPASTYAAMVEGFFETAVTRIGPGRWRVAGRGAVRTLRLDGPGDRRVDLDRSRGVIGQTRYADALYLALDPAVEAVEVVLAAGPPAIAAPAGLVESRWQLAHLRRDAHGWRFEAQGFGAGTFRWENVAAGRYGVTARRGGATAWHGIAEADGGGLTFTIPDEAGTTLDVEVARLPPTGRGAE

SEQ ID NO: 4219 - protein, 53 aa, Methylobacterium sp.
MITVTIPLTTIPLTTISPALSFAAVVLTCLVLHAACRAAALRPQLRPVRVRRR

SEQ ID NO: 4220 - protein, 131 aa, Methylobacterium sp.
MEMITEQQVRERAYYIWEGEGRIHGRAEAHWLRAETELNRPVAAIEAPKAARKSRARAAAPVVETVAAPLAAKPAARKTVEAAPTKAAKPVAKPVTKPAAKAAGKTAAKTPAVPAGLAAKKAARPAAIALH

SEQ ID NO: 4221 - protein, 52 aa, Methylobacterium sp.
MRNASALAARLAETVTDALTRASERLLDLVGPQRQAQLIPVRVRRGPQRARR

SEQ ID NO: 4222 - protein, 78 aa, Methylobacterium sp.
MDLCLTWFARAWIGLVLLLSLADIAVMALQSGGGAAAAMYNPFDLANFLMEAILLSPALAVLIWRDRRRLRGACETAL

SEQ ID NO: 4223 - protein, 71 aa, Methylobacterium sp.
VGGGALPAGGLAAAALAPAMGLLSGLVTTLPYRLEDLFERPPLHGMWWPALGGLAAAIDLMLFAAQARGSP

SEQ ID NO: 4224 - protein, 130 aa, Methylobacterium sp.
MPPGSKDIKPDVKWQAGAPYGDPTKSDALFIRDLALSSITMDSAGWPPEIGRALEQAIRSGSVKIQKASEVEGLNFKSWHTFTPNRNNGAGYDSMGGTTQNPVGAVKTAIDSGRGLAMWTADRGDVYLSW

SEQ ID NO: 4225 - protein, 218 aa, Methylobacterium sp.
MVKNALLFASALAGALTLVPAASEAQNISGFRGGNALAGGFSGPAPGGGFGGGIGGGGFNRGGVGIGGGGFNRGGVGIGGGGFNRGGFGGAGLAGRGYGFNRGYGFNRGYYGHRYGYGYGRRGYGLGGLGVGVGLGLAGGLAAGSLYGGYGYPGYGYDDGYYGGYAPAGYGYAPVNYGYAETVTSDSSAEEACARRFRTYDPRTGTYVAKGGVRRACP

SEQ ID NO: 4226 - protein, 122 aa, Methylobacterium sp.
MEVLTLRATMLRASWTSGASIETMLELWASSLREVKGRMRPLFTHERVAASAGAFLDGLLGAERRKTGWMRAEAAGDPGPWRQQAVLGRGRWEADALRDVVRDYERLTERARTARSGVGVNG

SEQ ID NO: 4227 - protein, 170 aa, Methylobacterium sp.
VVIRSSDCHLLLPTGPQADRERVRELLDVAGVSHWVEPAKGPGAPTQVDGITVEGYDAPAIAAPLRTAHYPAVADLAQVDTVMVTPILFIMVLFVCITYGPVAIYLVELFLARIRAPALGMPYHIGTGNFGDCMVYFATPISTTAGNIYDGLWYAVFAFACTAIDLWKLP

SEQ ID NO: 4228 - protein, 74 aa, Methylobacterium sp.
VTLGAILTVILVAAYFGFVGMGAFAPALLAKPVLAGGTVTWAFAYGLFVIALGVVLTGLYVLLVNRAEARLSGE

SEQ ID NO: 4229 - protein, 49 aa, Methylobacterium sp.
LTYDRWRKEFGGLKTDRVRRVKDLEVDNQRLRKTVADLTLDKLTLQEAA

SEQ ID NO: 4230 - protein, 296 aa, Methylobacterium sp.
MIVAVLMGGMSREREVSLATGRACAAGLMKAGYEVVELDVDRRVAEHLAHLSPNVCFNALHGPLGEDGSIQGMLNILGIPYTHSGVAASALAMDKLRTKAVASALGFATPRGGRIGRRTFEATLPTSPYVLKPVADGSSIDTFVVRDPTKAPFPTGCWPFSADPLLEDLVEGIEVTATVLGDRALTVTEILPRSNFYDYAAKYTGGGSEHVLPARLPAATFDLCLERSLAMHRAIGCRGISRSDFIISASTGEPIFLEINTQPGMTPTSLAPEQAAHVGISFPELMHLLVEAASID

SEQ ID NO: 4231 - protein, 54 aa, Methylobacterium sp.
MQVLQDPGRTGAPAEARDVQHAELMPRLQDDLQERVPARRVGQAQRPPVGGQLL

SEQ ID NO: 4232 - protein, 56 aa, Methylobacterium sp.
VRAVVVMVAPAVLHGGEAVRCLDRRGGERRGLGGGRRREEPAGEREGRQRAAAEGT

SEQ ID NO: 4233 - protein, 66 aa, Methylobacterium sp.
VIEFSERDRDLIEDFLNHVLDRYKAGSIGRPMARAELSEAMALAAADAGPLRRHMRETLHRPGEDE

SEQ ID NO: 4234 - protein, 168 aa, Methylobacterium sp.
LRATLNGLAPSERAQTLFLPALAGAPEALFDLLALLPVCDVNGALTACLAAGGIGDGPAPVAALFCVDPFLRVPDLAEAVLAAGLRRVANYPSIQAVDGETGRTIAAVGYGPEEEIATLLRLRAAGLEPVGCAASADFAAALAAAGIAPVLAIPALGSGSRTFAPFTR

SEQ ID NO: 4235 - protein, 566 aa, Methylobacterium sp.
MPAPALFYGRPANDLLIGAAIGLGMTARASVQGGADFLLVLNAGRLRVMGAASIAALFPIREANGFTDAFARGEILGRVPVPVFFGAAAFDPRLDIPALAAQLARAGYAGIANFPTAIHFEGRFRATLEKSGLGYAREIALLRAARAAGLATFGYAKTREEIEGLLGAEVDILCLNFGWNAGGSLGIDGVPLDEAADRARRVFQWVRQARPGTICVVEGGPIVDSASMIRVCDEAKADGYVGGSTLDRLPLEMSVMQTASAFKTASLLRPARDEAQREHARITALAGLVGQSEAITRMVERIARLVATDLAVLVRGEPGSGRTTVARAVHVASRRPGPFFVLDAADPEIGEALFGDGAGRRGALEAGDATVVVEAIGHLSVALQERLARVVEQAIVGRFGREEQRRARLVVTAHDQAGIVPALLARIEAGQVDVPPLRDRPEDIPLLARAMLRGLGRREARPAPAAIEPAVYRLLMTRDWPGNLRELRSFLARAAAESPDGTIRSDCVARLCQAAAEIRRGPVADERAWIVDALRRNRFRRTETAAFLGLSRKTLYNKMRRYGLTE

SEQ ID NO: 4236 - protein, 45 aa, Methylobacterium sp.
VRVPAGLAERIEKRRQALQKVFGLPVSKATAVIDVLAAGLDQLEK

SEQ ID NO: 4237 - protein, 126 aa, Methylobacterium sp.
MNAAPLYGRGLDEMTGLDAAALERGMDGLTQELASGPAYTAKDRAQLEENAQAYAAEFSAARVREARRIAKLHGCSMRGGRGIPGFQLTKKATGEVVGGPRSKAAMLTPGDVARVFGGRLSTKDVL

SEQ ID NO: 4238 - protein, 108 aa, Methylobacterium sp.
MQGRDSAVRRNSIDQVSDAEFLAEVVEAFAGEELGRCVLEGPDGVSFQVCGAAKPLIEQLTTWSGPSDQDGIEVHFCDVSRRGRAYPLQGLLHLVDVCAAARAQAVPA

SEQ ID NO: 4239 - protein, 974 aa, Methylobacterium sp.
MSQRHYQSESPERVASALAFVDPTDRETWVKMAMATKAALGDLGFDIWNSWSEGSDSYSQSDARDVWRSAKENGGTGAATLFWHARNNGWKDDGSFQAPPALTAEQVAEREAQRAHKAAEDAARRTAAANLAKTLRDAGSKEISDHPYIKRKGSGLKYGAGIRRGSFPQRGWDDALLVPIYGADQKVMSLEAISPDGEKIGLKDGARSGGFYPVGQFMAAETNPSRIVIIAEGLATATACQAATGYPAVVAFSVGNLRGAGETVKRMCPDARLVVAADLGAEVKARAAAVALGACLVVPQGEGLEKGNDFWDARDILGGKVVAAQFEDAIAAGPVEAEAPVSERAVRSEAAYQDAAVQTQTAQAAPVAYAEAEEVPDELAAQLLPKFEERSAQPVAVQPASSVTSEATGEEPDFDKHFAVLGFDRSTIFVYSHSRTQVLTTSASALSKASGLIELAPLNWWEFYFQKAGKGGSGLDAAAAADWLVRLAERRGIYDDSRVRGRGVWLDDGRLVFHHGNFLTVDGVQTELSNIRSRHVYEGAAAISLAADTPMTATEGEALTATACRFRWSHSGSGLLMAGWAFLAPVCGALNWRSHIWVTGAAGSGKSTLLDKFLAKLMPSDWLLSLQGSSTEAGVRQKLKGDARPVLIDEFECNTEADVKRIESILTLIRQSSSETGAEVARGTISGHAMSFRIRSAFCLASVGVSLSRQTDEDRLTRLELAAEAVGDWDTLERELEVIAADHTYGQRMFARALKMLPVIRESAAVISRVAGKHFGRQRDGDQFGTLLAGAWCLQRDRAPTETEAKVLIEGQDWASLGAGASVQVNDSRQALDAILSSPVRVDQRTFSVAQLIEVAAGGAMAATGSQPAFDQAVHTLGLHGIRISDGEDPRRLMFAMARRELVKLVEGTDFETDLIGRLARLPGAWKSKVKKPGEAGPPEKTRFAGATSRYVSIPLSLCSSGDDVAGANESHPF

SEQ ID NO: 4240 - protein, 147 aa, Methylobacterium sp.
MYETTDLSFDAVAAEVGVARRTVLKWSSQDGYWQKRNVPTSTAERARIMAELASDLQPDQAPDAAPAEAVAEPDPREVEAKLMEKHQRMWRVVDGLSAEAVRSRDDRTARVAHTLARTFAIAQRSERIAYGLGSGETPSSTVVLERE

SEQ ID NO: 4241 - protein, 102 aa, Methylobacterium sp.
VTAQAPTLFSSPLALHRAAILACPALLQLVLNLHHPIAFSLEPSADASMTDVQRAIAAELVASHARYGDTDAGFVLLATAAETALANAEREYGAMDWAALAS

SEQ ID NO: 4242 - protein, 88 aa, Methylobacterium sp.
MAAIMPAPAPIPDRPPQRAVNPGIPTPPNPGEMPPPNLPPPPEDPDTGPTGPRVPGPDPDVDEPPDPAQVPDRLPGIPTGPGTRHAAP

SEQ ID NO: 4243 - protein, 80 aa, Methylobacterium sp.
MSHHLATAALTIVLAAPAGAALAQGPTPFAGSSAAASLGYTAAPAAMALTLPELSVRIPPADPTTTGSIRPHHGHARTGH

SEQ ID NO: 4244 - protein, 152 aa, Methylobacterium sp.
VDVFPKEPGSNAERFVSPLQGLPNVILTPHIGGSTQEAQERIGSEVARKLVDYADTGATVGTVNFPQAFISTRPGGARFAHLHRNLPGVLGRLNDVFARSGINIAGQILQTDGDLGYVVIDTDAGLADPDAVLRELAAIEGTVRARLLYERA

SEQ ID NO: 4245 - protein, 126 aa, Methylobacterium sp.
VTALYAGLFAILYCALSLRVVRARRAARVLIGVAGQPALERRVRVHANFAEYVPLALVLMLLAELSGYPRWTLHGIGLVLLAGRCVHAVGVSQVREKIRLRVGGMLATLVPILALGLMLLAATARV

SEQ ID NO: 4246 - protein, 811 aa, Methylobacterium sp.
MIVEELIGRLTLQTKGLDKAKQATKELENFRKGLKALAGSARMRLDGPAQIAKAFRAAQKEAEKLAQVQKRLGSGAGFDRADASAKKHLSTVQKLRAAYVDTAKARALFDRRPTSSGRSWIQNELEALRQYQRTLKQVHAEAAKLGVPRGRTDQLSRIRYGDRNGFGEAVAAGTIANNAGRATQYAIEQGAVTQQETNRQINAGMEAEQIAALDRRATELSAQFPSVDATKIRTMGRDARNMFPSFEMAMKALPEMVRARVMLQAAKGVDAADNEMGDFLKGADILGKTEDVGSLRELLDSYVKAVQVEGRQLPLKEYKELAKYSKAGGVNLSNEFMGSVAPTFMQSEGGGRFGTQLAAGIRSLISGKRTKKSTAALMELGLLDKKGQLKNAEKFQDNPYQYAMEDMIPALRRKGVNPDDDKAVQARMANIFSDNMTENLFTKMITQRAQVERNIKTYRSAKGLDAAGGQTRGDPYVAWEGVVSQFRNLLGTTQKENIGLAGKVGAAVAESMADVNKSLSADPAKAQAIGAGTIAGTGLLTGAAGLKLWRVLSNWYGVGKQGAIGSGGAAGTGAGAAGAAGAAAEGAAAAGAGSTAATSTGVAAVAGGLLRGLMRLIPAAAAPLTMGPDKADMDQMTLRLGKLAADREKAKAGTRADAGESDRENRRAAEMTRRDREAPFGQQASRTAWQDPPKRYSFAESDRENRRGAEMVRRDQAFPLGDTTKLASLNIDGDAVKSRLAEIQTASQKVIDTLGTQVTIKVDSSQIDAAQAKADKLKATVAGIGSVSGGVGGAGLAKGSNSFTSSGATAP

SEQ ID NO: 4247 - protein, 243 aa, Methylobacterium sp.
MTPLLAVHDLTVRFGGLAALSDVSFAVRPGEIIGLIGPNGAGKTTLFSTLVGLVRPTQGHVSLAGVRIEGRRPHVASRLGMTKTFQNTALFPEMSLLDNVMTAAVVREDVATARRTALACLDRMGLAASAAEDPANLTFPQRALAEVARALATRPRVLLLDEVMAALTPLEMDEVMAALRRLRDEDGVTLLVVEHHMRAVMRLSERILVLNFGRLIADGSPEMVSADPEVVRAYLGHDHAHHA

SEQ ID NO: 4248 - protein, 65 aa, Methylobacterium sp.
MPKPVSPDRPIWPPLPAETDGQPESDVGAAERAPADGAASEPAGGLAGPGTRPDPAGPVMSAVLA

SEQ ID NO: 4249 - protein, 67 aa, Methylobacterium sp.
MERDAAADSSRTTEPPAPAFAVRLRPKFREVVLPPRPPPVPRGCEAAGSGGRPDATPDDPDDPARSA

SEQ ID NO: 4250 - protein, 86 aa, Methylobacterium sp.
VRKLTFAFAVAAAMGAAALAGPASAAPGLPAGVTAPDAVTHVQMSPMERRMERRAMRRHMERRMERRAMRRHMERRMMRRHMMRNM

SEQ ID NO: 4251 - protein, 232 aa, Methylobacterium sp.
MSVRDQLFQMLHTVAGALGTDLRGRLVFVGGCTTALFITDAVTLEDVRATDDVDLIVDLAGYAAWAELQAQLRRRGFVEAYDDTVICRMKLGDLKVDFMPDDPEILGFSNRWYTKGIETAVTYPLTEDVTIRRLTPELFIATKLEAYLGRGDGDLLGSRDLEDVLLILDGRAEIIEEVRRADADIRQFVAEQFRGLLKDRDFDHLLDGNIRGPEGRVDIVRERIVALSDDGA

SEQ ID NO: 4252 - protein, 298 aa, Methylobacterium sp.
MYGLLGLEAEPARPGYELLRSLMHPDDRCLMPDGRAVRQGLLPARERFRIIHPRGVTRTLATRNEIFFAPDGRPMAAAGLVLDVTDVVRLNQVRLRDRQRFEALARDHFIVNYQSPGHDSGIVWFDYPAAFQPSLGEMRDDPYSIISVRDRARAREARESARALGRIAQGTFRFRKADGSDVACRAVEVPIFDEARRIVEWSGLIAPLSEFVSSSSGFCRAINEAVRGHHLRAARAMLDCSLAQFSEISGLSVSSLRRLEEDAACSSARMRQRAIAAFHAMGIDFICADDGSIAVIKA

SEQ ID NO: 4253 - protein, 28 aa, Methylobacterium sp.
MKWTRQRCQVALITLATEALMPSWAVIR

SEQ ID NO: 4254 - protein, 329 aa, Methylobacterium sp.
MTVLVTGGAGYIGSHMVLALLDAGEEVVVLDDLSTGFHWALPPEVPFVRGDIADTALVQRVAREHGVRSLAHFAARIVVPDSVADPLGYYLSNTVKSRALIEAAVGVGIEHIIFSSTAAVYGEPARVPVPEDLPPDPINPYGRSKLMTEWMLGDAARAHDLRYVVLRYFNVAGADPRGRSGQSTRNATHLIKAATQTALGQRPGLEVFGTDYPTPDGTCLRDYIQVSDLADAHMMALRHLRRGGGSLTLNCGYGRGFSVLEVLDTVRQISGRDFPIHFGPRRIGDPARVIAQAGRIRDELGWQPKHDDLRAIVAQAFAWERALPYRNQI

SEQ ID NO: 4255 - protein, 107 aa, Methylobacterium sp.
MLASGLASVPAAAESLSDWARRAALEIRQHLRWPTGYGRAATPRTALVRFTIDRAGSVSGIALERTSGVGGFDAAALDAVRNARPLRPPPLPPGRDSITAQLPIAFQ

SEQ ID NO: 4256 - protein, 83 aa, Methylobacterium sp.
MPIVLAVLAAALLAGPALAQVDRTGTGGGPRTTERAGNVTATGQTKPPGRAASPTAQDDPEQVPDGQTRGGISTGICIGCNAK

SEQ ID NO: 4257 - protein, 68 aa, Methylobacterium sp.
MRECGILSPNRSGVTGDPRLHGIGHALEQLYAPVLAEGVPEVWLHLLGRAGAPRDPEREGNEAGEPAE

SEQ ID NO: 4258 - protein, 30 aa, Methylobacterium sp.
VGLVFALLLILPPLGIAVLDLLRTRRSHPY

SEQ ID NO: 4259 - protein, 89 aa, Methylobacterium sp.
LPHQIIGLAAISLTVAVLLRGWGVSRRTAFALGGLGLAATALIALGDSGRRVEPGLAGPSETETMRPLQSVVVPQRPGGATAGVEAFFP

SEQ ID NO: 4260 - protein, 64 aa, Methylobacterium sp.
VDEGASEAERIAAAYACAAGGDTWAALVRAVSDALADLAEAERRSLRRDRLLSRGYVRARPIDR

SEQ ID NO: 4261 - protein, 40 aa, Methylobacterium sp.
VSADQIFVTFGIPAIAVALAYAAMRANEWAVRRGRQHPSE

SEQ ID NO: 4262 - protein, 78 aa, Methylobacterium sp.
MIQTKTMLLPLLALGLALGLGTAPAEAKGCLKGAVVGGVAGHMAGHGKAGAAAGCAIGHHEAGKKSRQPAQGGQPQGQ

SEQ ID NO: 4263 - protein, 76 aa, Methylobacterium sp.
MQAHVHAPQSPSHPDADPHPWFGVEPEALEDAARALCAVRPGSHAAERLMERAAYLRVTRSRHADDRQRASALFLG

SEQ ID NO: 4264 - protein, 280 aa, Methylobacterium sp.
MADAEHKRRQQDLLTQEGGRDEVVQRIAQRQNQLVEARANLEQLPTVHGGRLQNLRNDLAWVEQRAAETEARQAYVVVAPASGTVATLQAAPGQPADPRQLQMTIVPQTSDLSAELFVPSRAVGFIVPGQPVRLLYEAFPYQKYGAYGGRVARVSGSVVRPGETGGPLTLAEPAYKVEVTLDSPFVRVDGRSVALKPDMALRADIVLEKRSLMRWLLGPFLDIRNAIDADPLVRWLRDELPAAAAGMLSEARALPETIFGALARRAARSPEPEPRRTAER

SEQ ID NO: 4265 - protein, 709 aa, Methylobacterium sp.
MGGGSLPLILQTEAAECGLACLAMVAGFHGHRIDMNTLRRRHPVSLQGVTLRGLIEVAKALDLACRPLRYEVEHIRHLALPAVVHWDMNHFVVLKSVSGRRIVVHDPARGERRLTYAEASNHLTGIALEIVPAAGFRRRDERARLPLSTFWQHSTGLRRSIVEVIVLSLVLEALVLAGPFYMQVTVDEVVARGDRDLMAALAIGFALLTALRVAVGALRARIILIVQNVLHYQIGARLFRHLLRLPVAYFEKRHVGDVISRFGSIDPIRNLLAQGLIAALIDGVLAVLTLGMILAYSPTLALVVLVGLTLCVGLRLTLFARFRRLNEEAIRVGAREDSTFIETLRAVQSVKLNNREAEREGQWLNRFAETVNANLALGRAKIGFLAIDQALTGAEYVVTVYVAAALTLDGILTVGMIFAFMSYREQFVEKSLLLLQTALDLSLVRLHLERLSDIAVTPEEPGHERPLVPKAPLRGEITLQGVCFRYAEGEREILQDVTLTIPAGRFTTITGPSGGGKTTLVKIMLGLLEPTAGQVLIDGVPLRTYGVRDYREQVAAVMQEDHLLSGSIADNIGFLDPVLDERRMVESAVQAGVHEEILAMPMGYDSLIGDMGSSLSGGQKQRILLARALYRQPRLLFLDEGTAHLDIRNERLVNQSLRALAMTRVSVAHRPEISCGADMLVHVDGRCRAVEGPEASEALARIGHPAEAQ

SEQ ID NO: 4266 - protein, 226 aa, Methylobacterium sp.
VGREIEMLFREAGYKVDQVPACKDLLAGRGAGVDLVIIDATRDGRRGLCLASSYRSASSVGIVVIHHADSEPDPVQALEVGADDVLVQPFRHRELLARVNSLLRRMDLDKGGPVAAKTRRGIRFKGWLLDLERRQLVCEATGCCVPLTTAEYNMLTVFAQNPCRVLSRDDLSILALGRPHSMDVRSLDAQVARLRKRLSTNKPNIAYIKSVRSVGYIFCNRTHDVY

SEQ ID NO: 4267 - protein, 91 aa, Methylobacterium sp.
MARDDGPETAVDRLAFNLLGEAFRKLSAEFIRTDRAAGIRHLQAIHDEIAAAARHVEMARPDLVREGIVEGATHRVCTVLQSAGAWPRTFS

SEQ ID NO: 4268 - protein, 54 aa, Methylobacterium sp.
MAYLALITAALALGTGIAQAATRRPLAAERLEMAAGTLLLTGLALLGTGLPLFR

SEQ ID NO: 4269 - protein, 224 aa, Methylobacterium sp.
MTASASKWTRDQIAARVARDIQDGMVVNLGIGLPTLVANHLPDDREIVLHSENGIIGMGPAPAEGEADPDLTNAGKQPVTLLPGGAFFHHADSFAMMRGGHLDICVLGAFQVSAAGDLANWHTGAPDAIPAVGGAMDLAIGAKRTFVMMEHLTRQGESKLVARCTYPLTAPACVSRIYTDLAVIERVPGTAELRVVDIVEGLSFADLQAVTAVPLGDARADANA

SEQ ID NO: 4270 - protein, 239 aa, Methylobacterium sp.
MIDKISASTEQALQGVRDGATVLIGGFGHAGLPVALIDALIDQGARDLVIVSNNAGNGEAGVAALLKAGRVRKMVCSFPRQSDSYVFDALYRAGKVELELVPQGNLAERLRAAGAGIGAFFSPTGYGTDLAGDRETREIDGRNYVLEYPIRGDVALIQAERADRWGNLTYRKTARNFGPVMATAATLTIAAVHEIVELGALDPEAVITPGLFVQRVVQVPMQVPMQVPAPGPASLRAPT

SEQ ID NO: 4271 - protein, 612 aa, Methylobacterium sp.
MWVFIEGRLQIDLGGAHGPETATLDLSATGTAAARLGLVVGGTYDIAIFHADRHTSGLDFGIQIPTQAAMSVDSTADGIIDRTEARATAFTVTGFDGLSGDAVFTDGIRTTQASVSGNGTHTIDLTGFSGAVSSRLAVGSQTSGVGNTVTARAVNGAPAIGGAAAGQAIDDTVTARPFSVVTVTDPDANASAAATITITVGGTASDAGGTLSGTGLTKTGTGTYTLAIGSPAATESALRNLVFTPVANQVTPGGTVTTGFSLAVSDGEATTTDSTTTVVATSINDAPGIGGDGRIDLSQGGTAAVTTGDLTAGDPDVGQSLTYTLTGTTRGQVLVNGTALSSNGTFTQTQLAAGQIAFRQDGSADPVAGFRVTVSDGIVTSSPATVLASVALTPPPSDPGAAGPSAGDDNLTGTAGPDTIGLGLGNDTFTGGAGNDLVYGNPGNDLIYGNPDADTLYGGQGDDRAYGGQGDDRLYGNIGDDVLFGNLGADIAYGNQGNDIVYGNQGADVLYGGQGNDVLYGGQGADTLVGGIGDDTLVGGLGADLYRFDPNSARDLILGFDRGAGDRIALGGQTYTVSSAQNGDAVLLLSGGGVVDLAGIRADQVDASVFAA

SEQ ID NO: 4272 - protein, 48 aa, Methylobacterium sp.
MALPKDEKPAPVRTNRFGLIAAAILFAALVAYTIYFLTVPATPPPTPH

SEQ ID NO: 4273 - protein, 103 aa, Methylobacterium sp.
VDLGATPRNRAAARARRIALLVVLWAGPGTRADAQDSPILRELQRREQELILQMRERQRRGDIREDERRDLARREDLRREEAREMDRRRLIEAEERRALDRRR

SEQ ID NO: 4274 - protein, 122 aa, Methylobacterium sp.
VGIDDVMSRLVLNGLIGLCLAAGAPAFAADPVLPRVRADPVHAYPVPVEPPPPATILPVLAPLVNAVDPRTGRCLAGFAPDRHGFCRRHDDPPIVCPEPDFCGAGAPSLAPYGIGPALRLNY

SEQ ID NO: 4275 - protein, 416 aa, Methylobacterium sp.
MRLDVMNQIGSALNRLLSGSAETSAPGGTGNLRGATVQMAATAQQPAHSAGIGERLKTLLAPLAGALKDAKAWLQAKMQPAPAPQVPVSQPRIDTNRTATQIQGRIEYAALTKSGSEFRAGDGALTPKIRNAITHAFGYELMESFANSSDQVQASQSFMRDNNTISKIASNTALRSPQMDAVASSVRAIIGDTPVILSRKSLGLTAQDEGGPTQPAHPALAAGSQPVDRQAAADASVATIDRVMVELFGDPDDPASIEAALDRLPRELCDQLGTMNALIDGTGARVDDALKKELKTTAGRDIFALRAINPALLARPGIATNDSRALSSSVMSVAKAVQNLVNGHGIALDGKEAAPEVSAAGAKANMQARWADGFEKFLAAASARADQGHLAQAAADAPQLLATRDRLVAELDRLRS

SEQ ID NO: 4276 - protein, 99 aa, Methylobacterium sp.
GFQGAGFRGGGFHGVRAGGYRGVRAGGYRGAVAGGYRGAYGRGAYGYGRYGYGYRPYGVGVAAAGVGAAAAAAGYYGATRGGCGPDAYYDSYAGVCRAY

SEQ ID NO: 4277 - protein, 109 aa, Methylobacterium sp.
MSARHRRPVQEAWDSAHQGRDVIGPRDIESRREVMVDKNDVLSGFRRYVPHPSFEDVAWWVQAFPHCADDIRALARAAIGIQALGSLAAREEDFAQPSLRREDRDNPPP

SEQ ID NO: 4278 - protein, 282 aa, Methylobacterium sp.
MLIPALPPQPTRDERARRIATPARRAAALAALLLAAALPWGSAAQQAVPQGSDRTPPQSAPALEPDALARLRETGAALAAARSLRFTASALHDVPTAEGQSVLYAVRSRVTLRRPDHLRIDTGGDEAPAAFVSDGRTMTLYRPSAGTVATAPAPAGLEAVLRAEIAAAGQAQAFADMLLDDPGRTFTDGLTRAFVVGRSALVGGVETEVVAFASPDAQGQIWIGAQDRLPRQLWVTETAAPGRPRSGVTFSDWQLDPILDDRTFSVAGADGARPVPFTKPEL

SEQ ID NO: 4279 - protein, 189 aa, Methylobacterium sp.
MRRIGFGLLALGLGVAAAGPAEAFWVARGWRGVAVGGIHAPLVAREAVMGRCWRCAPLAAGAALAIGAGAATAPAAAMPVAMPVAAPAAATVAAAPAPADAATAPAARHAAGTQVAQANTASTHCAAGLPADSKMIYDASLRNMKSLETLRDTVVSETRSLVEAGRITEADARPAAEKAGTCLRMLAHP

SEQ ID NO: 4280 - protein, 105 aa, Methylobacterium sp.
MTERYGAEANGHVLVAGRAGRRRHIAHLAREPRFDLIEADVTGLLPPLPRMGQVFNRACAASPPHDQADPLHTMMTSVLGTIAWFSREVAPRERARPEPLAAAAV

SEQ ID NO: 4281 - protein, 424 aa, Methylobacterium sp.
MTDTKTDATLSLCIAAGARPDFLDRLLGRVAADGGLPAPYEIVVSDASADGTIKEIVERRAAEGLPVVRFRHAGAAHRPGDAASLLAALRRGRGRYRVALAEDELPVPAALCEAVAFLDAHPEVLACYAPWELHDEAPGAVATAQYALEADAVFGPGEAMELFGFLVRHGAAPEAALYRAEALRALPPPSHHCHAGFVGLARLIAEGAVAFRSRPFRRIATQDPFTGRRHESATAGAADWDLHRGGLEFYVRALLARTGTAPDPAHRPVFRDAIDAYVETRMRQAFRVATGRGDFLAAHEIHNRLSLLSLGEARPPVEGLERLPLLVAVQTLARLANETAEVERVVLVGVEDGPSISSLLRELGLERRILVAPPLEAPGEKAIRGSLVFLGEKAADARARFIEQGYAPSLVVDERDLIAGICLP

SEQ ID NO: 4282 - protein, 47 aa, Methylobacterium sp.
EDIIEPYLIQQGFVQRTPRGRVLTPQAFRHMGLAVPSAEIAPEAAEA

SEQ ID NO: 4283 - protein, 92 aa, Methylobacterium sp.
MKWILPVCALVLCVADPAFARGVPHRPAPDPSGAEARVQPNDTGAPGSLIIPRGSTGADTIFLNSAAGGNAGQPERAIPLGSGGGGDSGGSP

SEQ ID NO: 4284 - protein, 94 aa, Methylobacterium sp.
MRLTLSLILIAAVALYGASFLQAAQSGALAEAGAHPVRDGAPRSICIGCGGPVVPFDPSGGVQAGQAPDAAGKPRPAVGPPASGGAPHRPGRAP

SEQ ID NO: 4285 - protein, 64 aa, Methylobacterium sp.
MVVLDPRTGRLVSISLGIQPDTRTGPAAPRPARPPREWPPHHPEAHQEPPGAPPARLRIRREES

SEQ ID NO: 4286 - protein, 114 aa, Methylobacterium sp.
MTYAFDTLKFTQRLEQVGVGRDQAVAHAELARDMILADTATKADLAALETALKAEITGVRTDTRADVSNLRTDIQTMKREFEGSLRELELRITVKLGAIIAAAVAAIAALQKFL

SEQ ID NO: 4287 - protein, 264 aa, Methylobacterium sp.
MPPASSLEDLILALLPTDSTPVLNRVMRVMLTRERQEPVGQDAYFAARDRLLAARRIGRLRGQGGQIFLMPEQAPVEAEAPAPESWPEAALMAPLRRYLEGPFAKGLDVGEGCTLVQDTSTLGPRQGVWARPDFICVTAMRFRLLPGVQVDVHAFELKTESGGTVQAVHEALAQTRFTHFGHLVWHLPEGSRAEARLAEIEAHCAAHGIGLIRLRDPRAPEAAEILVDPRRTATRPAMIDGFLESRLNAENRARLEAVLREVRA

SEQ ID NO: 4288 - protein, 69 aa, Methylobacterium sp.
MAHISLADLMKHPPAVDAAKLDALTEADLRAQRIADGYDPEAGPPDDTEIVLPLQQVRSRLGMTHTVSG

SEQ ID NO: 4289 - protein, 36 aa, Methylobacterium sp.
MIAASRTLILRHREIAGALASSGLFVASLLMLTALL

SEQ ID NO: 4290 - protein, 34 aa, Methylobacterium sp.
MSPQADDGIIRWNTPNKDGNLGGPGAGGSGGGGG

SEQ ID NO: 4291 - protein, 164 aa, Methylobacterium sp.
MKALVLAGAALGAGLMMTPSAEAGPYGYGGYRGGYGGGFAGHRGDYGGRGFGYRGYAGRGFGYGGYGGRGFGYRAAGYGYRGGFYGGRGYGRGLGLGLAGAGIGLGVGLAAGTLAAGSYGYAAPYYGTNGYGSYGYAPVGYSYPSYGYAAPAYGYSYGAGCGCW

SEQ ID NO: 4292 - protein, 231 aa, Methylobacterium sp.
MPSVRELGELKYKITRLRMVDARYVTGIEAVGDLNKTSDQRLKEVEAVAARYEPLIASTEERALWDEFRRNWTDYLAQRANIAASADTKSQTALDDLFQLSRKHFNAALDALDRDTALNIAGGERARSTASATYQFGIQLTILFCGLALITALAGILYTLVGVTRPIDRLIRRMHALAAGDVEGRIPHIDRTNEIGAIAAAVEASRGNLVRTRQLEAETALARASAEEQRK

SEQ ID NO: 4293 - protein, 197 aa, Methylobacterium sp.
MRGMSALKTHYRPYVCPLHAVLEQIPPEARVYDIGCGSGSFLYLIRRLRSAIRAQGHDVSAEAIAAGQQLAKIEPSISVSLRGADYVPDLSDVDVVTMIDVLHHVPKREQAGFVGRIVSKMRVGSRIVILDIDAARRWRAWANQVHDLLLAREWVNPRTAASTMRLLQDAGIQAEMPRLYSTLWYGHYLISGIKTKH

SEQ ID NO: 4294 - protein, 114 aa, Methylobacterium sp.
LRNSLQGLTVAARSERAVRQELVVLAVAVPAAFLIADQIYDWIALIGSLALVLIVELLNTAIEKLCDHLHPGRHPAIGTVKDFGSAAVFCALIFALIVWVSLATMNILLPHDSL

SEQ ID NO: 4295 - protein, 541 aa, Methylobacterium sp.
MFGGMLPVLAVALTFADGTAIATSSDRLLASFAFNAILFGLLVHSAAHLLKRSIFLLIYAIFAIYSSLYVLFYVYHFNIFGQIFGESSINAVIDSNPQEAGEFLSWAFRLEHLPLPLLAGLTVAAAFAVRAPAVPAIRSRRVGFAALTAALLMLPIAAVKTNVILYNPIFFPGHATYKALANRSAVAEIQSKIDTIRIGSVDGPGEKAVTHILIIGESTTRRHMSLYDYPRDTTPRLRKLAPELEVATDACSSRGATVPALQEMLTFATRENSAPLFEKPSLLQIIKAAGFRSWWLSNHAFYGDFDNWSMVLSRPADARHFVNRVGEGTSFDEQLLPYLKDALADPSPRKFIVLHLLGAHSDYTLRYPVGFDKFTDAPLPPTPRTLTSRDAQLFNAYDNAILYNDHIVGEIIAAARAADAHATVTFVSDHGEALGEISDFFTHIDGRAPRQVYEIPLTFWMSPAFRARATPRINQLRGNLGKPFQTDAMIHTLLDLYDIRHDAHAPQRSLFAADYSVPSRFCDKMPGLPASATNPLMVTAQ

SEQ ID NO: 4296 - protein, 51 aa, Methylobacterium sp.
MRAFGPSRSSGISLAWSAPSPASMKASLASLKSDESFLRSFRVSFPAVMRS

SEQ ID NO: 4297 - protein, 324 aa, Methylobacterium sp.
MDRRQFLGCGVAFAAAGNALAPRRAIAQAFPVRPVRVVVPFTAGGTTDFTARVVCETMSRAAGHNFVVENKPGAAGVIGVKDVAASEPDGYALLFSDSSLAVTPTTNPGAKLEPLKMLQPIGLAGIFPSVLVVHPSVPARTVQELIDYTKANAGKVNFGSGGIGTVPHLQAEQFKLVTGAVITHVPYRGAAAALQDVVAGQIQMLFTAAPTALAFIQSGDLKLIATTGAERLPVVADAPTLAEVGFKDLVSAQWFGMLAPAKTPADIVKRLTELMSGALNDGPTAKKLTDQGGIMKRGTPEDFARFIESEIAKWRDVIAASKQK

SEQ ID NO: 4298 - protein, 409 aa, Methylobacterium sp.
LAGPFCGYHLARMGAEVVKVENPKGGDLARRLGADPTMAERLMGLSFVAVNAGKQSVAIDFKSADGKEIFLRLVEQADVVLENFRPKVMDRLGLGYDVLAGRNPRLVYCAISGFGQNGPWLGRPAYDQIVQGLSGAMSVTGDAATAPLRTGFPISDTIAGITAAFAISSALVEQRTTGRGRRIDVSLLEATLAAMGWVVSNHLNGSVDPQPMGNENFTAAPSGTFQTGSGPLNIAANEQKQYETLCDLVGRPDLKADVRFADRQSRKVNRPALSNELNAALQARTAKEWEALFNAHGVPAGSVLSVPEILQEEQVTGRRFVETIDATVRGGQPMRVTRPGFLLDEDYPVPTPPPQLGQDTERWLEVLGYGPEQVASLKGNGTVAAVDRPTSGPSAKPPELQPRADSPRR

SEQ ID NO: 4299 - protein, 289 aa, Methylobacterium sp.
MSDKDPAAVLADAEAWWSTAIIDMKPGVIRFAGFPIEQLIGSVSFPQMIWLMLRGGMPTPAEGALLEAALVAGVDHGPQAPSIAISRMSVTCGLPLNGAMASAINVLDDIHGGAGEQCMELYTDIARRMDEGQTLDVAVEGGLDAFIAARGKIIAGFGHRFHPIDPRAPRLLALVDAAREQGVVNGRFAEIGRAVEAALGRRKGRGIPMNIDGATAVIFAELGFASPLGRGLFILSRSVGILAHAWEQTLQGGRIKGPMPRGIPYTYTGPAQRDFPGDAAAPEAGVLRS

SEQ ID NO: 4300 - protein, 323 aa, Methylobacterium sp.
MDLRDLAFFEVIADYGHLGRAAERLGRTQPALTKCIQRLEASVGAELFARSGRGLVLTQVGEVLLTRARLMRTAMDEAIREVSEFAAGTAGHVRVGTGATMAEYLLPHVCRRLIAAAHGVTVDLQIGMSGVLRAALRESRLDLVIGPVLPGDADEFAHESFGTDEVVVVAAKGHPLCGRPLEIEALSAWKWVLPARTVAMRQWLDTVFQAHDITGPHVQIETNSITMLPRLIGETDLLSFTSTRNLLPERLGGWVERLDIDVTTLRRPLGCVHRRGSYLSPAASRVVALLRDHGAALLAEGGVGTGALAPPSGRTPQDRVGTA

SEQ ID NO: 4301 - protein, 405 aa, Methylobacterium sp.
LVPILGLAYLFNYLDRTSVGFAALQMNQAIGLTASQFGWGAGILFFSYCLLEVPSNVMMYRYGARRWLARIMITWGLAAAATAFAVGPMSFYVIRFLLGAFEAGFFPGVIWYISIWFPARYRTRVLALFMASTPLSSLLGSPISAALLSMDGILGLGGWQWMFIIEGLPACLLGLACLWMLADTPKDATWLSADERNALVTELANERYEKPKKDLWAAMKDVRVVMLTTITFAFTIGSYGIGIWLPQILKGHGLSTLTIGWVTAIPYLFATIGMLVWAQYVDRTGKKIYNLIAALVLGAAGLAASVLFTSLIPGLICLTLALIGTISARTVFYTIPQSFLTGAAAAGGLAFINSVGAFGGFVGPYLVGYLKDATGSFDAGMLGMAATLLVSVFIAASLKLVIKNA

SEQ ID NO: 4302 - protein, 99 aa, Methylobacterium sp.
VAAQALAERIGDASVTCEPRPASEEGAATALCRVGDEDLGAWMVGRGYAVAMRQGPHPYAEAGARARGRRLGLWSGVFQDPDAWRRSHRAPVARLAGGS

SEQ ID NO: 4303 - protein, 184 aa, Methylobacterium sp.
VPESARLIDGGGEIRVEDCRPVSRDGPADAADEIGVVGAADRLLLAEHLQDALQRGFQRRVPGLHRLHQGHPGLVGLQMLTLEAAGPVDLDRPGEMLDRPSHVVEDLDPARVAHARTRAPGITCARNPSVHHVSGRMSAASPCAAQASSAKRQASASAATGTSMSRSTSLSWRIAPRAAEPYRR

SEQ ID NO: 4304 - protein, 125 aa, Methylobacterium sp.
MVPSEAEIEARLAELRRRREAIDREIADHLLYLELGRRLRAGTAEAGAASAGDDADPDAADPPGPVFPGPAEAGGTGPDGGAPPRRWPAREPAAGPAVPPSVPPPLSPAAASGAARGWAARAAEA

SEQ ID NO: 4305 - protein, 591 aa, Methylobacterium sp.
MSGPGTDRAPARAGGAESGCGDAVSSALIHAVGLLERGDPRAALEAASEACFDAPGRPEPHYVYGQALAALGEHALAERAFAEAVRLRPGWPDAWVNYGLARYRRGALGDAVTAMRAALAHAPGHAAATANLAAFLRISGGAEEAADLVRQALEREPAQAGVRLNRVADLLQEERAAEALALLDAGAPPAAAPADLPILRHWHLQRALALLQLGRGAEARAALAALDALGPLPPALAPLRLWRAVLLARGEGRDEAARAAAEAMAASLDAMGPDAIPEHRIMGHYDLAKFWSGRGEHPRAFAHWREGHRLLAPSQPFSRADHLGFVEGCMAHLGAARLARGPRAANRDPAPVFIVGMPRSGTTLCEQILAAHRDVHGAGERGALAEAGACLAGGAADGPGAPARLAALDAPALDAAAGRYLAELRALAPDKARIVDKMPGNYLHLGLVGLMLPGARVIHCTRDPRDIGLSIFTFRFHGRHGYAHDLGDLGWTIRQQTRLMAHWSAALPNPVLSVALSDWVTDFDGTLARVLAHLDLPPDPACARFHERTDPVRTVSRAQVRQPINARGLGRWRTYAAELAPLIAELAPAED

SEQ ID NO: 4306 - protein, 50 aa, Methylobacterium sp.
RPYGPAAYGRPRVVYEEPVYETRRVISYERVPVGYAPVRRGWDGPYGERW

SEQ ID NO: 4307 - protein, 101 aa, Methylobacterium sp.
MRQILTLAVAGALAGTALAVLAGPAAAQMRPVACPEGRLVDGSCVNPRLAFLARQQAVCFTQVKLSYIACPGTLPGVDTRYKFPFNVVTERQRELNFVVER

SEQ ID NO: 4308 - protein, 425 aa, Methylobacterium sp.
MRLLRWAGALGLLCGAAEAADLAAPVPLAPAAFEPVWTTTVNTEFRYFSFGGTKGQPTGIAPLGARGRGSQFYLPFGLAISGQPTPDLKIDLTARGGYVDSRQETQGLMGAVRTTLDTQLSATATYLGLDGVQPFASLNLNLPTGTSYLAGTRFLARLDSDLVDVPTFGEGFNIGPSVGVNVPIGQTMLFNLTLGYTARGQYFREGAPDPITGIDAFVDTRSGDTVSVNGSLAYEDGPWSGNVAVVYSQDGTTFINRLAAIRSGSRVGLSGQVGYAWSEAWGTTLSASFNHSERNFVPNAPLPGLIAEPRNSNSNLYRVGLDTLYRTGAFALGPTLSFLYRDVNSYDPITFQFLPARERYGAGGTFTYAITDAVSLSLRGERILVHEAANPDKEFFPGSGIVPGTGQPRLSYAGWSISGGATIKF

SEQ ID NO: 4309 - protein, 362 aa, Methylobacterium sp.
LDDVLSPAQISEIYEAAIEDDGLARLVEIVGRIADVDSAGIWLRQGSEIIDLTVSEAIAASMVPYLAYYARIDPWAAAMMASSRVTLGNEIVDEAQLVQGEFYTDFARHFGMLRPMGATLGIAPGVVASVSTNRASRAHLLDGTDKARFAVLAVHLQGALRLRHRLGGERVLRRDLAAAFDGLQFGAIICGPDGTVLFANDAARALEAARLLQLRGPGGVLTAATSEQTARLRGAIAAAAGSGQPGGIQLAGAEGSDIHALVTPLPGAAPDARRGRALVTLRRADAVAGPAEGRLRQLFGLSPAQAALCVQLARGLTFEAAADERGVALSTARTHFLGVLQKTGAANLRDLLRLLGTLPQAH

SEQ ID NO: 4310 - protein, 26 aa, Methylobacterium sp.
LGAHTLPQAVLIATAAGVRPVDQDGA

SEQ ID NO: 4311 - protein, 89 aa, Methylobacterium sp.
MRSGLERTAHLLCELLERLGSIGAVSDGQFELPLTQVDLAETLGLSSVHVNRVLQALRRDGLISLRAHRLRILAPRRLSQLAEFEAGYL

SEQ ID NO: 4312 - protein, 150 aa, Methylobacterium sp.
MVTPIRNGSSSLVELAGIVVSAYVSNNPVPLSELPKLIDRVHTALNEIMNADAVDRTTELEEKATPEQIKSSITPDALISFIDGKPYKTLKRLLAGHGLDPFSYRKRFGLPADYPMVALNYAQRRSEIARGITLGIYGGRGNQHRSGARH

SEQ ID NO: 4313 - protein, 46 aa, Methylobacterium sp.
MANRSRSLEITSASSRRTASTRSLRPLTETGSTSAVTLMPTSAAAP

SEQ ID NO: 4314 - protein, 474 aa, Methylobacterium sp.
MTSILRPVDGAHRKVLVLGGDGFCGWPTSLYLSRIGYDVTIVDDLSRRGIDRTLGTDSLTPIRPIGERLAAWEAVAGRRIRFVELRVGEAYAAFRDLVAEIGPDTIVHFAEQRSAPFSMRSAREKRLTVEGNVCATHDVVCALAETGLDAHLVHLGSVGVYGYGSTGFPRPEGYLKVAAQAPGGTVEKEILYPADPESIYHLTKALDQLVLQYYAKNDRLRITDLHQGIVWGTQTEETARDERLINRFDYDGDYGTVINRFLVQAALGYPLTVHGSGRQTRAFIHIRDTVRCVALAIGDPPRRGERVRILNQVTETHRVIDLARMIARLSGTPFQHVANPRLEPEENELDVSNRGLIGLGLVPTHLEDALLAEISAIAGRYAHRCDRATIPSRTRWCAAPEPSPIAPGAGAAPSPGSAARTCAEPASPSTECALAGGAAPAPPLPQADADELEAGPPQEAWYDPEIAAPEPARL

SEQ ID NO: 4315 - protein, 47 aa, Methylobacterium sp.
MIASLPDADLRAGDPESGLVGEPAMGRTGREISVYLEILLPSPSALR

SEQ ID NO: 4316 - protein, 40 aa, Methylobacterium sp.
LLPGFLADAGLSGLSTGLAGGVHAGRGRDEDGLGKGVGAE

SEQ ID NO: 4317 - protein, 59 aa, Methylobacterium sp.
MAEIRIVLSRLTPAERAAFWNAVDLLYRVPSGSPMSMKEDRSIQYGVAQGLEALLPPVR

SEQ ID NO: 4318 - protein, 114 aa, Methylobacterium sp.
MHSSPCCGRCGIVCRSDLRLVSARSFRRDDLDDRREISSMLSEIAREILAYLHGTHRLPGARLRITTLDERFGTDPAIAAAISELARTGYVATPDAGTIELTARGYGASMSEQL

SEQ ID NO: 4319 - protein, 99 aa, Methylobacterium sp.
MPMNMYDGEEGRPLLDLIIEGMEVVDSDGTRIGSVDKVEGGHLKICRADQKPRNQPQYVTPDWIAAVDDRVRLNRTFDEARRLWASEPYARRHHLQRAI

SEQ ID NO: 4320 - protein, 40 aa, Methylobacterium sp.
MPHDQTHANVGLTGLRFAPTVASLRETAAALLRHRMRPTP

SEQ ID NO: 4321 - protein, 29 aa, Methylobacterium sp.
VADPEGNTIEFVEPDKGIFAEGPLEARDA

SEQ ID NO: 4322 - protein, 44 aa, Methylobacterium sp.
MSILTQAVTGFPAAEAPARGWFARMIQLWLEHHARVLEMGGEPL

SEQ ID NO: 4323 - protein, 66 aa, Methylobacterium sp.
MTRLPALAAAALIGVGALSSTAAEARGRGGALAAGLIGGLAAGALLGAAASAHAEPAYGYGYAPPP

SEQ ID NO: 4324 - protein, 184 aa, Methylobacterium sp.
MATTFTVGNSNGAVFADAGTTSAGQTDGTNSLSLALAQANATGDSVIINLTSNITLTGPLSPIFNANVTINGNGFSITSTSQRIFFVGTSAGLGGGGLGAGGALFVNQTGDVVLDRIDVTNNRATGGAGGPGPGGGSGGIAELTKSGTGTPTLGDIDTTAGRATTSSTATRARTCSTAARATTR

SEQ ID NO: 4325 - protein, 245 aa, Methylobacterium sp.
MQDRPQPRTVGTAGSEPADDSPHAARLQPSDGNPHGVTGPVLFEAYRTASLARSSAAPQILTRTPRHVAGGTDEIMLYRQEAGTLEGEADGRSFRLEPGDLALFDYAQPLVSRTSAFTNLVLTTSRASVPAALVGPDLHGHLIPGGSGPGRLLATEVSDPVATRPGAVSGPAGLLQARHDRLGRGVGLLAGGAPVAQGVELDRLAGHRAAHEAAGLDHPHGAVAVLDDGLPARTPLEASQHRRCP

SEQ ID NO: 4326 - protein, 82 aa, Methylobacterium sp.
VRRLARLDPEVLQRFIDALAAGEIVQPVGVRTGSSVVVMTGPFASIPAAVEAILPGDRLRVAVSIFGRPPHAVLRMADVQAI

SEQ ID NO: 4327 - protein, 70 aa, Methylobacterium sp.
MTQPLRLIRLAAVESMVGLKRACLYDRMSRGLFPKPVRLGDARNSPVAWPEHEVQAFIAQKIAARDQAAA

SEQ ID NO: 4328 - protein, 71 aa, Methylobacterium sp.
MAGSAEERLDALNSEIADLEEKQDAYVSVIAALTDQGLDTAAAKAALKRIEDQLVALRVRTATFEGDARHV

SEQ ID NO: 4329 - protein, 131 aa, Methylobacterium sp.
VPNAFNPSFLSFNLPSGNVSQSFAPFFTQQVGMTYAGNREIEERVVADVASFGRQIGRLLDGVLLLARDRPEPEFATLRTMAAEIKRVKEETRSSALRDARAALDALARADPKGLAVLLEGYAPPVPRGSP

SEQ ID NO: 4330 - protein, 90 aa, Methylobacterium sp.
VECVFGIPGEESLDIVESLRTSKIELVLTRHEQAAAFMAATCGRLTGKPGVCLATLGPGALTCRPRARASMAACSLARVVGRKAQRSSAT

SEQ ID NO: 4331 - protein, 475 aa, Methylobacterium sp.
VDRETAIARAVEALRSGAFREDLARRVAIPTESQNPARAAELDRYIEQEMRPAFERMGFSCRVLHAPSAPTPFLYAERIEAPGLTTVLGYGHGDVIHGMDEGWRQGLSPWRLLERDGLWYGRGIADNKAQHSINMAALGAVLETRGRLGFNAKWLIEMGEEVGSPGLHAICAVHKDLLAADLLIASDGPRLNRDRPTVFLGSRGEFNFNVWIDARADDHHSGNWGGLLSNPAIQLTHALATLVSPTGQIRVSGLVPEAGIPENVRSALSDCILEAAPDAPSIDPGWGEPGLTGPEKVFGWCSFEILALEVGNPRAPVNAIPSRAWARCHVRLVVGVDCDAVLPAVRRHLDRHGFHYVQIEAAEEAPPFPPTRLDPNNRWVGWALDSIARSTGKKPALLPNFGGSIPNAAFSEILDLPTLWVPHSYPGCSQHAPDEHLPVAIVEEGLRLMTGLYWDLHATDGHGSEGATARNGQDA

SEQ ID NO: 4332 - protein, 302 aa, Methylobacterium sp.
MRLIVALTCATLLTSTTCPVEAEELSGTLKKIKERGAISLGFRDSSVPFSYLDNQQKPVGMAMDFCLAIADAVREKLNDKSIKIDLLAVAPASRIALLTNGTTDLDCGANTNNPERQKVLGFTNTIFLTASKYVSKKNKNLHTVEDLRGRTIVSTSGSSNMRQIVQLNAQRKLGLTILTAKDHAEGFLLVENGRADAFVMDDILLASFIAASKDPSAYEISSEGMSKAEPYSIMLRKDDAPFKALADEAVASILTSPRMATLYDKWFTKPIPPHGINLNFPMSAQMKQAFAHPTDSPDPDAY

SEQ ID NO: 4333 - protein, 77 aa, Methylobacterium sp.
AAAVEEQGAATQEIVRNVAEASTGTGAVTRNVAGVARAAEKTGSSAAQVLASASELSRQSEHLSGEVGRFLASVRAA

SEQ ID NO: 4334 - protein, 367 aa, Methylobacterium sp.
LRIRALTMTSILTNARALTALRTLGAAGDGLDTANRRVSTGARIGSAADGAAYWSIATTLKADNASLDALKDAIGLDKTAVDAAALGLTRTVDQLRIISQALVSAQGEQADRAKIQLDIGNAQRVMRSIAESSAVGGSNWLSVQSDAPGTFATRHLVMAYSRRDGTAHLTRSALDASQFVLFDAKARIDPPDWAEVSAAPALGTLAATTAAIAARANPTIVGGYTVSTFDAPGHTHVNGLLDTGYRIDGVPALTPVQTSFSVATIDVSQGHVNRGMIEAYARVVDATLQKVMDGAALLGSTSTLLTAQRDFARQMTAINGNAIGILVDADIEVESTRLRALQAQQMLGLRALSIANAAPDTVLALFN

SEQ ID NO: 4335 - protein, 77 aa, Methylobacterium sp.
MAGEKPHGDKTHAQQQRIIEHKDGPNVPAGGGAKIRNSPPREPRSASQQESRDHHKHNNPGQEGHRPQKHGPAEEKH

SEQ ID NO: 4336 - protein, 118 aa, Methylobacterium sp.
VSGRRGIAALPPARASGVPWWPMTLGWPLPRLLAAMILAILAGAALAATPSAAHAHEGHGRHGPRAAAHAPAAARPAAPVRLKTGPDIPRIAVLTAAEHAPAAGRSDSMDFPHVRTSA

SEQ ID NO: 4337 - protein, 56 aa, Methylobacterium sp.
MRDPNSLFTTQAFRMRNRDLIYVSNAPYTELQKVLGVFSSVTGPVASAAAVYAYSK

SEQ ID NO: 4338 - protein, 76 aa, Methylobacterium sp.
VLIRNRTNLAIIASISFDAPLLPRIAEGVALLSALWTRGLSAYVAWQSLTSARSIEQRPRIDTARAASFAGSVAEF

SEQ ID NO: 4339 - protein, 31 aa, Methylobacterium sp.
PSRELFKSFIDISKSFETHKTPDRQLSAWSF

SEQ ID NO: 4340 - protein, 48 aa, Methylobacterium sp.
VRGRANGALTPELALKVGQAAGLVFQRGEHRHRVVIGKDTRLSGYMIE

SEQ ID NO: 4341 - protein, 63 aa, Methylobacterium sp.
VSAPPVTPDGRYIVVRGRLWRRADPGLDEAARARAVSALMEARRAVRAAKAAERAGDPGAGEA

SEQ ID NO: 4342 - protein, 111 aa, Methylobacterium sp.
MISEPSSRVLGAQSIKRNAAAHLRLVLHRSEEAIMKALLASSLLTVGLLATDPASGQRLEIGPDGPSVDMRSRGQRERDIERREMRRDMRRDEVPRDRRDRSVDPDDDDED

SEQ ID NO: 4343 - protein, 82 aa, Methylobacterium sp.
RPAGTALPRSVEQMTELVGRVSMKTLVRETTDLIEKLCIEAALRITRDNRASAAEMLGLSRQGLYAKMRRYGIGDLDGPDEA

SEQ ID NO: 4344 - protein, 264 aa, Methylobacterium sp.
MFADAIRRQAEDAPRAALPAVAAALWRALANGQVSEAEAETLSALIDARREASGPQRHPTSPTSSSDGAADVRGDTLSGSTGCARTGVGSRPRTDASLERRRRWAASGRLPPAIAARFTAGEQAVLALVAAETARRKDCRLAIEHMAAIAGVGRSTVKNALREARRLGLITVEERKVTGWRNDTNIVRIVSAEWTAWLRLTRRSPTPGSETPSSAEGGGVKTATGTPTQVQIRGKPRPAEPSKMLPAGSGRPLPMRPRENSRGR

SEQ ID NO: 4345 - protein, 552 aa, Methylobacterium sp.
MSLAASPISSAPSMEEPEAFHRGVELFGDWRWRLNNLYWITNKEGRRVQFQMNWAQEALFREMHYLNVILKARQLGFTTFIALFGLDQCLFNADFRAGFIADTLENAKALFADKIRFPYENLPDGLRAARPVRKASETQVLFDNNSGVRVGVSLRGGTMNLLHVSEYGKICAKSAPKAREIRTGALNTLQAGQVAFIESTAEGQEGHFFDLTEAAQATARAGRPLSLLDWKFHFAPWWKEPAYVLDPTGVPIADGYRRYFAKLEAEQGIVLSPAQQAWYAKKAEVQLGDMKREYPSTPAEAFEAAVEGAYYGEWMAKAELDGRIGTFPAEPGFLVHTAWDIGRSDYTAIWFFQIIGGRLRIVGYYQNTGEGLPFYAAKLEEMAAERGWTYGDHFWPHDGRVTEWGSGRSRIEQALTDHKLKIRIATALSLHDGINAVRTTLPLCTFDAGPTAEGAKVLKSYRKEWDDEHGIWKDRPCHDWASHGADAFRYLAGSWRAVTETVAPETRTIHTPRGAIVRPALEPVKSLTGATPGNGYSMNELWEMDQPADTRV

SEQ ID NO: 4346 - protein, 98 aa, Methylobacterium sp.
MKGRARLAWNVRQIRAARGLSQETLAVDAGVAAPYLSGIERGTVNPTVDVLDRLATALGVEIDTLLRAYDTASTPPQPLRAGRKPRQGREGPATKAGA

SEQ ID NO: 4347 - protein, 64 aa, Methylobacterium sp.
MEARSVQLIALQTWAKGMSPNKAARQLGTTTARVQELRGGRFNRFTLGELQDLTSRAGLAYQAP

SEQ ID NO: 4348 - protein, 383 aa, Methylobacterium sp.
MIEALGSNALTWPSVRPTEVSVWHGHVAFAHWLVEALRPRLVVELGTHNGVSYFAFCNAIKRLGLDARAVAVDTWEGDHQAGLYDESVYERVRRFNGQFSDFSTLKRNYFDDVVESFEDGSIDLLHIDGLHTYEAVRHDYETWRAKLSPRAVVLFHDTRAFIEGYGVHTFWDELMREGKGFNFHHSAGLGVLVHGTDVPEAVEALCSVPDQSAEATRIRQSFEVFSRIAQTLGQEAVVHALAHQGENIALHCRASQSSYYSTNAETPQGAVNGIRTGHFGFHTDNEDRPWWRLDLGGRRTFDEIRIFNRLDPDCAVRSRTIEISISDDGLIWDTVYSHDGSVFGGIDGHPLSFVRGGMEARYILLRLRETNFFHLDEVEVYRH

SEQ ID NO: 4349 - protein, 1267 aa, Methylobacterium sp.
MFEITGADIGALSDGDLRTLIILLCEADLRRRGLSTAAVTAGGNQDAADGGVDVRVALPPGTSTETLDYVPRPATVFQSKASDMPRKAILKEMRPGDTLRPAIVALAEEGGAYIMVSPGADLTDTMLTSRKSAMKEALRGLPTAAALTLDFYDRTRIATWVRDHPGLIPWVRERIGRALRGWRSFGRWSSRPADADAGYLIDDAVRIRMPGEDEGDGLGAADGIDRIRAELREPGKAVRLVGLSGVGKTRLAEALFDPAVGHNSLDPSLAIYADTADEPAPSPGGLASDLIAGRTRAILVVDNCPPETHRRLTEIVTAPGGTVSLLTIEYDIQDGEPEETAVFELTTSSLAVIEQLVARRYPTLSEVDTRNIAEFSGGNARIALALASRDPRRGSFAGLDDKLLFERLFWQRNDPDTSLLTIAQVCALLYSFDGETLEGDAAELPILSGLSGRTVDAVYAAAAELKRRQLLQARTRWRAVLPHAVANRLAAIALQDIPRQRLAAALVEGAPDRVLRSFSRRLSYLDASPEAREIVQAWLVPGGLLADIRHLNDLGITVLTNVAPVAPKAVLSALEVAMHGADDLALRDFTPLARLMRALAYEPAQFERAVALLVRLARLPKENRLHGDAAEILESLFPIRLSGTLAPIDLRLAVVSQLLRSADGAEQRVGVQLLGAVLRTDGFSSWHGFEFGARSRGYGLYPRNGQEVRDWYAAVLECAEPFLTAEGAVADGVRSAVAQAFRGLWLRGGQAAALTRLAHAVIGARGLWRDGWGAVRQTRIYGGEQLTPDGLAELGALEDVLRPQTVADKVRSVVLQGGRSLDLDDVDDPKEDFALAMDRQAATIARLAREVIADEAIWRALLPDVAAGDGYKVVLFGDGLATAAEAPRAVWAALVEQTAALPVPGISVLCGFLQGIERRDRALACALLDEVLEDPILAPWLPVLQAGTTPDEAALARLHRVLASGVAPIGRFSRLAHGDASSAIPGAELARLLLRIAESQGGGTVARDILHMRIYADRGAGRAIDPDLVEAGRTLLLGFRFAKGPGSREDYELASIARVSLAGEGGRPAIQELGRALALAMSRYEVGLYDYNHLIHALFEAHPTEMLDALFAGDGSSPRRIVNLLTELPHSGKPPMGAVSDDLLLAWCECAPAERYPLAASFAMLFAQSDEGTSPQWTSLAGCLLAQAPDPVSVFEAIIGRLHPMSWSGSLAEVLSSRQDLLDRLDIAGLPTLAEPMGRAREALRVMVDRERQRERDEDRERDGRFE

SEQ ID NO: 4350 - protein, 198 aa, Methylobacterium sp.
VLMKLVSEQSDADIAKRRALEQLAQHLRALAANLMRTSRGAGAPYHLEEQMVGCLEALAAHRAAVGHGVSTYEYQAMLDPHEAQAEARPWAGGTEEDQARWEADGTVACADAIDDIRRASLQMTASMLVDQLTQMRRGESDIYEGVRRLEAAREKRRAYHQPRLSQLASRGCGQTVAEVVAWRRPRRCRLTIFVPTEV

SEQ ID NO: 4351 - protein, 150 aa, Methylobacterium sp.
MATALNDILLGVIATIRRRTLAAFGGLPNGWWRAHQRPATSGSLSSEVGVEGVLHIDGEDAQAQRMGHFAKQLHRSTWIGLSGIERWALLLTDYGPQPGLFLRPFITLHGLGTWNTFMGGSWLRLMMTARADRSRDTASASWHRRVQRWA

SEQ ID NO: 4352 - protein, 42 aa, Methylobacterium sp.
MKTCAIPCSAGYLWMAGLASFILAVAVIAVLREIEHRRGPPG

SEQ ID NO: 4353 - protein, 129 aa, Methylobacterium sp.
MKPMPWKNGGKTLTLDADPSSEEEMQIFTSPEERMQQRALNHDRALRASELGWLGKLIGSETNSARNLAAFFLTFSLLIGVGCLIAAWWQKEQGEFWSRSAERSFSAAAAALAYVFGQGSKGSSSQGPP

SEQ ID NO: 4354 - protein, 168 aa, Methylobacterium sp.
MQFHSTLSLPAIRAAQLRHVANEKNATSADIIDSFIRAAWTDVGGGVVLPGFDFVACLDDDSGEPVVTFVCTGSLPVLLKPEQAHGVANGIRDLLAAVAARFEVDAICEGSRARFIGTRKGRGFTIQLLDDLDDPGRKPVTLLGLTASIAADLADTFETFAKRAEALR

SEQ ID NO: 4355 - protein, 314 aa, Methylobacterium sp.
MITPTTLALAALMRLRGVGRKQALRMVPGEFPAGVDVEAKVHDLVAGAGRAGDVGEIVSSARTMLADSVDAGINVLGFHDGEYPVRLRDTPDPPAILYVKGNVSPLHAPRAVAVVGTREPTEYGGKVARKLALRVAEAGYVVVSGLAHGCDTLGHEGCLDAGGVGIAVMAHGLDKVYPAANRGLAQRLVENGGCLVSEYPLGVTPMRNAFAERDRIQSGLSDAVLVIETDVKGGTMHTVRFAREQHRPLACIDHPQKWLEEDKTRGNQKMIKDGWATAIPHGEALLAFLAGVPHGAGRPGDVASSPDRQHVLGF

SEQ ID NO: 4356 - protein, 172 aa, Methylobacterium sp.
MVIFDFDQTLVDTSPVENLRANRDWRGVMSRASSLQVYDGMTSLLRDLRAAGETVAIVTKSPDMVAKAFIREHAWPIDIVVGFHQVKRRKPDPEGLLLAVRQAGASAADSCHVGDRPEDTEAAHAAGMPAIGAAWGLDDAAALRASGPDHLFETVADLRTFLFRRRRQDTAR

SEQ ID NO: 4357 - protein, 491 aa, Methylobacterium sp.
MLAWVREVVISGATDYRRYQADAMKTRYALRFTGLSVRRSKGGLVLLNAARHSRLADAPARLRDEMGELLRFKTATLAERGLKRSGTWNAETAAQKVEHFALMFGALAADPDGEVEGFGTDPGALTLALLAIPAVWDWYLSWRERRRGFFTKWEANMLSIALSLVRAETGWLRQTPGIAGHLIPIPGLVSTADVAAARADWDATCEAMYRHGRARIREIERVARVHRDPFEPILAILEADSPVGEYRKITDEILRLMPNENLYPRAAAEAIRGFLMLRFGLHLGLRQRNLRELLLCPRGRMPTPERRLEELRRGEIRWAPREGGWEVLIPSVAFKNANSSFFGRKPFRLVLPDLGGLYEKIEAWVGRHRAVLLGPAQDPDTFFVKTVKRTSASAAYDQNTFYEAWRLTIQRYGIRNPYTGRGAIEGLLPHGPHNIRDVLATHILKRTGSYEQASYAIQDTPEMVMQHYGRFLPQDKAAIAARILNQVWEAA

SEQ ID NO: 4358 - protein, 167 aa, Methylobacterium sp.
MPEDAPSRLPAETPPGGARLYAWIFLAFSVVGLLTGGLERLALLPDAAAKACRAFYLCGPRPLNTLPPFEVVHGSGSTWEQVEKDDVPPVQRRLEAENPDFNIVWHRGEETGGCSGAFNTTCRYHYHGRWGAVPKWETASKLPWIVLGCVFLVSLAVILRRRGTRTA

SEQ ID NO: 4359 - protein, 303 aa, Methylobacterium sp.
MLERFQGERGRKHLVGEMERQRLVTGTPGLAEALVDVGELARVAPGTSIIEQGGTDNDLFFIVVGDFEVVVNDHRVNMRGPGDQVGEMAAVAPSQARAATVTATTEAIVLKVDEAGFSSVADRYPEVWRRMAQELARRLEQRNALIRPANEKPRVFLFSSSEALPVARAIENALADDPFLTVVWANGVFKVTNYTLETLEEELMQSDFAVAVAHPDDKTEVRDEEWPTPRDNVVFELGFFMGSLGRQRAVLMEPKGAKLKLPSDLAGITTIKYNFQPGADVGAMMGPACNKLRAHILRLGRNV

SEQ ID NO: 4360 - protein, 135 aa, Methylobacterium sp.
MGGLDVYLDVIDVQLAKSGPDLADYIRMRLDECSQLLAVLSPITRASWWVPWEIGVATEKERFLASFVSDGATVPEFLQKWPYLQSMSDLDKYIAESKSAQLLVENYRRQGYGSTAQSRGFRSFHNSLKSSLGQR

SEQ ID NO: 4361 - protein, 154 aa, Methylobacterium sp.
MSMPAQFISALEADREPNARTAATLRKILASNGVEGALMLDDRAGTPVRLPLTASAVEAVVAVLLRLGANADVVVAQREREVSPEEASRLLGVSRPLVYHRMDTGRLRFRQVGSHRRIAMDDVLALKAEEDELREAARAFGEDTDEQEMILRGP

SEQ ID NO: 4362 - protein, 209 aa, Methylobacterium sp.
VVLKVLLDANVLLPQQQRNIILQIALKHRIELHWTKLIVEEWLRNVEPAVRGNCERRTLPLMAKYFPRAELPAMPATPYGSTDAKDRHVAAAAVHVAPSVLVTWNIRDFDRSALAGHGVTLQTPDQLISNLYDQFPDLTYEAALEAKANLSRSAPSWDDFIALLAGNGLTTFVQRIDEHHKRLSYECEDEERSEEEEDRTDYTGSSGPP

SEQ ID NO: 4363 - protein, 204 aa, Methylobacterium sp.
VKYQPPGTDILLTAAAFDIKRLNGLTPDPVNGSRFSVQTGEVSAQGLEFEARANVTENLTLVGGVSLIDAVNTGTGTTPNETTGRTVPLAGLRPVQVPDTSVSLFANYRFLGGPLAGLGIGGGVRYLGASQGDAANSFQVPANTVIDALASYDFGYLDASLKGMQLQINAQNILDEKYVQSCIYQAWCFYGAPRTVFATLRYRW

SEQ ID NO: 4364 - protein, 64 aa, Methylobacterium sp.
MADTGETRAERLKSALRDNLRRRKAQERGKEQGRKPGEADPPTQDDSPGADASGTGPDSDKTGL

SEQ ID NO: 4365 - protein, 128 aa, Methylobacterium sp.
VETDQAAGEAGGRAPLRTPLDRGAVGALPSLPQAELHPGREVGQLPAVGVLDDLKHHRGLVPGDAEPVADQGAGRAMRPARIGDDQLDATGQQLVAEGPGLLARPAGLPGIAGRPVRVGTGVWGGVKG

SEQ ID NO: 4366 - protein, 239 aa, Methylobacterium sp.
VSLTDKQRRFVDEYLVDLNATQAAIRAGYSEDTARQIGSENLSKPDIADAIAEAMAERSKRVQITADEVLRELVEVALGDVNELVEHRVGCCRFCWGEGFRYQRTRQELIRAEATHAKDNEKAVREGRETTLFDVEGGDGFHAAREPNPDCPECFGEGRGRALFKDTGRASPRARRLYSGVKLTKDGMEMKLRSQDKAIELIGRHLGMWKDKVEHDVSGGLADLLRAVDGRTRGIPSRG

SEQ ID NO: 4367 - protein, 768 aa, Methylobacterium sp.
MSDTQGLDGERDEAPQSGPDEVVRFWLDQIERYEKAFGDWTIRVEKIWKIYTEARRAEGSSRSRKLSLLWSNVSTLQPAVYARLPAPAVSRRFKDSDPVARVASELMERALIYTFEDSDLDSTLALVRDDFLLGSRGTVWVRYEADFEPILDEMGQPVMQDAAEGEEPQPAERIADERVPIDYVHWKDFGHTPGRYWQEVTAVWRKTYLTRTQLVRRFGEEKARKVGLDQCRNTSGQYLDMGARKATVYEIWDRDTGKVYFIAKACPEPLEVTEPFLKLKGFWPCPKPVYGTLHDESLVPAPDYVFCQDIVEEIDQLTGRIGKLTDALKLVGFYPKGDDSSGALQIEKALQAGVENKMIAIPGWAAFTEKGGSNQIQYLPVEQVLKVLQGCIQLRKELKSDLYEITGISDIVRGESDPNETAKAQQIKTQWGSIRIRERQKLLAKFIRDVARIAAEIIADRFQPETLMAMANLPLPSDAEVQAHMQAQAEAAAMQQQIAAARPQPVPMMPGMGGPAPMMPPPGPGPIPSGQGAMMGPEGPKAIGGGGTTVNVDTKGAGKFTEVANAKQAERYAKMMDAADEAVSIRGDIDTLADLGSKIATGRLTEAKLGIAQYAKALGADDLANGLTGGKMSEMEAYQAIADKLAPRMRVPGSGATSDYEMRVFRNSLPSLLKTPGGNAIAVDTFRSLYDYQAAVGDIAGQALRGEIPQKDADAQIRALESPFLRFKEYRKEAVRGEASPPPPASSAPPPASGQKVRRYNPATGTLE

SEQ ID NO: 4368 - protein, 643 aa, Methylobacterium sp.
MPRLPSGEYAPPAGTAATPGAFITAEQHNTFVTDIGAEMTGSARESEMRDLGALVTTTGTGAAYALALSTPWEILPDGITVGFRVHVSNTGACSLSIKDVVGPLRAVSGTDLAFGDLPARSAIQATLNRQGASAIFAGTLTANSNQITGVSSTAGLYVGQTVSANGIPSGTVVTAISGTLVSLSKAYSGATGPALITAVGPEWLLVNGGLLATANRLAIANGQLPVTLTADAQLDAAAKGTAILASGNLRVKLPAPTIAGAGYFFDLRNDGIGDVTLSTQSVDFTGSVASGNAQIFNVSSTTGLAVGMLLTMPPAPKSFTGTLTANSAIITAVTDVSGLAVGQPVSSIVAGFPSGAAIVAFDSTTVTISAPFAGTTTTNASITATVDGILPGTTITAISGNTISLSQAYVGATFVTASLSAYSTAIDGLPFFVMYPGETRRVMCDGNTFRSIVTTPFYREWFGSGRFIRPPGYARIGYHAVAPGGGGGFQGGGGGEGISDTVPASSLPASMLLTIGAAGAPSATTGSDGGVTILGTLATLAGGKGGTASGAAAAVGGGTADGINAGGAGTGSGTNPTSSINGGGGGANNVAGGTVRGGSLNAGAGGRFPNLAPGPGGGGYGSATNGVAGSAGGPGRVRIYGIA

SEQ ID NO: 4369 - protein, 90 aa, Methylobacterium sp.
VTEPLEVRRRLAAGYLTGRTLEEALAAWRSDYDAPTYRERRPQLARLGNVIRKLAAEAEAQGDADADHPGQRPKRKKAAPRPKPGRRGDV

SEQ ID NO: 4370 - protein, 251 aa, Methylobacterium sp.
LARGALGVILPVLAPGRAGLGPRRRPLRCLGLGCAAAGFWGLPALGRSGALRRGLPLRLPLGRAVAGRRRRALGWVAVRALRTLGLTLPIGLTLRGSALLAGLGPLAGGRRLRTLGGCGAFGIAVGTRLRPLALGRRRRPLRRCPLGRGTLRALGPVRTLGALRSFGTLRSFGARRSAARAFPTAARPLSAAAGAPLHVRPALGEEQGRARIVRTCGDGRGEEAGQHGSGEEELPHRSAFAARRPRSGDGA

SEQ ID NO: 4371 - protein, 405 aa, Methylobacterium sp.
MLARLCFLTMVVTALAPAAAAQTRVTIGVLNDASGVYADSGGTGSVVAARMAAEDHMAARRGLDVGVVAADHQNKPDIAAAIARQWYDRDGVDAIFDLPPSSAALAVNQITRDKNKVFVASSAGTADLTGIHCTPNTVHWTYDTVALANGTGGALVRRGGDTWFFITADYTFGHVLQHDTTAVVERNGGRVLGSVRAPFPTADFSSFLLQAQASGAKVVGLANAGRDAAGAIRQAGEFGIRQGGQALAALLISLAEIHALGPAVARGLVLTEAFYWDLNDATRRFSDRFAARFGGRKPTAYQAGVYASALHYLRAVEAVGSPGDGAAVVDRMKAMPTDDPLFGRGEIRPDGRKIHDMYLFEVKAPAEATGPWDLYKVLAVIPAQAAFRPLDAGGCPLAGLSEARR

SEQ ID NO: 4372 - protein, 194 aa, Methylobacterium sp.
VPAFVARLHAADRGEVTKLAFEFLILTALRTSEVLGARWEEIDTVEAVWTVPAVRMKKKRVHRVPLSPRALAVLDRAKVLANDSPFVFPGQKPMKPLSNMAFDMTLRRMQVPVTAHGFRSSFRDWAAEQTSYPHEVAEMAIAHVVKNRVEAAYRRGDLLDKRRGLMADWASFCDGSGPADKSKANDAASNQVNG

SEQ ID NO: 4373 - protein, 176 aa, Methylobacterium sp.
MMEVYDFHAKNLSYPKRSYAASDSKGYELIRWIHGSRRGIIGIDLGRMETVWKELGSHAALIYAASTIAVSDRMTLLDVIRGGTADFDKHGHLLNSWMGRARYSAETILSNSTKPELGQATLTQLPTLPSEPTPEPHFDQEEQARIKAEFDMVAILGNRQRDQRRERLSRRGPRRV

SEQ ID NO: 4374 - protein, 71 aa, Methylobacterium sp.
VTDHLDLPQTGFVSPAWVKRRYAISNSTMYAWVANAYLPAPLKVGPRAVRFRAEDLRAFEAQFAARDVQVI

SEQ ID NO: 4375 - protein, 33 aa, Methylobacterium sp.
AHGFELVRKPYSAEELARVLREAAQRGRTAVER

SEQ ID NO: 4376 - protein, 111 aa, Methylobacterium sp.
MNGLLRDVQTNWLPSVRTASQVDALTGRYTTSVLRHILTSEPKMLATIDKDLGERARKLTEARAVYEPLISSSDERALYDGFSKSWAEFTATVEPILDLSRSGRKAEALAL

SEQ ID NO: 4377 - protein, 69 aa, Methylobacterium sp.
VNEAAPSVVLPTAARRASVPAERSAADARTDPIAPASARTGAVRPAATTIAARRARGTSGASAVRRAVP

SEQ ID NO: 4378 - protein, 223 aa, Methylobacterium sp.
MIDGYLREHYGLTVQDGPFRGMAYIAEAAGSLFGPKILGSYEQELAQIFNQLGRYETFVDVGCAEGYFAVGALVAAPHLRTAAFDLDPRARQLCAALAEMNKVAGRLQVAELCRPEDLVALAGPKTLIMIDIEGAETNLLGSTPAEALSDCDVVVETHYTAAGCTLEFLHSYFSRTHDITIIEQSARDPAAFPPLMALGQVDRFMAQWEGRGPEPWIFAEARR

SEQ ID NO: 4379 - protein, 426 aa, Methylobacterium sp.
MATIIGDATDNTLVGGTDNDTIIGNAGNDALNGGAGGSDLIYGNAGVDTITSTKNVVVGGFVTAAVDTVYGGQGNDIVNYAGATAGVSVRAFGGLGDDSLVGFTGNDTLVGGDGNDTLGGLGGADRLVGDAGNDVLDGGAGNDVIYGNLGNDTITGSNLNVAGNLDTVFGGQGNDLIDYSASGGNSIIYGNFGDDSVVGATGVSDRIYGGQGNDTINGTGVTAGTDTVFGGQGNDVINYATTAAVGGLIYGNLGDDTVTGGAGADTLYGGQGNDNVVGGALTDVLFGNLGNDSLSGGTGADTLSGGAGADTFAYAAGDSANSVTAGAADYDSITDFVTGTDKISGLGAVGSSTNFRTVTNTSNSFTDAQTAAGGLVAGDVRYVFVANQSGTGGYLFANTDGTAGLAATDTAIQLTTGTVAATDILA

SEQ ID NO: 4380 - protein, 79 aa, Methylobacterium sp.
MTLALAIPVVEAAAFTAGCTLIHGRRHQPQWVTFALLGLLCLVAVGGLALALAGIGPSDPVQATAQISFENHAAGAIRY

SEQ ID NO: 4381 - protein, 158 aa, Methylobacterium sp.
MPTRALPLWLFTIALVIGAPILNIVYWFQVLASGTLPHDGDAVAIPMFGGVILTLMLAPLVLGTAWICLRRYHPGTRLGAWRQDRPVRSLLASLLFGGPALVLAAGAVHDLLTPGPWYEHIPVALSVPCIVWLLAMRAAFIEQRGAALPRRPARHREP

SEQ ID NO: 4382 - protein, 72 aa, Methylobacterium sp.
MFLTIGAEADRLGEHLAARSRADKSEAMRVALAGRLRLCEASLANGTEPHPPGEGGGTRYRIGSRYCSAPEP

SEQ ID NO: 4383 - protein, 66 aa, Methylobacterium sp.
MAEVSQMAFKEQALSTRVMSRLGEIVSMVEDARKLSALCASEPVAGNVAVSGDGTLCWAPMSPGNH

SEQ ID NO: 4384 - protein, 58 aa, Methylobacterium sp.
MPAASCPGRSWRPRRSGALSPDAPAQTFSPAPVGGDSEPDPGLDRLLAALDFARLLPR

SEQ ID NO: 4385 - protein, 73 aa, Methylobacterium sp.
MMRCESGLVFPDLVEVQALVSFAVGMKREDAASRLGSRRRYDTQNRTARGIEVFGFWRDPSEDGERLRHPCLR

SEQ ID NO: 4386 - protein, 280 aa, Methylobacterium sp.
MPRYARRDLLAKFHAMIDRRQPIIGGGAGTGLSAKCEEAGGIDLIVIYNSGRYRMAGRGSLAGLLAYGNANEIVKEMAREVLPVVRHTPVIAGVNGTDPFVIMDHYLDELIALGFSGVQNFPTVGLIDGTFRANLEETGMGFGHEIDMIRLANAKDLLTTPYVFNAEEAAEMARAGADIIVPHMGLTTGGAIGAETALTLADCPALIEAWAEAARRVRPGVIVLCHGGPIATPEDAAYVLANTRHCHGFYGASSMERLPAETALTERTRTFKSILFPETR

SEQ ID NO: 4387 - protein, 401 aa, Methylobacterium sp.
MSVVYVVGTCDTKEAELLYARDVARAAGARAVLVDVGTLRSSALADVPAAEVAGHHPDGAATVLGGCDRGAAIAAMAEALARFLATRDDIGAVLGLGGSGNTALVTRAMRALPVGVPKLVVSTVASGQTADYVGPSDIALMYAVVDVAGLNAISRRVIGNAAHAAAGMALRAPPQAPADKPGLGLTMFGVTTSCVTQVREALSAEYETYVFHATGTGGQSMEKLADSGLLAGLLDITTTEVADHLFGGVFPCTGDRFGAAIRTRLPYVGSAGAVDMVNFGPRETVPERYRDRTLYVHNPQVTLMRTTPEENRAIGAFIVERLNRMEGPVRFLLPLRGVSAIDAPGLPFHDPEADAALFSAIRNSWREAPNRRLVEVDAAINDPAFAQALVAAFRDAVQERP

SEQ ID NO: 4388 - protein, 233 aa, Methylobacterium sp.
MLVVRDLHVRFGQAHILQGVDLAVGPAPLAIVGRNGMGKTTLCQAIMGMVAGRGEISLDGASLAGRAPDRVALAGIALVPQGRRTFPSLTVDEHLRLVDQGPRARWTRARAYETFPRLAERRRNGGTQLSGGEQQMLAIARALLMNPRLVIMDEPSEGLAPVIVDHLAEVLRGLTQEGIGLLLVEQNLRMATAVCDHVAVMVTGRIAATLPAAELAGNEDLQRRYLGVAAVHH

SEQ ID NO: 4389 - protein, 249 aa, Methylobacterium sp.
MAPEPALQLTGIGRRFGALHAVRGVTLSVAPGERRAVLGPNGAGKTTLFNLVCGDFPPTEGRIVFFGQDITGLPAHRRTRLGIGRTYQTSLLFNGLGVLDNLYLAVRGGRPGRFSFRRPGRGDPHLARARALAERMRLTHLEERPVSDLSHGQRRQLEVGMALACDPKVLMLDEPAAGLSPGDRPELLALLRGLPRSLTLVLVEHDMDVALPASDIVTVMKDGAVAVEATPDRIGSDPTVQAIYLGKGH

SEQ ID NO: 4390 - protein, 340 aa, Methylobacterium sp.
MSARLSLPALALLLAAPLLLGLVLPQPQAQFWTVNILGRALVYGIVALSLTFLATYGGFVSLAQMTVAGIAGYGLAILVEGAVPGIVGGLPYALAVPVGLLAATLAGLLIGAIAVRTRDIYLLMITLALAMAVSRFAESNIDWFNGYEGIRNVVGPTLFGVPFRQPHLFYYVSLAAAVALYVGVLHLVRTPFGLVLQAIRDNPRRAAALGYDVALHRIAAFGVAGFIAGCGGVLTTIYNIGISPGSIGLGASVNILIISVIGGLGHPVGAFVGSLIFAVFDTFAASLYDRDRFNTLIGLVFLGIVLVSPDGIVGLVRRIPGLRRLPRPRPDAARRAAETG

SEQ ID NO: 4391 - protein, 292 aa, Methylobacterium sp.
MALAATVVLNGFTLAALYFVVASGFSLIFGLMRTVNMAHGSLYLVGAYFAYAVFEPLYDRDAWYAWYLAVPVGMAAAALAGAAMQTLLLGWMQGQELRQTLVTIGISIVVADQLLAHFGGTPRQFFAPDALFGTTELPLVGRYPTFRLVQIAVAVAVGVGLWLLLAWTKLGLMVRAGVDDRTMLAACGVNVPRVALAVFALGAALAGLGGVIGATAQPLAQGMDGRFLLTSLVVVIVGGMGSVPGTAVGAVLVGLAEQIGQALFPTYAVILTFGLMVAVLAVRPQGLMGRPA

SEQ ID NO: 4392 - protein, 223 aa, Methylobacterium sp.
MSSLPGIRACLTYCVLIILIWTVGSTAWTMWIFHRPLDEPIALAPAGRIQRNIEIRFTAPYSLALDFSFGARRAEIMALVGEGSAIGSAVALHGRSGTTVPLRWSLTDVDGKVVAGSEADTHGRTSYASDFVSRNVATFSIIPGRYRLEVNVLRDVPEFRDVPVRVHLGLPVGKVSSGWQSEFAFFAGFANVLAIWPLAGLLLLALAMLTIRDLTGPGSMRSA

SEQ ID NO: 4393 - protein, 94 aa, Methylobacterium sp.
MTHLSTLSAPTTSTLAIGPGSWRDAPLPQRNSTDARDRLRLALNARGMRLSFCVDGMLARDLATNESCGGIYPYGDFAGMHAALVAGELEVDHV

SEQ ID NO: 4394 - protein, 65 aa, Methylobacterium sp.
MSEIRMDAEARARVIAWRCGFVLDRDAASIQIKYPADGVVAGRVASFEDVPGAFVEGRLAKEVRV

SEQ ID NO: 4395 - protein, 61 aa, Methylobacterium sp.
LTDTTPDIVELTGDIVSAYVSNNSVPAAELAGLIAGVHAALQRLTGAAAAPAEAEAPVEKP

SEQ ID NO: 4396 - protein, 93 aa, Methylobacterium sp.
MPPDDRTYDEQLRERLGAGGVKRLSELIGAAGGLTPTEARHWFELSVQDWREVEALAFLALDDCEQRGAILPWHLVRWLDRRRHHKPTTSLFA

SEQ ID NO: 4397 - protein, 133 aa, Methylobacterium sp.
VATTVTTFAELNTALRAADDRAANTGAIEIVVSGTIAATADLTAVNLRAGNTLLIRGTNGGTLDGGRTHRGLFVYSGTVTIQDLTIQNASAVGGAGGLGGGGGAGLGGGLFVAADTAHGATAGHVTLSNVSFT

SEQ ID NO: 4398 - protein, 246 aa, Methylobacterium sp.
VTGASEEQIPQPVAAFNGRVRGLALSQRADRAVGLAGDIVDLVRHAVSVHATNRIVTYSDRISSQVGTSFAANAFNDVQRSLIEAEILQTVRLWDHPDIDRIGLQTAYWLSKDPAVRTILNDRHTTAPEPYPGYIADRLARQDLLWLRLDRVMALILGSDLLTRLRNFRDKRLAHWLVQTKLERAGETVPPALYGDERRLLVRTVIAADLLARATRDASFDFKGQWRIAQRNAEAFWHGCTVKPLR

SEQ ID NO: 4399 - protein, 64 aa, Methylobacterium sp.
MQRGLDPLRDAHGLRWREQADRGAIQNRGVPGTIARSASATVFDSGVQISRSFHRGFGKSASGF

SEQ ID NO: 4400 - protein, 213 aa, Methylobacterium sp.
VNGEPVGSRPDATVGPGAPKQQELFEARTQWFHVFKTMIDSGDLATLSGSAVKVYLVVKSFTNFATGRAFPALETIAEKSGLSLAQVKRELKTLEERHYLTKAKSGRRNEYRLREKVEITDGSGRPAAVATWDYLPSSVQHAMADLKNVLITGDLAGAKIVHIERLQVNVTHLHDNAVNFNVQQFNADLEKLPPAMREKLLANWKASLEREDA

SEQ ID NO: 4401 - protein, 43 aa, Methylobacterium sp.
MAHYVFSATTPTRGEELWVTDGTAEGTILLKDINTGSVGSFPA

SEQ ID NO: 4402 - protein, 154 aa, Methylobacterium sp.
MLDPVATRLARLAQDVAATRARTQQLQAQGSVLRQRLGRARRALAAAGEASAQACRTSHLLLQERTPVVLEQAGLDEAPRTPDPSLGAVHELLSILMAQAGGPERLVDVLLLAHEEAEAAGEDERALILAGLLHQLGRHLAHQVGPRAAGITLN

SEQ ID NO: 4403 - protein, 300 aa, Methylobacterium sp.
ITVDVKGEILELKNTINTMVDQLNSFASEVTRVAKEVGSEGKLGGQARVEGVAGTWADLTNNVNLMAENLTGQVRNIADVTTAVANGDLSKKITVDVRGEILELKSTINTMVDQLNSFASEVTRVAREVGTEGKLGGQAEVKGVGGVWKGLTDNVNMMAANLTGQVRNIAEVTTAVANGDLSKKITVAVEGEILELKSTINTMVDQLNSFASEVTRVAREVGIEGKLGGQAQVRGVGGTWKDLTDNVNMMAANLTGQVRNIAEVTTAVANGDLSKKITVDVRGEILELKSTINTMVDQLN

SEQ ID NO: 4404 - protein, 208 aa, Methylobacterium sp.
ITVDVKGEILELKNTINTMVDQLNSFASEVTRVAKEVGSEGKLGGQARVEGVAGTWADLTNNVNLMAENLTGQVRNIADVTTAVANGDLSKKITVDVRGEILELKSTINTMVDQLNSFASEVTRVAREVGTEGKLGGQAEVKGVGGVWKGLTDNVNMMAANLTGQVRNIAEVTTAVANGDLSKKITVAVEGEILELKSTINTMVDQLN

SEQ ID NO: 4405 - protein, 105 aa, Methylobacterium sp.
ITVDVKGEILELKNTINTMVDQLNSFASEVTRVAREVGSEGKLGGQAQVKGVGGTWKDLTDNVNLMAANLTGQVRNIAEVTTAVANGDLSKKITVDVKGEILELK

SEQ ID NO: 4406 - protein, 25 aa, Methylobacterium sp.
ECRPVTPEVAGSSPVARATFSFQLR

SEQ ID NO: 4407 - protein, 180 aa, Methylobacterium sp.
MLAAPLNLAPRAPLKGPAGAPVPAGPQPAPGQIRVLIADDSAVVRGLVARWIGEAGFNVVGTASNGRIALEMMGRHDPDVVLLDIDMPELDGTEALPRMLAASPTLQVVMMSTLTTRNADISLKCLALGAVDYLAKPESNRGVTTSDAFRAELVERVRLFGAVRARGRRPAPVSAPAFHE

SEQ ID NO: 4408 - protein, 46 aa, Methylobacterium sp.
VQDGERLRTDCWEVRLGIVFAESHLPHGMGPHEVERIGSRAYRVSA

SEQ ID NO: 4409 - protein, 28 aa, Methylobacterium sp.
MQSIVPIDDVDKMEPLAHPMGVRSRDVV

SEQ ID NO: 4410 - protein, 238 aa, Methylobacterium sp.
LEAETALARASAEEQRKAGMRQMADGFEQAVGGIVGMVSSAASELQATAQGMSATAGQTASQSTSVAAAAAQAAANVNTVAAAAEELGSSVAEIGRQVSGSADLAQAAVAEANATAGLVQDLAQAASRIGDVVALISQIAGQTNLLALNATIEAARAGEAGRGFAVVAAEVKELASQTARATEEISTQIGQIQGSTDQAVGAIGGIGTRIREIAGVAASIAAAVEEQGAATQEIVRNV

SEQ ID NO: 4411 - protein, 396 aa, Methylobacterium sp.
MSSFGGSAPERSQLSEVTSDRRLSQPLAPGFIHLKVVQGLRIVVTELGADPDALAAAAGLDPRLFAAGSKLVPFTAIGRLLALGAERTRCPHLGLLVGKRTTLGSLGLVGLLMRSSDTVGAALRALEAHLSLYNRGAAAGLGIYDDTAVFSYALYEPEADGAALHTERALAKATNVLRALCGADWAPLEVMLPHSAPPNTKPYRAFFRAPVRFDQEEAALVFQAQILKQRIVTADPATHRRVEDRIRRIEAAQTTTLSDELLQYLRTAVTRQRCKAERAARLRQVTRRTLSRRLKAEGTSFKRLANEAQFRVAKQLLADTSISVTQISAILDFSEPSAFTHAFRRWSGVTPSAWRKGNWPRTEITQLDEEPGARGEILDAFAPPDLGLRPSHRRRQ

SEQ ID NO: 4412 - protein, 78 aa, Methylobacterium sp.
MNLRLQPVRVRTGSSDTDGLLVFTGEYLVAVLVQLSEEHGEHTGFWFLEAGFDGAEDLTRPTFRDLEEAQAWIEQRIG

SEQ ID NO: 4413 - protein, 181 aa, Methylobacterium sp.
MPRIGYARVSTLDQDLDGQLARLKAEGCAVIRSEKVSGASREGRAELATVLEFLRPGDELVVTRRDRLGRDTRDVLNVVHEAEQRGASVTVLDPHVSTRGEMGHVVLTVLGMVAQMERRFIKERQREGIERAKAEGVYAGGKRRLDREQVRALHAAGSEPAAIAAALGCSRMQVYRILRQA

SEQ ID NO: 4414 - protein, 968 aa, Methylobacterium sp.
LSVTGLALNGGFVGATGGPRLGAALAQDIGAIPFGAVAAAHMDADTMTDLVIATGSGISVLKGKGDGTFEAPISALAGPQGFYAVAVADLDGDGRQDIVAAGRDSSPGSLSVILRDASGGYRAPQVLNAGTIFTSIAVADLNGDGKLDLVAADPGNVNSTTPSAGSVKLFLGDGQGGFQGATSLTTGSSSVAVIAADVNRDGRTDILAANRTGGDISVLLGNASGGFTAAANFAAGSDPRTIAAADLNGDGNPDLVVTGSGAASILLSNGAGGFEPPNPIATGGLVYSASIVDFDGDGKLDLFAPIMQGSGGFAVMQGRGDGTFLAPLTFASGSGNYVGSVADVNGDGRPDALSTKLSGSGGFTVALNVTTQAAALDAATVSATLNGAATGLAIDTTAPTLTARSAQDLPLSGALSVTFSEAVVAHDPVPPPGANVIVNRGPTVTLYKNNRNDPATAIETFSRGQWTLNGNTLSVTPSAGLQPGTNYVLALDNLNLTDAAGNAIATSGSFTINPNTHSYALVPYAFSTAASPPSTGGGSSPSDPAPNLVDGVQVNTGMQTLPDGSSVPVTTIPVVTGGRTDTDTASSAADIPLVTGTGGATYLTAQVPTGYGLQALGPSTSGLNGLIAAIQSRTVAGSADQTALTGSGSGFLGALAANTNLTVRTIVPSVAPGTTTAPNQPLVIQGQPLAQDAGQQQAVVLDASQLPAGITIELRDIDFAAVVGAVTVRAPADTVVGSGSGGLSAVGALTVTPDPLRIYGDGAAQTFVGGAADDLLSGGAGTDTLLGGLGGDLIYGNLDADLIYGNQGADTLFGGQGDDRAFGGQGDDRLFGNQGNDMLLGNVGADIVYGNQGNDIVYGNQGADLLFGGQGNDVLYGGQDNDTLVGGIGDDTLVGGLGADLYRFDPNSGRDLILGFNQGEGDRIALGGQTYTVTSAQNGDALLNLSGGGVVDLAGIRADQVNASYFAA

SEQ ID NO: 4415 - protein, 26 aa, Methylobacterium sp.
VKLLVAVLLSTFVYAAILPPAVRFRD

SEQ ID NO: 4416 - protein, 64 aa, Methylobacterium sp.
VKSAPSNPGIKHVIGTIRDRGSLGADDFCCNLPRFAAENLAANEALIDTLAAEKGLTAAQLALA

SEQ ID NO: 4417 - protein, 488 aa, Methylobacterium sp.
VREIAFEIDDDSGAPVFIRLSRAIIAAIESGRLEPGRKLPGTRTLAAALKIHRNTVDAAYHEAVMQGWLVAEPARGTFVARDLPEMPAGGPPRAEAVRGANLRSCAEPVTPACGGAPMLHVSDGAPDPRLLPGAEMARAFRRALTAPEFLRSGRHDDPHGDPRGTPALREALCAHLSAERGLAASPGEILVTRGSQMALFLAAGALLGRDAVVAVEEPGYPLAVAAFRAAGARVVGVPVDADGLSIDDLERLAKVEPGLRAVYVTPHHQYPTTVTLGAGRRIRLLDLARRHGLTIIEDDYDHAYRFDGRPVLPLASRAGDVPVVHVGSLSKVLAPGLRLGYATGPAGLLARMAADRRAIDRQGDVPPEHAVALLLREGDLGRHARKTRRIYRARRDRLADLLWDALGDRLTFDVPAGGLALWARLGPGLDAARWSEAARRLGLAVTPGSAHCLNAVTAAQAFRLGFADLCDDDLRRMVALLGRAYPTR

SEQ ID NO: 4418 - protein, 114 aa, Methylobacterium sp.
VHNCLDFSFRRIEPGWPFREAGRDYLLAVDGNMQANNGETLVQLALAGVGITRVGNFHITEELATGRLVPLLDAFNPGDREAIHAVFVGGAAMPARVRVLVDFLAEHMRGNTGW

SEQ ID NO: 4419 - protein, 202 aa, Methylobacterium sp.
MRDAMQLVPMVVEQSSRGERSFDIYSRLLRERIVFLNGEVNDTVSALVCAQLLFLEAENPTRPIHLYINSPGGVVTSGLAMYDTMRHIRAPVHTLCMGTAYSMGSFLLMAGEPGERAALPNASILVHQPSGGFKGQASDILIHAEETQRTKQRMTRLYAAHCGRSYEAFERAMDRDRFMSAEEALDWGLIDRILPPRTGALA

SEQ ID NO: 4420 - protein, 118 aa, Methylobacterium sp.
VSDAGSDEFGHDIEQAYELNEPPEKVWRALSIPALREHWLPGAALVAPEPTAVTSEHEVSYRMREAAPPYLESTVTFRITPNGTGGTCLRIIHELTDARFAHLTKVAANGNVSLLRAA

SEQ ID NO: 4421 - protein, 37 aa, Methylobacterium sp.
VRQTTGLNVDEGVVRAIYIVRNPEKLRHLVATSEHST

SEQ ID NO: 4422 - protein, 217 aa, Methylobacterium sp.
MLGSVADAQDAVQDAYLRWHGLLHAGIEKPEAFLIRIVTRLCLDRLRAARRTRETYIGPWLPEPVFEAAPDEAGEDVSLVLMLALERLSPLERAAFLLHDVFGLGFEAISAALDREAAACRQLASRARRHVRAARPRFPVTPEAGARIAQAFFEASRRDDASGLQRLLAADVVAYTDGGGLRSAALNPILGRERVTAMFHGLARKIGFVRPPLLHRG

SEQ ID NO: 4423 - protein, 236 aa, Methylobacterium sp.
MKLPGLVRLLAEDDERGEPAIAHIARVIREAGHLPTTKRGRGASDMGVLEAANLLIAANATDVPSKVSETIETFRKLRQVPIRKSEGGITIDSSSWWKKLSSCTNFGDALEVLIAQSENDREDVCQAFNLSLGANRPSDLLTFRAVRFGWPEATASILLNVANAEPFRDGLQPDADLSGKRFEIRFALTEADRLFLKDQKPSGRIHEVTVRDSVIRRLSDACAAASTDAPDKEAVA

SEQ ID NO: 4424 - protein, 92 aa, Methylobacterium sp.
MGDVITFRPRPRPARPAVRHHRARIEGAVAHALDVVDELIAVLDGLDAPSVDLVPDADLEDGGDAEPSLAAPIGGPSQRVWAAGGSQDLERE

SEQ ID NO: 4425 - protein, 140 aa, Methylobacterium sp.
VKARATEVLQAKSPSGSLIEHLPAARDLADVVSLSELSLWRLRAVFRIISHFTDAADAMCCQPRCEVTQGELNDVGKFVEWHAELWGRLADRLIEEASNRIPADQDEAEDRLKILMERALIDCEYSFLAEAVHGLRMMAS

SEQ ID NO: 4426 - protein, 167 aa, Methylobacterium sp.
MSDEFGAMFDRVQQERVDAAKKEREAADEARSQARRDFDMKAACLTNVVLPTLEEAKAGFANKGLEVRFVTNATAPNVANYVDPTVRFHFAKPQGSTLALNVDASVIYTITVTHTQGGVQIHRESKNHHQTITRSDLSKQFGVGVADQLTRDQVMKVIESAFRDATR

SEQ ID NO: 4427 - protein, 68 aa, Methylobacterium sp.
MAAVNVCKANITQENKKVLYAKMLRSYETPSQVAYSVGVEVSALNKMPAADREAMCTAINDRIKAGIE

SEQ ID NO: 4428 - protein, 91 aa, Methylobacterium sp.
MGNTAGTVESVADLGPYWRAALRAASQHVDEQVAGTAMLLTAVQRLKAGMGVEGAANFLEILSRAVRDGEMVSIAIGDVTLNLKDDGVRTQ

SEQ ID NO: 4429 - protein, 862 aa, Methylobacterium sp.
MAAGLKKAADQADALTRLSAKGGTGKLAADLRNLGASASQIDAVTAAMKRYAAQNMIPANRADWTKVQASQMRTWEQSTVASLKHVIAAEREAARAAQDFASAQLAAAVKAGEASRKQRQAALEQAKAHREAIRERRRDAAATIASGAAVMAAHKGKKIGLDAVSSAASFDIAVRKQREFTDISAQIQAGLLAQAKRVGQETQFSNEDVVKAQTASMQGLPANFTPELRAAVAEGIVDNVRNFATLMETDLKEGAEIIRGYLQQSGKDISTKQKALAEANRATNQLVKMAKLGGMSGEDVGQFVKLAMSSGTTAGLTTDSLMSLAALAKRGGLRGDEAGTFVKTSAGKLVSPTKKGLAAFNAAGVEHSRFVKMPDRLSTSALEGQFRMEMGKGFTPGIRKRLDAINGDKTLLADQSRYIAAVTSAVEPILGKKKNGQVRASDRQVAAKAAGNYHKVAAQSVDVEGLLDALMKANPTLAQLNAIFTGAHGGKGAITQRQWDEFKASREEIHKSGDDPDYAAKKAREVMAGLGGSIENLKGSFDNLVLSIGTANEGLIKFSADSLGNLVDKFSKLDQGTQQALSLGAGGAALAGGAYGAFNLTKALLGFGTSSAALTGSAAALDASAAALTAAAAKLAGGSAVGDLAGGATKGKAGAAGRLAKMGPLGFLGWAGVGAGAMIGTGLLLDSFDEHRHRGNGYRGDSRRRAPTLGLDTLPQGWGAGGVDVSKGLGGGVGPYTTNREKTWGEWFFGRPTHRGGSDPTRMTLPLPAGMQGGAAAPTVAPKTDTTAFQALEQKMGEVKDKASELNGMSIAIPASSSGLGTIIQQMERIISLGPQVNAVMNAGAGNTGKVAQTLQNMRTTA

SEQ ID NO: 4430 - protein, 28 aa, Methylobacterium sp.
MAELDAMPWDEFCAEWIEAESVSRQHGN

SEQ ID NO: 4431 - protein, 170 aa, Methylobacterium sp.
MPRSKPLGWPKLMVARRLAGGATGYYWGPPTWAMKAGCTVGREALGTDYAEAKRRCDDVLNPQFDAWRTRDEGRTFDAVTVKRLTVAEVRALTAAQRAAEEKDPDASLPFPIFVDDEGAPIPQTVMDAMLDDDMVALERAADDFFPARFRASPAASSPASGADTGQTSDA

SEQ ID NO: 4432 - protein, 60 aa, Methylobacterium sp.
MSEARAFVATRSVFGLGPIDFGMFMSSPLRCGAKRLSLRADMWRRLYIRLGMLGVQHEWT

SEQ ID NO: 4433 - protein, 31 aa, Methylobacterium sp.
VPLLEALILVTPLCVGCTFWVAGRIYTGEGY

SEQ ID NO: 4434 - protein, 54 aa, Methylobacterium sp.
MGSLLAMIVGVVTFTAETGVEVVRVALVHPILQQGGRGVVFLLEVTARVRAAPR

SEQ ID NO: 4435 - protein, 80 aa, Methylobacterium sp.
VTAPDNERRRLAAEYLRGRKLEEALAAWRSDYDAPTYWERRPQLARLSNVIRRLADEAVAQDDEAADRPRGSGHENTRRG

SEQ ID NO: 4436 - protein, 31 aa, Methylobacterium sp.
MFARRTRLSLAIAIGSTLMLTTVAAVALCMP

SEQ ID NO: 4437 - protein, 92 aa, Methylobacterium sp.
MYRRRLSEQQFADELEDLEVTHRQSVGSAHIIAGESPSRGALMLIQTINAFAAMYELPEGDEPDYEPSPAEVQAHRERLFAFVAGLEAELRP

SEQ ID NO: 4438 - protein, 128 aa, Methylobacterium sp.
LGPVEWARLSPEAFAAERSAFGAWLAIDGPMQRQYRRRARAYVAARKVVLEMRMNDVELLPVEFGRRVSPFLEAPIDRSQGRQLLKQSLALECEGGPWPAVTASAEPSRQAEWEANYQENQAKAAGRT

SEQ ID NO: 4439 - protein, 112 aa, Methylobacterium sp.
MATIRGLIFAALKGVEPDSKRALAIADYLATEYRRHPQAQHIYSLRLEGPPRLLPPTVSKVTHGEHLWVSITHTPRRDPTVIAERAIFRSAQEFAAHLHYGVRKARMRKGGA

SEQ ID NO: 4440 - protein, 87 aa, Methylobacterium sp.
LALAALIGAATPAHAVDRNETMALMMAVATFNEKNCPGIQPNRQFIADTFNEFGVKTENMARQPYLGTIISTLNAFESNKPYFCESN

SEQ ID NO: 4441 - protein, 116 aa, Methylobacterium sp.
MSESDDAFTNEQLTELALMQAESTAQVGKALEATAHQALAGLVMNALLLHELERLGFVDCEALRAEAVQRALSIQPPQVGASVARVIQTIFDGKPPAAWSGADLTSVNDDLPDAKH

SEQ ID NO: 4442 - protein, 88 aa, Methylobacterium sp.
MCGHCLRVDAAVALGLLLASSVAALDASATLCRAFARERCACCHAVDSRGASLTRETPPFHLLAPRFPIDDIADVLVGGNGPPACRYA

SEQ ID NO: 4443 - protein, 56 aa, Methylobacterium sp.
MPERPHVASRPLRPEDRSFLSSPLADGSGKPDDQGVPLAVSVLVIAVVLLIVSAMG

SEQ ID NO: 4444 - protein, 35 aa, Methylobacterium sp.
MVKAASATRWLANPPSRVQPVKPGASQRFSQPVSQ

SEQ ID NO: 4445 - protein, 77 aa, Methylobacterium sp.
MAVTDCRVVGPVLVMTGVSPRYGEMVLVQSFDDLSAIYERPEGDEPNYESPEAGEAHREMLARLLAEFADPLPAPVG

SEQ ID NO: 4446 - protein, 128 aa, Methylobacterium sp.
LDLGGGEIWQAVAEPAEMTGDQGVQVTITAQVNAPVTVGRLASVVNEAVRDEEGPRGEGLHLDLHGMRQVEDEDLARADAVDLISVDTAGAAVERGPEHEMVERLRPSLLRGAYRASSLMRLCAHGRR

SEQ ID NO: 4447 - protein, 119 aa, Methylobacterium sp.
VRRYIESNLATVDAPTLMSRFGLSRTPLYQLFSECGGLYAYIRQRRLAEAMRRLRQVPAGRRPELARLAHACGFHNQTVFARAFRRRYGLNPSEVAIGELVPAGVNAADPTLLAWLREL

SEQ ID NO: 4448 - protein, 133 aa, Methylobacterium sp.
MQEIDLGKIGQWIVGNGPFDGQWAPTDFTAAEGRYPCAQTGGEDLGAEADSQCSAIKEGTFANGFRLTRHEGKSVISHIVRTTKYDQQIGAYGIEEVEVGGYGIQIADVVSMLQQQWLENAEILIRGMPDRND

SEQ ID NO: 4449 - protein, 56 aa, Methylobacterium sp.
MWAMGFVVEGAHYYTYVLPCPFSNSRSLRDAAFAARSMLKTAAMRSNREMTATDFG

SEQ ID NO: 4450 - protein, 630 aa, Methylobacterium sp.
MKIVILDSLPDDLLTVLLADNVVYRPDLRLKGSKAQVEALHWLKADAVVCTSELDPAGLSAWRPGACKDVACLDLDVGRSGTAVEIEEVEPGLWRTTVRCGDLRSGYIRAFETLEHLSLTRMVANETPIPRSSKILARRDVVLVGAGLVNLVTAYQLSRSGWIVRVIDAAPDPSTEAPWLSFGCSRGGDDARMFTLSEMDNYNDRALSLNMNSYFSKDVASLGWAASRIGSFSQSENDWISDYESVPIWLADRYNDDIFAFTRDSRNRWDRWIRDEPDLFSSCETRSGILRVYSDPDHFRSAVARQERIGAVMQVYSPDEVAVFEPALRAPAASGAIAGGILVVGFTVNAHKFMAQLISRMIDLGVSFEWETKVRAVLTDETGCVWGLDCGEKTVEASNFVVSPGAYAGELLNGTRCSGRIHGVLGAWLRLPNIEPRLEHSLKLARRGHVTEDANVTVATDVHGRPIMIIGSGYGHTGIDPTNVDEGFLRRIYNGLTDTAQTYFPEAYAACKDGGSIEASLKYCVRPWTSNGLGLFEIRPVQGGGKFVVTGGHNTGGFAQSPTISDAVAAALAGTQHDMHILYHPDRGISFLERVRSRDWCSTMSSIGTPDKAVEPSHLWDAVVRDVALS

SEQ ID NO: 4451 - protein, 80 aa, Methylobacterium sp.
MRKSFYSHTSRRIARRSAEPGRADGRHAPGARTRIARRRTCGIDAQPAILLDLTDQPAVLGPEIEAIEQHPASLVDDLLD

SEQ ID NO: 4452 - protein, 216 aa, Methylobacterium sp.
MSLRYLDDGVGLDGTFVLGFRITDEPAEKWSARMNAFKNKEKAALFGAAACLRTGVPGLLKALGLPADRTMLIPAISSRDEVASPESFISMLAAAVARSAGARFDGQAVRKKVHQPLHGIFAAAGRTAELDKAGYQAEPRAGIRHFVVVDDLVTRGGTMSRMAQALKGANPGATVHGVALGKTERRAYCGPNLDNGHVDQHWEEAWLRGERKYRER

SEQ ID NO: 4453 - protein, 249 aa, Methylobacterium sp.
MRVCLHLPGRTRITVEQALQEYGPNPPVDVFACPVCDGILSIRAQAALARTAHFAHARGADCPTIDAAAAPFENLRALDPDPVARIQRQARFRANWRRHFLHLGSLVPALAIEEFVARLDLSLEWNIWSYVGLTDAEIPIVLALLDQFSPDDAMQTHTVRPRDHWYRFWVSHGAGAGADWPWPEQGATISRGRFRYRGRGVAPAGADFIDLEIVPVSGAFLEGPEPPTLHDYRENAVNAWFVRHPAFGR

SEQ ID NO: 4454 - protein, 120 aa, Methylobacterium sp.
MARQLLLAGLWSGSAPVCAIDAPIDLPAMRERLTRFRECEFAERNRWLAWPVDDRPEPGRDGVAVTPGLRVWACDEVEVDPYAAAAGRPFDAELTLSDDVSLGRAAVVLLGLLSDRRPDA

SEQ ID NO: 4455 - protein, 97 aa, Methylobacterium sp.
MMALLRAWSQRRLDRDRLVQADASSLVERFGEGAYDVARGRVVEPRRGTVLDPARPTGHWTRVKLRIAEMSGREIGLDTATRMAMRGSHLEKGGGRW

SEQ ID NO: 4456 - protein, 39 aa, Methylobacterium sp.
MVGRSRKVVSDVVLNAVPPAVDRLAVSGRIVSGAVPVAT

SEQ ID NO: 4457 - protein, 33 aa, Methylobacterium sp.
MSSSPPIPDRTRIDAVAENESVTSILEGLEEPA

SEQ ID NO: 4458 - protein, 143 aa, Methylobacterium sp.
MNDNSTAFIATAAGLVSAYVSNNHVQAGELPGLLASVHGALVGLAQPAPAPEAPAEPLSAAQVKKSITDDGLVSFIDGKPYQTLKRHLTRHGLTPEQYRARFGLPANYPMTAPAYGARRSELAKAMGLGQIGRGAQVQQQAAE

SEQ ID NO: 4459 - protein, 82 aa, Methylobacterium sp.
VIGDMQLHASPLMTELIEDWTEVRSPGRAARRRRQGHRQRIRYVDRPKQQVIVFGNRIIAHPDIIERLRAQIPERSPLHRLF

SEQ ID NO: 4460 - protein, 78 aa, Methylobacterium sp.
MAWIQLTQASGGRKTYVNTDLIYQVTQAGKTRLHVAVAAKADDSTPLWPMHIEVAESIEQVMEMMHGAGEKVVSRLGS

SEQ ID NO: 4461 - protein, 30 aa, Methylobacterium sp.
MMRLVHPGWLATLTPAQIELFFSACSPTVH

SEQ ID NO: 4462 - protein, 181 aa, Methylobacterium sp.
MDRALTFIGTIGTALSFLPGLSDPVRWVIFASGMTIGLGGLAHMAWERRLAFAGWLDRRMPGRLVAPPAVETEHEFTSLYEVTRQAYERTRSTFLGNAADRLSNDSPLLWYVHLLDDHFPVFGTHPPSRIMERFDEVGFEYEVVGEMIIAVEQFGSRRWENLSLRASDVPEALKYVQDRAE

SEQ ID NO: 4463 - protein, 139 aa, Methylobacterium sp.
MRAVWFGLLGAVLAAGAAQAKACDLQGAELTADDGRTFRVVRISSHFDRIKSPKVNDLKADGYVLAVIEGAGQKFVLSQTYSGWGMPNNAARSYEYEEDRAAKIGSERARRAERARVDGTFDVLTGPLEGVSLRPTRCS

SEQ ID NO: 4464 - protein, 635 aa, Methylobacterium sp.
MGPGQGRPGLIDLLANGAGAVGRGITGLFGGGDAGGSFPESLPAEGTDGFGAPGYGPGDALGYGNGSFGGFTGTMETGGGRGFTGMNAGGGVGLGSFGSGITQPGPAPDLYGFTGMNPSQGVGPGTLGQLPAGFDPAAYLRANTDVAAAGIDPVQHYLNFGMQEGRAITPEGWTQTQGPPALTPTSGGGAAAPTIGGGQPTSTIGAPQAVNGLPPGFDAQTYLALNPDVAAAGLDAGTHYRAFGAQEGRAYAPPGGTSTLGPPASSPTIGPDGSVSVVSTGLVPTQGPPATTPTQGPGPTITARTGTFNPAEYLAANGDVAASGQSALDHFRNYGLKEGRAIDTLGNHFNGQAYLAANQDVAMAGMDPVEHFLKYGAQEARTLAPTDWTSPLTATTNIGTIGAPAATPTIGPAGTTPTIGAPALTPTYAPPAATPTIGAGSAVPTLGPGFTQPSWSPGGGISNPFGFSGANVGSALGATPQTFASAYPLDTNIGYSSGGSPGGGGISDFGFSGADVSGFDVNAAAPSAGTEAYSGPGATVDGPRTGTGKGSSSSAAFLADQARTRAYWDTLAKPASLYGYTNTSTPPIAAAPVVPNLTLTNLNAANAGMGGAMLGSGLNLSINSRPLAGGFGFGF

SEQ ID NO: 4465 - protein, 91 aa, Methylobacterium sp.
MSANAAGTPAPPGNSSHRTNASASRRADTPARTASGNDPDENEAVEIVVQDEADRPRPHMGPYMGPYMGPYMGPYMGPYTGPSRPTSPPRP

SEQ ID NO: 4466 - protein, 82 aa, Methylobacterium sp.
MTISELIAQLRAAGATIEVIEIAVRSLEAAMEAERTKEADRKAKQAARVRKHRDTRKGGITVTLPSRDGNSPPDPSPDGPPP

SEQ ID NO: 4467 - protein, 144 aa, Methylobacterium sp.
MMHGEEQAKAFAHHNVSARMAASGGALLGNTTATAANQLGGEGSRPSLRTAIENAYTAQKRLDETHSYVSSLADSAEALAQRISGPYPTEASPKTTDSAQRAAPQSTVQAVNHALDSVHGSISSLGSPIERLSRALGVIERAVG

SEQ ID NO: 4468 - protein, 127 aa, Methylobacterium sp.
MSTSLARAARAVTIAASDARAEAARTDHLVHVAREHAGKDMCGLAEAVRDHAEGVSEAAAWVARCAVLEGLPELVAAIEAGADVWVDGAPLSAGSIVVRPDADRAGLLPTLKAWARRGRGLLSRRAA

SEQ ID NO: 4469 - protein, 55 aa, Methylobacterium sp.
VSARPHFRVLLRVRWKLSGATWLWLVDRDGSLLLLEAARRTAGGSLLVRFAEPLR

SEQ ID NO: 4470 - protein, 41 aa, Methylobacterium sp.
MRELLTLIVFVLFLGVLHVVATAKREASLGRLPVLHLRSEP

SEQ ID NO: 4471 - protein, 78 aa, Methylobacterium sp.
MADTTEPDLAARVAAIELILKGWIAVSESATGKISGPIRAGIDDGLAEALGHGTADPERVKQLQTAVDLFFSGIPKAP

SEQ ID NO: 4472 - protein, 86 aa, Methylobacterium sp.
MDTFRDLIAGYGLSDFAADIGVQENTAKQMRKRDSVAPEYWDAWVKGAAERNLPGITYERLAKIAANKRVVAQAANTDATDPQRAA

SEQ ID NO: 4473 - protein, 37 aa, Methylobacterium sp.
MSPLAAELQTLAFYGLAALTVLGALWVAGRVVTGEGC

SEQ ID NO: 4474 - protein, 49 aa, Methylobacterium sp.
VRLHDRGGDIFAVGSMPLATAERFIEQLQGHVAAAKKQGLSVIRCEGSA

SEQ ID NO: 4475 - protein, 75 aa, Methylobacterium sp.
MSDCIREWVDLTPEFEVALEDACIATELLAAVIDEETSGNTAAQREFANAAMTDLIEALRDVEPCEEKARLALRG

SEQ ID NO: 4476 - protein, 92 aa, Methylobacterium sp.
MPREKKTLSELEEMLLARLRELPNGELVEGVNIVLSDREDGDPGVGVFWSETSATMRPLVGHAIAYGSVLVRQYQVIDDPNDEALPHATSSV

SEQ ID NO: 4477 - protein, 47 aa, Methylobacterium sp.
MAEPPRAPPAGLSGIDRDGARRRSKLLRALLLLATLAAVAWIAFHLR

SEQ ID NO: 4478 - protein, 60 aa, Methylobacterium sp.
LKSVMQMFQHPSAAHLSASTIALPAFTRVAPRKPATDEAEIVKRAIPLTIVDAHECKGDN

SEQ ID NO: 4479 - protein, 71 aa, Methylobacterium sp.
MVGSAEERLDALNREIADLELKRDAHVSIIAALTDQGLDTAAAKAVLQRIEDQLAALRVRTATFEGDARHI

SEQ ID NO: 4480 - protein, 84 aa, Methylobacterium sp.
LAVEHHVTQADILHLALKLARKAFLERAPQPPRSASPVPVATGAALIAIAEQLVELQEDARMSAADAEAHAMAPFGTDAFEVRP

SEQ ID NO: 4481 - protein, 377 aa, Methylobacterium sp.
MSFETFRTTFPALVEQRLAQISLDPDGSGGDILVAGALYKMAAAVSKTSLQGVASTALLSSMSASQLQAWLQAPENVTVFISAISNQGTMATVARSQSAMATIAGCPAAVGLILGSANAVAQVALSYVAILAVRNQPAALAAFVANAQASRLLASSQIAMDLLAASAAAMTTIAASSTMMAAIVGSGVAMTAVFGSAEAVSVLVQYSQAMQAMAASATAMAQAAASATTMAAILGSSTALAAVFGSSTARTAIHASTVAVDAIRDTPAAIAWLRANKMTTASVNIGGTNQSVITPVMAGVSKAISLSIKSGGISSASVTYSLKTKTAGSTEAAVVPLSPSATNTVAAYTSFGVTCSITIPATKNENYYPVIEFVAMD

SEQ ID NO: 4482 - protein, 81 aa, Methylobacterium sp.
MADLGVCVVSGVDGMTYEVNSRIDADLRAILREAQPDDGFQVAGSLRWADVRAGGKTYPLRGLTALAEVIAEYAERREVQA

SEQ ID NO: 4483 - protein, 77 aa, Methylobacterium sp.
MPNLLEGHPEFTRELINAARRIAKAHGHTMRKPTGRMSLHEWGMGFFRLTDAAGNIIAGPRHELTPRAVAKFYGETL

SEQ ID NO: 4484 - protein, 61 aa, Methylobacterium sp.
VATPNPTDLTTPGTLDDEAFVDAFCAIPEAVDGLWMNNNPSQEQLQSEYLVGVLEEDCGHA

SEQ ID NO: 4485 - protein, 36 aa, Methylobacterium sp.
VLAYAIDGLVAQGTVYEKQQALRLVSDALTKRGIIG

SEQ ID NO: 4486 - protein, 215 aa, Methylobacterium sp.
MNLDTAPAVATAALPPTPVPCLDPKPGLILLGRDERGRPHASAFGLDEAPAAERAAALMGFATLIVVEEHQGLASSLPKGRVFESGRAFVPFCSTQTFARLLEAAGLPDAPVPARAAAKPAEPSPPTAGSQGGGAPAGGDGGAAKPPFGWADITIGSLVLARGDDEDGYYAATVAATKADNHFVLTWRDYPDLPEFSRHRHALGLLHPGTPTKGK

SEQ ID NO: 4487 - protein, 95 aa, Methylobacterium sp.
MKFRPLHDRVVLRRIDGEEKTKGGIIIPDTVKEKPQEGEIVAVGPGARDEAGKINALDVKAGDRVLFSKWSGTEVKIDDQELLIVKESDILGVVG

SEQ ID NO: 4488 - protein, 77 aa, Methylobacterium sp.
MAAADALVATFSKQSGTREELAGIITGLMDQYRISPDRAHMLIDRFGRAQLALENAGDELMTRKQGDSERQPSLIAQ

SEQ ID NO: 4489 - protein, 110 aa, Methylobacterium sp.
VADQLRPKVPRLAALMDAAETDVLAYMGFPAAHRAKLHSTNRLERLNGEIKRRTEVVGIFPDEPSIRRLVGAILLEQNDEWAVQRCRYMTLESIAPIGDDPLVSLPNLAV

SEQ ID NO: 4490 - protein, 86 aa, Methylobacterium sp.
MMAVTCATVAAVTPVPPYSRGTVMAQSPEAVKRSISAKGSARSMSRAAAVPAKSAARVRAAARAAASSASTGTGRGGSGATVKARS

SEQ ID NO: 4491 - protein, 49 aa, Methylobacterium sp.
VIEVVEAEIVPVGEFRTMAGRQRESWYAEAIYAVAYGILIAIPIRNDDR

SEQ ID NO: 4492 - protein, 50 aa, Methylobacterium sp.
MANEPQKPSQVDAVPGSGTPKPESPEPGKAPKASEVDAQPDKPKADEAKQ

SEQ ID NO: 4493 - protein, 136 aa, Methylobacterium sp.
MSEIIAFRKVEAPSPRIGSVDVLGSNAAREVFAWQRILVRRATLSKLAFRVGIELAQSVDRKPGRGYAVRTHAQLMGVLRVTSRSKIQEAIARLQRLGFLSVEVSRGLGMANRYRLTWPPQIALPDADGDDDVCPF

SEQ ID NO: 4494 - protein, 92 aa, Methylobacterium sp.
MSMEAEIAVLRADLARTYELLTGVINTLAAQVAASRAVHDLLDAEGVLSRHRLCEQALAYAERAGLGPEVVAVMSSILAPTPTANASAGLYH

SEQ ID NO: 4495 - protein, 72 aa, Methylobacterium sp.
MPLFNSSAIERAEYDEPSSTLQIWFTGSGGPYSYYGVPPHIYQGLCAAASQGQYYAVYIRDKYSRDARFYRR

SEQ ID NO: 4496 - protein, 58 aa, Methylobacterium sp.
MTTQPTTLPDRAAAHAIERARLDALRASIAQVLSADLARLNRCLAAGTAPQATVGGAA

SEQ ID NO: 4497 - protein, 149 aa, Methylobacterium sp.
MIRRPIPPCELTQAFQQAGLEPSYPEHEGTSPQGLGTTSCAAEQAELEALAAVEFEPWDVPDDVLPTNAEWSSMANPHLATLRAATAVLGMTKDELMQLAADPTYDGLGDDMAGKLHRTAELMSSYRVMAEVAHGRLLAAMAAAQLRTA

SEQ ID NO: 4498 - protein, 51 aa, Methylobacterium sp.
MRQIAIDGLNTLSFLIRGLAAIIDQHPWVGQAIFFSPVLSALNWGPYALRY

SEQ ID NO: 4499 - protein, 81 aa, Methylobacterium sp.
MAEDKQAGTEPKVPAERADLKAQGQTSPKGEDRPGFDLGGSADRDAQQGAVPDTGPVSDPEIGNEQPTDRSQLTSKKGTPA

SEQ ID NO: 4500 - protein, 50 aa, Methylobacterium sp.
MADEPQKPSQVDAVPGSGTPKPESPEPGKAPKASEVDAQPDKPKADDAKQ

SEQ ID NO: 4501 - protein, 232 aa, Methylobacterium sp.
MTGPILIVDDDPHIRDVIRFALEKAGYATALARDGNEALARIAVEPPRLIVLDVGMPGMDGLELCRQVRRTSEVPILFLSARDEEIDRVLGLEIGGDDYVTKPFSPRELVARVGSILRRGAARTAATPEPLLSHGGLRLDPGRHEARFAGQVVAATAIEFAILAALAARPGLVLSRDQLMDAAYGGRVHVSDRTIDSHVRNIRAKFAAAGCAEVVATVHGVGFRLAACEPRA

SEQ ID NO: 4502 - protein, 516 aa, Methylobacterium sp.
VVLGVLAIVATLPLVGLFFFRVYENGLIREAEAELIAQSAVLAAVAAREIEALPEGERLLGPVVRPPEDPAARAAYRPIEPGLDLTAADILERRPAATEPARPPDQAALEIGARLQPVLLRTQVHTLAGFRITDRNGTVIAGRSEVGRSLAHLPEIADALQGRFRAVLRQRVSAHPPPPLYSISRGTGVRVFTAMPILVGDRIGGVVYASRTPSNVVRHLYGERAKLALAAAAVLAATLAIAALFSRAITRPIHALVTRSAEIARGNRAVLEQPGPLGTREIARLAQGLDRMARQLHERSDYIATFAAHVSHELKTPLTAIQGAAELLRDAQTSPADAMSGAEQVRFLDNILADTRRLTALLGRLRELARADNPDIRGTTDLATVVAGLQRACPELTVAVEGAREEPFAMSAENAGIVFAHLADNAVRHGAVTLHLAADLTGGHLRVRVQDDGEGIASQNRARIFETFFTTRREAGGTGMGLGIVRAMLLAHGGTIRVLPSDHGAAFEVLVPLRAG

SEQ ID NO: 4503 - protein, 26 aa, Methylobacterium sp.
MCGIVGMVGRDAVADQMVEALRRLEY

SEQ ID NO: 4504 - protein, 49 aa, Methylobacterium sp.
VTDPVSGALVGLLTGRDRLRVRAATLRGAGERRACIARPGRPRRSGATP

SEQ ID NO: 4505 - protein, 29 aa, Methylobacterium sp.
MSGGRSAIQRDNGPERSSLAPCIEIAPLA

SEQ ID NO: 4506 - protein, 66 aa, Methylobacterium sp.
VLRVHPLGGLGEGRNFDAHLAPLGNGIATFTGQLAVSERLLPSLSEADKAEATQADVTAPALNDGA

SEQ ID NO: 4507 - protein, 149 aa, Methylobacterium sp.
MIRRPIPPCELTQAFQQAGLEPSCPDHEGTSPQGLGTPSCADEQAELEALAAVEFEPWDVPDDVLPTNAEWSSMANPHLATLWAATAVLGMTKDELMQLAADPAHDGLGDDMASKLHRTAELMSSYRLMAEVAHGRLLAAMAAAQLRTA

SEQ ID NO: 4508 - protein, 89 aa, Methylobacterium sp.
VAAWFPEEARRRQARNLANQRAAALVRSKAGAMAIRAMADALMRKGEIGADEIEGLCREAYGGQQCEFGAWNAHWPPTLGQLRSGFIPG

SEQ ID NO: 4509 - protein, 78 aa, Methylobacterium sp.
MRRTVLFSALLLAECTPPEKAYSAMLNFFEHFIARAMKLGRADLDPFGILPVIDAVRAAYSDTLVVNGRQVEAIDAKR

SEQ ID NO: 4510 - protein, 255 aa, Methylobacterium sp.
MVDIPALRAVLPASVRIIEDAAHCFEGSRNGRRPGQDGDAAIFSFYATKNVTCGEGGAVITNDPDLAAALVQTVLHGMSAGAAQRFQSGTYRHWDIARLGTKANLPDLLAALLEPQIDRLEAQLARREQLCGRYEAALADTPFLWPEIEAGVVSARHLFPIHVPDGQRDAVLRVLGEAGIGATVNYRSVPCLTLYRSSGVPDLPISRLWGEGTLSLPLFPDLTDGEQDEVIAALRAQANTMRPSKMARHAEPALP

SEQ ID NO: 4511 - protein, 232 aa, Methylobacterium sp.
LHPLTVYAETCARAEEAVLARNSPCFTTAALRNATVFGLSPRMRFDLVVNQMTHDALEHGRITIGGDGTQWRPLVHVRDVARAILLAMRAPRRAIGGQAFNIGWENYQVGEIAHAVQRAVTVPAQITHLPGGPDRRDYHVSFAKAERALGFRASLTVEEAVVEIERAIRGKRLSNTPACYTVHWYRRLLAERGPGLRLPDTGPLHVLTEVPSTDAIIARDAVAGAPVAERVQ

SEQ ID NO: 4512 - protein, 209 aa, Methylobacterium sp.
LDGECDLVLEDEHTIVFIECKAKPITRAAMAGDASDAVLAYLEGIVASQAQALQHQSVLEKHGRITFGDGSVLDWGGRRIVRLSMTLFDYGTLQDRLVFAQLASTLANSRLNARDPADKSATRRAKKSNQIIEKLREHLQGAEGLDEELSRKIWARSLPTASLSIGQLAILLVDRNAVGKLADALMKPASFATGSVLKEFYYMREQKII

SEQ ID NO: 4513 - protein, 52 aa, Methylobacterium sp.
LELVADHLLMAHGLIEQDGAKEMLPVLRQALMTAGVLLARSTMSSDTSDRFH

SEQ ID NO: 4514 - protein, 36 aa, Methylobacterium sp.
VTCPPSDQDLSAVIAVICLLAGLIIGGAVAARGPPG

SEQ ID NO: 4515 - protein, 57 aa, Methylobacterium sp.
MDRERSAPLTAAIDACNARAVVPARAGVLEKRDWSPKVEMRTPRYTTQMRELPVAVA

SEQ ID NO: 4516 - protein, 57 aa, Methylobacterium sp.
LDGTDRAHLCGALVITGRMAETIDADRIGFGNLTYYRTQVGNPHPRLRGVSIWAFKG

SEQ ID NO: 4517 - protein, 60 aa, Methylobacterium sp.
MLRALGDPRIVLPRQAAAATVRTLAGRPPGPYPAAMDLNALILMASALTFSGFVVLLGWR

SEQ ID NO: 4518 - protein, 26 aa, Methylobacterium sp.
MNRNAAFDPAGVASHGARARPRRTGG

SEQ ID NO: 4519 - protein, 28 aa, Methylobacterium sp.
GLDAAAIVAKVNEVLPERQDGRSRLRLA

SEQ ID NO: 4520 - protein, 87 aa, Methylobacterium sp.
MMTEVDKLYFATTGETHRLRDPLCDEIRRVRIRPVRFRHLRTIVRASDGACITVCLSKPDDLGDYADFELAGAFDADLDLVVGGRRT

SEQ ID NO: 4521 - protein, 232 aa, Methylobacterium sp.
VSAALALVPASPDLSPARAALVAAFAERESVLRASGTIVQARERLSAALIARTEAQGALNALATAEAEAVTNWSFTGKGREPKPDLGKRRDLEGRLDDARVRAEAAQAAVAKLDAAGQEGERRLRAADEAVSLALSAVLMEEVEAELDEAAQLFAKARARVRAVTKLACEAQNTCAEAHRPRAGSLAYQASAMLSPAPDQWDRLGDWADTKRAVAQLIEDLRTEPTATLSLD

SEQ ID NO: 4522 - protein, 144 aa, Methylobacterium sp.
MNAQISKADIAKAEDAVDYHCEGLRGALFKLKWIDGQSVEDKRADMRKVFERFSENLLREMPDSATAQTPEPTSKAAAPKPETKKDEPTSPVDRLTKVVGEVLRADPKLSAEQAVTKAFEADPAAYDAIETERQAMIRRRGVSE

SEQ ID NO: 4523 - protein, 443 aa, Methylobacterium sp.
MTNLATLALEFADDLDRDWRTKARPEQLPPPGDWLTWLVLAGRGFGKTRTGAEWVQEQAMSGHVGRIALIAPTAADARDVMIEGDSGLLAIAPNRCRPEYQPALRRLTWPNGAIATAFSAEEPDRLRGPQHGAMWGDELAAWVNAQAVWDQAQFGLRLGRHPRALVTTTPRPIPLIRALLTDPHTVVTRGKTRDNIANLAPSRVKAMYDRYEGTRLGRQELEGEVLTDTPGALWKLEDIDGARIKPEQVPTLVRVVVAIDPAVSTRDGSNETGIVAAGVDAGGHFYVLEDASGILTPDGWGRRAVDLYAFRRADRIIGEANNGGDLIEATVRNVDQNAAFRKVHASRGKATRAEPVAALYEQGRVHHAGQFTRLEDQLTAFTPDFDRNRAGYSPDRLDALVWAITELMGRGQPDTGVIVIPPSIPNERKFSFDGGGLGLYQYD

SEQ ID NO: 4524 - protein, 80 aa, Methylobacterium sp.
MHSRFVMCAIVDSAQFGNEIVQHDTCLIPIGDQNARIDSDNVPYAADLLTVHETPRLQASEHIVGAGSGDARTRRDVRNG

SEQ ID NO: 4525 - protein, 63 aa, Methylobacterium sp.
VAKLRFCEGFAKALPGGCTAFDAKGLTSVATPIFVQWRNKGLVTVYPDADAKAKPVWQGKAVE

SEQ ID NO: 4526 - protein, 33 aa, Methylobacterium sp.
VHLRARIMCGIVGIVGRDAVADQMVEALRRLEY

SEQ ID NO: 4527 - protein, 81 aa, Methylobacterium sp.
MLGVAAPASSAMAFPSDAPRGHYGGHYTGFAADGVETTGALGVFGSRNPASCPMSSAAEGNASQQNFLVKQYGQTSGGNRC

SEQ ID NO: 4528 - protein, 48 aa, Methylobacterium sp.
MELKGWLNWVRGPVPAGPGILFGSLDARLVDVACQIAMSDPILDEAVT

SEQ ID NO: 4529 - protein, 83 aa, Methylobacterium sp.
LRTRCIVVRLHKDRLSFGDAPMTIGRQKIDPETCGDGLAFGPFPELERMADKSRQCAAQGEKDCVLYTNIPTNIPRAAAKRGR

SEQ ID NO: 4530 - protein, 163 aa, Methylobacterium sp.
MDSAREAGPVCVREPAALRPAGLTALFRPEVLAFQASQRQWGSVVELRPVSARALSWSAAFVTALVVAFLCLAQYARKEPVPGYLRPSLGSAKVFVPQVGVVREVRVGEGATVRKGQPLMIVDTQQVSAGGRDLTQAALDSLSAQRGRLARQIQAEEERVVSE

SEQ ID NO: 4531 - protein, 67 aa, Methylobacterium sp.
MLFAGTTPIVGQYLLHATGTITSVILLGISHVVVTVVCAMMLIARIEGTGQPAATPDVAPSGALQRT

SEQ ID NO: 4532 - protein, 45 aa, Methylobacterium sp.
VLGDRLQEPHLAGTDAVVGTEIDPDAQTGHRASAAPLAEAMFSGI

SEQ ID NO: 4533 - protein, 74 aa, Methylobacterium sp.
VEEQGAATQEIVRNVSQASTGTGEVTRNIAGVAGAAEETGASAAQVLGAASELSRQSEHLNAEVQRFLASVRAA

SEQ ID NO: 4534 - protein, 35 aa, Methylobacterium sp.
LPVPGPHGPKGLDLGGAGAAALDPGLPESLIGPMS

SEQ ID NO: 4535 - protein, 408 aa, Methylobacterium sp.
MAGGAGLNDRESSGSGAVSAPEDAGLGAVWDGESPEGGDVRFVLAEDGARVLHAWPGARALLHALAPAGVLPPALARQIRPAAGPGARMLRLRLDPRGIAPPTLCRAAPGRAADGRGLILLVVVGPLPILRAGPARVRMPADTPAEGTSDLMVEPLAESRVEERAAVPAPARAPVAPADREAGAPRPGDRFLWRSDAAGALTQLSGGGDALARLVGASWADLAASGRLREGEAFLDALARSRTFRGLGAILALEGGDSVAADLSGAPLGRPGQAFRGYGGFGIVRAVTLKDLTRPVANLVPLPEATGTETVAPEPPSEPPEAEAGSRESAGTPDPAAVSPVSVPVEATVSGAPVPREPPLLAPPYPLAPPFGRGLGTDPVAMATMAAPLLAAWLQQDWFGSPARTAPA

SEQ ID NO: 4536 - protein, 54 aa, Methylobacterium sp.
VVADRFDRAAIMAAAVSAARAYQEPAGCTWAEAMSVALKGAWQAAKIAKSRTAH

SEQ ID NO: 4537 - protein, 497 aa, Methylobacterium sp.
VAFLFPEVAKAARDGRLDQVIPGRSWPAWREPPAVTEKATDLDRWVTDLIERTASPMIRDRDALREIGVTCPYYAARYWSFIALQDAARDQEAHSAARAQRLKDQRDAYVTLATAARRTIEGEGKDRYHHGDAGPRGNPYWEDGARVWDERVAAREIGKAACDAATAALARAEEFIQRLTAEIDRIAPPTARPDIWKTSYATTMGNLYQLLTGEEVPDHGDIFGDLIKAPLDMIGTPIKPWGQVRTLRKRFSDPENGPGFGRGADGGMGLENLIRFRMRGPGAACIVHDALERADVMSVAMIRLADYTDAPVETVLRECLLKPYIRRHPALKEPEVLLIQLGWQEEPRPNAVQRALRETVARAKGGDIQAAAVIEILMTIGIDIDLTSRKFASGLSWLERYAGLAVADVMYGLYRESLRGDELSGALLGLIGQSDPVAGGLMGLIDLRIHTSTEPEDIELRGLIEARTERAEANIAHHRATAEAVRNYQKVPPRPAV

SEQ ID NO: 4538 - protein, 358 aa, Methylobacterium sp.
VIEQAFSTQAEADAWVAAERAQGREIRIIGPARRDEYFPGTVHHQIALGGTEKGMRSIAYIAQTFLAQAFPDLARSPQLQALKDYTLHNTGAGFVWWEFDPPNDVPASPFAFGHRVIVGHDSADGAVYARVSLFGSLNYALLLARVPSDTSRAVMTDIDPLALRAPADTQKQEFAKAVSAVIRPADPIQILGDALRTGRAEQEINKLVGRIQEFELNKTAGELMGTVAAASIKPEAERRADLTQVVAGQSQRLLVIMRKSAADMKSSWAGAGGQMVSSLLEAALRQDPASANGLSPEAIRSLELVRPVLVEQMDRDLVGGRLDQDRLAMLIGGGPGAAIMLEALIPNLVRRAASGQRT

SEQ ID NO: 4539 - protein, 139 aa, Methylobacterium sp.
MMTVGMVTALALVGGHAAVARAIWPGERVEDPGPALDPYLKAQAGALSTVVAIKERKLSDAHEALAAARKRETALRVELDAAKAEARELVDERSALRREVRRLRRVEVLAAVEGDGEGDETAGDDDGSAAPPAGPRPFQ

SEQ ID NO: 4540 - protein, 67 aa, Methylobacterium sp.
MHEDAPQNRRNGRPPLPPEDRRDQAVDVRLSPTEAKSITERAARVGMRLREFIRHAALNTRIVAPSS

SEQ ID NO: 4541 - protein, 59 aa, Methylobacterium sp.
VAHRHVADGRALSLAERAALLAYLRTPCLDRHGLVAKLLAVERWASEIAQDGLEAVLMV

SEQ ID NO: 4542 - protein, 257 aa, Methylobacterium sp.
MPKPLSAERRALDAAFGMTSGYVLDFTDRTMAEWFEEGFAIDIQSGAYDATGTSKAKRLRTFIEVEDGHTVGAVLRALWIYAEGIRNRRVDPPAEADVVTVFAFIERVERAEARPRTDALERFKADETLDELVAAIQRDIAVDKPAPALDRLHLYCMKKFAHLLDERSIPYDRAEPLHSRVGKYVKALERERELRRITVRMLKSAIGIFDDLNDVRNNGSFAHDNDLVDAAEARFIFDAISAILRFVKSVDTARFGT

SEQ ID NO: 4543 - protein, 418 aa, Methylobacterium sp.
VFWSWQSDIAQRVCREFVRSALSDALQRLAAELGLEESERPELDHDTKGEAGMVDITATILRKIEAASVFVADVTSIAETGQGKKVANPNVLIELGYALKAIGPEAIVLVANERYGGGPTDLPFDLRNRRGPITYKLDRKASDEELEAARGPLVDSLVEALSAILHVARTARDAEAQPVGQPSRNGDPSVWFPTGAALQARDWFGRAQMRRIILPDAPRSYMRIIPAGWGNTPPTAQDLHHPDGHGPRINPLGRGTNGDGGLNADGVLYYEPIENTDETETIVQWFADSGEIWGVDNKAARLIGEQTLFDIHYTTRRWATFMRTGLAALRAFGARGPILIEAGAVRLTDVQWYEVSPSARVSGLRPHACASRASRDWDDAAQIAFLKDAANQVRAAFGVRQVSIEEVDPVVRAGWQSI

SEQ ID NO: 4544 - protein, 46 aa, Methylobacterium sp.
MGIEALVIHAYREKKVERLGADTRRILGIRGPFLRRRLALRERVVS

SEQ ID NO: 4545 - protein, 45 aa, Methylobacterium sp.
VPFAQELDLIFEAHLFAIKIPALFDPPQQPGNCLRCIDPVEFSRR

SEQ ID NO: 4546 - protein, 295 aa, Methylobacterium sp.
MGDIFARSVSGALNFEYALDEALCNARLDASQLQMALLNVVINARDAMPDGGTVTIKTENLKINEEDQQLFEGLMPGEYIAVMVTDTGTGMPKEILKRVMDPFFTTKEEGKGTGLGLSMVYGYAKQSGGAARIYSEEGVGTTVKLLFPATDRPVNPMQQKQVSSSARGGTERILIVDDRADVAEMASMMLEAAGYRTVIAGDGHSALKLLTSDPDIDMMFTDIVMPGSLNGVSLSRMALVRKPKLKILLTTGFAETSSSGAIESDLEFPMISKPYTQTDLLKKVRIVLNGPDGVS

SEQ ID NO: 4547 - protein, 94 aa, Methylobacterium sp.
MTRVSLPALAGAAVVAGGFFAASIPAQARCVGIAACAQPPAGIAARPGFAANRPGIVNPGIARGNNLVGAGAGNLVGAGAGNLVGAGAGNFRPR

SEQ ID NO: 4548 - protein, 116 aa, Methylobacterium sp.
MFFLKVLQGAILIDVMIKMFLEKLQSRAIFLDYLPPGFDADAHIVGVVYDPVFSFRRSIQPILNRLVIFVGDDPEVPSDTFDSPEAIVFDNGSRIILDLRKFFRLDWHLRSLQLDH

SEQ ID NO: 4549 - protein, 110 aa, Methylobacterium sp.
MPLFAVSLLSECRVAGVVLPDPMHELAIHIVQAQDEAEARARGAELGAHRQHAYRNSDGEEVTWVFRRVVECQDLFERSFSDGMEVSSWLYRGERLCLNDGWSAPSAATG

SEQ ID NO: 4550 - protein, 67 aa, Methylobacterium sp.
MAIARSDGSALGCEEVELPGEAARAPLRLGRRSCGQHRQGRMRSSIQDRTNDLALLATMKGVQGMRS

SEQ ID NO: 4551 - protein, 52 aa, Methylobacterium sp.
MATTTLLAAQGQIILPAELGTTYSKAEPEMTSCLAVLAMMFIITMPILDLIL

SEQ ID NO: 4552 - protein, 152 aa, Methylobacterium sp.
MDIEDALDQLGRQIGIGLRLDGARACRLVFDGRTALDIEAPADRPGTVFLHSAVGLLPPTGRREAVYEMLLAGNLFGRDTGRATLGIDRDLGEILLVRQLDMAETPYAAFADAVEDCVARARAWTERLRQTHAETPAAAGDALALARFGLRI

SEQ ID NO: 4553 - protein, 508 aa, Methylobacterium sp.
MTHGISGLSPRASLDTTQAAAGTRGSFRGAAVEAAPAQPRAASALKTAWLEVRHFFASLVGMRVSTTKPETVADAASATRGVLHAMTKRDLDTLDVAEALVGMTEHGAFPQDLNRTGITEGAAGLFRPALQDLSDLQLMRLQANLCRKPDLLEGLSQLGTGFVMDADEPSVAAMAAGGQVNDLGFVMMSLHTCLRAELADRGLVPADLPGTPAALDPGLERFAQRAVANEGDLRAAIGEARVDLARARETAVLDALEQAGLYTREAEAPPEAPPAPPPAPPDNAAVNAPFGEARRAWIVETLNQAYLPQNQASERTGAVPVGPTGAFAVAQIFKRDMIGARDIAFAGERLPGTEGGTAALDANVAQFCQALGDRGATKGDILALSRVMNQATTGVVASQYMLDPDNAPGLRLADGDTVPIIADLKGGAWSITPSGTGYEIGYRAGQDLDGSAMATQGSRIFRFGEGSRLDVTLTFVLERGTEGELAVTGMRDSRIAIRAFDTEGRQLA

SEQ ID NO: 4554 - protein, 105 aa, Methylobacterium sp.
MMAQHVEVAMPLWEWSEDDVVARLIERRLPFPRHYTEIVDSLECLCCPAMISAERLAYLDAHHPEAAAFVRPLARRILDAARGAVASSDAALADAPQAEPEKDAA

SEQ ID NO: 4555 - protein, 188 aa, Methylobacterium sp.
VNAPLPAGRRILPRLAPETLALRERILSAPIMPAVEDAPWTLSPDPAEVLAIISDAEPDLHAAGYGRPQGWSAERQGRSWAEMETPAFLEEMDRAARFLSYLREHRRDRCPTRRSSAGWATIAEGIIAAPIGNGALVAAALALGFTVKPRASTAEAWLGLAETAFASLPGISPAARSSGGLAVVAASL

SEQ ID NO: 4556 - protein, 94 aa, Methylobacterium sp.
MALTSKEKQAAFRARRKAAVVEVVTLRAENAGLRDELATLKGENARLAGIVAAAKVSASAVSARPAPASVRVRLPAPPAETSPTRSPTSIRVRI

SEQ ID NO: 4557 - protein, 34 aa, Methylobacterium sp.
MPWDKLACEADKAKWKAACEVSKAPCTKLEEILK

SEQ ID NO: 4558 - protein, 88 aa, Methylobacterium sp.
LDVGSMENPLIRQCHELTAKVAGGWTDGQHAAGELMGRAREMAASLPASGKRDFFADLAKQAEAASRSLVDTEVFELFGQMLRVEAER

SEQ ID NO: 4559 - protein, 29 aa, Methylobacterium sp.
MEPASLSAILIAVGFALVAIGRLIAVFGM

SEQ ID NO: 4560 - protein, 72 aa, Methylobacterium sp.
MAVIEASTLTTEALEGYDRMMLEATLRVRNFASLAFAVWSEVLRELDKRGRVTLVSGSYDDVGNALITRNYE

SEQ ID NO: 4561 - protein, 66 aa, Methylobacterium sp.
MTHARFPDFSTPAPVARRVQAIALPAPLAHPALILAARAARLTGELLTACALIGGGCALVGFASLL

SEQ ID NO: 4562 - protein, 163 aa, Methylobacterium sp.
VEPLDFVREYVEPAITLWAERPNSPVLAVCAIAQIDILAEVVAIAQAGGTLSRGETGPFRTELGHREPAIARIRDAHDSHKHGRLRRSSGSGSSITQGQRPWRSTGSAWFLGRSRVGSVLGRKSTAILLDDGTPIDIAVLIREAMAAWDRELRRLRYRPSEEG

SEQ ID NO: 4563 - protein, 95 aa, Methylobacterium sp.
VLYGGQGDDTLNGGVGDDTLVGGLGADVYVFGATSGRDLILGFDRGAGDRIALGGQTDTVSSAQNGDAVLLLSGGGVVDLAGIRADQVDASFLAA

SEQ ID NO: 4564 - protein, 33 aa, Methylobacterium sp.
GLDAAAIVAKVNEVLPERKARTSNVVSVGRRQR

SEQ ID NO: 4565 - protein, 68 aa, Methylobacterium sp.
MPAGAVRVSIGLACAAPGTAADAVYRRADGALYDAKASGRNRTCCAPAPEPSEPPAARGGAGLRLAEA

SEQ ID NO: 4566 - protein, 70 aa, Methylobacterium sp.
MDRLNFQAWRILDFVFDHKTIERFLVEFSIVPIKNFDFANRVSVFRVINALGLAYFWMISLGMLVHGDET

SEQ ID NO: 4567 - protein, 60 aa, Methylobacterium sp.
VNRTLQEMRSAGLIVLKSKALTIPDLTALQKVALFNANYLHLEHEGAHLDANEPGERANG

SEQ ID NO: 4568 - protein, 31 aa, Methylobacterium sp.
VTAKAVVQFRPGKAMRERLNPALRQLPLAAE

SEQ ID NO: 4569 - protein, 67 aa, Methylobacterium sp.
MITRRYREPRGLHSDQAEYGFYVRLSGADRELMKRALEVATERLGGRPSNPMLLVEMMKVFTDGAEA

SEQ ID NO: 4570 - protein, 77 aa, Methylobacterium sp.
LLLSMIECRTLTFKSFFRSPEDQLVVLKHTVTSAKGRKIRVDWMDFESTTETQSIIDRLAKLNAFLKDADISFIVVT

SEQ ID NO: 4571 - protein, 79 aa, Methylobacterium sp.
MKMVARGAPADGNRGLLHQLRNDKKFAHEIGALVQDGRKHFGEAYPGQTRTSHFSNDEWAKAGYEDVAEIGHLMGLKGL

SEQ ID NO: 4572 - protein, 113 aa, Methylobacterium sp.
MMAQTLDAIPPLRNGRRGRPRRRPDKLHADKAYDARARRQECRVRGIVPRIARKGIESSERLGRHRWVVERTHAWFNRFRRRPIRYERRADIYDAFTSLAASLITLNQIRRFC

SEQ ID NO: 4573 - protein, 115 aa, Methylobacterium sp.
LADLGIAMKAAWDVADDVRTGRLVRILPDWWGGTDRWVRIVYPARLHQPRRVRAFIAFMEDEMTTSLAESADLGLFEAAALAKLQPRIDAVRRRPEPKLAEPRLAEPGLAEAKPA

SEQ ID NO: 4574 - protein, 36 aa, Methylobacterium sp.
LTGQVRNIADVTTAVANGDLSKKITVDVKGEILELK

SEQ ID NO: 4575 - protein, 35 aa, Methylobacterium sp.
LDLVEGGAGDDTQYGGDGDDVLGGQGGNDLLDGQS

SEQ ID NO: 4576 - protein, 33 aa, Methylobacterium sp.
MPFATRPAHLMRAAAIVAIAGLAGPAFAQPKKP

SEQ ID NO: 4577 - protein, 93 aa, Methylobacterium sp.
TNGTELWVTDGTDAGTTLLKDIDAGSDSSFPDGFTTLGNGKILFQATTTTNGAELWVTDGTAAGTTLLKDIEVGSASSSPRGFTALGDGKILF

SEQ ID NO: 4578 - protein, 60 aa, Methylobacterium sp.
MAAAVDPADEAGLRVGVEFETQSRDGARGEVRAERRRPPPSAGEGTLCSRGGRDEVPQEG

SEQ ID NO: 4579 - protein, 199 aa, Methylobacterium sp.
MNQEAIEPYYNELEREMLDAFYAHIRSHPMKTYLHWNMRDKNYGFHAIEHRYRVLGGEPFSIEDDKKLDLSRLFIDMYGVGYIGHPRLEKLLEENHIEARDFLNGAGEAQAFVDGKYVDLHRSTLRKVDVLANLATRSHDDKLKTLSSWTQSRGLSPKTIVSLAKEHWLVTGVIVLGGLISASLAAWRLIISVSSGTPH

SEQ ID NO: 4580 - protein, 402 aa, Methylobacterium sp.
VSLDKIVALNQSGSVQAETLSMEIYSQTRTILIVVGLLAVGLAAMLGVAIVRTISRDIASVVEPMNALAAGDASVTIPHQGAQTEIGVIAASVQVFKDNLIRTRELEAETALARASAEEQRKAGMRQMADGFEQAVGGIVGMVSSAASELQATAQGMSATAGQTASQSTSVAAAAAQAAANVNTVAAAAEELGSSVAEIGRQVSGSADLAQAAVAEANATAGLVQDLAQAASRIGDVVALISQIAGQTNLLALNATIEAARAGEAGRGFAVVAAEVKELASQTARATEEISTQIGRIQGSTDQAVGAIGGIGARIREIAGVAASIAAAVEEQGAATQEIVRNVAEASTGTGEVTRNIAGVAGAAEETGASAAQVLGAASELSRQSEHLSGEVSRFLATIRAA

SEQ ID NO: 4581 - protein, 180 aa, Methylobacterium sp.
MLSPVPVAGIDAGKHFLDLGFQPAAKGLRCENSPAGIQSVIEALRQRGVVRVALEAIGPYAQPLVTALVAAGFSVALVDPRRIKAFRTAEGLIAKTDRLDAGLIARFAARMSEHLRPAPEPEPIALKALSTRRRQLTALVILTHPSRHAPALLVVAEVDVSHRPAGGVLDREGLAELADV

SEQ ID NO: 4582 - protein, 67 aa, Methylobacterium sp.
MSELRYQQSGTWADGTPRLDVEAVEHPAEATPADARSGVSPERQRERVAAAVATTIRRFVSGGLRDA

SEQ ID NO: 4583 - protein, 33 aa, Methylobacterium sp.
MTVAQVLMSTDMARLNGCLAAGTAPQATVGGTA

SEQ ID NO: 4584 - protein, 31 aa, Methylobacterium sp.
MKLARMKIHAFVLTVPLAVMHGGEISCEIDE

SEQ ID NO: 4585 - protein, 64 aa, Methylobacterium sp.
MIPVSMGQDHVIYVLGVVAVANMFDETWCRIGITAVNNMNSVAVGIVAVTQCDGVSTTRFGTYG

SEQ ID NO: 4586 - protein, 98 aa, Methylobacterium sp.
LSSDAHVINRAASVGASDRFVRWLGRIATVTGVLMFVSYLDQIQLNLAGQKGSVIQPLATVVNCGLWTTYGALRRDWPVSFANAPGIVLGAVALITAL

SEQ ID NO: 4587 - protein, 64 aa, Methylobacterium sp.
TLKRHLTTHGLDPRAYRQRYGLPDDYPMVAPAYAAQRSALAKQIGLGRPGALAEREAGGRRKAA

SEQ ID NO: 4588 - protein, 346 aa, Methylobacterium sp.
MLSPVPVAGIDAGKHFLDLGFQPAAKGLRCENSPAGIQSVIEALRQRGVVRVALEAIGPYAQPLVTALVAAGFSVALVDPRRIKAFRTAEGLIAKTDRLDAGLIARFAARMSEHLRPAPEPEPIALKALSTRRRQLTALVAMEKTRLKQALDPLVADSHRAVIATLEAACAAVETALERRIAADPALARKRAILTSIPGIGARIAGVLITDMPELGRIDRKAAASLAGLAPHPSQSGAGPGRHAIAGGRPCLRAAFYMAGLVAARACPAFRGPYKAMREAGKPAKVAIVATGRRLVVLANPLIREDKTFPESTSALDPQYSRRLIDSAVGGGEPRRAPSPIGRGLG

SEQ ID NO: 4589 - protein, 343 aa, Methylobacterium sp.
LVGVLQRMAKGEIEAEITEAARGDEIGAVGRAVEGIKAMVARKAAEEAEVRRRSDAAAAAERKRTMVELADGFEAAVGGIVGLVSSSSTELQATAQQMTMTATETASQSTTVAAAAEQASSNVNTVASAAEELGASVREIGRQVSGSSDLAQVAVDEADRTAAQVHELSRAVTKVGDVVQLISTIAAQTNLLALNATIEAARAGEAGRGFAVVAAEVKELANQTGRATDEIASQIGHIQGATGQAVEAIGSITGRIQQISTVATTIAAAVEQQGAATQEIVRNVTQASAGTREVTSNIAGVAQASEETGAAASQVLASASELSRQSEHLSAEVQRFLATVRAA

SEQ ID NO: 4590 - protein, 32 aa, Methylobacterium sp.
AGATGWLVKPVQADKLLQVIRQVAPAVQPQAA

SEQ ID NO: 4591 - protein, 159 aa, Methylobacterium sp.
RGRLALAGNGATGGEGAALRALAAEAGIAGSVTVGGPVFGPEKDRTLRSWDFFVQSSRFDGLPIGAVEAALAGLPLIVSTATGLAEAVERHGAGFVVRDLSPGAVADALGQAARLTPEAWVRMSRAAHAMALVTGDWARSAEALQHLYAAGSDDLRLAG

SEQ ID NO: 4592 - protein, 41 aa, Methylobacterium sp.
RSRRPASEVIEAQAFEPLQHRSHAAPEPPHDAVDGRAYTLW

SEQ ID NO: 4593 - protein, 51 aa, Methylobacterium sp.
NGTELWVTDGTAAGTSLLKDINAGSSSSTPTGFTALGDGKILFSASTAANG

SEQ ID NO: 4594 - protein, 98 aa, Methylobacterium sp.
MRIEFADDDLARICTDQAYKMGLPVAVIKAARNRLVQMEAAKDERDLRNLKSLNYKKRNRQDEGIRSVCINDQYRILFTLSEDERPPVLRVIAIGDTH

SEQ ID NO: 4595 - DNA, 1089 bp, Methylobacterium sp.
gtgagccctgacgccccctccaagacggccccgacgccggcccgccctgaccggggcggccggtcggacacggccgcctcggtcctgcccggcatcggcctgtgcgcagtgatcaccgcggtggcgatggcggcgcaggcgttggaggagcgggtcgccggccatccctacatcgaggccctggtcctggcgatcctgatcggcatcgcggtgcggaccgcctggacgcccccggcgcagttccgcactggcatcgccttctcggccaagcagctcctcgaggtcgccgtggtgctgctcggcgcctccctgagcctcggggcgatcctcgcctccggcccggcgctgctggccggcatcgtcgggaccgtggtgctcggcatcgccgccagcgtggcgatctgccgggcgctcgggctgccggcccggatggcgatcctggtggcctgcggcaacgccatctgcggcaactcggccatcgcggcggtcgcgcccgtaatcggcgcggaggcgaaggacatcgccgccgccatcgcgttcaccgccgtcctcggcgtgctgatggtgctcgggctgccgctgttcgtgcccctcgcgggcatgaccgacaaccagtacggggtgctggcggggctcaccgtctacgcggtgccgcaggtcctggccgcgaccgtgccggtgagcctgctgtcgacccaggtcggcaccctggtcaagctcgtgcgcgtgctgatgctcggcccggtcgtggtggtgttctcgctgatcgccccgcgtctgccgcaggcggcgggggcgccgccggcgccgtcccgtccgggcttcaccaagctggtgccctggttcatcctcggcttcctggccctggccaccctgcgctccctgggcctcgtcccggacccggcggtgaagccgctgacccagctcgccggcgtgctcacggtcctgtccatggccgccctcggactcggggtcgacgtccgggtcctggcccgggtcggcggccgggtcaccctcgcggtcaccgcctccctggcggtcctgatcgccctcagcctgacgctgatccgcgccctcgggatcgggtga

SEQ ID NO: 4596 - DNA, 1410 bp, Methylobacterium sp.
gtggccggggcgatgtggaccctccccgcctggatcctgcgccgggagaccctgctcctggccggggccgccctcctgggtgcgggcggggtcgcggcgtggtacctgctccaggcgacggtgctcaccatcgcggtcgccccccgggacgggaccgagcccggcctgatcaaggcctacgcggacgcgctcgaggccgcccacgagaatgtccggctgaagatcctgtccttcgacgacgtgcgcgagagcgccgccgccctgcaggacgggcgcgccgacctcgcggtggtccgccccgacgtgcttctgccgacgaacggcctgaccctggcgatcctgcgcgaccaggcgatggtcatcgcctcgcccgagcaggccgggatcacgagcttcccgaagctcgccggcaagcggctcggcatcgcggcgcaccgggacgccgatctctggctgctccggaatctcctcggctattacgggctcactctggaggaggccgccggtccggtccgggactcgacggtcctgctggtcccggtcgaccaggaggcggtggccggcgcgttccgcgagaagcggatcgacgccttcgtcagcatcatcgcgccctcggcgccgaaggcgctggccctggtctcggccgtgcagggcgtcgcccgcggcggcaaggtggcgttcgtcgccgtggaggatgacggcgccgtgatcgagcgcttcccgcggctccaggcggtcaccgtcccgggcggcctgttcggcggccgcccgaagctgccggccgacgacgtgaagacggtgggcgcctcgtaccggctgatggcccgggcctccctgagccgggtcgtggcggccgacgtgacccagcagctcttcgagaagcgcagcgccgccgccctggcgacggacgccgccgagtacgtccaggccccggcctacgacacgaccgtggcggccaccagcgcccgcatcccgatccatccgggggcgatcgactattacgagcgcgaccagcacggcttcatcgagcgctacggcgacacgctctacctcctcggcgcgctggtgggcggcctcgtctcggtgctggcctggatccggcagcgcctcgccagcctgcgccgcgagcgcatcgacgagctcctggaccggctcctggagatcgccgggcaggcccgggcgctgcgcgacccggcggcgatcgaggcgctcaccgtcgaggtcgacgcgctggccatggacgtcgtccgctacgcccgcgagcgggagccggacacccgcaccatgtcggcggcgtccgtcgcgatcgacacggcccgggcaaccatcgcggattgccgggcacgggcggccgaggacggggcgcgggccgggcggcccgtccggctgcacggcgcggccggggcctga

SEQ ID NO: 4597 - DNA, 1416 bp, Methylobacterium sp.
atgcggcgcttcgccagcctcttcttgcgtcaggaattcgtcttcctgatgctggccatcctgctgagcgtcggcgcgggcgtggcctactgggcgtcgcgggccaccgtcctgacgatcgcggtcgccccgaaggacggaaccgagccggccctgatccaggcctacgcggacgccctggccaagcgccacaaggagatccgcctcaagatcctacccttcgacgacgtgcgcgacagcgccgaggcgctgggcgacggtcgcgccgatctggcgatcgtgcggccggatgtggagcttccggataacggcctgacgctcgcgatcctgcgcgaccaggcgatgatcatcgcctcgccggaatccgccgggatcgcccgcttccccgatctcgaccgcaagcgcctggcgatcctggcccacagggacgccgacgaggcgctcatccgcgccatgctggagcattacgggttgacgctggtgaccaccgagccggcaggggcgctgccgccgcgccacgtcgccctggtcgagatggccgagagcgacctgggtgcggccttcgcccgcaagcgggtcgacgcggtgatctcggtcatcgcgccgaccgcgccgaccgcgcagcggatcgtcggcctcgtccaggcggccagccgcgatcgcaagatctccttcgtggatgtcgagaacgccgaggcgatcgtcgcccggctgccgcggctgcaggtcgtcaccatgccggccgagaccttcggcggcagccccaaggtccccgacgaggaggttcacacggtcggcgcctcgtaccgcctgatggcgcgcgcgaacctcgcccggtcggtggcggccgacgtcacccagcacctgttcgagctgcgcagcgccatggccaacgtcacgcccgcggccgactattttcaggcgcccgcctacgacgggaccgtcggcgcgacgagcgcccggctgccgatccatcccggcgccgtcgactattacgagcgcgagcagcagagcttcatcgagcgctacgagacctggatctacctgctcgccttcctcggcggcggtatcggctccgcgctcgcctggatcggccagcgcctgtcgcgcctgcgccgggagcgcgtcgaggaagcgacggaccgccttctgaggatccgccaggaggcgcaggagacgaccgaaccggcgcgtctcgagagcctcgcccgggagatcgacgacctcgcgggcgacatcgccaagcacgccctcgagcgaccgacagaggcgcggaccatgtcggccgcggccatcgccatcgacgccgcccgctcgacggtcaagcgcgccatcacgaccggccggagcgcggaggacgggtccgcgttggctggccggacggtcgcgagcgacgcgggcccgagcggggcctga

SEQ ID NO: 4598 - DNA, 1071 bp, Methylobacterium sp.
atggctcagacggtatgcgttcttctcgatgcgagcgacgcggcacggctggttgcgatcgccagcgaccgctctcgcccgctcaaacatatccagcgcgcccgcatcgtcttgctctcggccgagcgcctgagtgtccaggacgtcgcccagcgggcgggcgtcagccgcccggccgtgtggcgctggcagcggcgctacgccgaggcgggtgtcgaaggtctgctgcgcgacaagacgcgtccgcctggcacgccgccccattcgaccgagacggtggccgaggtgctggcgctgacctgctcggagccgcccggcgaggtcacccactggaccggccgtgccgtggcacgcgctatcgggatctcgttgcgggccgtgcagcggatctgggacgctcaccgccttcagccacatcggctgcgcacgttcaagcgctcgcgcgatcctgccttcgccgccaaggtcgaggacgtggtcggcctctacatggccccacctgcccacgcggtggtgctgtccatcgacgagaagagccagatccaggcgctggagcgcacccgccccgaccgtccgctcgcccccggccatcccgccgctcagacccacgattatacccgtcacggcaccacgacgctgtttgcggccctcgacgtcctggcgggcaccgtgctcggccgctgcatgcagcgtcaccggaacggtgagttcatccggttcctgaacgccgtcgaggccaccgtcccacccggcaaggcgatccacgcgatcctcgacaacgtcgccacccacaaacatccaaaggtgcgcgcttggctcgcccggcatccgcgctggacgttccacttcaccccgacctcggcctcgtggctcaacgcggtcgagggcttcttctcagcgctcacccgtcgtcggctgcggcgaggctccttcaccggcgtcgtcgacctccaggcggcgatcaaacgctacatcgccgagcacaaccggagcgccagacccttcgtctggaccaagcccgccaccgatatcctcgccgccgtcagccgatcccctgaaccatccgtctga

SEQ ID NO: 4599 - DNA, 489 bp, Methylobacterium sp.
atgaggttccgccacatcgacgcggcgaagaaggacttcccggtcgcgcgcctgtgcaaggtcctcgacgtcagtccgagcggctatttcgcctggaaaaaccgcccggcctcgacgcggcagcgcgaggatctcgtgctgcttgcccacgtccgatccgccttcacgctctcgcacgagacgtacggcagcccacgcatgacccacgagctgcgcgagcagggcctggcggcaggccggcggcgcgtggcccggctgatgcgggagaacgggctcaaagcccgccagccgcgccgcttccggcgcacgacggacagcggccacgccttcccgatcgcgcccaaccacctcgaccaggacttcacggcggccggaccggatcggaagtgggaaacgacatctcctacatctggacgcgggagggctggttgtacctggcgagtaattacccaggcctgtgatggctgggttcaggcaccgatggttttg

SEQ ID NO: 4600 - DNA, 861 bp, Methylobacterium sp.
gtgaccttcgccttcatcgagcagcatgcgcggacctggccggtgcgtctcatgtgccgcgtgctcggagtctcacccagcggcttctacggctggcggtcacggcctgagagcgcccgctcggcctccaaccgccaactcctggacgacgtccggcgcatccatgccgcccatcaccggcgctacggctccccgcgcgtgcatgccgccctgcgggccgagggtcggtctgtcagccgcggacgagtggagcgcctcatgcgccggcacggcatccgtgctttggcggggcgtcggttccggccctgtacgaccgacagccggcacgatcttccgatcgctccaaacctcctgaagcaggacttctcggccgcgcggccaaacacggtctggctagccgatatcacctacctgccgaccggcgagggctggctgtatctggccgccgtcctcgatctggccacgcgcaagatcgtcggctggtcgatgcgcgatcacatgcgcaccgagttgagcgtggcggcgttgatgatggccgcccagcggcagcgaccaactgccgggctgatctgccactcggatcgcggcagccagtacgcggccgaggcttaccggagacagctcgccggtatgggggcgaagccgtcgatgagccgcacggcttgctgctacgataacgccccgatggaaagcttcttccacaccctcaaagtcgagctcgtccatcagcggcgatgggcgacccgggatgaagcgcggcgcgatctgttcgcttacatcgagggctactacaatcggcaacgcatccactcggcactcggctacctcacgcccgagcaagccgagaggaccgcgaaatga

SEQ ID NO: 4601 - DNA, 981 bp, Methylobacterium sp.
atgaggtacccggcctctgagaagctggagatcatccggctggtcgagcaatcccatctgccggtgcgcgccaccctggacaagctcggctacacccgggcgacgttctaccgatggtacgacgctttccagcgtggcggcctcgaggcattggcggatcgcccgtcccgacccagccgggtctggaaccggttgcccgccgaggttcgcgatcagatcgtcgctcttgcactggaggagccagagctcagcccacgcgagttggcggtgcgcttcaccgacgagcggcgctacttcgtctcggaggcgaccgtctaccgcctgctcaaggcccaggacctgatcaccagcccggcctacatcgtgatcaaagccgccaacgagttccgggacaagaccaccgcacccaaccaactctggcagacggacttcacctatctgaaggtgatcggctggggttggtactacctctcaaccgtgctggatgacttctcgcgcttcatcgtggcgtggaagctgtgcgcgacgatgcaggtcggcgacgtcaccgccacgctcgaccgcgcgctggcggcggccgggctcgatcatgtgcaggtggcgcatcggccgcggctgctctccgacaatggatcaagctacgtcgcgggtgatctggccgactggctcggcagccggggcatgacccatatccgcggcgcgccccgccatcctcaaacgcagggcaagatcgagcgctggcaccagacgctcaagaaccgcatcctgctcgaacacgcctacctgcccggcgaactggaggcgcgggttgccgccttcgtcgagcattacaaccaggctcgggctcacgagagcctgggcaacctcactcccgccgacgtctacttcggccgcggcgaggccatcctgcaggagcgggcgcggatcaagcgccagaccctcatcgatcgccgcttgcgccaccacgcgcaggctgcctaa

SEQ ID NO: 4602 - DNA, 438 bp, Methylobacterium sp.
atgaggtacccggcctccgagaagctggagatcatccggctggtcgagcagtcccacctgccggtgcgcgccaccctggacaagctcgacatcacccgctcgacgttctaccgctggtacgacgcctacagccgcggcggcccagaagctctggccgaccgcccctcgcggcccagccgggtgtggaaccgtctgccgaccgaggtccgcgatcagatcgtcgctctcgcgctggaggagccggaactcagcccgcgcgagctggcggtgcgcttcaccgacgagcggcgctacttcgtctccgaggcgaccgtctaccgcctgctcaaagctcaaggcctgatcaccagcccggcctacatcgtcgtcaaggccgccgacgagttccgcgacaagaccaccgcgccaagccagctttggcagacggacctcacctaa

SEQ ID NO: 4603 - DNA, 699 bp, Methylobacterium sp.
ttgcgggaggtgttcaacgggctgcgctacgtcgttaggagcggctgcccgtggcggctgatgccgcatgatctgccgccttggtttgtcgtgtatcagcaggcccagcgctggctatcagctggctgcttcgagcaactggccgaggatctgcgcgcggtgctgcgcctagctgcgggtcgtgcgccggagccgacggcggctgtgctcgacagccggactttgcgctcctcgccggagagcggcgagcgggccggctacgatggggccaagcgcaagaagggctcgaagctgcacatggcggtggacactctcggccatctcctggcgctgcacgtcacgcccgccgatgccgataatcgagcccaggtgggccggctcgccaaggccgtgcaggccgcgaccggtgagagcgtcgaggttgccttcgtggatcagggctataccggtgagaagccggccacggcagcccgcgagcatggcatcgctttggaggtggtgaagctgcccgaggctaagcgcggcttcgtgctgctcccgcgccgttgggtcgtggagcgctcgttcgcctgggccacccgcttccgcaggctcgtcaaagattacgagcgctatgccagcaccctggcagacctgcacctcgtcgctttcgtctgcctcatgctcagacaggccgctcaactcgccacagattcataa

SEQ ID NO: 4604 - DNA, 408 bp, Methylobacterium sp.
atgcagtcccgccacgcctatccgtctgatgtcagcgatgaagagtgggcgctggtcgccccctacctgaccttgcttcccgaaacggccgctcagcgcgagcacagtctgcgggaggtgttcaacgggctgcgctatgtggtgcgatacggcgtggcttggcgtgcgatgccccacgatctgccgccctggcacgcagtgtacgatcaagcccaacgctggctgaaggcgggctgcttcgagaccttggtccacgacctgcgcgccgtcctacgcgtggcttcgggccggaccgaggaaccttcggccgtggttctcgacagccggacgctgcgctcgacgcccgagagtggggcccgcgccgcttgggtaattacccacgcccttgcgcgggacggatttcgctga

SEQ ID NO: 4605 - DNA, 1203 bp, Methylobacterium sp.
gtgcgcctcgtgcgtgcggcgcctctgccgacgcagcccgagccgcgcatcgtcggcatcgacgagtgggcctggcggcgcgggcgcagctacggcaccatgctcgtcgacctcgaacgtcacaccgtcctcgatctcctgcccgaccgggacgccgggagcgtcgccgcgtggctgcgcgcccatccgggcatcgaggtcatcgctcgcgaccgcgccgacgtcttcgtcgagggcgcccgcgcgggcgcaccgcaagcccagcatgtcctcgatcgttttcacctgctgcgtaacctcagcgtcgccctacgtgcgatcgtcgcccatcatcatggcgtgatccgcgccgtcggtcgtgcgcgcgtcgaccacgatgtcgacgcagcacaggccgcgacggaagccgcgcgggcgccgacggcaatcgaggttcggaagcgggcgacgcacgcgctgcgtcgggctcggtactccgagctcaaaaggctgtccgaggccggcgcctcggtggccggcatggctcgggctctggatcttgatcgcaagacggtgcgggtctggctgagccaggacgcgccgccctcctggcggcgacgccgcaccgtgccgacgatcctcgacccctaccgcgatcatctcgaggcgcgctggcaggccggctgccgcaacgccaccgagctcgcccgcggactgatccgcacgggcgccgacatccgtccgcgggtggtgcgggattgggcgatgaagcggcgtcgcgcgagcacggacgtgatggacgccacgcccggctcgacgagcgtgacgcgatggcgccccccgtcgatcaaccggacggcgtggcttctgcaggcggacccgagcgcactcgttgcggacgaccgccgcttcctcgatcgcctgcgggtggaggcccccgatctggcgaggagcgtggccgtcgcgacgcgctttgccgacctcgtgcgacggcgctcgggcgagagcctggaggcttggttcgcggcggcggccgcgacgccgctggcgaagttcgccgccggtctcgagcgcgacagggacgcgttacgcggtgcgatcacgacgccgtggtcgacgagtccggtggagggtcaaatcggcaggctgaaaatgctcaagcgcaccatgttcggccgcgcgggcttcgcgctgctgcgccagcgcgccctcaccgcgacctga

SEQ ID NO: 4606 - DNA, 1140 bp, Methylobacterium sp.
gtgatcgccgcactcggcgtcgttgagatcctggcctggggctcgtcgttctaccttccggcggtgatggctgcccccatcgcggagagtaccggctggccgctcgcctgggtggtcggcggactggccttcggcctcctcgtcgcggccctcgcctcgccgcatgtcggggcggcgatccaccggagcggcgggcggccggtcctggccctcgcggcgctgcttctcgccgccgggctgaccgtggtggccgtggcgccgaacctgccgatctatctcgccggctggctgatcctcggcgccggcatgggctgcggcctgtacgaccccgccttcgcgaccctcggtcggctctacggcgcggccgcgcggccggcaatcaccacgctgaccctctggggcgggttcgccagcaccgtgtgctggccgctgtcggccttcctggtggcccatgttggctggcggggcgcctgcctcacctatgccggcctgcacctcgcggtgacgctgccgctgatcctcgcgatgatcccgcacgcgccggcacttccggtctccgacgggccacaggaggcagggtccgcgtcgctgtcgacccgggagcgccgcgcgttcctgctgttcgcgggggtgctggtcctcggcggcgcgatcatgtcccaggtctcggtccacctgctcaccctgctgcaggcgcgcggcgtgtcgctcgccgccgccgtctcgtacggggcactgatcgggcccgcgcaggtgagcgcccgcgtcgccgagatctcgctgaagggccggcaccacccgctctggacgctgacggccgccttcggcctgatcgccctcgggctgtggctcctcgcggccgggctgccgggcgtggcgctctggctggtgctctacgcgggcggcaacgggatctactcgatcgcccgcgggacggtgccgctcgccctgttcggccccgtgcgctacccgctcgtggtcggccgcctcgcccggccggcgctggccgcccaggccctggcaccgccggcgggcgccgtggtgctcacgcatgcgggaccgggcgccctgtggtggctgctcctcgccctggcgctcgccgccctgggcctgatcggagcgctgtggcgcgcgcggtga

SEQ ID NO: 4607 - DNA, 441 bp, Methylobacterium sp.
ctcattggtccggcgcaggtcgcggcgcgggtgatcgagatgtcgaacaagggtcggcaccacccgctgtggaccctgaccgccgcattcggcttggtcgccctcgggctgagcctgatggccctgggcgtgccgggcctgggggtctggctcgtcctctacggtggcgggaacggcatctactcgatcgcgcggggcacggtgccgttggccctgttcggcccggaccgttacgccgggctgatgggccgcctcgcccggccgggtttgatcgcccaggcgctggccccgccgctcggcgccagcgtggtgacgcatggtggggcggatgcgctgttcgtggtgctcaccgtcctcgctgctgggaacctcagcgtgatcgcggcgctgtggactgtcttgcggaaagatcttcggcgtcaaaaacaggtccttttgtag

SEQ ID NO: 4608 - DNA, 987 bp, Methylobacterium sp.
atggccggaaccgcacttatcacggccgaaaaccgcgcagtcggcgaccgggcgccagacgccctcgaccaggccgcgctcgcgctggcccgggcctcgaaatcgcccgccacgctgcgggcatacaagttcgatttcgccgacttctcaggttggctccaggatcagaagctcgaacacccggcggacgcccgggatgtcgcgcgctacctggccgctcaggtccaggccggtttgcgggcctcgacgatcgagcgccggtgcgccgcgatcggcttccactaccgggcgatggggcaggacaatccgtgctcgcgtgaggtggtccgggcggtgctcgccggcatgaagcggacgatcggcgtcaagccggacaagaagaaggccctcacggtcgacctcctgaaaaaggtcgtccagaaaatccgcggcgacgacgtcaaggcgctgcgcgacaaggccatgatcctgatctgcttcggcgcagcgctgcggcgctccgagttggtcgggctcgacgtcgacgacatcacgttcaagcggcgcggcctgatgctgcagctcgggcgcacgaagacggaccagtccggcaagggcaagcagctcgcgatcccggacggcaagctgaagatccccgcggcggtgcgggcctacatgacggcggctggcctcgtcgacgacgaccgggtcatcgcggagggcccgctgttccgcgcgatcctcaagggcgaccgggtgacggacaggcggatcgacaccgagtcgttcgtccggatgctcaaggcccggtgcgaggcggccggcctcgacccgaagaagttctccggtcactcgccgcggcgcgggttcgccaccaccgccggcgacgagggcgccgacctccggcgcaccgccgacgcgatgcgccacaagaagctcgagaccacgctgggctacatggaggagggcaaccttctcgacgaagcggtgggcaagctgttcctttaa

SEQ ID NO: 4609 - DNA, 825 bp, Methylobacterium sp.
gtgctggcgtatttgatcgaccacgctgccacgttgaaagttgtcacgttacaacgtcgacttgccgcgatccgcgagcagcacgccgctgcggggttcgatctggaaacctcctcctcggcgttccgggacacatggcgaggcatcaagcgggcacacggccagccggcggtgaagaagcgccctttgatgacggtggatctccgacgtgccgtcgcgaccctaccggacaccctacccggccgacgggatcgagcgctgatcctcgtcggcttcgcggccgcgctacgccgatccgagctagtcggcctggaggtcgctcgcagagatggtgcggcttgggtcgaggagcggcccgacggtctggttgtccatctcgctcgtagcaagaccgatcaatcgggggagggcgccgagataggcgtgccctatggctcgaacatggagacgtgcccggtgcgcagctatcgcgcgtggcttaatgcagcccacctgaccgagggaccggcctttcgaccgatcgacaggcatgggcatatcggcactgaagcggtgaccgatcgcgctgtcgcgcggatcgtacagcgcaccgtcgaggccgcggcacttgcggatgggtactcgccggaggaggcgcggcagctcgcggctgcctatgccgggcactcgctgcgctcggggctcgccacctcagccgcggcgaacgacgcgcccggtcacgcgatccagcgacagctccggcacaagcgcttcgacacgacgagcggctacatccggtccgggcagctgttcaagcagaacccggccgggatggcaggcctgtga

SEQ ID NO: 4610 - DNA, 936 bp, Methylobacterium sp.
atgacgctgcccgccacgcttgccgcccgcgcccgcgccttcgccgacgaggcgctctcggagaattcccgtcgggcctaccgcgccgactggcagcactacgcgcgctggtgcagcggccacgatctcgcgcccctgcccgcgggccccgagcaggtggcgagttacctcacctccatggccgagacccacaagcgcgcgacgatcgagcgtcggctcgtcacgatcggtcaggcgcacaagctccagggattgcagtggatcccggcgcatccggccgtccgggcggcgctgcgcgggatgttccggcgctacggcaggccgaagacgcaggccgccgcgctcggcgtgcccgaaacgctccggatcgtcgccgcctgcgacgggacggtggccgcgctccgggaccgcgccctgttcctgttgagcttcgccggcgcgttccggcgctccgaggtcgcgcggatccgccacgaggatctcgcgttccgggacggcgccgtcgatgtcttcctgccgcattcgaaaggtgatcaggacggcgagggcacgatcgtgaccgtcctggcgggcgggagccccgcgacctgtccggtcgccgcgctccggcgctggctgcaggcggctccggccgacggctacgtcttccgggccgtccgggcggacggcaccgtgatggacgacgggctgcatccggactcggtgggccgcatcgttcagaagcgcgcggcggaagccggcctcgtcgccggaccccgcgagcgcatctccgcccacgggttccgcgcgggcttcatcaccgaggcgtacaggcgcggatcgcgcgacgaggagatcatggcgcattcccgccaccgggatctcaagacgatgcggggctacgtccgccgggccaagctcgccgacgcgcatccgggccgcgacctcggcctctag

SEQ ID NO: 4611 - DNA, 768 bp, Methylobacterium sp.
atgccgaacgggtacaacgccccgatggagatgctggcgcgcaagctcgacagcatcgcgcgcctgtccgattccgaccgcgcggcgctcctcgatctgccgcacacggtccggaacctgccggcccgccacgacatcgtccggttcggcgaccggccgacccacagctgcctcgtcctgcagggatgggtctaccgctacgccgccctcgccgagggcgggcggcagatcctgtcgttctacatcgcgggcgacgtgccggatctgcagagccttcacctgcaccggatggatcacaacctcgccaccctgacgtcctgcgtcgtggcgctgatcgcgcacgacgacctgcgcgcggtcctcctgcgcaatccggggctcgccggcaccctctggcgcgacagcctcatcgacgccgcccattaccgcgagcggatcaccagcctcgggcggcggcaggcgctcgggcgggtggcccacctgttctgcgagctctacctccggcagaaggcggtcgggctcgcgcgcggaatgagctgcccgctggtgccgaagcagtccgaactcgccgacgcgctcggcctgaccagcgtccacctgaaccgggtcctgcgcaccctgcgcggacgcgggctcgtgacgctgagcggcggcatcctgaccatcgaggactgggacgcgctgacggaggtcgcggaattcgaccagacgttcctgcacctggcgaacaacccggcgccggcccgagagatcgccgaggcggtctag

SEQ ID NO: 4612 - DNA, 753 bp, Methylobacterium sp.
atgtacgagacaccccaaccgtcgggcagagagcccttcctgcgccggatcgagaccgtggccctgttccggctcacggacgcggagcgcgccgcgctcgtcgcgctcccgctccaggtcgcccagttcgaagccaaccaggacatcatccgggagggtgaccggccgtcccgaagcttcacgctgctcagcgggatcgcctgcacgtacaagtcgacccgcgcgggcaagcggcaggtgatgagctatcacgtcccgggagacgtgccggatttccagagcctgttcctggaggtgctcgacatcaacatcgcgacggtgagcgcctgccgcctcggcttcgtccagcacgacgcggtccgggcgatgctgcgggcgcacccgcgcctcaacgaggtgttctggcgcgcgacgctgatcgacgccgccctggtccgcgagtggatgctcaacaccgggcgccgggaggcgtacgcccggatggcccacctgttctgcgagctggtgacccgcctcgacgccgtcgggctggcacccgaccggacctgcgacctgccgatgacgcagcccgaactcgcggatgccctcgggatcacgtcggtccacgtcaaccgcacgatccgcgatctcaaagccgctggcctggtcacgctgcggggtcgccgcctcaccgtccacgattgggccgagctgcaggaagcggccgaattcgatccgacctatctgcacctgcgcaatgcggagacgcgctga

SEQ ID NO: 4613 - DNA, 2787 bp, Methylobacterium sp.
atgattaccgcccagctcagtcaagccgtctacgagcccgatcgcctcgccgcacttgacgcgctcgccatcctcgacacgccgtccgagcccggcttcgacgatgtggtgcggctcgcgacccgcctctgcgccgtccccgtggcgctcgttagcttcgtcgcggccgaccggcagtggttcaaggcccgcgtcggcttccccgcctgcgagaccgatctcgaccgctccgtctgcaagttcgcgatctccgcccccgacctcctgatcatcccggatctcacggcggacccccgcacggcctccaacccattggtgaccggcgatccgcatatccgcttctacgtcggtgcgccgttgcgcttgagcagcggtcttgtggttggatccctctgcgccatcgacaccgtgccgcgacccgagggcctgaccccggatcaggccgacgacctgcgggcgctggcccggcaggttgtcacgcagttggagttgcgcactgccctccatgccaaggacgtcgcggccgacaccgagcggcggctgaccaccgacctgcgccgcagcgaggtgcgttaccgctcgctgttcgagagcatggacgcgggcttctgcgtcatcgccgtgaaattcgacgccgatgccgacgccccccgggcgatcgattacaggttcatggaggtcaacccggccttcgcggcgcagactggcctcgccgacgcggccggccgatggatgcgcgacctcgcgcccggccacgagcagcactggttcgatctctacggccacgtcgccctgaccggcgaggcaatccgcttcgagaacggtgcgggcgcgctcgaccgctggtacgacgttcaggcctaccgcgtcggtgagccggaggagcggcgcgtcgccatcctgttcaacgacatctccgccaagcgcacggccgagatcgcgctgcgggcgagcgacacgcgctcacgactcgctcaggaggccgggcaggtcggcaccttcgagttcgacgtcgcgagcggggaggtcaccgtctcggcggagtattgccgcctgcacggcctcccggtccgtccagtctataccatgggcgacatcaccgcgccggtcctcctggcggatcgcggcaagctgtccacggcggtctctcgggcggacggcagcgcggcagaacccatcgagtaccgcatccggcgcgtcgacgacggggccctgcgctggatcacccggcaatggcagccgacgcgcgacgaggccggggccatcgtgcgctggttcggcaccgtccgcgacgtcaccgagcggtacatcacccaggaggccctgcggatcagcgaggagcgcctgagcctcgccttcgaggcgtcgggctcgctcgggtggtgggactgggacatcccgaacgaccgcctgtatgcgggcgcgcatttcgcccggatgtacggcgtcgatcccgacctcgcggcggccggggcgccgttggaggcgttcgtcggcggcatccacccggaagaccagggatgggtcggagaacggatcgagcaggtcctcgcgagcgccggcgagttcgccgaggagtatcgcctgctggctgcagacgggacggtgacgtggatcttcgcccgtgggcgctgctaccatgatcccggggggcagcccctgcgcttccccggcgtcgcgaccgacgtcaccgacgccaagcaggcgggcttgcggcaggacgccctcctgcgcctcggcgaccggctgcgcgatctcgacaccatcgccgccctggttcaggcggccgccgagatcgtggcggacgtcctggacgcctcgcgggcgggctacggcgtcatcgacattgccaacgatgccctcgccatccccaccgactggtgcgcgccgggcatggcgacgctcgccggggtgcatcggctgtccgactacggccgccacgtcgacgacctcaggcgcggcgagattgtcctcgtcggggatgtcgtactcgacccacgcagccgcgccacggcggagctagggctgaccgccgatgtgcagacgatgatcaacgtgccggtgatggagcgaggccgcctcgtgggcctcgggttcgtccactacgctcacgagcgccgtttcaggccggaggaactggcctttgtgcgcacggtcaccgaccgcgtgcaggtcgccgttgcacggatccaggcggaacagcagcgggtactgctgaacggcgagctgtcgcatcggctcaagaacactctggcgatggttcagggcatcgctggccagaccctgcgcaacgtcacggaccaagctccggtccaggcgttcacggagcgcctgatcgcgctgtcgcaggcccatgatgtcctgatgcaggacagttgggtcggcgcgccgatccggtccgtcgtcgagaaggtgctggcgcttcagacctccctcgaccgcttccggatcgagggaccgcccctggcgctggccccgcaggcgacgctgtccctgtccctgctcctgcacgagttgaccaccaacgccatcaagtacggctcgctctccgccgaggcgggctacgtctccttgtcttggcggatcgaggagggggccgagcgaacggtcgtgctgtcatggcgcgagcgtggcggaccgcctgccatcgcgccgaccaggcgcggctttggggcgcggctgatccagactggtctagtgggaacgcgggacacgcggctggattatcccaatgacggcctggacgcggagttccgcgcgcccatctcgcaggtcgtagcatcgtga

SEQ ID NO: 4614 - DNA, 1725 bp, Methylobacterium sp.
atggcattctcttcgaccccgcctgctctgcagatcgactccgaggcggcacgtcgcctgctcgaaccgatgcttccgcgccgcctgcgcgcctgcctcgctcaggatctgcgtgtggcttctgcttgctctgagctcgccctcgagatcaccaccctcgccccggatgccgaggccctcgtctccgcctggatcggggcggcctcttcggaaggcggcttgtggcgtgaccgtcgatggatagcccgacgatccgctctgatccggttcctcgatgtttgggccgtggagcacgatcagcctgtggcgcgggcgttggccgatgtcgcgacgctgttgtcctgcgccggcgatgatcgcagagctgcagcgcgcttggcccagcccctgtggctggaacgcgaagcggttctcgacctccggaatgggtttgcagcgctggccgaggcgcagacgcgcctcactatcggacgcgtcgccgaacagggtgccgattcggacatcaccggtgcgaccgatctcgctgtcgcgctgcaggcagcttggcacgacgcgctcacggacgcgcttctgacgttctccgagaagacgagcagcgccattgctgcggccgccgccctggcctgtggcgccgatgatgccttcgccagcgacgtggcactcgtccacgcgctcgtgcccgttggggaggtcttgacacgacccgtcgcagacagcgcggcgacgcgggagcggcgcagatggaagacgatcgaggctcagctcgtcaaaaaaagcgaggcgcgccggcgcgagaaggcggcgaccgtcgataccatgccacagcggccggatgccgatgccccacccgcggaagtgcacaaaggccacgtcctcgtcgttccggcgatccaggaaaccgggagtgaccgcggcaaatccatcgcccgcggttatgagcacatcatcggcaagccgctcccgctggtcgccgtgccggatctcgcggatgtgcgcgctcggttggtattcgagtttccttacgcgcagaccatgatcgacaggcttctggccgatctgatcggacgtgagcacgccacgttccgcccgaccctgctgatcggcccgccgggagccggcaagagtcgaatcgtcgcgaggatcgcccatcatctcggattggggctgtggcgggtcgatgctacgcgggacgcgggcgcatcgctcggtggccttgatcgccgctgggcaacgtcggagccagcgcatccaatcatggcggtggctcgatctggcaccgccaatccgctgatgctgatcgacgagttggagaaggccgcaacgcgcgcagatcacggtagactctgggatgccttacttccgatgctcgaaccggagaccgcccggacctaccaagatccttgttttcagaccgaggttgacatcagccgagtgtcctggttggccacggccaacggggtgggcaacattcttggtccgttgctcgaccgcctgcgtgtcttggagatgacggcgccaagccaagcagatcttgaggcgctgctcggaccggtcctggagggtatcgctgccaatcgcgggctcgatcctgcctttgaagcgcctctggatggggaagcggtcgcgctgcttcgtcgatcctggcgcgggggatcggtgaggcggttgacccgattggtcgaggctttcgtaacggcgcgcgaaactcttgcggttcggcattag

SEQ ID NO: 4615 - DNA, 222 bp, Methylobacterium sp.
atgaccgttcgcaccatcgctatcgccgccctcgctgccgttccgatgatcggcaccgcatgggccgacgagagcatctcgctgaccccgccgctctatcgcgagcaggcgcgtcccacggccgccgtgcggccggcctccgagctggccacgacgccgcgtctcgtcccggcgagcccggcctcgcggcgggtcgtcgccaccgcggtcccggcccgctga

SEQ ID NO: 4616 - DNA, 918 bp, Methylobacterium sp.
atgcgtaccgtcactttcccgctgctggcggttctcggtctctgcggcgcgaacaccgcgcgcgccgcggatctcgattacgattacctgcgcggcgcggattacgacccggtcccggccccggtggtcgactggagcggcgtgtatgtcggcggccacggcggcttcacgtcgacgagcctgggcttcgggaacaccgcccagccgatcgttgccaatgatctgcgccagaccagcgtcgagagccagtaccacgtctcgaccctgatgtcctcgaacgccaatcggcgtgtgaacggaaccagcttcggcgcattcgtcggctacaacattcagttcgacgagatcgttctcggtatcgaggccgactacacacatttcggctcgggcggctcggtcactgataccatcagtcggcagatggtgaccgacgatggcttcgtgaactacgtcaacctcgcgagcagctcccgcaccaagctcaacgattacgccacgctgcgcgcccgagcgggttacgcgttcggaaacgttcttcccttcgtgacgggcggattcgcgatcggctccgcgcagatcgccgaccacgtgtccgtgcaggtggccggctacgaccagacgacctacagagcgaaccaagcgatcacggacgctaccaagccggccttcgtcggacgttacgggtacagctcgttcgacgcgagcaacccgaatgccgggatcctggccgatcccttggtattcaaccgcgccaagaccaagatcgtcggcggcttctcggccggaaccggcgtcgagtacgccatcacgcccaacatcctcctgcgcgccgagtatcaatacgtgctcttcgatgccttcgacgggcacaaggtcaacctgaacaccgtccgcgccggcgcggccgtcaagttctga

SEQ ID NO: 4617 - DNA, 483 bp, Methylobacterium sp.
atgttcgacctagcgatcgacagcaagctgcgcggctgcgacatcgtcaagctaaagatcggcgatctcgtcagtggtggtcgcgttcgtagccgggccatcgtcatccagcgcaagaccggccgaccggtgcagttcgaattgctcgaacccgcacgaaccagcatcctcgcatggctggaggccaggggtggtacgctcgacgactacgccttccccagcaggctcgacggcgtcacgcacatcagcaccaggcagtatgcgcgcttggtcgatgagtgggtcacgggcatcgggctccgcagcgaggattatggcacccattccctccgccgcacgaaggcatcgttgatctacaagcgaaccggcaacctgcgtgccgtccagatcctgctcggccataccaagatcgagagcacggtcagatacctcggcgtcgacgtcgaggatgccctgaccttggcagagggaactgagatttga

SEQ ID NO: 4618 - DNA, 1056 bp, Methylobacterium sp.
atgtcttccgaggagagaaaccgggacccggacgcggcgccggccgggggcgaggctccgggcggcgaggtcgcctgcctgcggttcgagccccccggtgatcccgcggcgctggggcgggcgtggcaggaccatctcgcgcccatcttcgacgtgagcttccgcccggagaccgacctcaccgtcccgatcgcgatgcgcagctaccatctcggcgacctgctcgtcggcgacgtggtggcgccggcccacaccctcgtgcggacccgggagatgatcggccagcagggcctcgaccacatcctgctgcaattctaccggcgggggcagagcctggtggagaccgatcagggcagcggccccgtgaacgaggtgcagtgcatcgtcttcgacctcgcccagcccgtgcgcatcgtggcggctgccgtcgacgccacgaacgtcgtgatcccccgcgccctgctggagaagcagggctgccaccccgacgccctgcacgggcgccccctcgaccacgacggcgacccgttcgggcggctggtccacaacttcgtcgccaacgtcgtcgcctgcggcgacctcctcgaccgccgcgaggccctggcggcctcggcggcgatcacccagctctgcgccagctggctgcgcgggcaggaggaggggcgcccctcccagcaccaggacatccggatccgggtccgccgcctcgtcgaggcggaactcggcaacccgaagctgacgccggccctgatcgcgacccggctcggcctgtcgcgctcgaccctgtaccggctgttcgcccccaacggcatcgtggcgtatatccgcgaccgccgcctcatggcggcgatgcggatgctcgtgcgcgacgatgcccccaaacccctgcgcatctcgcaggtcgccttcgcggtcggcttctcggacgagcggaccttccggcgggcgttcaagcgccggttcggcttcatcccgagcgacgcgtcccagcgcctggagaccggccccgatcccgcgcccggcgccgtcctgcgcaactggatcgagagcctctga

SEQ ID NO: 4619 - DNA, 507 bp, Methylobacterium sp.
atggaggacgcgatggcgcatccggcccccacgcgcgaggacgccccggcgactgcgcatgctcggggacggacgcgccacgcggacgatctctacacctgggttcaggagcaggtggcactgctccgcgccggccgggtggacgcgctcgacctcgacaacatcgccgaggagctgagcgacgtgggcctgagtgagtattaccggctccagagtgcggtcgagatcatcatcctgcatatgttgaagtgggaccatcagccggagcggcgaagccgcagctgggcgctcagcatcgccgaacatcgggagcgcgccacgatccagctacggaagagcccgggcctgaagtcgagcctcgatgagatccggcacgatggcttccggctcggtcgcctcggggcagcccggcagatgaagcgcgcgcccaaaaccctgcccacggattgtccctatagctgggacgagatcctgaaccgccccttcgcgttcgacgacgaccggtag

SEQ ID NO: 4620 - DNA, 639 bp, Methylobacterium sp.
gtgtggccaccccctcccagcagggcggacagccgcgccgaggccctgacgctcctgcgcgagacagacctgacgtgcgacgcgatcgcggcccgtctcggcgtccacccgaagacggtgcacacctggaacgcccgggccggctggccgaggccgcggcagcaacggccgaggctcctgacggggcgctggccggcggcgcgccgggccgccctgatccgcctgctgtgcacgccgggcgccgatcccggcgacgtcaccgagatccttggtctcggccgactcgacccggcgatgatggccacggccttcggggctgacctgccgctgccgccggcggtcaccgggcgcggcgaccccgcggccgacccggcgaccctgcgggcgcgtctgcgcgcccacatcgcccggcagatcgccgccttcgacgcggctctgagcggggcgggggcgggcgcgggcgactccgcccgaatcctgcgcgacctcggcggcctcaagcggctcctcgacacggtggatgcggagggcgcgcgcggcgccgcgggggaggggggcgatggcaccggacgcgacaccgaacccggcaccgaacccggcaccgaacccgacctgcccgccctgcgcgcggagatcgcg

SEQ ID NO: 4621 - DNA, 1320 bp, Methylobacterium sp.
atggccgtcaccaccgccgccccggccgccgggcccggacagaaccagtcggcgcgcgcggcgctggcggccttcgtgggcaccacgatcgagtggtacgacttcttcatctacggcacggcggcggcgctggtgttcgggccgctcttcttcacgaccgaatccccctacatcgcgacgctctcggccttcgggaccttcgcggtcggcttcctcgcccggccgctgggcggcctgatcttcgggcatctcggcgaccggttcgggcgcaagcgcgccctggtggcaacgctcgtgatgatgggcatcgcgacctccggcatcggcctgctgccgacctacgcgtcgatcgggatctgggcgccggtgatgctggtggtcctgcggctgatccaggggctcgcggtcggcggcgagtggggcggcgcggtgctgatggccgccgagcacgcgccggccgggcgaaacaccttcttcgcctccttcgcgcagctcggcagcccggccgggcagatcctgtcgctgctggccttccggctcgcgggcctcctcgacaaggagagcttcctgacttggggctggcgggtgccgttcctcgtcagcatcctgctgctcggcgtggggctcgcgatccgcctcggcgtcgcggaatcgccggccttcgagaaggcccgggccgccggcgggccgccgccggcgccggtccgcgaggtgctgacgacctgcctgaagccggtgctgctggcggcgggggccaacaccttcgcgatcgcctcggtctacctgttcaacaccttcatgatcgcgttcaccacgcagtatctcggcatcgcgcgggcgacgatcctcgacgccctgctgatcgccgccatggtccagctggtgatgaccccggtgggcgcccggattgccgagctgatccgcaacgagcggctgttcctccaggggacgctggtctgggcgatgctggccccctacccgctgttctggctcgtcgagaccaagtcggtgcccctgatcgtgctgggtctcgccctcaacgtgatcggcagcgcgaccttctacgcggtgatcgccggctatctcgcgggcgccttcccgacgcgggtgcgctacacggcgatctcgatcgcgtaccagttctgcggtgcgctcgcgggcggcctgacgccgatcgttggcaccgtgctggccgagcgcttccagggccactggtggccgatcgcggttttcggcacggcgctggccggcgtgtcgttcctgtgcgtcacggcgatcggcggctaccgggcgcggcagcggggcttcctcgacgggtga

SEQ ID NO: 4622 - DNA, 1275 bp, Methylobacterium sp.
gtgccggtcgccgaccggcgccagatcgtctggtcgagcgtcatcgggacgacggtcgagtggtacgacttcctgatctacgggacggccacggcgctcgttttcaacaagctgttcttcccgagcttcgacccgctggtcggcaccatcgcggcgttcggctcctacgcggtgggcttcctcgcgcgccccctcggcggcgtcatcttcgggcatttcggcgacaagatcggccgcaaggcgatgctgtccctgaccatcatcatcatgggcctcggcacgttcctgatcgggtgcctgccgacctacgcgcagatcggcatctgggccccgatcctgctcgtggcgctgcgcctggtccagggcatcgggatcggcggcgagtggggcggcgcggtcctgatggtggtggagagcgtcccggcggagcggcgcggcttcttcggcagcatcgtccagctcggctaccccctcggcgtcatcgcgtcgatcggggccttcgcgctgtgcggcttcctgccggaggcggacttcctcgcctggggctggcggatcccgttcctggccagcgcgctgctggtcggcctcgggctgttcatccgcctgcgcctgcacgagacccccgcgttccagcgggtgaagcggcggtccgcggtggcgcgcctgccggtcatggagatcctcaccgagcacccgcgcaccttcctgaaggccgtgggcctcaaggtctccgagatcgcctacgtcagcgtcgtgaccgtgttctcgatctcctacgtgaccggccagctcgggctgtcgcgcagcatcatcctgaacggcatcctggtggcggcggtgatcgagctcttcaccctgccggccttcggctggctgtcggaccgctacggccgccggaccctgttcgtcgccgcctgcctgttctcgatcgccttcgcgttcccgctgttcaccctgctcgacacgcgcgacccaacgatcatcaccctgaccgtcgcggtggccctgagcttcggccaggggatcatgttcggcaccggcgccgcctggatgtccgagctgttcgacgcgcgcctgcgctacagcggcgcctcgctgggcttccaggtgggcgcggccctcagcggcggcttcaccccgctgatcgccgcggccctgctgggctggagttccggcgcgacctggccgatctccgtctacctgatcgccctcgcctgcatcaccctgacggcgacgctcctcgccccggagacggcgcgcaagccgatcgactga

SEQ ID NO: 4623 - DNA, 1410 bp, Methylobacterium sp.
gtggagcaggtgcgggtgcccttcctcgaggccatggaggatcaactccccgccgaccgacggcggcggttcgacctctttgtcaaggaattcgtcgcctaccagaccgatacggccgaactcggcctcacggtctcgcccaaggccgcgcagatccaggcgaccgacgaggcgaccgtgaggaaccgcgagcgcatggtcgccgagatcggcattctcggacgggaggtgctgaaccgcctgaacgcccgccgggctgcggacgcggccgaccgccgccaggcgcggatcaccctggtggccgtgccggccgcggcgctggcgttcggcctcctcgcggcgatctggatcatcgtgagccaggtgcggcggccgctgcatcggctcaaggacgggatgacggcgctcgccgccaacgatctcggccgcgcgatcccgttcacgcatcgccgcgacgagatcggcgagatggccgccgccatcgcggcgttccagacggcgctgatcgagaagcgcgacctcgacgccgaggcgcagacgcggcgcgaccgcgaccgcagccgggcggaggccctggccgcggccacccgcaccttcgaggccgagacgcaccgcgccgtcaccgatctcgccgactcggccgaggcgatgcaggcggcggccgacacgctctcgggcaacgcgggcgcgatggcggccgagtcggccgtcgtcgccggagcgtcggagcagagcgcgggcctcgtcgacagcatcgccagcgccgccgaggagctctcggcctcggcgcgggagatcgaggcgcgggtccgtcacaccagcgcgatcgccacctctgccctctccgatacgcaggggctcaaggagacggtgatgagcctctcgcaggcggccgaggagatcggcgccgtggtcacgctgatccgcgaggtggccgagcagacgaacctcctcgcgctcaacgcgacgatcgaggcggcgcgcgcgggggccgcggggcggggcttcgcggtggtcgccgcggaggtgaaggctctggccggccagacggcgctcgccacagaccgcatcactgggcaggtcggggcgatccagggcgccgcggggcgcacggtcggcgccatcggcacgatcggcgagaccatcgcccggatgagtctgatcgcctccgaggtggcggacgccaccgaccagcagggacaggccagccaggagatcgcgcgggcgatcttcggcgcggccgcggaggcccggcaggtgtccgagagcgtggcgggcgttcaggccgccgccgcgtccaacgaggcgcaggccggccaagtgcgcggcagcgccgcccgggtcaatgccgggacgcacagcctgcagcgggcgatcgagaccttcatggtagaggtccacggcgcctga

SEQ ID NO: 4624 - DNA, 1308 bp, Methylobacterium sp.
atggcgacgctcgaccggccggcctccggactgggagccccagagcgcgccgcgccgacggtcggcggcgcggatgccgcggcgccgggcatcgcggccccgcaggccatcgtcaccagcctgaagcgcagcgacgcggtcacgccctaccggttccgcgacctgctggccctcgacgatttcgagcggtacgcccgcaagctcctgccaccgatgatcttccagtacgtggccggcggggtagaaaccggctcggccctggcgcagagccgcggcgcctacgccgactacgccctcgtcccccgcctgatgcgggacacctcggcgcgggacaccgccaccacgctgttcggccagacctacgcggcgcccttcgggatcgggccgctgggcggggccgccttcatcgcctaccggggcgacctcgtgctcgccgaggcggcccggcggatgaacctgccgatgtgcctgagcgcctcctcgctgatcaggctggaggacgtccacgcccagaacccgcaggcctggttccagggctacctgccgggcgaccagaaccggatcgaccgcctcctcgaccgggtcgaggccaccggctaccggaccttcgtggtgaccgccgacacgccgaccctcggcaaccgcgagcacaacatccgcagcggcttctccatgccgatcaaggtcacgccgaaggtggcgtggcagagcgccacccacccgcgctggctgctcggaaccgtcgcccggaccttcctcaagcacggggccccgcacttcgagaacaccgaggccgagcgcgggccgccgatgatgtcccagggcgcggtgcgcaacaccatcgcccgcgaccagctctcgtggaagaacctggaggcaatccgcaagcgctggtccggcaacctgctggtgaaaggcctgctggcgccggaggacgtcgacatcgcgcgggagtgcggcgccgacggcgtgatcctctcgacccacggcggtcgccagctcgactacgccgttgcccccctcgacgtgctgccggagatcgcagcccggaagggcgggctgaagatcatcgtcgacagcggcatccgccggggcaccgacgtgatgaaggcgctggcgctgggcgccgacttcgtcctcctcggtcggcccttcatgttcgccgcggcgctcggcggcgccgcgggggtcgagcacgcgatgcggatcctgaaggaggagctcaaccgcgacatggcgctgatcggggtgaaccgcctgtccgaactcaatcccgacttccttcgccgcgtcccgcggcgggcctga

SEQ ID NO: 4625 - DNA, 1194 bp, Methylobacterium sp.
atggcgcccatcatcacgacggtcgaggacctgcggcgggtcgccaagcggcgcgtgccgcggatgttctacgactactgcgattccggttcgtggacggagtcgacctaccgcgcgaacgaggccgatttcgccggcatcaggctccgccagcgcgtcgcggtcgacatgaccgaccgtaccctcgccacgacgatggccggtcaggccgtcgcgatgcccgtcgccctggcgccgacgggactcacgggcatgcagcacgccgacggcgagatcctggccgcgcgggcggcggaggcggcgggggtgccgttcacgctgtcgacgatgagcatctgcagcatcgaggacgtcgcggagaacgtcagcaagccgttctggtttcagctctacttcatgcgcgaccgcagcttcaacgaccgcctcatcgaccgcgcgaaggcggcgggctgctcggccctggtcctgacgctggatctccagatcctcgggcagcgccacaaggacatccgcaacggcctgtcggccccgccgcggctgacgccgggcacggtcctcgatctcctgaccaagccccgctggtgctggtccatgctgcgcacgcagcgccggaccttccgcaacatcgtggggcacgtggacggcgtgcgggatacccgctccatctcggcctggacggcggaccagttcgacccgcgcctggactgggacgacgtgcggcggatccgcgaccggtggcagggccctctgatcctgaagggcatcctggacgtcgaggatgccgagagggcgaccgcgaccggggccgacgcgctcatcgtctcgaaccatggcgggcggcagctcgacggcgccccctcgtccatcgccgcgcttcccgggatcgcggacgcggtcggctcgcgcgtcgaggtgctgatggacggcgggatccgctcgggccaggacgtgctgaaggccgtcgccctgggcgcgaagggcgtgttcatcggccgcgccttcctctacgggctcggcgcctacggccaggccggcgtcgcccgctccctggagatcatccgcacggagctcgacatgacgatggccctgtgcggccatcgcgacatccgcgccgtcgaccggtcgatcctctggacgccctccgcgcaggagacccgggaggatgcgccgcccgtgcggcgcatcgggccctga

SEQ ID NO: 4626 - DNA, 1623 bp, Methylobacterium sp.
gtggaaccgaccgacatcgacgccgtcgcggccggcgcgttcgactacgtgatcgtcggcggcggcaccgcgggctgtgtcctggccaaccgcctgaccgagtccgggacgcaccgggtcctgctcctcgaggcggggggacgggcgcgcagcccctgggtcgcgatcccggccgggttcagccgcctgctccagcacccatcctacaactggcggttccggaccgagcccgaggcggcgaccggcggccgggtgatcgcggtcccgcggggcaagggcctcggcgggtcgacgctgatcaacggcatgatctacgtgcgcggacagccgcaggactacgatgcctgggcgcaggccgggtgccgcggctggggattctcggacgtgctcccctatttccgcaggctcgaggattacgagggcggccgcgaaccgctgcgcgcccgcggcggtccgctgccgctgacggaagtggccgagcggccggccatcgcggaggccttcatcgccgccgcgcaggcggcaggctacccgcgcaatcccgactacaacgcggagagccaggacggcttcggctactaccaagtgaaccagcggcgcggccggcgcgtcagcgccgccgacgcctatctgcgaccggccctgggccgcccgaacctcgccgtcgtgaccgacgcgcacgtcctgcggctgaccttcgacgcggaccgggcgagcggcgtcgccgtcctggtcggcggccgcgagcggctgttccgctgcggcggggaagtgatcctcgccgcgggggcggcccagaccccgcagatcctggaactgtccggcctcggcgatccggcgatcctcggggcgctcggcgtcgccgtgcggcgcgccctccccggcgtcggcgccaactacatggaccattactgcacgcgcatgaactggcgcgtgcgcctgccggtgacgctgaacgagcagacccgcggactgcgcctcggcctcgcggcggcgcgctacctcgcgacgcggcagggcatcctggcactggggaccggcctcgcccacggcttcgtgcgcacccggccggggctcgacgggccggatgtgcagtacttcttcatgcacgcgagctacgccaacgccgccgagcgcaagctcgaccggctgcccgggatgacgatcggcgtcacgcagttgcgaccggaatcgcgcgggacgatccacgccgtctcgcccgacccgctcgcgccgcccgccatccgcccgaacttcctcgccaccgcggaggatcgccgggcgatggtcgagggcatgaagatcgcgcgcgccatcgtcgcgcaggcaccgatggagcgcttccgcggggccgagctcaaccccggcccggactgccggacagacgcggactggctcgatttcgcgcgccgcgacggccagacgatctaccacatctgcggcacgtgccgcatgggcgacgatccggattcggtgacggatcccagcctgcgcgtgcgcggcgtggccggcctccgagtggcggatgcctcgatcatgccgcgcatcgtctccggcaacacgcaggccgcggtgttcatgatcgccgagaaggccgccgacctgatccgggccgatgtctga

SEQ ID NO: 4627 - DNA, 1617 bp, Methylobacterium sp.
atgagcacttcagacgccctcgaccgggccgatttcgcgcggcgggcgggggagaaccaggcccggctgaccgccgacctgaaacctgcctacgacttcgtcgtctgcggcgccggcgcctccgggtcggtcgtcgcgcggcggctggcggagaaccccgaggtgcaggtgctcctgctcgaggcgggcggctcggacgacgccgaggccgtgctcgatcccgccctctggccgaccaacctcggcggggcgcgggactggggcttccgcgcggagccgaatgcccacctgaacggacgcacgctctccatggcgatgggcaagggcctcggcggcggctccagcgtcaacgtgatggtctgggcgcgcggccaccggtgcgactgggacgccttcgccgccgaggccggcgacgcggcctggggctacgagagcgtcctcgacatctaccggcgcatcgagaactggcgcggcgcccccgatccggcgcatcgcggaagcggcggtccgatctgggtgcagcccgcgtccgatcccagccccgtggcccacgccctgctcgacgccgcgcgggaactcggcatcccgaccttcgacaaccccaacgggcgcatgatggaggggcccggcggcgcggcgatcaccgacatgctggtccgcgacggccggcgcgtctcgctgttccgcgcctacgtccatccctggctcgaccgccccaacctgaccgtcctcacggacgccctcgtccgccgcgtgaccttcgacggccgccgcgccacgggggtcgagttcgtccacgcgggcgcggtccggacggtcggcgcgcgtgccgagaccgtcctgtcgatgggggcgatccacacacccaaggtgctgatgctctcggggatcggcgaccgggacgagctcggggcgctcggcatcccgtcggtgcagcacctgcccggcgtcgggcagaaccttcaggaccacgtgtccttcggctgcacctgggaatatgccgacccgatcgcgccgcggaacagcggcagcgaggcgaccctgtactggacgagccggcccggcctctcggcgccggacctgctgttctgccaggtcgagtttccggttccgagcgagcagaccgcggcgcgcggcgttccggcccacggctggacgatgttcgccggcctcgcgcagcccgccagccgcggccgcctgcggctgcggagcgccgacatggcgacgccgccggtcatcgaggcgaacttcctgtcccacccgaccgacgtgacggcggccgcggcctgcgtcgatctctgccgcgccctcggcaacgcgcgggcgttccgcccgtacgtgcgcgccgaggccatgccgggtccgctgtccggcgcggcgatggcggactacatccgcgatgccgccgtcacctactggcaccagagctgcaccgcccggatgggccgcgacgcgctggcggtcgtggacggtgcgctccgggtctacggcatcgacggcctgcgggtcgccgacgcctcgatcctgccccgcgtgaccaccggcaacacccaggcgccgtgcgcggtgatcggcgaacgggccgccgagatgctgaagcgggcgaacggcctgtaa

SEQ ID NO: 4628 - DNA, 1326 bp, Methylobacterium sp.
atggcggcgacggcgcggcgccgctcgctccgcacacggctgctcgcgtcggccctggtgctggtgctggcggccctggtggtggcgggcctcgccatcggggtgatcctgcaccgattcgtgcgcgggcaactcgacggccggctcgacgcgcagatcgtcgccctgcgggccggcctcgaggccgggattcttccgcaggatctcgacgcgccgcccttcgaccggccgggccccggctgggcctgggaggtgcgccgcggcgccggaacgatccgatccggctccctgcggggcggggacatccgcctgtccgatcccggaccggacgacgatccgggccggccgcacccggccgcgggcacgggcccgcgcggcgagcccctcgtcgcccgcgtgctcgccgtgcccgggcccgagccggcgacgatcgtggtggcggcgccggagggggagttgcgcgggccgctgcgcgaggcgctgacgagcctcgccctggcgctcggcatcctcggcctgtgcctgctcgccggcttggccttccaggtgcgcctcggcctcgcgccgctgacgcgcctgcgcgcggacctcgcgtcggtccgggcggggcggcgcgagcgcgtgccggcggaccaaccggccgagatcgcgccgatggtggcggaactcaacgcgctcctcgaacagaacgcgcagaacctggaacgcgcccgcggccacgtcgccaacctcgcccacgccctcaagacgccgctcgccaccctgtcgatggccctcgcggagcccgcccgcgacccggacggcgccctgcgccggcaggtggacgacatggaccggcgggtgcgccaccatctccggcgcgcccgggccgcggctctggcgggctcggcccggggccgcacggccctggcgccccggctgtcggacctgcgcgcggcgctgagccggatccacgccgagaagggcgcggcgatcgacctcgacgtcccggagacgctttccgtctcctgcgagggccaggatctcgacgagatgctcggcaacctcgtggacaatgcctgccgctggtgccgcggccgcgtgcgggtctccgcgacggcgcgcgacggcgcggtggccgtggtcgtggaggatgacgggcccggcctcgacccggcggcggcctccgccgtcatggcccggggccgccgcctcgacgagggcgtgccgggccacggcttcgggctgccgatcaccctggagctcgccgagctgtacggcggcggcctgagcctcgggcggtcggatctcggcggcctgcgggcggagctgcggctgccggcctga

SEQ ID NO: 4629 - DNA, 648 bp, Methylobacterium sp.
gtgctcaacgagatgcgcgctatcgagaacgtcgtgcgggcgatcctgcgcgagggcgggatcaagctcggcacgccggcccgtgcagccttcgctggacgggttcgggagatggtgggtgacgatcccctgatcctgccgctcgtcacgcccctcctggcaatcctgtccacgatgctggagcaactcgatcggctgacacggcaagttcttgtcatcgcacgcggtgaagcggcttgccggcggctgatgagcgtgccgggcgtcggcccaatcaccgcactcgccttccgcgcgaccatcgatcagccggagcgattccgtcgctcgcgagacgtgggggcccatctcggtctgacgccgtctcgctatcagtcgggcgagaccgatatccagggcaaggttagccgctgtggcgacgaactggcccgcaccgcgctctacgaggcggcccactctctgctgacccgtagccgcaaatggtcgagcctgcgcgcctggggcctgcagatcgccaagcatcgcggcatggcgcgggcccgcgtggcggtggcgcgcaagctcgccgtcgtcctgcaccggatgtggagtgacaagaccgagttccgcttcggcaaaaagccagtagcggccctcgcggccgcctga

SEQ ID NO: 4630 - DNA, 1179 bp, Methylobacterium sp.
atgcggctgagcgccctcggcgccctcgccgcgctcggaggcgtgccgcgcgcacgggcgggcgacggcgcgacgctgcccttcggcaacggcgagcggccgctcgtggcctatccgggcaagcggccgctcctgcagatgaccgcgcgcccgccgcagctggagacgccgttcgcggtcttcgacggcggcgcgatcacgccgaacgacgcgttcttcgtccgctaccacctcgccgacatcccgaccgagatcgacccgcaggccttccgcgtcgccgtgaccgggcaggtcgagcgcccgctctccctgtcgctcgccgacctcaaggcgatgccgcagaccgagatcgtcgcggtcaaccagtgctcgggcaattcccgcggcttcttcgagccgcgcatcgccggcggccagctcgccaacggcgccatgggctgcgcccgctggaccggcgtgccgctcaagacggtgctcgaccgggccggcgtgaaggccggcgccgtgcaggtcgccttcaacggcctcgacgggccggtcctgcccgagacgccggacttcgccaaggcgctgaccctcgaccacgcccgggacggcgcggtgctgctcgcctggggcatgaacgggcaggacctgccctggctcaacggcttcccgctccgcctcgtcgtgccgggctactacggcacctactgggtcaagcacctcgacagcatcgccgtcctcgatcaccccttcgagggcttctggatgaagacggcctaccgcatccccgacaatccctgcgcctgcaccgagcccggcaaggcgccggacaggaccgtcccgatcggccgcctcaacgtccgctccttcctgacgaacctgaccgacggcgcgcaggtgaaggcgggtccggtcgccctgcggggcatcgccttcgacggcggctcgggcatccgggacgtcgcggtctcggccgacgacggccggacctggagcgcggcgcggctcggccaggatctcggcccctacgccttccgcacctggaccgcggaggtcgatctcgcgccgggcgcccacgccctgcgcgtgcgggccacgggcaacgacggcgcgacccagccgatggagccgcgctggaaccccgccggctacatgcgcaacgtcgtcgagacgacccgcgtgcgggcggcctag

SEQ ID NO: 4631 - DNA, 195 bp, Methylobacterium sp.
gtgcgcgaggagcgtgcctcgggcgagcgcaagtactatctctcgaacctgctggccgaggccaccctgaagcaactggccacaaccatcaaggcgcgctggatctgtgagcaggcccaccagcagatgaaggagaactcggcctcgatcacttcgagggccgatcctggaccgggctgcatcggcacgcgctga

SEQ ID NO: 4632 - DNA, 333 bp, Methylobacterium sp.
atgttcagcacccgcccgctccgcgcgtcggtcgtcgcgatcgccgccgcgctggccgcgacacccgcgctggccgcgcccgagacctacgcgctgccggagccgacggcgcagttccggccggccccggatgccgcgcacgcggccggcttccaggccgcgcaggagaactgcctgacctgccactcggccgactacgtcgccatgcagccaccgaagaaggggcaggcgttctgggacgccgaggtcgccaagatgatcaaggtctaccgggcgccgatcacggaggaccaggcccgggccatcgccggctatctcggcgcggcctactga

SEQ ID NO: 4633 - DNA, 999 bp, Methylobacterium sp.
atgcagatgctcgcgattgatctggccaagcagtcgtttcatgttcacggcgtcgatgccgacggtcaggtgatctcccggcgcgtcgggcgcaccaagcttccggcgctggtggccagcctcgccccgaaggtgatcgccatggaagcttgcgcgaccgcccaccattgggcgcgagcattcctcgcggccgggcatgaggttcgactgatcaacccgcgcttcgtcaagccgttcgtgcgcggctcgaagaacgatgccgtcgacgccgaggcgatcttcgacgcggcatcacgtccaacgatgcggtttgtgccggtgaagtcgaccgagcagcaagacctgcagtcgcttcatcgcgtccgcgatcggctggtctcacaacgcacgaacctgatcaatcatacccgtgggctcctggccgagtacggcctcgtctacccgaagggtgcggcccgctttccagcgcgtgtgcgggcggagctttccgaggcggagctgtcgccgatggcgcgagcaaccttcgcagccctgctcgacgagctggacgccctggagacgcggcttgaacggctcgacgaccagcttcgggcaatctgccgcgaagacgtcgtctgccgccgcctgatgacagtgcctggcgtgggcccggtggttgccaccgccctcaaggccagcgtcggcgatgcccggcagttccgctcagggcgcgaactcgcggcctggatcggcttggtgccgcgccagtactccaccggcggcaagccgcagctcgggggcgtcggacgccgggccaaccactatctgcggcgccagctcgttcacggcgcccgtgcggtcgctttgcgcctggccacgaagactgatccgcgctcgcgctggtttcaggcggtgatcgaccggcgcgggttcaacaaggggatcgtggcgatggccaacaagaccgcgcggattgcctgggcgattctgcggcgggaggaggattacgcccgcgcctga

SEQ ID NO: 4634 - DNA, 1227 bp, Methylobacterium sp.
atggtcgaccgcttgcgcatcgcgatcctcacgcactcgaccgatccgcgcggcggcgtggtccacgctctggctctcggggaggcccttggcaggctcggccacgaggcggtcgtccacgcgcccgacccgaccggcggcggcttcttccgcgcggcgcagtgtccggtgatctcggtcgcggccaagccggtcgcgggaccggccgccgccctggtcggcgcccggatcgccgactacctcgcgcatttctcgacgcccgccgcctgcgacttcgacgtcttccacgcccagtgccggatcagcggcaacgcgctcgccaccctgacccggcgccgcctcatcccgggcttcgtgcgcacggtccaccggatcgacacgttcacggatccgcggctcgcccagtgggaggagcgggcgatcctcgacgccgggcggctgctctgtgtcagccagacctgggcggcgacgctggcggccgagtacggcgcccgggccgacgtggtcggcaccggcgtcgatggggcggccttcacgcccgatcccgggccggaggacgacgcgctccgccgccgcctcggcctcggcggcggcccggtcttcctcagcgtcggcggcttcgaggcgcgcaggaacacgctggcgatcatcgaggccttcgcgaccctgcgccggacctgccccgacgcgcagctcgtcgtggccggcggcgcgctgcccctcgatcaggccggctacgaggcccggtgctgcgccgccctcgagcgcgaggggctcaaggtcgggcccggccggccggtgatccgaaccggcgccgtggcgcaggcggacatgccgggcctctaccggctcgccgacaccctggtgtctccctcgctcgcggagagctacggccagtgcgttctggaggcgatggcctgcggaacgccggtgatcgtgtcgggccggccgcccttcaccgagtatatcggccccggcgaagccctgtcggtgaacccggacgacaccgacgccatcgcggcggccatgcgggcgagcctggagccgagccggcgggcgcggctacgcaatgccggccgggaggtcgcccgggcgcatgtctgggacgcctgcgcggcgcgtcacctgccgacctacgcggaactcgcgcccggggacgcgccgttgatagccgcggccacgggggcggcggcctggaacacgctgcgggtcccgcgcgatgcctga

SEQ ID NO: 4635 - DNA, 1182 bp, Methylobacterium sp.
gtgaagccgctgcgcgtcgccctcctgacccactccaccaacccgcgcggcggcgtcgcccactgcctcgccctcgccgaggccctgtgcgaactcggtcacgaggcggtggtccacgcgcccgacccgtccggccgcgggttcttccgggacgcgtcctgcgcgaccgtggcggtcgccgccgagccggtcgcgggcgggacgaccgacctcgtgcgggcccgcatccacgactacctgcgccacttcgcgagcccggcggcccgcgacttcgacgtgttccacgcccatgacggcatcggcggcaacgccctcgcgaccctgaagcaccggcgcctgatcccgggcttcgtccggaccgtccaccacgtcgacagcttcgcggaccccgtcctcgcaggctggcaggaccgcgcgatccgcgaggccggccggctgctctgtgtcagccgcctgtgggccgactggatccgggacgcaatcggcaccgaggccgggatcgtcggcaacggggtcgacctgtcggtctatcgcgcagcggtcgcggagggagacgcggcactgcgggcgcgctgggggctcggcgcggggccgatcgtcctcagcgtcggcggcctcgaggagcgcaagaacagcctcggcatcatcgccgggttcgcgcgcctgcgggcgcgccacccgcacgcccagctcgtcgtcgcgggcggcgcctcgctcctcgatcacgccggataccgcgaacgctgccgcgcggccctcgtcgccgcgggtctggacgtgggccgcggcgcggccgtcatcgagacggggcccgtcccgcaggccgacttgccggcgctctaccgggccgcggacctgctggccttcccatcctggaccgagggatttggcctctgcgtgctggaggccatggcctgcggaacgccggcgatcgtctccgaccgaccccccttcaccgagtacctgacgccggccgacgcgctgttcgtcgatcccgccgaccccgacagcatcgccgccgccatggcggcgacgctggagccgcggacccgcgcccgcctgcgcgcggcggggttcgcgcgcgcggccgcccattcctggcgcgcctgcgccgcgcgccaccgcgacgcctacgccgcctgcacccgcggcgcggcagccttcacggagttgcagccatga

SEQ ID NO: 4636 - DNA, 486 bp, Methylobacterium sp.
atgcccttcgctttctgccggtcccttcccctcgccaccctggcgttcgccgcggccaccgtgccgggctacgccctggaggtgacgcgctcggccgacatcgccgcgcccccggccaaggtctggcagacgatcggcgagttctgcggcatcggcgactggcacccggcgatcgagaagtgcgccctgtccgacaaggacggcatgaaggtccgcacgctgagcctgaagggcggcggcaccatcaaggaggagcaggtctcccgggacgacaaggtgatgagctacacctacacgatcctggagagcccgctgccggtctccgactacaagtcgaccctctcggtcgctcccgagggctccggctcgaaggtgacctggaccgggaccttcaatgccaagggcgcgccggacacggtcgccaccgacgcgatccagggcatctacgattccggcctgaaggcgctcgccgacaaggcgaagtaa

SEQ ID NO: 4637 - DNA, 360 bp, Methylobacterium sp.
atgcggtttccgccttctgaacgggcgctcgccgcctgcgaggacatcatcgacaacgccgatgccgcccagcgcttcgtcgccggcatgacgttcgaggccttcgtggcggacctgcggaccaactacgcggtcgtccgctgcctggagatcgtctcggaggcgagccggcggctgaccgacgcgatgcacgagcgccatccggatgtgccgtggcgcgacatcgcctccatcggaagcgtctttcgtcacggctaccatggggtcaagctggacatcgtctggcggaccgtccacgagcgcttgcccgttctcgtcgcggcctgccgcgccgaaatcgcccgcgcgtccgactcctga

SEQ ID NO: 4638 - DNA, 645 bp, Methylobacterium sp.
ttgcaggcggatggctatgccggcttcaacgggctctacgagggccgtcgcccgggcggcgcgttgatcgaggccgcctgctgggcgcacacccgtcgcaagttcttcgatgttcatgccaggaccggctcggcggtcgccttcgaggccctggaacggatcggcgcgatctacgaggtcgagcgatccgtcagcggcaagcctcccgacgagcgcctgcggcagcgccaagctcgatccaaaccgctcgcagcggccctgaaggcctgggcggcgacgatcctgccgcagctctccggcggctccgatctcgccaaggcgttccgctacatgctggtgcgctggacggcgctgacccgcgtcttcgacgacgggcggatcgcgctcgacaacaacccggccgagcgggcgctgcggtccgtcgcgatcgggcgcaagaactacctgttcgccggctcggagcgcggcgccgagcgagccgcggcgttctacacgctgatcgagacggccaagctcaacgggctcgatccggaggcctacttgcgcgacgtgctcacccgcctcgccgatcatccagccaaacgcctggccgaactcctgccctggaactggtcgccggtcaccgctggtgctcaggccgcctaa

SEQ ID NO: 4639 - DNA, 849 bp, Methylobacterium sp.
ttggagacgctcaagcgctcgggcaagctgtttgccgacgagaccacggcaccggtgctcgatccgggctgcggccgcaccaagaccggccagctctgggcgtatacccgcgacgaccggccctggggcgggaccgatccgcccggcgtcgcctacatctatgcccctgaccgcacggctggacgaccgatcgcgcatctctgcgggtttgcaggcgtgctgcaggtcgacggctacgcggcctacgagacgctagccaaaggcggcgcggtgcggctggcctactgctggagccatgtgcgtcggcaattctatgacctcgccgcggcctcgccgatcgcgacggagacgctgtcgcgcatcgccgcactctaccggatcgaggccgagatccgcgggcgctcggctgaggagcgacgggcggcccgtcaggaacgaagccggcccgtggtcgaggcgctggaggcatggctgcgggagaagctcggcctcttgagccgcaagagcaacctggccgaggcgatccgctacgccctgagccgctgggcggggttgagcctgtacctcgacgacgggcgcgtcgagatcgactccaacaccgtcgagcgggcgatccgacctctggccctcaatcgcaagaatgcgctgtttgccggatccgacggcgggagcgagcactgggcggtgattgcctcgttgatcgagacctgcaagctcgtcggcgtcgagccgcaggcctatctggccgacgtcatcacccgcatcgtcgacggccatccgcatcggcgcctcgacgagcttttgccctgggcctacccgagtacacctacgctccgagccgtggcctga

SEQ ID NO: 4640 - DNA, 663 bp, Methylobacterium sp.
gtgggcgcgcctgcttcgccctcgtccgacgatcccgagacgctcaaggcgctgctcgccgaggagcgcgccgagaacgagcggctgcgccagatcatcctggcgatgcagcgccaccgcttcggccgccgcgccgagagcctgcctgaggatcagcttctgctcgggctggaggaggccgagcaggtcgaggccgcgggctttgccgccgaggagagcgagcccgccaaggaggcccggagggccaagcggcgcgcgaaccgtggtgcactgcccgcccacctgccgcgggtcgagtgcctcgtcgatatcgacagcctcgtctgcccatgctgctcgggcgctctgcatcggatcggcgaggacgtctctgagcgcctcgatgtggtgccggcgcagttccgagtgctggtgatccgccgcccgcgctacgcttgccgcggctgcggggacgcgatcgtgcaggcacccgcgccggcacggctgatcgagggcggactaccgaccgacgctctggtcgcgcaggtcctcgtctccaaatacgccgaccacctgccgctctaccggcaggcgcaaatcttcgcccgccagggcgtcagcctcgaccgctcgacgctggctgactgggtcggacgggctggagatcgcggcagagaacggtga

SEQ ID NO: 4641 - DNA, 1506 bp, Methylobacterium sp.
atgatcctggccgagcgggcggcccggctcgcctcggagatcgcggtcgaacggctgaagctggaggtcgcccggctgcggcgagaacggttcgggacctcctcggagcgcagcgcccggatcgaccagctcgaactcgtcctggaggatctggaggagacgctggccgagacccaagcgcaggcggccgccgagcccgaagcgctctccggtgcggcttcctcgcggcgcaagcccgcccgccggcctctgcccgagcacctgccgcgcgagcgcgtcgtccatcccggcccgacgacctgcgcctgttgcggcggagcgcgccttcgtcaccttggcgaggacgtcaccgagaccctggagcggatcccggcgcgctgggtcgtgatccagcacgtacgcgagcgcttctcgtgcagcgactgcgagacgatcgcgcagacaccggccccgttccatccgatcccgcgcggacgagcgggcccaaaccttctggccgaggtgatgatggccaagttcggcctgcacctgccgctgcatcgccagagccagcgcttcgcccacgagggcgtaccgatcgacgtctcgacgctggccggctgggtcggagcggtgaccaccgccctgtcgcccctggtcacccggatcgaggcccatgttcgaggggctgagcgcctgcatctcgacgacacgcccgtcccggtcctggccaagggcaagacccgcacgggccggctctggacggtggtgcgcgacgaccgtcccttcggcggttccgagccgccggctgcagcctacttctactcccccgaccgctccggcgcgcatgccgagacttggctgggcgacttccacggcatcgtgcaggcgcatgccttctccgggttcggtcggctgtacgaacccggccgtaaaccaggcccgctgcgcgaggcggcctgctgggcgcatgcccgacgcaagttcttcgagctggccgagctcaggaaggctccgatcgcgatcgaggcggtggcgcggatcgatgcgatcttcgccaccgagcgcgccaccaacggtcttgccgccgatgaacgccgcgcgcaccgtcgcacccgctcggccaccctcgtcgccgagttggaagtgtggctacgggagaaccgcgccaagctctccgccaaggctccggtggcgcaagcgatcgactacatgctcaagcgctggagcgccttcatccttttcctcgacgacggacgtgcctgcctgtcgaacaacgccgccgaacgggcgatccggccgatcgcggtaggccgccgcaactggaccttcgctggctcggatgccggcggccatcgcgcggccgccctctacacgctgatcgagaccgccaagctcaacggcatcgatgcgcaggcctggctcgctgatgtgctcagccgtctgcccgaccatccggcccggcacatcgacgatctgttgccgtggaactggacccaacatcagcccaggccgatcgctgcctga

SEQ ID NO: 4642 - DNA, 909 bp, Methylobacterium sp.
atgatcgtcggcatggcgagggacgccgttcatgccaacacgctgatcgagaagctccgcggcgaactcgccagattgaagcgggcgcagttcggcgtctcgtccgagaagctgcaagcccgcgtcgagcagctcgaactcgccatcgaggccctggaggtcgacgaggccgaacgcctcgcggcggccccggtcgtcgccgaggcggtcgaggcggcaagccgagggccggggcgccgccccttgcccgatcatctgccgcgcgagaccgtcgctcatcccggcccctgcgcctgcccggcctgcggcggtcgcctgcgccggatcggcgaggacgtgacggagagcctcgattacgtgccgggccgcttcaaggtggtgcggcacgtgcgcgaggccttctcctgccgagcctgcgagaccgtggtgcaggctcccgcgccctaccacgccatcgcccgcggccgtgccggccccgggctgctcgcgcacatcgccgtggcgaagttcgacgatcacctgcccctgtatcgacaggccgagatctatgcgcgggacggcgtcactttgcagacctcgaccctgtccggctggatgggcgccacggccgccgcgctggccccgctggccgatctcctgcgcacggaggtgatcgccgggtcggacgtcctgcacggtgatgatacgacggtgccaatcctggcgcccggtgcggggaagacgagaactggccggctctgggcgtatgtgcgcgacgagcgcccctttggcggggtgcgtccgccggcggccgtgttcttcgcctcgccggaccggaagggcgagcgtccgctcacgcatctggcggcgttctccggcgtattgcaggcggatggctatgccggcttcaacgggctctacgagggccgt

SEQ ID NO: 4643 - DNA, 1272 bp, Methylobacterium sp.
atgaccggttccgccggacccgccatcggcacccgggtcgtcgacaccctggcgaccctgcggccgctggcgccgttcttctgcctgtacgtgaccttcggggcgacgctcggcttcctgtccggcggggcgccgctgatcctgcgggcgcgcggcgtggagctggccgaggtcgggctgctgcagctgatcaacctgccggtcgggctcaccttcctgtgggcacccctgctcgaccggatccgcctgccgatcctcggccaccggatcggctggatcgcggccgcgcaggccgcctcggtgctcctgctggtcgtcctgagtctcggcgaggcctggccgctcccggcgctgctcggcctggcgatcgccgcctgcacctgcgtggcgaccatggacatcgccctcgaggccctggtggtcgagaccgtgccggcggagcggcgcgctttcgtggcctcggccaagctgtgtggcgcctccctcggcgggatcctgggggtcggcgtgctggtcggctcctacgacagcctgggctggcgcggggcggtcctggcctgcgcggccctcgacgccctctgcctgctgccgatcctgggctaccgggaatcgcgcctgcgtgagtccgggagcgccggtgccggcaccgcggccggtgcgggcccggagcgctggtcgggctcgctggcgcggctgcgccgcctgggcggtcgcgtgctggtgctcggcgcctacttcgccgcctcctacctcgtgggcgggcccaacaccctcgcgctcctcgatctcggcgtcccgctcgggcaggtcggcacgctcaccggcaccgtgctcccggccgtgaacctcgtcatggcgctcgcggccggatggctggccgcgcggttcggcacggtccggctgatcgccgtgggggccctcggcgtcctggcctccgggggcctgatggtcgtcgcctgcgcgggccggatgccggatctcggcatcgccgccgccgtgctgggcttcgtcgcgggcgggttcctgggcgtgccggtcttcaacatgatctaccgctgggcccaggggccgaagcccgccaccgactacgcgctcctgttcggcgccgccttcttcgccgcgatgccgctgcgggtggcggccccggcgctcgccggctggatcggctggccgggctacttcgccgcccccctgccgctctacgccgccgcggtggcgtggctcgccgtcgcggtggaccggaccctgcgcgacgacggggcggcgcgatga

SEQ ID NO: 4644 - DNA, 297 bp, Methylobacterium sp.
atggacaagctcgccgccctcgacatcctgcgcgccaacgaggcggaactgcgccgccgcggcgtgctgcacgcggccttgttcggttcggttgcccggggcgacgcgcaggccgacagcgatctcgacgtgatgatcgagatcgaccgggagcgcgtgcgcgacctcttcacctatgccggcctgtgccgcttcatcgacgatctgttcccggttccggtcgacgtggccgaccgggaaagcctgaagccgcgcgtccgtcagcgggccgagcacgatgcggtttccgccttctga

SEQ ID NO: 4645 - DNA, 324 bp, Methylobacterium sp.
atgatcctcggaatcgggacggaacgagaggccctgccgatgggcgagacgatcagcatcaccctggcaccggacacgctccgcgccgtgcgggagagcgtcgaggccggtgagtacgcctcggtggacgcgctgctcgacgaggccgtgcacgccctgcagcgccagcggcgcgaggatgccgagcggctcgatgacatccgcgcccgcatccggcggtcgctggatgacccgcggccaccacggagccttgaggagatcagaacccatatcgatgccctgcatgccgagaccgtgaaggctcaccgggatgcggcgctttga

SEQ ID NO: 4646 - DNA, 1413 bp, Methylobacterium sp.
atgcgccgtcaccgccacgccaagatcgtcgccaccgtcggtcccgccagcgccgccccggaccagctccgcgccctgttcctcgccggcgtcgacacgttccggctcaatttcagccacggcctccaggcggatcacgccaaggtccacgcggccatccgcgccctcgagaaggaggtcggccggccgatcggcatcctgcaggaccttcaggggccgaagatccggatcggcacgctccagggcggccggctcgatctccaggccggcgagacggtgcgcttcgtcctcgacggcgcggacggcgacaagcaggcgatcccgctgcaccacccggagatcttcgacgccgtcgtgccgggccaggagctgctcatcgacgacgggcggattcgggtgcgggtcaccgggccagagcggacctccatcaccgccgaggtcgtcaccggcgggccgatctcgaaccgcaagggcgtgaacctgccgggcacgctgctggacctgtcgccgctgaccgagaaggaccgggcggacctcgccttcgggctcgacctcggcgtcgactgggtcgccctgtcgttcgtccagaagccgtccgacgtcatcgaggcgcgggggatcatcggcgaccgcgccggcatcatgtcgaagatcgagaagccgcaggcgctggagcggatcgccgacatcatccggctctccgacgccgtgatggtcgcccgcggcgacctcggcgtcgagatcccgcacgaggacgtgccggggcggcagaaggagctgatccgggcctgccggctcgccgtgaagcccgtcgtggtggcgacccagatgctcgactcgatggtcaacgcccccgcgcccacccgggcggaggcgtcggacgtcgccaccgccatctacgacggcgccgacgccgtgatgctctcggcggaatccgcgaccggccgctacccggtcgaggcggtggcgatgatggaccggatcatccggagcgtggagggtcacaagctctaccattccatcgtcgcggcctcggagccgggcgaggaggagacgccgccccacgcggtggcgaccgccacggccgacctcgccgaggcggtgcgcgccgcggcgatcgtcgcatacacggcgagcgggacgacggccgcgcgggtcgcgcgcaagcggcccgcggcctcgatcctggccctgacccccaacgtcgcgacctcgcggcggctgagcctgctctggggagcgcacagcgtcctgacggaggacgtcgacagctacgaggagatgacctcgaaggcctgccaccacgcccaggacgagggcttcgcgcggccgaacgacgtcatcgtggtcaccgccggcatcccgttccacacggccggcaacaccaacaacatccggctgatgcaggtctga

SEQ ID NO: 4647 - DNA, 1548 bp, Methylobacterium sp.
atgaacctcgcggggatgcggagctaccgcgcggatgaggccgtcgacgcggtcgtggtgggaaccggtgcgggcggcgcgccgctcctcgcgcgcctcgccgcggcggggctgaaggtcgtggccctggaggccggaccgaacttcaccccggagcgcttcgccttcgacgagacgctggcggacgagatctactggaccgaggagcggctgagcggcggctcgaccccggaggccttcggggcgaacaacagcgggaccggcgtcggcggctcgacgctgcactggggcgccttcgtgccccgggccgacgcccgcgacctccgactgcacacggagagcggcgaaggggtcgactggccgctgtcctacgaggacctgctcccgttctacgagcgggtcgagcgcttcctcggcgtctcaggcgcgcagagctatccgtgggatgccggccgccgctatcccctgcccccggtgccgcggaacgggccggcgcagatcatggcgcgggcctgcgaggcccgcggcatccggtgggcggacgcgcccgccgcggtggtctcgcgggacttccagtccgaggacggaccccgccgcaacgcttgcatcaattgcggcttctgccaccagggctgccgcacgggcgccaaggccagcatggacgtgacctacctgccttacgcggtcgcccacggcgccgagatccgggccgaggccttcgtccacggcctggagcggggcgccgacggccggatcaccggcgtggtctaccggcaggacggcgcggagcggcggcagcgctgcggcgccgtcttcctctgcgccggggcggtcgagacgccgcgcctgttgctccatctcggcctcgccaattccagcggccagatcgggcgcaactacatgggccacgtggcgacccaggtctggggcaccttcgaccacgaggtgcgcatgaaccggggctacccgtcctcgctgatcaccgaggacttcatccgcgccggcgccgacttcgccggcggctacctgatccagagcctcggcgtggtgccggtgaccttcggcaactcggcggcgcgggggcgcggcctgtgggggcagccgctgctcgactacctcgaccgctacaaccacttcgccggcatcggcatcaacggcgagacgctgccctgcgacgccaacgtgctgaccctcgccgacgagaccgacgcgcacgggatgcgcaaggcccatatcagcttcggctacagcaccaacgagaaccgcctcaacgcgcacgccacgaaggtcatgcgcgatctctgggaggaggcgggggccgacgacgtctgggtgctggagcgcgtcgcccacacgctcgggacctgccggatgggccgcgacgggacgagcgccgtcgtcgacccgcacggccgcagcttcgacatcgacaacctgtggatctgcgacggctcgacgttcccgagctcgctcgcggcgaacccggccctgaccatcatggcgctcagcctgcgcagcgccgaggcgttcctggctggcggcccctga

SEQ ID NO: 4648 - DNA, 1569 bp, Methylobacterium sp.
atgtcagctccctacgacctcagcgacggctccgtcttcgtcatcgtcggctcgggcgccggcggcgggaccctcgggacccaactcgcgctcaagggcatcgacaccgtcatcctcgaggcgggcgaccggcacgagaccttcgacttcgtcaacgacgagtgggattcgttcgcccagctcgcctggaaggacaagcggcacgccaccgggccgtggccgatcgccaagacgttccccaacctgccggcctggatcgtgaaggccgtcggcggctcgaccgtgcactgggcgggcgcgtcgctgcgcttccaggagcacgagttcaggacgcgcacgcattacggcgccgtgaagggggccaacctcctcgactggcccgtcgacctcccggagatggacccctggtacgccatggccgagaaccggatgggcgtcacgcgcaccaacggcatcccgggcctgccgggcaacaacaacttcaaggtgctcgaggccggcgcccgcaagatcggctacacggaggtgcataccggccggatggccatcaactccgagccgcgcgacgaccgcgccgcgtgcatgcagctcggcttctgcttccaggggtgcaagtcgggcgcgaagtggtcgacgctcatcgcggagatcccgaagggcgaggccacgggccggctcgaggtccgttcgggctgccaggtgctgcggatcgagcacgatcccggcggcaaggtcaccggcgtggtctacgccgacaaggacggcgtcgagcaccggcagagagcgcgggccgtcgccgtggccggcaactccatcgagagcccgaggctgctcctcaattcgcactcggcgaagttccccgacggtctggccaacgcgtcggggcaggtcgggcgcaactacatgcgccacacgaccggttcggtctacgccatcttcgagaagccggtccacatgtaccgcggcaccacgatggccggcatcgtgcgcgacgaggcccggcacgatccgagccgcggcttcgtcggcggctacgagctcgagacgctctccctgggcctgcccttcatggcggcgttcctcgacccgcagacgtggggccgcgacttcaccggcgccctcgacaagtaccggaacatggcgggcctctggatcgtgggcgaggacatgccctgttccgacaaccgcatcaccctgtcggacgacacggatgcctacgggatgccggtcgcgtcggtccatttcgccgaccatcccaacgacgaggcgatgcgcgagcacgcctacaggcagggcagcgccctctacgaggccgtcggcgcggtccgcaccatccgcaccccgccctatccgtcgacgcacaacctcggcacgaaccgcatgagcgagaagccccgggacggcgtcgtcaaccgcttcggccaagcccacgatgtcgagaacctgttcgtctcggacggctcccagttcacgaccggcgccgcggagaatccgaccctcaccatcgtcgcgctggccctgcggcaggcggaccacatcgccaagcggatgagtcgcggcgagatctga

SEQ ID NO: 4649 - DNA, 1269 bp, Methylobacterium sp.
atgacgacaacgacccgtcacgtccccgtcgccgtggtcggcggcggccaggccggcctctcggtcagctatcacctgaagcagcgcggcatcgcgcacctcgtcttcgagaagcacacggccgcgcacacctgggcgacgcagcgctgggacacgttctgcctcgtcacgccgaactggcagtgcgacctgccgggccaccgctacgacgggccagatcccgacgggttcatgaagaaggacgagatcgtcgcctacctgaaggccttcgtcgccaaggtgaggccgccgatccgcgagaacgtggcggtcacgcgcgtggcgcggcgcgacgacggcgtattcgcggtccggacctcgaacggcgactacaccgcggacgagatcgtggtggcctccggcggctaccacacgccgatcgtcccgcgcatggccgagaagctgccacccgcgatcacccagatccactcgaaccagtaccggaacccggcgcagctgcccgacggcgcggtcctggtcgtcggctcggggcaatccggcgcgcagatcgccgaggacctgcatctcgccggacggcaggtgcatctcgccgtgggcgacgcgccccgctgcgcccgcttctatcgcggccgcgacgtcgtcgcgtggctcgccgacatgggctactacgagaagaccgtcgacgatcacccgctgcgcgacggcgtccgggacaacaccaaccactacgtgaccggtcgcgacggcggccgggacatcgacctgcgccgcttcgccctggagggcatggcgctctacggagtcctcgaggactacgcggcgggcgccctccgcttccgggacaacctccggcccgcgctcgaccaggccgaccggacctacaacggcatcaacgcggccatcgacgcccatatcgacgcggccggcatcgcggcgccggtccaggcgccctacgcgccggtctgggagccgggcgagccggtcaccgcgctccccctcgaagggtccggcatcgccggcgtggtctggtgcatcggcttcgcaccggatttccggtggctcgacgcgtccgtgttcaacggcgccggccagccgaagcacaggcgcggcgtcacggccgaggcgggcatctccttcatcggcctgccctggctgaacacctggggctcgggccgcttcggcgcggtcggccgcgacgccgagtacatcgtgcaggtgatcgcggcgcgtctcggcgccggtgcggtcggcctgaagcgggcggtgtga

SEQ ID NO: 4650 - DNA, 336 bp, Methylobacterium sp.
atgcggcgctttgaggtcctcttcagtgcggaagccgagaccaatctgctgcagatctaccgctggatttacgacgcgagccgagatccgaacgtagccggccggtttctggacaggctgatcagccgttgtgagcgcatcggtgacgcgcccctgggcgggcgcccgcgcggtgatctggagccaggtctgagaaccgtgccgttcgaacgatctgccgtcatcgcctatcgggtcgaagccgaactggtgacgatcaccaacgtcttctacggcggccgggatttcgacgcgctgtatcggaccgcatcgcctggcgacgaaccggcaccgtga

SEQ ID NO: 4651 - DNA, 306 bp, Methylobacterium sp.
gtggcgcgtagcgtccaattccatccgctggcacgcgcagacctcttcgacctctacgactatatcgagaggcggtccggctcggagcgggccggcgcctatctggatcgcatccagcggctctgcacgagcttggccgacttccccgagcggacggtgcctcgcgatgacctgttgccgggtctgcgcacggttgctctggaccgccgcgtgctgatcgccctcaccgtcaccgagcctgtcgtgacgatcctgcgcgtgctctatgcgggccgcgacctgtcggcacaggacgtgctcttctag

SEQ ID NO: 4652 - DNA, 558 bp, Methylobacterium sp.
atggcgctcgaacaggaactggcgaccctgatggcggcggcccagggcggcgacgcgcccgcctatcgcgcgctgctgaaggcctgcctgcccgtggtctcggcgatcgcgcgggcgcagggcgtgcgcggcgaggcggtggacgacgtcgtgcaggacgcgctgatgaccgtccaccgggctcgggcgagctacgatccggcccggccgttcctgccctggctgcgcgccatcacccagcggcgggcgatcgaccgcctgcgccgcgcggggcggcgcccgcgggaggtcaacgacccgctggcctacgagaccgaggtcgatccagggccggcccccggccacgggctggaggcgcgggaccgggctgccgccctggccagggcggtggcggccctgcccgacggccagcggcaggcggtcgagcacctgggcctgcgcgagctgtcgctcgacgagaccgccgccctcaccggccgcagcaagggggccctcaaggtgaacctgcaccgggcgctgaaggcgcttcgggccagcctgacgcaggagcgggagtga

SEQ ID NO: 4653 - DNA, 843 bp, Methylobacterium sp.
atgagccagcaccccgcgatcagcccgggccgcagcgcggtcgtcaccggggctgcgagcggcatcgggctcgccgccgcgcaggccttcgcccgggccggcatgaacgtctggctcgccgacctgccgggcccggccctggacgcggcccgggccgccgtcgccgaactcgccgccgtcgaggtgcgcgccgtgcccaccgacgtgtcggaccggggcgccgtggaggccctggcggccgccgtcgccaagggcgggccgcccgccctggtgatgctcaatgccgggatcgaggccggcggaaagctgttctccgacgccgacacctgggcgcggatcctgggcacgaatctcggcggcgtggtcaacggcatccacgccttcgcgcccggcatgatcgagggcggcaagcccggcgcgatcgtcgtcacgggctcgaagcagggcatcaccaccccgccgggcaacgcgccctacaacgtctcgaaggcgggcgtgaaggcggtcaccgaggcgctcgcccacgagctgcgcaaccgggagggctgccacaccacggcccacctgctgatcccgggcttcgtctataccgggctcaccaaggcccgcggcgtcgccgagaagcccgccggggcctggacgcccgacgagaccgtggccttcctgctggagcggctcgcagccggcgatttctacatcctctgcccggacaacgagaccacgcgcgcccaggacgcgaagcggatcgcctgggcgtccggcgacatcgtcgagaaccggcccgccctctcgcgctggcatccggactacgccgaggcgttcaagcggtacatggaggggtga

SEQ ID NO: 4654 - DNA, 417 bp, Methylobacterium sp.
atgagcgccccgtcgcccgagccctgcacctgctccgccctgcgtcgcgccacgcgggcgctgacggcgagctacgacgccgcgctgaagccgaccgggctccgcgtgacccagttcgcgatcctgcggctgctggaccggctcggatcggtcccggtctcgcgcctcgccaccgaggcggcgctggagcggaccacgatgggccgcaacctcgatccgctcaagcgccgcggtctcgtctcggtcacgcccggcgcggcggatccgcgcgagcgctgcgtgtcgctgaccgcggcgggccgcgaggccctcacggccgccacgccctactggcgcgaggcgcagagccgcatcagcgcccgggtcgatcccgcgaccgtctccgccctggcggagtcgctgatctccgccgcctga

SEQ ID NO: 4655 - DNA, 666 bp, Methylobacterium sp.
gtgaagatcctgctggtggaggacgacgccgccctcgcggcggaggtcgccaaggtcctgcgcgccgagaacttcgtgctcgaccacaccgacaccggcgaggacgcccagcatctcggcgagaccgagggctacgacgccgtcgtgctcgatctcggcctgccgaagggcgacggcgtctcggtgctgcgggcctggcgcggggccggccggaccctgccggtgctggtgctcaccgcccgggacggctggagcgacaaggtcgcggccttcaaggccggggcggacgactatctcgtgaagccggtccgcgtggaggagctggtgatccgcctgcgcgccctcgtgcgccggtcccagggcggcggggcgagccggatcacctgcggtcccctcagcttcgatccgggtctcggcgccttcgagcacgagggcctgccgctcaagctcaccggtctggaatggcgggtcctgtcctgcctgatgctgaaccgcgagaccgtggtgccgcgcccgcacctgatcgagcgggtctacgaaggcgacgccgacgtcgattcgaactccgtcgaggtgatcatcacgcgcctgcgccggaagatcgcgccggcgcggatcgagagcgtgcgcggccacggctaccgcctgcacgcggagccggcctga

SEQ ID NO: 4656 - DNA, 687 bp, Methylobacterium sp.
atgagcgacgacaagaccatcgacgggacggcgcgggaagtccgcgagaccgaggccgccgggccggcgtcgagggcgatcccgcggcggacctgggtggtgggcgcggtggcgctgccgctggccctgggcgccgtcggcctgtccctggcgcagggaacgccgttccagccgacgccggtcgcgccggtggcgatccaggccctggccccctccggcgcgaccgccatcaagggcgaggtcgcggagatcttcggcaacaagttcgtggtgcaggacgggaccgggcgggccctcgtggagacgggccgcgagggcgagggcggcggcctcgtcgccaagggcgagaccgtgacggtgcagggccgcttcgagaccggcttcctgcacgcccgggtcctgacccacggggacgggcgcacgctgctgctcgggccggccggtggccctccgaccggcagcctggactgggccaaggaccggctcggtctcgggccgaagcccgacatggccgccctgaccgcctcgctccaggcggcgggctacggcgacgtgcgggtcacgggccgcgggccgcgccatttcgaggtggccgcgaaggaccgggacggccgcgagcaccggctccatgtcggcttcgacggccaggtgcgggagcgcccggcgccggggctgccgccgctctga

SEQ ID NO: 4657 - DNA, 270 bp, Methylobacterium sp.
atgcgattccatatccggtggccggacgggacccgcgaggcctgctactcgccgtcactggtgatcaaggaccacctcgcggtcgggcaggactacccgctcgacgagttcgtcgccctgacccggttggccctgggcatcgccagcgagcgcatccgcgcccgctacggattcccgtgcggccgcgcgcaggcgcagctcgcccggatcgaggagggtgcccgccgccaggagcccgggaccgtccacgtcgaggccttcgaggactga

SEQ ID NO: 4658 - DNA, 381 bp, Methylobacterium sp.
atgcctgaggcggacgacgagacgccgccggtcgtgccgccggtcgtgccgccgggcgtgccatcgggcggaccggtggttgccgcggcgggggtgcgggccgatgtaggaggcatgccttatcccgaacaccggcctgaaccgcggcccgagcaccggcgtgccgccccgagaccgaccgagcgctacgcccccggcgcggcacccgccgccctgcgggtgatccccatcgcgggcggcccaaccctcgacgcgcagacgcgcgtgcggctcggccaccagatgcgggcgatgtatgatccggtgatcgacgaggcgttggatccccggctggcggagctgctgcagcagctcgatgcggatcggggcggctcgacctga

SEQ ID NO: 4659 - DNA, 672 bp, Methylobacterium sp.
atgacccacgatcacgcgcggcacgcgcttggccacgacgatcaccaccacgatcatcaccacggcagcgacctgttgccggtcgaggcccgggtgcgcgccctggaatcgctgctgaccgagaagggctacgtcgacccggcggccctcgatgccctggtcgagctctacgagaccaaggtcggcccgcacgcgggggcccgggtcgtggcccgggcctggaccgaccccgccttccgggcgcggctcctggccgacgccacgccggccatcgccgagttggacatcggcggccgcggcggcgagcacatggtggtggtcgagaacacgccggaggtccacaacctcgtcgtctgcaccctgtgctcctgctacccgtggccggtgctcggcctgcccccggtctggtacaaggcgccgccctatcgggcgcgggcggtgatcgacccgcgcggcgtgctcgccgagttcggggtgacgctgccggaaaccacccgcatcaccgtctgggactcgacggccgagacccgctacatggtcctgccgatgcggccggccgagaccgacggcttctccgaggaggccctggccgccctcgtcacccgcgattccatgatcggcacggggctgcccaaggcgatcccggtcgcgcccgcggagatgccggtatga

SEQ ID NO: 4660 - DNA, 903 bp, Methylobacterium sp.
atggaactccggcatcttcgctacttcgccgcggtggcggagcatctcagcttcaccgccgccgcccagagcctgggcgtgtcgcagccgccgctgagccagcagatccgcgatctcgagttggagatcggcgtcaacctgttcgagcgctcgagccggcgcgtcgtcctgaccgcggcgggcgaggatttcctcgggaacgcgcgggcggtcctcgcgcaggtcgccgacgccgtcgaccgggcgcggacgatcggcaccggaacggccggcatcctcaacatcggcatgacgagttccgtcctcgcggggccggccggctgcctgatccgggccttcgagcagcgcttccgggcggtggacgtgcgcatccacgagatggcgccggccgaccagatcgcggccctcaaggcgaaccggacggatctcagcttcctccgcagcccccccgaggatccggatctcgtcgcccacctggcgtggccggagcggctctgcgtggccgtgccgcgcgagcacgccctcgccgccggtcgcagcgtcgcgatcgacgtcttccgcagcgagccgctgatctcgctcggcctcgagagctcgcgcttcgcggcggatatctaccaagcctgcatcgcgcgcgggttcacgccgagcatctcgcagcaggtccgcgaggcctcgtcgctgatcaacctggtcgcggcgggcttcggtctcgccatcatcccggaattcgtcggccgaccgagacatccggacgtcgtcgtcctgccgatcaagccgcccttcctgtcggcggacgtctacgcgctgcatcatcagcgccggaacccggtgatcgacaactttctcgggctgatccgcgaggaggccccgggcttgatcgcgcgcttccagaagcggtga

SEQ ID NO: 4661 - DNA, 912 bp, Methylobacterium sp.
atggaactgcgccacctccgctacttcgtcgccgtagcgaagcacctgagcttcaccgccgccgcggacagcctcggtgtcgcgcagccgccgctcagccagcagatccgggatctggaggccgagatcgggacggccctcttcgagcggaccacccggcgcgtggcgctcacgcgggccggtcacgactttcacattcaggcgatcgggctcctggagcgggccgccgaagccgtcgagcgcgcccgggcgatcggcgcgggcactgccggcatcatcaatgtcggcctgacgggctcgatgctcgccgggccgctcgggcacgcgatccgggatttcgcgcaggtctatcccgcggtggatctccggatccacgagatgtcgccggatcgccagatcgcgatgctgaaggcgggccagaccgatgtcagcttcctgcgagccccgccgcaggatggcgatctggtccgggtccgggcgtggagcgagaccgttcaggtcgtccttccgcgagggcaccgtctcgcgcggggcaggctaaggctcgccgacctgcgcgacgagcggttcgtgttcctccggatgtccgattcgctgttcgccaagtatctctgggattgctgcgtcgaggccgggttcgtccccaccatcacccatcaggccgtcgaggcggcctcattgacgagcctcgtcgcatccggcctgggcatcgccatcatcccggaatacgtcgcccggctggcgcatgccgacgtggtctacaggccgctcgagggaccccgcatccgcgccgacgtcttcgcgctgtggtcgcccgcgaaagcggctctggtcggaaatttcgtcgatctggtgcgcgacggtcggaagacgcccgctgatcaggccgaagaccccggctcggcgccatga

SEQ ID NO: 4662 - DNA, 1617 bp, Methylobacterium sp.
atggagcgggtgatcggaggcacggaccggccgtcggcgaccggtggccgggcgcccgcccggacggagccgtcgccctccgggacgctctcccgcacccggaccatcgtcgtgcggctcgaccgccggtccctgcgtggctggcacatccggctcctcgaccagctcgggcagcggcccgaccatcggatccgtgtcgcctgggtcgagcacgcggagggcctgccgccgaacgcggagctcctgttccgcctggaggccgccatccacggcctgccgcggccgggtctagcgaccgcggcggagccggtggccctcgccccctacgaggcgagccccgacgacgcggagcccggcgggagcgcagccgacctcgtcctcgacctctcggacagccccgcggatccgggcccggcgccggcctggcggctcgattacgacgggatgccgggcgaggccggcctcctcgccgccctgttcgcccacggggcgccggtggcggccctgcgcgggccggacggcgcgccggtggcggtcggccgcctcggcaccgagtcgcacacggtgatgctcacggccttcgagggctacctcgcgcggaccatcacgctgatcctcgccgccctggacggcgccgcctcgacggcgctccccgacggcgccggggcacccctgcggcccgcggccgcctacgatctcggcggcctgggcgcccgccgccgggccgccggggggctggcccggcagatcgctcgccggctctacgacctctgcttccacggcccgcactggcgggtgggctggcggcggatcgtcggccccgacctgatcgacctgcgccggcatcccgagggtggctggcaggtccttcccgacgacgggcgtcgcttctacgccgaccccttcgcgatcgcccgggacggcgccgtgaccctgttcgtggaggaattcgactaccgccgcggcaagggcgtgatcgccgcggtggatttcggggagaacgggccccgcggccgcccggagccggtgctcgagctcgagacccacctctcctacccgttcgtgttcgaggcggacgggcaggtctggatgatcccggaatcccacgcctccgggacgatcgacctctaccgggccaccgacttcccgcgcggctgggtccacgaggcggtgctcctcgacggggtcgtggccggggacgcgaccctgctgcagcacgggggccgctggtggatgttcgccacggtccgggccggtggcggcagctactccgacacgctccatctctggcacgcgccgcatttccgcgggccctggacgccgcaccggcacaacccggtgctgatcgatatcggctccgcccgggccgcgggcccgatcgtggcgcgcgacggcggcctgatccggcccgtccaggattgccgccagggctacggtgcggcgctcggcctcgcacggatcctgcgcctcgacgaggaggcctacgcgcagcgggtcgagacgcgcctgtgcccgggcgcggcctggccgggcacgcgcctgcacatgctgagcgccgccggcggcttcgagttcatcgacggatcgcaccgggcccgcacccgccttctgggctga

SEQ ID NO: 4663 - DNA, 987 bp, Methylobacterium sp.
ggagcgggcgcggccgcgcccgctcgtccggcgcggatcctggcgtcccggccggcgcggctcgtcgcccggagcctcgtcggccgcctgtacaggctgtgctaccacgccccgcactggcgcaccgggtggcggaccctccgcgggccggacctcgtcgcgctgggccgccatcccgcggagggctggcaggtgctgcccgacgacgggcggcgcttctacgccgacccgttccctctcgcggtcgacgggacgacccacgtcttcgtggaggagtttccgcacgcgactggcaaggcgatcatctcggcggtccgcttcgggccggccgggcccgaggggccgcccgtcccggttctggaggagccgcaccacctctcctacccgttcgtgttcgcgcgcgcgggctccgtctggatggtgccggagagttccgcggccggcacggtcgatctctaccgggcgacccgctatccgggcggctgggtgaaggaggcgacgctcctctccggcgtggtcgcgagcgacgcgacgctcctcgagcacggcggccgctggtggatgttcgccaccgtccgggacgcgcccgtcggcgccccgcccggatcgggctgccaccacgacgcgctgtatctctggtccgcgcccgacttccgggggccgtacgcgccgcatccggccaatcccgtgctggtcgacccgtccttcgcccggcccgcgggccggatcgtcgcgcgcgacggcgtcctgatccggccggtccaggattgcgcccacggttacggccgcgccctgtcgctggcgcgcatcgaccggctcgacccggaggggttcgcccagaccatcctcgaccggatcgagcccggcccggcctggcccggcagctgcctccacacgctcaacacgggcggcgggatcgagtgcatcgacggctccggtcgggcctcgcgtctcagggcgtatctaaacgcgcggtccggcgcctag

SEQ ID NO: 4664 - DNA, 429 bp, Methylobacterium sp.
atgaaattccacgctctcctcgccgcggtccttctcggaagctcgccggtcatggcccaggcgcccgaggcggtgccgggaacgccggccaccctgaacgacaccctcaaggcgaggttcgtcgcccaggcccccgacgacgtcgtcgcgtccaagctcgtcggcctgagcatccgcaacggcgccgacgagacggtcggctcggtcgccgacgtggtgttcgacgacaagcgcgggatcaagtcctacgtcgtcagcgtcggcggcgtcctgggcctgaacgcgaagtacgtcgccgtggcgccggagacgctgcagctgaaccgccaggacggcggcaagctcgatgcggtgatcgacaccgacaaggaccagctccgggccgctcccgaatacgtctacctcggctccgagccgaccaagaagtag

SEQ ID NO: 4665 - DNA, 501 bp, Methylobacterium sp.
atgcgcaccccgctcctcgcctcggccctcctgctggccggcctcgccaccgcctcggcgcagaccgacggcgccaagccagacggcggcgccgcgaccccagtccccggccagcccgccaccatggccgacagcctgcgcccgaccttcgtggcccaggcccccgacgacatggtcgccagcaagctgatcggctccagcgtcgtcaacggcgccaacgagacgatcgggcagatcgccgatttcgtcctcgaccagaagggtgccgtgaaggcctggatcatcggggtcggcggcttcctggggatcggctcgaaatacgtcgcggtcgacccgtccgtgctcaagctcgaccgcaccgacggcaagaccctccaggcgcggatcgacacgaccaaggaccagctccgggcggcgccggaatacgtctatctcggcaaggagccgccgaagggcgccgcccccgcgagccccgcgggggagccggcctcgaagccgtag

SEQ ID NO: 4666 - DNA, 840 bp, Methylobacterium sp.
atgtacgccaggagcttcggcgcgacgcgcgtctctgtgccggtgatcggccagggcacgtggcacatcgacagttcggaccggacggacgcggtccgggcgctgcgggccgggatcgacgccggcatgacccatatcgacaccgcggagatgtacggggatgcggaggcgatcgtcgccgccgccgtcgcggattgccgcgaggaggtgttcctcgtctcgaaggtggtgccgggcaacgcgacgcgccggggcgtcgcgcgggcctgtgaggcgtcgctccggcgtctgcggacggaccggctggactgctacctgctgcactggccgggccagcacccgctcgaagagacgatcgcgggcttcgaggatctgcgccgtgcgggcaagatcctgtcctggggcgtcagcaacttcgacgtcgaggatctcgatcgcgtccgggccatcgcggggccggaccggatcgcctgcaatcaggtcctctaccacctgaacgagcgagccatcgagcacgccgtgctgccctggtgcgagaagcacggcgtggcgatggtgggctactcgcccttcggcagcggcgacttccccgatccggccagcgcgggcggccgcgtcctggcgggcatcgcgcagaaccacggcacgacgccctacgcggtggccctcgcctacctgacccggctgccggggacgttcacgatccccaagaccggtcgcccggaccgggccgtcgagaacgccggcgcggcggacctgcacctcggcgcggccgagatcgccctgatcgacgcgcatttcccgcgcggaccgcgcccccggatgctgccgatgctgtga

SEQ ID NO: 4667 - DNA, 930 bp, Methylobacterium sp.
ttgccgatcctctccgtccgccaccgcacggtctaccggtaccggcgtccggtcgccttcggcgagcaccggatcatgttccggccgcgcgacagctacgatcagcggctgatcgcggcgaccctcgacatcgccccggagccggcctccctgcgctggctgttcgacgtgttcggcaactgcgtggcggtcgcgaccttcgacacccgcgccgagaccctgaccttcgactgcgggatcaccctcgaccacaccccggagcacgcgccggtcttcccgctggcgccgcacgcgacccactacccgttcggctacggcgccgaggacatgccggacctcgcccgctccatcgagcggcaatggccggacccgcggcacgaggttgatgcctgggcgcggagcttcctgccgccgcagggccgcatcccgactcaggaactgctggccgcgatgacgcgcagcgtgcgggcgaacttcacctacctcgcccgctccgagaagggcgtgcaggacccgctcacgaccctgcgcacgaagctcggctcgtgccgggacttcgcggtgctgatgatggagggcgtccgggcgctcggcatggccgcccgcttcgtctccggatacctgtacaacccgcgcaacgaccgggcgcgccacgtcggcggcggctccacccacgcgtggctgcaggtctacctccccggcgccggctgggtcgagttcgacccgaccaacggcatcgtgggcaaccgcgacctgatccgcgtggcggtgacccgcgatccggcccaggccgtaccgctgcacggctccttcttcggcctcgccagcgacgatctcggcatgcgcgtcgacgtcgacgtggtggagctgcccgccgacgggccggcggcccgaaccgtgcaggggccggagacgtccctggcgcgttga

SEQ ID NO: 4668 - DNA, 1077 bp, Methylobacterium sp.
atgtcagagacccggatcgtgcgggctgccgcgatccagatcgcgccggacctcgaccgcccggacggcaccctggagcgcgttctcaacgccgtcgacgaggccgccgccaaaggcgcgcgcttcatggtcttccccgagaccttcgtgccctactatccctacttctcgttcgttctcccgcccgccctccaggggcccgagcacctgcgcctctacgagcgcgcggtcgccgtgccgggtccggtgacgcaggcggtctccgcggccgcacggcgccacggggccgtgatcgtgctcggggtcaacgagcgcgaccacggatcgctctacaacgcgcagctgatcttcgacgcggacggcgccctgaagctcaagcgccggaagatcacgccgacctaccacgagcgcatgatctgggggcagggcgacggcgccggcctcgccgtggtggagacggcggtcggccgcgtgggggcgctcgcctgctgggagcactacaacccgctcgcccggtacgccctgatggcgggccacgaggagatccacgccgcgcagtttccgggctccctcgtcggccagatcttcgccgaccagatggaggtgacgatccgccaccacgccctggaggcggcctgcttcgtggtcaacgccacggggtggctcaccgacgcgcaggtcgcgcaggtctgcccggacgagcgcctgcgcggcgcctgccgcggcgggaactgcaccgccatcgtctcgcccgagggcaagcacctcgccgatcccctgggaccgggcgagggaattctgatcgccgacatggatctcgcgctggtgaccaagcgcaagcggatgatggactcggtcggccactacgcgcggcccgaactcctcagcctgctccacgacgaccgcccggccgcctccgtgcagcggccggcccgttcgcagaccgccccccggagccccgaccatgagcagcagcccgcttccgacgcgccgtcccgcgttcccgccggcccagacgggcctgatcgggatgccgacggagcgcctgatcaacgcgttgcaatcctgcggcgttag

SEQ ID NO: 4669 - DNA, 1008 bp, Methylobacterium sp.
atgtcggttcgcgagcgcctgcgcggcgccctctcccatcttgtcccgcaacgcccggcgcggcgcgtcattgtggccggactggtcttcgcgcccctggcgatcgcgggcccggcccgcgaggcccgggccgacccggtctttccgggcgccggcgccctcggcctgacgccgccggccgggatgagcgtgagccggcgcttcgccggcttcgagcatccggccggtgcgtcgatcatcctggtggagatgccgccggaggcgtgggaccagatcaacggccggttcactcccgaggcgctggccgccacgggcttccgggtgaagggcggggccgagcccctgccggtcgctggcggtgagggcttcgtcctgcgcggcacccagccggccaacggcctgacctacgccaaatgggtcgccgtcgtgcgcggcgcccccggaaccgggctcgtcaccgtgcaggtccccgagaaggcggcccggcaggtgcccgccgcttccgtcgaggcggccctccgcacgatcgcgttccgggcgaaggcgagcctgaccgatcaggtcgccgcgctgccctacacggtcggcgacatggcgggctaccggccggccgcggtcttcgcgggcaacagcctccttctcaccgagggacccaaggacgtcgatcccgagcgcgagcagccggtgatcgtcgtcgcgccctcgctcggtcaggcgccggtcccggcgggcgcggaggtcgcggtcgcccgccggctgttcgcggcgcagaaggacttcgccgacgtgaacgtcacggacgaggcgcggtccagtcgcggcgaggcggtcgtcgtgcggctgcgcggcaccgggaccgacaccaagagcggccgtgcgctcggcgtgacgcagacgatggtgttcgacggcaagcgctacctgcgggtcctgggcttcgccgatgccggtcgccccgacgccctggacagggccgaccgtgtcgccgcctcggtcgcgatgcgctga

SEQ ID NO: 4670 - DNA, 240 bp, Methylobacterium sp.
atgccgctcaacatccgcagtgaagaggtgaatcagctggccgagaagctggcatcgcgggccggcgtgagcaagaccgaggcggtgcgactcgcgctcacgaacgagctggcgcggcgggacgcggagcgcgagaccttcctggagcgggtcacgcagattcaggaaaggctggcgtcctacccgtcaacgggcctccaggcagacaaggcgttctacgacagcctgaacgacgagtga

SEQ ID NO: 4671 - DNA, 2232 bp, Methylobacterium sp.
atgtcgtttcgttccgctccgtccggtctgctcctcgccaccaccgctctgtccaccgtcgccctcgtcccggcggccgccgcgcagggcgccgccgtccagctcgacgagatctccgtggaggccgcccgcccggccgccgcggccccgacgggcggcgtcggcggcggcggcaatgtcaaccgcggcgacggcggcggcgcggccaccagcggcggcggcggcggcccctccggcgtcaccggctacgtggcgcgcgtgagccccgcggcgaccaagaccaacacgcccctgctcgagaccccgcaatcggtctcggtggtcacccgcgagcagctcaacgaccgcaacgtgcaggatctggcccaggcgatcgcctacacgccgggcgtgtcgagcagcgtgttcggcttcgatccccgctacgatgccttctacatccgcggcttcagcgcgacctacaacggcatcttccgcgacggcctgcgcctcaatgccgtcggcctgacgatcccgcgcagcgagccctacgggctggacgcggtcaccatcctgaggggtccggcctcgggcctctacggtctcggctcgcccggcggcatcgtcgactcgacctcgaagcgcccggtcttcgtacccttcggagaggtgcagttccaggccggcaactacgaccgcttccagggcaatttcgacatcggcggcccggtggcgggcaccgacgggacgatggcctaccgcgtgaccggcgtgaagcgccagtccaacacctacctgcccggcggagacgacgaccgcaccttcatcgccccgtccttcacgtggcgcccggattccgacaccagcttcaccttcctcagcgagtatttcgagtcgcgcctgccgggaacgtccttcttctacaacgatccgggcttccgggtgaccaatttctactccggcgatccggcgctcaaccagtacaagcagcagcagtatcgcgtcggatacgccttcgagcacaggttctcgccggatctgatcttccgtcagaactttcgctactatgacgttcgcgcggattacgattacacctcgatcacggggctgaacccggcccggaccctgggcgcgcggacggccggcgcctacctggacacgctgggccagatctccctcgacaaccagctcgagggccgcttcgccaccggtccgatccagcacaccctgatcggcggggtcgattacgcccattacgactacacgcgcgccttcggtttcggggccgcgccggacctcaacctcctgaccctgaactacggccagcaggtgatcgcccggccgcgctacacgaacttccagagtcaggcgcaggatcagatcggcgcctacttgcaggatcaggccaagctcgggcgcttcgtgctgaccctcaccggccggcacgactgggtcttccagaacacgagcgaccggacggccgacacggtcgccgaccagaccgaccgggccttctcgggccgcatcggcctgaattacctgctcaccgacttcctggtgccctacgccagctacgccacgaccttcacgccgcaggtcggcatcgacgtgaacgggaacccgttcaaggccgcgaccggcgaccagatcgaggccggcgtgaaggcggccatcccgaacaccaacatcacgacgtcgttctcagggttcgacatcgtgcaatcgtcgctcctgcggcaggatcccaacaacatcgccaatcaggtcgcgaccgggtcggccgagtccaaagggttcgaggccgagctgacggcgaacttcgcgccgggaaccaacctgacgctgtcctacacccacctcaaccttcgctatctgcgccagacctccctggtcaccgggcggccgatcgacggcaacgccctctcggggatcccgggcgacagcttcaccgccttcggcacctatcagttcgcgcccggctcgccgctggccggcctgcagctgggcggcggcatccgctacgccgggacgagcttcgccgacgacgagaacaccgtccgcaacccgaccgtgaccctgttcgacgcgctggtcgcctacgatttcgcggccctcgacccgaagtaccggggtttccgcgcgcagatcaacgcgtcgaacatcttcgaccgcagctacacgacctgccaggccgggttctgctatcgcggcgcgcccgcgacggtcatcggcagcctgatctaccgctggtag

SEQ ID NO: 4672 - DNA, 1887 bp, Methylobacterium sp.
gtcctcaacgcccgccccgtcacgcggcccggcgaggtgctggaggcggtgccgggcctgatcgtcacccagcacagcggggaggggaaggccaaccagtacttcctgcgcggcttcaacctcgaccacgggaccgacatcgccatcagcgtcgacggcatgccggtcaacatgcgcacccacgcccacggccagggctacgccgacctcaacttcctcatccccgaactcgtcggcgcggtggagtaccacaaggggccgtacttcgtgcgcgacggcgacttcgcctccgcgggctcggtgcgcatcgactacctcgacaccgtgcgggagaacctcgcgctgacctcgatcggcagcttcggctacaagcgggccctgtcgatcgcctcggccccgctgggcgagggcaccctgctggtggccggcgaggcgcaggtctacgacgggccgtgggccgtcccggacgcgctgcgcaagctcaacggcgtcgcccgctacagccagggcacggcgctggacgggttcgcggtcaccggcatggcctacgcgtcccgctggacggccaccaaccagatcccggagcgggccgtcggcgcggggctgatcggccgctacggcaccctcaaccccacggatggcggcgacaccggccgcttctccctgtcggggcggttcagcgcgacggacgacaccggcatcacccgggcctcggcctacgtgatccgctaccagatgaacctgttcaacgacttcacctacttcctcaacgatcccgtcggcggcgaccagttccaccagctcgaccagcgcgtcctcggcggcggcgaggtgctgcacatcttccagggcgacctgttcggccggccgctggaggtcgaggtcggcgcccagacgcggacggactcgatccgcgtcggcctgttcaacaccgccttccgccagtaccgctcgaccgtgctcgacgaccgcgtgctggaatcgagcggcgccctctacctcgacacgcgggtgcgctggaccgagtggctgcgcacgagcgtcggcgtgcgggcggacggctactacgccgatgtccgcgcggacacgccggcgaactccggacgggccaccgacggcatcgtcaacccgaagctcggcctcgtgctcggaccgtggtccgacaccgagctctacgtgaattacggcggcggcttccactcgaacgacgcgcgcggcgtcaccgccacggtcgatcccgcgagccccctgttcaacatcacccggtcgcccttcctggtgccctccacgggctacgagctgggcctgcgcaaccggtcgatcgccgggctggagacgagcctcgccctgttccggctcgacttcgcctcggagaacatcttccagggcgacaccggcaccacggagccgagccgctcgacgcgccggttcggcgtcgagtggacgaaccgctacgcggtgacgccgtggctgtccctggacggggatctgacgatcaccaacacccggttctccagctacgacccggcgggcaaccgggtgccggaggcccccacgaccatcgcgtcggcgggcgtgaccttcggcgagcccctcggctggttcgggagcctgcgggtccgctatttcgggccgcgcccgctcatcgaggacaacgcgatccgctcccgggcgaccgccctgctcaacggccgcatcggctacctgttcgacaccggggtgagcgtctcgctggatgtgctcaacctgacgaacagcaaggccgaccagatcacctacgcctacgtctcgcgccttccgggcgagcccgccgaggggttgatcgaccgcgtcttccacccggtggagcccacggccgtgcgcctgacgatcgccggacggttctga

SEQ ID NO: 4673 - DNA, 480 bp, Methylobacterium sp.
atgagcaagggatatccctcgatgacggccctgctgggactgctcgcggtggcgggctaccagaacagggacaagatcgccgattggctcggtgccccgtcccgcgacagctacgacgcgaccctcacaccggcctcccggaccaccccggtggccaactcgtcgatgccgtccaacttggagcatgtcctgggcggcgtcggctcggccggcgtcggcggactgatcgccagcgggctggccgagctcgtcgagcacttcaccaagggcggccacggcgagacggcgagctcgtgggtcaatcagggcgacaaccgctccatagccgaggcggaccttgagcgcgccatcggccccgagacgctcgaccacctcacgcagcagaccggcctgagccggcccgccctgttgtcccgcctgtcgcgcgagctgccctctgccatcgaccgctacgccaccgagggccgccgcttcgcctga

SEQ ID NO: 4674 - DNA, 456 bp, Methylobacterium sp.
atgaccgccctgctgggcctgctggccgtggccggctaccagaaccgcgaccggatcgccgagtggctcggcggccacgccaaggacgcgtcccggtcgccggcgccgcaggtcccgcccgcgacgggttcgaccatcccggcgaacctggatcggctcctcggcggcgccagcgcgggcggcgtcggcggcctcatcgccgggggcctgaccgagctggtcgaccatttcaccaagggcggtcacgccgagacggcccagtcctggatcaatcacgggccgaaccgcgacatcccgaccgcggatctggagcgcgccatcgggccggacacgctggcggccctggagcagcgcaccggcctgagcaagagcgagctgctggcgcgcctctcgcgcgacctgccctcggccatcgaccgctactcgcccgacggacgcctgccggctttcagctga

SEQ ID NO: 4675 - DNA, 1077 bp, Methylobacterium sp.
atgggccggatactcctcatcacggacgatcccgcacgcagccagggcctggcccaggacctgtccgatggcctgtcctgtgagctccacgatctgcgcgccgcggaattgcccctcggcggcgcgaccgcgatcgtcaccgacgtccacgatctgggtacggcctccgtcgagcgtctccgccgccgtctcgcggaggtccggcacggggctccgctgaccgtcctgctccacaccgacagcccgcgaacccggctgctcggcgtcgccctcggcgcgacccacacgctgtgcgcgcccttcgacacggatcgcctgcgggagacgctgggtgcgccgcgcgcgcccgcgcgcctcgcgaccttcgccgacgagcccctgccagcctgcgccgtgcggacggccgcggcggtgcgcgggttctacgcctcggtgttcgtgcccgaccagccgatcacgcccggcgtcatcgacaacggaacccaggccatcgacctcgcgatccgggacaccgggatccgcgactgggtccgggcggtccggcagttcgacgacgccacgcaccagcactgcctgctggtcgccggtctggcggcggccttcgcggcgagcctcggcctcggcgagcaggagcgccaccgcctgaccaaggcggccctgctgcacgacgtcggcaagatccacatcccggccgcgatcctcaacaagccggggcggctcgacgacgccgagctggccgtcatgcggctgcatccggagaagggctacacgatgctcgtcgatcagggcttcgagcagcagatgctgcacgtcgtccggtcgcaccacgagatgctcgacgggtcgggctatccggaccggctcaagggggaggagatccccgacctcgtccgcctcgtcaccgtctgcgacatccacgcggccctgatcgagcagcggccctacaagcagcccatggcgagcgaggcggcctacgcgatcctggagggcatggcggggcggctcgacccggcgatcgtcggcgcgttccggccggtcgtcgccgccttcgcgccccacaccctcaacgcggcctga

SEQ ID NO: 4676 - DNA, 1065 bp, Methylobacterium sp.
ttgggccagaccctgatcctgaccgacgatgtcgagcgcgccgagaggctcgcgcgcaatctcggcggcgtcacgcccgttgtgctgcacgacctctacggcgacgccgtcccgccgcggggggcggggctgatcatcagcgacgtcagcgcgctgacctccgaatccgtgcgccggctgcgccaggcgctgtccaccgcgcgcgggcccggcatcccgttcctggccctgatccacggcaacctcggccgcggcgagatccaggccaccgccctcggcgcgacccgcgcgatgccggccgccgcggtcagcgccatgctgctgaacgcggtcgcgaccctgatcggcaccgccaaggccccgccgcagaccggcaactggcaggagcaggtgaacgaggcccgctcggccttcgtcagcctgttccgcgccgatcaggcgcccccggccgcgctggtcgagaacggcgccgacttggttaaccaggcgatccgcgaggccaaggtgcgcgaatggctcagggtcgtggcgagcttcgacgacgtcacgcaccgccactgcctgagcgtggccgggatcgcggccgagttcgcgcgcgtcctggggctcaacgaggcggattcccgctacctcgtcaaaggcgcgctgctccacgacatcgggaaggccaagatctccctcgcgatcctgaacaagcccgcgccgctgacgccgacggagcgcgccgaaatggctcgccacccggcgctcggacacgagatgctgctgacgggcgactacgacgcgctgaccctgtcggtggtccgctcgcaccacgagtatctcgacgggtcgggctatccggacgggctgcgcgggcagcagatccccgacctcgtccgcctgatcaccatcgccgacatcttcgccgcgctgatcgaggcgcgcccctacaaggcgccgaaggccccgcgcgaggcctacgccatcctcgaatcgatgagggcgaagctcgatgcggacctcgtccgcgccttcggagcggtcgcggtcgcctgcgagacgccccgccgcgcctccgcctga

SEQ ID NO: 4677 - DNA, 723 bp, Methylobacterium sp.
atgcttgaggtcacgggtctgtcggccggctacggccaggtcgaggtgctgcacggcctcgacttccaggtcccgaagggccaggtcgtggcgctgatcggctccaacggggccggcaagaccacaacgatgcgcgccctgtcgggcatgatccgcccgcgggccggctcgatccgcctcaacggacaggagatcggcgggctcgagagtcacgacgtggcccggttcggcctcgcgcactcgccggagggccggcgcgtcttcccgacgctctcggtcgaggacaatctgaccctcggtgccttcccgcgcctgaccggctcgcgtccgaagggcgacgtcgcggccgaccgcgagcgggccttcgagatgttcccgcggctcaaggagcggcgcgcgcagctcgccggcacgctctcgggcggcgagcagcagatgctcgccatgggccgggcgctgatgctgcggcccgagatcctcctgctcgacgagccctcgatgggcctcgcccccaagctggtcgaggaggtcttccggatcatccggctgctcaagtccgagcaggtgacgatgctcctcgtcgagcagttcgctatggcggcgctcggcgtcgccgaccacgcctacgtgctggagaacggccggatccgcttccagggcccggcgcagcagatgcgcaacgatccggccgtgcgagcggcgtatctcggcggcagccactga

SEQ ID NO: 4678 - DNA, 705 bp, Methylobacterium sp.
atgcttgagatccgcgacctcgtctgcggctacggccacgtcacggcgctgaagggcctcacgatcgacgtgcgcgagggccagctcgtcgccctcgtcggcgccaacggcgccggcaagtccacgacgctccgggcgatctccggcctcgtcccgccgcgctccggcgcgatccggttcgccggccgggacatcgcgggggcggagccccgccggatcctggcggcgggcatcgcccattgcccggagggccggcgcgtcttcccgcagatgacggtcgccgagaacctcgccatgggcgcctacctgcgccgcgaccgggcggcggtcgcggcggacctggcgcgcatctacggggagttcccgcgcctcgcggagcgccgcgaccaggcggccggcacgctgtcgggcggcgagcagcagatgctggcgatcggccgcgcgctgatggggcgcccgaagctcgtgctgttcgacgagccctccctggggctcgcccccaacatcgtcgagcggatgttcgcggtgatcggggcgatccgcgacgccggcacgaccgtgctcctcgtcgagcagaacgccttcgcggccctggaactctgcgactacgcctacctcctcgagaccggccgcatcgtcctcgaggggcgcgggcaggacctcatcgccgacccccacgtgcgggacgcctatctcggtggttga

SEQ ID NO: 4679 - DNA, 390 bp, Methylobacterium sp.
atgcccttcatcaatgtcaaagtcgcaggtgcgcccctcgcacccgagcagattacggcgctccaggcgggcatcacccgactgatggccaccgtcctgcacaaggtcgcgcctctggtcggcgtactggtcgaggaggtgtctgccgcgggatggagcgtcggtgccgagccgattgcccgcgccgcacaagtggatgccgtcatcagcgcggacacgaacacgcccgatgagaaatcgcgtttcatctatgaagtgaaccagctcctgaagaccgttctcggggccgaactggcggaggtgtcctacatcgtcatccacgaggtgccgaaggacagctggggttacgacggcctgacccaggcggagcgcgggcgtggccgggcatag

SEQ ID NO: 4680 - DNA, 2673 bp, Methylobacterium sp.
atgaccaagcccgacagcgtgccgccgcacctcttcgagaccgccgagggccgccgtctcgtcgaggcccgctccgatccggcgtggcgccgctgggggccgtacctcagcgaccggcagtggggcacggtgcgggaggattacagcccgaagggcgacgcctgggactacctgccccacgaccacgcccggtcccgcgcctatcgctggggcgaggacgggatcggcggcttcggcgaccgccacctgaactggtgcctgtccctggcgctgtggaacgggcgcgacccgatcctgaaggagcggctgttcggcctgaccaaccaggagggcaaccacggcgaggacgtcaaggaactctactactacctcgacggggtcccgacccacgccttcatgcggatgctctacaagtacccgcaggccgctttcccgtacgggcgcctggtcgaggagaacgcgcggcgcggcctcgacgacccggaattcgagctcctcgacacgggcctgttcgacgcgggccgctacttcgacgtcgagatcgcctacgccaaggccgcgcccgacgacatcctgatgcgggtgaccgccaccaaccgcggcccggacgccgcggacctgacgctgctgccgcatctctgggcccgcaacacgtggtcgtggaagcagggcacgccgaagccggaactcatggccgggtcggagggctcggtctgggcgcgccaccccgagatgccgaccttccggttcttcgccgagggcgcgggcgacctgctgttcaccgagaacgagaccaacacgcaccggctgttcggcagcggccccgccgagggcttctacaaggacgggatcgaccggtgcgtcgtgggcggcgaccgggccgccgtcaacgccctgtccggcaccaagtgcgccgcccgctacgacctgcatctcggccccggcgagacgcggaccgtgcgcctgcgcctgcgcgccgagaccgcgccgggcgcgcccttcgcggatttcgacgccgtcttcgccgcccgcgagggggaggccgacgacttctacggggcgctccaggcgccgatcgccgatcccgagatgcggctcgtgcagcggcaggcgctcgccggcatgctctggtcgaagcagctctaccattacgacgtgcgcgagtggctcgccggcgacccggcgcagcccgcgcctgcgccggagcggcggcacggccgcaacagcgactggtcgcacctgcgcgccaacgacatcatctcgatgccggatgcctgggagtatccctggttcgcctcctgggacctcgctctccaggcgatcgtgttcgggctcatcgacccggacttcgccaagaaccagctcctgctcctggtcgacgaggcctacacccacccgaacgccgcgctgccggcctacgagtggggcttcggggacgccaatccgccggtccacgcgctggccgcctggcgggtgttcgagctggaccgggcgctcaccggcaaaccggaccacgccttcctcaagcggatcttcaacaagctcaccctgaacttcacgtggtgggtgaaccggaaggatgccgacgaccgcaacctgttccagggcggcttcctcggcctcgacaacatcgggatcttcgaccggtcgaagccggtgggggacggcgccacgctgacccagtccgacgccacggcctggatggcgacctacgcgctgaacctgatgcggatcgccatcgagctcgccctcgaggatccgaccttcgaggacatggcggagaagttcttcgagcacttcctcctcatcgcaggcgccacgggcgcgggcgtctgggacgagccggacggcttcttctacgacgtcatcgagacgagggacggtcagcgcctcccgatccgcgcccggaccatggtcggcctgatcccgatcttcgcggtggcggtgatcaacgagtgcgacctcgcgcggctgccgtccctgcgcaaccggatggtgttcttcctgaagaaccgcccggacctcgcgaccctggtctcgcgctggaacgagcccggcgagggccagacggcgctgctgtcgctgctgcgcgggcaccggctgaaggccctgctccaccgcgcgctggacccgaacgagttcctgtcggattacgggctgcgcgccgtgtcccgcgtctacgcggacgagccgttctgcttcgcctgggacaggcgggacctggggctcgcctacgagccggccgagtcgcgctcgcggctgttcggcggcaactcgaactggcggggcccggtgtggatgccagtcaactacctgctcatcgcaggcctgaaccgcttccacgactattacggcccggatttccgggtcgaggcgccgaccggatcgggccggacctacgcgctccgggagatcgccgcccacctgtcacggcggctgatcagcctctcgacccgccgtccggacgggcgcaggccggtctacggcgacagccggatcgagcaggaggatccgcatttccgcgacctcgtcctgttctacgagtactaccacggggacagcggccgcggggtcggcgcgtcgcaccagaccggatggtccgggctcgtggccctgctgatccaggaggtggcgaccgccgctgccgaggcgcagaatccgggctggccgtga

SEQ ID NO: 4681 - DNA, 2646 bp, Methylobacterium sp.
gtggactgggccgagcgccgccggatcgccgagcagggccggggcgaccgggcgtggtcgctctggggcccctacctcagcgagcggcaatgggggaccgtgcgagaggattacagcccctgcggcaacgcctgggccgccctgacgcacgaggacgcccgctcgcgcgcctatcgctggggcgaggacgggctggccggcatctgcgacgagcgcggcaacctgtgcctggccctcgccctctggaacgggcgcgaccgcatcctcaaggagcggctgttcggcctgaccaaccaggagggcaaccacggcgaggacgtgaaggaggtctaccactacctcgacgcggtcccgagccacgcctacctgaagatgctgtaccgctacccgcaggcggccttcccctacgcggacctcgtcggcgagaacggtcggcgcgggcgggagcagcccgagtacgagatcgaggagacgggcgtcttcgacggggaccggttcttcgacgtcaccgtggagtacgccaaggccgacgccgacgacgtccacgcggtgatcaccgcgctgaaccgggggcccgagcccgccgacctccacctcgtcccgcagctctggttccgcaacacgtggtcgtgggaggccgggcaggcgcgcccgcggatcgcccgcgcgcccgacgggggcgcgatctgcacgcacgagcggctcgggccgtaccggctcgccttcgacggggcgccggacctgctgttctgcgagaacgacaccaacctgcggctgcacggcgggcagccggacgccgcggggccgttcaaggacggtctccacgcggcgatcgtcgacggcgatcccgcctcggtgcgccgggacgcgggcaccaagctcggcctgcactacgcgctgcggctggcgcccggggagaccgcccggatccgcctgcggctgtcggcgggcctgcgcgcccgggccgtcgacgacgggtccctggtccgccgccgggtggccgaggcggacgcgttctacgaggaattgcaggacggcatcgcgagcccggagtcccgcgcgatcttccgccaggccgccgccgggctgatctggtcgaagcagctctacagctacgacgtgcggcgctggctggagggcgacccgctccagccgccgccgccccgggggcgcgcgggcggccgcaacggccagtggcgccacttcgcggcggccgacgtgctgtcgatgcccgacacctgggaatatccctggttcgccgcctgggacctcgccttccactgcctgccgctcgccctgctggacccggacttcgccaagaagcagctcctgctgctcacccgcgaatggtacatgcacccgaacggccagctcccggcctacgagtgggagttcggcgacgccaatcccccggtccacgcctgggccacctaccgggtgttcgagatcgaccgggaccggcggggcgggggcggcgacctcgccttcctggaaggcgtgttccacaagctcctgatcaacttctcctggtgggtgaaccgcaaggacgcgcagggccgcaacgtgttccaggggggcttcctggggctcgacaatgtcggcgtgttcgaccgctcgcgcccgcccccgggcttcggggtggtgcaccaggccgacggcaccgcctggatggcgatgtacgcgctgaacatgatgcgcatcgccctggagctcgccctccacaacgacgtctacgagagcaccgcctccaagttcttcgagcacttcctgctgatcgccgaggccatgaccgacatgggcgggtcgggcggagacgggcagggctacggcctgtgggacgagaccgacgcgttctactacgacgaggtcgacatccccggcggcgggatgctgcccttgcgggtccgctccatggtcgggctggtcccgctcttcgccgtcgaggtgatcgagccctccgtgctccaccggctgccggatttcgcccggcgcctgaactgggtgctggagaaccggccccacctcgcccgtctggtctcccgctggaccgagggcggcgtgaaggaccgcaagctgctgtcgctgctgcgcggccaccggatgaaggcgctgctgcgccggatgctcgacgaggccgagttcctctcgccctacggcgtgcgctccctgtcgaaggtgcaccgcgacgcgccctacgtgctcaacgagctcggcgcctccttcacggtccggtacgacccggccgattccacctcgaacatgttcggcggcaactcgaactggcgcggcccggtctggatgccgatgaacttcctcatcgtcgaggcgctccggcgcttccacacctattacggcgacgacttccgggtggagtacccgacgggctcgggcgcgatgctgacgctcagcgccatcgcggacgccctggaggaccgcctgatcgccctgttcgccaaggacgagaccggacgccggccggccttcgggacccggccgccgatcgccccggcgccgggcgccgaggaggcgctgctgttccacgagttcttcgacggggatacggggcggggcctcggcgccgcgcaccagaccgggtggacggccctgatcatcaacctgctgcgcgaccgggcgcgcgcccggtaa

SEQ ID NO: 4682 - DNA, 990 bp, Methylobacterium sp.
atgaccatcgcgggccgcaccgtgatggtgccggtccacacggaggccgccttcgattcacccttcctggtgcgcccgccggacccggacgggatcgcggtgatcgagcacgcgggcgtcgtaattggccacgtcaccttcccgggccgcccgcgcttctacgccctctccaccttcgacggcgtgccctacgcgaagatcgccgtcctgcacgggcgcgacgtgctggccaccacggtgctgcagacctgcatccgctaccagagccgcgcaaagacctgccagttctgctcgatcggccagtcgctggcggccggccgcacggtggcccgcaagacgcccgagcagctcgccgaggtcgcccgcgccgccgtgctgctcgacggcgtgaagcacatggtcatgaccaccggcacgccgaacgccaccgaccgcggcgccgcgatcctgtgcgagagcgccttcgccgtgaaggccgccgtcgacctgccgatccaggcccagtgcgagccgcccgacgacgaccgctggttcgagcggatgaaagcctcgggcatcgacgcgctgggtatgcatctcgaggccgtcacgcccgaggtgcgggcgcggatcatgcccggcaaggcgagcgtgccgctggagcggtactacgacgccttcgcggccgccgtcccggtcttcgggcgcggccaggtctccacctacatcctcgccggcctcggcgacgcgccggaggcgatcctcgcgatggccgaccggctgatcgggatgggcgtctacccgttcgtggtgcccttcgtgccgatctccggcacgccgctggagagccatccggctcccgggcccgacttcatgcacgccgtcctgaagccgctcgcggagatgctggggcgggcgaacctgcgctccaccgacatcaaggccggctgcggccggtgcggcgcctgctcggcgctctccacctacgagcgcgcgggggaggcggcctga

SEQ ID NO: 4683 - DNA, 774 bp, Methylobacterium sp.
atgaaccgggcggacgtggttcgcgccgcggcagggacgagcgtcatcgtccacgcggtgaacccgcccggctatcgcgggtgggaccggctggtcctgccgatgctcgacaacacgctcgcagcggcgcgggacgcgggcgcccggatcgtcctgccgggcacgatctacaactacgacccggccctcgcttcggtgatcgatgagacaaccccggaaaaaccgcgcgggcgcaagggcgccatccgcgtcgagatggagaagcgcctggcggaggccgccccggaggtcaggagtctcgtcgtgcgggcgggcgatttcttcggaccgggggtgggccagagttggttcgcgcaggccctggctaagccgccgctcgcgcgcatcgtcaatcccggcaagcccggcgtcggccatgcctgggcgtacctgcccgacctcgccgaggccatccttcgcctgctcgaactgccgccggatcggctaaggccatgcgagcggctccagtttcccgggcatgacgatgccgacggcggcaagatggtcgctgcggtccgccgcgcctcgggtcgccctgacctgcccgagcgccgcttcccctggacgctgatgcgggcgctcgccccgttcggcgggtttccgcgtgaagtcatggaggttcgccccttctgggcgtaccctgtgcgcctcgacgggcggcgcctgtcgaccttgatcggtgatcctccgctaacgccgctcgaccgggccgtcgccgcgtcgctgcgcgggtag

SEQ ID NO: 4684 - DNA, 471 bp, Methylobacterium sp.
atgacggcgctcctgggcctcctcgccctggcaggctaccagaaccgcgacaagctcgcggaactgctgggcggcgccggtcagaccgcgccggcgggccccggcggccaggccgacggctccaacagcggctccaacggcgcctccggtgccggcctgggcggtctcctcggcggcctcctgggcgaccggcgcggcgaggctcccggcgggttcctgcacagcggactcggcgagatgctggaccgcttccagcaggccggtcacgggacggccgcccagtcctgggtcaaccagggaccgaaccagaaaatcgcgccgcaccacctggaacaggcgatcggacccgacgtcctcgcggctctcacccagcggacgggactgtctcgcgatgagctgctctcccggctgtcccgcgagctcccccgggccgtcgaccgctacacgcccgacggacggatcccggcctga

SEQ ID NO: 4685 - DNA, 1278 bp, Methylobacterium sp.
atggcgacggacgagacggccgacaccgtggtggtcggcggcgggatggtcggcctcgccagcgccatcgcgctgagggaccgcgggctcgacgtggtcctgctggatcccggcgaggcgcgggcccggacttcctacggcaatgccggcgtggtcagccgcggctcgatcctgccgatgtcgagcccggccctgtggggcaagctcccggcctacctgcgcaacgccgatcgcggcctgcggctgcactacgggcatctcccgcggatcgtgccctacacggcgcacttcctcgccgccgcgcgcgcctcgcgctggcgccgcgccgcggcggcgctgctgccgctgaccagcgccgcctatccggcccacgagcgcctcgcggcccgggccgggaccggcgaccggctgcagcggaccggctggatcaaggcttaccgcaccgaagcggccttcgcgtccgccgccctcgagcgcgagatcctggccgggcacggggtcgccttcgacatcctcgacaccgcggcgctgcgcgcgctcgagccggcgctggtgcggccctacgcgcgggccatgctgctcaccgagacgggatcggtccgcgagcccggccggctcatcgaggcgtgcgaggccctgttcaccggtctcggcggccgccgcctgcgaggcagcgtcgcccggctggaacccgaggtggacggctggcgcgtcgatcacgacggcggcgcggtacggggccgacaggtggtcctcgcggccggcgccgcgtccggggcgatcgcccggaccctcggctaccgtttcgccgttgcggccgaacgcggctaccaccgccactacgccctgcatccggacagcccgccgctgacccggccgatcctcgacacgggcgcgggctcgatcctgtcgccgatgggcgagcaccgggtccgggtcctgtccggtgtcgaactcaacgcgcgcgccgccgcgcccgaccacacccagatcgatgcggcgtcccgggaggcggcctccacccttcggctcggcgggccgctggacaacgcgccgtggctcggctcccgcccctcgacgcccgacgggatgccggtgatcggccgcgcaccccggcacgacggcctgctcttcgccttcggccacggccatatcggcctgtccaccggcccgatcaccggcgagatcgtcgccgacctcgccacgggtcgggaaccggccgtgccggtcgcggccttcgcaccggagcggctcctgcgatggccgcggctgctctga

SEQ ID NO: 4686 - DNA, 690 bp, Methylobacterium sp.
atgcccggagaggggagcaactgggccggcggcgacctgtcccgccacgagcggctcgtcgaggaactcgcgggcgggctcgaacccgtgcggccgctgccggccccggaggcccgcgcggccctctggctcggcgtgacgctggtgctcggcgtggtcctcgccgcctgggtcgggaccggcggcttcatgctgcgcatgcatgtgccggatctggccctcgcggcggtgggcgccgtgctgacggcgatcacggccgcctacgcggccttcgccaccagcgtgccgggacggtccggccggtgggcgctgctgccgctgccgcccctcgcgctctggatcggtgcgagcgggctgggctgcctgcgcgactggatcgcgccgggggccgagatgcacggcgagcacccgatcacgggctgcttcagcttcctgatctgcgtctcggtgccgctgtccgtgctgatcgtcgtgatgctgcggcgcgcctgcccgctgcggccgaacctcacggccgccctcggggggctggcggtagcggcggcggcggcggcgctgctgatgccggtccacccgcacgacgccaccgccacggacctgctgttccacgcggcggcagtcgccatcgtgatcgcggcgaacggattggccggtggccggctgctcggccagcacgccggggccggctag

SEQ ID NO: 4687 - DNA, 210 bp, Methylobacterium sp.
atgggcgacgacgtggcggcgatcctgttgaccctcgtgaccgagaattccgagctgcgcgagcagctcgccagcgcgcaggacatgctgatggagacggccatcgatgccgggcagctccatgcccggatccagggcctggaggccgagcgcgacgcgtggcgggccgaggccgggcaccggcaggcccgcgccgccctgaccgcctga

SEQ ID NO: 4688 - DNA, 1440 bp, Methylobacterium sp.
atgaaggctggcgggcggggaggacggtcggtcgaccggagcgacgcggccggtatctggacgccggacctcaggcgctgggggaagccccattacctggccatcgccgacgcgctggcggacgacatccggaccggccacctgcttccgggcacgcgcctgccgacccagcgcgcgctcgccgccacgctcgacctcaacttcacgaccgtgtcccgcggctacgtcgaggcccacaggcgcggcctgatcgagggccgggtcggccggggcaccttcgtggtcgacccggcggacgccgcccgcaccgctgagccggcccttccccggcggccgggaccggtcgacttcaccatgaacctgccccccgaacccgacctgcccggcctgcaagcccgcatgcggtcgtccttcgcggagctgtccggcaacctcgccgacctcctgcgctaccagggcttcggcgggacggaggcggacaaggaggccgcgctgcgctggctcgcgggtcgcgggatcgcggcggcgcgcgagcgcctgctgatctgccccggcgcgcacagcgccctgtccagcatcctgggacaggtcgcgcaggcgggcgacacgatctgcgccgagcgcatcacctatccgggcatccggaccctggcggcgcaccggggcctgcgcctcgtcggcctgccgatggaccgccacgggctcgaccccgacgccttcgcggccgcctgcacgcggggggcgccgaaggccctctacctcaatcccctgctgcagaacccgaccaccgcgaccctgtcccgcgcccggcgcgaagccgtcatcgcgacggcccgccgctacgcggtcaccatcatcgaggacgacgcctacgcgcgcatctgccccgcaccgccgccgagcttcgccgaactggcgcccgagatcacctactacgtggcgggcgtcgcgaagtgcctgggcgccggcctccgcctcgccttcctggtcgccccgaacgcgcgggccgccctgcccctcggcgacgccctgcgcgccgcgaccgtgatggcgtcgccgatctcgaccgcgctgacgacgcgctggatcacggacgggacggcggacgccatcgtcgatttcgtccgcgccgagtcggccgcgcgccagagcctcgcggccgcactgctgcccgctgaggcctacgtcgcggacccgcacgccttccatgtctggatcacccttccggcgggatggacgcgctcggccttcgccagccagggccgcgcggcgggtctcggggtggtcggcagcgaccccttctgcgtcgcggggacgccgcccgaggccgtacgcctctgcctcggcggcccctcgacccggcagcagatcgcccacgggctggagaggctggcccacgccctggagggctcgccgacgctggcctcgacttacatctga

SEQ ID NO: 4689 - DNA, 279 bp, Methylobacterium sp.
atgacgaagcgcagcacacccttttcgcctgaggtccgcgaacgcgcggtccggatggtgttcgaccaccagggcgagcacggctcgcaatatggggcgatccgctcgatcgcagccaagatcggttgttcgggcgagacgttgcggaactgggtccggcaagccgagcgggaccagggccagcgacccggaccaacgacggacgagcgcgagcggatcaaagcactggagcgcgagaaccgcgagcttcggcaggccaacgagatcctgaggaaggcg

SEQ ID NO: 4690 - DNA, 1371 bp, Methylobacterium sp.
atgaacgagatcgcccccttcgatacgcgcgtcgatccctccgtgctggccgcacgcctgtcggacgaacgggcgcccgacatcgtcgaggccctgaacgacgaggcacccgaggtcgccgccgccatcctgctcggcctgccgatggagcgggcgatcgaggtgctggaccagccggaactcgactgcgccgccgacatcatcgagatgctgccgcgggaccgggtcgcgggctacctgtcgggcatgtcggccgaccgggtcacggacgtgttccgcgagatcgaggagccgggccgctccgacctgcgcgcccgcctcgacgccgagactcgcggcgctgtcgatcgcctgtctgcctacggcgaggagaccgtgggctcgctgatgaccaccgagttcgtcaccgtgccggggacctggacggtgggccagacgctggagcacatccgccacgtcgagaagacccgggagacgatctacgcgatcttcgtgctcgacccgcgcacccgcgcgctcaccaaggcggtgcccctgcggcgcctgatctcgggggacccgagcgacaacgtgctcagcgtcgcgccgggacgccggccgctcgcggtctcgcccacggccagccgcgaggaggcggcccggctgatctccaagtacgacctcctggcgctgccggtcgtcgacgcggtcggccacgtgatcggcatcgtcaccgtcgacgacatgatcgacgcgatgatcgagaaacagacgcaggacgtgcagcgcttcggcggcatggaggcgctgcccgagccctacatggatatcggcttcttcacgatgatccggaagcgggccggctggctgtgcgcgctgttcctgtcggagatgctgaccgcctcggccatgcagggcttcgagggcgagctggagaaggcgatcgtcctgactctgttcatcccgctcatcatgagctccggcggcaattccggctctcaggcgacctcgctcctgatccgggcgctggccctgcaccagatccgcctgcgcgactggtggcgggtggcgctgcgcgaattgccgaccgggatcttcctcggcgcgatcctcggcgtgatcgcggtgatccggatcgtcgcgtggcagaagctcggcctctacgattacggcgcgcactggcccctggtcgccgccacggtcggcgcggcgctcgtcgggatcgtgaccttcggatcgctcgccggctcgatgctgccgttcctgctccagcggatcggcttcgatccggccaccgcctcggcgcccttcgtggcgacgctggtcgatgtcaccggccttgtcatctacttctcggtggcgctgctcatcctgcgcgggacgctgctgtag

SEQ ID NO: 4691 - DNA, 1074 bp, Methylobacterium sp.
atgtcgacgacggtcgcccttcgctccctgatcaagcgctacggcagcttcacggccgtggacgacatcaccctcgatgtgcccgaaggccagctcgtcgccctgctcggcccctcgggctgcggcaagaccacgacgctgcggatgatcggcgggttcgtcgaggcggatgccggcagcatcctgatcggcggccgcgacgtgacccgtctgccgccggccaagcgcaacatcggcttcggcttccagagctacgccctgttcccgcacatgagcatcgcccagaacgtcgccttcggcctggagatgcgtcgccttccccgggccgagatcgcgtcgcgcgtcgctcgggcgctcgaccgggtgcgcctgtcggcgatggcggatcggctgcccaagcagctgtccggcggccagcagcagcgggtctcgctcgcccgcgccctggtgatcgagccctcggtgctgctcctagacgagccgctctccaacctcgacgcgcagctgcgcggggagatgaagctcgagatccgccagatccagaaggcaatgggcatcaccacgatcttcgtcacgcacgatcaggacgaggcgctctcgatcgccgaccgtatcgtcgtgatgcgcgccgggcggatcgagcaggacggcagcccggaggcggtgttcggtgcgccacgctcgcgtttcgtggcggaattcatgggcgtgacgaacctcctgccggggacggtggagggaccgggcacgttccggctcgccgacggcaacgcgatccgcgttccggtcgctggcgccggccgcggggcgacggtcctggcgatccggcccgagcgcgtccggatcacgccctccggcgcggacaccgcgcccgacacgctggatgccgagatcgaggcggcgacctaccggggtcttgccgtcgagtacaggctgcggaccccgtccggcctgtgcctgacggcgcgccgggcgacccctgcaaccggcggcccggccatgctcgaacccggcgcgcgcgttcacgtcgccgtcccgccggacgcctgccacttcgtccctgtcgaactctga

SEQ ID NO: 4692 - DNA, 882 bp, Methylobacterium sp.
gtgagcgccgggaccaccctgatcctcgacgggatcacccaacgctacgggtcggcgctcgccgtcgacaccgtgaccctcgacatccggggcggggagctcgtcgcgctgctcgggccctcgggctgcggcaagaccaccctgctgcgcgcggtggcgggcttcctgaagcccacggaggggcgcgtcatcatcggcggccaggccgtcgaccacctgccgccgaaccggcgcaccgtcggcatcgtgttccagaactacgccctgttcccgcacatgagcgtcgccgacaacgtcgcctacggcctcgcggcccggggcgtcgggcgggccgagcagagggcgcgggtcgccgagatgctggcgctggtgcgcctggagcacctcgccgggcgcttcccgcgggagatgtcgggcggccagcagcagcgggtggcgctggcccgggcgctcgccgtgcgcccctcgatcctgctcctcgacgagcccttcgcggccctcgacaagaacctgcgcctcgacatgcagatcgagatcaagcgcatccagcgcagcgccggcaccactacgctgatcgtcacgcacgaccaggaggaggccctgtcgatggccgaccgggtcgccgtgctgaacgccggccgcctggagcagttcgcccccccgaccgacgtctacgaccgccccgagacgctgttcgtcaacaccttcgtgggcacggccaacgtcctgcacgggcggctcgcgacggagccgggcggcgcccgcgtggtggccctgaaggcgggcggcctgctccccgccgccacttccctgccggacgggacccgggtcgccgcctgccttcggcccgagcacgtcgccttcgcggaggaggggccgggg

SEQ ID NO: 4693 - DNA, 1086 bp, Methylobacterium sp.
gtggatccgccccgcgacagacccgtcgtcgggcccgcggacccgtcggccgcgtctgaggctgcagtcgaggcggcgtctgaggccgcggccgcgcgcgccctccagcgggcgatcctccgccagcaggccggcctgctggcgcggcaggagcgtgccctcgcggcggccgggatgggcctctggtcctgccgcctgcgcgacggcgccctcgactggtccggaggcgtccacgacctgttcggcgtcccccggggcgcggcgctgcaccggccccggatcctggacctctacgagccggcgtcgcggcgcctgctggagacggtccggcaccgggcgatcgccgggagcggcgccttcgtgctcgacgccgagatcctggccgggggccggcgacgctggatccggatccgcgccgcggtcgagaccgaggacgggcgccccgcccgcctgttcggaaccaagcaggacgtcaccgaggagatcgtccggctggccgaactgagccggcgcgccgagcgcgacccgctcaccgggctggcgaaccgccgcggcttcgaggcgcgattcgaggcgcggttcgaggccgggacggacggcgccggtccggattccttcggcgccctgctgctgatcgacctcgacgggttcaagccggtcaacgacgtccacggccacgcggccggcgacctgtgcctccggcgctcggccgcgcggctcgccgccgtctgccgggacgcggccctcgtggcccgcatcggcggcgacgagttcgccgtgctcctgcgggcgcccgtcgacccgctcgcgctggtggagcgcggccggcgcgtcgtcgccgccctgagccggccgatcccgtatcgcggccgggagttgcggatcggcgcttccgtggggatcgccgtgggcgacgccgcggggatgtccagcgggcgcgggggccgcgcccggctgttcgaccgggcggacgcggccctctacgccgccaaggacgcgggcgggaacgccgtccggatcgtcctcggcggcggccggtcaggcgccggcgctgcgcaggccgcggtcgcgctggggccgggctga

SEQ ID NO: 4694 - DNA, 483 bp, Methylobacterium sp.
atgcctgccgtgaaccgcgagccgcacaagaagggcgacgtcctggtcgactacgaggagaaggtcttcgaggacgtgaaggccgaaccgggccagaaggcgctcgtcaccttccacaccgtcgcgttcgagggctcgatcggcctcgtcaacctgctccaggcgacccgcctgcagcgcaagggcttcgagacctcgatcctgctctacggcccgggcatcaccctcggggtccagcgcggcttcccccggctcggcgacgaggccttcccgggccatctcaacttcaacaaccagctcgagaagttcatggccgagggcggaaaggtctacgcctgccgcttctcgacacaggccctgtacgggcacagcgaggcggccttcatcgagggtattcgcatgatcaaccccctcgacgtgctcgactgcatcctcctgcacaagcgcgacaacgcggtgatcatcgacacctggaccgtctga

SEQ ID NO: 4695 - DNA, 543 bp, Methylobacterium sp.
atgttcgaccccgttccgccgtatcggcccagccacttccgggtgaagttcgcggtcgcaccctgggagcggcgcgcctgcgccgccctgcggcggcaggtcttctgcgcggagcaggggattttcgaggctgacgatcgcgacgcgatcgacgcgcacgccatcccggtctgcgcgctctcgacgctcggcggcgacgcggacgccgtcgtcggcaccgtgcggatccacgaagacggcgcgtgcccgggaacgtggtggggctcgcgcctcgccgtcgccagaccgttccgcagcgccgccgccctcggcacagggctcatccgggtcgcggtgtcctcggcccacgcgcggggctgcacccgcttcctcgcgcacgtccaggagggcaacgtcgcgctgttcgaggccctgcactgggagagcctcgacgcgctggacctgcacgggcggccccaccgcctgatggaggcggacctcgcggcctacccgccgatgcacgatcccgagcacggcctcctcaccttccgcagggccgcgtga

SEQ ID NO: 4696 - DNA, 996 bp, Methylobacterium sp.
gtgaccgccgggatcgacatccgggcgctggcccgccagatccgcgaggcccgcggggtcggccacaagcgcgacatcgacgcggtggtgcggcggctcgggctcgggagccggcacgcggccgtgccggtcggcgacgattgcgcggcgatccccgacggcgacgggcacctgctgctggccatcgagggcttcctcgacagcttcgtggccgacgatccgtacttcgcgggctattgcgggatcatggtcaacctgagcgacgtcgccgccatgggcgggcgcccgctcgccgtcgtcgacgccctctgggcccgggacgccggggccgcagacccgatcctggccggcctgtccgacgcagccgcgctctacggcgtcccggtggtcggcggccacaccaacacccgcgcggccgccggcaacctcgcggttgcggtgctcggccgggcggggccgcgcctgctgacgagcttcgacgccgcgcccggcgacgacctcgtcgccgccatcgacctgcgcgggcgcttccgcgacccgcacccctactgggacgcgtccaccggcgcgccgggcgcgcggctgcgcggcgacctcgcgctgctgccgggcctcgccgaggacggcctggccggtgccgccaaggacatcagcatggcgggcgtcgtcggtacggcgctgatgctgctcgaatgctccggcgtcggcggcgtcatcgacctcgacgcgatcccgcggcccgaccacgtcccgctcgcgcgctggctgacggcgttcccgagcttcggctatctcgtcagcgtccgccccgaccgcacggcggccgtcacggcgcgcttcgccgagcgcggcatagcggcggcccggatcgggggtctcgacgccagtcgggtcgcccgggtgcgggacagctcgggcgccgaggccgtcgtctgggacttcgccgccggcccgctgatcggctgcggcagggatggccgggaggcgacgccgtga

SEQ ID NO: 4697 - DNA, 354 bp, Methylobacterium sp.
gtgaataagtcaatcccgcaggcccgcaacctgcgccgcactcaaacctcggccgaagccaagctctggcgcgttctgcgaaaccgggccctgaacggctggaagtttcgccgacagcacccgatcgaccgattcatcatcgacttcgcctgcatcgaggccggactcatcgtcgaggtggacggggcgacgcattccacggacgtcgagatcgctcgggatgccgcgcggaccgaaatccttgagtcgctcggcttcgccctcctccgcatcccgaatgcggacatccacaagcatcttgaaggcgtgcgcgagaccatcctggcggctcttgaacgccgcgagaccgtgtga

SEQ ID NO: 4698 - DNA, 375 bp, Methylobacterium sp.
atgaaacagacgtccgggccggcgcggaagccggcagaagccgtgatcaaggacattcgacgcgccacgcgccggcagttctcggccgaagagaagatccgcatcgtgctggaagggctgcgcggtgaggacagcatcgccgagctgtgccggcgcgaaggcatcgccagctcgatgtactacggctggtccaaggagttcttggaggccggcaagaagcggctggccggcgatacggcccgtgccgcgaccgccgacgaggtccaggacctgcgtcgcgaggcgggtgcgctgaaggaagtcgtagccgatctcgtcctggaaaaccgcctgctgaaaaaaagtctgaccggggctgggggcgacgaggcatga

SEQ ID NO: 4699 - DNA, 333 bp, Methylobacterium sp.
gtgatcaaggatatccgtcgagccacacgccggcagttctcggccgaagagaagatccgcatcgtgctggaaggcctgcgtggtgaggacagcatcgccgagctgtgccggcgcgagggcatcgccagctcgatgtactacggctggtccaaggagttcttggaagccggcaagaagcggctggccggtgacacggctcgggccgcgaccaccgacgaggtcaaggacctgcgccgtgaggcaggcgcgctgaaggaggtcgtggccgacctcgtcctggagaaccgcctgctcaaaaaaagcatgagcgaggctgggggcgacgaggcatga

SEQ ID NO: 4700 - DNA, 978 bp, Methylobacterium sp.
atggccgagcggcgcatgaccttccggcacatcgaggccttccgggccgtggtggccaccgggtccatgaccgaggcgagccgccggctccacacctcgcagccgcaggtcagccggctcatcgcacagctggaggcaatcaccggcctgcccctgttcgaccggagcgggagccgggtcgtgccctccctcgacgggacgcggttccacgcggaggtcgagcgcgccttcgtgggcctcacgagcctggaatcggcggccgcgcgcatccgcgccttcggtgcggagcggctgcgggtggcggcgatgccgcgactggcgggcgggctcctcgcgcgcgcggtcgtccgcttccgggccgcgcatccggacgtgatcgtggcgatccattccggcgacgacgagaccgtgaaccactggctcgccaccggctcctgcgacgccgcgctgacgatgctgtacggcgacgccccggaggcgcgcgccgagcacgtcgagacgcgcgcctgcgtcgccgtcctgccgcgggaccacgccctcgccgcgcgggaatcgctcgcgcccgcggattttcagggcgtgcccttcgtcgccgcgtcgctcgggagcgccctgcgcgaccggaccgaggccgtcttcgaggccgccggcatcggcctgaccatcaccgccgaggccggcctcggcgcctcgatctgcaccctcgtctcggccgggctcggggtcagcgtgatgaacccgctggccgcccacgaggaggcgaaggtctcgccgatcgcgatccggcccttcgccccggcgctcccggtccatttcgcgctgctgttccccccggaccacgcccgggggcggctgatgcgggccttcggcgcctgcgcgcggacggtcctgctggaggagctcgcccagctgccggacgccgcgatcgggcgcccggccgcctctgctcaggcggcgcgcttctcggcgccagcgtag

SEQ ID NO: 4701 - DNA, 771 bp, Methylobacterium sp.
atgagcttcaccgacacccgcgccctggtcaccggggccgattccggcatcgggcaggcgaccgcggaactgctggcccgcgcgggcgccgacgtggccatcacctatcacagcgacgccgagggcatccgcgagaccgccgcgcgggtcgaggccgcgggccggcgggcgctggtgctccagctcgacgtcggcgacccggcggcggtcacggcggcgttcgaccgcatcggcagcgagttcggcaccctcgacatcctcgtggccaatgccgggcaggccatgagcggcatgccggtcgccgagatggacgacgcggtgctggagcggatcctgcgggtgaacctcatggggccgctgttctgcgcccgccccttcatccggatgcgccgggctcagggcggcaacgggaagatcgtgttcgtctcctccgtggcccagcacctgcccacgccggagagcgctccctacggcatgtcgaaggccgggctcggctccctctgccggtccctgtcgcgcgaactcgcggaggaccggatcaacgtcaacaccgtcgccccgggcctgatcgagacgccgatgaccgccgaccggttcgagaagccggaggttctcgaccggtccctggagcggatcccgtggcaccgggccggccagcccgaggagatcgcccgggcgatcctctacctcgcctcggaggacgccgcctacgtcaccggccacacactggtggtcgacggtggcctgacgatgcagtggggcggcgcctga

SEQ ID NO: 4702 - DNA, 720 bp, Methylobacterium sp.
atgcgcatcctgctgatcaacccgaacacgagtgcgcacgtcaccgatctcgtcgcgggccatgtccgcactcagctcggcggtcgtgcggagctgcgcgccgtcaccggccggttcggagcccgctacatcgcgagccgggcggcggcggcgatcgccggccacgcggccctcgacgctctcgcggagcacggcgccgactgcgatgcggtctacctggcctgcttcggtgatccgggcctcctcgccctgcgcgagctgtcgcgggtaccggtcatcggcatggcggaggcggcctgccgcgaggccgctgcgtccggtcgcttcggcatcgtcaccgggggcgcggcctgggagccgatgctgcgggaactcgtggcggcgctcggtctcgccgacgccctcgcggccctccgcacggtggctccgagcggcggcaccatcgcccgtgacccggacgcggccctggagatcctggccgaagcctgccgcgcctgcgcggcgtccggcgccgagacggtcgtcctgggcggtgccggtctggccggtcttgccgggcggatcgccccgcaggttcccgttccggtgatctgctcggtcgaggcggggacccgcgcggttctggccgcgggcgcatccgggcaggccccgtcgaggcccgacccggtcgagagcatcggcctgacacccgcgctggcgacgcggctcatggacccctga

SEQ ID NO: 4703 - DNA, 696 bp, Methylobacterium sp.
accgacctcctggccgggcaggtcgggacgatggcgggcgcagccgcgaccttcgtcccggccacggcgcggttcggcgccgcctacatcgccagccgggcggccctggccatcgccggccacgccgccctcgacgccttcgcggagcacggccgggactgtgacgcggtcttcctcgcctgcttcggcgatcccggcctgctggccctgcgcgaggtctcaccggtcccggtggtggggatgctcgaagcgtcgtgcctcgaggcccagcgggtcgccgggcgctacgccatcgtgaccggcggggccctgtggaagcccatgctccgcgagtgcgtcgcgagcctcggcgtcggtgacggcctcgcgggcatccggacgatcgcgcgcaccggcggcgagatcgccaaggacccggaggcggcgctgtccgacctcgcggccgcctgccgggcctgcgccgaggaggatcgcgccgaggcggtgatcctcggcggcgccgccctggtcggcctcgcggctcgcctgcagccgcacgtgccggtcccggtcctgtgctcggtcacgtcgggggtgagggcggtcgtcgccgccgcggccgcgccctaccggcgcccgcccgccgtcgccgcggacaatgtcggtctcggccacgccctcgcgacgctgctcgcgccgcgcgaagccatcgtctga

SEQ ID NO: 4704 - DNA, 933 bp, Methylobacterium sp.
atgtctagcgcccaagccctgagcggcgccccgctggccgggccgggcgtcgcgccgcgcctgccgcccctgcctccgtccggccggcccgagatcgtgcgcgagaccggccacgcccacggcgccgcggtggtggagaagccgctgtcgatcaccgagcgcctctacaaccaggcgtggctgcgcaagatcgtgatcctcgtgctcctcgccgggatctgggaggcctacgggcgctacctcgacaacgacctcctgttcccgaccttcacggcgaccgtggaggccttcttccggggcatcgcggacggcacgctgccggcccgggcctggagctcgctgaaggtgctgctcatgggctacgccgccggcgtcgccctggcgaccgtgctcaccggcgtcgccatcgcgtcgcggatcgggaccgacctgctcgagacgctgacgtcgatgttcaacccgctgccggcgatcgcgctcctgcccctggcgctgatctggttcggcctgggtaacggcagcctgatcttcgtgctggtccactcggtgacctgggcgatcgccctcaacacccattcgggcttcctgtcggtcagccgcacgctcaagatggtcgggcgcaattacgggctgtcgggcccgcggctgatcggcaagatcctgatcccggcggcgttcccctcgatcctcaccggcctgaaggtcggctgggccttcgcgtggcgcaccctgatcgccgccgagctggtcttcggggtgtcgtccggagcgggcggcctcggctggttcatcttcgagaacaagaacatgctcgacatcccgaacgtgttcgccgggctgctcaccgtgatcctgatcggtctcgtggtcgagaatctgatcttccagacgatcgagcggcgcaccgtccagcgctggggcatgcaggcctga

SEQ ID NO: 4705 - DNA, 1161 bp, Methylobacterium sp.
ttcctcacgggcctcgcctaccagatgcaggcggtggcgatcggctggtacgtctacgacctgacccattccgccctggcgctgggcctcgtgggcctcgcgggcttcctgccggccgtgctgtgcgcgctgatcaccggccacgtcgccgacgcctacgaccggcgccttgtcggcgccgccgccttcgcgctccagagcgcggcgagcctcggcctcctcgcctgcgccctcgcgggcgtgcactccgtctggccgatctacgccctggtcatcgtcgtcggcacggcccgggccttcgccaacccggccctgcaggcgctgctcccgaccctggtgcccgggccgcttttcggctcggcgatcgcgtggaacgcgtccctctggcagagcgcgtcggtgatggggccggcgctcggcggcttcctctacgctctcggacccgccgtcgtgttcggtggggcagggggcagcttcgccctggccagcgccctgaccctgctgatccgctaccggccggcggcggtgagcgagcggccgccgatcacctgggcggcgctctcggccgggatcgactacatccgctcccagccggtggtgctcggggcgatcagcctcgacctgttcacggtgctgctcggcggcgccacggcgctgctgccgatctacgccgcggaggtcttgcacgtcggcccgctcggcctcggcgcgctccggagcatgccggccttcggggctgtcgccatggcggtgctgctggcgaactaccccctgcggcgccacgcgggcgtgcgcatgctccgcgccgccgcggtgttcggggccgccacggtcgcgttcgggctgtcgacgtcgctgccgctgtcgatggcctgcctgttcgtcacgggcgccgccgacatgatctcggtctacgtgcgccagaccttcgtgcagggcgaagcgccggacgcgatgcgcggccgcgtctcggcggtgaacacggtgttcatcggcgcctcgaacgaactcggcgagttcgaatcggggctgctcgccgccgcgatcggcgcggtcccggcggtggtggtcggcggcgccgcgacggtcggggtcgcgctgctctggggcaggctcttcccggcgctgagggcccgcgaccggctgatggtgcagggatag

SEQ ID NO: 4706 - DNA, 300 bp, Methylobacterium sp.
atggcggggacacaggcgcacggatccgcgtccgggtctgggtccgagtccggctccgcgccgggacccgcgtccgggaccgacgaggcggcctcgcagccttcggcgcggtcgtccgacgcgatcacgttcgagcagatccgcgagcgggcctacgagctctgggagcgcaatcacaggcccgagggcttcgagatcgagttctggctgctggccgagcgggaattgcgcaaggagcgcgatcgccggaaggccaacgcggcgccggccgcgccgcggtccgatccgccgccggcctga

SEQ ID NO: 4707 - DNA, 1590 bp, Methylobacterium sp.
atgacggtcatcgacgaccgctacagcgagttcctcgcccgcgaggcgacggcggtggcggaggcacgcaggctgaaccgcctggtgatcgagttgaactactgggtctatcggatcatcgcggagaccgatcaggaccagatgcaggccgccaacaggggcttcgaggccgcgctgcccacggtgcgggcgctgcttccgagcctccgatcgcacgcgccgaccttcgccgcgcgcatcgatgagcaggccgcgcggatcgagcgctatctcagggatgtgagcgaggtccgccggctgggcaccgccaatcagaacgagcaagccatcgcgctgatccacacggcgatcgacccgacgttctccggtttgctgtccgacggcaaccggatggccgaggacatcgatacgtacatgcagaagggttcgggcgacctgaccgatcagaccaacgagactcgccggacgctgatgatcgtgagcgctctcggcatgctggcggggctgctggcggcggtgttcatcgccacggtcgggatcacgcggccgctcgaccggctggtcaaggtcctgcagcggatggcgcagggcgagatcgaggccgagatcaccgaggccgcccgaagggacgaggtgggtgccgtcggcaaggccgtcgagggcatcaaggtcatggtcgcccgcaaggccgccgaggaagccgaaatgaagcgccgcgccgacgaggcggcggcggccgcgcgcaggcggaccatggtggagctcgcggacggattcgagcgggccgtgggcagcatcgtcgggatggtctcgtcctcggccaccgagctgcaggccacggcccagatcatgacgtcgagcgcgaccgagacggccagccagtccaccacggtggcggccgccgccgagcaggcctccgccaacgtccagaccgtggcggccgctgccgaggagctgggcacctccgtgcaggagatcggccggcaggtcctcggctcggccaacctcgcgcaggcggcggtcggcgaggcggacgagacccagcacctcgttcaggcgctcagtcaggcggcgacgcgcatcggcgacatggtcgggctcatcgcgaacatcgccggtcagaccaacctcctggcgctgaacgccacgatcgaggcggcgcgggccggcgaggccggccgcggattcgcggtcgtcgccgccgaggtcaaggagctcgccggccagaccgcccgggccaccgaggagatcagccagcagatcggccagatccagggcgtgaccggccaagcggtctcggccatcgacacgatcgccgcccggatccgcgagatcgacgcggtcgccgccaccatcgcggcggcagtcgaggagcagggcgcggccacgcaggagatcgtgcgcaacgtctcgcaggcggcggccggcaccgacgaggtgaccagcaacatcgccggcgtggcgcgggcctcggaagagaccggcgccgcggcagcccaggttctgggggcggccggcgagttgtcgcgccagtccgagcatctcggcaccgaggtctcccgcttcctcgggtcggtgcgggcggcctga

SEQ ID NO: 4708 - DNA, 1326 bp, Methylobacterium sp.
atggcttctgcggacgcggcgatcgggatcccggccgacgggcggcagcgcggcgtcgcgggccgcgacgtgccggacgttctgcgcgtgctcctgaacggggccgtcttcgtcctgctctggaaccacgtctggctgaaggacctgtccgaccggtcgatgctcgcggcctccgaggacggcagcctgctgacgcagatcctgttcctcagcgccggcgccgccatggcggcggcgatccaccggatcggcgtgcgccacctccgccccctggtgacccgccccctcgtgctctgcgccctctggctcggggcgacggcgctgctctccgtcgagccgagcctgtcgctgcggcggctcgcgctcttcgccatcgcggcgatgctctcggcgggcgtgctgatcgtggcccgctcgccccggcaactggccctgaccatggccgggtccgccctggtcatcgtgctcgcctcctacctcgcggtcgccttcgtgccgaacctcgcgatccactcggccttcgacgtcaattccgatccgagccacccgggcctctggcgcgggatcttcccgcagaagaacgaggccggcgccgccatggtgatcctggtgatcgtgggcctctacgtcgccaaggtggcgagccgcgtcctcggctgggcgatcgtgctcctggcggccgggttcctggtggcaagcggctccaagaccgcgatcctgctcctgccggtgatcctcgccgtgaccggcctgtgccaggtcctgaccggcgggttcctgcgccgcctgctgctcctcggcccggtgatcgggttctcgctgatctcgatcggctcggtgctcgcgccgccgatccaggaggcggtggggtcgctgctcaccgacgcgaccttcacgggccgcagcgagatctggcagttcgccatcgacaacatcatgatccggccctggcgcggctgggggatcggcgccttctggatgaccgagcggaccatgtatgccggctccgaggcgctgacctgggtcaacaccgtcgaccacgcccacaacgcctatctcgacaccgcgctgatcggcggcctgccgttcctcgccctgaccgtcgtggccttcgtgttcgccccggtgcgcgacctgcagcgcgtggccggcgggacgcgcctcgacgcggagaccctgctgttcctgaggctgtggttcctcgggctggtctcggcctccttcgagacggtgctctacaacggcaacaacgccacctgctgcatgttcatgatggcggtgttcggcctgcgcctgcgcacccgctacgccgtcgtggcgggctga

SEQ ID NO: 4709 - DNA, 330 bp, Methylobacterium sp.
ttgcggatcgagctcggctcggacaccctgctgggaccgggcaaggccgccctcctgagcggcatccgcgacaccggctccatcgccgccgcggggcggcggatgggcatgagctacaagcgagcctggtacctcatcgacacgttgaacaaggcgttccaggagccgctcgtctccgcgagcaagggcggccgccggggcggcggggccgtcctgacggtcacgggcgacgccatcctggacagctacctgcgcatggagcggctcgcctcggaggccgtggcgggcgaactcgaccttctctcttcgctgatgaaggccgattcgtag

SEQ ID NO: 4710 - DNA, 279 bp, Methylobacterium sp.
gtgcaactcctggagatgatcgccgagcacggttccatcgcgggcgccggccgtgcgctgggcatgtcgtaccgccgggcctggctgctggtcgaggcgatgaacaccggcttcggtcgccccgtggtcgaggcgcagaccggtggccgggccggcgggggcgcgcgcctctcggccttcggcgccgacgtggtgcggcgataccgggccgtcgaggcggccgcggaggcggcggccgcgccgttcctgcgttgcctgggacaggccggggacgcgtaa

SEQ ID NO: 4711 - DNA, 771 bp, Methylobacterium sp.
atggacacgggtcagcctctgctggaggtcgacggcgtcacgctccgctacaagacgcccgagcacctcgtcacggccacctaccgggtgagcttccgggtctggcccggggaccgcttcgtcctgctcgggccgtccggatgcgggaagtcgaccctgctcaaggcggtgggcggctacatggcgccgaccgagggcgagatccgcctgaaggggcgcccggtcaccgagcccggccccgacaggatgatggtgttccaggagttcgaccagctcctgccgtggaagacggtccggcagaacgtggtcttcgccctcgaggcctcgggccggctgagagggcgcgaggccctggaccgggcgaacctctacatcgacaaggtcaacctgacgaagttcgccgacagctacccccacaccctgtcgggcggcatgaagcagcgtgtcgccatcgcccgcggcatggcgatggagcccgacatcctgctgatggacgagcccttcgcggcgctcgacgcgctcacccggcggcgcatgcaggacgagctgctcgccctgtgggagggcacgcgcttcaccgtcctgttcgtcacccactcgatccccgaggcgatcaaggtcggctcgcgcatcctgctgctctcgccccatcccggcgaggtgaaggccgagctcaacagcgccgaatcgccggaggcggcgctgcagctcgagggccggatccagcacatgctgttctcggaagagatccaggaggcggagaatgtctag

SEQ ID NO: 4712 - DNA, 2304 bp, Methylobacterium sp.
ttgggcggggatgcatccgccgacccggatagcctgaaggcctacgcgacgaaccgggacgcgatggtcgcgggcttcgcgagcgttcaggacctgctgcggaaccgggatctgccctccgtgacggcgacgctggcgaggctcaacgcggcgcaggacgccgtgaatctgctccgcccccgcgtcgacgacgctctgcgcgtcgcgaagccgaagcgcgacccggcgctgctgcccgcggtgctgacggcgttccaggatcttctcgacgcgctgacggcgaccacggacgccgtggattcggctattccgcgctccgacgccgtcctgcagcgctacctcgtcctcaagcggtccgcctgggcgacccgtgtcgcgatcgggaacgtcgctctgcgcgtgcagacctcgctggcggccggcacgtcgtggtcgctgcccgagaccgtggctgcggccgaggagcgggcgcgggtccagtcggcgtggtcgagcaccagcgaggccgccgcgcagagctcggacaccgtgcgggccgcgttcgagagggccaagcgcagcaatttcgagggcgaggcggcggaggcggcgcgcgcgatcttcgatgccctgagccagcagcgcgcgtcccccatcacgttccaggatctgcgcaagcgcaacaccgtcgagcagatgacgatcgtcgatctcgccgatgccgccctcgccgagatggtggcgcgggccgagagcctcgccgcggaggcggaccgcgttctcctgcacagtgccgcggcgctgctggccgtcctgctgctcgtcgggctgggcctcatggctctgttcgggggcgtgctgcgccccctccggatcatcgccaccgcgatgcgcgcgctgacggggggcgagaccgccgtcgccgtcccggtgcgagcgtaccggaacgagttcgcgccgatcatggtggccgtgcaggccttccgggacaatctgatccgcacgcgcgacctcgaggccggggccgagcgggcgcggctggaggccgacgaccagcgccgggacagcctgcgccagatggcgcaacggttcgaggaggcggtcggaggcatgatcggctcggtcgcgtcctcggccaccgccctgcaggtcacggcgcagacgatgaccgcgacggccacccagacggccgggcagtcgacggcggtcgcggccgccgccgagcgggcctcgagcaacgtcaacaccgtggcggcggctgccgaggaactcggcacctccgttcaggagatcgggcggcaggccgacggttcggcggagctcgcgcagagggccgcgtccgaggccgaccggaccgccgcgcgcgtccaggacctgagcagcgccgtggaccagatcggtgccgtcgtggggctgatctcgtcgatcgccgagcagaccaacctgctggcgctcaacgccaccatcgaggcggcccgcgcgggctcggccggccgcggcttcgcggtggtggcttccgaggtgaaggccctcgccgcgcagaccgccaaggccaccgacgagatctccggtcagatcgcgcaggtgcaggcctccaccgggcaggcggtggaggccatcgcggcgatcaccgcgcggatccgcgagatcaacggtgcggcgaccacgatcgcggcggccgtcgaggaacagggtgcggcgacccaggagatcgtccgcaacgtcgggcaggcggccaccggcacaggcgaggtcaccacgaccatgaccggcgtcgcgcaggcggcggagggcaccggcctggccgcgagccaggttctcgcggcggcctccgccctgtcggaccagtcggaccgtctgaccgccgaggtcgagcggttcctggcgagcgttcgcgtgtcctacgcggtctccgccgcccaggtcgcgatcgtgcagcgcagcttcgcgacggtgcaggcgctcggcgacaccgcggcagagctgttctacggacgcctgttcgacatcgcgccgcaggtccggtcgctcttcccggacgacatgaccgcgcagaagcgcaaactcgtcgccatgctggcactggcggtggccaacctcgacaagccggaggccctcgtcgccaccgtgcgcgatctcggggaccggcacgtcggctacggcgcgctgcaggcgcatttcgagccggtcggggcggcactgctctggaccctggagcaggggctcggcccggacttcacgccggagatgcgggaagcctggaccgagacctaccgggtcatcgccggcctcatgacgatgaccggagccgcgaaggccgcgtga

SEQ ID NO: 4713 - DNA, 2064 bp, Methylobacterium sp.
atgagcctcgtcctcgtcgtcatggccacgatcatgctcggctacgcgacgggcaccgtgcgggaggcgcggcagcacgccgccgaggccgagcgggtcatcgcgctggtgcgggcgagccgcgccctcctccagacgctgaacgtgacccggttcgagcgcggcgcgacgctgcagttcctcgccgccgccgagcccgtcgaggccgagacccgcgcgtcgctctacgccgaccggcagcgggcgatcgcggggctcgccgcggcccggccgctcctcgacggcctggagctccccgccgtggcggcgaccctcggccggctgcaggaggcgagcggccgcctcgatcgcctccggccgcgggtcgacgcggccctggacgtgccgggcgcgcggcgcgacggcgcggtgacggcagaggccagggccgccctccaggccatgctcgatgccctgatcgccacgagcgacgccgtggacgccgcgatcccgctgtccgacgggctcctccggcgcgacctcgccctgaaacgggcggcgtgggcgacgcgcatggccaacggcgccgtcgcgctgcgcgtgcagacgtccctggcggccggggcgtcttggtcgctggacgagaccgtcgcggccgccgaggagcggggacggctcgacgcggcctggaacgcggcgatcgaggcctcggccgacacctccgagacggtccgggccgcgttccggcgagcccgggagaacaatttcgagggcgcccccctcgcccgccggcgcgccgtggcgcaggccctggctcgcggcgaaccgccgggcctgacgctcgcgcaggcgcgcaagctcgacacgcccgagcaggtcaccctcgtcgacctcgccttcgtctgcctcgacgagatgatcgcgcgggccgaggccctgtcgggcacggcgcggagcaccctgtggcgcgacgggacggccctggtcgcgaccctgctgctcgtcgccctcgggctgctcgccctgttccgcggcgtgctgcggccgatccggcggatcaccgcggccatggaggccctggcggccggggacgccgccgttgccgtccctggcctgcggcggcgcaacgagatcggcgccatggcccgcgccgtgcaggtgttcaaggacaacctgatccgcacccggcggctcgaggccggggccgaggcggcgcggcaggacgcggagcgtcagcgcggcctcgcgatgcggcaggtcgccgaccggttcgccgacgcggtcggcgggatcgtcgcgcaggtctcgaccgcggccgcatcgttgcaggccacggcccgcggcatgacggagattgctgccgaaaccgcggagcagtcgaccaccgtcgcggccgcggccgaggaggcggccagcaacgtcggcaccgtggcggcggcggccgaggaactcggcgcctccgtgcaggagatcggccggcaggtcgacggctcggccagcctcgcgcgggcggcggtcgccgaggccgaccggaccggcgcgctggtccgggacctgagcgaggccgtggcgcggatcggcgacgtggtcgggctgatctcgaccatcgcgggccagaccaacctgctggcgctgaacgccacgatcgaggcggcgcgcgccggcgcggccggccggggcttcgcggtggtggccacggaggtgaaggcgctggccgcgcagaccgcccgggccacggaggagatcgcgggccagatcgggcgggtgcaggcctcgaccggccaggccgtcgcggcgatcgggacgatcacggcccggatccgcgacatcgacggcgtggcgaccacgatcgcggcggcggtggagcagcagggcgcggcgacccgcgagatcgtccgcaacgtcgggcaggcggcgcagggcgcggccgcggtcaccggccacgtcgccggcgtcgccgcggcgtccggcacgaccgaggcggcggcgggcgaggtcctgggtgcggccgccgccctgtcggcccaggccgaacacctgaccgaagaggtcggccgcttcctcgacggcgtccgggccgcctga

SEQ ID NO: 4714 - DNA, 2061 bp, Methylobacterium sp.
ttgtgcctggtgatcgtcatcatggcctgcatggcgctgagcaacgcggtgcggacactcgtcgacgcgcgggcgcgggcggcgggcgccgcgagagccctgaccctgacgcaggcgagccagggcctcctccggacgatcctgccgctgcggctcgagcgcggatcgaccctcgccctcgggggtgaggcgccggcggacgcgaagaccctgtcgaccatcgcggggagccggcaggcgatgaccgagcattacgccggggcccggcgcagcctgggcgatctggccgagccggcggtcggcgcgacgctcgagcgcctgagcaccgcgcaggcggcgatggcggacctgcgtccccgcatcgacgcggccctcgggctgccgctggcccggcgggacccggcgctgcgggacgccgcgatggccgccttccaggacctgctcgaggctctgacggccacgctgaaggcggtcgacgcggccattccccggtccgatccggtgctgcagcgctatctcgccctcaagcaggcggcctgggagacgcgcgtcgccagcggcaacgtcgcggtgcgggtacaggcctctctggtcgccggcacggcgtggtccctgcccgagacggtcgcggcggcggcggagcggaccgagcttttgtccgcgtggcgccgcaccaccgaggccgcggccgacgtctcggagacggtgcgggccgcgtacgaccaagcgaaggccgccaatttcgagggcgacaccgaggccatcgcgcgggcggtcttcgacgcgctcagcgcgcacgcgcccccgcggcacaccttcgcggagctgcgcgaccgcaacacggtgaaccagcgctccctcgtggccctcagcgacgcggccctcgacgcgatggtggcgcgcgccgaggtcctcgccgaggaggcccggggcgacgtcgcgcgcagcggggcggcgctgctggcggtgatcctgctggtggccctcggcctgtggaccctgttcggcggcgtgctgcgcccgctccgggcgctgaccgcgacgatgggggcgctggccgacggggacgcctccgtcacggtcccggcgcgcacctaccgcaacgagatcggcgcgatggcgcgggccgtccaagttttcaaggagaacctcatccgtggccgcgagctcgaatccgaggccgccgaggcgcgtcaggcggcggaggcgcggcgccggtccgacctgcgggcgatggccgagcgcttcgagcggacggtcggcggcatcatcgcccaggtctcgggcgcggccaccgcgctgcagggtacggcccagaccatgacggccaccgcgaccgaaaccgccagccagtccagcaccgtggcggccgccgccgaggaggccgccaccaacgtcagcaccgtggcggcggcggccgaggagttcggctcctccgtggaggagatcggccggcaggtcgagggatcgaccaggctcgcccagggggccgtcgcggaggcggggcagacaggcgcgatggtccgggacctgagcggcgcggtcgcgcggatcggcgacgtgatcgggctgatcgcggcgatcgccgggcagaccaacctgctggcgctgaacgccacgatcgaggccgcccgcgccggcgaggcgggtcatggcttcgcggtcgtcgccggcgaggtgaaggccctggccgcgcagaccgcccgggcgaccgaggagatcgcgggccagatcgccggcatccagggcgcgaccggcggggccgtcgcggcgatcggcgcgatgacgggacggatccaggagatcagcggcgtggcgagcgcgatcgcggcggcggtggaggagcagggatcggccacccgggagatcatccgcaacgtcggggaggcggccgtcggcaccggcgcggtgacccgcacgatcctcggcgtcgccggggccgccgaggagaccggccgggcggccaacgcggtgctcgcggcggcgtccgcgctgtcgcgccagtccgagacgctcacggacgaggtcgcgcgcttcctcgacaccgtccgggccgcgtga

SEQ ID NO: 4715 - DNA, 729 bp, Methylobacterium sp.
atggatcccgaaggatccgaaccggcgccggagaccgcgccccggcccgacgccgggccgctgcgggtcctcgccctggcggtgcagaagggcgggacgggcaagaccaccctggcggcctccctggcggtcgctgccgcggaagcgggcgagcaggtgaccgccctcgatctcgacccgcagagctcgctggccggctggggggccctgcgcaagaacgacggcaggagcgaccgcgcgcgcgacgccgtcgcggtcgaccgggtccagccctgggagatgggccagctctcggagatcctcggcatcctcgccgagcagggcacgacgctggccgtcctcgacaccgccggcagcgcgtccggcctcgcgccggccctgaaggacgccgatttcgtcctgatgccggtccgtccctcgcggctcgacatcgtggccgcccggccgacgctccaggcgctggtcggcctcggcctgcgggagcggctggccctggtgctgaaccagtgcccgccgccgccctcgccgcgcaccagcgcctacgcggcgcagctgcgcgccctgggcgtgctggccgagcccgggatcatccaccgggtcgaccaccaggacgccctggcgaccgggctcggcgtcacggaattcgcccccggcagccaggccgccgaggaggtccgggcgctctgggcctgggtcgacgggaagatgcgggcggcgcccgcccgctga

SEQ ID NO: 4716 - DNA, 1179 bp, Methylobacterium sp.
atgccccctctcccgcaccgccggtcgatcctcgccggcgcggccgctctcggcctcgccggcgcggcgcgcgcggccggcccggcagggttcggtcccctcggccggccgtcctggtcgcccgacagcctccaggccgccgcggccgccaagggcctgacatacggctgcgaggtgccgttccaccgcttcgacgcgacgcccgcctaccggcaggcggtggcgcgggaatgcggcatcctcgtctgcggcaccgagatgaagatggaggaggtcctgccggcgccgggcaagaccgacttcgcccgcggcgacgcgatcctgcgcttcgcgagagcgaacggccagcgcatgcgcggccacacgctcgtctggcacgcggcgctgccgccctgggtcgggccgctgctcggccgggcgagcgccgtccaggccgaggacttcatgcggcgctggatcgagacggtggcgggccattaccggggccagatcgtcgcctgggacgtggtcaacgagatcctcggcaacgaggccgatcccgaccgcggcggcggcctgcgcgactcgccctggctcgcctcgatcggccccggctacgtcgacctcgccttccggatcctgcacgagaccgatccggccgccgccggcacgtggaacgaggacgcggtggagcagggcgtgccctggatggaggccaagcgcaccaaggtcctgcgccgcctggaggcgatgcggtcccggggcgtgccgatccggcgcttcgggctccagtcgcacctcaccagcacgatcccgatcgaccagggccagctgcggcgcttcctgcgggagatcggccagatggggctcggcatcgagatcaccgagctcgacatcgacgaccgcgccttcccgtccgacgtggcgacccgcgaccggatggtggccgactacccccgccgctacctcgacgtggtgctggacgagcccgcctgcctcgacgtcctgacctgggacatctacgacccggacacgtggctgaacgaccacccctaccgcaagcggcccgacggcctgccgcagcgggcgctgccgctcgacgcgcagttccggcgcaagcccctgtggcacgcgatgaaggcggccttcgaggccgcgcccgatcacagggccgcccgcgagaagctcaggcgggcgtga

SEQ ID NO: 4717 - DNA, 1122 bp, Methylobacterium sp.
atgagatcgattctgctggccgggctcgccctcggcgcgatggcggcggccgcgcaggccgccgaggtcaagctcggcgtcgccgcgccgatcaccggcaacagcgccgccatcggcgcgcagctcaagaacggcgcgagccaagcggtcgaggacctcaacaaggccgggacactgaagggcacgacgctgaccgtcacggtcggcgacgacgcctccgacccgaagcagggcgtctcggtggccaacaagttcgccagcgacggcgtgaagatggtcgtcggcgactacaactcgggcgtgtcgatcccggcctccgacgtctacctcgacgccggcatcatccaggtcacgccggcctccacgaacgtgaagttcaccgagcgcgggatgtggaacacgttccgcacctgcggtcgcgacgaccagcagggcgcggtggccggcaactacctggccgatcacttcaagggcaagaaggtcgccttcgtccacgacaagaccccctacggcaaggggctggccgacgagacgctgaaggcgttcaaggccaagggcggcaaggaggtcatgtccgagggcatcaacccgggcgagaaggactactcggcgctcgtctccaagctgaagtccgccaacgtcgacgtcgtctatttcggcggctactacaccgaggccgggctgatcctgcgccagatgcgcgatcagggcctgaaggcgccgatgatgggcggcgacggcatggtcgaccgcgagctggtggcgatcgccggtcccgcggccgagggtacgctgaccaccttcccgccggacgcccgcaagaacccgaacgccaaggcggcgctcgccgccttcaaggccaagaacatcgatcccgagggctacacgctctactcctacgcggccgtgcaggtcctggccaaggcgatggccgagaccggctccagcgacggcaagaagctcgccgaatggctgcaccagggcaagccggtggacacggtggtcgggccgatcgcctacgacaagaagggcgacatcacccggcccgactacgtcatgtacgagtggaagaagggacccgacggcaagatcgactacagcggcaatgagctgacgaagtaa

SEQ ID NO: 4718 - DNA, 1314 bp, Methylobacterium sp.
ttgccgggcttcggcgatgccgccggcacgccgggctactccgtcgccgccatggccgatcacgtggccgaggccatccgcgcgcgggctccggcgcgctacgcgattgccggccacagcatgggggccaaggttgcgctggcgctcgcgcgccgggccgaggatggcgaggcggggctggcggggctcaccgacctcgtcctggtctccggttcgccgccgagcccggagccgatcccggaggaccggcgcgccgacatgctcgcttggatcgacgcggatcccgagacccggcgccgcgaggccgaagccttcgtgcgcgccaacgtgggcgacggcctggatcccgagaccgaggcccgggcggtagccgacgtcctgcgggccgagccggccgcctggaaagcctggctcgaggagggcgccaacgaggattggtgccgccgggccggcgtcctgcgcaccccggcgctgatcctcgcggggtcggaggatgccaacctcgggccggacgcgcagcgggccctcacggcgccccacctcgcgcaccaccgtctcgtcaccgtcgacggcgtcggccacctcctgcccctggagcggcccgcggccctggccgaccacctgcgcgcccatctcggtgaccggccccgcccgcccgtcgaggccggcccggcggtgccgccggactacgcggcgctgatcgcctccgagcgcgtgaacagccgcctccgtgaggcgctcgcggagcgcgccgcgccggacgatcccgcctatcggccggcggccctcgacccggtggagctcgcgatcctgcgggcggccctcgcccgcgtcgtgccggtgccgcacctcgatctggccgccagcctcgaccggcggcttgcctccggcgacggggacggctggcgcttctcggccctgccgccggacgcggaggcctaccgcgcagctcttcggacgctggacgccgccgcccgcatcgcccgcgaccgcccgttcgtgaccctcgacgcggccgagcaggacgggctgctcaccctgtgcgcgcgcgccgcgctgacggtcccggagagcctcggcggccgcctcgacgccgaccggatgcggttctggttcgaggatctccgcgccgacgcggtccgcctctggctcggccaaccggcggccctggcgcggatcggcttctcgggcatcggtgccggcggcgaccggccgggcgagatcgccgacggcctgccgggcttccacgccgtcggactcgacgcgccggaaccctgggagccgcgggcgctgcggacggaggcgggacgatga

SEQ ID NO: 4719 - DNA, 879 bp, Methylobacterium sp.
atgacccaggacccgcgcgaggccggcccccggccgccattccccggcgaccagcagcagacccgcccgggcctcaccacgaagatgacgccgcgccccgaccacggcgaggagagctacgtcggcaagggcctgctcaccggccaggcggcgctgatcaccggcggcgattccggcatcggccgggcggtggccatcgcctacgcccgcgagggggccgacgtggcgatctcctatctcgaggtcgagcaggaggatgccgaggacacgaaggcctgggtcgagaaggccggccgccgctgcctgctgctccccggcgacatccgcgacgaggcccagtgccgggatctcgtggcccgcaccgtcgcggcctacgggcgcctcgacatcctcgtgaacaacgccgccgcccaagtggtgaacgagggcctcgacgatctggcggcgtccgacatcgagggctcgttccgcgccaacgtcttcgccatgtactacctcgcccaggcggcggtgccgcacatgaagccgggcggcgcgatcgtgaacagcaccagcgtgcaggccaaggtcgccgggccgaacatgctgatctacgccgccaccaagggcgcgatcgcgagcctgaccatcggcctgtcgaacctgctggcgccgcagggcatccgggtgaactgcgtcgccccggggccggtctggacgccgatccagccgatcgtgaagagcccggagcagatggagcagctcggtgcgcagacgccgctcggccgcgccggccagcccgcggaactcgcgccggcctatgtgctgctcgcctcccgcgagggcagctacatgtccggggcactggtgccggtcaccggcggcatcccgatgctctga

SEQ ID NO: 4720 - DNA, 831 bp, Methylobacterium sp.
atgcgcctcatcgccggcctcctgctcgccgcgctcctcctctgcgggctggcctgcgccgcgctcgcgctcgggcagcgccggttcctctatccgggcgccttcgggcctcagagcccgtggacgatcccgccgggcctcgccacgatcacggtcgcgacccccgacggcgagaccctgcacggcctgtggcggccgccgcggccgggctgcggcgtcgtcgtgagcttccacggcaacgggtcccgccccgaaccgcacgcggcccgcttcgccgcggagccctggcgggcgcgcggctggggcgtgctcaccgtggcctatcgcggctatcccggctccaccgggagtcccagcgaggacgggctgatccgcgacgggctggcggccgtcgaggccgcgcgggcgcgggtgcccggcgcgccgatcctcctccacggacactccctcggagcggccgtggccgtggccgtggccgaacaggtgccggcgatcggcctgtacctggaggcgccgttcgactcgatgacccacaccgtgcggctgcatgtcccgctagctccgatctggctcctgcgcgacacgtaccgctcggacctgcgcatccgcgatggcacggcgccggtgctgatcgtgcagggccgcgacgacacggtggtgccggccaagctggcgcggaacctcgccgaggctgccggcccgcgggcccggatcgacgtgatcccgggggaccacgtctccatcctggggagccgggatcgcgaggccgaggcgctgttcggacagggcgtcggtccggcctgcccgcagccggtggatcagcagggatag

SEQ ID NO: 4721 - DNA, 990 bp, Methylobacterium sp.
atgccgaacctgaccctgccggaggccgaggccctcgccgccgacgccctggtccgctgcggcacggccgaggccgcggcccggagcgtcgcccgcgcgctggtcggcgccgaggcggacgggctcaagggccacggcctgtcgcgggtcgcgccctacgccgcgcaggtccgggccgggaaggtcgtgggcgacgcggtcccgcttgcgtcgcgcccgcggccgggcctgctcgcgatcgacgccgcccacggcttcgcctacccggcgatcgacctcgccctggaggcgctgccgggcgtcgcgcgccagcagggcgtggcggcggcgggcatccgccgctcgcaccattgcggcgcggccggacgcccggtcgaggccctggccgagcagggctgcgtcgccctgctcttcgccaacacgcccgccgcgatggcgccctggggcgggcgtcaggcggtgttcggcaccaacccgctggccttcgcctgcccgctgccgggccgcgcgccgatcgtggtcgacctcgccctgtcgaaggtggcccgcgccaacatcgtcggggcggccaagcgcggcgagccgatccccgagggctgggccctcgacgcggagggacgcccgacgaccgacgccgaggccgccctcgacggcaccatggtgccgctgggcgacgccaagggcacggcgctcgccctgatggtcgagctgctcgccgccggcctcgtcggcgcgcgcttcgccggcgaagcctcctcgttcctcgacgccgcgggcgacccgccggggaccggccagctgatcctcgccctcgacgcggcggcgctcagcccggacgcgccggagcgcttcgcggcgctggccggcgcgatcgaggcgcaggacggcgcccggctccccggcagccgccggctcgggctccgccgccgggccgccgaggcgggcctcgacgtggccgaagccctcgtggccgagatccgggcgctgtga

SEQ ID NO: 4722 - DNA, 426 bp, Methylobacterium sp.
atggcggacctgttctggctctcggacgagcagtgggcggtgatcgagccgttcatgcccagggaccagcccggacccgagcggaaagacgaccggcagattatctccggcatcctgcacgtgctcacgtccggctgccgctggcgcgattgcccggccgcgtacggcccgcgcaccacggtctacaaccgcttcaatcgctggtcgcggcgcggcttctggaaggcgatgctgaccgcgctggccaaggccgggtgggctggcgatgcggcggctctcgacagcagctacgtccgggctcaccggtctgcccatggcgggaaaggggggcaagggcgcaggccatcggcccatcgcgcggtggtcaaacgaccaagatccacgcactcaccgatgtcctcggccggcccggcgtcctcctgctga

SEQ ID NO: 4723 - DNA, 435 bp, Methylobacterium sp.
atggcggacctgttctggctttcggacgagcagtggacggtgatcgaaccgttcatgcccaaggatcagcccggacccgagcggaaggacgaccggcagatcatctcgggcatcctgcacgtgctgacatcgggctgtcgctggcgcgattgcccggccacgtatggcccgcgtaccacggtctacaaccgcttcaaccgcttcaaccgctggtcgcggcgcggcttctggaaagccatgctcgccgcgctggccacggccggatgggcaggcgatgcagccgccctcgacagcagctacgtccgggcccaccgctcggctcatggcggcaaaggggggcgacggcgcaggctatcggcccgtcgcgcggcggccaaacgaccaagatccacgcgctcaccgatgtcctcggtcgccctggcgtcctgctactga

SEQ ID NO: 4724 - DNA, 378 bp, Methylobacterium sp.
atgagcatgctgcaggggatcctgtacgaggagccgtcggcctggctgttcctgctcgtgaccgtggtgatgggcggctgggccggctggatggcggcccgcggcatcgcccggggctggcggccgttctggcaatgcgccctggcgctgcttctggtggcagccgccgtgcgcttcatccactacgccctgttttcgggcaccctgctgtcgctgcactactatgcggtcgacgcggtcatcgtcatgatcatcggcgcggcgggcttccgctacacgcggacgcgccagatgacgagccagtaccgctggctctacgagaagacctcaccgctgacatggcgcgcacgggcgcccgcggccggcgaggtccgatga

SEQ ID NO: 4725 - DNA, 798 bp, Methylobacterium sp.
atgagcgtcgccggcatcaacgtcctcgtcgaggagacgcgggcgatccaggcgggacagaagccgccgctcctcgcggtgcgcgacgtctcgacttattacggcagcgtcgcggccctgcgcggggtcgatctcgacgtggccgagggcgagatcgtcacgctgatcggcgccaacggcgccggcaagtcgaccctgatgatgacgatcttcggcagcccccaggcgcgctcggggacgatcacctacgatggccgcgacatcacccggctgccgacccacgccatcgcccggctcggcatcgcccagtcgccggaggggcgccgggtcttcccgcgcatgaccgtctacgagaacctccagatgggcggcgcgctccatgacgggcgcttcttcgccgaggatctggagaaggtctgcaccctgttcccgcgggtgaaggagcgcctcaaccagcgcgccggcaccatgtcgggcggcgagcagcagatgctggccatcgcccgtgcactgatgagccgcccgcggctgctgctgctcgacgagccgtcgctcggcctcgcgccgctcgtggtgaagggcatcttcgacgcgatccgggagctgaaccggaccgacggcatgacgatcttcctcgtcgagcagaacgcctaccacgccctcaagctcgcccatcgcggctacgtgctggtcaacggccgggtcacgatgagcgggacgggtcgggcgctgctcgacgatccgaacgtccaggccgcctatctggaggggggccattccggcccggtcgggacatga

SEQ ID NO: 4726 - DNA, 864 bp, Methylobacterium sp.
gtgctcacggtcgagcacctgaccatgcggttcggcggcctcaccgccgtctccgacctgtccttcgaggcgcgccgcggcgacatcaccgcgctgatcggcccgaacggggccggcaagaccacggtgttcaactgcatcaccggcttctacaagcccaccgagggcatgctgacgctggcgcacgccgacggcacggcgcacctgctggagcggcttccgaaccacaaggtgaaccgcactgcgcgggtcgcccgcaccttccagaacatccgcctgttccagggcatgaccgtcctggagaacctgctcgtcgcccagcatgcgccgctgatgcgggcctcgggctacacgatcctcgggctgctcggtctcaagacctaccgcgacgcgcaggccgcggcgatcgagcgggccaaggcctggctcgcgcgcatcgacctgatgaagcgggcggatgatccggccggcgccctgccctacggcgcgcagcggcgcctggagattgcccgggcgatgtgcaccgacccggtcctgctctgcctcgacgagccggcggccggcctcaacccgcgggaatcggccgagctgaacggcctcctgcgccacatccgcgacgagcacgacacttcggtgctgctgatcgagcacgacatgtcggtggtgatggagatctccgaccacgtggtggtgctcgattacggcgtgaagatcgccgacggctcccccgccgacgtgcgggccgacccgaaggtgatcgccgcctatctcggcgtcgaggacgaggaggtcgaggccgtggaggccgaggtcgggatcaccgtgccgcacggggacgcggcgcacacgggagcgtcggcatga

SEQ ID NO: 4727 - DNA, 1395 bp, Methylobacterium sp.
atggccgcctcgcagaacgctctccccggctccgcgatggccggcatcctgcgcgacgccgccctctacgccctcgtcaccttcggcctctgcgtcccgatcatcgcctaccggaccgatcccgggcccgggagcgagttggtgctcgtgccgcgctgggggctggtggcggcgctctgcgcggcgatcttcgtgctgcgcctcgtacagcgcctcgtgctgctgcgccgcgatgcccggcgggcgctgaccccctccccggcccaggccaccgaggcggtgcacggcgagcccgatgccgggcagaagacctcgaaggtcggcctctggctgttcatcttcgtcgcgctgaccctgccgatgatctctgccctggcgaccggcggcctgtcctccgcccgctactggatcgacctcggcatcctgatcctgacgtacgtcatgctcggctggggcctgaacatcgtggtcggcctcgcgggcctgctcgacctcggctacgtcgccttctacgcggtcggagcctattcctacgcgctgctgtcgacgaccttcggcctgtcgttctgggtctgcctgccgctggcgggcctgttcgccggcctgtggggcatgatcctcggcttcccggtgctgcgcctgcgcggcgactacctcgccatcgtcaccctggccttcggcgagatcatccgcctggtcctgatcaactggaccgacgtcaccggcggcggggccggcatctcgtcgatcccgcgggcgaccttcttcggcatcccgttcacggcgggcgagggcgggttcgccgcgaccttcggcatcccgtacgattcgatgcaccggctgatcttcctgtactatctgatcctcgggctggcgctgatcaccaacttcgtcaccctgcgcctgcgccgccttccgatcgggcgggcctgggaggccctgcgcgaggacgagatcgcctgccgctcgctcggcatcgacaccaccgccacgaagctcacggccttcgcgctgggcgcggccttcgggggcttcgccggttcgttcttcgccgtgcgccagggtttcatcagcccggagagcttcaacttcctggaaagcgccatcatcctggcgatcgtcgtcctcggcggcatgggcagccaggtcggcgtcgcgatcgccgcggtggcgatggtcggcgggccggagatgctgcgcaacctcgggttcctgaaggccgtgttcggcgagggcttcgaccccagcgagtaccggctgctgctgttcgggctcgccatggtcgccatgatggtctggcggccgcgcggcctgatatcggaacggatgccgtccgtgtcgctgggccagcggcgcgcggtctcgggcgcccatgtcagcgaggggcacggctga

SEQ ID NO: 4728 - DNA, 918 bp, Methylobacterium sp.
atggacgtcttcgtacagcagctcatcaacgggctgacgctcggctcgatctacggcctgatcgcgatcggctacacgatggtgttcggcatcatcggcatggtgaacttcgcccacggcgacgtcttcatggtctcctgcttcatcgcgctcatcaccttcctgctgctgacggtctggctcggggtcagctccatcgcgctggccttcctggtggtgctggtggtcgccatggtgctgaccgccctgtggggctgggcgatcgagcgcgtggcctaccggccgctgcgcggctcgttccgcctcgcgccgctgatctcggcgatcggcgtctcgatcttcctgtcgaacttcgtgcaggtcgtgcagggcgcgcgcaacaagccgaccccgccgatgctgtcgggcggcatcacgctgttcgagcgcgacggctacgcggtgttcctggcctggaagcaggtgctgatcatggcggtgaccgccgtgctgctcaccggcttctggtacctcgtgcagcgcacgcccttcggccgggcgcagcgcgcctgcgagcaggaccgcaagatggcggcgctgctcggcatcgacgtggaccgcacgatctcgctgaccttcgtgctcggcgcggcgctcgcggccgtcgcgggcgtcctctacctcatgtactacggcgtcgtgtccttctcggacgggttcgtgcccggcgtgaaggcgttcacggcggcggtcctcggcggcatcggctccctgcccggggcggtgctgggcggcctgatcatcggcctgatcgagacgttctggtcggcctatttctctatcgagtacaaggacgtcgccgccttctcgatcctggcgatcgtgctgatcttcatgccgtcgggcatcctgggccggcccgaggtcgagaaagtctga

SEQ ID NO: 4729 - DNA, 558 bp, Methylobacterium sp.
atgtcgggtggtcacggggcggtcgaggggtcgaacaagcgcgtggcgctgctgatctcggtgctggcgctgttcctcgcgttcagcgagacactgggcaaagcgtcccagacggattcgatcggcgccaacgtcgaggccgcgaaccagtgggcctatttccaggcccgcacgatccgcgcgacggtgctcaagaccgccgacgaggccctggcgctggtgcccccgggaccgaaccaggaggccatcgccgccaagcgcgccgagtggtcgaagacgctggcgcgctgggattcggagccgtcgaccggcgaaggccgcaaggagctgtccgagaaggcccgcgcctcggagggccggcgcgacctcgcgctgctgcgctaccaccactacgagctggcctcggcggccttccagatcggcatcgtgctggcctcggccgaggtcatcaccgggatcagcctgctggtcttcgccggcggcttcctgggcctcgccggggcggcgctgctcggcttcggctacctcgcgccgcacgccctgccgttcttccactga

SEQ ID NO: 4730 - DNA, 1056 bp, Methylobacterium sp.
atgctgaacggccgggcgaggtcgatgggcctcggttcgctaaacaccctgacgctggccgaggcgcgcgagaaggccaccgagtgccggaagctctgcctggacgggatcgatccgatagaggcccgggagaaggcgcgcgcggccgcgcggctcgacgcggccaacaccatcaccttcgacgcctgcgctgaagcttatattgaggctcacaaggccggctggcgcaacgcgaaacacgctgaccagtggagcaacaccctcgccaactacgcctcgcccgtgttcggcgccctccccgtccaggcagtcgataccggactggtgatgcgggtgatcgagccgatctggggcgacaagacggagacggccacgcgggtgcgcggacgtatcgagtcggtgctggactgggctgctacccgtggctaccggcaaggtgagaacccagcgcgctggcgtgggcacctgcagaacctgttgccgaagcgctcgaagattaagcgcgtcgagcatcacgccgccctgcccttccgcgagatcggcgagttcgtcggccggttgcagacgcagtccggtacgtcgccgctcgccctagaattcacgatcctgacggctgcgcgtacgggtgaggtgatcggcgccacctgggacgagatcgacctcgccgagcggacgtggaccgtgccagcggagcgcatgaagagcggtcgcgagcatcgggtgcctttgtgcgatcgggccgtggatatcctcgaaggctttaaggtgctcggagatcggcacgtcttcccaggcggcaagcgcggcaggccgttgtccaacatggcgatgctggagttgttgaagcggatggatcggccggatctcacggtgcacggcttccgctcgacgttccgcgattgggccgccgagacgacacacttcccgaacgagatggtggagatggcgctcgcccacatcattgagaaccgggtcgaggcagcctaccgacgcggcgatctcttccaaaagcgacgcgaattgatgaacgcatgggcggtgtactgtggccgatga

SEQ ID NO: 4731 - DNA, 1242 bp, Methylobacterium sp.
atgaccgacagcacagagccggctctcccgtccagcgcggccgtcgccccgccgccggccacgtcgatcccgcgcctgatcgtcgtcctggcctgcgcggggttcggcagcaccttcgcgctccgctcggtcgagcccctggtcggcgtgctcgcccgggatctcgcgagcgacgcccacacggtggcgctcctctccaccgccttcgcgctgccctacgcgttcatccagccggtgctcggcccgatcggcgacgcgctcggcaaggagcgggtgatgagcacctgcctcgcggtgctcgccgtcgcgctgactctgtgcagcgtcgcgccggatatcggcagcctgttcggcctgcgcatgctggcgggggcggccgcgggcggctgcatcccgctctcgctggccctcctgggcgaccgcgtgccgatggagagccgccaggtggcgatcgggcgcttcctcgtggcggtgatcctcggccagctctcgggctcgaccttcgcgggcctgatcgaggcggcgatcggctggcgcggcgtcttcgcggtcaccgccgcggtggcggccctggcctgcgcggcgaccgtcctcggcttcgaccgggccggccgggccccggcccgccgccccgccttcggcgaggcggtgacgcgctaccggacgatcctgggcaatccccgggcgcgggtgctgttcgcggcggtattcatcgaggccatcgcgatcttcggcgtcttcccgcacctcgccccgctgatcgaggcgcggggcgagggcggcccgcgcgaggccgggctggtgctggcggggttcgcggtcggcggcctgctctactcggccctggtcgggctgctggtgcggctgctcggcctgccgcggatgctgatcggcggcgggctggtctgcggcgcgtcgctcaccgtggtcgggctcgcgggctcctggcaggtcgactgcgccgcgctcaccgccatgggcctcggcttctacatgctgcacaacacctaccagacgcaggtcaccgaggtcgcgcccaaggcccgcgcctccgcggtggcgctccacgccttctcgttcttctgcggccaggcgctcggcgtcgcggtgatcgggcaggcgctgctccggttcggtcagctcggggcgctgctcggatgcgccgtcaccatcctggcgctcgggatcgccaccgccatcgccctgcggcagaagccgggaccagtcccgttcaccggctga

SEQ ID NO: 4732 - DNA, 1260 bp, Methylobacterium sp.
atgcacgtgctcatcctcggcggcggcgtcgtcggcgtcacctcggcctactacctcgcccgggccggccatcaggtcaccgtgctggagcgccagccgggctccggcctggaaaccagcttcgccaatgccggtcaggtctcgcccggctactcggccccctgggcggcgcccgggatccccgtgaaggcgctcaagtggctgatgatgcggcaccggcccctggtgctgtggccgcggctcgagccccgtctctacgcgtggctcacgcgcatgctcgcgaactgcaccgaggaggcctaccagcggaacaagggccgcatggtccggctcgccgagtacagccgcgacgcgctgcgcgacctgcgcaccgagaccggcatcgcctacgaccaccgggagaagggcacgctccagctcttccggacgcggaagcagctcgaccatgtcggcgacgacacccgcgtcctcgacgcctacggcgtgccctacacggtgctggacccggccggctgcgtcagtgccgagccggcgctcgccgccgtgcgcgacgtcttcgtcggcggcctgcggctgccgggcgacgagaccggcgacgcgcacctgttcacgcagcgcctcgccgcgatctgcgagggcctcggcgtcaccttccgctaccgcacggcgatcgcgcgcctgcaccatgccggggaccgggtgacggcggtcgagaccgccgacggcgacctcctgcgggcggatgcctacgtcgcggctttgggcagctacacgccggccctgctgcgccccctcgggatcgccctgccggtctacccggtgaagggctactcgctcacgctccccatcaccgacgcggcggccgcgccggtctcgacggtgatggacgagacctacaaggtcgcgatcacccggctcggcgaccgcatccgcgtcggcggcaccgccgaactcgccgggttcagcagcgccctgcgcctgccgcgccgcgagaccctcgcgcgctcggtgcaggacctgttcccggccggcggcgacctcgaccgggccgcgttctggaccggcctgcggccgatgacgccggacggcacgccgatcgtcgggggcacgcgggtcgggaacctgttcaccaacaccggtcacggcacgctgggctggacgatggcctgcggctcgggccgcctgctcgccgacctcgtgtccggacgggcccccgagatcgcgagcgacgatctggccctcgaccgctacgccgcgtga

SEQ ID NO: 4733 - DNA, 915 bp, Methylobacterium sp.
atggatctggactgggtgcgggacttcctcgcgctcgccgagcaccggaccttctcgcgggccgccgaggtccggcacgtgacgcagccggccttcagccgacggatccgcgcgctcgaggcgtggctcgggacgcccctgttcctgcggagcgcgcaaggggcgcacctgaccgccgccggaacgggcttccgctcacacgccgaggaattgatccggggcctggatcgggcatgccgcgaggcgcgggccgccggtgcgcgcgcggatgcgagcctcgcgatcgcggccacgcacgcgctgtcgttcacgttctttcccggctggatccgccggcacgcacccttcgagacgctgggcgccctcaacctgatctcggacagcatggcggcctgcgaggcgatcctgctggccggcgaggtgcaactgctcctgtgccaccaccgcgcggacctccccacgcccctggacgatggccgctgcgagtcggtccgcgtcggcgcggacagcctggtgccgctctgcgcaccgacgtccgaagggggaccgctctggcccctgagcggcgcggtccgctacctcgcctacggcgaggcctcggggctcggccggatcctggcggcgagcggggcggcggccggccacgagccggccttcacgtcgcacctcgcggcgacgctgatgaccatggcccagggaggcgacggtgtcgcgtggctcccggtgacgctcgcggaggcggcgatcgcccgcggacagctcgtgcgggcaggtccggaggaactggacgttccggtggagatccggctgttccggatgcgcgagagccgaggcggcgcggccgatgccctgtggcggcgcctgcacgcgcccgagggcgcccgacccgatcaggccttcgccgcccgggcgtag

SEQ ID NO: 4734 - DNA, 852 bp, Methylobacterium sp.
atggagctgaaatggctcgaggacttcctgagcctcgcgcgcaccggcagcttctcgcgctcggcggtcgagcgccacgtcacccagccggccttcggccgccgcatccgggcgctcgagggctggctcggcgtcgcgctggtcgaccgcagcacctacccgaccgccctgacgccggagggccggctgttcctggagaccgccgaggagaccgtgcggcggctccacggcagccgcgacgcgctacgcgcccggatccggccgccgccgcggaccgtttcggtggcggcgctccacaccctggcgctgaccgtcttcccgggctggttccgggacatcgaggcccgcaccggtcccctcggcagccggctgctgccggacgatttccacgcctgcgtgcaggcgctggccgaaggcggctacgacctgctgctgacctaccaccatcccctggtgccgatccccctcgacccggccgccttcccgcacttgaccatcggccgggacagcctcgtgccggtgcaccggccggggccggccgcggaccggcccggactcggctacccccgggactcgttcctgggccgggtcgcggcgctcgccggtgacggggcggcggccgcccacgtcaacgagaacgccatggcggaggccctgaagttcatggtcctcgcgggccacggccgcgcgtggctgcccgagagcctcgtcgcccgcgagctcgccgacggcagcctcgtgacggcggggccgggcacgccgctggagatccggctctaccggagggccgggcgcggcggcgcggtcgcggcggtctgggccgcggccgccgccctggcggccggaccctag

SEQ ID NO: 4735 - DNA, 1287 bp, Methylobacterium sp.
atggaccgcgtgtccgccatctcagcagctgtgcgcgcgcagcgcggcccggtcgaggtcctgttcgcggagctggcccggtgcggccggacggagcccgggttcacccggccctcctacagcccggaggagaccgcggcgcacgcggcggtggcgcgctgcgcctccgatctcggcctcgcgatcgcccgggacgccgccgccaacaccgccatgacgctgccggggcgggaccgaaccctgccgccgatcctgatcggctcccacctcgacaccgtggcccagggcggcaacttcgacggtgccgccggcgtggtggccgggctcgccgccgtcgcggccatccgccaactcggcctggagccggagcgggacatctccgtcttgggcatccgcgccgaggagagtgtctggttccaggtctcgtatatcgggagccgcgcggcgctcggagccctgccggacggggcgctcgacgcggcccggatcgacacgggcctcagcctcgccgaccacatcgcccgggagggtggcgacccggacgcgctcgcccgcggcccggcagccttcgacgcagccgcgatccacgctttcctggaggtgcatatcgaacaggcgccgagcctcgaggaggccgggatcccggtcggactgtgcaccgggatccccggcaacgtccgctatcccgacgtccgcatcgccggccgctacgaccatgtcgggacgccgcgccgcttccggcgcgacgcggccatggccggggccgagatcgccctggcgctggaccgggtctgggcggagcgcgaggccaccggctgcccgatggccgtcaccttcggccggttccacaccgacgccgcggcgcacgggctgacgacggtcccgggcgagttccggttcagcctcgacatgcgggcctacgcggccgcggtactggccgagctggaggcagcgttcctggcagccgtggcggaggtgtccgaccgtcgcggcgtgacggtgacgctgggtccgcgcgccgaggcgggcgtcggcgccgtcgcgccgcggatccgcgacgggttcgcggcggccgcggacgccctcggcatcgcgacgcggcccctcggcagcccggcctcccacgacgccgccgccttcgcgaaggccggcgtgccgatggcgatgctgctcgtgcgcaacgccaacggcagccacaatccgcgcgaggccatggcgatcggcgacctgctcgacgccgtggcgatcctcaccgcgtggctcgtggcggagacctgcggcggctga

SEQ ID NO: 4736 - DNA, 1257 bp, Methylobacterium sp.
atgacccggctcgcgatcgatccggatctctgcgcgggcctgttcgccgagctcctgagcttcagccaggacgcgccgggcgtgacgcgggcggcctacggcgtcggcgaggagcgcgcccacgccctgatgcgggcgaccgggctggcgctcgggctcgccgccgagaccgacgcggccggcaacctgttcctgacgctggcggggcgcgacccggcgctggcgccctggatggtcggctcgcacgtcgacacggtgccccacggaggcaatttcgacggcgcggcgggcgtgatcggcggcctcgcggccgtggaggccctgcgccgggcggggatcgtgccggcgcgtcccgtgacggtggcggtgttccgggccgaggagagcgtgtggttcccggcctcctacgtcggcagccgggccgcgctcggcctgctgccgccggaggtgctcgacctgccccgcgccgataccggccggagcctgcgcgaccacatggccgaactcggcctgcggccgggggcggtggcgcggggcgagcggctcctcgatccggcgcggatccacggcttcgtcgagatgcacatcgagcagggcccggcgctggaggcggccgggttccccgtgggcttcgtcacggcgatcagcggcagcttccgctaccgcaaggcggcctgcttcggccgctacggccattccggcgccgtggcgcggggcgagcgcagcgacgccgtcttcgccctcgccgacctgatcaccggcctggacgcgctctggggcaggctggaggcggagggctgcccggccacgatcacgctgggcgaggtcgccaccgacccggtccagcacgccttcgccaaaattcccggcgaagtccgcttctgcctcgacgtgcgcagcaccgagtcggacgttctcgaccgggtcgaggcggcgctcgccgcgcatatcgccgccatcgaggccgcgcgctcggtacgcttcgtgctgggcgagcgcacgggcagcacgccggcgcggatgagcgccgcgctggtccaggccctgtcgggccacgcgcgccggctcgggacgccgttccgcacgatggcgagcggggcggggcacgacaccgcgacgctggccggccagggcgtgccgagcacgatgatcttcatccgcaaccagaacggcagccacaacccggacgaggcgatgcggatcgcggatctctgcgccgccgccaccctggtggcccacctcgtcgccgaagcctga

SEQ ID NO: 4737 - DNA, 1605 bp, Methylobacterium sp.
atgagcgagccggtcgtccgcatccgcgatctgacgatcgcgctccccaagggcgccgaccgcccgcacgcggtcgagggcctgaacctcgacctcgaggccgggaagatcctgtgcgtcgtcggggaatcgggctcgggcaagtcgatgagcgcctacgcgctgaccggcctcctgccccgggcgctgaagccgacggccggcacgatcctgttcgagggccgggacctcctgaccctcgacgagcccgcgtggcgccacttgcgcggccggcgcatcgccatggtgttccaggagccgatgacggcgctgaacccggtgatgcgggtcggcgaccagatcgccgagatgttcgaggcgcacaacctgctcacccgcagcgagcgctgggcccgggcggtggcgctcgccaccgaggtcggcctgccgaaccccgaggaggcggtgcgggcctacccgcaccagctctccggcggccagcggcagcgggcgatgatcgccatggcgctggcgctggagccctcggtgctggtcgccgacgagccgaccacggcgctcgacgtcaccacccaggcccagatcctccggctgatccgcgacctgcagcggaagcgcgggatgagcgtcctgttcatcacccacgatttcggcgtcgtggcggagatcgccgaccacgtggcggtgctccagcgcgggcggctggtcgaatccggcaccgccgaggccgtgctgcgcgcgccccaggcgccctacaccaaggcgctgctcgccgccgtcccgagcctgaccccgccgccgcgcccgcccctggaggcggccccggtcgcgctctccgtgaaccggttgtccaagacctattccgggcgctccggcctgttcggcaagccgcgggtcgtggcggccgtcaaggaggtctcgttcgacgtccgccgcggcgagaccctggggatcgtcggcgaatccggctccggcaagtcgaccacggcgcggctcgcgatccggctgatcgagcccgacggcggcaccgtccggctgggcgagctcgactacacggcgctcaagagccgcgaactgcgcgacaagcgcagccggatccagatgatcttccaggacccgttcgcgtcgctgaacccgcggcgaaccgtggagcagatcatcacggcgggcccgatcgcccacggggtcccggccgcggaggcgcgcgagcgcgcccggagcctcctcgacctcgtcgggctcgatcccagggccgccgcccgctaccccaacgccttctcgggcgggcagcgccagcgcatcggcatcgcccgggcgctcgcgatggagccggacgtgctggtggccgacgaggcggtctcggcgctggacgtctcggtccagcggcaggtgctggacctgctggaggatctgaagcagagattgtcgctggcgatgctgttcatcacccacgatctgcgggtggccgccacgatctgcgaccggatcgccgtgatgcaccgcggcgccatcgtggagatgcgggggaccgcggacctgttcgccgcgccggagcacgcctacacccgcaccctgctcgccgcagtgccgggcgcgcgcgcctcctga

SEQ ID NO: 4738 - DNA, 903 bp, Methylobacterium sp.
atgattgtctggacccgccgcgccgtcggcctcggcctgctcgccgcgcccctcgccgcgcccctctccgcgtccctggccctgcccgcgcgcgccgcggaggcggagccggactgggccgccatcgagcgccagctcggcggccgcctcgggatcgcggccgcctcggcggaccgcgtccttgccgcctaccgcgccgacgcgcgcttcccgatgtgcagcaccttcaaggtgccggcggtggcggcggtcctggcgcgggtcgatgccggccgcgagaccctcgaccggatcgtcagctacggtgccggcgacctcctgagctacgcgcccgtgacccggaaggcgctggaggccggcgccgggaccgggcggatgagcgtcgccgacctgtgcgcggccacgctgatctggagcgacaacacggccgccaacctgctcctggcggatctcggcggccccgacgcgatgaccgcgtggctgcgtaccacgggcgatcccgtcacccgcctcgaccggaccgagccgaccctcaacacggcgctgcccggcgacccgcgcgacacgaccacgccggacgccatgcgggcgaccctgggccgtgtcctcctcggaaccatcctgtcgccggcctcgcgcgcccggctggaggcctggatggtcgcctgcgagaccggccggaagcgcctgcgggccggcctgccgcccgactggatcgcgggcgacaagaccgggagcggcgacaacggcaccgtcaacgacgtggcgatcctccggccgccggggcgcgcaccgatcctcgcggcggtctacgtcacggactcgaccgcctctcccgacacctgcgcggcggcctacgcggagatcggccgcctcatcgcctcacgcgcccacgcgacctga

SEQ ID NO: 4739 - DNA, 912 bp, Methylobacterium sp.
atgcggcgcggcaccctcgacgatctggcggccttcgcggcggtggcgcgccatcgcagcttcacgcgggcggccgccgagatggggctgtcgccctccgcgctcagccacacgatgcgggctctggaggcgcgtcacggcgtgcgcctgctggcccgcaccacccgcagcgtcgcgctcaccccggccggcgagcggctgctgcggtcggtcggccccgcgctcgaggacgtcgcgcgggggctcgacgcgctggccgactggcgcggcgcgccgtcggggcggctgcgcctgacgaccttcgcgtacgccgcgcgggcgatcctggaaccccgattgcccgccttcctgatcgatcacccggccgtctcggtggaggtgatcgtggacgaccgcctgaccgacgtcgtcgccgccggcttcgacgccgggattcgcttcggcgagacggtcgagcgcgacatggtggcggtccgggtcggacccgacctgcgcacggtcgtcgtcgcgattccggactatttcgcccgccacccgcgcccggagagcccggccgatctggaagcgcatcgctgcgtgaactaccggctcgtcggcggcggcggtttgctgccctgggagttcgcccgcgacggccgcgacatccgggtgcgcgcggcaggccaactcgtcgtgaacgacggccggctcgcggccgccgcgatccgggccggtgccgggctcggctacatgctggaggacgaggcggccgacgacctcgccgcgggtcgtcttgtccaagtgctggacgcgtggtgtccgccgtttcccggctgtcacctctactaccccgaccggcaggtcacgcccgccctgcgcagcctgatcgacgcgctgcggtggcgggaggcgccgtcgccttcccgcccgtga

SEQ ID NO: 4740 - DNA, 717 bp, Methylobacterium sp.
gtgagcgcggtgcaggtctggatcgtcgacctcgccctgtctccgagccaggtggatcggtgcgatgccgtcctcgacgccgcggagcgcgcgcgggctgaccgtttcctgcgcccggcggatcgggcccggttccgcgccagccacgccgcgctgcggctcgtcctcggcgacgcgctcggtctcgcgccggccgacgtcgaactcgccgccggagccggcggcaagccggagctggcgggcacaggacggggcgccgccgacttcaacctctcccattccggggcacgcgcgctgatcgggctcacccgcggcgcggcgatcggcgtcgatgtcgaggccgtgcggccgatcgcggacgcgctgcggatcgcggcggcccatttcgccgccgacgaagtgtcggccctggccggggccccgcgaagcgcggtcgagaagtgcttcttcggtctgtggacccgcaaggaggcggtggtgaaggctttgggcagcggcctgtcgctgcccctcgaccggttcagcgtcagcgttccgcccgaagcgccgcgccttctccgggccgacggcgacgcgtcctggaacctggacggtccgtggagcctggccgagatcgattgcgggcgcgatcacgtcgccacggtggcggtccgatccgcggaggcggagatcacctgccaccgtcccccggacgactggcccgatcatctgggctga

SEQ ID NO: 4741 - DNA, 768 bp, Methylobacterium sp.
atgacgccccggcaccgcgccccgacccgcgaccgccgcgcgctccgcgccgcgctgcttgcctgctcgacgctggccgcgatgccggcgcgggccgagcccgtccgcgccgtggtcgagctcttcaccagccagggctgcggcgcctgccggtccgccgacccggtgctgcgcgacctcgcccacaagcccggcgtcatcgccctgaccctgccggtgacctactgggactatctcggctggaaggacacgctcgcgctgcggccgctgaccgagcgccagcgcgcctacgcgcggggccgcggggcccgacaggtcttcacgccccaggtcgtggtcgacggcaacggcttcgccgtcgggtccgaccggccggccctggagcgcctgatccgcgatgcctgccagcacggcgggctgccggtgccggtgcgcggggagaccaacggcgaccggatcctggtggaggtcggggcggccccggaggccaagaccgagatccgcggcgacgtctggctggtgcccgtgctccgcagccgcgccatcgcgatccagtccggagagaacggcggccggacggcgacctacgtcaacgtcgtccgcggcatgcagcggctcggtccctggacgggccagccgacccgcttcgaggtgcccgacacccaggcccgcgtcgccgacgcggacagctgggtcgtcctgctccagggcgctgccgacggcaagccgggccgcatcttcggggccgccaagggaccggggctctag

SEQ ID NO: 4742 - DNA, 246 bp, Methylobacterium sp.
atggatcaggagcagcgcatgacggatctgctcgagaaggccgtggcgaaggcgcgggatctcgcaccggagatgcaggacgagattgcccgcctcatgctggccttcgtgggggatgaggcccccgtctaccggttcaaccccgaggaagaggcagagcaggacgcggccgatgccgaggaggcccgcggcgagtatgccaccgaggcggaggtgcgcgccatctgggcgaaatatggcctgtaa

SEQ ID NO: 4743 - DNA, 1251 bp, Methylobacterium sp.
gtggtcgcgaaggtcctgaccatgcagagcgtcgaacgccataagccgcagcctgccggccggctcgagatcccggatgccgcccttcccggcttctacctggtcgtgcagccgagcggcgcgaagtcttgggcggtgcgctaccgtttcggcggcaagacccggaagttcacgatcggcccctacccgctgttcgacctcgccgcggcgcgtgcggcagcgcgcgaagcgctccaaatggcggcccgcggccgggacccgatccttgagaagaaggccgccgtggaagccgctcaggccgccgagcgcgacaccgtgcgggcggtcgctgcggaatacgtcgagcggcacctgaagccgaacagcaagcccaggtacgccgcggaagcggaggcactgctgcgcaaccacgtagtcgcgcgctggggcgaccggcgcatgtgcgagattacccgcaaggacgcgatcgccctcacggacgcgctcaccgacgccggcatgggcgtcggagccaatcgggtgttctcggcggcgcgcgccctgttcaactgggccctggagcgggaggtcatcgagaccacgccgttcctgcggctcaagccgccgctggccgaggcgagccgggagcgcgtgctaagcgacgccgaggtgcgcctcgtgtggctcgctgccgagaaggtcggctaccccttcgggacgctcgtgcagctcctacttctgaccgcccagcgccgcgacgaggtcgcccgcatgacttgggcggaggtcgacgcggacggcttatggacgctcccggctgctcggacgaagaacagccgcgagcacttggtgcccctccccttctctgcttgcgagatccttgcgaccgctccacgcatcgccggccgggcaggtttcgtgctgaccaccgacggcgcaaccgcatcgagcaacttcgcgaagaacaaggcgaagctcgatgccgccatgctggagattgcgcaccaagaagcggccgaggcaggccgcgatcccgatagggtcgagctcatttcctggcggctgcacgacctccggcggaccgccagcaccggcatggctcgcctccgccaacccgtccacgtcactgaagccgttctgaaccacgcgacgggcgccgtgagcggcgtggccggcatctacaaccggtatcagtacctcgacgagaaacgggcagcgctggaggcctgggctgcgcacgtcgaggcgatcgtcggcaaggaggcccggtga

SEQ ID NO: 4744 - DNA, 1245 bp, Methylobacterium sp.
gtgacccgggaaagggcttgcgagacgcagttgccggctcagatgttgacggatgcgcaggtgcgatcgttgaaggctgacggcgcatcgcgcctgatgatctacgacgccaaggctcaaggcctatgcctccgtgtctcggccacttcgaaatcgtggagttttatctaccgcccgaaaggcggcgccaagcagcggcggtatacgatcggtgactatcccagctggagcctggcccaggcccgcgagaagacattcgcccttcgccggactgtccaggaaggcggggatcccgtggcggccgctcaggagcgtgtcgcggcgctcacggtcgccggcttcatagagcggtatatcgagcggtacgccaagaagaagctgcgctcttggcgcgattacgaggggttgctcaaacgcgacgttgttccggcgctcgggcagcgccgagccgaggagctgacccgtgccgaggtggcaaacctgctcgataagatcgctgcccgcgcgccggttgtcagcaacagggtcctgaacacactgagcgccgtgtactcctggggcgtctccgaagggctcgtgccatccaatccggtcaccggcctgaagcgccggcatctggaggctcccaaggagcggtatctctcggacgaggagatcgtagcgttctggaacgtgaccgagtccgcggcgccagcttaccgagacacgttcaggctgatcctactgaccggtcagaggccaggcgagtgtgctggcatccgagcggaggaggtcgatctcgctgccgaaatttggacgctgcccccctcccgaacgaagaacggtcgccagcacaaggtcccattggtcggtagggccctggagatcgtgcgccggctccgtgcggatcgatcggccggagcgctgatcgtcagccctcgcggcaaactgatcacgcctcaaaacctcgctaaggccttcgagaatttgagagatggtgtgttcgagtcgaacgtgacgccgcacgatctgaggcgcacagctgcgacgctgcttggaaagctcagcgtcggacgcctgactcaagggtatgtactcaatcacgtgagcacgaccaagagttctgtaaccgggtcagtgtacgaccaatacgattatgtgcctgaaaagcgggtcgccctcgaagtacttgatgccaagattttatctataatcaatgggcatacaatgccgacaaatgttgtattgatggcgcggggttcatag

SEQ ID NO: 4745 - DNA, 684 bp, Methylobacterium sp.
atgcccctcgagcagcttgagctggcgatcgcgctcggcgaggcggtgctcgcgggtcgcgcggatctcgctctcctcaatcgccgctcgctcgcgtggcgcggcaagatcgccctcgcgccggtgccaacggctctccgcgacggcgacctgaccctgcgccgctggcgcccggaggacgcggcgccgttcgcggcgctcaacgccgatccggcggtgatggcccactttccccggacccggaccgcgacggagagcgaagccgaggccggcctcctcgaccgccgcttcgtggcggacgggttcggcccctgggccctggaacacgcgggccggttcgtcggcttcgccggcgcgatgcggatcctgcggcccctgcccttcccgggcggcgaccggcccggttcgacggtcgagctggcctggcgcctcgcgcgcgactcctggggccgcggcctcgccacgcgcgccgcgcggctcgcccgcgccgacctcgccgggcgctgcgggatccggagcgtcgtggccttcacggcggccggcaacggccgctcccgcgccgtgatggagcgtctcggcatgcgcgtggccgggacattcccgcatccggcggtgccggaggggccgctgcgcgaccacgtgctctaccggctggactgcgccgacagggaggaagcggcatga

SEQ ID NO: 4746 - DNA, 120 bp, Methylobacterium sp.
ttggtggggcgccgcctgcccgatgccgcccggccgggatggccggtgcggctcgaccattgcttcgcccgcatcctcctggatcaggcctgcggcggctcctggcgcgaccatgtccgc

SEQ ID NO: 4747 - DNA, 1572 bp, Methylobacterium sp.
atgctccgtctcctcaccttcctttacctgctgctctgcgccccggccctcgcccaggcgtccgatccctacgcgcagctcgccggtgacggctacgccgagatcgaggccggcgtctccggcctcgccgcctccggcgacccgcgcgccgacgcgatcctctcggccttgtcggacggccgcctgctggtgagcccggacaggaccctgctgatccggcagggcaacgccgtcgtcgacgcgaggaccggcgctccggccgccgacagccccgacctcaagccggtgcgggccaacaaccgggtccgccgggcgatcgaggccgcccgcgggcagctcgacctcgcgagccccgacccggccaggcgccgcgccgccgccgacgcggtgttcaaggcgcgggacgcggcggcgctgccggccctcgacgtggcgctcgcccgcgagaccaacccgggcgtccggcaggcgctcaccgaggcgcgcgccgccgtgctgctcgcgaggcccggcaccgcggaacccgaccggattgccgcgattcccgccatccaggcccggggcgatggcgacgcgatgggcatcctgcgcggtctcgcggcggatccgagcgaggccgtgcgcgccgccgccgcccgcggcatcgcggcgatcgagacgcggctcgcgatcctcggtgccctccagaacgtctggtacggcatctcgctcggctcggtcctgctgctcgccgccatcgggctcgccatcaccttcggggtgatgggcgtgatcaacatggcccacggcgagatggtgatgctcggcgcctacacgacctacctcgtgcaggagctgatccgcaccaaggcgcccttcctgttcggctggtcgctggcgatcagcatcccctgcgcgttcctggtcgccggcctcgtcggcgtgctgatcgagcggttcatcatccgcttcctgtacgggcgcccgctggagacgctgctcgccaccttcggggtcagcctcgcgctgcagcagggcgtgcgctcgatcttcggcccgaccaaccgcgaggtcggcgcaccggccttcatgagcggtgccttcgacttctacggcctgtcggtcacctggggccggatgtggatcatcgtgttcgcgttcgccgtgttcctgggcctcctgttcgtgctgcggaagacgtccttcggcctgaagacccgggcggtcacccagaaccgccgcatggccgccgcgatgggcatccgcacgccctacgtcgacgccctgaccttcgggctcggctccggcatcgcggggatcgcgggcgtcgccctctcgcagatcgacaacgtgtcgcccaatctcggccagggctacatcatcgactcgttcctcgtggtggtgttcggcggcgtcggcaacctctgggggacgctggtggcggcgctgacgctcggcgtcgtgaacaagctcgccgagccgtatatcggcgcggtgctggccaagatcggcctcctgatcttcatcatcctgttcatccagaagcgcccgcgcggcctgttcgcgctcaagggccgggcggtggaatcgtga

SEQ ID NO: 4748 - DNA, 1155 bp, Methylobacterium sp.
atgccgtcccgcaccccccttatcgatctcaagggctggatcttcctcgccgtcctggccgccttctgcctcgccgtgccggtgctgaacctcgcggtgccggagggctccggcctgcacctgccgacctacctcgtctcgctcctcggcaagtacctcgcctacgcgctgctcgcggtcagcctcgacctcgtctggggctattgcggcatcctctcgctcggccacggggcgttcttcgccctcggcggctacgcgatgggcatgtacctgatgcgccagatcggatcccggggcgtctacggcaacccggtcctgcccgacttcatggtgttcctgaactacaaggcgctgccctggtactggtacgggttcgaccacttcgccttcgcggccctgatggtgctgctggtgcccggcctgctcgccttcgtgttcggctggctcgccttccgctcgcgggtgacgggcgtctacctatcgatcatcacccaggcgctgacctacgcgctgatgctcgccttcttccgcaacgacatggggctcggcggcaacaacggcctcaccgacttcaaggatctcctgggattctccgtccagtcccagaatttccgcgtcggcatcttcgtggccaccggaatcgcgctggcgctgggctacctgatcgcccgggtcctgacggtctcggcctacggcaagatcctgatcgccgtgcgcgacgccgagagccggacgcgcttcctcggctaccggccggagcacttcaagacgctggccttcacggtctcggccatgatggcgggcgtcgccggcgccctctacgtgccgcaggtcggcatcatcaacccgggggagttcgcccccaccaactccatcgagacggtgatctgggtggcggtgggcggccgcggcacgctggtcggcgcggccctcggcgccgtgctggtcaactacgccaagaccgtgctcaccggcgcgatgccggacgcgtggctgttcgcgctcggcggcctgttcgtgttcgtgacgctgttcctgccgcgcggcctcgtcggcaccgccatcgagcggttcggcggccggcgcgcggcggccaagctgccgccggagcccgagatcgccccgaaacgcgtcgaacaagggcagggcgcatga

SEQ ID NO: 4749 - DNA, 1296 bp, Methylobacterium sp.
atgaaggcatttggaacttgggcctcggccgccgcgctggccgccgggctggcgatgggcacgctgggagcgggcgccgcccgggcgcaggagaccatcaaggtcgggatcctgcactcgctgtcgggcacgatggcgatctcggagaccaccctcaaggacgcgatgctgatgctcatcgcggagcagaacgccaagggcggcgtgctgggcaagaagctggagccggtggtggtcgatccggcctcgaactggccgctcttcgccgagaaggcccgcgagctgatcagcaaggacaaggtcgcggcggtgttcggctgctggaccagcgtgtcgcggaaatccgtgctgccggtgttcaaggagctcgacaacatcctgttctaccccgtccagtacgagggcgaggagagcgagcggaacgtgttctacaccggcgccgccccgaaccagcaggcgatcccggcggtcgactacctgatgtcggaggacggcggcggcgccaagcgctgggtgctggaggggaccgactacgtctacccgcgcaccaccaacaagatcctcgaagcctacctcaagtccaagggggtcaaggacgaggacatcatgatcaactacacgccgttcggcttctcggactggcagacggaggtgtcgaagatcaaggcgttcgggtccgccggcaagaagaccgccgtggtctcgaccatcaacggcgacgccaacgtgccgttctacaaggagctcggcaaccagggcatcaaggccaccgacatcccggtcgtcgccttctcggtgggcgaggaggagctcgccggcatcgacgccaagccactggtcggccacctcgccgcctggaactacttcgagtcgatcaagacgccggagaacgaggccttcatcaagaagtggcaggcgttcaagaagaaccccaaggccgtcaccaacgacccgatggaggcccactacatcggcttcaacatgtgggtgaaggcggtcgagaaggccggcaccacggaccccgacaaggtgatcgacgcgctgccgggcatcgagcagaagaacctcaccggcggcaccgcgaagatgctgccgaaccaccacatcaccaagccggtcttcatcggcgagatcgagtcgaacggccagttcgacgtggtctggaagaccgagggcctgatccccggcgaggcgtggtcgaagcagctcgagggctcgaaggacctcgaggccgactgggtcaagctcaagtgcggcaactacaacaccaagaccaagtcctgcggcggcgcctga

SEQ ID NO: 4750 - DNA, 1761 bp, Methylobacterium sp.
atgccgccgcgcttccggttccccgtcccgcttccgcgctcgctcccgcgctctctgccgctgtcgctgacgacccgcatcctgctgctcgtcctgctcgccctcgccccggcgctggcgatccagggctacaacgaggtcgccctgcgggcgagccgcgacgcggccgtgcgggccgacgcccgcgccaccgcgcgggacgtcgccgaggatttcgcccagatctccgagcggatgcagcaggccctcgacctgatctccgaggatgccaccgtgcaggtgcgggagccggcggcctgcaccgcctacctgcggcgggctgccgcgcggctgccgcacgtgctgctgatcgccctcaccgatcccgacggggccgtgatctgcgacagcgccggcgcgcccgcgggctcctactcgagccgcggccgggcctatcaccgccgcgccctggagcggggcggctacgcggtgggcggatacgcggtcggcttccagacgaagcggccgtcgatccacttcgcccgggccgtccatgtcggcgagtcggcgggggccccggctggcgtcctgctcgccgccgtcgacctcgactggctctccgatcacctggagcaggcgctccatcagccggagacggcgatcaccgtgacggaccgggacggcctgatcatcgcccgccgcccggacgaggcggcctggatcggcaggccgatcccgcccgaccgggccgccatgctggaggcccagggcagcgacgtccgcgtcgccgccggcctcgacggccggaagcgcatcatcgccaccgcgatgccggacggcccgctggccggggtgcgcgtcgtcgtcgggcgcgaccacgccaccgccttcgcggatatcgacgccgccacccgccgcgggctggtcctgatcgccctgggtgcggcgctggcgctcgccgccgccctcttggccgggcgggtgttcatccggcgcccggtcgaccggctcctgcgcaccgcggcggcgtggcaggccggcgacctcgccgcccgcaccggcctgcgcggggccgcggagttcgaccggctcggcagcaagctcgacgccatggccggcaccctccagcgcagcaccgccgagctgcgcgcggagatccagcgcgggcgcgccctgcaggcgcagcagggcacgatgctgcacgagctgaaccaccgggtgaagaacaccctggccaccgtccaggccctcgcccggcagtcccgcggctccgcggaggtcctggaggcgcggatcctggccctgtccaagacccacgacctcctgacccgcgaggactggagcggggcccccctgcgcgaggtgctggagagcgagctcggcccctaccggaccggcggcgaccagatccgcctggacgggccggacgtgtcgctgagcccccgcgaggtgctggccctcggcatgacggtccacgagctgaccaccaacgcggccaagtacggggccctctcggtccgcgagggccgcgtccgggtggcgtggtcgctcgccgccggtgcggccggggagcggcgcctgcggctcagctgggaggagcgcggcggcccgccggtgcgggcgccgacccgggtgggcttcgggacgcggctgatcgccggcggcgtgcggcgggaactcgccggcaccgtcgaccttgccttcgaggccgagggcctgcgctgctgcctcgacgtcccgctcgatccgggtctcggcaccatgctggcgccgacgggctag

SEQ ID NO: 4751 - DNA, 735 bp, Methylobacterium sp.
atggtgcacgcccgctcgctcctgttcgccgtctactgggccgcctggaccacgctgttcctcgcgccgctggcgatcttcctcctgtccggatcgccgcagcggccgatccgccgggcgacgcggctctgggcgcgcgggatcctgggcggactgcggcgcatcgtcggactgcgctacgtcgaggagggccgccagcacctgccggacgagccctgcctgatcgtcgccaaccaccagtcgacctgggagacgctggccttcctggtcctggtgccggacgtggcgatcgtcgccaagcaggaactgctggcgatcccggtggtcggctggttcctccggcgctcgccgatgatcgtcatcgaccgggccaagggcacccaggccctgcgcaccatgatcgacggcggtcgggaggcggtcgcggcgggccggtcggtcctgatcttccccgagggcacccgcggcgcgatcggcgaaccgctgcgcttcaagcgcggcgtcgagctgctctacggccggctcggcctgccggtggtgccggtggcgctcaattccggcctgttctggcccgggggcgcggcgacccggtccggcacggtggtggtgagctacctcgccgccctggcccccggcctgccgaccgcggagttcctgcacgggacggagggcgcgatcgatcgggagttgaaccggtggcggccgggcggcgcggccgggctcggcgccccctga

SEQ ID NO: 4752 - DNA, 987 bp, Methylobacterium sp.
gtgacgctcctcgtcgtcctcatcgtcctcgccctggtcttcgacttcctcaacgggctgcacgacgccgcgaactccatcgccacgatcgtgtcgacgcgggtgctggcgccccgctacgccgtgttctgggccgcattcttcaacttcgtggccttcctggtcttcggcctgcacgtcgccggcacggtcggctcgggcatcatcgacgtcgcgacggtggacgaccgggtcatcatgggcgcgctcggcggcgccatcacgtggaacctcatcacgtggtacgccggcatcccgtcctccagctcgcacgcactgatcgggggcctgctcggcgccggcatcgccaaggcgggggtcggcgtgatcgtctggcccggcgtcatcgccaccagcgccgccatcgtcctctcgccggccctgggcttcgccctcgggctgctgctgatgctggcggtctcgtggatcttcgtccgctcgacgccgcacgccgtggaccgcgtgttccggggcctgcagttcgtctcggcctcgctctactccctcggccacggcggcaacgacgcccagaagaccatgggcatcatcgcggccctgctctacgcccacggcgagagcggggcgttccacgtgcccctctgggtggtgctgtcctgccagaccgccatggccctcggcactctgatgggcggctggcgcatcgtccacacgatggggtcgaagatcacgcggctgtcccccatgcagggattctgcgccgagaccggcggcgccgcgacgctgttcgccgcgacggccttcggcatcccggtctcgaccacccacacgatcacgggcgccatcgtcggcgtgggcgccgcgcgccgggtctcggcggtccgctggaacgtcgcgcagggcatcgtgatcgcctgggtgatcacgatgccggccgcggccctggtcgcggccctgacctacgcggcctcgggcctggtcctgccgtag

SEQ ID NO: 4753 - DNA, 1593 bp, Methylobacterium sp.
atgacgctctcccgccgccagatcctggccggtaccgcaggcgcggccgccggccttggcctcccgcacctggtccgggcccagcccggcggcggcagcgtgctgcgcttcattccgtcgacgcccctgccgtccctcgatccgatcgtcgccacgagctacgtcatccgcaaccacggctatctcgtctacgacacgctgttcgccaccgacgagaatttccgcatccagccgcagatggtgaaggagtggcagaccgcgcccgacggcctgcgctggaccttccatctccgcgacggcctcacgttccacgacggctcccccgtcgaggccaaggactgcatcgcgtccatcgcgcgctggtccaagcgggacgcgttcggccagaccctggcgggcttcgtggaggggtacggccaggaggacgcgcggaccttcaccgtcgcgctgaagaagccgttcccgctgctcccggcggcgctcggcaagctgtcctcgaacgtgcccttcatcatgccggagcgcgtcgccctccaggacgcgtccaagccgatcgccgacgccacgggctccgggccgtggcgcttcgaggcgcgggaatggatccccggccagaacgcgatctacacccgccacgcgggctaccgaccccgcgaggaggcgccctcctgggccgccggcggcaaggtcgccaaggtcgaccggatcgagtggctcgccatcaccgaggcctcggcggcggtgggcgcgatgatccagggggcggtcgactggtacgagcagccggcgatcgacctgatcccggtcctcaagggcaagccggggatcgagatccgcaacgtgccgctcgggctgatcctgctgatgcggttcaaccacacgcagccgccgttcaacaatcccgagatccgccgggccgtgatgatggccatgaagcaggacgactacatgcaggcggtggtcggcagccccgaatactaccgggaggccaagaccttcttcacgccgggctcgccgatgtcgaccggggccggcggagccgcggccatgcaggcggacctcgccaaggccaaggcgatgctggccaaggccggctacaagggcgagcgcgtggtgctcctggccccggccgaccagccgatcgcctacaaccagtcgctggtgacccaggacctgctcaagcagctcggcatgaacgtcgatctggtctcgaccgactggggcagcttcatcgcccgccgcggcaaccgcgggccggtcgatgccggaggctggtccctgttccacaccctctggtcgggggcggacgtgctgaacccggccctgcacccgctgatccgcgccaacggtcaggcggcgtggttcggctggccggacgacccgaccctggagacgctgcgcagcgagtggatcgccaccagcgacgaggcgcagcagaaggcgctcgccgcgcgcatcgaggagcgggctttcgaggtcgtgccctacgcgcccgcgggcctcgtgcagcagccgatggcggtcagcgcgaagctcaagggcatggtcatggcgccggtgcagttcttctggaacatcgagaagaccggctga

SEQ ID NO: 4754 - DNA, 1596 bp, Methylobacterium sp.
atgctgcgacgaaccttcctcggcggtgccgccgccgcggccgcggcgcccttcctgccggcccgcccggccctggcccagggcggccgggcgagcgtcctgcgcttcgtgccgcaatccgacctgaccatcgtcgacccggtgacgaccacggcctacgtcacgcgcaaccacgcgctcatggtgttcgaccagctctacggcctcgacgcgcagctcacgccgcagccgcagatggtcgaggggcacgcggtcgaggaggacgggcggcgctggaccttccggctgcgcgaggggctgcggttccacgacggcgagccggtgcggggccgcgactgcgtcgcgtcgatccggcgctgggcgcagcgcgacagcctcgggcaggccctgatggcgcgcgccgacgccctggaggcgccggacgaccggaccttcgtcatccgcctgaagcggccctacgggctgatgctcgagaccctggcgaagctcggtccgccggtcctcgtcatcatgcccgagcgcctcgccgccaccgacccggcccagcagatccccgagctgatcggctccgggccgttccggttcaacactgaggagcggctcgtcggagcccgcgtggtctacgaccgcaacccggactaccggccccgcgaggacggcccggtctcctgggtggcggggccgaagcgggtccatttcgagcgggtcgagtggcaggtcatgccggatcccggcaccgcggcggccgccctccagaacggcgaggtcgactggtgggagaacccgatcagcgatctcgtgccgacgcttcaggcgcacccgcagatcgccacgcagctcgcctcgccgctcggcaatctcggcaccggcgtgatgaatcacctccacccgcccttcgacaagcccgcggtccggcgcgtcgtcctcgaggcgctgtcccaggcggacttcatggcggcggccgccggcgacgatcccaagctgtggcgcaaggatgtcggcctgttcacgccggggaccgcgatggccaccgatgccgggctcgacgtgctcacccggccgcgcgatctcgccaaggccaagcgcgacctcgtggcggccggctacaagggcgagcgcgtcgtgctcatgtcgacgagcgagaaccccgtgctcggcgccctcggcgagatcatgcacgacctgctccagcgcctcgggatgaacgtgcagtacgtcgtctccgactggggcacgctggtcacgcgccgcgccagcaaggcgccccccgaccagggcggctggaacatcttcaccacgacctggaccggcctcgacatggccaacccggtcgtggagcaggtcctgcgctgcggcggaccgaagggcttcttcggctggccggacctgcccgaactcgagagcctgcgcgaggcctggatcgaggcgccggaccaggccgcgcgccaggcgatcgcggcccggatgcagaccctggcgatgcgcgacgtgccgtacctgccgaccggccagtacttctaccggacggccttccggcgcgacctccgggacgtggtcgacggccagttcgtcttctggaacgcccgccgcgcctga

SEQ ID NO: 4755 - DNA, 1551 bp, Methylobacterium sp.
atggccctgtcgggtgccgccctcgcgaccccggcgctggcgcagggcagtgccgcccggacgctcaagttcatcccgcaggccgacctgacggtgctcgatccgatctggacgaccgcctacgtcacccggaaccacgggctcgccgtcttcgacacgctctacggcaccgatgccgcctacgccgcccagccgcagatggtggcgggccacacggtggaggacgacggcaagctgtggcgcctcaccctgcggcccgggctgaccttccacgacggcagcccggtcctggcccgcgactgcgtggcgagcgtcgcgcgctggggcaagcgcgacgccatgggccagacgctcatggcctacacggacgagctctcggccccggacgaccggacgatccagttccgcctgaagaagcccttcgcgctcctgcccgacgcgctgggcaaggtcggctcctcgatctgcgcgatcatgccggagcgtctcgccaagaccgacccgttcacgcaggtgaccgagatggtcggcagcggcccgttccgcttcaaggcggacgagcgcgtggtcggcgcccgggtggtctacgagcgcttcgccggctacgtcccccgcgagggcggcgagccgcaatggacctcgggcccgaagcgcgtccacgtcgaccgggtcgagtggaacgtcatccccgaccaggccaccgccgcctcggccatgcagacgggcgagatggactggtgggagcagccgccggccgacctcgtgcccaccctccgcgggctgacgacgcggatcaccgacccgaccggcctgatcggctgcctgcggatgaaccagctccagccgcccttcgacaatccggcgatccggcaggtgctgctcaaggtcgtcgaccagaccgacttcatgcaggcggtgaccggcaccgatcccaagctgatccacgtgccgaccggcttcttctgcccgggcctgcccatggcgagcgacgtcggcctcgacgccctgacaagcaagcgcgactacgcgggcgccaaggcggcgctggcggcggcgggctataagggcgagaaggtggtgctgatgggcgcctcggacttcccgagcctgaaggcgctcgccgacgtggcggccgacatgctcacgcgcgccggcttcaacgtcgactatcaggtcatggactggggctcggtggtgcagcggcgcgccaagaaggagccggtcgcccagggcggctggagcgccttctgcaccttctgggcggggctcgaccaagcgaatcccgcggtcagcgccttcctgcgcgggaccggccagagcgccgcgatcggctggcccaccagtgcgaggatcgaggcgctgcgggaccagtggctggacgccccggacaccgccgcgcgcaagcggctcgccggcgaactccagcagcaggccttcgtcgacctgccctacctgcccctcggccagtacttcaaccagacctcgtacaagccgtccctgaccggcgtcctcgacggcgtgccggtgttctggaacgtcaagaagggctga

SEQ ID NO: 4756 - DNA, 903 bp, Methylobacterium sp.
atgcatcaagacgtacctttcccgcgctcgacatcctccaccggtccccgccagcaggcgacactcgcgcgccccttcgagcgttcgggccgcagcctccattccgggcggcacgccacggtccgcgtcagccccgccccggccggccacggcatcgtcttccgccgccacctgaaggacggacgggcggtcgacgtgcccgcccactggcactaccgggaatcgcagccgctctcctcggcgctgcgacgcgacggcgtcctcgtgcgcacgatcgagcacctgatggcctcgctcagcgcgctgcggatcgacaacgtgctggccgagatcgacgccgacgagttgccgatcttcgacgggagcgcgacgccctggtgtgaggcgatacggatcgcgggtcggcgcgagcagagcctgccctgccgggtgatccgcctgctgcgcacggtcgcggtcgagaacgggcggcgccgcctcgagatcgagccgggcccgggcctgcacgtcaccggccacgtcgcgctggcgcatttcggatcgatcgactggtcgggcgcgatcacgccggactccttcgagcgggagatcgcgccggcccgcagcttcgggcgctacgcgcgggccatggcgggccgcgcctacggctacctgatgcggaacgacttcctgcagggcgtctcgccccgctcggcagcgctgctggtgcgcgggcacgtgctgggcgggatgcgcgtccccggcgagccggttcgccaccggatcctcgacctcgtcggcgacctcgcgctggcgggccacccggtcgagggccggatctcggcgttccacacggggcacgagctgaaccacgccctcgtcaccgccctgatgcgggacggcaaggcctgggaactcgtctga

SEQ ID NO: 4757 - DNA, 1149 bp, Methylobacterium sp.
gtggttctcatcgatctgcccttcgtcatcgccgacaaggaccggcacggcaacgtccggtactacttccgccgacgccccgagaagaaagtgcgcttgcgcggcaagcccgggtcggccgagtttcagacagcctatgaggctgcccgcgatcgcgcgccgatggctccaccggcgaagggcggccgcccggccgtcggctcgttcatcgacgtgtcgcagcgctacatcgcgagcacgaccttcaagaagctcgatgcctcaacgcagggctggcagaagcgtgcgctgaacgagatcgccgccagcgacaaaggcgcggcgccgctcgccatgatgcagccgcgccatgtgcgacgcctgcgggatgagaaggccgagacgccggccgccgccaatacgatgctgaaggcgctccgagccatgttccagtgggccatggaggaggacatcgtcgactcggatccgacgcgggacgtgaagcgggcccagtacgtcaccaaggggcatcacacctggaccctggacgaggtcgaccttttcgagcgccggcatccgctcggctcgaagccgcgcctcgccttcgcgatcctgctctacaccgcctgccggcgcgaggacgcgacgcgcctcggcccgcagcacatccgcgatggccgcctgcgatacgtccaggccaagaacgagcaccggaagcccatcacggtcgacgtgccggtgttcccggatctggccgaagcgatcgccgccctgccctcctcgcacctgaccttcctggtgacggactatggcaagccgttctcggtggcggggttcggcaatcgattccgggagtggtgcgaccaggctggactgccgcactgctctgcgcacggcctgcggaaggcgaccgcggcgcggctcgcggagcgcgggtgcacgccgcacgagattatggccgtcacgggccatcagacgctggaggaggtggagcgctacacgcgcgaggcgcagcgggcgggcctcgccgacagcgcatgggaacgcttcgccgcggggcggcgtggtcccacctcgggagcgggttcaggtcccacttccagtaatccactgacaaagcttgataaaaatgcgccggtggcgctcccaaggggaccgcgccgagcttga

SEQ ID NO: 4758 - DNA, 1245 bp, Methylobacterium sp.
gtgagcgcggaccgggcgaccgcgaaccggttcctgctcggcctcgcgctgatgctggtcgcgttcaacctgcgcccggcgctgagcacggtcggacccctgctggcgacgatccgggacggcacggggctcggcgccggcggcgccgccatcctcacgacgctcccggtcctgtgcctcggcatcgcctgcgcgctggccgcgccgctgatccgccggatcgggcccgacctcgcggtgctcgccggctcgacgatcctcgtcgccggcctgacgctgcgcggactcggcggcctcgtgccgctcttcgccgggacggcgctggcggccatcgggatcgggatcgacaacgtcctgctgccggcgctggtgaagcgcgatttcgccggcaacggcggcctgatgaccggcctctacacgatgaccctgtgcctcggcgcggccgcgggcgccggcgcgtcggtgccggtcgagcacgccctcgggggcggctggccctcggccctggcgatctggtcgctgcccgcgctggtggcggccttcgtgtggatcccgttcgcccgccgcaccgccgcgaccgccgcgccctccgccgggcggctgctccgcaacccgctggcgtggtgggtgacgggcttcatgggcctgcaatcgtcgctcgcctacatcctgttcggttggctgccgctgctgctgcagggccgcggcctcacaccgctgaatgccgggctctacgcctcgctggcgacgctggtgcaggcgccgggcgccctgctcgttgccatgctggcggcccgcgcccgcgaccagcgcgcctggatcgtcgtgattcccggcctgacggctgccgccttcgtggtcctcgccttcggggcggattctctgcggatccccgccgcctgcgcgctgggcttcgggatcggcggatgcttcgggctgggcctgaccctgatcgtgctgcgcgccgcggacgcggcgagcgccgccggcctctcggccatggcgcagggcatcggctacacctgcgccgcgctggggccgctggtcttcggtctcgcccacgaggcgaccggcggctgggccgtgccgggcgccctgttcgtgggcatcaccgtcgcggcgatcctgatcgggctggccgccggacgcgaccggaaggtcagcgcggccggacccgagccgcgggatccggccgctcagccgctgaccgaactccagccggcgaacccggccagcggttcctga

SEQ ID NO: 4759 - DNA, 1221 bp, Methylobacterium sp.
gtgctcgccggcgccctcgcggcgggtgcgggtatccggcccgtccagggcagtcccgcgccggtcgccctgcgccggggcatcgccctctggccctggttctcgctgaccaccgagtacccgcccccgcggaccgactacgcgtggccgcccttccaggccgggcggccggtgccgacccgcgacgacctcgcccggatcgccgggttcggcttcgacttcgtgcgcctgcccctcgatcccgggccgttcgtggccttcacggggccgcggcgcgccgaactcctcggcaccctgtcggaggccgtcgacgcggccctggcggccgggctgcgcgtcttggtcaatgtccaggcgaacgccgcgacccaccactacacgcccgacgcgttctacggctcggatcgggccccgctcttcgcctcctatcgcgacctcgtcggagacctcgcgcgcctgtgcgcgcgaaagggcacggaccgcgtggccctggagcccgtgaacgagccgccgcaggcctgcggcgccggcgcctggaaccgggtgcaggacgggctcctggcggcggcccgcgcggccgcgccggcgctcaccctggtggcgaccggttcctgcggcagtctcgtcgccggcctgacggctttggacccggccgcgctcgcgcggttcgcgccgctcctctacacgttccacttctacgagccgtacctgttctcccatcagggggcgacgtggctcaccgaggagccgttctaccgctggctcaccgccgtgccctggcccgggagccgcggcacgctgcgcgagaccctcgcggcggtgcgggcgcgcatggacgcggaccgcacggtgccgcaggccgagaaggcgcgcgaccgcgcggtgatcgaggcgaaactgcacgagtatttcgaggccgtgcccggcccggcctacatcgccgacgcgatggcgccggtggcgacctgggcggacctctacgggatcccgcgcgggcaggtgctgatgggtgagttcggcgccctgcgcaccgacgcccgtttcacggcgtcccgggcgccggaccgggccgcctacatccggaacgtgcggctggcggcggaggcgaacgggttcgcgtggtcgttctggaacctgttcgacggcctcggcctcatggacgacgcgcacgtcgccgatcccgccctgatcgcggcgctcgggctgcgggcccggccctga

SEQ ID NO: 4760 - DNA, 261 bp, Methylobacterium sp.
gtgaacattcccgccgagcgtcgcgtcaaccagctgaccgacgccgaggttctgtcgatccgcgagacgatcgaccgcgactacctcgtcgagggcgacctgcgccgcgaagtgtcgatgaacatcaagcgcctgatggatctcggcgcctatcgcggtctgcgtcaccgcaagcagctgccggtccgcggccagcgcacccacaccaacgcccgcacccgcaagggcaaggcgaagccgatcgccggcaagaagaagtaa

SEQ ID NO: 4761 - DNA, 1020 bp, Methylobacterium sp.
atgacggcacggagcatcatccggctcgtcgggacggtcgcggtcctatggggggcgctcggcgccgcccgggccgaggtctcgaccgttcggctcgccaagcagttcgggatctcctacctgccgctcaccgtgatggaggaggagggcctgctcgagaagcaggccaagcagcgcgggctcgacgtcaaggccgagtggctgcgcttcaccggcggctcggggatgaacgaggccctcctgtccggcaacctcgacctcgcctcgggcggcgtcggcccgttcctgacgatctggggccggacgcagggcaatctcaaggtcaagggcgtggcggcgctgaacgcgatgccgctctggctggtcaccatcaatccggcggtgaaggcgatcacggatttcggcccccaggacaagattgccctgccgaccgcgaaaacctccatccaggccatcaccctgcagatggccgccgagaaggccttcgggccgggccagcaggccaagctcgacccgctcaccgtctcgatggggcacccggacgcgcagaccgccatgatgggcggccgctccgagatcacggcccatttcggctcgccgcccttccaggagatggagctgaaggacccgcgcgcccgcaaggtgctcgacagctacgatgtgatgggcggcccccacaccttcaacctcgtctgggcgaccagccgcttcgtcaccgagaaccccaaggtcacggcggccttccgggcggcgctggaggagagcctcgcgctgatccgcgacgacccggcccgggccgccgccctgtggatcaaggccgagggggcgaagatctcgcccgcggaggccgtggccatcatccgcgcgccgcagaacgcctggaccaccaagcccgagcggatgctcgcctacctcgcctacatgaaccgggccgggctggtctcggccaaggccgacagcgagagcgagctgttcttcccggatccgaacgccggcgccccgaaggaggccaaccggtga

SEQ ID NO: 4762 - DNA, 1929 bp, Methylobacterium sp.
atgagcggacccgcaccgcggccgggggcgggcctgcgtcggcgactgggtgagcgactcggccagcgcctcggcaagcgcctcggcaagcgcctgggcgatcgcctgggcgagcgcgtcggcgccctgcgctacctgccgacgctgttccgggagatcgccgccgcgagcccgcgcctgctggcggcgagcctgtcgctgcgcctcgtggcggcctgcctgccggtcctgaccctctacctcgccaagctgatcctcgacgggatcgtggccgagcacgcccggccggcgccggaggcggggctcgcggcgtggctcgccgatcccggccgggcgcggctcgccggcctcgtcgccgccgagttcggcctcgccctgctctcggacctgaccggccggctctcgagcctcgtcgagaccctgatcggcgacctctacgccaacgcggcctccctgcggctgatggcgcacgccgccgaactcgacctcgcgcagttcgaggacagcgcccagcaggaccggctggagcgggcccgccggcaggtcagcggccgcaccggcctcatcggcacggtgttcggccagctgcagggcctcctgaccctcgcgaccctggcggtcggggtcgcggccttcacgccctggctcgtggtgctgatcgccgccgccctggtcccggcggtgctcaacgagtggcacttcaccaaggccggctaccgcctcgcctggatccgcagccccgagcggcggcggatcgactacctgcgctacctcggcgccagcgtcgagaccgccaaggagatcaagctcttcggcctcgcgggctacgtcaccgggctctacgccgcggtggcggggcggctgctcgccgagaaccgcggcctcgcggtcgcccgggccggctggggcttcgccttcgcgagcctcgggacgctcgcctactacgccgcctacgcggtgatcgtctggcggacggtggcgggcgccttctcggtgggcgacctcgccttcctggccggcgcgttccagcggctgcgcggcggcctggaggggctgctgctcgggctgacccagatcaccggccaggcgcagtatctcgaggatttctacgccttcttcgcgatccgaccgcagatccgctcgcccgcgcggccccttccggtgccgagcccgatccgcgcggggctggtcttcgagggggtcggctaccgctacccgggcacgcaggtctgggcgctgcgcgacctctccttcgccgtccgggccggggagacggtggcgctggtcggcggcaacggcgccggcaagaccacgatcgtcaagctgatgacccggctgtacgacccgcacgagggccgcgtgctcctcgacggcgtgccgctgcccgcctacgacctcgacgacctgcgggcgcggatcggggcgatcttccaggacttcgtgcgcttcgacctcaccgccggggagaacgtcgcggtcggccggatcgcggccgccgacgacgcggaccgcatcgcggccgcggcggcgagggggctcgcggccccggtgatcgagcgcctgcccgcgggctacgcccagccgctgggcaagcgcttcgccggcggcctcgacctctccgggggcgagtggcagaaggtcgcgctgtcccgggcctacatgcgcgaggccgagatcctgatcctggacgagccgaccgctgccctcgacgcccgggccgagcacgacgtcttcgcccggttccgggaattgtcggccgggcggacggcggtgctgatctcgcaccgcttctccaccgtgcgcatggccgaccgcatcctcgtcctggagggcggccgggtcctggaggagggcagccacgccgccctcatggcgcggggcggccgctacgccgagctgttcgccctccaggcggagggctaccggtag

SEQ ID NO: 4763 - DNA, 642 bp, Methylobacterium sp.
atgctggcttggtttcgcgccctgatgccgcgggaggaccggttcttcgatctcttcgagcggcacgcgcggacgctcgaggacggcgcggccgcccttcgaggccttctcgacgggactcaggccgtcccggcggcctacgcggcgatcgcggcccacgaggacgcggccgacgggatcacccgcgaggcgctgctggcggtccgccggaccttcatcacgccgttcgaccgcggcgacatccaggccctggtcggctccctcgacgacgccatcgaccagatgctcaagaccgcgaaggcggtccagctcttcgaggtgaccaccttcgagccggcgatgcgcgagatgggcgcggtcatccaggaggcggcgcaggtcaccgccgaggcgctgccgaagctgcgggccctcggcgagaacgccgccgcgctgaacagcctgaccgagcgcgtcatcgagctggagggacgggccgacgacctgcacaatgacgggctgaaggcgctgttcaaggcctcggggcgggaccccatggccttcctcgtcgggtccgagctgtacggccacctggagaaggtcatggaccggttcgaggacgtggcgaaccagatcagcagcatcgtcgtcgaacatgtctga

SEQ ID NO: 4764 - DNA, 1122 bp, Methylobacterium sp.
atgttctcctgccgaagcggcgcggctcttcccctgcgcggagcggtcttcgccctggccctggccagcggattcggggcggcgcccctcgtcgcccgcgagatgcccgaggccggcacggccgccgcggcgaagaagccgaacgtcgtgatcctcgccaccggcgggacgatcgcgggcgccggcgccgacgccgccaacagcgccacctacacggccgccaaggttccggtcgacaagctgatcgccgccgtgccgcaggtgaacaccatcgccaacgtccgcggcgagcaggtcttccagatcgcgtccgagagcttcaccgacgcccagctggtccagctcggcaagcgcgtgtcccagctcctgaagcaggacgacgtcgacggcgtcgtggtcacgcacgggaccgacacgctggaggagacggcgttcttcctcgacctcgtggtgaagagcgacaagccgatcgtggtggttggctcgatgcggccgggcacggcgatctcggccgacggcgccctcaacctgctcgacgccgtcacggtcgccgccagcaaggaggcgatcggccagggcgtcaccgtgacgatgaacgactacatccagtgcggccgcgacgtgaacaagcggaccaacatcgtgcccagcgccttctacagccagtggggcccgctcggcatggtggtcgagggcaagacctacttcttccgctcgctgacgaagcggcacaacatgagctccgagttcgacatcgaccagatcgacagcctgccgctggtcggcatcgtctacggctccggcaacatgatcccgggcgtctacgacgccgagctccaggccggcgccaaggcgatcgtcaacgccggcaccggcaacggctcggtccccggctacctcgtcgacaagctgaaggagatccgctccaagggcgccatcgtgatccgctcgtcgcgggtgccggacggcttcgtcctgcgcaacgccgagcagcccgacgacaagtacgactgggtggtcgcccacgacctcaaccccgccaaggccaagatcctcgccgccgtggcgctcaccaagaccagcgacaccaaggagctgcagcgcatcttctgggagtactga

SEQ ID NO: 4765 - DNA, 369 bp, Methylobacterium sp.
gtgcaacccttccgcgccttccgcgtcctcctgtctctcgccggacaggaggtgcgcgccgtggagccgatgaagccgatggaacccatgaagcccatggagccgatgaagccgatgaagggcgcggagccctggtggccgaaggatctcggcgagcccgcgaccagcggcgcgcagaacgggatgaagtacgcgttcttcccggacaagcgtcgcctcctcgtcgaccgcgacgggcaggtctcgacctacgacagcggcgaccaccggatcggcggcgtcgcgcaggcggacggggcggcccagaccctgaccttcaccggccaggacggcgaggtcgacctgggctccctgaagaagctcgactga

SEQ ID NO: 4766 - DNA, 384 bp, Methylobacterium sp.
atgcactacgcctgcgaccacctccacctgcgcagccgcgacgccgtcgcggccgcctccttctacgtcgagaccttcggggcccgggaggtcaagcgcgtcggcgcggacccggtgcagcgcgtcgtgctcgacctcggcggcctcgccgtcttcatcgagcaggccccggacgagatcgcgccggcgactgccacgccctgtctcgggatcgagcatttcgggctgcgcgtcgccgacatcgaggccgcgatggccgatctcaccgcccggggcgtgcgggtgcggaccggcatcacggagcgcggaccgggcctgcggatcgccttcgtggagggccccgacggggcgctgatcgagatcctggagcggaagcccgcctga

SEQ ID NO: 4767 - DNA, 624 bp, Methylobacterium sp.
atgcaggagtcgatgcaggaggccatgagcggggaggaggcgggggaaccgatcgaggcgcgtctgcgccgcgcgctcggcctgcgctcgatcgtgctcgtcggcctcatgggagcgggcaagagcaccgtcggccggcgtctggcgagccgcctcggcctgatcttcaaggatgccgacatcgagatcgaggccgcggccggcctgacgatccccgacatcttcgcgatctacggcgagccgagcttccgcgacggcgaggagcgggtgatctcgcgcctgctgcgggccggcccgctggtcctggcgacgggcggcggcgcctacctgcgcgaggcgacccgcgcgcgcatcgcggaatcggcggtctccgtctggctgaaggccgatctggacgtgctgatgcggcgcgtgcgcaagcgcggcaaccgcccgctgctgcagaccgaggatccggaggcgacgatgcgcgacctgatggccgtgcgccacccggtctacgccgcggccgacgtgatggtcatctcgcgggaggtctcgcacgaccgggtcgtccaggacgtgctggaggcgctggatgcccatctcagcggcgaaggatccatccccgtggccgcccagtga

SEQ ID NO: 4768 - DNA, 1365 bp, Methylobacterium sp.
atgatgcacaccgtcgccagctcggcccgcccgacgaaccgccgcgtcctggccctggcgctgcccatgacgatcgccaacgtcacgacgccgatgctcggcttcgtcggcgcggcggtgatcgggcggctcggcgacgcggcgctgctcggcgccatcgccctcggcgcggtgatcttcgacgcgatcttctggtcattcggggcgctccgcatggcgaccgccggcctgaccgcgcaggcagtcggagggcgggacgacgccgaggtcgaccgcatcctggcgcgggcgctggcggcgggtgccctgatcggcctcgtcctggtggtcctgcagggccccctcgcgcagctcgccttcgcgatcagcggggcgagcgcggcggtgatcgccggtctggccacctacttccacatccgcatcctgtccgcgcccttcgtgctggcgagctacggcgtgctcggctccgtcctggggcgcgggcgcaccgatctcggcctgctgctgcagatcgccatcaacctgaccaacgtcgcgctgacgctcaccctggtcctgggcttcggcctgggcctcgccggcgcggcgctggcgaccctcggcgccgaggcgctcgggctcggtctcggactgatcctcctggcccgcctcggctcccggcccttccgggtaccgctgcgcgacctgcgcgacgccgcggcgctccgccggacgctcagcgtcaatggcgacgtcatcctgcggacgctcgcgctgatcaccggtatcgtgctgttctcggcgctcggcgcccggcagggcgacgtggtcctggccgcgaactcggtcctgtggaatctcttcctgatcggcggcttcttcctcgacggcttcgccacggcggccgagaccctgtgcggtcaggcggtgggcgcccgggaccgggaggcgttcgacgcggccgccgccctgagcctgcgctggtgcctcggcttcggcctcgcggtcagcctgctgtcgctggcgggcggcccggccttcatcgatgccgtgaccacgaacggaccggtgcgcgaggtggcccggtcctacctcgtcctcgccgccctggcgccgctcgccgccgcggcacccttcgcgtatgacggggtctatatcggcgcgacctggacgcgggcgatgcgcaacctgatggtgtgcgcgctcgccgcctactgcgcgatcctcgcgctcgtcgagagcctgggcttcggcaataccgggctgtggctggccttcgtgagcttcctgggcgcccggggcatcggacaggcgatcgccttcccgcgcctcgcccggaacacgttccggacgcctgccgcggccgccctcggaaccgcggcctag

SEQ ID NO: 4769 - DNA, 954 bp, Methylobacterium sp.
atgttgatcaagcgcaggcgcggttgggagattccggagcatctggcgacgccggaagccgtgtttctcaatcggcgggccctgatcggcggcgcggccgggctcgcggccggctcgctcctgggcggacgcgcggccctcgcggcggcgggcgaccagccgctctacccggcaccgcagaaccccgcctacacgctcgaccgccccctgaccccggagcgcttcagcgccgactacaacaatttctacgaattcggcacgtcgaagacggtgctgccggcggcgaacgccctcaagacgcagccctggaccctgaagatcgacgggctcgtggagaagccgttcgagatcggcgtcgacgacctgatccggaaggtcggcctggaggagcggctctaccgtcaccgctgcgtcgaggcgtggtcgatggcggtgccctggaccggcttcccgctggcgaagctcgtggcgctggccaagcccacctccggcgcgaagtacatccgtttcgagaccttcatggacaaggcgatggcgcccggccagcgggcgttcttctatccctggccctacacggagggcctgaccctggctgaggccggcaacgacctcgccttcatagtcacggggatctacgggaagccgctgcccaaccagttcggggcgccgatccgcgtcgcggtgccgtggaagtacgggttcaagtcggccaagtcgctggtgaagatctcgttcacggccgaccggccgaagaccttctgggaggggctgcaggcctcggagtacggcttctgggccaacgtgaatccggccgtgccgcacccgcgctggagccaggcgaccgagcgcgtcctcggcaccgaccagcgcgtgccgacgctgatctacaacggctacggcgagcaggtcgccggcctctacaagggcctcgagggcgagcgcctgttcgtgtga

SEQ ID NO: 4770 - DNA, 597 bp, Methylobacterium sp.
atgaccctgatgctgcaagccgcccccgcggggagcggatccggtccggccccccggggcgccgacgcggagatgcgcgacctcctgctgggggcgatcccggcgctgcgggccttcgcgttctcgctgacctacgatctcgaccgctcggacgacctcgtgcaggacacgctcgtgcgcgcctgggtcaacgccgccagcttccgccgcgggaccaacctgaccgcgtggctgttcacgatcctgcggaacctgttctactcggagcagcgcaagcgcaagcgcgaggtggaggacgccgacggcgtccatgccgggcgcctgaccgccctccccgagcaggagatccggatggagatggcgcagttccagagcgcgctgaaccggctcccgccggcccagcgcgaggcgctggtcctggtcggcgcccagagcttcacctacgaggaggccgcggctatctgcggcgtcgcggtgggcacgatcaagagccgggtcagccgcgcccggacccgcctgatcgaggtgctgggcatgaccggcaccgacgatatcggacccgacccgcagacccgcgcggccctcgacggctcctga

SEQ ID NO: 4771 - DNA, 192 bp, Methylobacterium sp.
gtgcgggacgacgacgaccggccgcgcaaggccgttgcccacgagatcgggcagcccctcgacacgctctcgctcggggatctcgacgagcgcgtcgcgctcctgcgcgccgagatcgcccggctcgaggcggcgcgggccgccaagcaggcggcgcagggcgcggccgacgccttcttcaagcggggctga

SEQ ID NO: 4772 - DNA, 1113 bp, Methylobacterium sp.
atgccgatgaccgcagatcgtgatctgttttctccaacgaagatcggtgccatcgacgtcgccaaccgcgtcgccatggcaccgctcacgcgctcgcgtgccgacatggagggcgtccattcgcagctcgccgtcgcgtactatcgccagcgcgcatcggccggcctcatcatcaccgaggcgaccaatatctcacggcagggccggggctatgccttcacgccaggcatctacacggaggcgcaggccgaggcatggtcgcgtgtgacctcagccgtgcacgaggcaggcggccggatcgtctgccagctctggcatgtcgggcgcatgtcgcatgtcagcctccaggagaatggcgaggcgcccgtgtcggcctcggccatccaggccggagagctcgtcttcctcgagagccgcacgcaggcacctccatccatgccgcgcgcgctgcggaccgacgagattcccgatctgatcggcgactatcggcgcgctgcgtccctcgccaagcaggcgggcttcgacgggatcgaggtgcattccgcgaactgctacctgctcgatcaattcatccgcgacagcacgaaccggaggacagatcgctacggcggctcgatcgagaaccgcacgcggctcgccgttgaggtcgtctcggcggtggcggaggtgtggggtgccgaccgcgtcggtctgaggctctcgccgatgacgcgggccgtcggtgatactccgctcgacagcgacccgcaggcaacctacggctatctcgcccggaagcttggggagctcggacttgcctatctccactgcgtcgaggggcagacgcgcgggccgaacgggtcgtccgcgttcgactacaaggcgctgcacgccgctttcggtggggcctacatcgccaataacggctacgaccggcagctcgcggtcgaggcgatcgcctccggctacgccgacatgatcgccttcggtcgctccttcatcgggaatcccgacctggtcgagcggctgcgccgcaacgcccatctcgcggaggccgatcaggcgacgttctatggcggcggagccgagggttataccgattatccgaacttggacatttcagggaacgcataa

SEQ ID NO: 4773 - DNA, 381 bp, Methylobacterium sp.
atggccgaggcggcacggcgttaccagcaggcgggcggctcggacctcgtgcgtcgcctgatggcccggccggtccggctggagcagcaggtccggacccggatgcccctccgcgacccgcgccgcgtcgacgcgttcgccgacgcctatgaagacgaggccgcggacgacgcggaggcgcgggacgaggccgacgcgatcgcccgcctcgagaccgagctgcaggtgatgaaggcggtcctccgggcccagcggcaggaggtcgagtcgctgcgggcgcagcggcagctcctcaccgaatcggccccgaccgacgacgtccgcgcgacccgcgagcgctgggcggccctggtcgactcactcctgatccgcgcccgctga

SEQ ID NO: 4774 - DNA, 999 bp, Methylobacterium sp.
gtggcccgggccttcggcgcggcgccgtcgtccaccgcgaagcttccgttcggacccatgatcgatcgatcggccgccgccctcggcatccccctcccctggctcgaccgggccggccgcctctcctggctgaagctcgcggtgttcgcgtgctgcgtcgcgcccgcgctctacctcgcggccgcctaccggctcgacgccctcggggcgaagccgatcaccgcgctgatccacgccaccggcgagtgggcggtgcgcttcctgctcttctcgctggcgatctcgccgctgcgccgcctcgcggactggccgaaggtcatcgtcgtgcggcgcatgctcggcgtcaccgtgatggcctacgcggtggcccatctgaccctctacgccgtcgaccagaacctgatcctcaccaaggtgatctccgagatcgcgctccggctctacctgacgatcggcttcgtggccctgatcggcctgatcgccttagggctgacctccacggacgcggcgatccgcaacctcggcccgaactggaaccgcctgcaccgcctcacctacacgatcgccgtggcggccctggtccactacttcctgcagtcgaagatcgacgtcaccgacccggtcttctcggcgggcctgttcctgctgctgatgggctggcgggtgatgcggcgcttccagtggccggagcggccctggtcgctcctcctcctggcgatcgtcgccgggctcgcgacggccgggctggaggccgcatggtacggcctcgccagcggtgtgccggccaacctcgtcctcgccgccaacctggacttctccggcccggtccggccggcctggtgggtgctggccgtcggcctgtcgctcccgctcgtggcgctcgtgcgcggcccgaaggcccgcgcctccgggccggcaccgggcaggcgaccggcccaggcggcccgccgggagcctatccgggagcccgtccgggagcccttgtcgccgtcggcctga

SEQ ID NO: 4775 - DNA, 1326 bp, Methylobacterium sp.
atggcctcgggcagcgccggcaacccgacgctctccgcgctgccgcccgcgcgggtacctgccgagggccgggcggatcccggatcggacgacgaggcggtgctgcggaccatgcaggccggcggcggcctgcgcctgctcggcctgcgggtggtgatcgtgctggtgctgctgatggcggcccaggcctatgacggctcgctgcacgccctgagccactggttcatcctcggcctgtacggcctcggcacgatctggttcgggctgcgggagcggggcggcggccccgcggccaacgcctacagctgggccggcaccggcctcaatgccgggctcgccgtctacgtgatcatcgagcacatgctggccgggggcggggcggggctcggcgccgacgcggtgagccgcctgcccgccttcctgctcctgctccagaccggcctgagcatgcgggtggcgcagaccctgctgttctgcgggctcgtcaccgtctgctggagcgcggccttcctggtcggcctgatccatccggacctgttcccgaacgccgacaccttccccaccgcgcagctcaccgggctggccaccttcatggcggcgggcctcctggtggtcgacggcatggtccgcctgcgcgccgcggtggtgcgggccctacgcatggagcacgagcggacccagctcgcccgcttcgtgcccgacacggtcgccctcgacctcgccgccgacgacggcgattccggcctcggcatccaccggcgccacgcctgcctgatgatcctcgacatccgcggcttctcgcggctttcccgcgagcacccgcccgaggccatggtgacggccctgctgggggtccgggcggcggcccaggcggcggtggcggagcagggcggcctcgtcgacaagtatatcggcgacgcggtgctggtgcagttcgtcgtcggccatcccgacgtccaggcgcgcgcggcgctcgcctgcgccctgtcgatccgcgaccggatcgccgcgctcaacgcggcccgcgcccgggagacgctgtttcccctgcgggtcgtggtcgccctgcacgcgggcgacctattggtcggggtcttcgacgacggcgtgcgggccgagtacacggtgctgggcccggcgatgaacgccctggcgcggatcgagacccaggccaaggcggccgagatcgagatcgccgcgtcgggagacttcctggacctgctcggcggcgtgctcccggccgggatccgggccgtgccggtgccggacgccgccctgccggagcacctcaccctgtcggcgatcgcggtggcgcccggcgcctga

SEQ ID NO: 4776 - DNA, 357 bp, Methylobacterium sp.
atgatcgggccctccggcgcggtgcgcgtcatgctggccacacggccggtcgacttccgcaagggcatggacgggctggccgctctggtccgcgacgcgatgggcgcggacccgttctccggcacggtctacgtgttccggtcaaaacgcgccgaccgggtgaagctcctggtctgggatggaagcgggctggtcctcgcgaccaagcgtttggaggcgggtcagttctgttggccgaagatcgaggacggcgtggtccggctgagtgcggcgcagctcgcggcgctcgtcgaaggtttggactggaagcgcgtccatgcggcacgtgccgtgggcgtgccggcggtggccggctga

SEQ ID NO: 4777 - DNA, 348 bp, Methylobacterium sp.
atgatcccgctgccggccaacgtgcgggtgtggctggccaccggccacaccgacatgcgcaagggcttttccagtctcggcctgatcgtccaggagacgctcaagcgcgatccccatggcgggcatctgttcgtgttccgcggacggcgcggcgacctgatcaaggtgatttggcacgatggccagggcgcgtgcctctacacgaagcggctcgaccgcggccgtttcctgtggccctcggtggcggatggagccgtgacgatctcgacggcgcaactcggctaccttctctcggggatcgactggcggatgccgcaggagagctggcgtccgagcgctctcggctga

SEQ ID NO: 4778 - DNA, 348 bp, Methylobacterium sp.
atgatccccgttccctcgggctcgcgcgtatggctggccaccggccacacggacatgaggaagggcttcgacgggctcgccgcgctggtgcaggaccacctgcaccatgatccgttctccggtcaggccttcgtcttccgcggccgtgcggggcggctgatcaaggtcctgtggtgggacggccaggggctgtgcctgttctcgaagcggctggagagaggccgtttcgtctggccgggaactgcaggggccgcggcggcgctctcgccggctcagctcgcgatgctgctggaggggatcgactggcgggcgcccgagcgcacggaccggccgcgcatcgcgggctga

SEQ ID NO: 4779 - DNA, 318 bp, Methylobacterium sp.
atgaaggcgattctggcagcggccgcggtgagcctcggcattctgggcgtggtcggcccggtctccgcgcagccgcgccccgactacgacgattacggcggccggggctaccgcgaccgcggcgactacgattaccgggaccgcggctaccgcgaccgggacgattaccgcggccgcgccaattacgggttcgacgagcgcgagtacctgcgctgcaatccggatgtccgccgcgccgtggccaacggccagatggaatcgggcgccgcccattaccgggtgttcgggcgccgtgagggccgacggctgagctgctga

SEQ ID NO: 4780 - DNA, 2319 bp, Methylobacterium sp.
atgagcgagacgatcgacaagacggacacgacgtcgtttcacatggccggccaatgtccgttcggcggcgaccggatcggcggcgcccacggcaaccggccgacgctggagaactggtatccccatcgcctgcgggtggaagtgctccaccagaacgggctggcggccgatcccctcggtccggatttcgactacgcggccgagttcgccaagatcgacttcgacgcgctcaagcgcgacatcaagcagttcctgacctcgtcggtggagtggtggccgtccgactacggcaattacggcccgcagatgatccgcatggcctggcactcggccggcacctaccggatcgccgacgggcgcggcggcggcggcaccggcatgcagcgcttcgccccgatctcgagctggtgggacaacggcaacaccgacaagtcgcggcgcctcctgcagccgatcaagcataagtacggcaacgccctgtcgtgggccgacctgatggtcctgaccggcaactgcgccctcgagatcatgggcctgccgacctacggcttcgccgccggccgcctcgacgcctgggaggcggacgacgccacctactggggaccggaggtcgtcgagatgggctcggtctcgagcttcgacgacatggtgaaccgcgacaagcgctggcggggcaagaacggcgacgccgactacgacctggagaacccgctggccgcctcccaccaggcgctgatctacgtgaacccggagggcccctacgcgagcggcgatccgctggcctccgcgcgcgacatccggatcaccttcacccgcatggcgatgaacgacgaggagaccgtggcgctgatcgccggcggccacgccttcggcaagagccacggcatggtgccggccaaggagatcgggccgccgcccgagatggcgccgatggaggcgatggggctgggttggcacaacccgaagggcaccggctccggcaaggacacgatgaccaacggcatcgagggcagctggactccggatccgacgaagtgggacaacgcctacctggagaacctcttcaagttcgagtgggagcagaccaagagcccggcgggcgccctccagtggacgccgaaggatcccgccgcgccgaagacgccggacgcccacgtcgcggggcagatgcacccgctgatgatgatgacgtccgacatcgccctgaaggtcgatcccgactaccggaaggtctgcgagaagttcctcaacgacttcgacgccttcacccaggccttctccaaggcgtggtacaagctcacccaccgcgacatgggtccgaagcaccgctacctcggcccggaggcggtgatcgaggacgggctgctgtggcaggacccgctgcccgagcgggactacgacctcgtcggcgaggcggagatcgccgcgctgaagcaggcgatctccggcacgggcctgtcggtctcggatctcgccttcacggccttctcggcggcctcgacctaccgcgacagcgacaagcgcggcggggccaacggtggccgcctagccctcgcgccgcagaaggactgggccgtcaaccggcgggccgcgcccgtggtcgaggccctgcgcggcgtgatggcgaccttcaacggcggccgcagcgacggcaagaagatctcgctggcggacctgatcgtgctgggcggctgcgtcgccgtggagaaggcggcccgcgatgcgggggtcgagacgccggtcccgttcacgccgggccgggtggacacgacccaggcgctcaccgacctcgagatgttcgagtggctgaagccggtggtggacgggttccgcaactacgtcgacgacggcttcgggcagatgacgcgcagcgtctcgccggaggagatgttcctcgacaaggcgaacctgctgacgctgacggccccggaatggaccgtcctgaccggcggcctgcgcgcgctcaacgccaaccacgacgggtcgaaccggggcgtcctgaccgaccgggtcggggcgctgacgaccgacttcttccgcaacctgaccgacgtcgacctggtctgggagaaggcggatccggacgggatgaccttcgcgctcaaggaccgcgcgagcgggcagacgaagttcgaggcgacccgcagcgacctcgtcttcgggtcgaacgcgcagctccggtccatcgccgacgcctacgcgggcagcgacggccagcggcgcttcgtggcggacttcgtcaaggcctgggacaaggtcatgatgctcgaccgcttcgacgtgaagggtcaccggcgctacgggccgatggcggcctga

SEQ ID NO: 4781 - DNA, 579 bp, Methylobacterium sp.
atggccgggcagtcgggcgcgcgcgtcccgcgggcggcgctcacgctcgcgcgggcggtggggctgtcagccgcgctgtcagccgcgctgtcagccgcgctggcggccctgccggcgatcgccgccggccgcgccgcggcggaagagggcctgacggcccggacgcggatcgagctgctgacgctcaacggcttcgacccggtcagctacttcctggaaggcgggccgcacgccggtctggcccggttcgagctgtcctggggcggccaggtctggcggttctccagcggcgccaaccgcgcggccttccgggacgatccgcccgcctacgcgccgcgcctcggaggctacgacgccgccgggatcctggatggccggctggtggacgccgatcccctggtcttcgcggtgatcgacgagcgcctctacctgttccgggatgccgggcgccgcgcccggttcctggcggagcccggcctggcccggcaggcggaggcggcctggccggccgtgcgccgtctgcaggatgtcccgcccgacggcttgcccgacgtcccggctatggatgcgccgcgctga

SEQ ID NO: 4782 - DNA, 927 bp, Methylobacterium sp.
atgatcgatctcaacctcgacccgtccgagacccggcctgaccggatgccgtcggccaagcccgggccgtcgctgaacctcaaggtcgtgctgttcagcgtggccggcgcgagcgcgctggtcggcttcggcgtcgccgcctcgacggtgatggccggcctcgcggcgccgacccccgtgaagatcgtcgcgtcccggcaggccgcggactggccggagctgaaggacgggctgcccgccatcaagggctccgtccaggcggcggccgccccggcgcagcccgccaagccggagacaccggcgctcaggatggtgtcgctgccggaagccttcgcggcgatcacgcccgcgccgacgccgcccgcgcccgacgccccgcggcgggcggccccgcagcccgcgaaggtcgccgccgcccccgtcgcgccgacgcagcgcatcccggtcccgacgcccgtcacgccggtcgcggccgcgcgggaagtcgcgccgctggcgccggtccgcacggccgcgcttcagacgccccgcgcctccgagacggtccgggcccgcgagctcgtcgagccggccgcgccgaagccggtggcggagagcacggagcgcgcggagaagtccgagcgtcccgagaagaaggagcgggccgagaagacggagcgctccggtaaaccggagaggacggagcgcgccgagaagatcgagcgctccgagaagcccgcgcccaaggcggcgacccgccaaacgcccgcgccgatgcggaccgccgacaaggcgaagggcgccgccgccaccgttgcccaggcggagcccgccgaggcggaggacaccgaggtgctcggcatcaagctcccgtccctggcgccggccgggcggaagctgaaggagagcgtcgacgccctcggcgacgccgtcaagaacgtgttctga

SEQ ID NO: 4783 - DNA, 207 bp, Methylobacterium sp.
atggatacgccaccgaacgacctcgatgcccgcgccctcggccgggccgcgcccgccaagggcctcgcccgggaagcctgcccctacgcggaggggacggaggcgcgcgcgctctggctggccggttacgacgcggccctggcggagggcgagacgcccgtgaccggcggtctcgccaagcacccggtcgacggttcggcccgctga

SEQ ID NO: 4784 - DNA, 1149 bp, Methylobacterium sp.
atgctgcgacgcgtgctgcgtcggctgacggctgcggcctcgctgacagtgctgacattcgccgttccggccttcgccgaggagccgctgcgcttcgaggtcgatccggcctggccgcagcgcctgccgaacgactggatcatgggtcaggcggcgggcgtcgcggtcgacgcgcaggacaatgtctgggtgatccagcggccgcgcaccctcaccgacgacgagaaggccgcgagcctcgatccgccccgcacccgctgctgcaagccggcgccgccggtcctcgtcttcgaccaggccgggcgcctggtgaagtcctggggcggcccgggcgagggctatcaatggccccagaacgagcacggcatccacgtcgaccacaagggcttcgtctggctcgccggcaacggcgacaccgacggccagatcctgaagttcaccccggacggcaagttcgtgctgcagatcggcaagcaggggccgcagaccgacagccgggacacgagccgcctcggcaagccggccggcatgatggtcgatccggagacgaacgagctctacgtggccgatggctactacaaccaccgcgtcatcgtgttcgacgcggagaccggcgcgttcaagcggatgtggggcgcctacggcaagccgccgaccgacgacaagctcggcccctacgatccggcggcggccccgtcccagcaattcgccaacccggtgcactgcgtgcaggtcgcccgcgacggcctcgtctacgtgtgtgaccggaccaacgaccggatccaggtgttccggaaggacggcaccttcgtgaaggagatgttcgtcgagaagaacacccgagccaacggctcggtctgggaactcgccctgtggccggacgagcgccagacctacctgctcaacgccgacggggccaacaacgaggtccgcaccctgagccgcgacaccggcgagatcctcggccgcttcggccgcaacggccggatggccggcgacttccactgggtccacaacctcgccatcgactccaagggcaacgtcttcaccaccgaggtcgacaccgggaagcgggcgcagaagttcctgttccggggcgacatggtgctgcgcaagcgcgccgccctgccggagggcggcgcgcgatga

SEQ ID NO: 4785 - DNA, 1086 bp, Methylobacterium sp.
ttggtcgaacgcggctggcaggtcggcgtgtactgccagcgggatgtcgagacggtgcgggaccgcatcgtgcggagcacttggaacggcgtcgaactgatcaccgtggagatcggcctgcgcggtcccgtcgcgaccctcgccttcgacgccatctgcgcccacgacgccgcgacccgcggcggcgtctgcctcgtgctcggctacaacggcgccgcgttcctgccctacctgcgggcgcggggcgggcgtatcctgaccaacatggacgggatcgagtggcgccgtccgaaatggtcgctgcccgtgcgcgccttcttctacgtcagcgagtggatcgccgcgtggtcctcgcagcggctggtggcagaccatcccgtgatcgccgaccacctcgcccgtcgcaggccgcgcggcgccatcgcgaccatcccgtacggcggcgatcccccggcggccgatgtcggaccgccgcccctcggcctcgagcccgaccgctacctcgtctcgatcgcccgcatcgagccggacaacaacatcctgacgctcgtcgaggccttctcgcgccgtgcccgcggcgtgcggctggtggtgctcggcacgctgcgggtcggcaacccgtaccatcgcgccgtggaggcggccgcctcgccggaggtgctgtttcccggcgccatctacgagcccgagcaggtccaggccctgcgggtccacgcgcgggcctatctccacggccacacggtgggcggcaccaacccgtcgctggtcgaggcgctctgggcgggcaacgccgtggtcgcccacgacaatccgttcaaccggggcacggccggggacgcgcaactctatttctcgggtccggacagctgcgcggcggccatcgagcgcgtgctctccgacggggccgcggtcgcggcggcccgcgcggccgggcgggcgcgcgccgagcagttccgctgggacgccgtgctggcctcctacgaagacgcgctgcgccgtgtcggcggctacccgccggccccggaccgcgcggcgcacgccaccgcggccgagcccgtcgccgccccggccggtccgagatggtag

SEQ ID NO: 4786 - DNA, 462 bp, Methylobacterium sp.
atggcgggactgaagcccatcctcctggtcgaggacaatccgaacgacatcgagctgacgctggcggccctcgaatcgagccagctcgccaacgagatcgtcatctgccgcgacggggccgaggccctcgacttcatctaccggcggggcgcgcacgagaagcggcaggcccaggatcccgcggtggtcctgctcgacctgaagctcccgaaggtcgacggcctggaggtgctcgccaagatcaagggcgacccggtcacccgccaggtgccggtggtgatgctgacctcgtcccgcgaggagaccgacctcgtgcgctcctacgatctcggggtgaacgccttcgtggtgaagccggtcgccttcgaggagttcttcgcggcgatcaaggagatcggcgtgttctgggccctcctcaacgagccgccgccgtaccggggaggctggccatcgaacgcgtga

SEQ ID NO: 4787 - DNA, 213 bp, Methylobacterium sp.
atgcgcctctatcgcgtcaccttctacaagaccgtcgcggacgataccggccacgaacaccgggtgcggcagcgcgagatcctggtccgggcgccgtcggaggtgtcggccgtctggcaggccaaggcgctgctctgcgcgggggcccgggtggtcgactggcgcctgcgcgccgacagctgcgaggtcgcggcgctgccggccgccgcgtag

SEQ ID NO: 4788 - DNA, 624 bp, Methylobacterium sp.
atgatcatctacggcagcagcgtgtcgccctacgtgcgtaaggtgctcgcggcgctctacgagaagggcgtcgccttcgagcaccgcccggtcggcttccaggcggcggatcccggcttccgggccgcgagcccgatggggaagatccccgcgatggaggatgccgggtatcgcctcgccgattcgagcgccatcgtggactatctcgagcggctgcatccggcgcccgcgctgatccccgaggacgcgcgggacgccgcccgcgcccgctggttcgacaagttcggcgagtgcgagctgacccggcaggtgctggtgccgttcgtcgagcgcttcctcaagccccgcctgttcaaggtcgagggcgacgaggccctggcgcagcggaccgtcgacacggcgctgccgccgctgttcgactacctcgaatcgcagatcgacgggccctacctcgtgggcggccggttcggcatcgccgacatcgccgtggcggcgccgttccacaacctgcggctggccaaggtcgcggtcgacggcgcccgctggccgaagctcgccgactgggtggcggcgacgctggagcggccgtccttcaccgcggcgatcgccgcggcgaagagctga

SEQ ID NO: 4789 - DNA, 609 bp, Methylobacterium sp.
atgaagcgaccgctctccgcccgttccgccacatccctggcgctcctgccggccgcactcgtcctgctgccccaggcggccttcgcccatccggggcacggcagcgcgacgggcgcggaggcggggttcctccatccgcttctgggcgccgaccatgttctcgcgatggtcgcggtcggcctcctcgccagcctgcgcggcggacgggcgctctgggcgctgcccctgtcgttcctggcgttgatgagcgtgggggcggggctgggcatggccggcgcggtgctgccgcatgtcgaactcgggatcgcgctgtccatcgtcgtgttcggcctcgccaccatcgtcggcctgcgcgcgccggtagccctgctggctgccctggtcggggtcttcgcggtgttccacggctacgcccatggcgccgagatgcccgagaccgcctccggcctgtccttcggcctcgggttcctcgcggccaccgcgctcctgcacgccgcggggatcggactcggtgccgcggcgtcgcggatcggagcgacgcgggccgccccggccctcggcgcaggcctcgccgcggccggtctcgcgctgctggcgctccccgcctga

SEQ ID NO: 4790 - DNA, 288 bp, Methylobacterium sp.
atgatcactgccgcccagatccgcgccggccgcggacttctcaagtggacgcaaggggttctcgcgagccgcgccgcggtctccgtcgtcaccctgaacatgatcgagagcgagcaggtccagccccgcagccggaccctcgcggcgatccgcacggtcctcgaaggggcgggcatccgcttcgtcggcgacgcgcgggacggctacggggcgatcctgcgccccgcccccgcgaccggggacgcaccggcacagaaaagcccggcgcggcggaccgcaccgggctga

SEQ ID NO: 4791 - DNA, 189 bp, Methylobacterium sp.
atgcccgaaaagctcgacgctctcctcgaacgcctcaaggcgcaccagcgcaccctcatcttggcgatggccgagcatgacgggatgccggccggaagcgcgatccgtcaggtcgccgaactggagaacgttatcgctgcggtcgaggctgtcgcggacgaggaggcagatcggaagcgtcgaggctga

SEQ ID NO: 4792 - DNA, 366 bp, Methylobacterium sp.
atggccactgtcctcgccgtcgacgattcgcccagcatccggcagatgatcaaggtggtgctcggcccggccggccacacggtgatcgaggccggcgacggcgccgaaggcctcgcgaaggccaggagcgagagcgtcaacctcgtcatcaccgatctcaacatgccggtgatgaacgggctggagatgatcaagcagctgcggacgctgccgagctgcaccggcgtgccgatcctcttcctgagcacggaatccgacgaggcgatcaagcagcaggcgaaggcggccggggcgaccggctggatcaccaagccgttcaagcccgagcagctgctcgccgtcgtgggcaagctcgtccgcgcctga

SEQ ID NO: 4793 - DNA, 387 bp, Methylobacterium sp.
atgaatacgatattacttgtagacgactcgccgacaattctgtcgagcatgtcaggaatacttcgcagttccggatatgaaaccgaacaggccgccgatgccgagaccgccctcgcgaaggtcaaggcaggcctgaagccggccctcgtgatcacggacttccacatgcccggaatggacggcgtccagttgatccaggccttgcggaagctggcgccgacccgcttcacgccgatgctcgttctcaccacggagtcgcagcaggagaagcgcgacggcgcgcgccaggcgggggcgaccggttggctggtgaagccggtccaggccgacaagctgctgcaggtcctgacacaggtcgcccccgcgattcagcgccgcgccgcctga

SEQ ID NO: 4794 - DNA, 309 bp, Methylobacterium sp.
atggcgacgacagtatcggcccggagcgcggccgcgggcccgcacggcgagatccccctcgcccgcggagagcggctcggcatgcggatgtggcgggccgaggagcccaacgccgacaagccgatgaccacctcggcgcacgagacggtcggctacgtcgtcagtggccgggccgagctcgtgctggagggcgagaccgtggcgctcgcgccgggcgattcctactgcgtgccggcgggcgccgcgcacacctaccggatcctggagaccttcacggccgtcgaggcgaccgccccgccggccgggtga

SEQ ID NO: 4795 - DNA, 249 bp, Methylobacterium sp.
ccgggaacggccttcgcctggggcggcggtggtggcggcggtggcggcgacagcgggagcggcctctcgccctacgcggcgctgagcggcaacgatcgctcggccggggtcaacaacggcaattaccgcgacccggccctcgacccctacatccggacctacgatccggaggccgcggcccgctacgccgctccgccggcggcgcagccgcgcctgcgcgtgcggccgtactacggctacccctactga

SEQ ID NO: 4796 - DNA, 144 bp, Methylobacterium sp.
atggatctcgggtctcacggcggcttcatcctggccgcctacgcgttcacggcggtggtgatggtcgccctcgtgggcaacgccctgcgcgaccgccgggcacagcggcgcgccctcaagggcttcggcgaggaccggcgatga

SEQ ID NO: 4797 - DNA, 240 bp, Methylobacterium sp.
atgcgcagcgcttctgaaaaccagtcgccggccttcgatccgttcggcgagcccgtcgccgacggcgtcgccggcgcctgcccggccacctcgaccggcgaccgcacggcgcggcgcgtcggcggtgcggtgttctggacgctggcgctcgcgatcctggccggccgcgtctacgcctacgatctaccggccgtgcaggccgtcgcctcgcacgccgcccaggtgctcgccctgcgctga

SEQ ID NO: 4798 - DNA, 1728 bp, Methylobacterium sp.
gtgatcggaccttccgcgggcccgctgcgcatcctccacctggaggacagcgacctcgacgccgagctgatcgaggccgagctggagaccctcgggcacccggtcgcgatcgagcgggtgatgacccgcgacgccttcgcgcgcgcggcggtcgccggccggcacgacctgatcctggccgactacgtcctgccgaccttcgacggcgtgagcgccctcggcatcgcccgggcgcagtgccccgacacgccgttcatcttctgctcgggcacgctcggcgaggacgtcgcggtcgaggccctgaagaacggcgccaccgactacgtcgtcaagcagcgcctggaccggatgccgcgcacgatcgtccgggcgctcgccgaggcgcgggcgcgcgccgacaagcgcgaggccgaggccgccctgcaggcgctcaacgagacgctggaggtgcgcatcgccgagcggacccgcgaactcgccgcggcgaacgaggccctccaggcccagatcgtcgagcgggagcgggcggaggacgccctgcgcctcgcccagcgcctggacgcggtcggccagctcacgagcggcgtcgcgcacgacttcaacaacctgctgacggtcatcgccggcaacatcgagttcctcgagagggtcgtctccgacaaccgctcgaagcgccgcctcgccatgatgcgcggggccgccgagcgcggcgcccggctcaccgcgcagctcctcgccttctcccggcgccagcgcctggagccgacgccggtcagcctcaaccagacggtcgcgtcgatgcgcgacctgctgcagagctcgatcggcggcgcggtccgcatcgagacgaccctccagcccgacctgtggccggccctggtcgacgccacccagatcgagctcgtgatcctgaacctcgccatcaacgcccgcgacgcgatggcggtgggcggccggctcgccatcgagaccgccaatgtcagcgtggccggggcgccgacccggcccgagcagccggcgcccggcgcctacgtcatggtggcggtgagcgacaccggcaccgggatgacgcccgacgtgctggcgcgggtgttcgagccgttcttcaccaccaaggaggtcggcaaggggtcgggtctcgggctcgcccaggtctacggcttcgtcaagcagtccggcggcggtatccggatcgacacggtcgcgggcgagggtacctcgatcaaggtctacctgccccgggccgcggacgcggagggcgccgctccccgcctgcccgccgcggccgaggccgcgcggccgcacccgcccggaggcggtccccggctcctcgtggtcgacgacgacgccgaggtgcgcgaggtgacgacgacccgcctgatcgaggccggctacgcggtgcgcgaggcggcctcgggcctccaggccctggccgccctggaggcggatccgagcgtcgacctcgtcgtgatggacttcgccatgccgggcatgaacggagccgagacggccctggaggtccggaagcgctggccggcgctgccggtcctgttcgtcaccggcttcgccgacacctccgccctgaccgaggccggcgccgtcggcgccgacgcgatcgtgctgaagccgttccgcgtcggggaactcgagggcaaggtcgccaccgccctggcggcccggccgccggcgcagctccggttgatctcgggccgcgacaggagcgcctga

SEQ ID NO: 4799 - DNA, 519 bp, Methylobacterium sp.
atggaaaccgagagggcggtgctggccggtggttgcttctggggcatgcaggacctcatccggcgacaggagggcgtcgtgtcgacccgcgtcggctacacgggcggcgacgtgccgaacgcgacctaccgcaaccacggcacccatgccgaggcgatcgagatcgtctacgacccggcgcggacgagtttccggcgcatgctggaattcttctttcagatccacgacccgacgacgccgaaccgccagggcaacgacaggggcccgagctatcgttcggccatcttctacaccgacgagggccagcgccgcgtcgccgaggagaccatcgccgacgtcgacgcgtccggcctgtggcccggcaaggtcgtgacggaagtggcgccggccggcccgttctgggaggccgagccggagcatcaggactacctggaacggcgtcccgacggatatacctgccacttcatcaggccgaactgggtgctgcccgcgcgcgtccccgccgcacagggcgcgtag

SEQ ID NO: 4800 - DNA, 351 bp, Methylobacterium sp.
atgacccaggaccgaacgctcagcatcgacgaccccgccctcgactgtccggtcgcaccggacgtggtcggccgcctcatcaaggccgatccggagggcgccgcgttcctgctcgacggcatcccggaggcgacgcgcgcacggctcgccgtctggctctacggccgcagccacacgtacgcgatcggcgtccgcgtcgcggcgacctgcgagggcgcgaccttgcggcggaccgctggcctcgtcggaaacgtcctctacgacctgtcccgccgtccggtggcggccgcgagccacggaccgcgcggcgccggccgcatctccctgggcgggtcgaagcgccgcgcctga

SEQ ID NO: 4801 - DNA, 147 bp, Methylobacterium sp.
atggacctggagcggcagcgcgagatcgccagcaagggcggccgcagcgttccggccgagaagcgctccttctcgcaggaccgtgagctcgcctcgtccgccggccgcaagggcggtcagtccacggggaccggccgggccgagtga

SEQ ID NO: 4802 - DNA, 237 bp, Methylobacterium sp.
atgatgaccagccagcagctcgccgacgaactgaagcggatcgccaccacccaggtcagcgacatcacgcgggcggtgaaggaaggccagaagtcgatcgccctcaacgaggtgcgggacatggcgcggcggctcggcctgctcgcggacgccttcgatccgaaatccgcggcggagagatccgaggccgatggcgcgagcgtcgccgatgcggtcgacgacgcccaggccgcctga

SEQ ID NO: 4803 - DNA, 570 bp, Methylobacterium sp.
atggacacgactcccctcggccccaccgccttccgggccccggccgtcctgctctccggaccggtcgactacgccatgtacaaggacttccgccgccagctcgacgcggcgggggaccgcgacctcgtcgtcgtcgagctgacgacgctcggcggcgacccggaggtcgcccggatgatgggcgaggacatccgcttcaacagcgcgatggatccgaaccggcggttcgtcttcctcggcaaggccgcgatctactcggccggcacgaccttcatgagcttcttcgcccggcccaaccgctatctcacctgcgggacgcggctgatgatccacgagcgcaagatgaacaagcagctccaggtcgagggaccgctcaccacctgcatcgcctccgtgaaggcgacgctcaacgagatcctgtgctcgatcgagatccagaacgagggcttcgccaacctgatccagggctctgacgtcgccctcgacgaggtgctcgagaaggcgccggccaactggtacatcgaggccgaagaggccaagcggcgcggcctgatcgaggcggtcatctga

SEQ ID NO: 4804 - DNA, 606 bp, Methylobacterium sp.
gtgaagagccccgtgagacgtctcttcctcgccggccttctggcgattgcggccatccccgccgcccgcgctgagccggcgattgtccggttccgcggaaccgtggtccaggccgattcggagcgcgtggagatccgccgcaccagcggcagcaccctggccgtgcggatgggaccccggacccgcatctacgcggtcaacggcgccagcctgcgcgcgatcaagccggagagctacgtcagcgtcctcggtgcgtccgatgcggagccgcggcaggcgagcgccgtgaccctgtactcgccctcggagcgcgggttcgaggcgggcagccagccctgggacaccgggcagggcgcgcgcctcaccgccggctgggtcgccgacctgcagcggggcgcgccgatgcgcctgaccctcgcctataacggcggccaatcgtccttcgcgatccccgacgacacgccggtgacgcagctctcgccgggggagaaggcgatgctccagcctggtgccgccgtgacgatcttcgcgcgcccgggcgacgacggcgggctgatggcggggaccatcgcggtgggccgccagggcgtcgtgccggggctctga

SEQ ID NO: 4805 - DNA, 882 bp, Methylobacterium sp.
atgagcgagatccgtccccgtcgcagcgtcttggcgatgccgggctctaacgcccgggcgctggagaaggcgcggtcgctccccgccgacgtgatcctgatcgacctcgaggacggcaccgcccccgccgcgaaggcggcggcccgcgcccaggtcgccgccgcggtcgccgcgcggggcttcggcccgcgcgaggtcgtggtccgcatcaacccgcccgagaccgaggacggcgaggccgacctcgtggcgctcgcgccggccgccccggacgcgatcctggtgccgaaggtccggacctccgacgcgctgatcgccgtgggctcccgcctgcgccgcctcggcgcgccgctggcgacgcgggtctgggcgatgatcgagacgccgatggcggtggtgaacgccgccgagatcgcgggcgcggcccgggacgtggacggccggctcggcgccctggtgatcggcccgaacgacctcctgaaggcgtcgcggatccggccgccgggccgggccgcgctgctgccctggctgatgaacgtcctggccgccgcccgggcctacgagatcgaggcgatcgacggcgtgttcaccgacctcaaggacgcggccgggttcgaggccgagtgcgcgcagggccgcgacctcggcttcgacggcaagatgctgatccacccgagccagatcggcccggccaacgccgccttcgggccggatgccgaggagatcgcgcaggcccgccggctgatggacgtgttcgacgcgccggagaaccgcgagcgcggggtcatcgcggtggacggcaggatggtcgagcgcctccacgtcgaggccgcccggcggacgctcgccatggccgaggcgatcgcgcggatgaccgcgtga

SEQ ID NO: 4806 - DNA, 879 bp, Methylobacterium sp.
atggccaccgaccgccccctcgacctcgaaggcgtgctggccttcgtgcgcgtggtcgatctcggcagcttcacccgggccgccgaggcgctcgccacctcgcaggcggcgatcagcctgcgcctgaagcggctcgaggacaggctcggcacgcgcctcctggaccggaccccgcggcacgtggacctgacacgccagggcgcgcagttcctgcccgcggcccggcgcctcctggacgcccatgacagcgccgtggccgacgccgcgacggccgttcccgcccgtctcagcctcgggatcagcgatcacgtcgccggccccgacctcccggtgctgttgcggcacctgggcctgaatcgggccgggctgatcacggaggtgcggatcttcccctcgcgcgacctcgcggcggcgttcggatcctccggcgagggcggctacgacgcggtgatcttccggacggaggacgaggccggccacggcggcgcggtcctggcggaggagcggctgggctggttcgccgcaccggatttcccggcgccccggccgggcgagacgctgcgactggcggggctcgcgggcccctgcacggtccggggcgcggcgatgcgggttctcgacgcggccgggctcccctggaccgaggtcttcgtcggcggcggcgtgctggcggtgggagcggccgtgatggcggggctggcggtggcggccctggcgccgagcacggcaccggccggcgccgtggaggtcggcggccggttcgggctgcccgaactgccgcgcaccttcgtggtcctgcgcgcccgccgcctggccgggcgccccgccgaggcgctgcgcgcgctggcggcggcgtatcgcggtcccggcggccgctga

SEQ ID NO: 4807 - DNA, 495 bp, Methylobacterium sp.
atggaccgaccgagtctctacgacgacgacatcgtgacctgggccgaggagcaggcggcggccctgcgcgcgctggccgagcggcccgagctgtcgaacgcggtcgattgggagaacgttgccgaggagatcgagagcgtggggcgttcgcatctgcgggccgtcgaaggtctgctgatccagacgctcgcccacctcctcaagcgcgcatccgccccgctcgcaccggccagcctgcactggcgggaggagatcgcgaccttccagatcaccgcctggaacacctacgaagcgtcgatgcggcaaaggctgaactggaacaggatctggaaatccgccgtcacggcggccgaggctggtctcggcgcctatgggaacgcgctgctcccggggctgccggaggcctgcccgatccgtcctgaggatctgctgaccgagactttcgacatagagcgcgcacttcgtacgatcgctacatcggttgcgcgccgctga

SEQ ID NO: 4808 - DNA, 270 bp, Methylobacterium sp.
ttgcgtatcctgcgttccctcctcggcgccgtcctcgtcctcgtctcgacggcgaccgtcgccctcgtcagcgccgaccggctcgcccatctggcgccggcgccggtggtccgtgccgcccaggccgagccgtcggcgacggggtcgatcccgcttccggcgaaggccgcgcccgcgccgaagccggccgtgcccagcatccccaacgggttcgacacggagcggctgcacgcgctgatgcgcggcgacccgatcctgccgggccgctga

SEQ ID NO: 4809 - DNA, 1293 bp, Methylobacterium sp.
atgatacaggcccatccgtcgagttccaaagtcgccacggtcctgcgcgtgaccagcggcaacttcctggaaatgttcgacttcttcctgttcggcttctacgccacctacatctccaagaccttcttcccggtcggcaacgagttcgcctcgctgatgctgaccttcgtgacgttcggcgccggcttcctgatgcggcccctcggcgcgatcttcctgggcgcctacgtggacagtatcggccgccggaaggggctgatcgtcacgctcggcatcatggcggccggcacgatcctgatcgccttcgtcccgggctacggcacgatcggcctgttcgcgcccttcctggtcctcgtcgggcgcctgcttcagggcttctcggccggcgtcgagctcggcggcgtctccgtctacctgtcggagatggccacccccggcaacaagggcttctacgtgtcctggcagtccggcagccagcaggtcgcggtcatgttcgccgccgtgatcggctacatcctcaaccacgccctctcgctcgccgacatgaacgactggggctggcggatcccgttcttcatcggctgcgcgatcgtgccgttcctgttctacatccggcggtcgctggaggagacggaggagttcctgaagcgcaagcaccgcccctccatgaaggaggtgttcggctcgctcgccagcaactggcagatcgtgctgctcggcatgctgctcgtcggcatgaccacgatctcgttctacacgatcaccgtctacaccccgaccttcggcaaggccgtgctcaagctgtccgacaccgacagccttctcgtgaccttctgcaccgccctgtcgaacctgttctggctgccggtcatgggggccctgtccgaccggatcgggcgcaagccgctcctgctggtgttctcggcgctgaccctgctcaccgcctacccggtgctgggctggctcgtggccaacccgagcttcgggaacatgctgatcgccctcctgtggctgtccttcctgtacggcagctacaacggcgcgatggtggtcgcgctgaccgaggtgatcccggcgagcgtgcgcacggccggcttctccctcgcctactcgctggcgacggcgctcctcggcggcttcacgcccctcgtctccacgtggctgatcgaggccacgggcaaccgcgcggcccctgggctgtggatggccttcggcggggcgtgcggcctcgtcgccacgctcctgatctaccgccgcgcgacccagccggtcgctctgggagcccccgcgtga

SEQ ID NO: 4810 - DNA, 1308 bp, Methylobacterium sp.
atggccggtgatcccggggccgtcggggccacgctcaagtcgcggatcggcgcgatcctccgctcgacgagcggcaacttcctggagatgttcgacttcttcctgttcggtttctacgccacctacatcgcgcgggcgttcttcccctcgggcaacgagaccaccgagttgctcctgaccttcggcaccttctggctcggggcgctgatgcggccgctcggggcgatcgtgctgggcgcctatatcgaccggatcggccgccggaagggcctgatcatcacgctcgccatcatggccagcggcaccgtgctcatcgccttctgcccgagctacgacacgatcggggtcgcggcccccctgatcgtgctcgccgggcgcctgctgcaggggttctcggcgggcgtcgagatcggcggcgtctcgatctacctgttcgagatcgccacgccgggccggcgcggcttctacacgtcgttccagtcggcgagccagcaggtggcgatcatgttcgcagccctgatcggctacgggctgaacgcgttcctgaccaagcagcaactcggcgatttcggctggcgcatcccgttcttcatcggctgcctgatcgtgccgttcatcttcttcatccggcgctcgctccaggagacgcaggaatttgccaagcggacccgccacccgaccacccgcgagatcctgagcacggtggccgccaactggcggatcgtgctgctcggaatgatgctgaccacgatgacgacggtgaccttctacatgatcaccgtctacaccccgaccttcggcaagaacgtcctcaagctcaccgagaccgacagcctgatcgtgacgctgttcgtggcgatcaccaacttcgtctggctgcccgtgggcggggccctgtcggacgccatcggccgcaagccggtgctgctcacgatctcgaccctgtcgctgctgacgacctacccggccctgcactggctcgtagccgatccgaccttcggcaagatgcttgccgtggaactgtggttctcgttcttcttcggcgtctacaacggcgcgatggtcgtctcgctctccgaggtggtgccggcccatgtccgcgccagcggcttctcgctggcctacagcctcgccaccgcgctgttcggcactgcgacgcccatggtctcgaccttcctgatcgagaagaccggtgaccgggcggcaccgagctactggctcatggcggcggccgcctgcggcatcgtcgcgacgctcgcgctgttccggagccggccgggcctggagcgcgtgccggcccacgcctga

SEQ ID NO: 4811 - DNA, 288 bp, Methylobacterium sp.
atgagagtttcggccgacctctgcatcgtgccgatgggcgtcggcccgtcggtctcgccctacgtgcgggagatcaaggggatcatcgagtcgagcgggctcaccgccacgatgcatcccaacggcacgaacatcgagggcgaactgtcggagatctgcgcgctggcggagcggtgcgaggcgaagctcgccgagctcggcgtccagcggaccttcttcacgctgatcttctcgacgcgccgcgacaaggaccagtcgatggccgacaagctcgccgcggtctcctga

SEQ ID NO: 4812 - DNA, 297 bp, Methylobacterium sp.
atggaagccaaggtcattcgctggggtgacgacctcgccgtgcggctgagcagtgcggaggccgaggaactcggtatttgcgagggcgcgacggtcgagatcgtctcgaagcgccccgcgcagcccgagtccacgcaatgggtcgggcgccggtatgtcgacggactgccggtctacacgatggaagagatgatcgccgaggcccggcgcctgggttcggaagcagagccgccgacggtcgattgggggccggatcgcgggtccgagatcatcgatgacgacaacgacccctactga

SEQ ID NO: 4813 - DNA, 756 bp, Methylobacterium sp.
atgacgacatcgagctggcgcaccctccgcaacgtgcaggcccggaaacggctggagaaggccctgccggcgatcttcccggcgccggtcctgcagcacgcccttgcgcggcccctgatcccgccgacgccgcgtctcgccgtcgagagctactggcggaaccacatcctccgggccgacaggctcgcccgcgcgctggcggcccgctccgggacaccggagggctgggcctggcagatcggggccgaggggcgggccgggagcttccgcacgccgcccgcgccgttccgcgatccggccttcgcccgcggccgcggtgcctgctgcatctgcggccagccggtctaccggttcggctggcaccgggatctctgggcgcgcggcgcgcccaacaccaatgccggctggcacgcggcctgtgtcgcggcgtggaagttctggatcgcgccgcacgcccaggttcgggcgctcaagctccgccagcgtcaccgctgcaccaccaccggcaagcggctgctgaggacggccgaggtcgaccacctgctgccgctctaccgggtctggcgcgagcaccgcgacgccccctggccggagctcctcggctactggggcgcgccgaacctgcaagtggtcaaccgcgcagcccatctcgacaagtgccgcgacgaggcggccgagcgctcccggaccttgcagcgcgcccgattccgggtggtcgaggacgagtccgggttcagtgtggtcgaggaggagtga

SEQ ID NO: 4814 - DNA, 612 bp, Methylobacterium sp.
atgatcgtcgacgatctcgccgccctggaggcgctctacagcgcgcccctggcgcccgcctccacggtgaaggtggcggccgcgatcacgccggactacgcggcgctgatcgcggcctcgcccttcgcggtgctggcgaccgccggccctgaggggctcgattgcagcccgcgcggggaccggccgggcttcgtgcgggtcgccgacccgcgcacgctgatcctgcccgaccggcggggcaacaaccggatcgactcgctccgcaacgtcgtgcgcgacccgcgggtggcgctgctgttcctgatcccgggatccggcacgacgctgcgggtgaacggccgggcggtgatctcggccgacccggacctgctcgcctcgttccgggtcgacggccacgcgccgcgcaccgccctcgtgatcaccgtcgcggaggtgtacttccagtgcgcccgggcgatcatccgggccgggctgtgggatccggacgcccgcgtcgacccgggaagcctgccgacgccgggggcgatcctggcggcgctgaccgcgggcgaggtcggcggccagcgctacgacgcggaatggccggagcgggcggccaagacgatgtggtga

SEQ ID NO: 4815 - DNA, 933 bp, Methylobacterium sp.
atgcgcctgtgcatctgcatctgcacctgcgagcggcccgtcgggctggcgcgcctgctcaaggccctggaccagcagcggctcggcagcctcgccgagaccgccctgcgcatcctgatcatcgacaacgggcgcagccgcgccgccgtcccggtggtggaggcctaccgggcgaccggccgcttccccgtcacctacgcccgggaggagacccgcggcctcgccgcggtccgcaaccgcagcctcgcggaggcctccgcggccggcgcggactgggtcgctctgatcgacgacgacgagtttcccgaccgcgactggctccacaacctgctcgagaccgccctcgccgcgggcgtcgcggcctgcgtcgggccggtcgtgccgttcttcgaccgggttccgcccgcctgggcggccgccgggggcttcttcgccaagcgcctgccggtccgcgacggctacgtggaggacggctacaccgccaacgcgctgctggatctgcgggtgatccgggcgctgggcctggccttcgacatgcgcttcaacaccatgggcggcgaggacacgttcttcttccgggccctgatgctcgccgggcaccggatcgcctgggccgagacggccgtggtctacgacagcatcccgacgcaccggatgcgggtgcgctggctgctggcgcgctggtaccgcagcggcagcgtcgaggcctatctcggccggctccgcccggaaacggtgggcggccggctcgccaacgcgggccgcggcttcgtgcgcctcggcggcggcctgctgcggctcgggatcgcgggcctgtccctcaggccggcgaccctgatcggcggcggctacacgctgtgccggggagccggcctgctcgcggccgtgatcggcctgagctaccgagaataccacccgtcgcgctaccgctag

SEQ ID NO: 4816 - DNA, 963 bp, Methylobacterium sp.
gtgcccctcaccctggaggggacccgcgaagtgccggtgatccgcctcgccgagccggtcgcgccggcggcggccgcggacgcgatcctggcgcgcgccgaggcgctgaccgcccaggacatgcaggtcctgcgcatcgtcgtcgcggccgatccggcgacgtccggacggctgctcgacctcggcgcggcccgggccctcggtgacggcgacggggtcgagatcctgccggggctcctctggcaatgcgccgcccgctggctcccgcgggcccggccgcccttccccgagctgttcaccgccacggccggccgccgccacccgctgcggccccggacgcccgccggcacggtctacgcgcgggcgatcccgtggctcgaccggcgtctgagcttccgcacgatgacggagcccggcgacgtcgccctgttctcgacctggatgaacgacccccgcatcgccgcgatctggcaggagaccggtaccctggaggcgcacgccgcctacatcgccgggctccaggccgaccccgcgaccctgccgctgttcggctgcctcgacggcaggccgttcggctatttcgagctgtactgggcgcgggagagccgcctcgggccgctctacgaggccgacccctacgaccgcggctggcacgtcgcgatcggcgacgcgtccgtgcgcgggcgacccgcgctctcggcctggctgccgtcgctgatgcactacctgttcctcgacgagccgcgcacgcagcgcgtcgtcggcgagccgcgggccgatcacgcccagcagatccggaacctccacggctccggcttcgcgacgatcgcgaccgtcgacttcccccacaagcgcgcggccctggtcgcgctgtcgcgcgagcacttcgtgcgcgaccggctctgggtgccgggggcggccgccgccgacgccgcgccgcggcctcccgcggtgcccgcctag

SEQ ID NO: 4817 - DNA, 693 bp, Methylobacterium sp.
gtgaagcgcgtcgttctcctcctgctcggcgggctcgccctcctggcgatcggcggcttcgccgggtggcgcctgcaccggccgggggccgacgcgcgggcgtacgccgagatgcgcctgatcgccgtgcaggttagcctcgacgaggcgccgccggactacgtgttctgggccggcgattcccaggtggagctgcagcccgggagccagcggccctgcgggctcgacttcctcaacggcgggatcagcggcgcgaccgcgggcagctacgcggactacctcgcacgcctgaccttcaaggtgcatccccggctcgcggtcttgaccatcgggaccaacgacatcctggtgaagaacaacccgcaactgcacaagccgaccgagcagttcgaggccgccgccgagacgatcgtcaagcggctgcagaccctcagcccgcgcgtcgtggtgaccgccctccccccggtcggtcgcgagatcggcaagctggtcgatgccggcgcggtcgcggattactcgcgccgattgcagaacctctgcgggcggctcggctgcgtcttcacggacccgttcgcggccctgcgcgacggcgatacgggctacgccaagtccggcgccctacgcgacgggctgcatctcgcggcgttccggccggcgctgaaggcggtcgagccggcgctctgcaccccgtga

SEQ ID NO: 4818 - DNA, 1275 bp, Methylobacterium sp.
atgacgccgatcagccagccgatcccgacccgcggcctcgccgccgccctcgccggactgagtctcggcctcatgggatccggcccggtcgccgcgcaggagacgcccgcgaccgccgccccgccgcccagcgtccaggtcgatcgcggctcggccctctacggccggcccgagggcggcgccgcggcgaagctcgcgccagtggccggaccgcctctggcgaccgcggccgccaagctgccgctcgacaagctgaaggtcccggagggcttcaagatcgaggtctacgccagcggcctcgccaacgcccgcgagatgacccaggcgccggacggcacgctgtacgtgggcacccggacggtggggaaggtctacgcggtgctgccgaagccggacggcgacgggaagcgcgcggtgaagaccatcgcgacgggcctgcaccggccgaacggcgtcgcgtactacgacggcgcgctctacgtggccgaactctcgaagatctggcgctacgacgacatcgccaaccacctcgatggcgcggcgaagccgaccctggtctacgacgacctgccgaaggacgaggcccacggctggaagttcatcgccatcggcccggacaacaagctctacgtcccggtcggcgcgccgggcaacatcgtgatgccgccggacacgcacgcgcagatccggcgcatggacctcgacggcaagaacgccgaggtcgtcgcccgcggtgtgcgcaacaccgtcgggttcgactggaatccgaagaccaagcagctctggttcaccgataacggccgcgactgggtctcagaggacatcccgaacgacgagctgaacgtgctcacggaaccgggcaagcagcatttcggctatccgtactgccaccagggcacgttcacggatccggaatacggctggggtcatgcctgctcggagttcaccgcgccggcggcgctcctcggcccgcacacggcctccctcggcctgcggttctacaccggcacgcagttcccggaggcctaccgcgacgcgatgttcgtcgcccggcacggctcgtggaaccgcacgaccaagctcggcggcgacgtggtcgtggccaagcccggaccggacggcaagaccgccgcggtggagccgttcctgaccggcttcctccaggacaacaagtatgtcggccggcccgtcgacgtgctggtcgccaaggacggatcgctgctcgtctccgacgactacaacggcgcgatctaccgcttcagctacggccggtga

SEQ ID NO: 4819 - DNA, 2256 bp, Methylobacterium sp.
ttgaaccttcgaagcggcgcggcccagcgtctcgacctgaccgcgtgcgatcgcgagcccatccacatcgtcggcagcgtccagccgcacgggttcctgctcggcctcgaggcccggtccctcaccatcgtccaggcgagcgccaacgcccccgcggcggcctcggtcggcaccgtcctcgacgcggccctgcccgacctcgcggccgtcgtccgccaccatctcgaggcggcggagccccaggacggcgccctctatctccggaccgtgacgctggagaccgccggcgggcgccaagcctacgaggtcgcggcccaccgggtcgacgatctcgtcgtgctggaactggaggagatcgacgcggccgcggccgagatcggcgtcgacgtgctcaccccgcgcctgcgggccttcgtcgagcgcctgcagaccgcccgcaccgtcgaggacctctgccagttcgtcgccgaggacatccgccagatcaccggcctcgaccgggccctggtctaccggttcgaccgcgactggcacggcacggtgctggcggaggccggcaacggtgtcctgccctcctacctcgacctgcgcttccccgcctccgacatccccgcccaggcgcgcgaactctaccgccggaaccggctgcgcatcatcccggatgccggctacgtccccgtgccgatccggccggccaccacgccctccggccggccgctggacctcagccagtcggtgctgcgctcggtctcgccggtccatgtcgagtacatgcgcaacatgggcacgatggcgtccatgtcggtgtcgatcctcgtcgacggcgccctctggggcctgatctcctgtcacaaccgcgcgcccaggcgcgtgcccctgcgggcgcgcaacgcctgcgacgtgctcacccagatcttcgccctgcagctctcggcccgcgagcgcggcgcccagtccgagaagcggttggcgctgggcgccgtgcaggcgcgcctcctcgccttcatggccgaggaggacagcttcgtcgacggcctgctcaaccaccccgacgacgtcctggccctggtggacgcgaccggcgccgcggtggtgacggccgaccgctgccggctgctcggggcgacgccgaccgagcgcgaggtccgcgccctctaccggtggctgtccgagcgcggcgatgccgaggaggtcttcgtctccgaggccctgtcggaggcgttcccggcggccgccgccttcgccgaccgggcgagcggcctcctggcgatctcggtctcgaagaagtacgcgagctacatcctctggttcaggcccgaggtcgtgcggaccgtgaagtggggcggcaaccccgtgaaggccgtccggcccgatccggagggcggaccggaccggctccacccgcgcaagtcgttcgagatctggaaggagaccgtgcagggccgctccctgccctggtccgacccggaggtggaggccgccaaggacctgcgcgcctcggtgctcggcatcgtgctccgccgggccgaggagctcgccgccatgagcgaggagctgcagcgctcgaacaaggagctggaggcgttctcgtactcggtcagccacgacctgcgcgcgccgttccgtcacatcgtcggctacgcgaacctgctcaagacccgcgagggcgcccagctctccgacaagggccggcactacgtggagacgatcatcgaggcggccttctcggccggcaccctggtcgacagcctgctgagcttctcgcagatgggccggcacgccctcaacaaggtctggggcgacatgaacgccctggtcgaggaggtccgccggaaggtcctgcgcgacgtcacccccgaccggaccctccgctgggagatcgcgccgctgggccgcgcctacgccgacccggtgatgctgcggctcgtcatcgagaacctgctgtcgaacgccgtgaagtacacccgcggcaccccggaggcggtgatcgcgatgggcagcctcccgccccgggagggcgaggcggtctacttcgtgcgcgacaacggcgccggcttcgacatggcctacgtcgacaagctgttcggcgtcttccagcggctgcaccgggtcgaggagttcgagggcacgggcatcggcctcgccaatgtccggcgcatcgtcgagcgccacggcgggcggacctgggccgagggcaggctcggcgagggcgccaccttctacttcaccctgcccatccgggaggaggcgcactga

SEQ ID NO: 4820 - DNA, 1494 bp, Methylobacterium sp.
atggcgtggctgcacacgtggtccggcctcgtggtcggctgggtgctgttcgcgatcttcgtcaccggcaccgccagctattaccgcaccgatatctcgcactggatgcggcccgagctgtccgcgacggcacccgatcccgccgcagcggcgacgcgggccggggcgttcctgcgccggaccatgccggacgcggccggatggtcgatcaagctgccgaatgccgagatcccggccgtcgaggtctactggtggccgcgtccgggtggcccgttccaccacgcgctcctcgatcccgccacgggcgagcccgcgcgcatccgcgacacgcgcggcggcgacttcctctaccgattccacttcgagctgagcctgccgccgatctggggtcgctggatcgtgtcggcctgcgccatggtcctgcttatcgcgctgatctccgggatcgtgacgcaccggcgcatcttcgccgacttcttcaccttccggcgcgaccgctcggcgcagcgcggctggctcgacgcccacaacgtggtcggcgtcctggcgctgccgttccacctgatgatcgtctacacgggcctcgtcaccctgtcggcgatgctgatgccctggggcatgaaggccgtctacggcgacgacgtgctgcgctactacgccgaggcgggtctggcgatcccgggcgcggccccggtcgggcgccccggcacaccgctgccgctcggcgagatcgtcgcccgcgcgacggccgccgggggcgaggtgcccgaggtgatgctggtcactcggccgggcgatgccggcgccaccgtgacggcgtacttcgaggagccccacgggctcgcgcacctgcacccgcagatcgcctacgcggccgataccggttcggagatcgcccgggtcggcgatgccggcgccgcgacccggaccggggccgtgatggtggggctgcacgaggcacacttcgccgccgcgcccctgcgcctcctgttcttcctctgcggcgtgatgggcgccgccacggtcgccagcggcctcgtgctctggaccgtggcccgggcgccgaagggcgcggatcccgagggtttcggcctgcgtctcgtgcggttcctcaacctcggcaccatcgcgggtcttccggtgggcctcgccgcgtatttcctggcgaaccggctgctgcccgacgggctcggggcccgagcggactgggaggtgcgcgccttcttcgccgcctggctcgtggccgcgctcgcggcgtccctgtacccgcgaaggcgggcgtggtcgctcgccctggcagtgccggcctgcgccttcctggcgatcccgctggtggacgtgatcctcatcggccagcagcgcttcctcgccttcgacgccgccatggcggccgtcggcctcgcgctcggcatcgcggcccggctgtccacgcggcggggcgtggctgcggcccgcccggccaaggtaaccctgtcgcagacggtcgaagcatga

SEQ ID NO: 4821 - DNA, 1224 bp, Methylobacterium sp.
atgacggcgaaccacggcgtgttcgccttcgcgcatatcggcgacctgcatctcgagcgggcctccgacccccacgccgccgacctgcgggcgatgctcgccgaggtggcggggctgcacggacacggtctcctcgacttcgtctacatccccggcgacctcgccgaggacgggcgggcggagcagtacgcggtcctgcacgaagccctggaccggcacccggacctgccggtgcgcctgatcgccggcgaccacgaccgccagcacggcacgatggcggatttcgacgccctgttcgccgcggtggcgggcagcccgcgcggcggcggccacgcggcgcagcgccacgacctgccgcgcccgcgcgatccggcctccgtgacgcactactacttcgccgagacctgggcgggcgtgcgctgcctgttcctcgacatggtcagccccggctacggccagaagggcttcggcctcgacttccgcctcggcccccaccagctcgcgtggctcggcgaggagctggcccgggccgagcgggagggccagccctgcgcggtcttcgcccacacctacccggacgacctctgcgtgcccgacgagcgggcggccttcgccggcctgatccgccactacggcgtccgcctcgtcgagatgggccacacccactacaacgagctcgccccggacgggcgcaccctctacgccgcggcccgctcggtcggccagaacgaggacggctcggtcggctacgcggtcgcggcgatcgacgggccggtcacgagctggcggttcaagcccctcgaccgggcgctgcccttcgtgatgatcacgagccccgccgaccggcgcctcgccaccgcccccctcgacgcccccgacggcacgatcaccgtgcgcgccctcgtgctgtcggcgaagccgcaggacgcgtggcgctgccacctgcgcgtcgatggcggcccggcccacccgatggtgccggacggcccccggacggtccacgcccgcatcccctggcgcgacggcgcgcgccgcctcgccgtcacggtcgcggacggcaccggccacaccgacaccgaggtgatcgagccggtggaccggagcttcgtgccgccgcccgcgcacgagcgccccggcagcgacgcgttccgcctgccggcctggcccgagaaggggctccggggcgaccagctcgggccgaaccgcaacggccggcactggtag

SEQ ID NO: 4822 - DNA, 660 bp, Methylobacterium sp.
atgaacggagcccaggatctcggcggggcgcacggcttcgggccggtgttgcctgagccggacgagccggccttccacgccgcgtgggagcgccgcgtcttcgcgctggccatggccatgggctacacgggcgcctggaacctcgacggcagccgggccaaccgcgaatccctgccgccggcggagtatctcgcgtcgagctactacgagatctggctcagggcactggagaagcaggtcgtcggcaccgggctggtgacgccggccgaactggcgagcggccgatccgcggagccggccaagcccgtcgcgcgggtcctggcccgcgacggcctggagcagcgcttccgggccggcttcccgagcagccgcgccgccgacggcccggcccggttcgcggtcggcgacgccgtcctggcgcgcaacgtccacccgaccggccacacgcggctgccccgctacgtgcgcggcaagcgcggccggatcgtgcgcgtcgacggggtcttcgtcttccccgacaccaacgcctacgggtcgggtgagaacccgacctggctctacacggtcgccttcaccgcgcaggagctgtggggcgagtgcggcgacccgggcggcgtcgtcacggtggcggccttcgaaccgtacctggaccccgcgtga

SEQ ID NO: 4823 - DNA, 324 bp, Methylobacterium sp.
gtgaccgcgccgtcgcccagtcccttcgcggcgccctgggaggcgcaggtcttcgcgctggtggtgtccctgcgcgaatccgggctgttcacgtggtcggaatgggcggaccgcctcggccgccagatccgccccaccgaggcccccgagcaggcggccgattacggcgcgtggctcgcgacgctggaagcgctcctggccgagcgcggcgtcgcgggacccgagagcgtcgcggcgcggaccgaggccttcctgcgggccgcggaggccacgccccacggccagccgatccgcctggagaacgacccgctctaccggccctga

SEQ ID NO: 4824 - DNA, 1374 bp, Methylobacterium sp.
atgaccgcgcgcgccgcaccgctctgcgacgtcatcggggtcggcttcgggccgtcgaacctcgccctggcgatcgccctggccgagaccccggcggcgcgcggcctccggtaccgcttcctggagcggcagccgcacttccgatggcacggcggcatgctgctgccgggcagcgacatgcagatctcgttcctcaaggacctcgtcacgctccgcaacccgacgagcccgctgaccttcgtgaactacctgcacagccagggtcgactgcacgatttcatcgatctcgggacgtttcatcccagccggatcgagttcaacgactatctccggtgggtggcggaccatttcgccgaccgctgcgactacggcgagaccgcggtcgcggtggagcccggtctgggaccggacgggacggtcgagaccctgtgggtcgtcacccgcgacgccgcgggccgcgagatccgccgccagacgcgcgacctcgccctcgcggtgggcggcgccccgcacgtgcccgccgccttcgccgccctggcgcgcgatccacggctctgccattcgagccgctacctcgaccacgtcgaccggcgcggcccgggcagcccgctcgacctgtcgcgcccgggcgcccgcgtggcggtgatcggcggcggccagagcgccgccgagatcggccacgatctccacgcccgcttcccgcagctgcaggtcgatctcgtcttccgcggccacgccctccgaccgtcggacgcgacgccgttcgtcaacgagatcttccaccccgaccgcaccgacttcgtgtacgcgcagccgagcgagcggcgggcggcgatcgtgcgcagctaccgcaacacgaactacgcggtgatcgacgccgacctgctcaaggcgctccacgtcatcgtctaccgggagaaggtctccgggccgcagcgcctgcacctccggccgcgcagcgagatcctctcggccgtcggcgacgcgggcgggatcaggctgcggaccgtcgaccgctacgccgaggtcgaggcggagcgcagctacgacggcatcgtcctggcgaccgggtacgcgcgcgacccgaacccggcgatcctcgaaccgctcgcgccctaccgcgacgggccggacctggcgcgcgactaccgcgtcccgacccgtcccggcttcgtcccgcgcatctacgtccagggctactcggagacctcgcacggtctgagcgacaccctgctctcggtcctgccggtccgcgcgcaggagatcgtcgacagcctgctcgatcaggacgggcacgggggcgcggtcgccccggcgcgcgcgcccgccgccggcgggatccgcgcctgggaacgacagggagcgcatccatga

SEQ ID NO: 4825 - DNA, 1032 bp, Methylobacterium sp.
atgcccaagctgcgtgaggtcaccaagggaagccggttcagcggcgacctgcgcgggacccggatcctggtcacgggcggatcgggcttcatcggctcccacatcatcgacctgctggtcgaggccggctgcgacgagatcgtggccatcgacaacatgatccgcggccgccccgagaatctcggggacgccctcggctccggccgcgtccgcctcgtccagggcgacatccgcgaccgcgccctgatggacacgctggtcaagggcaccgacgtggtgttccaccaggcggccctccggatcacgcagtgcgccgcggagccccgccacgccttcgaggtgatggccgccgcgaccttcaacctgctggagagctgcgtcgaggccggcgtcgccaaggtggtgatggcctcctcggcctcggtctacgggatggcggaggtcttcccgacgaccgagaagcatcacccctacgacaaccggaccctgtacggcgccgccaagtccttcggcgagggcctgctgcgctcgttcaacgacatgcacgggctcgactacgtcgcgctccggtacttcaacgcctacggcccgcggatggacctgaccggccgctacaccgaggtcatggtccgctggatgcagcgcctggccgagggccagtcgccgatcgtgttcggcgacggcctgcagaccatggacctcgtccatgtccgcgacatcgcccgggccaacatcctgtcggcgatctcgcccgccaccgacgtggtgctcaacgtcggcaccggcgtcgagacctcgctggtcgacctcgccggccacctcacccggatcatgggccgggacggcacgccgctggtccacgaggccgagcgggccgtgaacccggtgccccggcgcctctgcgacacgagcctcgccaaggagctgatcggcttcgaggcgaagatcggggcggccgagggcctcgccgacctcgtcgcttggtggcaggacgagtcccgctcggatcacctgcggcgggcgctcgcatga

SEQ ID NO: 4826 - DNA, 1107 bp, Methylobacterium sp.
gtgccggaatccgtgctcattaccggtggtgctggcttcatcggccgccacctctccgccgagctgctgcgccgcggctaccgcgtgcgggtgctcgacagcctgatcgagcaggtccacggcggtggcgccgaggcgctgccgccggaggtcgagttccaggccggcgacgtccgcgacggcgcggccgtggcccgcgccctgtcgggcatcgaccgggtcgtccacctcgcggccgaggtcggcgtcggccagagcatgtacgcggtggagcgctacgtctcggtcaacgattgcgggacggcggtcctgttccagcagctcatcgacgccccggtgaggcgcgtggtcgtcgcctcctcgatgagcatctacggggaggggctgtaccgcacctccgacggctcgaccgccgaggaggtggtgcgccgcccgcgccgtcccggggaaccctgggaccccctcgacgggcacgggcagcccatgcgaccgatcccgacacccgagacgaagcggccggcgctcgcctcggtgtacgcgctgaccaagtacatgcaggagcgcctgacgctcaccctcgcccccgcctacgggatggagggcgtggcgctccgcctgtggaacgcctacgggccgggccaggcgctctcgaacccctataccggcgtgctggcgatcttcgctgcgcgcctccacaacggccagccgccgatgatcttcgaggacggcgaacagcggcgcgacttcgtccacgtggaggacgtcgcccaggccttcgcgctggccctggagcacccggccgccgccggccaggtctacaacgtcggcagcggccaggaccgcacggtcagcgaggtcgcccgcctgctcgcccgcgcgatgggccacgaggacatcgggccggaggtgaccggccaggcgcggctcggcgacatccgccactgcatcgccgatatcggcaagatccagcgggagctcggctacgccccgcgccgcgacttcgccgaggggctcgccgaactcgccgcctgggtggccgagcagcaggccgtcgatcgcgtcgccgaggcgcggcgcgagctcgaagcgcgcggcctcgtcgcgtga

SEQ ID NO: 4827 - DNA, 465 bp, Methylobacterium sp.
atgtccgcagggctcgaccggatcgaccagaagatcctccgtctcctccagacggacgggcgcatggcgaatgccgagatcgccgagcgggtcggcaccagtgcggccacctgccatcgccggatccagcgcctgttcgcggacgggttcgtgcgggcggtccgggcgctgatcgaccccatgcgggtcgggcgcggcaccttggtcttcgtcggcgtcgtactcgaccgctcgacgcccgagagcttctcggagttcgaggcggccgtgcgggcgatccccgcgctcctcgattgccacctcgtggccggcgattttgactacatgctgaagatccgggtctccgacatggccgacttcaaccgcctccacagcgccacgctgatcggcctgccgggggtgcgccagacccggaccttcttcgtcatgaaggaggtgatcgacaacgcgccgctggatctgtga

SEQ ID NO: 4828 - DNA, 105 bp, Methylobacterium sp.
atgctgaagcgggtgatcctgaccggaatggtcgagttcatggcgttcgggatgctgttcgtggcggtgggcgcctgggcgatagccttggcaccggttcgttag

SEQ ID NO: 4829 - DNA, 258 bp, Methylobacterium sp.
tcctggccccgctacgccctgctggccgcgatgacgctcggcgggctcgcgaccgcccccaccgagggcgcggaccggcacctcgaacggcccaagccccgcgtcgcgatccaggcggccgagcgctggcgcctgcggccgaccgagcccgtcgtggcggcgacgaccggcagcatccgcaagcgggcggagaccgcgatccccgaggatcggcgcaacgtccgcctcgtctacccggcgctgatcgaggcgcgctga

SEQ ID NO: 4830 - DNA, 1488 bp, Methylobacterium sp.
  modified_base (1167)..(1170): a, c, t, g, unknown or other
  modified_base (1173)..(1173): a, c, t, g, unknown or other
atgcgcgccggtatctccatcgcggccaaactcggcctgtgtctcgcggccctggtgctgctgatcgccgcgacgagcggcctctcgctggccgagctcggccgcatcgagtccgccgccgcgcagctgcgcgacacgcgcatcccggccaccgacgccctcggccggatcggcatcaacttcatgcggcagcgggtcaacgccgtccgcctgatcaccgccgacacgcccgcgctgcgcgccgaggtcgccgaccagatcgccaagcgcgacgcgctgctcgccgcccagtacgcccggtacgaggccctgccgctgacccagcccgagcgcgaggcctacgcggccttccgccagcacgtggccacctacgccgagcagcagcgggaggcggtggccaaggccgaggcgggcgacgtcgccggcgggcagcggatctacaacacgaccatgtcggacagcatccgcgccatcatggcggactgggagaagctcgtcgccctgaacggcgacgggtcgcaggcgagcggcacgctgatcgtgcagacctacgacgccgccaagcggaacgtgctggccctcgccggcctcgccctgctggtggcgctcggggccttcgtgctggtgacccgcggcgtcagccggccactccgcaagatcgccgccgtcacgcagcgcctcgctgcgggcgacgccgaggtggcgatctccgggcaggagcgccgcgacgagatcggggcgctggcgggttccgtggtggtgttccgcgacaacctcgtccgcgcgcgcgccctggaggccgagacggcgctggcccgcgccgatgccgagacgcagcgccgggccgcgacccgggccatggccgacgccttcgagcaggcggtgggcggcatcgtcggcggcgtgtcggcggcggccaccgagctggaggccaccgcccggtccctgaccggcagcgcggccgaggcggccgggcagtccggcaccgtcgcgggcgcggcgagcgacgccgccgccaacgtcaacaccgtcgcggccgccgccgaggagctcggctcctcggtgcaggagatcggccggcaggtcagcagctcggcggaactcgcgcgggtcgccgtcgccgaggcgaccaacacggtggcgctggtccaggacctgagcggcgcnnnnganggtcggcgacgtggtggcgctgatctccgggatcgccgcccagaccaacctgctggcgctcaacgccacgatcgaggccgcgcgcgccggcaccgcgggccgcggcttcgcggtggtggcctcggaggtcaaggcgctcgccgagcagaccgcccgggccaccgaggagatcaccggccagatcggccggatccagtcctccaccgggcaggcggcgtcggcgatcgacgggatcggccggcgcatccgcgagatcgacggcgtggcctccagcatcgcggccgccgtggagcagcagggcgcggccacccatga

SEQ ID NO: 4831 - DNA, 306 bp, Methylobacterium sp.
atgcgttcccgatcccgacaggttcttcccgcgatcctcgtcctcgccgacctgtccggcgccgtcgcgccccggacggcccgcgcgcagggggcggattcggtgatggcctgcgagacgctgatcgccgcccggcggatcgacgcggcctcgggcagcggcggccccgccccctcggaggccggctgtcggcggatgccgcgcagcgcgatcggcaccgtggagcagcgggccctgatcggcggggcgccctacgagtgcctgactgtcgccggcggggggccgtgccgctggatcgtgccctga

SEQ ID NO: 4832 - DNA, 1473 bp, Methylobacterium sp.
ttgaagatcttcatcgccggcctcgccaccgagaccaacaccttcgcgccgctgcccaccggacggtcggcgttccacgccgactacgcccgccgggacggcagccggaacccgccgagcctcagcaatatcggcctcaaggcctggcgcgcgttggccgaggcggacgggcacaccgtcgtcgagagcctctcgaccttcgcgcagcccggcgggatcaccctgcgggccgtctacgaggagctgcgcgacgccctgctggaggacctggaggccgcgatgccggtcgacgccgtgatgctgttcatgcacggcgccatggtggccgaggggtacgacgactgcgagggcgataccctcgagcaggtccgcgccatcgtggggccggaggccacgatcggcgtcgagcttgacctccactgccacctcaccgagacgatgcgggccagcgcagacgtcatcgtgatctacaaggaatacccccacaccgacatcgtcgaccgcgcccgcgacctgtaccccctggtcgtccggaccgtgacgaaggacatccggccggtgatggcctacgccgactgccggatcgtcaacatgtggcgcaccagccgcgagccggtcgcgggcttcgttcgccgcatggaggcgctggaggggcgcaacgggatcctgtcggtctccttcgggcacggcttcccctggggcgacgtggccgatgtcggcgccaagatgctggtcgtcgccgacggcgatgccgccagggcgcaggcgctggccgacgagctggccggcgccgtctgggcgatgcgcgaggaggcggcgagccactgcgacacgatcgacgcggccatcgaccgggcgctcgcctccggcgacccgcgcccgatggtgctcgccgacttcgccgacaatgccggcgcgggcgcgccctccgacaacaccgcgatcctcgcccgcctcgccgagcggggcatcgcgaacgtggcgctcggcctgatctgggatcccggcgcggtcggcatctgccacgaggccggcctcggggcgaccttcaccctccggatcggcggcaagtgcggcgtgacctccgggaacccggtggacctgcgcgtcacggtccgcggcctgtcggacgaccacagccagaccggcctcagcggcggccgggcccatctcggccccgcggcctgggtggaggcggacgggatccacgtggtgctgacccacaagcgccagcaggccttcgcgcccgacgcgttcacgcgcctcggcctgagcctcgacgacaagcggatcgtcgtggtgaagtcgatgcagcacttctacgccgccttcgcgccgatcgcgagcgaggtccgctacgtcgcggcgcccggcgccgtgccgccggattacggcgcgatcccctacaccaagcggtccggcctctactggccgcgcgtcgccgatccgttcgccgaggagaacgcccgatga

SEQ ID NO: 4833 - DNA, 1293 bp, Methylobacterium sp.
atggccctcgaccccaccctcgccgccgagatcgaagcctccgtggcggagggcttcgccgatcaggtcgcccacacgcaggcgctggtccggttcgcctccctgcgcggggaggagcatgcctgccaggactacgtcttcgaccagttccgcgcccgcggctacgccaccgagcgcttcgccatggatcgggccgcgatcgcggcgcatccgggcggctcgaagatcgacgcggcgctccactcggacgcgccgatcgtggtctgccaccatcgtcccggcacggagaccgggcgctcgctgatcctccaggcccatgtcgacgtggtaccgccggggcccgccgacctctggacccaccggcccttcgatcctgtgatccagggcgactggatgtacggccgcggcgccggcgacatgaaggccgggcacgccgccaacctgttcgccctcgacgccctcgcccgcctcggcctgcagccggcggccgccgtgacggtgcagtcggtggtcgaggaggaatccaccggcaacggcgccctgatgacccacctgcgcggctaccgcgccgacgccgtgctgatccccgagccggaggacgagaagctcgtgcgcgccaataccggcgtgctctggttcaccgtggaggtccggggcgtcccggtccacgtgcgcgagatgggcgccggcgccaacgcgatcgacgccacctaccgggtgatcggcgcgctgcgcgacgtcgaggcccgctggaacgccgagaaggccgcgcacccgcatttcgagaccgaggaccacccgatcaacctcaacatcggcaagatcgagggcggcgactgggcctcctcggtcccggcctggtgccggatccactgccgggtggcgctctacccgggcgtcaccgccgcgcaggccgccgacgagatcgaggccacggtggcaggcttctctcgcaccgacccgttcctggccaacagcccgccgcgggtggtcttcaacggcttcttcgccgagggctacgtgctggaggaaggctcggaggccgaggccgtgctcggccgcgcccacgagcgggcgatcggctcaccgctccagagcttcatgacggccggctacctcgatacccgggtgcacgccctctacgaccgggtgccggccctctgctacggcccgacttcccagaacatccacggcttcgacgagcgggtgagcctcgcctcggtgaagcggatcacgaccgccatggcgctgttcgtggccgagtggtgcgggacggagcggaaggcggggtga

SEQ ID NO: 4834 - DNA, 1599 bp, Methylobacterium sp.
atggccgggaaacgccgcgccgccccgtccggaaccctgcgcttcgtcctcggcgatcagctgacccgccgggtgtcgagcctcgtcgacctcgacgccgagcgcgacgtcgtcctgatcgtcgaggtccgcgacgaggcgacgtatgtccgccaccacaagcagaagatcgccttcctgttcgccgccatgcgccacttcgcggccgagctggaggcggaggggatcgcggtcgagtacgtgcgcctgaccgacgcgggcaacaccggcagcttcaccggcgagctggagcgtgccgtggcgcgccaccggccggagcgggtcgtggtgaccgagccgggcgagtggcgcgtctgggagatgatgcaggactggcgcgagaccctggcgatcccggtcgagatccgcgccgacaaccgcttcctgtgcccgcgggaggatttcgcccgctgggcggagggccggcatcacctgcggatggagaccttctaccggggcatgcggcgccggaccggcctcctgatggacgacggcgagcccgcgggcggccgctggaactacgactccgagaaccgcaagcgcctgcccagggggcatcgtccgccggaccggatcggcttccagcccgattccgtcacgcgcgcggtcatcgccctcgtggaggccgagttcggagaccatttcggcgatctcaccggcttctactggccggtgacccgggccgacgccctcgcggcgctccggcacttcctggccgacgccctgccgaccttcggcgactatcaggacgcgatgaagaccggcgcgccgttcctgtaccacgcgctcctgtcgcccgccctcaacgccgggctgctcaccgccgaggaggtgtgctgggccgccgagcgcgcctaccgcgacggcgcggcgccgctccactgcgtcgagggcttcatccggcagatcctcggctggcgggaatacgtgcgcggtctctactgggcccggatgcccgcctaccgcgacagcaacgccctcggcgcgggccgcgacctgccgtggttctactggtcgggcgagacggcgctgaactgcgtcgcgcaggtcgtcgccgagacgcgcgcccacgcctatgcccaccacatccagcgcctgatggtgaccggcaacttcgccctcatcgccggcctcgacccggctcaggttgaggaatggtacctgatcgtgttcgcggacgcctacgagtgggtcgagctgcccaacgtccacggcatggtgctgtgggccgacggcggcgtcatgggctccaagccctacgcggcctcgggcgcctatatcgaccggatgtccgattactgcgcgtcctgcgcgtacgacgtgaaggtcaaggccgggccggaggcgtgcccgttcaactatctctactggaacttcctcatggagaacgaggaccggctggcgggcaatcagcggatggccatgccgtaccggacgctccgcgggctgggcgacaggcgccgcgccgagatccgccgcgacgcggccgcgttcctcgacaccctcgaggcccggccgagcgccgatcagaggggcgaccagacggacaggctcaggtag

SEQ ID NO: 4835 - DNA, 420 bp, Methylobacterium sp.
gtgagcaccggcgcggccatggccgaggatcgctccgacgggcggctcagcgtctactacgacggcggctgcccgctgtgccgcgccgagatcgaccagtatcgccggtgcgccggcgcggaccggctcgccttcgtcgatgtcggctccggggcgcccgaaccggcgctcggcgcggatctcgaccgggaccgggcgctgcgccggttccatgtccggaccgcggacgggcagctgatctccggcgccgccgcgttcgcgcgcctctggcggaccctgcccagctggcgctggctcggccgtctggtcgacctgcgcgtcctcggtgtccggccgattctgccgctcgccgagctggcctaccggctgtcgctgccgctgcggccgcgcctggcccggctgatggcccgcctccggtga

SEQ ID NO: 4836 - DNA, 549 bp, Methylobacterium sp.
atgatcgccgaggtcgccgcccaggttcccgacacgctcgcggcctaccgggacggggtcgccgagggcccaggcggcccggacgcgctgcccctcggcgccctgcgcgatggggccgtgttcgacgcgacgctggccgccttcggggccgggttcggcgcggagttccggaccgcggacccgcgggtccgggtctcgtactggagccagttctacctcgcggccctggcgacgccggcgctgaccgccctggtgcgcctcggccggccgctgccgctcgccttcgacgcggtcagcctcgagctcgacgcggccggccggccgcgccgcttccacctgcccgcggacgggtcggcctgcgcggcctgcccggtacccggcctgaccgggctggtggaggcgcatctgcgcccgttcgtcgagctctgccacgcccggtgcgggatcgccccccgggtcctctggggcaacgccgcggtgatcctcgactacgtcgcccgggaactcggggacccgctcgccgggccggctggggacggggcggggggc

SEQ ID NO: 4837 - DNA, 1290 bp, Methylobacterium sp.
atggcctcgcgcgcgcgcaggggtgccacgaaggcgctgcgggtcctcacgcggccggtccgccgcgcgcagggccatggcggcaagggccgcggcgggctcgtcgtcgagccctaccgcggctacgggtcacgggacgaggtattcctgatcggccgcgtcttccggcagtcgccggggatacccggcgaggatcccgaatccctgcgggcgcagtggcgcgacctgcgccgccgcatcgcccggcggacgatcgccggcgcggccgtcaccgcccggttcggcgacgatgccgtgcgggtcgagaccgaccgggacggctatttccgcgtgcacctgcacccgcgcacgcccccggccgagacgggtgactggcacgcggtcgaactgcgcctcgaggccgatccgccgatccccgccgagggcgcggtgttcatcccgcccgaccattgccgctgcgtcgtggtcagcgacatcgacgacacggtcatgcgcaccggcgtcgccaacaagctcaagatgctctggcgcctgttcgtggaggatgccgagggccgagtcgccttcccgggcgtcgccgccctctaccgcgccctccacgcgggcgccggcggcgacgagggcaacccgatgctctacgtgtcccgcgcgccctggggcctctacgagatgctgtcggagttcttccagcgccacggcatcccggcggggccggtgctgttccttcgggaatggggcctctcctggacccacccgctgccgcgccgggccaccgaccacaagcacgcgctgatccggcacatgctcgccctctaccgtgacctgcccttcgtgctgatcggcgacagcggccagcacgacccggaggtctacgcgcagatcgtcgaggagaatcccgggcgggtgctggcggtctacatccgcaacgtgtcccgcggctccgcgcgggtggaggagatcgtccggctcgccggcgccgtcgcccgggccggatcgagcctcgtgctcgccgccgacagcgtcgccatggccgagcacgcggccgccatcgggctgatcgcgcccggagcggtggccggcgtcgccgacgagcacgcggcggcggccgagaccgggccgcgccgggagaccgcccggatcacgccggaaccgtcgggcgtcgccgacgcggccgaggacccgatcgggccggaggcgatcgccgaggccctcgccggcgacggccccgtgccggcgaccctggtggtcgagccggagacgccggccgcgctcccgcggctcggtgcgtga

SEQ ID NO: 4838 - DNA, 489 bp, Methylobacterium sp.
atgcccgcccgaccggccgccctcgacgccgcgagcctgcgcatcctcgcgtgcctgcagcaggacagcgagatcagcatcgcggatctcgccgagcgcgtgggcctctcgacgtcgccgtgctggcgacgcgtcaacgacctgaaggaggcgggggtgatccgcggctgcgtggcggtggtcgacccgctgagcctcgggctcgcggtcaacgtcttcgtccacgtgtcgctggagaagcagacccaggccgcgctccaggccttcgacgaggcagtgcgcagccgccccgaggtgatggagtgctacctgatgagcggcgaggccgactatatgcttcgcgtcgtcgtcgaggatctgggccagtaccagaagctcgtcctcgaccacctcacgcggatccccggcgtcgccaacatccgctcgagcttcgccctcgggcaggtgaagtacacgaccgcgctgccgctcggtcacctgacccgctga

SEQ ID NO: 4839 - DNA, 360 bp, Methylobacterium sp.
atgccccgcacccgccgccacacgggcgcctgcagccccggctgcgccgtcgaggcgacgctccggctcatcgacggcaagtggaagggcgtgatcctctaccacctgctggaggggaccctgcgcttcaacgagatccggcggcgcctcgccagcgtgacccagcgcatgctcaccaaccagctgcgcgaaatggaatccgacggcctgatcacccggacggtctacgccgaggttcccccgaaggtcgaatacagcctgaccgagcgggggcggtccctcgatccggtcattcgcgcgctgaagacctggggtgatctgcacgccgaagtggcagatccggccgagaacgctgcctga

SEQ ID NO: 4840 - DNA, 327 bp, Methylobacterium sp.
atgaatccgtacctgatcctcgggctcgccatcggcgcggaggtgaccgccaccctggcgctgaaggccgccgacggcctcacccgcccggggccgacggtgatcgtggccctcggttacggcaccgccctgtggctgatgtcgaccagcatggacatgctgccgatcggcgtggtctacgcgatctggtcggggatcggcatgatcggcgcggcgctcggcggcgcgtggctgtacggtgaggcgctcaacccgacgatgctggtgggcatcggggtgatcgccctgggcgtgaccgtcctggccgcgggccagggccagcaatga

SEQ ID NO: 4841 - DNA, 2049 bp, Methylobacterium sp.
gtgaccctacccggatggcgcgactgggccttcgcgctgaagacctacgcggcggcgatgctcgccctgtacctcgcgctctggatcgacctgccgcggccctactgggccctcggcaccgtctacatcaccagccaagttctctccggcgcgacgcgcgcgaaggccgcctaccgggtctgcggcaccgtgctcggcgcggcggtcagcgtcgtgctggtgccgaacctcgtgaacgcgccgatcctgctgagcctcgcggtggcgctctgggtcgcgctctgcctctacgtctccctcctcgaccggacccccgcgagctacctgccgatgctcgccggctacacggcggcgctgatcggtttccccgccgtcgacgatcccggggcgatcttcgacacggcggtggcgcgggccgaggagatctccctcggcatcgtctgcgccagcctcgccgccacgctgatcctgccgcaatcggcggccccgctcatcgtcggacggctgaacgactggtcggcggaggcccgggcctggatccggagcgccctcgcggccgcccgcgcgccggaggccgtcgggccgagccagggccggcgcctgcgcctcgcctcggacgcgatcggcctcgacgccctcggtctcgccctgcgcaacgaggcgacaggcgcggagcgcgccgccgaggccttcgcgccgctccggcagcacatgctgatggtcctgccgatcgtcgccgccgtgacggaccgcgtcgccgccctcgagcgggccggcgcggttgcggcgcgggtccgggccttcctgtcggacctcaccacctggctcgtcgacgaggtcgatgatccggatcgcgccgcgcggctgcgcgaccggatcgacgggttcgagcccgccctcggccgggcgccggactggaacacgctcctgctcgcgagcctcgcggcgcgcctgcgcgacgtcatcgacctgcgccaggatctgcgggcgctgcgcggccatctcgcggccggcacggccccccgcgcgccgctcgccttcgcctacacggcccgggtccggtcgatccgccaccgggaccacgggctggcggccttctcggccttcggggtgttcgcgggcctgctcgcctgctgcgccatctggatcgccaccggctggccggacggctccgcggcgccgatgatgggcgcggtcgcctgctgcctgttcgccgcgcaggacgatcccgcgccgcagatcctgagcttcgccaactcggcgatcgtcggcgccctcggcgcgggcctctacctgttcgccgtgctgccgctcgccacctccttcgagatgctggcgctcgcgctcgcgccggccctgatcctgtgcggcctgatgatgacgcagccgcgcaccgctccgatgggcatgggcgcggcgctgaacggcgcgaccctgctggcgctccagaacggctacagcggggacttcgcgcccttcgccaacggggtgatcgcctcggtggtgggcatgtgggtcgccgccgcggtgacccgggtgatccgctcggtcggcgccggctggagcgcggggcggctgatcgggatcaaccgccgcagcctcgcggccgccgcggccgggcgcggcaccggccacgggctcgaactcgcggccctcatgctcgaccgcgtcggcctgatcgcgccgcggctggcgagcctgcccgcggacacgtccgcctccgtgggcgacctgctggccgatgttcgggtgggcatcaacctcgtggaggtccgccgggtgcggcggcggctgacgggcccggtccgaagcaccgtcgaccgggtcctcgcgctggcggcgcgccagctgcggggccggaccggcgggccggacgcggcgctgctggcggcgctggacgaggcgctcgacgccgtcgcgggcgcggccccgtcgccggagcggcgcgccgccctgatcggcctcaccggcctgcgccgcgggctcttccccgacgcgccggcctaccgggcggcgcccgccctggaccaccgggagctggcggcatga

SEQ ID NO: 4842 - DNA, 2043 bp, Methylobacterium sp.
atgacgcttccgggctggcgcgactgggccttcgcgctcaagaccttcggtgccggcatgctggccctgttcctggcgttctggatcgatctgccgaacccctactgggcgctcggcaccgtctacatcaccagccaggtgctggccggcgccacccgctccaaggcgctctaccgggtgctcggcaccctgctcggggccgtggtcacggtcgccctcgtgccgaacctcgtgaacgcgccggaactcctgacgctcgccatcgcgacctgggtcgcgacgtgcctgtacttctccctcctcgaccgcaccccccgcagctacctgatgatgctcggcggctacacggcggcgctgatcggcttcccggccgtgggcgatcccgggacgatgttcgatgtcgcggtggcccgggccgaggagatcaccctcggcatcctctgcgccagcctcgtcaacacgatcgtgctgccgcagtcggtggcgccggtgatctccggccggctcgacctctggctgcgcgacgcgcggggctgggtcatcgacgtcctcggccgcacccgcgcgacgacggacacgcaggccacccggctgaagctggcctcggacgcggtcgcgttcgatgccctggcgacgccgctgcgctacgacatgaccggcgcggaacgctcggcggatgccatggcgaccctgcgccagcacatgctcatgttcctgcccatcgcctcggcggtctcggaccgcatcgagacgctggagcgggcgagcgcgctgccgcagcgcctgcgcaccctcctcgacgccatggccgcctggctcgcctccggaaccaccgaacaggccgaggccgaccgcctgaaggccgaggcggacgccctcgaacccgggctcggggagcggccgtcctgggacgccctcgtgctggcgagcctcctggcgcggctgcgcgacttcatcgacctgcgccaggacgcccggatcctgcagcggcacatcgcggacggcacgccggtcaccgaggacctgaccttccggtacaccgcggcggcgcgcacgatccgccaccgcgaccacggcatggcgctgctgtcggccctgggcgtgttcctgaccatcctggtcacctgcgcgatctggatcgcgaccggatggccgcacggctcggccgccccgatgatggccgcggtcggctgctgcttcttcgccgcccaggacgatcccgccccgttcatcgtcagcttcgccaactcggccatcgtcggcgccctgggggcgggcgcctacctgttcgcggtcctgccgctggccaccaccttcgagatgctggccctggcgctgtccccggccctcctggcctgcggggtgttcatggcccagccgaggaccgcgcccctggcgatgggcgcggcggtcaacggctcggccatgatcgccctccagggcagctacacgggggacttcgcggccttcaccaacgcctccgtcgcggtcatcgtcggcatgtgggtcgcggccatcgtcacgcgcctcgtccgctcggtcggcgccggctggtcggcgcggcgcctgcgggccgtcaaccgccgcagcctcgcccgcgccgccgggcgccagggcgcgcagaacggtctcgaactcgccgcgctgatgctcgaccgggtcggcctgatcgcgccgcggctggccgccctgccgtccgacgacgcggaatggaccgccgacctcctcgccgaggtccgggtcggcatcaacgtcgtggaactgcggcgcgaccgacggcagctctcggagccggcccgggcggcggtcgaagcactcctcgtcgcgctgtcgcggcacttcgcggccgagccggggaagcccgcccccggcctgctcgaggccgtcgacggggccctcgacgccgtctcccgcgacgcgcggcaggcggccggccgggccgcgctgatgggtctcgtcggcatccggcgcggcctgttcccggacgcgccgccgtaccggtcgacgctgcccaccaccacgcatccggagctcgcggcatga

SEQ ID NO: 4843 - DNA, 2718 bp, Methylobacterium sp.
atgatcgcgccgaccagggaggccgcgccgatgaacgccataccgccgaaagccacgatcgcgcggtccgccgaggtggatcacgacccggccgagacccaggactggctcgccgcgctggaatccgtcttccgcaccgagggcgcggcccgggcgcgcttcatcctcgaccgcctggagcggcgctcgaaggagatcggcatcctcgacgaggccctgccctactcgccgtaccggaacacgatcgcgctggagaagcagccgcgctatcccggcgacctcgacatcgaggagcgcctgacctcgatcatgcgctggaacgccctcgcgatggtggtgcgcgccaacatggcctacggcgagctcggcggccacgtggcgagctacgcctcggcggcggagctgttcgaggtcggcttcaaccacttcttcaagggcggcacggacggcgacctcgtctatttccagccgcactcggcgccgggcgtctacgcgcgggccttcctcgagggccggctctccgaggagcagctgaagcactaccgccaggagatcgccggcgacgggctgtgctcctacccgcatccctggctgatgccggatttctggcaggtcccgaccggctccatgggcatcggccccatccacgcggtctaccaggcgcggttcatgcgctacctcggtgaccggggcctcgccgacaccaccggccgccacgtctggggcgtgttcggcgacggcgagatggacgagccggaatcgatcggcggcctcgccctggcggcgcgcgagaacctcgacaacctgaccttcgtcatcaactgcaacctgcagcggctcgacgggccggtgcgcggcaacggccagatcatccaggagttggagagcctgttccgcggcgccggctggaacgtcatcaaggtgctgtggggctcggagtgggacgggatcttcgcccgcgacaccaaccacgccctgctgcggcgcttcgccgagaccgtcgacggcaagtaccagacgctcggcgcgaaggacggcgcctacaacctcgcgcacttcttcggcgaggacccggaggtgcgcgagctcgtcgcccacatgtcggacgccgacgtcgaccggctgaagcgcggcggccacgacttccgcaagctctacgcggccttcgcggccgccaagaccaccaagggccggccgacagtgatcctggccaagaccaagaagggctacggcatgggcggcgcgggcgagtcgcgcatgaccgcccaccaggccaagaagctcgacgtcgacgcgctgcgcgccttccgcgaccgattcgccctgccgctctcggacgcgcaggtggagggcctcgccttctacaagccggccgaggacggcgccgagatgcgctacctgcgcgagcgtcgcgagatgctcggcggcgtcctgccggcccgccgccgcacggcgccgacggtccctgttccggagctctccacctacgcgggcttcgccctcgaggccggcggcaaggagatgtcgaccaccaccgcagtggtgcgcctgttcggcaaccttctgaagcacaaggatctcgggccgcgcatcgtgccgatcgtcgccgacgaggcgcggaccttcggcatggccaacctgttccggcaggtcgggatctacgcgccgcaggggcagctctacgagccggaggatgcgggctcgatgctctactaccgcgaggcccgggacgggcagctcctcgaagagggcatcaccgaggccggggcgatctcatcctggacggcggcggccacgtcctacagcgtccacggcctgtcgatgctgccgttctacatctactactcgatgttcggcttccagcgggtcggcgacctgatctgggcggcggccgaccagcgggcccgcggcttcctgatcggcgccacggcgggccgcacgacgctcggcggcgagggcctgcagcaccaggacgggtcgagccacatgcaggcggccgcgatcccgaactgccgggcctacgatccggccttcgcgtacgagatggcggtgatcgtcgaccggggcgcccgggcgatgatggaggagggcgaggacgccttctactacctcacggcgatgaacgagaactacgcccagccgtccatgccgcagggggcggaggccgggatcctgaagggcatgtaccggctgtcgggcccgcaggccggccagggcacgggcgccgccgccgtgcggctcctcggctccggagcgatcctgccggaggtgatcgccgcggcggcgctgctcgcgcaggatttcggcgtcgcggccgaggtgttcagcgtgacgagcttcagcgagctggcccgcgatgcccgcgaggccgagcggcaggcgatgctcaacccggaggccgaggcgccggtcagccacgtggcggcgctgctgccgggcacggcgcccatcgtcgcggcgagcgactacgtccgggcctacccgcagctgatcgcctcctatgtcggcgcgcgcttcgtcgccctcggcaccgacgggttcgggcgcagcgacacccgcaacgcgctccgccggttcttcgaggtcgaccggcagcacgtggtcatcgccgccctgcacgccctggccgaggccggcacggttccgcgcgcgacggtggcggacgcgatccgccgctacggcatcgcggcggacgcgcccgcgccctggacgatctga

SEQ ID NO: 4844 - DNA, 1335 bp, Methylobacterium sp.
atgcgccccgcggattaccgcaccgtcgccgacgcgatcgcggccgacatcgcggcgggccggctgcgccccggcgcgcggctgccgccgcagcgcgacttcgcctacgcgcggggcatcgcggtctcgacggcgagccgggtctacgccgagctggcccgccgggggctggtgaccggcgaggtcgggcgcgggacctatgtccgcagcgagccggggcgcgccgggttgctccgcccggagccgcccccggccgccctcgacctgcagcggacccactcgcgcctgcccgagcaggaggcggtcctggccgagaccctggcggcgctcgcccgcgacgacggccagatcggcttcacccagtacgggccggcgggcacgccctcggcgcaggcgatcgccgccgggttcctggcgcgggcgggctacgcccccgatcccgccgacatcctgttcaccggcaacggccggcaggcgctggccgccgccctggcggccctggcggcgcccggcgagcggatcggctgcgagcccctgacctatcccggcgtgaagggcatcgcggcgcggctcgggatcacgctgatcccgctcgccatggacgcggagggcgtctgccccgaggccctcctccaggcccaccgcgcgaccccgctgagcggagtctatctccagccgaccctgcacaaccccctcggcgccacgatggggccggcgcgccgggccgccctggcggaggccctggagcggaccgggctcaccgccgtcgaggacgcggtctacagcttcctcgccgaggcgcccccgctcgccggcctcgcgccggaccgggtgatcttcgtggacagcctgtcgaagcgggtgatgccggcgctcaccgtcggcctgatcgccgcgccgccggcgctcaccgaccggctcgccgcctccgtccgccagggcgcctggacggtgctcggcctgtcgctcgcggccggcatgcactggatggcggggggctcggccgcggcgctggcggaggccaagcgccgggacgccgcggcccggcaggccctcgcccgggccgcgctcgccgacctgcgggtcgtgggcgatccgcaggcctaccacctctggctggaactgcccgagacgtggcgggccgaggcctacgcggccgcggccctgcgccagggcatcgccctcctcccggcctcgtccttcgcggtccatcccggccacgcgccgaacgcggtgcgcctcgccctggcctcgccgtcgcgggaggagctcgaccgggcgctgcgcggcctgcgccgcctggccttcgcgggcgacgaccaggtggtggagtag

SEQ ID NO: 4845 - DNA, 843 bp, Methylobacterium sp.
atggccctgacggcatcgcggtacggcaaggaacgggttcgcgtgctgcgtctcgcccgcgacggcgaccaccactcgccgcgcgagctgacgctgtcggtgatgctgaccgggcgcttcgaggccgcctggacggagggggacaaccgcgcctccatcgccaccgacagcatccggaacatcgtcaacgtgacggcggcgcggcatctcgggctcgacgccgaggggttcgtcgccgcggtcgcgcgggttctgctcgagacctacccgcaggtcgagaccgtcacgatcgaggcggaggagatccgctggctgcgtcacgcgatcgccgacgcgccgcacggccacaccttcacccgcgacgggaacggcgccggcttcgcggggctcacggccgacaggaccgggtcgaccctgcgctccgggttgcgcggttacaccttcatgaagaccacgcaatcgggctggacggggttcgtggcggaccggtaccggaccctgccggacacgaccgaccgcatcgcggcgaccagcatggacgcgacctggacctgggcctcggcgccgcacgattacgccggaacgaatgcccgcattctcgcgacgctgttgaccgtcttcggcaccacctacagccgcgggatccaggacagcatgtatcggatgggcgaggccgccctggccgccgtcccggaactggccgagatcggcttcgtcatgcccaacaagcactacctgccgatcgacctgacaccgttcggcctcgacaatccgggcgctgtcttcctgccgaccgacgagccctacggccggatcgaggcgaccatcggccggacaggctga

SEQ ID NO: 4846 - DNA, 513 bp, Methylobacterium sp.
atggctgacagcagacggatcgtcgacgcgctcgtgcggtcgaggcggggcgggctcgccgccggtgccgccctcggcgggctggcgctgatcggcggcctcgcctaccgggcgctgcgcggcgcgccgccgcccgaggccgggggcccggacttcacgaaggtcgacgaggacgaggcccggctgatgctgcgggccatggtggcggccaccacggccgacgggatggtcgacgccgcggagcgcaagcgcctcgacgcggcggtggcggaggcgggcctcgatcccgacggacgagcctggctcgagcgcgagctcgcggactccgccgacgtcgacgcgatcgccgaccgggtcgcggatcccgacgcggcggcgcggatcttcgcggcggcgcgactcgccatcgagcccgacacgctccaggagcgtcagttcctgaagatgctggccgaggccctcgacctgcccgcggaggcggtcgagcgggtcgagcgcgacatcggagcctga

SEQ ID NO: 4847 - DNA, 513 bp, Methylobacterium sp.
atgatcgacctcgaccgcctcaacgccctcgagcgcgacgccttcgtggcgtatctcggaggcgtcttcgagcacgcgccctgggtcgcccgggccgcccacggcgcggcgcccttcgccggcgtcgccgatctccatggggcgatgatggcggccgtgcgcgcggcgccgccggacgtgcgcctggccttcctcaacggccatcccgaactcgccggcccggaggcccgggcccgggcgatgaccgccgattccgcgcaggagcagggcagcgccggcctcgaccggctgacggaggcggacgccgcggcgttcgaccggctgaacgccgcctaccggcaccggttcggcttcccgttcatcgtcgccgtgcgcggccgggacctgcgcgagatccgcgcgctgttcgaggagcgcctcgcgcgcgcggtcgtggacgaggaggcgacggcgctggaggagatcggcgcgatcacccggatgcggctcgaccggctggtgcggccggcctag

SEQ ID NO: 4848 - DNA, 510 bp, Methylobacterium sp.
gtgatcaccatcgccgcgctcaacgcgctcgcgcgcgacgccttcgtggacctcctcgccgaggtctacgagcactccccctgggtccccgaggcggccttcgaccgcgggcccttcgcggcgcgcgcggacctgcacgcggcgatggaggcgacggtggccggcgccgactgggtccgccagctcgccctgctgcgggcgcatcccgaactcgccgggcgggccgcccagcgcggcgagctcaccgcgcattccagccgcgagcaggcgggaagcggattgctgggcggcccctcccccgcggtggcgcggctgcaggacctcaaccgggcctacgccgagcgcttcggcttcccgttcatcatcgcggtccggggcctcgaccgcgacgcgatcctcgcccggctggagcagcggctcggcaacccgccggagaccgagcgggccgaggccctgcggcaggtcggacggatcgccgccctgcgcctggaggccctcgtcttggcctaa

SEQ ID NO: 4849 - DNA, 123 bp, Methylobacterium sp.
atggcacccgcagcatcacagcccctctggaagcgcctcgcgtggttcgcggggctctgggcctccagcatcgtcggtctcggcttcgtcgcgacggtcctccggtattggctcaagagctga

SEQ ID NO: 4850 - DNA, 1323 bp, Methylobacterium sp.
atggaaacccatatcgacctgtggttcgccgcgagcatcgtggcgatctcgttgctgctctcggccttcttcgcgggcgcggagaccgccttcacggccgcctcgcgggcccggatgcacgccctcgagcaggcgggcgacccgcgcgccgcgatcgtcaaccgcatcctggcgatccgcgagcgctttatcggcgcgatgctgatcggctacaacatcgtggcgatcggcgcctcggccttcaccaccagcgtgctcacggcgctgttcggcaagagcggcgtcatctacgcgacggtcggcatgtcggtgctggtcatcgtcttcgccgaggtgctgccgaagacgctggcgatctccaagcccgacagggccgcgctgctcaccgcccgcccggtggccttcgcggtggcgctgatgggcccgctggccatcgcgatcgagcacgtggtgcggctgatggtgaagccgttcggcgtcaccatcggcgagcaccagtcgatcctcaccgccgccgaggagctgcgcgggcaggtagcgctgatgcaccgggagggcggcgtcgccaaggccgagcgcgacatgctgggcggcctcctcgacctgtcggacctgtcggtctccgacgtgatggtccaccgcacgaagatgcgggcgatcgacgccgaccagctctccgaggacatcgtccgggcggtgctgtcctcgccctacacccgcatgccgctgtggcgcggcacacccgagaacatcgtgggcgtcctccacgccaaggacctgctgcgggcgctcgacgccgcgggcggagatgcctccggcctcaaggtcgaggcgctggccctggagacgtggttcgtgccgggcacgacgtcgctgcgcgcccagctcaaggccttcctgaccaagaagacccacttcgccctggtggtcgacgagtacggcgaggtgatggggctcgtgaccctggaggacatcctggaggagatcgtcggcgacatcgccgacgagcacgacgtcaccgtctcgggcgtgcgcccgcagggggacgggtcggtgaacgtggacggcggcgtgccgatccgcgacctgaaccgggccatggactgggacctgcccgacgaggaggcgaccacgatcgccggcctcgtcatccacgaggcgcggaccatcccggaccagggcaccgccttcaacttccacggcttccgcttccaggtgctgcggaaggccaagaaccggatcaccacgctgcgcatcacgccgctgaccgcggcggggctccaggccgccgcgctgccggacgcgccgcgcgacgcggtgtga

SEQ ID NO: 4851 - DNA, 1593 bp, Methylobacterium sp.
gtggccaagccgggcttcaaccggtggctggtgccgccggcggcgttggcgatccatctctgcatcgggatggcctacggcctgtcggtgttctggctgccgctgacccgggcgctctccgtgggcaagccggcgcccgccgcgtgccccgacatgggcgtgatgacggccctgttcaccatcacctgcgattggcgggtcagcgacctcgtcacggtgttctccatcggtatcgtcgtgctcggcctctcggccgccctgttcggcggctggctggagcgggccggaccgcgcaaggccggcatcgcggcggccctctgctggggcggcggcttcctgatcggcgccttcggcgtctacatccaccagctctggctggtctggctcggcatgggcctgatcggcggcatcggcctcgggctcggctacatctcgccggtctcgaccctgatcaagtggttcccggaccggcgcggcatggcgaccggcatggcgatcatgggcttcggcggcggcgcgatgatcggctcgcccctggccgacagcctgatcaagagcttccggaccgccgattcggccggcgtctggcagaccctcgcggtgatgggagtggggtacatcctgttcatgctgggcggcgcgttcggctaccgggtgccgccggccggctggcgcccggacggctggaccagcccgaccgccaggaacgccatgatcgcctcggggcacgtccacctgcgcgacgcccacaagaccgtccagttctggatgatctggctcgtcctgttcctcaacgtgtcggccggcatcggcgtgctggcgctggcctcgccgatgctccaggagatcttcggcggcgagctgatcggcctgcccggcaccggattctcggccctcgacgccggccagaaggcgcaggtcgcggccatcgcggccggcttcgtcggcctgctctcactcttcaacatcctgggccggttcttctgggcctcgatgtcggaccgcatcgggcggaaggtcacctacgcgatcttcttcgccctgggcggcctcctgtacgcggccgcgccctgggccgccggcatcggctcgcaggcgctgttcgtcgccatcttctgcgtgatcctgtccatgtacggcggcggcttcgcgaccgtgccggcctacctcgccgacgtgttcggcacgcagttcgtgggcgccatccacgggcgcctgctcaccgcgtggtcgatggccggcatcgtcgggcccttcgtcatcaccaagatccgcgaggcgcaggtcgccgcgggcgtgcagggagccgatctctacggccggaccatgtacgtgctggcgagcttcctggcggtcggcttcctctgcaacctgctcgtccggcccctggcgcaacgctggttcatgtccgattccgagcgggcctccctggacgtccgcgcgggcgccacggcctcggggccgtccggctccttcgggatcggccgcggcggcttcagcgccggcgccgcgctggcctgggcggtggtcggcatcccgatcgtctggggcatcggcatcaccctgtcgaaggcgttcatcctgttccgctga

SEQ ID NO: 4852 - DNA, 765 bp, Methylobacterium sp.
atggacaacctcaccaaccgcttcaaggcggccctcgccgaggggcgccagcagatcggcctgtggtgcagcctcgccagtcccatctccaccgaggtggtcgccggggccgggttcgactggctgctcctcgacatggagcactcggccaacgacctccgggacatctacgcccagctccaggcgatgatggagggggacacgcacccgatggtgcgggtgccgagcgacgacccgatcaccatcaagcgcgtcctcgacgccggcgcgcagtcgctgatgatccccaacatcgacgatgccgagcaggccgcccgggtggtcgcggcgacgcgctacgcgccccgcggcatccgcggcttctcgcaggcgccccgcgccgcccggttcggccggatcaaggactaccacacccgctgcgaggccgaaatcttcgtggcggttcaggtcgagtcccgccgcgccctcgacaatctggacgcgatcgccgccgtggagggcgtggacggcgtgttcatcgggcccggcgacctctccaccagcctcggctacgtcggccagcagggtcacccggaggtggtcgccaccatcgaggcggcggtcgcccggatcgtccgggccggcaagcaggccggcatcctcacgccgagcgaggaactcgcccgccgctacatcgcggccggcacccgcttcaccgcggtgggctccgacatggggctgctcgcgcgcagctccgaggcgctcgccgcccgcttccgcgcctga

SEQ ID NO: 4853 - DNA, 279 bp, Methylobacterium sp.
atgctgacctatgacacgacccggaacacacgtcccgacctgagccccgaaccggccgcgtccctcggccgagccctgtcccggagcgtccgctcccatccctcccacgagcgcgccgccctcgtgagcgccctcgacgacggcctgatgcccgacgaggtcgcgcagatcctcgccggccgccgtgtggccgaggccttcccgatccgctggggcgagagcccggaagcctacgcgtcgcgggccgtgtccgagatgttcgtcgcctacctccagtag

SEQ ID NO: 4854 - DNA, 345 bp, Methylobacterium sp.
ttggctgccgcgacgctctcggccaagcgccggagcctggatcggcaactcggcgccatcctggccacgccgagccgctgcgacctgacccgcgagctccaggccaagatcagccgcgcccgcgatcagctcctggtgttcctcgcctatcctggaaaggtcgagccgaccaataacggctccgagcggctgctgcgtccggccgtcgtgcagcggaaggtgaccaacggctaccgcgccatgtgggcggctgagggcgaggccgccatccgcaccgtcgtcgacaccgcccgcatcacaggcagcagccccttcagcaccgtcctcaaaaccatcggtgcctga

SEQ ID NO: 4855 - DNA, 966 bp, Methylobacterium sp.
atgggccgcagcgaccttgaacggctgagccgcgaagagctgatcgagctggtgctgcggctgcagcggccagagaagacgtcgcgcacctcgtccaagccgcccgcgaccgatcgcaaggagcagcgggagcactccaagcccggcggcgccaagccgggtcacgagggtcacagccgcgtcgtgagcgacgatcccgatgctgtcgtcgagcatcgtcccgaggcgtgtgcgtgctgcggcgccagcctgcacgccgctcttccggcagaggtcgtcagcgtcgccgagcagatcgagctgcccgcggtggcgccagtcgtgacgcagcaccagcgtctcgcggtccgttgcccgcgctgtggggagcgggtggtcgcaccggtgccggaggcagcgcgcggcacgccgttcggcccacggctgcatgcggtggcgacgtacctgaagacctttcaggcgctctcgtacgaacggttgcaggcggcgctctccgacctgtttggcctcaccctcagccagggcgggctgatgaacctgctccgccgcgcgcagggctgcttccgtccgggtcgcgacgcggccatcgcgaccctgcgccgggccgaggtcgtcgcctgcgacgagaccggcgtgcgcatcgaaggctcgaacgcttaccactggctgttccactcggcgcaagccgtggtgcacaccgcctcgccgacgcgtggcgctgtcgtggtgcgcgagatgatggacgggcaccggcccgcggtgtggatctcggaccgctacaccgcccaacagggccacgcggatgagcaccagacctgcctggcgcatctggcccgcgatgtcgcctacgtcgtcgaggtcagcgacgatcccgtcccctggcgcctgcaactctggctaaagagcgtgttcgccctggccgagcgcgtcacgcacttggctgccgcgacgctctcggccaagcgc

SEQ ID NO: 4856 - DNA, 1341 bp, Methylobacterium sp.
atgcgcggcctgttctccgcgatgctcggcggatcgcgctcgctcagcgcggccggcgagagcctgagcaccgctccggcgccggacgacgaccgctggtacggcgatgtcggcgcgatgagcttcgcgggacggcgggtaacccccgacatcgcgatgcagttctcggccgtctacgcgggcgtgaacctgctggccaagacggtcgcctcgttgccgcttcgggtctaccggaaggatccggcgaccgggaagagctacgaggcacccgagcacccgctcaacgaccttctggagcaccagccgaaccgctggcagtcggactgggacttcaaggcgatgatgcagagccatctggttctgcgcggcaacgcctatgccgagatcatctccggtccgcgcgggtttgccgatcgcctcgagccgctgcatccggaccgggtgacgtgccggcggctcagcgatggcacgctcggctacgacatcgtcgactggaaggggaacgcgcggcggctccttcaggacgagatcctgcatctgcgcagcagcaccacgctgggcggcctcgtcggcatcgggccgatctcctacgcgcggcagacggtcgggctggcgctggcgaccgaggagcacggtgcccggctgttctcgaacggcgcgcgcccgtccggcgtgatcaccgtcccgaagtcgtggagcgacgaggccttcgatcgcttcaaggccgactggcgcagcgcctacaacggcctgtccaacgcgggcggcacgccgatcctggaggacggcgcgaagttcgaggcgatcgctctcacgtccgaggatgcgcagttcctggcgactcgccagcaccagatcgaggagatctgccggtggctcgatgtgccgccggtgatgatgcaccacctcaccaagacgacgtcctgggggacgggcgtcgaggcgatcatgctggccttcgtgcgcaacaacctgcgcccgtggcttcggtgctggacccaggcgatccgccgcgacctgatcctggccccgcagatctatgaggtccggttcgacatcgaggacctgatccggggcgactcgaaggcccaggccgagttcttcactcgcctcgtcctgaacgggatcctgacgcggaacgaggcgcgcctggagctcggatacaacccgctcgaaggcctcgacacgccactcgagccgaacaccggggccacctcggatcgcctcccgggcaacggcggcggggaaacccgggacgccagccagatcggccacaacggcgggccgccgctcgaagaaacgagcgagcctgagccgcaggaagaggacatcgccgaatga

SEQ ID NO: 4857 - DNA, 813 bp, Methylobacterium sp.
gtgggccatactctctgcggcgacaacaacggggtcgccatcatgaaaacctccggcaacacgatcctcatcacgggcggcgggtccgggatcggagccgcgctcgcccatcgcttccacgatctgggcaacaccgtcatcgtcgccggtcgccgcgcggaggcgctggaacgggtcacggccggccgcccgggcctgcacgcgatgcccctcgacatcgcggatgccggagacatcgcggcgttcgcccggcgcgtcacggccgagcacccggccctgaacgtggtgatcaacaacgccggcatcatgcgcttcgaggcgctggatcaggcgcgcgacctctccgacgcggaggcgacgatcaccaccaacctgctcggcccgatccgtctgacggatgccctcgtcgcgcatctggtcacacggccggacgcgacgctgatcaacgtgtcgtccgggctggccttcgtgcccctgacgaccacaccgacctactcggcgacgaaggcggctatccacagctacacggtctcgctgcgcgaggtcctcaagggccgggtcgaggtgatcgagctggtgccgccggcggtccagacggatctcacgcccggccaggccacccgcgcgggctacctgccgctggccgacttcatcgacgaggtgatggccctgttccagcagcagccgacgccggccgagatcctggtgcagcgcgtcgccttccagcgcaacgccgaggccgagcaccgcttcgacgcggccgtcgcgaccctgaacgaggccgctcgcgcggcccgcgcggcgcaggaatga

SEQ ID NO: 4858 - DNA, 1671 bp, Methylobacterium sp.
atgaaaatcggcggaaaactcctgagcttcgtcggcgcctgcagcatgacgacgctggtcgtggcaggggtcagcgtcgcgacgctgaagagcttcgagcgctcgctgacgagcgtcgagagcgcctcgatccgggcgctcgacgccgcgaacttcaaccgcctcgccgccgaagtcaccatggactcgcgcggcgtctacgcctccgccgaccgcgcggaggccgcgaagtacaccgccgggatccgcaagggtctcgccgagatggacgcgctgcgggccgactgggcgccgcgggtgaccgaggccgagcggccgctcttcgagacgatggtccgcaacgccgacgcgttccgcaccctccgcagcgccctcgcggacgcgggcgacacgaccggccccaaggcggccgcggagctcgggttcaacgacgccaaccgggcaaaccgaaaggccttccaggccagcatcgacgccctggtgaagcagggccggggcgagatggcggcgatcaaggccgacacccaggccatgttcgagacgcgcaccctcctcctgctcggcctcgccctgatcggcaccgtcatctgctgcgccctcggcctgctcatcggtcagcgtcagatcgcccggccgctgcgggcggtctcggtctcgatccagcgcctctcgcgcggcgaccacaccctgcccgccgtcaagccgggacgcgacgagatcggcgcgatctggacgagcatgcaggtcttcagcgacacgatgcgggaggccgagagcctgcggcacgagcaccagcggctggaggccgacacggcgacgcgcaagcgcgccgagatggccgggctcgccgagcgcttccagggcagcatcggcggcctcgtcgagcacctcgccggggccgccgccggtctggagcgcgccgccgcgaccatggcgggcaacgccgagcacgccggcacgcagtcgcaggcggtcacccgcgccgccgagacgacggcccacaacgtcgaggccgtcgccgccgccaccgaggagctcgccgccaccgccagcgagatcggcgtgcaggtgacccagacctcgacggccgccgagagcgccgtcgaggcgacgcggcggacccgggcgagcgtccaggccctcgcccgcagcgccgacgggatcgggcaggtcgtctccctcatctccaccatcgccgggcagaccaacctgctggcgctcaacgccacgatcgaggcggcgcgggccggcgaggccgggcgcggcttcgcggtcgtcgccaccgaggtgaaggatctcgcgacgcagaccgccaaggccaccgaggagatcgccgggcagatcgccgcgatgcggaccgcgacccacgacgccgtcgcggcgatcgaggagatcggcggcacgatcgagcaggtccacgggatcgccctcggcgtggccgccgccgtcgaggagcagcaactggcgacccaggagatcgcccgcagcgtctccgaagccgccagcggtacccgcgccgttacggacacgatggcgctggtcctgggcgcggcccgcgagacgggcgccagcgccgcggaagtcctcgacgccgccgccgacatcgcgcgccgctcgaacgggctcggcggcgaggtcgcgggcttcgtaacgcaggtccgcgcggcctga

SEQ ID NO: 4859 - DNA, 447 bp, Methylobacterium sp.
atgcagcgcatcaccatcaccatcgacgacgccctgctgacggcggtcgacgacctctgcgcgcggcgcggctacggcagccgctcggaggcggtgcgcgacatcgtccgcgacgccctggcgccggcccgcgccgcggagaccggcggatcggcggcctgctacggggccctgagctacgtctacagccacggcacccgcgacctggcccgccggctgaccggcgaggggcatgagcacggcgtctcgatcgccagcctgcacgtgcacctgacccacgacgcgtgcctcgaggtggcggtcctgcgcgggccggtggcccggatgcagagctacgccgacgccgtcgtcacgcagcgcggcgtccgctacggtcacctgcacctcatcccggagggcgacgacgcccacgctcatccgggccacggcgacgacggcgcggggtga

SEQ ID NO: 4860 - DNA, 903 bp, Methylobacterium sp.
atgcagagtacgggcctgcgctacttcctggccgtggcccgcaccgggtcgatcgcggccgcctcgtcccagctcaacgtggcggcctcggcgatcagccggcagatcgccaacctggaggccgagctcgactgcgtgctgttcgagcgccgcccgcgcggcatggtgccgagcccggccggtgagctgctggcgcagcacgcccatcaggtgctgatccgctccgagcaggtggtcaccgagatccgggagctggaagggctcgcccgcgggctgatccgggtcgcctgctcggagggcttctccctcgacatcgtgccgaacgcgatcgcggccttccacgcggcccatcccggcatccgcttcgaggtcacggtccagcccccggcccaggtcacccagacggtgtcggtgggggatgccgatctcgggatcaccttcgcgctgacacccaccgcgcaggtcgaggtgctctacgacgggcaggtcgacatgctggcgctggccgcgcccgaccatcccctcgcgcgggcgccggccctgcgcctcgtcgacttgctggactatcccgtcgccctgccgacccgggacacgaccctgcggcaggtcttcgacgccgcctgcgcgcacgagggcatcgcggtggagccggtgctgacctccaacacgctctcggcgctgctgcccttcgtgcggcgctcccgcggcatcgcgctgatgtcggcgctgtcggtgcagacgcccctgcgtctcaacgagcttgtcagcctgccgatccagtcccggacgagcctcgcccggggcgtgaagatccaggcgatgcgcgaccggcggctgccgaaggcagtgcgggcattcctgcgccagctgctcgacgcgctgccgccgccgcgctcgccgtga

SEQ ID NO: 4861 - DNA, 1545 bp, Methylobacterium sp.
atgccgctacggaccctcacccgggccgccaccttggccgccaccctggccgcctcgttcgcgaccctgatcgccgcccacccggcgctcgccggcaaggccaacgacacgctggtctacgcgtcggacagcgagcccgagaacgtcagcccgtaccacaacagcgcccgcgagggcgtgatcctggcccggaactgctgggacacgctgctgtaccgggatcccaaggacggcacctacaagccgttcctggcgaccgcctggacatgggcggacgacacgacgctcgacctcacgatccgcgagggcgtggtcttccacaacggcgacccgctcgggccggaggacgtggccttcacgttcaactacgtgctgacgcccgaggcgcgcacggtcacccgccagaacgtcgactggatgaagtcggtggaggtgacgggcccgcatacggtccgcatccacctcaaggcgccgttcccggccgcgctcgagtacctcgccggcccgaccccgatcttcccggccaattacttcaagaaggtcggcctcgacggcttcgccaaggcgccggtcggcagcggcccgtaccggatcaccaaggtcgacagcggccgcggcgtctccatggagcggttcgacaagtactgggccgagagccctctgggtaagccgaagatcggcaagctgcagttccgcgtcatcccggacggcgagagccggatggccgagctgatgaccggcggcgtcgactggatctggcgggtgccgagcgaccaggccgagcagctgcgcgccgcgcccaacatcacggtcctcaattccgagacgatgcgggtcggcttcctgcagttcgacacgctgggccgggcgaaggagaactcgccgctcaaggacgtgcgcgtccggcaggcgatctcctacgccatcgaccgcaaggcgatggtcgacaacctcgtgcgcggcgcctcgcgggtgatgaacgcgctgtgcttcgtcgagcagttcggctgcaccgaccagggggtgatgcgctacccctacgaccccgccaaggccaaggcgctgctcaaagacgccggctacccgaacgggttcgagatcgacctcggcgcctatcgcgagcgcgactacgccgaggcggtgatcggctatctcggcgccgtcggcatcaaggcgcggctcaactacctgcgctacgcggcgttccgcgacgcgctgcgggccggcaagacctcgatcggctaccagacctgggggtcgttctcggtgctcgacgtctcggccttcgacggagtgtatttccgcggcggcgaggaggacctgaccaaggatccgcaggtgatcgccgacctgcaggagggcgacagctccacggatcccgagaagcgcaaggccgcctacgccaaggcgctccagcggatcgccgcgcaggcctacgcgctgccgatgttctcctactcgaccaactacgccttcacgtcggacctcaacttcaccgcccagcccgacgaggtggcgcgcttctacgcggcgtcgtggaagtga

SEQ ID NO: 4862 - DNA, 918 bp, Methylobacterium sp.
atgctggccttcacgttccggcgcgtgctggtcgccctggcggtggccttcacggtctcggtggcgagcttcctgctcctccacctctcgggcgacctcgcgaccgcgatcgccggccctgaggccaccgggccgcagatcgcccagatccgccaggattacggcctggaccagccgctgctgacccagttcctcacctggggctggcgggcgctgcacctcgacttcggcaactccttctatttccgcgagagcgtgatcgacctgctggccgcccgcctgccgatcaccctctatctcggcatcatcgcgctcgccgtggcgctgttcgtggcgatcccgctgggcgtcgtcgccgcggtgaagcgggacacgtggatcgaccgcacggcactcgccgtctcggtgctgggccaggcgatgccgagcttctggttcggcctgacgctgatcctgatcttctccgtgaatctccgctggctgccggtctcgggcaacgccacctggaagaacttcgtcctgcccgcggtggcgctcggctactacgcgatgcccgccgtgatgcgcctcacccgcaacggcatgctggaggtgctggcctccgactacgtccgcaccgcccgcgccaaggggctgccgccccggaagatcctggtgcggcacgccctgcgcaacgccgtgatcccggtgatcgccctgtcggcggtgcagttcggcttcatgctcggcggctcgatcgtgatcgaggcggtgttctcgctccagggcctcgggcagctcgcctgggaatcgatcgcccgcaacgacttccccgtcgtccaggcgatcgtgctggttctggccatgatctacatcggcctgacgctggcggccgacctcctgaacgccttcctcgacccgcgcctgcgccagtcgtga

SEQ ID NO: 4863 - DNA, 825 bp, Methylobacterium sp.
atgatcggcgcgttcgtcatcgccttccgcgaagtcatcgaggcgggcctcatcatctccatcgtgctggcggccacccgcggcatcccgggccggatgcgctgggtcctgctcggcatcgccggcggcctcgcgggcgccgccctggtggcgctgttcgccgagaagatctcggacgcgttcgagggcagcgggcaggacatcctgaacgccgcggtcctgatcgtcgcggtgctgctgctgatctggcacaacacctggatgagcaagcacggcaaggagctggcgggcgagctgcgcgccgccggcgcggcggtgcgctctggcgagcgggaggcggcggccctgtcgatcgtgatcggcgccgcgatcctgcgcgagggggccgagctggtcctgttcctctacggcctcgtggcctcgggcacctcgggcgccgacatccagttcggtgcggtcgccggcatcggcgcgggcgcgctcctctcggcggtgacctatctcgggctcgcctcgatcccgagccgctacgtcttctcggtgaccagcgtcctgatcatcttcctcgcggccggcctcgccgcgcaggcggcgcagttcctggcgaatgccggcgtggtcgaggtcctcggctacaccctctggaacagctccggcgtgatcgccgagaattcctggccgggccgcgtcctgcacgccctggtcggctacaccgaccggccgaccgccctccaggggctggtctacgtcgccaccatcgcggtgatggtcggcctgatgcagtggagcgccgccgacaagcgccgcgcggtgcggccggcctag

SEQ ID NO: 4864 - DNA, 219 bp, Methylobacterium sp.
atgcccgtcttcgaagccaagaacctggacagcgagttcgaagggcagtccctgctcgctgccatcctgcacccgacccgcgcggcgcagacccgggccctgcggcacgggcgcaggcgcgcggagcgcgcggcggccctggccgatccgatgacgatcgagccgcgcttcccaatcgcgcccggtgagctggcgccgaccgggttcacgggccgctga

SEQ ID NO: 4865 - DNA, 597 bp, Methylobacterium sp.
atggcgcaggaagcaatcctcatcatcgatgaccacgcgctgttccggtccggcatcgtctcgatgctgtcgacggcgttcgatgagatcccggttctcgacagcccatcgctgcacgaggcgctcgccatcgtggccgtcgtcccgacgatcgtcctcctcgacatccagttgccgggcatcggcgggctcgaggggatgggcctgctccagcagcgctggccggccgcccggatcgtcgtcgtgtccggcctggatctgcccgataccgtcagcacggctctggcgcagggcgcctgcgcgttcctgtccaagaccgaccgccccgagcggatgatgacggtcctgcgcgagatgctggcccggtcgtccgcggtcccgcggatcggcggcgccctctgcccgacgctcacgccgcggcaggccgaggtgctgaccctcgtcgggcgcggattgtccaacaagatgatcggacgcaatctcggtctgtcggaacacacggtccgcggccacgtgcagggtctgctgtcggtcctgggggtgacccggcgcgccgaggcggtgttcaaggcgcagcagttcggcctgatccgatga

SEQ ID NO: 4866 - DNA, 633 bp, Methylobacterium sp.
atgaacggctccgcgcgagagaccttgatcgttgccgacgatcacccgctgttccgcgagggcatgcggcacatcgcggagcggctctacccgcaggccctggtccgggaggccgccaccatggagcaggtcctggcgatggcccgcgccggggcgcccccgcgggcgttcctcctcgacctcctgttccccggcctcgatccccaccactccatcggcgcgctgcgcgtcgagttcgagcgggcctcgatcatcgtcgtgtcgatgatcgaggacgagggcctgatccggaccgtcatggccgagggtgccgacggcttcatcggcaaggcgctgcccgccgcggagatcgcccaggcgatcgcggcgatccgcgacggcgagttcgtgatccggcgcagcccggtctcgagtctcgccgcgccacgcggcccgctcccgcccctgacgcagcgccagcgcgacgtgctgcgcctcgtcgcgctgggacgcaccaacaaggagatcgcccgggagctcgagatctcccccttcaccgtccgcatccacgtctcggcgctgctgcgcgccctcgacgtcacctcccggtccgccgcggccgcgaaggccgccaccgccggcgtcggggattga

SEQ ID NO: 4867 - DNA, 1422 bp, Methylobacterium sp.
atgacgcgagacgccgccatcgcgcgcgccactgacagcttcgattcgggcgcgttcctcgccctcctgcgggaggccgttgcgatgccgaccgagagccaggcccccggccaggaggcggcgctccgcgcctatctcgacgccttcatcgcgccgctggtcgcccggctcgggtttgaaactccaaagatcttccccaatcccgacggggtgcacggcccgttcctgatcgccgagcggcgcgagggtgcggacctgccgaccgtgctgatctacggccacggcgacaccgtgcggggctatcccgagcagtggcgcgagggcctcggcccctgggagatcgtggtcgagggcgaccgctggtacggccgcggcaccgccgacaacaagggccagcacgtcctcaacctcgccgccctggagcaggtgatcgcggcccgcgagggccgtctcggcttcaacgtgaagctcctgatcgagatgggcgaggaatcgggctccccgggcctgcggccgttctgccgcgagcaggccgaggccctccggtccgacgtgctgatcgcctcggacgggccgcgcctcaacggcgagcgcccgaccctcttcctgggctcccgcggcgcctacaatttcgagctgagcctgaacctgcgggagggcccgcaccattccggcaattggggcgggctgctgcgcaaccccggcacggtgctggcctcggcgatcgcctcgatggtcgacgcgcgcggcgccatcctggtggacgccctgcggccaccgccgatcccggaaggggtgcgcgcggcgctcgccgacatccgcgtcggcgaggacccgaccgcgcccacgatcgattccgactggggcgagccgggcctgagtccggccgagcgggtcttcgcctggaacacgctggaagtgctggccttcaagaccggcgatccggacggtccgctcaacgccgtgccgccccacgccaaggcgaccctgcagctgcgcttcgtggtcggcaccgactggcagaacctcatccggaacgtccgcgcccatctcgacgcgcacggcttcccgatgatcgaggtccggccggcccgcgccgcggaagtcttccaggcgacgcggctgcccgtggaggatccctgggtggagtgggccctggaatcgatcgaggcgagcacggccaagaagccggcgctgctgcccaatctcggcggctcgctgccgaacgacgccttctcggagattctgggcctgccgacgctctgggtgccgcattcctacccggcctgccgccagcacgggcccgacgagcacatgctcgcttccggcacccgcgagggcctggcgatcatggccggcctgttctgggatctgggccgagacggacctgacatcctccgccgccgcgaagcgagggcctga

SEQ ID NO: 4868 - DNA, 885 bp, Methylobacterium sp.
gacgcgccggtcgcgctcgcgccggtcccctcccccacccgcctgatcctgcggcggggcctgcgccacaccggcttcctgatcggggccgggattctcgggctgatcgtgctggccgcgctcgccgccccgctcatcgcgccccacgacccctacgcgcaggacgtgtcccgccgcctgatcccgccggtctggcaggccaagggcacctgggagcacgtgctcggcaccgacaagctcggccgcgactacctgagccgcctgctctacggcggccagatctccctcctgatcgggatctcggcggcgctgatctccgggctgatcggcaccacgctcggcctgtgcgccggctatttcggcggctgggtcgattcggtggtcagctacgtggtgaccacgcggctggccatgccggtggtgctggtggcgctcgccatggcggcgctggtcggcggctccctgaaggtggtggtgctggtgctgggcttcctgctctgggaccgcttcgccgtggtgacccgggccgcgacccagcagatccgcaaccaggacttcatctcggccgcccgcgccgcggggctgaccgacctgcgcatcatccgccaggagatcctgcccaacatcatgaacgccctgatcgtcgtggcgaccctggagatggcccacgcgatcctgctggaggccgccctgtcgttcctcgggctcggcgtgcagccgcccctgccctcctggggcctgatgatcgccgagggcaagcagtacatgttcttccagccttgggtgatcaccatcccgggcgtggcgctcctcctcctcgtgctggcgatcaacctcctcggcgacggcctgcgcgacatcaccgcccccgaggcgcgcaactga

SEQ ID NO: 4869 - DNA, 471 bp, Methylobacterium sp.
atggaggccaagctctgcttcatcggccatgccctgatggagaaccgctcggccctgatcgtggacacctgcctgacgtccgcagacggccacgccgagcgcatcgccgcgctggcgatgatcgagccgagggcggaccgccccaaggccatctccgtgggtgctgacaaggcctatgacgcggaggacttcgtcaacgagctgagatcgatgaacgtgcgagcgcacgtggcccagaacaccagcggccgccgctcgtccatcgatcgacgaaccactcgccatgtcggctatggcatgagccagaagatccgcaagcgcatcgaggagggctttggctggatcaagacggtgggcggccagcggaaaacccgcttcagaggccgcgacagggttgggtgggccttcgccttcaccgcggcggcctacaacttggttcgcctgcccaagctgctcggagctctggcttga

SEQ ID NO: 4870 - DNA, 648 bp, Methylobacterium sp.
atgcggggttcggatcagcgttcggggaggttgttctcctatgtggacttggaggctcgggtccgacccgaccaccccctgcgcacgatccggcagctcacggacgtggcgctcgcagcgctgagcggggacttctccgtgctctatgcggcccggatgggtcgcccgtcgatcccgcctgagatgctgctgcgggcgatgctcctgcaggcgttctactcgatccgctcggagcggcagttgatggagcggctggagttcgacctgttgttccgctggttcgtggggctgggtgtcgacgatccggcctgggatcactcgagcttcagcaagaaccgggaccggctgctggccggcgagatcgccgccaagttcctggcagccgtgctcgcccagccacgggtgaagcggctcctgtccagtgaccacttcagcgtcgacggcacgctgatcgaagcctgggcctcgatgaagagcgtcaagcccaaggatcaaagcggggaccaagctccaccacccgctggcggacgtaacgccgaggtcgacttcaagggtcagaagcgttcgaacgagccgaccccgaagccaggctctaccgcaagggcccgggcatggaggccaagctctgcttcatcggccatgccctga

SEQ ID NO: 4871 - DNA, 780 bp, Methylobacterium sp.
atggccgactggaaccccgccctctacacccgcttcgaggacgagcggacccgccccgccgccgaactcctcgcccgcgtgcccctcgacgcgccgcggctcgccgtcgatctcggatgcgggcccggcaactccaccgcgctgatcgcggcgcgctaccccgacgcggaggtgatcggcctcgacacctcgccggccatgctggagagcgcccgcgcccgcctgccgggcctgtccttcgtgcgggccgacgccgcgacctggataccggaccgagccccggacctgatctacaccaacgccgtcctgcaatggctgccggaccacgcgaacctgctgccgcggctgttcggcctcctcgccccgggcggcgtgctcgccgtgcagatgcccgacaacctcgccgagccgacccatcgcctgatgcgcgcggtcgcggcggacggtccctgggcggccgcgatcggcgatccggccgtggccggccgcctcggacggatgctggagcccgccgcctactacgacctgctggcgccgcgcgccgccgaggtcgatgtctggcgcaccgcctaccatcaccgcatggcggacgccgccgccatcgtggagtgggtcagcgccaccgggctccggccgttccttaatccgctggatccggaggagcgggccggcttccgcgcggcctacacccgcgcgatcgacgccgcctacccgccgcgcagcgacgggcggcgcctgctcgccttcccgcgggtgttcatcgtggcgcgggcgcggtag

SEQ ID NO: 4872 - DNA, 474 bp, Methylobacterium sp.
atggccagcctcagcgtcgcgatcgcgttcggcgtccgcctgctcctcgtgctgctgttcctgccgttcagcgccctcgacaagatcctgaacttcaggggcgcggtcgggcaggcgcggcaggccgtgcacgccaccgcgcccgccgtggcgctgatcctgatcgggctctgcgtcgagatcgggatgtcgctgtgcatcctgaccgggacggccgaccgggccgccgccttcgtgctcgccggctattgcggggtgacggcgctgctgtggaagcagttctgggtgccgggggatttctgggccgggggcaggggccgcgagctgttctgggacttcctgaagaacttcgcgctggcgggcggcttcctgctcatcaccttcggcaccggcgccgggacggtccaggacttcctcgccgatccgctcggatcgacccatccctacgcgatcgccgaccgggcccggccgtag

SEQ ID NO: 4873 - DNA, 1383 bp, Methylobacterium sp.
atgaccagcaccgtttcaccgagcccgatcccgtcgccggccgagggccgggccgaggacgggcgcgcggcccggttctggccggacgtctggtggcggctgatcgacttcaagatcggcatcataccgctccctatcttcgtcgtgctggcgatcctcctcgccatcctggtccaggagggcgagatcaagcccgacgggccgaccatgatcgccgtgctggtgatgggcggcttcacctgcgcggagatcggcaagcggatcccgatcctgaaaaacatcggtgccggcgcgatcttcgcgaccttcatcccctcggcgctggtctactacgccctggtgccgccgcagatggtcaaggcgatcaccgattttaccaagttcaccaacttcctctacatctacatcgccacgatcatcgtcggctccatcctcgggatggaccgcgaggtcctgatcaagggcttcctcaagatcttcgcgccgcttgccctcggctcggtggcggcggctctggtcgggacgctggtcgggacgctcctcggcctcggcccctacaagaccttcttcttcatcgtcgtgccgatcatggcgggcggcgtcggtgagggggcgatcccgctctccatcggctacgcggcgatcctagggatgcagcagggcgtggtcttcgcccaggtgctgccgccggtaatgctgggctccctgaccgcgatcatcctgtcgggcacgctcaactccgtcggcaagcgctacccgcacctcaccggcgagggtcgcctccagcccgattcggacggcatcaagtcgagcgacgcccaggccaaggccgaggcggccaagggccagatcgatcccgccacgatcggtgcggccgggctcacggcgatcaccctctacctgctcggcgtcatggcccaccacctcgtcgggctgccggcgccggtggcgatgctgttcctcgccgtcctggcgaagctcgccagcgcggtgtcgccccatctccaggccggcggcttcgtggtctacaagttcgtccaggtctcgatgacctacccgctgctcttcgccatcggcgtcgcgctgacgccctggcacgagctgatggccgccttcaccctggtgaacctgatcacgatcgtgtcgaccgtcgtgacgctgatgacggtcggcttcttcgtcggccgctggctcggcatgtacccgatcgagaccgccatcgtgaacgcctgccacagcggccagggcggcaccggcgacgtggcgatcctcacggcggcgaaccgcatggcgctgatgcccttcgcgcagatcgccacccgcatcggcggcgcgctgaccgtgaccggcacgatcgtcgccatgaagtggatcggtgcctga

SEQ ID NO: 4874 - DNA, 654 bp, Methylobacterium sp.
atgtcgccgcagatgatcgaacgcctctggcaggccttcctcgacaccgcgctcatggtcggggtctcggccgggatcgccgtggtcgccggcattcccctggcgctgttcctcgtcacctccggacccggcggcatcttcgcggcgccgacggcccaccgggtggtcgggaccgtggtcaacggcttccgggccgtgcccttcatcgtgctgctggtggcgctgatcccgttcacccggctggtggccggcaccacgatcggcgtctgggcggcgatcgtgccgctctcggtgagcgcgaccccgttcttcgcccggatcgccgaggtctcgctgcgggaggtggatgcgggcctgatcgaggccgcccagtccatcggctgccggcgccggcacatcctcgcccacgtgctcctgcccgaggcgctgccgggcatcgtggccggcttcaccatcacggtggtggcgatgatcggcgcctccgcgatggccggcgcggtgggcgcgggcgggctcggggacgtcgccatccggtacggctaccagcgcttcgacaccaccgtgatggtggtggtgatcgcgatcctgatcgccctcgtgtgcgcggtccagttcgcgggcgacaccgcggtgcggcggctccgggcccgctga

SEQ ID NO: 4875 - DNA, 1191 bp, Methylobacterium sp.
atggtcggcctgatcttcgacagcctgcgcgagccgggcacgccggccgcggccgggcggacgagcccgggtgccgcgaccgccgcccgggccccggccgccgcgcccggccgcgaggccggccgggagaccggccgggagaccggccgggagaccggaacggtgcggttcgagtccgtctcgaagacctaccgctcggccgccggaccggtgcaggcgctcgaccgggtggacctcgcgatccccgccggcgcgatcttcggcatcatcggccgctcgggggcgggcaagtcgagcctcctgcgcacggtcaaccggctggaggcgccgagttcgggccgggtcctggtcgacggcgccccgatcgacgccctcgacaccgacgggctcgtcgccctgcgccggcgcatcggcatgatcttccagcacttcaacctgctggcggccaagaccgtccggcagaacgtggcgctgccgctcacggtcgcgggcgtcccccggcacgcgatcggcccgcgggtcgcggaggccctgcgcctcgtcggcctggaggacaaggccgacacctacccgtcgcggctctccgggggccagaagcagcgggtcggcatcgcccgggcgctcgtgagcgatccggagatcctgctctgcgacgaggcgacctccgccctcgacccggagacgacgctggcgatcctcgacctgctgcgcgacatcaaccggcggctcgggatcaccatcatcctgatcactcacgagatgagcgtgatccgcgagatctgcagcgacgtggtggtgctggaggccggccgggtcgtcgagaccgggccggtctggcgcgtgttcggggcgcccgagcacccgaccacccgggcgctgctcgaacccctgacccgcgggctgccgccggatctggcggcccggctgcagccgcggcccgcgccgggcggctgggcgatcctgcggatcacctgctcgggccgggccgcgccggatctgtcgggcctcgcgggggccggggcgccggtgcgcctgctccaggcgggcatcgagcggatccagggccacgcggtcggccggatgctggtggccgtcccggccgaggacccgggcgcggaggcgcggctgcggacgctcggcggcgacgtggagcgggtcggctacgtccccgccgacccggcggaggggtga

SEQ ID NO: 4876 - DNA, 924 bp, Methylobacterium sp.
gtggccgtcgcgacggagaccctgcccggccccgctcggccggcgcgggaggccgggacgggcgccgaggccgatccccggatcgtgccgcgccggatcgtgcccctggccgacgaccggacgatcgcctacgcggagaccggtgccgggccagacctcgtggcgatccacggcacgctgatgtgcctggaagacgtctggctcgggcccgtgccggcgctggccgagcatttccacgtggtcgccgtcgaccgccccggccacggcttcagccgccggccgcgcggcggtgccgccgacatctgggatcaggcggcgtgcatccgggaggcggtgcggcgcctcggcctggagcgcccggtcatcctgggccactcgttcggggccgccgtcgccctcgcctacggcatgctccatccggatgaggtggccggcatcgtcgccctggcgccgatctgcttccccgagccgcggctggagcaggctctgttcgggccgcgggcgctgcccttcggcggcgacgcgctgtcggcgctcctgggcgccagcagcgaccgggcgctgctcccgctcctgtggaacgcgatgttcttcccggaggcgatgccggcgcgcttcgcgcgggacttccccttcgccctcgcgggtcgcccggcgcagatcaccgccgagggcgaggatgcgggctggctctggccggggctcacgcgcagcgtcctcggctacccgtccctgcgccgacccacccgtatcctgggcggcagcgccgacctggtggtgaacaccgacctgcacggccggcgcgcggccggcctgatccccggggcgcggttcgagtaccttccgggggccggccacatgctgcaccacctgcagaccgacgcggtcgtgcgcgcggccctggcggtgcggtcggaggcctga

SEQ ID NO: 4877 - DNA, 246 bp, Methylobacterium sp.
atgtcggaattgctctccgttgccctcgtctgcgccggcacgctgctggcccaggactgctcgcgcgacaccgccctcgacgtcatcgtcgcgccggcgcacacgccgatggaatgcctgatgcacgcccagacgatggctgcccaggccgggttgcccgggggcagcgaccggtacctcaaggtcgcctgcgagcatcgtcggagcgaggccgacccgcgtccggtcatccgccgcgcctcgtga

SEQ ID NO: 4878 - DNA, 1176 bp, Methylobacterium sp.
gtgggagaggtcttccgcgccttcctcaagctcggattgaccgcgttcggcggccccatcgcgcacctgggctacttccgcgacgagctggtcacccggcgccgatggctggacgagcgcggctatgccgatctggtggcgctgtgtcagttcctgcccgggcccgcctccagccaggtcgggttctcgctcggcgtgctccgcggcggcggcctcctgggcgggctcgccgcctgggcggggttcacgctgccctcggccctgctgctcctggccttcgcctacggcgccgcggccctgtcgggtccggtcgccgacggcgtgatccacggtctcaagctcgtcgccgtggcggtcgtcgcgcaggcggtctgggggatggcccgctccctggcaccggaccggccgcgcgccggcatcgcggtggcggccctgttcctcacggtgttcgtcgcgggctcggtcgggcagctcggcgccatcgccctcggtgccctcgccgggctcgtcctctgccgggcggcaccgcaggcgcaggaggggcacctcgcggtcccggtgtcccggcgggccggcgccgcggcgctggtcgccttcgccctgctcctcgtcgtgccccatctgctcgtcgccggcctgccatcccagggcctggcgctgttcgacgccttctaccgctccggatccctggtgttcggcggcggccacgtggtgctgccgctgctgcaggccgaggtggtcgcgccgggctgggtcggctccggcacattcctcgccgggtacggcgccgcccaggccgtgcccggcccgctgttcacgttcgcggcctacctcggcgcggtcgcggggccgtcgccccacggcgtggtcggcgcggccatcgcgttggtcgcgatcttcctgccgggcgtgctcctggtctacggcacgctgccctactgggacgcgttccggacgcgtccgctggcccaggccgcgatgcgcgggaccaacgcggcggtggtcggaatcctcggttccgcgctctacgatcccgtctggagcagcgcggtcggcaacccgcgcgatttcgccgtggccgtgctggcgttcgtgctgctgacggtcggtcgggtggcgccgtggatcgtcgtcgcgctcacggccctgggcggcgtcgccctcgcctcgctctga

SEQ ID NO: 4879 - DNA, 1176 bp, Methylobacterium sp.; identical to SEQ ID NO: 4878

SEQ ID NO: 4880 - DNA, 1644 bp, Methylobacterium sp.
atgcccggtgagcactacgacgtcatcattgtcgggtccggtcccggcggcggcacgatggcgtggcgcctcgcccagacgggcaagcgcatcctgctgatcgagcgcggcgactacctgctgcgcgagccgcggaactgggacagtcaggcggtgatcgtcgacggctactaccaggccaaggagacgtggtactcgtccgacggcaagagcttccacccgggcctgcactactacgtcggcgggaactcgaagttctacggctcgatcctgttccgcctccgcgagagggacttctccgagatccgccaccaggacggcgtcgcgccggcctggcccgtcggatacgacgtcttcgagccgtactatcaggcggccgaggagctgttccacgtccacggcctgcgcggcgaggacccgaccgagccctggtcgacgaagccctacgcccatccgccggtggcgcacgagccgcggatccaggagctgttcgacaacctgaagcggaccggacaccacccgttccacctgccggtgggcgtgcggctggtggagaaggacggccgcgcggtgccgacctcgccctgcatcaagtgcgaatcgttcgacggcttcccctgccccacgaacggcaagtccgacgcgcagaccatggtggtcgaccccgccctgcgcgactgcccgaacctgacgctgctcacccgcacctacatcgagcgtctcgtcaccgacgcctccggccgcaccgtcacgggcgtcgtcgggaaccgggacggcgcggccttcgaggcctcggccgacatcgtggtggtggcctgcggcgccctctcctcggcgctgctgctgctgcgctcggccagcgaccgccacccgaacggcctcgccaacgggtcggatcaggtcgggcgcaactacatgcgccacaacaactcgacggtgctggcgatctcgaaggtcccgaacccgacccggttccagaagacgctcggcctcaacgacttctacttcggcgatccggacccgaaggacggctgggacttccccctcggccacatccagatggtcggcaagtcggacggcgcccagatccacggcgagggcctgccgggcttcctgcaatggttccccgacaagccgttcgactggatcgccaagcactccgtcgatttctggctgacctccgaggacgtgccgctgccgcagaaccggatcttctacaaggacggcaaggtccatctcgacctcaccgagacgaacgtcgaggcgcacaagcggctccggcacaagctgcgcgagatctgcagcgtcaccgacatccacccgcacctgttcgaccgctcgctctacctgggcaagaacgtcccgatcggcgggacggcccaccaggcggggaccctgcggttcggcgcggatccgagaacgtcggtgctcgatccgaactgcaaggcgcacgagttggacaacctctacgtgaccgatgccagcttcttcccgtcggtcggcgccgtgaacccgacgctgaccatcatcgccaacgccctgcgggtcgccgatcatctcgtcgcccggatgggcgcccgggacgcgatcgcgccgccccggctgttcgaccacaccgagccgcgcgagccgctgccggcctga

SEQ ID NO: 4881 - DNA, 1257 bp, Methylobacterium sp.
atgatcttcatcggcatgctcctcggcatcgccgtcggctacgcctgcagcatcacctggcccgacccgcagaccgccaaggagatcgccggctacatcgcgctggtctccgacgtgttcctccgcctgatcaagatgatcatcgcgccgctggtcttctccacattggtcgtcggcatcgcccatctcggggataccgcctccgtcggccgagtcggcggcaaggcgctgctctggttcgtcggcgcctcgttctgctctctgatgctcggcctcatcatggtcaacctgatgcagcccggccacaacctgaacctgccgctgcccgatgccggcgccggcaccgggctcaaggcggcctcgctctcgctcaaggagttcgtcacgcacctcgtgccgaagagcgccgtcgaggcgatggccaacaacgagatcctgcagatcgtggtcttctcgatcttcttcggcgtgggcctcgccgccctcggcgagaagggccgcctgctcgcgcagggcatcgagggcatcgccgacgtcatgctcaaggtgacgggttacgtgatgatgttcgcccccgtggcggtgttcgccgccatcgcggcgacgatcaccacgcagggcatcggcgtgctcgtgacctacggcaagttcctcgtggagttctacatcagcctcggcgtgctctggatgttgttgatgggcgtcggcttcctgctgctcgggggcggcggcatcatgcgcctgttcaacctgatcaaggagcccttcgtgctggccttctcgacggcgtcgagcgaggccgcctaccccaagatgctctcgaacctggagaagttcggggtgccgaaccggatcacctcgttcgtgctgccgatgggttactcgttcaatctcgacggctcgatgatgtactgcaccttcgcggtgatgttcatcgcgcaggcctacaacatcccgctgagctggggccagcagctcacgatgctgctcctgctgatggtgacctcgaagggcatggccggcgtgccgcgcgcctcgctggtggtgatctcggcgacgctgtcgcacttcaacatcccggaggccgggctgctcctgatcatcgggatcgaccagttcctcgacatgggccggtcggccaccaacgtgctgggcaacagcgtcgccaccgtggcggtcgccaagtgggagggccagctcagcaccaccgaccagcgcctcgaccatgtcggcacgatggcctcgcccgcggagtag

SEQ ID NO: 4882 - DNA, 1350 bp, Methylobacterium sp.
atgacgcacgccgatacggacccggattccacgacatcgcgctcgggccggctcacgctctataccgggctcgggctggcactcggcatcctcgtcggcgccgtcctccacggactggcggccggacccgacgaggccaaggcgttcgcggcgcacttcaccctcgcgaccgacatcttcctgcgtctgatcaagatgatcatcgcgccgctcgtgttcgccaccatcgtggccggcatcgcgagcttcggcgacgcccgctcggtcggccgggtcgccgcgctggccatgggctggttcgtcaccgcctcggtcgtctcgctcaccctcgggctcctgaccgcgaacctgttccagccgggcgcgggcctgggcctgccgctgcccgacgcgggggcgcagaccggcctgaaggccgcctcgctgaacctgcgcgacttcctcgtccacgtcttcccgaccagcatcgtctcggccatggccggcaacgaggtgctgcagatcctggtcttctcgatcttcttcggcttcggtctcagcacgatcgaccggcgctacagcgagccgatggtgcagcttctcgacggcctcgcccgcgtgatgttcagggtcaccgacacggtgatgcggctcgcgccgatcgccgtcttcgcggccatcgcggcggtcgtcaccgtccaagggctcggcgtccttctcgattacggcaagttcatcgccagcttctacgcgggcctgtccctgctctggctgctgctgatcggtgccggctgggccgtgctgggccgccgcgtggtggagctgctgcgcctgctgcgcgccccgatgatcctcgccttctcgacggcgagcagcgaggccgccttcccgcgcaccgtcgaggtgctggagcgcttcggggtgcgcccgcgcgtgaccgggttcgtgctgccgctcgggtactcgttcaacctcgacggctcgatgatgtaccaggccatggccgccctgttcatcgcccaggcgttcgggattcacatgggcttcggcgagcagctgacgatgctgctcgtcatgatggtgacgagcaagggcatcgccggcgtgccgcgggcctcgttggtcgtggtcgccgccaccgtgccgatgttcggtctcccggccgccggcatcctgctgatcatgggcatcgaccagatcctcgacatggggcgcaccgtcacgaacgtcctcggtaacgggctcgccaccgcggcggtcgccaagtggcggggtgagatcgcgggtggcgtccgggaggtgagcgcggagcccgcggggccgcgcctcgacctcgccgcgcggcccgcgaccggcgccgcccgcgcttga

SEQ ID NO: 4883 - DNA, 903 bp, Methylobacterium sp.
atgttcgatctcggccatgcccgcagcttcgtcgccgtcgcagaggagatgcatttcggccgggccgcggcccggatgcacctgacccagtcgcccctgtcgcggcagatccagatgctggagcagacgctgggtgtgacgctgctggagcggaccacgcgcgcggtgcgcctgaccccggcgggccgcacgttcctggccgaggcctaccgggtgctggcggcggccgagaacgccgcgcgcatcacgcgccgcgccgcgcggggcgagagcggggtgctgcgcctcagcttcaccgccgcctcggcctacaggacgctgccgcaggtcgtcgcccatgtccgccgaacgctgcccgaggtcgacctcgtgctggaggagatggtctcggacgagcagatcctggcgttgggcgagaaccgcaccgatctcgcgatcctgcggccggcgccggtcctgcaggatccgaaatccgcgatcgccaccgcgccgctggcgcgcgagcggctcctgctcgcggtcccgcgcgggcaccgcctcgcggcggcgcgcgccccgaccctgcgggacctcgacggcgaggccttcgtgacctggtcgccccggggcgggcgctacttcatcgacctgctcgaccgtctgttcgaggccgggggcgtgcagccgcggatcgtgcagcgggtgaaccaggtccacgcgatgctggccctcgtcggcgccggcatcggcgtcgcgctggtgccgggcagcgcccggggcaacagcatggccgacatccggctccggccgatcgccctgccggccgcgaccgggccggagctgtggctcgcgtggcgcagcgacaacgccaatccgtgcctgccctcggtgcgggccgcggcgctggagaccggcgaggcgtga

SEQ ID NO: 4884 - DNA, 891 bp, Methylobacterium sp.
atgttcgacttcagccagctccggtgcttcgccgccgtggcggaggagctgcatttcgggcgtgcggccgcccggctgaacatgacgcagccgccgctgtcgcggcagatccaggtcctggagcgcgtcctcgacgtgcagctcctggagcgcaccagccgcacggtccggctgaccgccgccggtcgcagcttcctgcccgaggcgcagcgcatcctgcggctcgccgagaccgcgacgcacgtcacccggcaggtcgcggcggggcgcgcgggcgtcctcaagttcggcttcacggcggcctcggcctacgacttcctgccgcgcctcgtcaccgcgttccggcgggcgctgccggacgtgacgctcgcgctgcgcgagatggtcagcaaggaccagatcgaggagctgctcgccggccggatcgacgccgcgctggtgcgcccgcccgtgacgcacccggacctgatcgccgtccgggcgctggccgagcccctggtggtggccctgccggccgggaaccccctggccctgcgcgacgggctcacccccgccgatctcgggcgcgagccgctcatcggctacgcgcccaacgaggcgcactacttccacgacctcgtcctgggcctgctcgccgaggccgagatccggcccccgacggtccagcagctgacgcagatccactcgatcctggccctcgtccgggcggcgctcggcgtcgccctggtgccggccgccgccgagcgcctgcgcttcgagggcgtggtgttccgccccctcgtcctgccggcgccgcgcccggtggaactgctcctcgcgtggcggcgcgacgcggacgacccgctcatcgcccagctggtctcgatcgtggccgagatgccgcccgcgtga

SEQ ID NO: 4885 - DNA, 702 bp, Methylobacterium sp.
atgaccagccccttcctgcccctcgaccggaaagtgatcgcccgcgaggcggccaagatgttcctcgagatcgaggcggtcctcttctacaaggacgagccgttcaagttcacctccggctgggcgagcccggtctacaccgacagccggaagatcatctcgttcccgcgcctgcgctcgacgctgatggatttcgccaccgccaccatcgtgcgcgagatcggctacgagaagctgacccacatcgccggcggcgagaccgccggcatccccttcgcggcctggatcgccgaccggatgatgctgccgatgcagtacatccggaagaagccgaaggggttcggccgcaacgcccagatcgagggtgagatcgtcgagggcgcccggacgctgctggtcgaggacctcgccaccgacgggcgcagcaaggtcaatttctgcaaggccctgcgcgattccggcgcccaggtcgatcactgcttcgtgctgttctactacgacatcttccccgacagcgccgcgctgatggaggagatcggcatcaagctccactatctcaccacgtggtgggacgtgctggcggtggccaaggagatgggcaccttcgacccgaagacgctggccgaggtcgagcgcttcctcaacgcgccggcggagtggtcggcggcccacggcggcatctccgccttcggccaagcctga

SEQ ID NO: 4886 - DNA, 234 bp, Methylobacterium sp.
atgaatcagttgacgcgccgggtcatcgtctgccccatcacgcgcaacccgcatccgtggccgacgaaggtgttcctgccggtcgggctctccgtctcgggtgccgttctcgtggatcaagttcgctcgatcgaccgagctgcccgcatcctgaggagtctcggcaatgcgcctgatgacatcgtcgccgaggtgcgcggcaagctgaggacgttgctcgggctcacaatctga

SEQ ID NO: 4887 - DNA, 2187 bp, Methylobacterium sp.
ttgaccgcgccgagccctacagcctcgccccccggacgtgtccggcgccgcctcgccgccggccggggcagcctgagccggccgggcggcgacctgcggcgcctgcccacgggcctcgacctccggaacgtgcggctcgtggagggcgtgcgcgccgccttcgcgttcggcgtcgtcatcctcctcaacatctggatccagtggtcgccgctgctgaccatggcgctcgccgccaacctcgcctgcttctgcgacaacggcggcccgatgcgggcgcgcctgcgcgtcctcaccgccttctcgttcctcggcggcctgctctgggccggcctcggcctgatccagcccctcggcctgccggtggtcgtcccggtcgcctgcgcgctgatcttcgcctgctcgtacgcgcgcgtctggagcgtgcaggcccagtcggccggcaacgtgctcgtggtggtgctgtgcatcgccctcgaccggccgctcgacgtcgcgcaggcggccgtcaccgcggcgatgttcgcggccggcggtctctgggcgaccttcctggccctggtcatctggcggctgcacccgtaccgcccggcccaccgggcggtggcggaggtctggcacaacctcgcccggctctgcggcgacctcgagcggctcgtcgccctgccggagcccgacacggccgccttcgacggccacgcgcggggccaccgccgcggcgtgcgggcgagcatcgagaccgcgcggaccatgatcctcgacctcgcccgctcgcgcgagcgggtctcggaccgcaccgcccaggcgctgctgcgcctggagagcgccgagcagatcttcgccgcgctgatcgccgtgggcgagttgatcgacagccggcccgacgcgcgccgccgggcgctcgccaaggtcttcctgcggcgcctgcgccccctgctggtgaccatcgcccgggcgatccgcgacgacgtcaacctcgacctcggccgcctggagcactccatcgcccgggtggccgagggcctgtcggaggacccgaccctggcccgcctcgccgaccggatcgccgggcgggtgcggctcggcgccaagctgtcgacgccggagggctaccggcccggcggcacgatcacggagggcggcagcctcgaccgctggacccgctacgtcgggccgctggcgcagaacttcaccctggcctcgccgaacctgcggcacgccctgcgggcgagcgcggtcgcggcgccggcgctcgccgccaccctgacctacgcgggcgccttcacgcactggctggtgatgaccgtggtgctcaccatgcagcccttctacgcggcgacgtggcagcgggccctggagcggatcggcggcacggtgctgggcggcctcgtgggcgccgtgctcgcctactacgccacgagcccgctggcggaggccgggctcatcctcgtgctcagcatcgtcggcttcgcggcgcgccagatctcgtacgggttcttcgtcacctgcctgacgcccctcgtggtgctgctcgtcgaattgctggagcccggccacagctcctgggagatcgtcgctatgcggggcggcttcacggtgctgggcggcgtgatcgcggtggcgagctgcctggtgctctggccgatctgggagcccgatcaggtccggcaggagctgcgccgggcgctcaaggcccaggccgggctcgccgaggcggtgctccgcgcgccgcccggcgagggccgcgaggccgcgatcgcggtgcagagccgcgaggccggcctcgccctcaacgatctggaggcggcgctctcccgcgccctgcagcagccccgagccggcagccacccggaggtggaatccgccctggtggccgacgcgaccctgcgccggatcagcgcccggctcatcgtcctgcggcacgccccggaggcggccgcccccgaggcggagccctggcgggcctggatcaccgcgaccctggcggccctgggcgcggacaggcccgtgcccgagcggccggcgctggatcgcggacagtcgctcgtgcgcctcgtcagtcaggtcgatcttctggtcggaaccctgcggcccggggagatccgggccgcgacggttgcggatggcggagccccggcttcgggccaagggaccgcgacgcgggccggtcagcccttcctgccgtcctga

SEQ ID NO: 4888 - DNA, 207 bp, Methylobacterium sp.
atgggcgagatcgacctctacggcgtgttcgtgccgggcctcgcgctctggatggccgccgccttcgcgctcagcctgccgctgcgccgcctgctcgcggcgaccggcttctaccgcctcgtctggcaccggccgctcttcgacctcgccctctacgtcgtcctgctcggcggcgtcgtgaccctcgcccatcggaccctgcaatga

SEQ ID NO: 4889 - DNA, 210 bp, Methylobacterium sp.
atgacgggtgaactcgatctctacggggtgttcgtgccgagcctcgcggcctggatgctgatcgccttcgccctgagcctgctcctgcggcgggtgctggcccggaccgggttctaccgcatggtctggcaccggcccctgttcgacctcgccctctacgtcgtgctcctcggcctcgtcgtctcggtcgcggtccctctcacctcctga

SEQ ID NO: 4890 - DNA, 927 bp, Methylobacterium sp.
atgaccgccctgttctccgccctcggccgcctcctggtcacgctcggcatggtcgccgcggcgctgatcgtcggcctcggcctgtgggattactacatggacgcgccctggacccgcgacgggcgcgtgcgcgccgacgtggtggcggtcgcgcccgacgtctccggcctcgtcaccgaggtgctggtggaggacaaccaggtcgtgcggaagggcgacgtcctgttccggatcgatccggaccggttccgcctggggctgcggcaggcggaggcgatggtgcagggccgcaaggccaccgccgagcaggaggcggccgactacgcccgctacagcaagctctccgacgcggcggtgtcgcagcagagggtcgaggccgccaaggcggccgacctgtcggcgcgggccgcctacgagcagggcctggcggaccgtgacctcgccaagctcaacctggagcgctcggcggtgcgcgccccggtcaacggccggatcaccaacatggaactgcggccgggcgcctacgtcaccacgggtcgcggcgtgatggcgctgatcgacagcgacaccgtccgggtcgagggctacttcgaggagaccaagctgccgcggatccgcgtcggcgcgcccgtgaccgtcgagatcatgggcgaggacggggcgctccgcggccacgtcgccagcatcgccggcggcatcggcgagaccggccgcagcgacgcctccaacctgctcgcgaacgtgaacccgaccttctcgtgggtgcgcctcgcccagcgcatcccggtgcggatcagcctcgacggcggcacgtcggatccgcggctggtgagcggccggaccgcgacggtctcgatcgcgccggcggccggcggggaggccctgcgctggccctggacggcgtggcgcgaggcgcgcgcccgctga

SEQ ID NO: 4891 - DNA, 948 bp, Methylobacterium sp.
atgccccggcttctcgccctctcgttccgcctcctcgtcaccctcgggacggtcgccgccgcgatcgtcgtcgggctggcgctgtgggactactacatggaggcgccctggacccgcgacgggcgcgtgcgcgccgacgtggtgcaggtggcccccgacgtctccggcctcgtcaccgaggtgctggtggcggacaaccaggtggtgaagcggggcgacgtgctgttccgcatcgaccccgagcgcttcgatctcgccctgcgccaggcggaggcggtggtcgagggcaagcaggcgaccgccgagcgggccgcggccgactacgtccgctatcagaagctcagcgacgccgccgcgtcccagcagagggtcgaggccgcccgggcgaccgacctggaggccagggcggcgtacgggcaggcggtggccgaccgtgacctcgccaagctcaacctcgaacgctccgcggtgaaggccgcggtcaacgggcgcatcaccaacatggagctgcgtcccggcacctacgtctccaccgggcggggcgtgatggcgctcatcgacagcgacacgctgcgcgtcgagggctatttcgaggagacgaagctcccgcgcatccatgtcggcgacaaggccagcgtccgcctgatgggcgagacctccacgctgaacggccgcgtggagagcttcgcgggcggcatcgaggaccgcgagcgcacggcgggctcgaacctgctggccagcgtcaacccgaccttcgcctgggtccggctggcccagcgcatcccggtgcggatcaagctggacgacgttcccgacgagacccgcctggtcgcgggccgcacggcgacggtcgcggtcgcgtccgagggcgggaccccgcatttcagcctgttcggatcctggcgcggggcgccggagcccgccgcccgggagacgagaacccgctga

SEQ ID NO: 4892 - DNA, 498 bp, Methylobacterium sp.
atggcagccaagaccctgcggcagctccgtctggcctacacccacacgctgctgctctccggacgccagtggcggcggctggccaacgcggcgaccgaggcccacggcatctcggaggccaaggccctgccgctggtgctgatcgcccgcatgggcggcgagccgcgccagaccaccctggcggacgcgatcggcatcgaggggccgtcgctggtgcggctcctggatcaactggagaaggcggacctcgtcgcgcgccgggaggaccccaccgaccgccgcgcgaaggtgctgaccctgacgcccgcgggacaggtggtcgtcgcgcggatcgaggcggatctcgagcgcctcagggagacggtgttcgcgaccgtgagcgccgcggacttggaggccggcctgcgggtgttccaggccctgcaggatcatctccgcggcgaggccgggctcgacggggcggaggccggggcccaccgaggcgaggccgccgaatga

SEQ ID NO: 4893 - DNA, 1083 bp, Methylobacterium sp.
atggcatatgcccgcctcgacgatccacccccgaccgcggccgggccctcgccgcgcgcagacgtgatcgatcgccggcccgtgagggcgccgaccgcgccgaggatcgcggcgctggcacgcctcggcgggatccttctcgcgctcctcgcgccgccgacaggggcgatcgccgccgatgcccaggacctggtggaggctctgcggaaagtcgccggcagtcggccgggcgtgcgcccgaccttcgccaaagggcagtgcgtccgcggcacctacacccctgcggccgaagtgggacaggtgacgcggtcgatcagtttcacgcggccgtggcctctcgtcgggcggttctcggtcggcggcggcaacccgtcggtgccggacgcgaccaggaccgttctgcgcggcttctcgatcaagctcctgtcggacggtggcgagacccatctgctgttcgagaacgcgccggtccacttcgcgcggaccgtcgaccagatgctcgcgttcctgcaggtccgcgttcccggccccgacggcaagccgaatccggaggccatcgcggccttcgcgaaggccaatccggagacgacgcgccaggcggccttcgtcgccggcaagcctgtcccgggcagctatgtcggcctcgtctattggggcgtacacacgttcacggggctcaacgcggacggccgtgccgtgcccttcaagttcaagatcgtgccccgagccggcgagatcaccctcagcgacgaggaggcgaagggcaagcctgcacagttcctggccgacgcgctgcgggagcagctgtcgaggggcccggcggggttcgacgtcgtggccctgctcgccgggcccagcgacgatctcggcagcgacatcacccagcggtggaccaacgaggacgaccggaaggcggtcaccctcggcacgatcgccgtgaccggcatcgagccgaacgagacctgcgaccagggcatcttcgacccgggacagctggcggacggcatcgacgcgccgaaggacgagatcttcgcggcgcgccgcaccgcctacgggatctcgttcggcctccgctcccagtga

SEQ ID NO: 4894 - DNA, 420 bp, Methylobacterium sp.
atgagcgaaccgtccgacaccgccgagccctacgccctcgtcgtcgacgacgacggcctcatccgcatggacgccatggacatcctggcggatgccgggtttcgcaccttcgaggcgagcgacggtgacaaggccatgacgctcctcgcgcgggaacacgccctcatcgtcctgctgttcaccgacgtccagatgccgggctcgcgaaacggcttcgccgtcgcccgcgagaccgccacccggtggccgcacatcgccatcgtggtcgcctccggccacgttcggcccggacccggcgacatgccggaaggggcgtgcttcatcggcaagccgttcaccgccgacatggtccacgaccacctccaggaaatcctgccggatgggcgcaagccggcgccgctgcgcgaccgggaacgatag

SEQ ID NO: 4895 - DNA, 801 bp, Methylobacterium sp.
atgaagttcctgcgtctcctcgccgtcgcggcgctcagcctcggggccctgccggccggggcggagaccctccgggtcggcgtcgtgcccggcgcctacggcgacgccgtcacggtcgcggcccgggaggccaaggccgagggcctcgacgtcaaggtggtcgagttcagcgactggacgacgcccaacgtcgccctcgacgccggcgacatcgacgtgaacttcttccagcaccgccccttcatggagaacgccgccaagcagaagggctacgcgttcgacatcgtcgggctcggaatcctgtccaatatcggcctgtactccctgaagcataagagcttcgaccagatcccggcgggcggcacggtggcgatcgccaacgacccggtgaaccagggccgcggcctgctgctcctccagaaggccgggctgatcacgctgaaggacggtgtcggcttcctcggcaccctcgacgacatcgtcgagaacccgaagaagctgcggttcaccgaggtcgaggggccgcagctcgcgcggatcaccggcgacgtcgacctcgccctgggctacccgcacttcatcgtggcggccggcagtttcgacccgaccagcggattgatctattccggtatcgaggaccggcgcttcgccgtgagcttcgtcaccaaggccgcccgcaaggaggaccccgtgatccggaaattcgtgacgctcttccagaattcggaggccgtgaaacagcagatccgcaagtccttcgccaacagcgacaagctctacctgctggcgtggcagaactga

SEQ ID NO: 4896 - DNA, 1392 bp, Methylobacterium sp.
atgatggaatcctggagcccgacaatcgccggcgagacggggcccaagtacctcgccatcgtcagggcgctggccaaggacatccgggccggccggctcgcgccgggagcgcgcctgccgccgcagcgcgccctggcgaagcacctcagcgtcgatctcacgacggtcacgcgcgccttcaacgaggcgcgccgaacgggactgatcgacgcgaccgcgggccggggcagcttcgtccgggcgtcccgatcaccggccgcggagatgcgcaggccggatccgaccggcagcgtcgatttcagcatgaacatgccgccccagccggaggcggcgtggctggcggagcgccttgaggcgggtctgtcgcggttggccggttcgtccgccttcctggcccggatgcagtaccaggacagtgccgggaacctcgccgaccgggcggcggcggcccactggctcggtcaacggctcggggcgctcccgatgcagcgcgtcctcgtggccggcggtgcccaggtcgtgctggccgcggtgctcgccgccgtcctgaagccgggcgacgcgctctgcgtcccggcgctcacctatcccgggctgcgcatggccgcggagcgccgcggcgtccgcctcctgcctgtggccggcgacgcggaggggctcgacccggacgccctgctcgagcgctgccgatccgatcggccgcgggccctgtacctcgtgccgaccctcgacaacccaaccacggcgaccctgccggcactccggcgccggcagatcgccgagatcgcccgcacgcacggcgtcgccatcatcgaggacgacgcgtacggcgccttgccccacgacgcgccggctcccatcgcgtcccaggcgagcgacatcacgtggcacatcgcgacgctgtccaaatgcgcgagtcccggcctgcgcatcgcctacgtcgcggtccccgggacgaacgaggcggtgcggctggcggccgagctgcgcgccatcaacatgatggcctcgcccctcacggccgcgctcgcctcgcactggatcgccgagggcgagctcgacggcatcgtcgcggcgatccggcaggagaacgagctcaggcaggcggtcgcgcgcgagacgctccggggcctggaagtctgggcgcatccgtgcgggcaccatctgtggctccggctgcccgatccctggcgtcgcggcgagttcggcgcgcacgcgcggcagctcggcgtgtcggtcgtcctgagcgacgccttcgcggtcggggccgccccggaagcgatccgcgtctccctgggcgcggcgccggacgccgagacgctccggtacggcctcagcctgctcgcgacgctgctggcgcacccgcccggcgcgatctccaccgttgtctga

SEQ ID NO: 4897 - DNA, 507 bp, Methylobacterium sp.
atgacggccgtagcgttcgacaccctgaagttcgcccgcgccctgcgggagaaggcgaagctgtcgccggagcaggcggagggcctggccgacgcgctggtggacgtcttcgacgggaatctggcgacgaaggccgacattcgcgacgtgcaggccgaactgcagatcgtccgcggcgatatcgaagccctcaagatacagacccgcggcgacatcgaggcactgcgactcacgacccaggcggaaatcgaggggcttcgcatttccaccaaggcggattctgacagtcttcgtcagtcgaccaagtcggatatcgaagccctccgcctatccacaaaagccgacatcgacggtctgcgcctcgagaccaaggccgacatcgaggccgtgaagggcgcgatcgcctccgcgaaggtcgagacggtgcgctggctcgtcggcgcgatcggctttcagacgctcgcggtgctgggcgcggtcatcgccctgacccgcaccctccactga

SEQ ID NO: 4898 - DNA, 780 bp, Methylobacterium sp.
atgatgacgcgcagaacgctgacccgcacccttgccgccggcgcggccaccgcgctgctgcccggaccggccaccgcccaggacctcccgcgggcgcgcaacgtcgtgctggtccacgggttgttcgccgacgggtcgtgctggtcggaggtgatcccgcacctgcaggcggccggcctctccgtcacctccgtgcagaacccgctgaccaccctcgcggaagcggtggcctcggcgcagcgcgtgctggcccgccaggagggaccgaccgtcctcgtcggccactcgttctccggcatgatcgtgaccgaggccgggatcgacccgaaggtctcggcgctggtctacgtggcggcgcgggcgccggacgcgaacgaggattacgcggcgctggcgaaggcctacccgaccccgcccgcctcggccggcatcgtgttcgacggcgacgaggggcgcctgagcgaggcggcgttcctgcgggatttcgcgggcgacctgccggtggagaaggcgcgggtgctgttcgcggtccagcagccgttccgcaaggtcctgctgacgggacggaccacccaggccgcttggcgctcgaagccgagcttctacgcggtgtcgaccgaggatcggaccatcgacccggacctcgaacggttcatggccaagcgcatgaacgcgcggaccgtcgagctccgggcgagccacctgtccctgatctcgcgcgctccggatatcgcggacctcatcctcgaggcggccggccagccccgccgtcggcgctga

SEQ ID NO: 4899 - DNA, 1434 bp, Methylobacterium sp.
atgagcgcgtccacgacagcgcccggttccctggccctcaccgacgtcacgccgcggcgctccgcggtcgacgcgcggctcgcccggttcggcgacgcgctgcgccggtacggctggatcatccggtccgtgcagtggctgatcgtcgccgtctacgcggtgctggtgatcgtcccggcgctgctgccgctgcccgacaatgccgcccacatctggaccaacctgacgctcgccgcgcagttcgccttctgggggatctggtggccgttcgtgctggtcagcatggtgctggtcggccgggcctggtgcggcgtgctctgcccggagggggccctcagcgagttcgcgagccggtggagccgcggctacgccgtgccgcgctggatcacctggcagggctggccgttcgtggccttcgccggaaccaccgtctacgggcagatgaccagcgtctacggctacccgaagccggtcctcgcggtgctcggcggctcgaccctcgcggcgatcgtggtcgggctgctgtacgggcgcaacaagcgcgtctggtgccgctacctctgcccggtcaacggcgtcttcgcggtgctgtcgaagctcgcgccggtgagcttccaggtcgaccgcgccgcctgggcggactcgcccaagcccgtcggcggcaccgcgtccttcaactgcgcgcccctcgtgccggtcaagaccatgcgcggcgcgggcgcctgccacatgtgcggccgctgcagcggccaccgcggcgccgtgcgcctcgccctgcgctcgcccaaccacgagatcgtccacgtggccggcgcggagcccagcctcgaccagaccatgctgatcctgttcggcatgctggcgctggcggtgggcgccttccagtggtcctcgagcccctggttcgtcgatgccaagcagtgggcggccacgtggctcatcgagcgcgggacgacgtggcccctggagcactcggcgccctggttcgtgctgacgaactaccccgaccgcaacgacgtcatgacgctcctcgacggtgggctgctgctggcctacatcggcgccgcgacgatcgtcctcgggctcgccctgtcggggatcgtggcgctcgcgaccctgagcctcggcggctggtcgctccggcgcttccaccacctgacccagacgctgatcccggtcgccggctgcggcgtgttcctgggcctgtcggcgctcaccgtgacgttcctgcgcggcgacggcatcgtgatcccctacgtggcggagattcgcgcgggcctgctcgccggcgccagcctgtggagcgtctggctggcctggcgggtggcgggtctcgccgctggcggcctccgccgggtggcggcctccgcctgcatcgccggcgcggccgccctctcggtggccaactgggtgctcctgttctggatctggtag

SEQ ID NO: 4900 - DNA, 369 bp, Methylobacterium sp.
gtgccggagctgaccgtgtcccgcctgccgcgctgctccctcgtccgagccatcccgctgctgctggtcgccgccgcgtcggcctccgcgcccgcgcgcgccgacgacatgccggtcatcaaggtggagatgcgcgacggcgtgatcatcccgacggtgatcgaggttccggccaacacccggttcaagctcgagatctcgaacaccggccagacgccggtggagttcgagagcacggaactgcgccgcgagaaggcgctggccgctggctcgacctcggcgatcgtgttccgcaccctcgatgccggcacctaccaggtgttcgacgatttccacccggaagcgaaggcgaccctggtggccaaatga

SEQ ID NO: 4901 - DNA, 564 bp, Methylobacterium sp.
atgcacgcctcgcacatcctcccggttctccgcggccttgccgcggcctcgctcctggcgttcgccggtgccgcggccgccaaggaggtgccgatcggtccgcacgtgacgcgcaacggcctggaggtcgcggccgtctacctgcagccgatcgagatggatccgcccggcatgatgcgcgaagccgccaagtcggacatccacctcgagaccgatatccgcgccgccaaggacaaccgcaacggcttcgcggaaggggactgggtgccggcgctcgacgtccgcttcgaggcggtgaagctcgacggcgacaagcccaccgaccagacggtgtcgggtatgctgatgccgatggtcgccaatgacgggccgcattacggcgacaacgtcaagctgttcggcccgggtcgctatcgtctgaaggtcaccgtcgcgccgcccggcaaggacagccacttcggccgccacgtcgacaaggagacgggcgtcggcccgtggttcgagcccttcgagatcacgcaggacttcaccttcgcgggtgtcggcaagaagggcgcctactga

SEQ ID NO: 4902 - DNA, 729 bp, Methylobacterium sp.
atgtcgggcgtgaggccggatctcttcgcccgcctgcacgacgacctggagtccggcttccgggaggacctcgaggaggccgtgatcgaccccgcgcgctggccggacctggccgagcgcgtcgtgcgggcgtccggcagcgagggcgcccttctgctgcgctccgaccggaccggcctcgaatcgctctgcaccgcctccctcgccgacgcctcgcgccgctacttcgacgagggctggcaccgcgacgaccatcgcctccgcggcatcccgctcatgcggacgcgcgggatcgcggtcgatcaggacttcaccacgccggaggagatcgcgcgcctgcccttctaccaggatctgctggcctcccgcggcctgcgctggttcgccgggatcggcttctccgtgaagggacgcctgtggtgcctctccctgcagcggaccgtggagcagggaccgtacgagccgcacgagcagcggcgcctcgcgaccctgtcgccgctcctgcagcgcgcgggcctgctgacgtcgatggtcgagcgggcccggctcgcggggctgacgcaggccttcgagctgatcgaccgcgccgccctgatcctcgacgccgacggacgggcgctccgctggaacgacgcgttcggcgccctcctcgggcgcgacctgaagctctcgggcggacgcctcaccgcggaggatccggacgccgcgcggcagctcgaggccctggcg

SEQ ID NO: 4903 - DNA, 384 bp, Methylobacterium sp.
gccctggcgcggccctgcggccgcccgccgatctcggcggtcgtggcggcgcgacgggacgggccgccgctcgtgatccacgtcgtgccgctggtcgggccgagccgcggcctgttcgccggggcgagcacgctgctcctcgggagcgtgcccggggccccggccgcacccgcgaccgcgatcctccaggcggcctatcggctgaccccggcggaggcgcgtctcgcccaggcgctgtcgagcgggatctcgctggccgaagccgcttcgcgcttcgcgatcaccgcggcgaccgcgcgctcgcagctgaaggcgatcttcgccaagaccggagcgacgcgccagtcggatctcgtgcggctcgtggccgggctcgcgcgctga

SEQ ID NO: 4904 - DNA, 1413 bp, Methylobacterium sp.
atgttcgggacgctgcgggtcggattggcgctgctcggggcggcgctgcccctccaggccttcggacagtcggccgccaacctgtcggccctgcgcgggctggtcccggtggcccggctgcagacgacgcccgacggcaaggcggcgctcgacgcgaacctgcgggtcaccggcgacatccagaccggcgcgctgaagcagccgacgctcctgccgttccccgagcagcagcagctcgccctgcgggactgcttcatcaccgacggcaacgccgccaacctcgccgacggcctcggcaccacgctcgcccgggcctaccacgccaaggcgacctacagcgactacaagaccttcaccagcatcgcgccttcggtcgccaacctgatcggctacaccaacaacgtgaccaagtcggactcgaattccggcaagtacttcttcgccaacgccaccacgaacggcaagcatccggtctccgaggaggccgccgcgatcctgtcgaacggcgccgtcaccgacgtcttcggcaaggcctacgaccggccggccggcagccccggcgccgaccgctacggcaattcgcggccgttccagacgctgccgcgcctcctcacctatcgcggcaaggactatttcggtgacgcgtccgacagcctcgactggctgcgcggcccgtcgcaggacctcgtgaacagcccgtcctacccgagcggacacaccacctacggctacaccgagtcgatggtgctcgcgctgctcgtgcccgagcgctaccagcagatggtgacccgtgccgccgagtacggcaacgaccggatcatcgtcggcgcccactacgccatggacgtgctgggcggccgggcgacctcgctgcacgccctcgcacacctgctcgccaacgatccggcctatgtcggccagatccggaagaacccggccgtcctcgacaaggcgtccgccgaggccgacaagacggtcggcgtgacggattaccgggcgctcctgacggaggcccgcgcggcgattggcgaggcgctgaaggccggctgcggcgacacggtggcggcctgcgcggcgaaggataccggccggttcaaggacgcggccgccaacgcggccttctacgcggcgacccagacctacggcctgcccgtggtgcatccggacaccgccggccggcgggaggacgtgggcaaggtcgcgccggaggccggccacctgctgaccgcggccttcccggcgctgacactggacgaggccaacgcgatcctcaccgagacgcaaggcccgggcggcggtttcctcgacgacggctcggaattcggcgtctacgcgcgcctcgacctctacacggcgggcggcaaggccgccgcgctggcggccagccgggcggggtccagcgcgacgcgctga

SEQ ID NO: 4905 - DNA, 426 bp, Methylobacterium sp.
atgccgtactggcacgtctacaccgatgcggagggtgtgagccgccaggagctgttccacctcgagcggttcaagttcgaggggatcaaccccgggaccgcgccccagtggaacgacaagatggatccggctccgtcggtcgtgaccttcacggtcctgccggtcggctgggtcggcgagtggcacgagaatccgcggccgcagtggatcgccgtcctgtcgggccgctggttcgtcgagacgatggacggccaccgggtcgagatgggaccgggcgagctgatgatgggcgaggaccagaacacgaaggcgcgcgacggccggaagggccacctgtccgggacggtgggcgacgagccctgcacgatgatcgtgaccgggctccaggtcgagccgaccgtcaatcagcccggccgcttcaagtag

SEQ ID NO: 4906 - DNA, 675 bp, Methylobacterium sp.
atgagcgtcgcggcgttgcaggagtggtggctcaccctctcggacgaggtcgtcacctacggccccggcttcctctcggccaccctggtcgtgctcggcgtcacggtggcgagcatcctggtgagctgggtctgcggcctgctcggggcgctgggcaagcgctcgtccttcgcgcccttccgggcgctggcgagcttctacgtctggttcatccgcggcacgccgaccctcgtgcaggtcttcatcgtgtatttcggcatgccgcagatcggggtgaagctctcgcccgtgaccgccggcatcatcgcgctgggcgtcagcagcggcgcctacgtggccgagaccatccgggccggcctcgcggcgatcccgaggggccagatcgagtcggcgctggcgctcggcatgaacccgcggatcatgatggtgcgcatcgtcctgccgcaggtcttccgcatgatcctgccgtcgttgaccaacgaggcgatctcggcggtcaagaacacctcgctgctgtcgacgatcacggtggtggagctgacgctctacgcgcagctcatgatcgccacgaccttccggccgttcgatttctacatcgcggcggcgctgatctacctcggcctcacgtcgatcctgtcgcagctctcggcctatttcgagcggcgctacgcccgc

SEQ ID NO: 4907 - DNA, 390 bp, Methylobacterium sp.
atgccgaacgacacgcagcggatcgagatcatcaccgggcgcgagcgccgcaggcgctataccgcccacgagaaggtgcgcttcgtcgaggagacgatgcagcccggcatgaccgtctcggcggtagcgcggatccacggcctctcaccgagccttctattcgggtggaggcgtcgcatggccgagggcggacaggtggcggtgcaagccgacgacgaggtggtcgctgctagccggatgcgcgagttggaagctcgcgtgcgcgatctggagcggctgctgggacgcaagacgctggaggtcgaggtgctcaaggaggcgctggccgctgcacgggtaaaaaaagccgcgtggccgctaccgtcgccgcccgcgggctcttcccggtga

SEQ ID NO: 4908 - DNA, 435 bp, Methylobacterium sp.
atgctcgccaccatgacctcactggacgccccggtaccggcgaacgccacgctgcccgccgcgtcgagcctcatctacgtcgtggacgatgacccggccatcctgcactcgacgcgcttcctgctggagagcgcgggccaccgggtggagaccttcgccgacggacgcgcgctgctggccgccttcccgggcccgaacccgaccttcgtcctgctggaccacgtcatgccggggatggacgggctcgcggtgtggggccggctgcggcacctcgctgccggcgtgcccgtgatcctgatcaccggccaccccgatccgagcatccggagccgcgcccgcgccgccggcatacccctggtcgagaagccgctggcgttcgacgccctgatgggcatgctcgccgccggcccgatccccgccagccgcgcccgttag

SEQ ID NO: 4909 - DNA, 408 bp, Methylobacterium sp.
atgggcgacgtgctcacctttaccccgcgctcgaaaccgaccactccagaggccctaccgcccctcgctggggccgacctccgagccagccttgaggaggcagcacagaccgccctcgacgcagcggaccgtatcatcgccgtgctcgaccgtatggacggggatgccgaccacgaggacggcggggacgacgagccgtcccttgccgcgcccgagaacaccaccggctcacaggtcgtctacatgcggggcagcgaccgggacggcgaggccgaggcggccgaggccgtgctgccggtggtccaggccgagccgcagccggtcgctgagatcctgccctggcgtgggcgcggcaacgtcatcgcggcagccggatccttcctcgtcgacctgctggagcgtgcctga

SEQ ID NO: 4910 - DNA, 252 bp, Methylobacterium sp.
atggccaacgtcattcccttccggcctcggcgaaaggccgtcgccgtgcctgacacccgagcccgcatcgagggcgccctggccttggctctcgacgccgtcgaccacctcgtcgccgccctggacgagatcgacggggatccggacatcgaagacagcggcgacgctgagcccagcctcggcgcgcccgagggccaggcctcgcagatcgtctggctgcggggtggagatcgtgaccttgagggggtgtga

SEQ ID NO: 4911 - DNA, 237 bp, Methylobacterium sp.
atgccccgctacttcatcgacctgcacgacggctcccagccgatccacgatgaggtcggattcgacctgccggaccttccggcggcccgcgccaaggtcacccggatcatgtcggcgatcgcccgcgacatgctgccggaggtcgagcgccaggattacgtggcctgcgtccgcgacggcgtcggcaaggtggtctaccgggcgcgcctgtccctcgctgccgagatggtggagtga

SEQ ID NO: 4912 - DNA, 801 bp, Methylobacterium sp.
atgttgaaggaggcgcgcggcgccgcgggacggtcgaccgaggcggccgactaccaggacgtgccccgcccggtcgcggtgatgcccaagacctacgcggccgggatgcatctcgcgcggcacttccatccccgcgcgcagctgctctacgccacgtccgggctgatgatggcgttcgcggaggacggcacctgggtggtcccggaggggcacgccctctggatcccgccgcttctgccgcacgcggtcgcgacccacggcgccgtcgcgatgtgctcggcctatctcgatcccgccgcggtccggtccttcccggcgagttgccgggtgatcgcggtgtcgcggctcctcgccgccgcgctcaccgcgctggcggaggagccggtgctctacgcagaggcgggtcgcggcggccacctcgccgccctggtgctcgacgagatcggccgggcccccgcaacgccgctcgcgctgccgctcccgcgcgacgcgcgcctgcgccgggtctgcctcgcgctgatcgaggatccggcctcggaggccgatctcgacgcctgggccgaccgtgccggcgcgagccggcgcacgctcacgcgcgggttccgcgcggagacgggcctcagcttcggcgactggcgggcgcgggcccgcgtgatccgggcgctggcgctcgcggccgaggggcggccgccgcgggcggtcgcggcggccgtgggctaccggagcgcccaggcgctgcggacgaccgtggcgcgggtgctcggcacggaccatccgctccgcggcgccggatcgccgtga

SEQ ID NO: 4913 - DNA, 2091 bp, Methylobacterium sp.
atgtccacggtaaccgacccccaccccgaccccagaccgacgctcgcgcggcccgacgacgatccgtacctctggctggaggaggtcgacgggccggacgcgctggcctgggtcgaggcgcgcaacgcggagacgctcgcccgctacggcgatgccggcttcctccgcgaccgcgacatcgcccgcgcgcttctcgaccggccggaccggattccgttcgtccagcgcttcggcacctggctctacaatttctggacggacggcgcgcatccgcgcggcctgtggcggcgcgtcgacgcggccggctaccgcgccgcgatcccggactgggagatcctgctcgatctcgaccatctcgcggcgaccgagggggaggactgggtctgggccggggcgacgatcctcagggacgcgctcgatcgcgccctcgtgcgcctcagccgcggcggcaaggacgcggccgtgatccgcgagttcgatctggacacccgcaccttcgtggccgacggcttcgtcctgcccgagggcaagggcggcgcgacgtggctcgatcgcgagacggtgctcctgtcgagtgccctgggcccgggcatggccacgcggtccggttacgcgcgcaccgtccggctctggccgcgcggcacggacccgcgcgacgcgtccgtcctgttcgagaccgccgagaccagcatggcggtctggggcgcgtccgaccggcagaccgggaccgagcggatcacggtcgtcgagcagctcggcttcttcgacgcggctgtccatatcggcgatcgcggcggcctgcgcgcgcgcctcgacctgcccacgcatgccggggtccagctgcaccgcgaccacctgtccgtgcggctgcggcggccctggacggtggacggcgtcgcgcatgacaccgacacggtgctggcgatcgcgctccccgacctggtggcgggaggtcgcgccttcacggtcctctggcagccggacgcgcggctcgccctgcagagggtgttctggtcggccgggcggctgatcgtggacgtgctcgaggacctgcgtcccacctaccgcgtcttcgagccggggccgggcggctggaccgagcggcccctcgccggcctgcccgccctcggctccgtccatctctggcccctcgacggcgatccggagcgggcggacggagccctgctggcgctggcccacgatccggtgacgccgccggcgctgctcgccttcccgcccgcgctcgacgccccggccgtcctgcgtcgggcgcccccggccttcgacgcgcgcggcatccgggtgacgcgccacgaggccgtgtcggcggacgggacgcgcgtgccctacgtccaggtcgggccggaggccgagaccggtgcggcccccgtctacctgacggcctatggcgggttcgggctctcgcgcctgccggattaccagcccgtgctgggcaagctctggctggagcggggcggcacctgcgtgaccgccaacatccgcggcggcggcgagttcggcacccgctggcaccacgcgggccggcgcgagggcaaggcccgggcgcacgacgacttcgccgcggtggccgccgacctcgtggcccgcggcgtgacgcggccggggcggatcgcggccgagggcggctcgaacggaggcctgctgatcgccaacatgctcacccgctacccggagcggttcggggcgctggcctgcacgatcccgctgatcgacatgcgccgctacacgaagctcctggccggcgcgagctggatcggggagtacggcgatccggacgacccgcaggactgggcgttcctgtccggcatctccgcctaccacgccgccgaggccgggcggccctacccgccgatcctgctggccacgagccgcggcgacgaccgcgtccatcccggtcacgcgcgaaagatggcgcagaagctccgcgtcctcggctgcgacgtcgccttctacgagcccgcgaccggcgggcacggcgccggcaaggacagcgagcagacggcggcgttccgggcgctggggctcaccttcctgcgccgcgccatcggatgggatgacccggtcgcgtga

SEQ ID NO: 4914 - DNA, 774 bp, Methylobacterium sp.
atgcaggcgcccgaaccgaccttcgagaccctgcgcgacgcccatgtggccgcgctcaccggctccctgatcgacggcgtcgagcacggccccgggggcgccggctacgtctggtcgcgcagcatcccggacccgaccgtgaacttcgccttcggcgtgcaccgtcccgaccagttcgcctgggcgggcgcggccgccctcgggcgagcccgagcgccggccttcctggcccgggacgacggcgagatcgcgctgctgcgcgccctgttcgagcccgcgatcctctacccggcgcgctggatggtggcgcgggagcttccggcgccggccccggccggcagcgccatcaccgtgcaggcgacgcccgcgccggggccggatttcgagagggtcttcgcccacctgtccgacgcgccgggcgtgcggacgcatctgcgccgctactacatcccggcgctgcgcgcggcccggggccggcacggcctcgtgaccctgcacctcgtcctgcgcgacgccgccggcccggcggcgtgcgccagcctctacctgcgcggcgagacggcgggcctgtacaatgtcagcacgcgggccgaccggcagcgccgcggcctcggcaccgccgtgacggtcgcggccctgcgcgaggcgcgggcgcggggggtggttcaggtcttcctgcaatgcccggccgacggcaggaccgaggccctctacgcgcgggcaggcttccggacggcctgcgcgccgaccctgctgtgcacgaccccgccctga

SEQ ID NO: 4915 - DNA, 1152 bp, Methylobacterium sp.
atgatcgcccatgacaccgacgccctcggctggctcgacgcacaggagggcgccatgctggccctcctcgaagagctggtgaacatcgactccggctcctacgacaagccgggcgtcgacgcggtcggcgcgcgcatcgcggcgttcctgaccggccacggcatcccggtgaccacgatcccggtcgacggctacggcgacgcgctcaaggcgagcgtggccggatcgggcggcggcaaccggccggtcgtgctcatgggccaccgcgacactgtcttcccgaagggagagccggcgcggcggccgttccgggtcgccgacggccgcgcctacgggccgggcgtcgccgacatgaaggcgggcctcgtgatgaacgccttcgtgctggccgcctaccaccgggccggcggcgcgccggtgccgctcgtcggcctgttcaccagcgacgaggagatcggctcgccggcctgccggccgatcatcgaggagaccgcccggggcgcccgcgcggtgctgaattccgagccggggcggccgaccggcaacgtcgtcaccggccgcaagggcggggtgttcatgcacctcgaggtgctcggcagggcggcgcattccggcggcaactacgccgacgggcgcagcgccatcctggagctcgcccacaagaccgtcgcgctccaggcgctcaccgacctcgaccgcggcaccacggtgaatgtcggcctggtctccggcggccagtcggtgaacaccgtggcgccccgggtgacctgcgagatcgacctgcgctacgtgaccctgcccgaacgcgaggccgccatggaccggatcgccgcgatcgtggcgggatcgacggtgccggacacgaccgcgcatctcaccatcaagggcgagttcctgccgctcgtgcaggacgaggcctcgcgggcgctgttcgagacctacgcaagggtgagcgcggagggcggcaaccccgtcaccggcgagttcgccggcggctgcgccgattcgggcttcaccgccagcgtcggctgccccacgctctgcgccgtgggcccggtgggcggcaaggcccactcgcccgaggagtacctggaggtgggaagcctcgtgccgcgggcgcgcgcgatggccgagaccatcgcggcgctctga

SEQ ID NO: 4916 - DNA, 846 bp, Methylobacterium sp.
atgtctgacactgccgatacaccgcgggagggcgccagcctgcacgcgccgctggcgcggctgctgcgccccctcgtgcgcctgctcgtcgcccgcggcatcaccttcccggcgctcaccgacctgctgcgcgagctctacgtgaacgtcgccgagtacgacttcgccctcgccggcaaggagcagaccgacagccgcgtctccctgctcaccggcatccaccgcaaggaggtccggcgcctgcggggcgccggtgctccggtcagcgccgtcccggcggtcgtctcccgcaccagccggatcatcgcccgctggatcgccgacccggccttcaccgacgcgcagggccagcccctgaaacttccgcgcacggccgagggcggcgcaccctcgttcgagtcgctggtcgcgggcgtgacgcgggacctgcggccgcgcgccgtcctcgacgagtggctcgatcgcgggctggccttcaccgatccgcaggaccggatcgtgctggccgaggccgcctacgtgccgaggggcgacggcgccgaggggccccagctctactatttcggccgcaacctgcacgaccatatcgcggccgccgtcgccaacatcttcggagacgcgccgcgcttcctcgagcgggcggtccactacgacgggctgtccaaggacctcgcgaccaggctcgaggcgcgcgcccgcgagatcgccatggaggcgctgcagcaggccaaccgggaagcgcacgccgcctgccagaccgatcccggcggcacgcatcgctggaacttcggactctacgtctacaccgaagcggcgccgccggcgcggcgagcggacgagcggtga

SEQ ID NO: 4917 - DNA, 849 bp, Methylobacterium sp.
atgcatcccggatacgaacccacgacgcccttcgggcggcgaccgctctcgctcggcatgatggccgcgcaggcggcggccaaggcctgccccgacgacgcggtcgggcacaaatggcgcatcttccgcgacgtgaccgaggcgaaggatcacctcgccgtctcggaccgcgccctcgcggtgctgagcgcgctgctcacgttccatcccgagacggcgctgcagcccggctcgccgctcgtggtcttcccgtcgaatcgcgaattgtcgctgcggtcgcacggcccgtccccggcgacgctgcggcgcgcgctggcccagctcgtcgcggccggcctggtgatccggcgggacagcccgaacggcaagcgctacgcgcgccgcgacggcgccggcgcgatcgcgcgtgccttcgggttcgacctgacgccgctcgtggcgcgcgcgggggaattcgccacgctcgcccgggcggtacgggcggccgcgcgccggcgcctgctcctgcccgaggagatcgccctgcaccgccgcgacctgtcgaagatcctcgccctggccgccgaatccggatggcccgggccctgggcggcgctcgcggaccggttcgcggcctgcggcggcatgccgggtcggaccgccggcgagccccacctgtacgccgccgccgagccgctgcgcgcgctgcgccgggaggtggacaagtggctgccaagtttggcgaatgcgacggaaatggtcggcactgcgtctcacggtgagcgccaccatcagaattcagatccagatcctgctgacgattctgaacggtgcccccggcgaggcccggccggagccgcgcgatccgac

SEQ ID NO: 4918 - DNA, 1665 bp, Methylobacterium sp.
atgtcgcgcgacacccagcccggaggcctgacccgccggagcaccatggcgggggccgcagccctcggcctcgtcgcgggccgggccggcgcgcaggagccggccgaggccaccgaggccaccgggatcgtctccgcgcgcgacgcggccggcggggagccggtcccgctgccgggcgtgctggtgtccaacggtcgcgagatcgcgcggaccgacgagcggggccgataccgcctgccgatgccgggcgacggcgcggtcttcgtcatcaagccgccgggctacgccctgccgcgcgacgccgacaacgtgccgcgccactcctacatccaccagcccgggggcacgcccgccgagctgggcctgcgctatcgcgggctcgcgcccaccggcccgctcccggcctcgatcgacttcaccctgacccgggcggacgagccggacgacttcgacgtcgtgctgttcaccgatccccagccggagagccggttcgagctcgaccacgtgcgcgacaccgcggtcgcccgcgccatggcgatcccggccgccttcggcctgaccacaggcgacgtgctgttcgacgatctctcgctctacggccggtccaaccggatcgtcgggcagatcggcctgccctggtacagcctgccgggcaaccacgacctcaacatgcaggcgccggacgcgcgctacagccgcgagacctggaagcgggtgttcggcgcgccgacctacgcgttccggcacggccgggcgtggttcgtgatgctcgacaacgtcgagtggctcgggccgccggtgccggtgggcgccaacacctaccggggccggatcggcgaccgcggcctggccttcctgcgcaacctcctggccgagatcccgcggaacgacctgatcgtgctggccatgcacatccccctgcacaccgagaccggccccgaagagccgcgcacccacaccaccgaccgcgccgcgctcctcgacctgctcgccggccgcaaggtgctgagcctcgccggccacacccacacgaccgagcaccactacctcgccgacgggcaccaccatcacgtgctcaccgccgtctcgggctcgtggtggagcggtcccgacacccgcacgggcatcccgtctgccgacagccgcgacggcacgccgaacgggttccacgtcctgtcgatccgcggcaccgactacacgacgcgctacgtcgccgcgcaggggcagccggacgagaccatgcggatcctgttcgagagcgagctgcgggccggcgcgcccgaggtggtgcgctggacccggcccgtgcaggggctccggccgccggtgccgcaggacgcgctcgccgacacgaccctggtggtgaacgtgttcgacggcggcccgcgcacgcgcctcgcgttccgggtcggcgacgcgccgccccggccgatggcgcgcacccgccgccccgatccgttcgtcaccgagctctacgagcgctacccggagacgaagaagagctgggtgaaggcggtgccctcgacccatatctggacggcgcggctcccggacgacctcgcccccggcgcccaccgggtgaccgtggagggggcggacgagtacggccgcccgatccgcggccgcacggtgctggaagtcaccggcgagcgcggccgcggctga

SEQ ID NO: 4919 - DNA, 1497 bp, Methylobacterium sp.
atgtacgcacaggtcgaggccgccggcatcagcacggccgtgtcggacgaacgggaagccgtcgtcatcaagccgagctacgatccggatctcgtgaacgaggatctggccccgctgcgcaagcagacctggggcacctacaacatcttcgccttctggatgtcggacgtccacagcgtcggcgggtacgtgaccgccggctccctgttctcgctgggcctcgtgagctggcaggtgctgatcgccctgctcgtcggcatcgtgatcgtccagatcttctgcaacctcgtcgccaagccgagccagcagaccggcacgccctatccggtgatctgccgcgcctccttcggcgtgaagggcgccaacatcccggcgatcatccgcgggctgatcgcggtcgcgtggtacggcatccagacctacctcgcctcggcggcgctgacggtggtggcgctccgcttctaccccgaactcgccgtctacgccgacgtcaagcagtacggcttcgccggcctgtcgggtctgggctgggccgccttcatgacgctctgggtcctgcaggcgctggtcttctggcgcggcatggaggcgatccgcgtgttcatcgactgggcggggccggcggtctacgtggtgatgatcgcgctcgccgcgtatctcgtcgccaaggccgggatcggcgagatcgggctgaccctgggcaccgtgaagtataccggctgggacgccctgccggtgatgatcaacgccgtcgccctcgtggtctcctacttctccgggccgatgctgaacttcggcgacttctcgcgctacggcgcgagcttcgatgcggtgaagaagggtaacttctggggtctcccggtgaacttcctcgggttctcgctcctgacggtcgtcaccgcctcggcgacggtgccggtcttcggccacctgatcaccgacccggtggagacggtgagccgcatcgacagcaccttcgcggtcgtgctcggcgccttcaccttcatgaccgcgaccatcgggatcaacatcgtcgcgaacttcgtctcgcccgcgttcgacttctcgaacgtgtcgccgcggcggatctcgtggcgcatgggcgggatgatcgcggccgtcggctcgatcttcatcacgccctggaacctctacaacaatcccgcggtgatccactacacgctcgacgtcctcggcgcgttcatcggcccgctgttcgggatcctgatcgccgacttctacttcgtgaagaagcagaaggtggtcctcgacgacctctacaccatgagccccaccgggacgtactggtacaatggcgggtacaaccgcgccgcggtgaccgccatgatcccctcggccctcatccccgtgctctgcgtgatcctgccgggcctggagggcgtggcgaacttcacgtggttcatcggctgcgccctgggcttcgcgatctacaccgccctcatgcgccgccccgcgggcgcggcccgtcccgcctga

SEQ ID NO: 4920 - DNA, 276 bp, Methylobacterium sp.
gtgagctgggccatcgaggagaagggctattcgcagcgtcgcgcctgcgggctgatcggcttggagccgaagacgtaccgctacgcctcgacccgtggtgacgacgcggtcgtgcgggtatgcctgcgcggccgggccggcgagcgccgccggttcggctaccggcgcctgctcatcctgctgcggcgagagggcctaacgctcaaccacaagaagcttttccggctctaccgagagacacggctgtcggtgcgcaagcgcgggggtcgcaagtga

SEQ ID NO: 4921 - DNA, 1809 bp, Methylobacterium sp.
gtgagcggacctgacacggccctggacagcccgcgtcccgccggggggatccgcggcgcgcgaccgctccggaccggggatgccctggcgcggctcggcttcgccgacatcgaccccgtcccggccgccggcggcgccgggcgcgcgggcggcctgcgcggggccggcccgatccgccggggcgaccccctgtcgaagcgcggcttcgccgacgtgctggccgccggcgcgcccgcggacgagctgatgaagcccggcgccctgcgcggggcggcccggggccgcgacctcgacagcctgtcccacaccctgttcctgcgcatctacccggtgatcggcgccctcctgctgctgacccagctcgggatcgcctgggtgacctacaccgaccagctccggctgtacggcgaccgggcgcatctcctcgcccggctcaccgccgcggcgatcgcgcggcccgactgggcgcgcgacccggacgcctacgacggcccgctcaaggccctggccgccgagcccgatttcgcccacgccgtcctgcgcgacgccgcgggccacgtcgtcgggacggcgggcgcggcgccccccgcgcggggctggtccaccctctcggcccaggccgacctgtcggttcccggccgcgccggcccggcgggcagcctgaccgtcacggtctccacgaaggcgctgcgggacaacgcggcgtggcaggtgatgctcgccctcggcgccagcgtcgggctgatgatcgccttcgtgatcaccctgcacgccaccgtgcgccgccacgtcatggcgccgctgatgcggctgctgctcgccatgcgggagatcgagcacaagcgctggacgaccgtggagctcgggggcgcctacaggccgagcaatgagatcgacgtcatcagccaggccttcaaccgcatggtcgagggcctgcggagcggtgacgccgccaagcagctcctcgtcgagctggagcaggcccacgaccggctggagcgcgccaaccgccaggtggtcgagagcatcggctacgcccggcgcatccaggattcggtgctgccggaccgcagcgccctggcgggcgcgggggtcgaggtcgcggtgctgtgggagccgctccacgtcgtcggcggcgactatttctggctggaggagatcgacggcctctgcgtgatcgcggtggccgactgcaccggccacggcgtgcccggcgcgttcctgaccctgatcgtcgcgaccgccctcgaccggctgctgcacgagcgcggcctgcgcgcgccggccgcgatcctggccgggctcgacgcgatggtccgcacgcagctccgccaggacggacgcggcgccgaatcggatgacgggctcgattgcggcctgtgcgtctgggaccgcgcggccggcaccctgcacttcgccggcgccggcctgtcgctcacggtggtccgggacggcgtggccgagcgcgtccgcggcggccgccgggggctcggctacccgcgccccgcccgggacgggcagccggaggacgtcgtcgcggatatcgccgtgccggtggcgggcgccacattctacctgatgacggacggcatcaccgaccagatgggccgcgcggcgcccgaccgggcgccgcggctcctcggccggcgcggcgtggccgacagtctcctgcgccatgccgacctgcccctcgccgcccagaccgcggccctggaagccgatctcgacgcctatcgcgggaccgaggcccggcgggacgacatgaccctggtggcgttccggctttctatggcgacggccgccggctga

SEQ ID NO: 4922 - DNA, 846 bp, Methylobacterium sp.
gtgagcccgcaccgggcgccggcccacgatctcctgtccgagccggcggacgccttcagcctgttcgacaccgaggaggccgtcctcggccggtccgaggtgatgctggtccgcctcgccgaggtcggcgacggggtgcgggagctcgccggcgcctaccggcgcagctaccacgagcagcgccggctggtgcggctgagcgaccggatgcagctcgacctgcaccgcgccaaccagcggatggccgaacagcagcgcgccctgcgccacctcaacgacgccctctcggcggagatcgagcaccgggcgcgcctcgaggccgagctccgccgcctcgccgacaccgaccacctcaccgacgccctgtcgcgccgccgcttcctgcagatctgcgaggaggtctgggcccggacccagtcgggcgacacgccctccagcgtgctgatgctcgacctcgaccgcttcaagctgatcaacgaccgctacggccacagcgcgggcgacacggtcctcaaggccttcgtcgagacctgccgcgacagcctgcgcgcggtcgacgtgatcggccgcatgggcggtgaggaattcgccatcctcgtcaccggcaccgtgatggccgaggcgcagaccatcgccgaggcgctccgccgcgcggtggcgcagcggccggtgcgcctggagcacggcccgctgccgatctcggtgagcatcggcctcgcggcgttcggcccgagcgagtcgatgtcggcgaccctccggcgggccgacgcggcgctctacgccgccaagcatgccggccgcgactgcgtgcgctgcgcggccgaaccgggcgcgtccctgacctga

SEQ ID NO: 4923 - DNA, 390 bp, Methylobacterium sp.
atggaccgcatcacgctgccccggaccgagcgctcgcccgaggtcgatttcgacttcgcgtcggggcggctcgtcctgcgcggcgaatcctacccggaggacgccgccgcgttcttcggcccgctgctgcaggccctgcgcggccacctcgcggcgaccgaggcgagcccgatcaccttcgacgtcgcgctcgcgtacttcaactcgtcgagcgccaaggcgctgatgaacctgttcatgccgctggaggacgccgccgccgaggggcgcccggtgacgatccgctggatgttcggcgccgacgacgacgtgatccaggaggccggcgaggatttcgcggccgacttcgcgcatgcccggttcgagatgatcgcgagcgtccccgcgtga

SEQ ID NO: 4924 - DNA, 555 bp, Methylobacterium sp.
ttgcgcgcgagcgatttccgatccttccacgaggcgtcgaagcgcagcggcgtgatcctgtcgttcggcggagatctctcggagaacatcctgttctcgctcggggaagtgctgaagctgcgcatgcggcacgaggagaccgacgccgcggtcgccaagcgcgtcttctcgatcttcgtcgagcaggcccagaacgtgatccgctactcggccgacaaggtcgcgcccgccgagccgccgggccccgcccgggtcagcgccggcatgatcgccgtcggcaccgaggaggggcggttcttcgtggtctgcggcaacgaggtcggcaggaccgaggtgccgcggctgcgcgagcggctcgacgagatcgcgaccctgtcgagcgacgagctcaggaaagtctaccgcgagaagctgcgccagccgccggacgagggcagcctcggcggcagcatcggactgatcgagatcgcccgccggtcgagcgcccctgtcgagtacgacttccaggatctgggcgcggagcgcagcctgttctgcctcaaagccttcatctga

SEQ ID NO: 4925 - DNA, 618 bp, Methylobacterium sp.
atggacaggatcatgtacgcgctcgtcaccctggcggaggcggtgctcgggatcttcggtgtgcgggcgctctacgagcagcccgcctacacggtcgtcgagcgcctcgaccgcggggtcgagatccggtcctacgcgccgcgcctcgcggtcgagaccgacgcgcgcggccagggcgacggcgacgccttcgggcggctgttccgctacatcaccggcgccaaccgggccggcgaccgcatcgccatgacggcgccggtggagagcggcggccagcgcatcgcccagcaaatcgccatgacggtcccggtggagcgggacggctccggcacgatgcggttcttcctgccccgcgcggtggcggcggccggggcgccggcgccgaccgagccgggggtccggctggtcgaggtcccggccgagcggatcgcggccctgcgcttctccggccgcctcaccccggaggcgcgggccgcgcaggcgggcatcctcgccgccgtcctggcggcggccggccgcgcaccggcgggcgcgcccttcgtcatgggctacgacccgcccttcgcgatcccgttcctgcgtcggaacgaggtcgccgtccgcctgccgccgccgtga

SEQ ID NO: 4926 - DNA, 324 bp, Methylobacterium sp.
atgactcagtgcctgacagagaccgccgccctggaaacccggatcggatcccagatcagatcgcgcggcggatggctcgcccggatggccgggcccgtgctgacggtcgccgctgaggtgcgcgcgggcctgtcgcgggcggcgatgaaccggcgcgtgctccagcgcctgtcgaccctgtcggaccgggaactgaaggatatcggcctgacgccgcaggacgtggccgatgcctgcgtgccgggcacgggcgacgcgatccacctgctggtcggccggcgcgacgagcgccgccacgcccgggcggccgcacggccttggtga

SEQ ID NO: 4927 - DNA, 1530 bp, Methylobacterium sp.
atgtcgcgcgccgcagcacgctgttgtctggtcaccgtcctgctgctcgcctccgcgggccccgggccccgcgcggccgaggcgccgcagcgcaccgcagcggccgacgccgctttcctcgatgccctgacctggggcgccacgccctcgaccttcgcgcagctcacagcggagggccgggcccgctggctcgacgcgcagctccatccgccggccgaaccgcggctgccgcccgccgcccaggcgcaggtcgacgccctgaccccgccggggagcctgttcgagcgggcacaggccctggacgcgcaggccaaggcggcgaaggacatcgccgatcccgaggccaggaaggttgcgcagcaggctttccaggcggcgctcaacacggccgcacggaacgccgcctccgtctgggtgctgcgggcgctctacagccccgaccagctgcgcgagcggctgacgtggttctggttcaaccggctcaacgtccaccagggaaagtcgaccctgcgcgccgccgtgggcgactacgtcgagatggcgatccgcccgcacgtgctcgggcgcttccgcgacctgctgatggcgagcctgcgccacccggcgatgctgcgctacctcgacaacgacgccaacgcggccggccgcccgaacgagaactacgcccgggagatcatggagctgcacacgatgggtgtcggctccggctacacgcaggacgacgtcgaggcgctggcccggatcctgagcggggtcggcatcgacctcaagcccgagaacccgaagctccgccccgagcgcgccgccgacttccgccgggacgggctgttcgagttcaacccgaaccggcacgattacggcgacaaggtcttcctcggcacgcgcatccgggggcgcggctggcccgaggtcgaggaggcggtcgacctgatcgcccgcaaccccgccaccgcgaccaacgtctcccgggcgctggccacctacttcctcggtcagccgcccgacgacgccctggtggcgcggctcgccgccgtcttcacgcggaccgacggcgacatcgccgcggtgatggaggcgctggtgggcgagccggccttcacggccgagcgtggcggcgccttcaaggacccggtccgctacgtcttctcggccctgcgcatggcctacgacgcgcgcgtgatccgcaacgccggcccggtgctcggctggctgaaccgcctcggcgagggcctgttcaaccgctcgacgccggacggctaccccctcgacgccgctgcctggaccggacccgggcagctcgcgacgcggttcgagatcgcccggcagatcgggtccggctcggccggcctgttcaagccggcgctgcccgaccaagccgaggagccggccttcccggtgctcgccaacgggctctacttctcggcgctgtccggcaccctgtcggcggcgacgcgggcggccctcgcccaggcggtctccccgcaggactggaacaccctctacctcgcctcgccggagttcatgcgatga

SEQ ID NO: 4928 - DNA, 1188 bp, Methylobacterium sp.
atgaaccgtcgcgacctgatccgcgcctcggcggcgctcggcctgtccacggtggccggccgcgtctgggccgccccgaaggccgacgcgcgcctcctcgtggtgttcctgcgcggggcctacgacgccgccaacgtggtgatcccgaccggcagcgatttctattaccggtcgcgtccgaacctcgcgatcccgaagccggacgcttcggacccgaaggcggcgctgacgctcgacgccgactggagcctgcacccggctttgcgcgacacgctcctgccgctctacgccaagggtcaggccgccttcgtgcccttcgccggcaccgacgacctgacccggagccatttcgagacccaggacacgatcgagatgggccagacggtcggtgcggcccgcgactacaattccggcttcatggcccggctcgccgcggagctgacccgggtccggccgatcgccttcaccgaccagatgccgctgatcttccggggcggcgagacggtgcccaacatcgccatcaacggggtcggcaagcccggcatcgacgaccggcaggcccgcctcatcgcggcgatgtacagcgacaccaagctggccgctgccgtgaccgaggggttccgggtgcgcgacgcggtctaccatacgatctccgatcatgccgggcaggccgaccgcggggcggtctcgcccaagggcttcgagctgtcggcccgacgcatcggccgcctgatgcgcgagaacttcaacctcggcttcgtcgatgtcggcggctgggacacccacgtgaaccagggcgcgggcaccggctacctcgccgaccggctcggcgagctggggcgcggactctcgggcttcgtcgaggagatcgggccgggctggtccgacacggtggtggtggtgctgtcggagttcgggcgcaccttccgggagaacggcagccgcggcaccgatcacggccacggcagcgtctactggatcctcggcggcggcgtccggggcggccggatcgcgggaccgcaggtgcgggccgacgaggcgcacctgttccagaaccgggactatccggtgctcaccgactaccgcggcctgctgggcgggctgtttcggcggctctacgggctcgaccaagcgagcctgcggcggatcttccccagcgcggacccggcggatctcgcgctgctgtag

SEQ ID NO: 4929 - DNA, 627 bp, Methylobacterium sp.
atgtaccagccgccccatttccgggacgattcccgcgccgcgcagcacgcgctgatccgcgccaaccccctcggcctgctggtgaccgccggggcgggtggcctgaccgccaacccgatcccgttcctgctggacgacgacggcccccacggggtgctgcgggcgcacctcgcccgcgccaacccgcagggggaggatctcgccgcggcggaggagtgcctgatcgtgttccaggggccgcagggctacgtcacgccgagttggtacgcgagcaagcgcgagcacggccgggtggtcccgacctggaactacgccacggtccacgcctggggccggccccggttgatcgaggatgccgactggctcgggcgccagatcgccgacctcaccgccctgcgcgaggcgtcccgggccgagccgtgggcggtcgcggacgcgccggcgccgttcgtcgccgcgcaggtccggggcatcatcggcatcgagatcccgatcacgcggatcgaggggaagtggaagatgagccagaacaggcccgaggccgaccggcatggggtcatcgcggggctgcgcgccgagggcgaggcgggtctcgccgggctggtcgccgagcggagcggcctgtga

SEQ ID NO: 4930 - DNA, 702 bp, Methylobacterium sp.
gtgacaatccgggcgctggtcttcgacgtcttcgggacgctggtcgactggcgctccggcgtcgcccgcgaggcggcgcggctgctcgcgcccgtcgcgccggacctcgatgccggcgccttcgcggatgcgtggcgcgcccggtacaatccctcgatggagacggtgcgctccggcgcccggcccttcgtcgacctcgacacgctccaggccgagtcgctgcccgacgtgctggcgcagttcggcatcgcggacgtgtccgaggccgtgcggggcgagctggtacaggcgtggcaccggctcgacgcgtggcccgaggtgccggacgcgctgcgacgcctgcgcgagaagcacctcctggcaccgaactccaacgggcatgtccggctgatggccgacctcgcccgccgcaacggcctgatcttcgacgcggtgctcggcgccggctattcccgcgactacaagccgaagccggcgctctaccgcgacgcggtcgcggccttcggcttcgcggcgggagagaccatgatggtcgccgcccactcgaacgacctcgcggcggccgccagccacgggctcgccaccgcccacatcgcccgcccgcacgagcacggcccggccggcggcgagaccgcgccgacggtgccggtcacccacgcggcgcgggatctcgcggatctcgccgaccggctcggctgctga

SEQ ID NO: 4931 - DNA, 681 bp, Methylobacterium sp.
gtgccgcactggctcgacctcatgctccagtcgctggggccgctgctcgcggccggcctgcgcttcaccgtgccgctgacgctcatcaccttcgcgctgggcctcgcgctggggctcgggaccgccctcgtgcgcctgttcgcgccccggcccctggcggccctggcctggttctacgtgtggatcttccggggcacgccgctcctcgtgcagctgttcgtgatcttctacggcctgccgagcgccggcatcctgatcgacgccttcccggccgccgtgatcgggttcaccctcaacgtcggcgcctacacgtcggagatcgtccgcgccgccatcgcctccatcccgaagggacagtgggaggcggcctacgccaccggcatgacgccggtccaggccctgcgccgcacgatcctgccccaggcggcgcgggtggcggtgccgtcgctggccaactccttcatcgccctggtgaaggacacctcgctcgcggccgccatcacggtgccggagctgttccaggcggcccagcgcatcgtcgccgtcacctacgagccgctgatcctctacatcgaggtggcgctgatctacctcgtcctgtcgacgctgctgtcctggctccagacgctgctggagcggcgcctcgggcgctacggcggctacctggaggcccgcgcgtga

SEQ ID NO: 4932 - DNA, 918 bp, Methylobacterium sp.
atgagccggtccctggagcgcctgacctccgaagtcgtctcggcgcgcgccgcggaggaccagctcaggtccggcagcgtcgcggtcgatctcgatccgggcctcgtcgacccgtcgccggctcccgaccggctgccggtgatcgacggccccggcgaggacgccttcgtcgccgtcatccgggcgcaggggcagcagaccccgatcctggtgcggccccatcccaccgtcagcgggcgctatcaggtcgcgttcggccaccggcggctgcgggccgcggccgcgctggggcggccggtccgcgcgctggtgcggacgctcacggatgccgaactcgtcgtcgcccagggtcaggagaacaacgcgcgggccgatctcagcttcatcgagcgggccgccttcgccctgacgctggagcggctcgggcacgggcgcgacgtgatcatggccgccctgctcgtcgacaagaccgagctgtcgcgcctgatcgcggcgcggcgcgccctgcccgattctgtgatcgccgccatcggtcccgccccgaaggcgggacgccgccggtggatgagcctcgcggatcgcctcgccagcccggagatgcgggcgcgggtcgatgagatcgtcgccgcggacgccttcgcgaccctgtcctccgaccagcggttcgtgcgcgtgtacgcggccgtggcgccggtcccagccccggcgccgccggtggtccgcgcggggccggaggtggggctggcggaggacgggcgccacttggcgcgcgtcgagcggaccccgacgaccgtgggcctgatcatcgacgagacgctccatcccgccttcggcgacttcctcgtcgcgcgcctccccgagctgttcgcggcctacgagcgcgaacaggcgcgcggcccggagcgatccgggctctga

SEQ ID NO: 4933 - DNA, 1545 bp, Methylobacterium sp.
atgggaaagcatcggggaaagcattggcggtgggccgcgctggcgttctgcgccgcgtcgatcacggcgggcgcgggcccggcggtcgcgcaggtcgaggcgacggccccggacgggggaccggccccggtgaatccgggaccgaaggcgagcccggcgcagaaggcccggtaccgggcgaaccgcgcccggcggcgggtcatccgggaggcgcggagcttctcgggcgccagtagcgccgccgccagcctcgacgcgcagggcagcagcgcgacgccgcccagcctgccgccgggcaccctcgacctcggcaacgggatcagcatggtcctgaactacacgggcgagttcgccgccaacccgtccggcggcatccggcagggatcggcctatgcgggccagatcgcgttcggcctcgacgccgatctcggccgcctcgccggcatcgacggcggctcggtccacaccgtcgtcacccagcgtcacggccggagcctggcgcaggatgacatcggcttcaacggcagcgtgcaggagatctacggcggcggccagaccgcccacctgacgctgctgtcctaccagcagaagctgctcgacaaccgcctcgacatcgaggtcggccgcctgctcgccaatcccaacttcctggcctcgccgctctactgcaacttccagaacaacgcgacctgcggcgcgcccaagtccatcttcaagctgacgaacttcacctactggccgatcgcgacctggggcggccatgccaaggcctgggtcaccgacagggtgttcctgcacgccggcatctacgaggtgaacccgcgcgaccagctgccgacccggaacggcgtcgactggtcgaccagcggcgccaccggatacctggtgccggtggaggtcggctactcgaccaatttcggcaacgacccgctgccgcgcaactacagcatcggcgccgtgttcgaccggtcggactacacagatcccgtgctcgaccggcggggcgccgcccaggtcttcagcggcctcgatccgctgacccggttcgggcggtcggcggtctacgcccgcttcgaccagatggtctggcggccggacccgaacggcgtccagggcctgtcggtgttcggcgtcgcgatcggcgggaccggcggacggcagacccaggattacttcctggagggcggcgccgtgctgaccggcaccttcccgggccggccctacgacaccctcggcctcgtcttcgccatggagaagctctcgccgctgggcacggccaacatccaggcggcgcgcgtcgctggggctcggcacccggaacgtcgagtccctgcagaccatcctggagctgagctacggcatccagctgaccccggcggtgcggctgatgccgaacctgcaatacgtgatcgacccggaccagacccgcttcccgttccgcccgaagccgatcccggacgccttcgtgatcggcgcgaagctgtcggtggacctgttcaccctggccggcctcgcgaagggcccgggcagccagtgacgccctga

SEQ ID NO: 4934 - DNA, 249 bp, Methylobacterium sp.
atgacgcgcgcggccctcctcctgcccctgatcttcctcgccggcgccgcgcgggccggcgaggcgcccacgcgcgcgcgcctctgcccggagaacctgccggagggcgtgcgcctcccgccccaacccggctgcgacgccagcgcgcgcccgccgacgccgcgccggccgggccacttcgatctcggcgacgggacgagcatccagatcggcgggagcgcgtccgccctctacggcgtgcggcgctga

SEQ ID NO: 4935 - DNA, 372 bp, Methylobacterium sp.
gtgccggtcgggaagaaagcggtcgcggtcgtggacgacgacgaggcggttctggacgcgacgtccagcttcctcgaggcgttgggctacgacgcgcgggccttcaactcgggcgaggccttcctggccgcgatggccggcagcgacgtgtcgtgcctgctgacggacgtgaacatgccggggatcagcggcatcgagttgcaggatcgcgtccgggagcagcgccctgccctgccggtcatcatgatgaccgcgctgaccgacgacgcgctccggcgccgggccctcgccgggggcgcccgcgatctcctgcgcaagccgctcgtggccgacgagctgatccgctgcctggaagagacgatcggggcctga

SEQ ID NO: 4936 - DNA, 876 bp, Methylobacterium sp.
atggcgcgacgcttcaccgtgatacagggcgggctcaccgagcggccggaccgcgcggcggatccggaagccggagccggcgccgagtccggcgtcgagtccgggacctggcgggtcgatctgcggcgacccggtgccgtcgacgcggccaccgtcgccgcgtggcgggccatgctggtgcgcaacgcggtgaccgacccgctgcgcgacccggatcacctcctcccgctcgcccagcatcgcccggccggtcgtcccgtggccgtcgccctcgcctggagccgcgacgcgcgcgacggccatgagaccctgcgcggcgtggtcccgctgacgatgccgcatccggtctggggccgccgcgcccggccctggcagcccgccgagcccgacgcggccgccctcgtggagcgcgcggccgcggaggccgtcgaccgggcactacgggagcggctcggggcgctgcgccgcccgctccgtctggtcggccagtctgcgcccgcgccggatccggagccgcggcgccccgtcctggcggccagccgcccggcgcgtgcccggccgatcccggccgggaacctgctcggcgtgcgtcccgaaggctgggagcccgcggagaccgagatgctcgccgtcaccgagccggaagcggtccgcgacgcggtcgagaccttcctcgccctcgacgcccgcacggccgcgcggccgatcatcgccgacccggccgaggcgtcgctggtccgtgtggtcacccggctgttcgcccgccgcggcgcgctgcgggtcgagttccggcgccgggccggcgcggtggtcgccgggacgcttcacctgtgcgccggcgccaacgccgtgccctggcggcgcgcccgggcctga

SEQ ID NO: 4937 - DNA, 246 bp, Methylobacterium sp.
atgacggagaatcgccgcggcaccttccggaagaacgccttcacgttcggcgccgtgctgctcgatggcggcgaggtgagctgcctggtctgggacgccaccgatgtcggcgcgcagatcgaggtcgaggacgatcaggccgtgccggaccgcttcgcgcttcgtgtcagcacgggcaccgagccgcgcccggccaccgtggcgtggcggcgcagccggcggatcggcatcgccttcgacggctga

SEQ ID NO: 4938 - DNA, 1125 bp, Methylobacterium sp.
gtgaccgtgccgaactcgcggcagccgtttcaatcctcgtccgccgccagcgcgccgctggcgagcctgcggcgtgggtcgggccagctcttcgagagcgagcgtcgcctcaacgcggtcctcgacaacgcctcggtgtcgatcttcctgatggatgaccgccagcactgcatctacatgaaccgcgccgccgagcagctgaccggctggacgctgcgggaggttctcgcccgcgattgcccgctgcacgacatcgtccaccacacttacccggacggaaggcccttcccgctggaggagtgcgcgatcgaccgcgccttcccggagaacaatcaggagcgcggcgaggaggtgttcgtgcacagggacgggcacttcttccccgtggccttcactgccagcccgatccgcgacgacgcgaccaacatcatcgggacgatcatcgaggtccgcgacatcagcgaggagaaggccgccgccgagcgccaacgcctgctgatcaacgagctcaatcaccgggtgaagaacaccctcgccacggtgcagtcgatcgccgcgcagaccttccgcgggcagacggaccagacgacgcgcgccgtcttcgacgcccggatggccgccctgtccaacgcccacaacgtgctggtcgaggacaattgggagagcgccagcctgcgcggcgtgatcgagcgcgcgctcgccccccaccttttggcagaggtcgatgccggccgcttccggttacaagggccagacgcgcgattgcaccctaaggtggcagtgacgctggcaatggccctccacgagttgatgaccaacgcggcgaagtacggcgctctgtcgacgcccgagggccaggtcgcggtgacgtggtccctgcacgatcgcgatgacggccgtcagcagctcgacctgctctgggaggagcgaggtggcccgccagtcacgcccccgacccaaaaggggttcggctcacggctcatcgagcggcaattgccgctggagttcgacggcagcgcggcgatcaccttcgcgccggcgggcgcgacctgccagatgcggatcccgctgacccggctcggctggatcggccaggaggcggtcgaagggccacgcgcgccatga

SEQ ID NO: 4939 - DNA, 459 bp, Methylobacterium sp.
atgacgccgctcgccggacgccgggtcctgctggtcgaggacgagagtctcgtcgccatgctcgccgaggacatgctgctcgacctgggctgcgaggtcgtggtggcgatgcgcctcgaccaggccctggcccatgcccggaccgaggcgttcgatctggcggtgctcgacgtgaacctcggcgaggcgcgcagctacccagtcgccgacctgctgctggcgcgcggcacgccgttcctgttcgccaccgggtacgggcagcacggcctggacgccgcctatcaggcggttccggtgctccagaagccctatcaggcggcgccgctcgagcatcttctgctgcgcctgttgagcagtgaggggccgcaccgcacgggcccgaccggcctgccgcccgcctgccgctgtcgggcgtccgagcccgcccacggacagttcagtgccgatccgatccgctga

SEQ ID NO: 4940 - DNA, 933 bp, Methylobacterium sp.
atgatcgacctcgccggggtgagccgcgtcttcgaggggcgcacggtggtggcggacgtcaccctgcgggtcgagaccggggcgatcctgacggtggtcggcacctcgggatcgggcaagaccaccctgctgcggatgatcaaccgcctgatcgagccgagcgccgggacggtccggatcgccggccgggacgtccgggaggtgcccccgcacctcctgcgccgcgggatcggctacgccatccagggccacgggctgttcccccaccgcacggtcgcggagaacatcgcggtggtgccgaagctcgtcggctgggaccgccggcggatcgccgcgcgggtcgacgagctcctcggcctgttcaacctcgatccggcgatctaccgggaccgcctgccggcggcgctctccggcggcgagcagcagcggatcggcgtcgcccgggcgctcgcggccgagccgccgatcctgctcatggacgagcccttcggcgccctcgatccgatcatccgcgggcgggcgcaggcggacctgctggcgatccaggcgcgctacggcaccacgatcgtgctggtgacccacgacatgaccgaggccctgcatctcggcgaccgggtcgccgtgatggatggcgggcgcctggtgcaggaggccgcgccggcggacctcgtcggcgcgcccgccaccgccttcgtcggtgccctcctcggcagcggcgaccgggccttccagctcatggccctgcgcgtcgtggacgatctggtcgagcccggcccggcgccgggcccgcccatcccggccgggacctcggtgcgggccgccctggccgagagcctgtggtcccggcgcccggccctgccggtcagccgcgacggcgtcgtcctgggccgggtgacgcgggaggccctcgaggcgcggggcgcccggccgtga

SEQ ID NO: 4941 - DNA, 1446 bp, Methylobacterium sp.
atgcaggacgcgcgacaggacggcatcaccgccatgggcgcggtggacctcgccgccgccatccgcggccgggtggtctcctgcgcggaggtgatgcgcgcctatctggagcggatccaccggatcaacccgcaggtgaacgccctcgtgggcctcgccgacgacgccgcgctcctgcgggaggccgaggccgccgacgtcgcgctggcgcggggggacgtcgtcgggccgctgcacggcttcccgttggccgtgaaggatctcgacccggtccgcgggctgccgttcacgcagggctccccgatcttcgccgaccgggtcgccgacaccgactcgatcatggtgacgcgcctgcgcgccgccggggcgatcttcatcggcaagaccaacatccccgagttcggcctgggctcgcacagcttcaacccggtctacggcgccaccggcaacgcctacgacccgggcaagaccgggggcgggtcgagcggcggcgccgcggtcgcggtggccctgcggatgcagccggtcgccgacggcagcgaccatgccgggtcgctccgcaacccgccggccttcaacaactgctacggcctgcgcccgagctggggccggatccccgctgaggccaaggacgtgttcagcccgaacctcggcgttctcggggcgatcgggcgcacgcccggcgatatcggcctgatgctctcggtgctggcgggctacgacccgcgttgcccgaacgccatccggcaggacccgtccgccttcgcgagcccgctcgcccgcgacttccgcgggacccggatcgcgtggctcggcgattgcggcggccagatcccgttcgatcccggcgtgctcgacgtcgggcgttcggcgctcgccaccttcgcggagatcggctgcaccgtcgaggaggcgatgccgcgctacgacatggagaccctctggcaggactggctggtgctgcgggcgctgaccgtcgcggcgaacctccgcccgttctacgacgagccccgccaccgggccctgctcaagccggaggcggcctgggaggtcgagcgcgggctggcgctcggcgccgaccggatcatcgcggcgctggagggacgcacccgctggtacgagaccctgcgccgcttcatggagtcctacgactacgtggtcatgcccagcgcccaggtcttcccgttcgacaaggccctgcgctggcccgagacggtgggcggccacgcgatggacacctaccaccgctggatgcagatcacgatccccgcgacgatgtcgggcctgccggcgctggccgtgccggccggcttcggcgaggccgggctgcccaccggcatccagatcgtcgggccgaaccacggcgagctcgcctgcctgcaactcggcgccgcctacgacgcggcgagcagctgggtccgccgctacccgccgccggtcgagtga

SEQ ID NO: 4942 - DNA, 2217 bp, Methylobacterium sp.
atgtctgacaaagcagtcactgtgatcgatcctgccacggacgcgggccatcatccgttgctcatttgtttggtcatcgtcgcccgccatcatggcatccaattgtcgacgaagcagatcatccacgacaaccagctgaagccgggttcggtcagtgcttcggacctggcgcggtgtgcgcggcgtgccgggctgacagctaagcggctcaccgtgggctggcgtcacctcgtgaagctgcaaaaagtcctgccgtcgatcctcctgcttcggaccggcacagcgatggtgctcacgcgggtcgagagcaatgacgctgtagaacaggttgtgctgagagacccgctggctccggaggacgcgcctctggtgctggaccgggtgcaactggaggaggtctgggacggcgcggcgatcctgatcaagcgcgactacagcatccgcgatgaggagcagcccttcggcttcggattcctcgcgagcctgatcctgcgcgagcgccgcatcctgcgcgatatcgtgatcgccgcagtcgcgctgagcctgctcgctctcgtcccaattctgttttatcgcctgctgaccgaccgggtgatgatgcatcacgccatgaacacgttcacggcactgtgtattgggctcgcggttctcgtgacctttgaggttgcgttcacggcgcttcgcaggacattgttgctgcacctaacgtcgcgcatcgacgtaaagatggaaacatatattttcgatcgattgctacgcttgccggtcgatttttttgaaaagcatcccgtcggattcattacacacaaacttggagaagcatatcggatccgcgattttctgacaaatcagctcttcggaacggtattagactctgtttgtctcttgttcttcattcctgtgatgctggtcttcagcgtgcctctgacgctggtggtgctcgcgtcctgtggactgatctgtgcatggacggcggtaatgcttccagcctatcggcgccgtctgggcgccctaatctcggcacaggcggcgcggggatcattcctcgtccagaccctgcacgggattcgcaccgttaagtccctcgccctggagccgcggcaggctcacggctacgacgtacacgttgctcggattgctcgtctccgcttgcgcgaaggaaatctagcgacggtcattcaggcggcgattgtgccggtagagcgttttatgatctcgggaacgctcgcgatcggtgtctacctggcagtaacgtctgcggacccggccgcagtgggggagatctttgtatttctgctgctggcgcagcgtgtcgcagcaccgctgcgccaaatgtccgcgctcgtcgaacaatatgatcaggccagaatcgctgtcgcgagtgtcgcagacatgctgaatcggcccggggaggagatccgtcccgggcagggtgtgcgtcggcagctggtgggcgaggtgagcttctctgacgtgctgttcagataccccggcgcgaccacgcccgctctggatcgtgcctccttcatcgtgccggccgggacgaccctcggcatcatggggcgaagcggctcaggcaagacgacggtgacgcgcctgctccagcgcctccacgcggaatatgatggcctgatcaaaatcgacggcatcgacgtccgggagtacgccctcgatcatctgcgtggcagtcttggtgtggttctacaggacagcttcctgttcgctggcacgatccgcgagaacatcaccgcggcgaagacagatgcgaccttcgacgaagtggtccgggccgcccggcttgccggtgcggaagaattcatcgaccgcttaccccgtggctatgaaacctatctgcccgaaggtacgacgaacttgtccggcgggcagcgtcaacggttggccatcgcccgagcgctgatcaccaatccacgcattctcatccttgatgaagctacaagcgctctcgatcccgaaagcgaggccatcgtaagcgcgaacctcaagcgcatcgccgagggtcggacggtcctagtgatctcacaccgcttgtcgtcgctagtagaatctgacgcgatcttggtgttggagcgtggccgcgtccacgatcggggcacgcatgccgagttgctcgatcgctgcgacatctaccgcgatctgtggacccagcagaacggggcggccgggcggcaaacgtcgccgctgcgcctcgtaggctga

SEQ ID NO: 4943 - DNA, 642 bp, Methylobacterium sp.
atgggtgtgagcgaacagcgagagcagtacggcgtgccgaagccccgatcccttggcggtcagacttgtccgaaggcatttcagtcggcgctcgatgaactcgacgtcatcggccagtgggaatgggacgcggcgacggactgcgcgcgctcggacgccttcgtggcgctgctcttcgatgtcgacccgcagcaagcggaggcgggcgttttactgacccattacgtcgaagccatacaccctgaggatcgagtgcgggttctcgacctgatccggcgcagcgccagcgaaggtagcaccttcctgaccgagtatagggtcatctcagtcgaccgtcagacccgctgggttctggcgcgaggccgcttcaccgctgatcatcaggggcgaccgatcggcggtggcggaatcctcgtcgacatcacctcactgcggatgagcgagggcacgttcgcggaggtcacgcgctgccccgatgaaaccgcccttgaccgggccgccgatcacgccatcgccgcacaggaggcgattgtggagttgcgagacccggagttgaaagcgcaggccgacgcgctcctgatatcgctgggccggaagcttgcgcagcaagaggtgcaggaccggcgccggacgatgaactga

SEQ ID NO: 4944 - DNA, 498 bp, Methylobacterium sp.
gtgcgggccgacgccttcgtcgccctggtgtacaacgtcgatccggccgaggccgaggaaggcgtcccgctcggccgctacatgagcagcatccacgcggacgatcgcgagcggatcgatgatctgattcggcgcagcgcccgcgaggggacaccctacctcgccgagcatcgggtgacctcggcggacggtcggacgcgctgggtcctggtgcgcgggcgcttcacaggcgatcatgtcggacggccccagggcggcagcggcatcctcctcgacatcacccggatgcggatgttcgaggacatggccgacgaggccgtgccgcatgcggagacgtcgcccctcgagctggcagcggatcacgccatcgcggcgatgtacgcgatcagcgagctgcaggacgcggagctcaagatgcaggccgacgcgctgctgatgacgctgggccgcaggctcgccctccaggagatccaggaccggcaccgccatatgaactga

SEQ ID NO: 4945 - DNA, 1059 bp, Methylobacterium sp.
atgattccggcgatgaccctgctcaggcgcctcgagggcccgcagaccctggggcgcggcccggccttctggaccgccttcgcgctcgcggtcgccgccgcggtggcctacccgtggttcgcggacggctacacggtcggcaacacggcgtacttcttctgctgggtgttcatggcgctcggcctgtgcctgatctggggctacggcggcgccctcagcttcggccagaccgccttcttcggcctctccggctacgcctacggcgtgctcaccctcaacgtcggcgccgcctacggcttcaccctggcggccgttgtgctggcggtggcgctctcggccgtgatggcggcgctcctcggctacttcctgttcttcggccggatcggcggcgtcttcctcggcatcatcaccctgtcggtgacgctcgccctggagcgcttcatggcgcagaccgccggtccggaatggaagattggggcggcgcggctcaatggctacaacggcatgagtggcatgccgcccctgaccgtgccgtggctcgacggcgacgtcgtgctgtttcccgacgtcgccctctactacgggctgctggctctcctgatcgtcgtctacctcgcgctgcgcatcctggtgaacgcccggttcggcaacgtgctggtggcgatccgcgagaacccggagcgggccgagatgctcggctacgacgtgcggcgctaccagctcgccgccttcgtgatcggctcggccctggcggggctgagcggcaccctctacaccgcctggggccagtacatcacgccctccagcatgggcctcaccgccgccgcgctgccggtgatctgggtcgcggtcggcggccgcggcgacctgacggccacgctcgtcggcacgctcgtggtcctcggcggcttccaggcgctgacgatctacggcagccagtacgccctggtggtgatgggcctgctcctcgtcgtggtggtgctggccgcgcctgacggcctcgtggtggcggccatgcgcgggctcgggcgcctgcgcggccgggaggccggccgatga

SEQ ID NO: 4946 - DNA, 447 bp, Methylobacterium sp.
atgcggccggcgcctgcgcgcgtcggccccgaccaggagaaccagatgtccgacgagagcgagctgttcggccagggttttgagaaccgcaagactgtcctcggcgccgcccatgtcgagaagtcctgggccaatgccgacgcgttcaaccgtccggtccagcggctcgtgaccgagtattgctggggcgcggtctggggcgacgagactctgccgttcaagacccgcagcatgctcaacatcgcgatgctgaccgcgatgaaccagcaccacgagctcggcgtccacgtcaaaggcgcgctcaacaacggcgtgacgaaggacgagatccaggccgtgctgatgcaggcgctcgtctattgcggcgccccggcggccctggccgccttccggaccgcctccgcggcgatcgccgattgggacagagagcacgccagcgggcgctga

SEQ ID NO: 4947 - DNA, 1206 bp, Methylobacterium sp.
atgaacccggcgctggacgccaccgtgtccgtcctgcccggactcgcgaccggccgtgccgacgtggacgcggccgtggcgcgctggcagcggttcgcgccgctcctggcgcgcctcttccccgaagagggcgccggccggatcgactcgccgctcgtcccgctggaagagcacctgttccggaaagtcctggacggcgccgacgggcgcgtgctggtgaaggccgaccacgcgctgccggtgaccggctgcatcaaggcgcgcggcggcgtctacgaggtcctggcctatgccgaggatctcgccacgcgggccgggctgctcgccgaggggcgatcctacgcggccttcgccgacccggaattccgcgccctgttcgcccgccacgtgatcgcggtcggcagcaccggcaatctcggcttcagcgtcggcctgatggggcgctcgctcggcttcgcggtcgaggtccacatgtcccacgacgccaaggcgtggaagaagcagcgcctgcgcgaactcggcgcccgcgtcgtcgagcatcgcggcgattacggggcggcggtcgcggcggcccgcggcgcgttcgccgaccgtgcggacgcccatttcgtcgacgacgaggattccgtcgacctgttcctcggctacgcggccgcggccctcgaccttcagcgccagctcgcagaggccgggatcgcggttgcgtcggcgcatcccctgttcgtctacctgccctgcggcgtgggtggagcgccgggcggcgtcgccttcggcctcaagcttttgttcggtgacgccgtgcacccggtcttcgtcgagccggtcgcgtccccgtgcatgctggtccagctcgcggccggtctcgaccgcccggtcagcgtctacgatgtcggcctcgacaaccgcaccgcggcggacgggttggcctgcgcctccgcgtcgatgctggtggcccggacgctcgagaagctggtggccgccgtggtcacggtgcccgacgacgcgctgtaccgctggctcagggtgatgtggaccgaggcgggcctgcgcctggagccctccgcggcggcggggttcgcggcggccgggcgcttcgccgccacgctgcccgcggcggtcggcgccgcggccacccacgtgatctggacgaccggcggcgcgcacctcccggccgaggaattcgaggcggccctcgcccgcggttga

SEQ ID NO: 4948 - DNA, 834 bp, Methylobacterium sp.
gtgctcggcgccggcgcgctcctcgcggccctcggcacgacggcgccgcgggccgcggatctcggcgcggatcttccgcgcaccacgccgaccttcgcgatggtcgatcccaacacttggatcgtcacgctgagcggctcgatccaggccgtgccgcgctatccgggcgccagcgactacacggccgtcggctacccgtcgatcgacatccgccgggtcggcgagccgcgccgcttctcgacgccggatgacgggttcagtttctcgctcttcgacaccgagtcgttccgcatcggcccgaccgcgcgcttcgtgccggggcgctactacggcgacgaccggcgccacctgtacggtttccgcgacgcccgcttcgccgtggagcccggcgtgttcgcggagttctacccggtctcgttcatccggacccgcgtcgagctgcgccagggcgtctacgggcaccacggaacggtcggctcggtggcggccgactacctgatcccggcggagaagttcctgttctccatcgggccgcgcctcaatgtcggcgatgccagctacgcccggaaatacttcggcgtctcgccgatcgaggcggcgctgaacgggcgcgtcaccccctacgacccgcgcagcttctactcggccggcgtgctcggcggcgtgacctacacgcagagcgagacctgggcctacacggcctatgccggatacacccggatcctgggcgcctccggcaacagcccgctggtgcggcgcccgttcggcaaccccaaccagtatcagttcggcctgcgcatcgattacgctttccgcatgccggcgctgttctga

SEQ ID NO: 4949 - DNA, 1197 bp, Methylobacterium sp.
atggattccgacacgctgtcccgccgcaccctgcgcttcgtcaacgtcgcgcacgccctcgaccatttcgtgctgctgatctacccgaccgcggtcatcgccatcgcggcccagaccgggctcggctacggcgagctgatcgggctcgccaccggcgccttcgtggccttcggcctgtgctcgctgccgatgggctcgctcgccgaccggttcgggcggcgcaacatgctggcggtgttcttcttcggctacggcctgtcctgcctgggcgtggcgagcgcctcgacgccgctgggcttcgccctctggctctgcgtcctcgggctcgcctcggcgatctaccacccagtcggctcggccatgctggtcacccatgcgcgccggctcgggcacgatctcggcatcaacggggtctggggcaatctcggcgcggcctcggcctccggcctgaccgcgctgctcgccgccacggtcagctggcgcgcggccttcatcgttcccggcctcgtctgcctcgcctgcggggccgccttcgtggcgctggtcccgggggacggcgacgccgcgggccggaagaccggcggcgcggccgtgatcccggtgacccggccctgggcgctcatggcgatgttcgccctgtcgatcttcgcgggcggcctgaccttcaacctgacgacgatcagcctgcccaaggtgatcgacgagggcgtcgggcaggcgctgccgctggcgctgaccggctcgatcgccaccggcgtcttcctgttcggcgcgctgatgcagctcgccatgggccggctgatcgaccgctacagcctgccgtccctgttcgtggccctgtcggtgctgcagccgctcgggctcgggatcgcggccgtctccaccggactgccgctgctcgccgggctcgtcctcgccatgacggcgatctacgggcaggtggtgatcaacgacgcgatgatcgcccgctacgtgccgcccgcctaccgggcccgcgcctacagcgtgcgctacttcgtgggcttcacggcgagcggcttcgtggtgccggcgatcgccctcctgcacgaccgcggcggcttcgcgctggtcctcggggtcgcctccgcctgcggcgcggtgatctggctctcggccctgggcttcctgaggctgacgcagggcggcgcgcggcccgcgctcgccgccgccgagtag

SEQ ID NO: 4950 - DNA, 969 bp, Methylobacterium sp.
ttggggctgagcgtgttcgccgttggcttggcggtgctggcgatcatcaccctggccgcgggcgtgaagatcgtgccccagggccacgtctacacggtggagcgcttcggccgctacgcccgcagcctcgacgccggcctcggcctgatcacgcccttcgtcgagcgcatcggccggaaggtcaacgtgatggagcaggtcatcgacgtgccgagccagcaggccttcacccgcgacaatgccggcgtcaccatcgacgcggtggtgttctaccaagtgctcgacgcggcgcgcgcctcctacgaggtctcgagcctcgacctcgcggccacgaccctgaccatgaccaacatccgcaccgtggtcggctcgatggatctcgaccagctcctcgcccaccgcgacgagatcaacgagcgcctgctccgggtgatggacgcggcggcctcgccctggggcgtcaagatcaaccggatcgagatcaaggacatcgtgctcccggccgacctcgccggggcgatggcccggcagatgaaggccgagcgcgagaagcgcgcctcgatcctggaggcggaggggcagcgcgccgccgagatcctgcgggccgaggggcgcaagcaatcggcgatcctggaggcggagggccggcgcgaggccgcgttccgcgacgcggaggcgcgggagcgctcggccgaggccgaggcggcggcgaccgggatggtcagccgggcgatcgccgagggcgacatcgcggcggcgaacttcctcgtggccgagaagtacgtcgacgcggtgcgggcgatcgccaccgcgccgaaccagcgggtcgtggtggtgccgatcgaggcggcggccctcgccggcacgctcggcggcatcggcgagctcacccgcacggtcttcggcgacggcgccgccgcgccccggcgcaccgggaccccgccgaacgtcgcggcgccgcgggcctga

SEQ ID NO: 4951 - DNA, 1335 bp, Methylobacterium sp.
atggccaaggtgtttcgcgcgtgggacgtcgatcagggctggctgctgccgccctcgctgcacgagttcgtgccgcctgggcacatggcgcacttcgtccgcgatacggtgcgagaggcgctggacctctcggccatcctcgacacctacacagaggagcgcggatacccgccctaccatcccggcatgatggtagcgctcctgctctacggctacagccgcggcctgtactcctcgcgccagctcgcccgcgcctgtgaggagcgggtcgacgtcatggccgtgaccggcctgaatcgaccggatttccgcaccatcgccgacttccgcaagcgccacctcgtggccctgtccgacctgttcgtgcaggtgctgcgcctatgtcgggcggcgggtctcgtcgagttcgctcacgtggcggtggacgggaccaagctgaaggcgaacgcctcgcgccacaaagccatgagctacggccggatgaagacggccgagccggccctgactgctgaggtccaagcctggttggatcgcgcgggcgaggctgacgcagcggaggatcaggctcacggtgccagccgtcggggcgacgagaccccggactggatggccgacaagcagcggcggctggaagcaatccgcgccgccaaggccgcgctggaggcggaggcggctgatccgcccgatcccgaggacgagagcgggccgggcgcctcgtcgggcatgcgttggcagggccggccactacgcggcgaagacggcagtccgcccgaccgggcgcagcgcaacttcaccgacccagacagccggatcctgcccacgcgtgatggcttcgtacagggctacaacggccaggtcgcagtcgacgcggcgcatcaggtgatcgtcgcgtatcggctcgtgaccaactcggccgatcaccgcgcgctcgtgccgcttgtagacgggctccgcgcccaccttgggcgcaagccgcgggaggtctcgggcgatgccggcttcgccaacgaggcgaacctcgccgcgctgaaggagcgcggcatcacgggctacctcgctccgggccgggcgcgtcatggcgaggcggacgcagccggccgccggaggctgaccaagatgccgttgatgagcgcgatggccgcccgcctgaagcgggctgggcgccgcagtcggtaccgtcttagaaagcaggtcgtcgagccggtgttcggacagatcaagcaggcccgaggcttccgacagttcctgatgagagggctcgatcaggtccggggcgagtgggcgatgatctgcaccgctcacaacctgctgaagctggcacagtcaggccgctga

SEQ ID NO: 4952 - DNA, 1056 bp, Methylobacterium sp.
gtgcggtccggttcaaggctctccgaacgctggttcacgctggcgctctggctcgtcgcgctggtcttcgcgtggttcctgatcgggctcggctcgctggtcgtcggcgatctgccgcaggttgagcaccgctacaccctcgaccagttcctcgacaccgaccagggcacggcgtcggccgaggccctcaagcagatccgccgagagcaggacgacaaccgccggacgatcgagcaggaccagctcgccctcgaggcagcgcagtccgcctccgagggcgcacgcgagaccttcgccaactggctgaagacccgggacgccacccagcgggtcgaccaggatcccgggctcatcgcgcgcacccagcagctcgacgcgctcaaggccgccgagcgcgccatcgaggagcggctcgcggccctggcgcggacggggctcgacctgtcggagcgcgaggcggcgcagctgcgcgtggacaccgatctgcgggccgcggcgcagacgcgcctcgacgcggccgagcgcggccaggagctgcgcgtcttcggctatcgcctcgccctgacgctgccgctgctggccctcgccggatggctcctgctcaagcgccgccgcacccgcaactggccgttcgtgtggggcttcgccttcgcggcggccttcgcgttcttcgttgagctcgtgccctacatgccgagctacggcggctacgtgcagtacggcgtcggcgtgatcgtcaccctggtcgcgggccgggcggcgatcaacgcgctgcacgcctaccgcgcccggcaggccgtggtggaggcgcgcccggacgccgagcggcggaccgagatcgccaccgaccaggccctggcgcgcctcgccaagaaagcgtgcccgggctgcgagcggccgatcgccctcgacgacgcgagcacgaacttctgcccccattgcgggctcggcatcttcgcgcactgcccgtcctgcgcgcagcgcaagagcaccttcgagcgcttctgccgggcctgcggcacccggagcccggatctcgcgagcgaggcgccctga

SEQ ID NO: 4953 - DNA, 1008 bp, Methylobacterium sp.
gtgcgcgccacgctcaaccgccggttcgtcctgcgcctgctcgcgggcgccgcgaccgtgctgcccggcaccgtcaggtcgcaggaatccccgcgcgatcagggcatcggcgggaccggcatgatgcggaccgacgagccgaagagcgggcccctcggcgagggcgaccgcggcatcggcggcaccggcgtgatcggcacgatccgccgcttcggatcgatcgtcgtcaacgacctgcgcatcgcctatccgcccgaggtggaggtgcgcatcgacggcacggccgcgaaggccgccgacctgaagatcggtcaggtcgtccacgtggtggcgcggcccgagggcggcggactcgccacggggcggatcgacgtcacgagcgaagtggtcgggccggtggaatcggtcgcgcccgggcggctcgtggtgctcggccagcgggtctcgaccgcgggtctcggcggcgcgtggcagccgggcgcgcgggtcgcggtgagcgggctgcgccggcccgacggcgtgatcgtggcgagcctgatcgagccgcgggacaccgggcccgaccgcgtcgccggcccggtgcggcgggtcgcgggcggcctcgggatcggcggcctccgcctcgcgggcgccgacgccctgccgccgggtcggcgcgccctggtgacgggccgtgcggcgaacggcgtcctcaccgtgaccaacgccgcgcaggtcggcctgcccttcccgccgggtctgaagcaggtgtcgatcgaggcctatatcggccggggcagcggcggccttgatgtcggcgcgggctacgcggtcgcgggtcgcccaggcgcgcaggttccgcgcaccgggagcgtgcgggcggtgctgaccgcagcgttcgcgcgggacggggacctgacggtggagcggctgcggatcgagaaccgcatcgcccccgagccgcagcggccggacgccccgcggttcgagcgggagcgcgaccggctcgacctccgcaacctccccgac

SEQ ID NO: 4954 - DNA, 654 bp, Methylobacterium sp.
atgaacggcatcgcctccgcttctcgcctgcacccatggccggtgcgggtcatgcactggacgaacgccgtggcgatggtggtgctgatcggctccggctggggcatctacgacgattccgtcatcatccacggcgtgtacttccccaaagcgatccggctcgggtcctgggcggccgagagcctgctctggcatttcgccgccatgtggctgctggttgctaacggcggcgcctatctcgtctacggcgtcgcgacggggcgcctgcgcgagcgcctcctgccgatccggccgcgcgacatcgtgcagacggtccgcgacacgctgcggctcaagctcgcccacgaggacctgacgacctacaacgccgtccagaagatcctctacatcgtcgccatcctggccggcatcggccagatcgtcagcgggctggccatctggaagccggtccagttctccggtctcgtcgcgctgctcggcggcttccagggggcgcgcctcgtccacttcgccggcatggcggtgctggtcggcttcctcgccatccacgtcgtgctcgccctgctcgtgccgcgcacgctgtgggcgatgctgaccggcggcccggtccgccgtccgattctcccggccgcggcgcgggaggcgacgcgatga

SEQ ID NO: 4955 - DNA, 774 bp, Methylobacterium sp.
atgaggtcgcccttccgcccccgcacggtgccggatcccggcatcctcgacgaccatcgccccctggtgcggcagatcgagcggcgcgggctcctccgcggcggtctgacgctgggcgcgctcaccctgctcaccggctgcgacgtgaccgacacgaccgcggtcggccgcgcgctgcgcgtggtctccgacttcaacgacggcgtccaggccgcgctgttcgatccccacaagctcgcgccggaataccccgcctcccaggtcctcaagccgccgcgcttcaacgcctactacgacgtcgaggacgtcaagccggtcgacggcgaggcgtggcggctcgaactcgccgggctgatctccgacaggcggccctggacgcgtcggcagatcgcggaactgcccgagcgcgagatcatcgtccgccacgtctgcgtcgagggctgggactatatcgggcagtggtcgggcgtgccgctccgcgctttcctcgagcgggtcggcgccgacctcaccgccaagtacgtcgccttcaagacggcggacgactacccgagcagcatcgacatggccagcgcgctgcacccgcagacgctgctcgccacccgctacgccggccacgacctgccggacccctacgggtacccgctgcgcctgcgcactgcggtcaagctcggcttcaagaacccgaaatggatcacggccatcgagatcaccaacacctatcccggcggctactgggagagccgcggattcagctggttcgccggtctatga

SEQ ID NO: 4956 - DNA, 852 bp, Methylobacterium sp.
gtgccggccgaacggcggaccgagccgtcgacgctgcgggtcaccgagatcgggcccgacgaccggatcgtcgccttcgacgccgccggcctctggcagtatcgcgacctgctgtacgtgctgatcctgcgggacctgaaggtgctctaccggcagaccgcccttggcgcctgctgggcgatcgcgcagccgctcttcaccgtgctgatcttcacggtgatcttcggccacttcgccaagatcccgacagacggcgccccctacgcactcttcgccggcagcgcggtcgtcctgtggacgtacttctccgaggcggtgcggcgcagcgccaacggcctcgtggcggaggccgagctcatccgcaagatctacttcccgcggctggtcatcccgctggcaacggtggtgtcgccgatggtcgatttcgcaatcgcgctcggcgtgctgttggtcctgatggcctggtacggggcggtgccggactggcacctcgtgctggccgttccgaccctgatcgtcacggcgatgctcgccctcggggtgagcctatggctcgggcccgtcaacgtccgcttccgggacatcaagcacacgctgccgttcctgatccagatctggatgtacgcctcgccgatcgtctacgcgtcgagcatcgtgcccgcctcggtgcgctggatctacgcgctcaacccgatggtcggtctgattgaagccttccggtttgcgatcctggggggaacgccgcccgatgccctggcactcgcggtctcggtcgccgccgcagtcggactcttggtgagcgggctgatcttcttccagcgcatggagcgctctttcgcggacgtgatctga

SEQ ID NO: 4957 - DNA, 1386 bp, Methylobacterium sp.
ttgcgcggtctcgtaaccgacctcatcggcggcccgagctacgcctatgccagcgcgttcttccgatctgtctccgcaggcgaaggccgccgcatcgtcgtcatcgggcgtgatttgcgcgacagcagccccggcatcgccgcgacggtggcagatgctgcggcagccgctggcttcacggcgctcgattgcggcgctttgccgaccccggctctcgccctcgaggcgatgcggcgcggggcttatgcggtcatggtcacaggcagccacatccccgaggatcgcaacggcctgaaattctaccgacccgagggtgagatcaccaaggtcgacgaggcggctatcctggctgctctggaggagagcgcatcgggcgagagccaagcgtcaacgcccgctacgcctgaacctgacgcgatcgcgcgctatcgacagcgctacgctgccgccttcgcgccggacatcctgcaaggcctgcggatcgcggtctatcagcagagttcggtggctcgcgacctgatggccgacctgctcgccggcttcggcgcgcaggtgacgccgctcggccggtcgcaggtcttcgtgccgatcgataccgaagcccaccgtccggaggacatcgccttcatccgcgacgtcatggaaccgggctccttcgacgcgctcgtgaccacggacggtgacgccgaccggccgctggtggccgacggcgcgggtcggatcctgcggggcgacgtgctcgggctcatcaccgcccgctttttggctgccgacacggtggtggtgccggtcacggctggctccgcgctcgagcaatccggcggcttccggaaagttgttcgtacgaaggtgggctcgcctttcgtcatcgccgggatggaggaagcgacgtctgccggggcgcggatcgtcgctggcttcgaggcaaacggtggattcttgctcggatcggacgtcacgttccacggcaggacattggccgcccttccgacgcgcgacgcgatgctgccgatcctggccaccttggcagcggtgcgcgcgaccggcaccgccctcgctgacctcgtggcctccctggatgcgggagagatggccagcgatcggctgcccaacatcccgtccgagacgagcgctgcctttctcgatcgccttcgggacgcggacttccgggccgccttcctcgcctcgatcgggtcgtcgggctcgatcgatcagcaagacgggatccggatcgaactggatggcgggcgcacgatccatttccgggcctcaggaaatgcgcccgagctccgctgctacgcggaggccaagacggcacaggaggcgcacgatctcgttcggtggggacttgcctccgccgcgaccgcgatgccggcaaaagcctga

SEQ ID NO: 4958 - DNA, 129 bp, Methylobacterium sp.
gtgagcgacgggctgttcgccgccctcgatatcggactcgtcttcgccctggcgctgggtgtcggggtctggcaactcgtcacggtccgccgcagcatccgccgcgaccgggacggcaaggcggattga

SEQ ID NO: 4959 - DNA, 1149 bp, Methylobacterium sp.
atgcccagcaggttcaccctcacgaccgcgatcctgctggcgctgacggcgacgggcgcacgggcggaggcgatccgcatcggcgtcaacgagcccctgaccgggccgttcgcggcctcgggcacctacgtggtcaacggcgccaagatcgccgccgacgagatcaacgccaagggcggcgtcctcggaaagagaatcgaactcgtgatcgaggacaacaagagcaacccgaccgaggccgccgcggtcgcggagaagctgatcaccagcgacaagaccccggtgatgatgggcgcctggggctccagcctgacgctcgccgtcatgcccaagctcgcggattacgagacgccgatgctggtcgagacctcctcgtccggcaagatcacgacctccggcaacccctacgtgttccggatctcgccgccctcgtcgctcgaggccgagaccttcgcccccatggtcggccggctcgggctgaagaaggtcgacttcctcgtcctcaacaacgatttcggccgcggcgccgcgaccgatttcggcaagatgctcaaggacaagggcgtgacggtcggcctcgtcgagaccatggaccagggggcgcaggacatgagcgcccagctcgccaagctgaaggcgtcggattccgacacgatcatgatcacgagctcggtcgatcagctcgtgctgctgttcaagcagatggcggcgctcggcctgaagaagcgggtcatcaccaccggcggatcccagaacccggaccagatcatcgcccaggccggcgcggccgccgacggcacgatgcacctcacgaccttcctgccctggtcgcccgacaggacgccggacccgaaggccaccgaggccttcatcgccgcgtggaagacgcgcggcttcgacttcgccggcgtcaccgagagcttccgcggctacgacggcatccgcgcgatcgcccacgccatcgagaaggcgggttcggccgatccggccgcgatcaccaaggccttctggtcggtcgacttcgtcgggctcaacgggccgatccgcttcgccaaggccggccccgccgggaaggagagcggccagagcaagcccgacgtctacctcatcgagatcaaggacgggaaggtgatggtgccgacactgtag

SEQ ID NO: 4960 - DNA, 231 bp, Methylobacterium sp.
gtggtagattggctgatggctgccaagttctcccagcacgtcgccctgacggccccgcttgcccgttacgttgccgaacaggtcgagaagggcgagtacgccacggccagcgaggtcatccgggccgggctgcgcctgctgatcgagcgcgacgaggatcgcgccctggccaaagtcggacagggcaagcaacccgccgcggcggctgcgccctcgcgtgggcaagcctga

SEQ ID NO: 4961 - DNA, 1224 bp, Methylobacterium sp.
atgaccgcgtccttggcgatcccggattctccggcccgcgcgcgccgcggacgccgctggggcgcgatcgccgcggcgggcggcgccgcgatcgcgggatgcgcctggaccgcggccgcgctgatcaacgtccccgatcccgtcaccctgacggcgctcgcggtcatcgagccgtcgtcggtgggcacgtggttcccgagccggatcgtccaggccccggcccgggcgagcgacctgccggcgcggccgcgcccgatcctcgaccgcgtcccctggaaagggaagacggtcccgttgatgacggtgctggaggcgacccacaccaacgcgttcctggtgctgcaggacggcgtcctgatccacgagtggcagcgcgcgggcaccggaccggagacgctgttcccctcgtggtcggtggcgaagtccatcgtctcgctgctgatcggcgccgcggtggcgcggggccagctcgccgagaccgaccgggtctccaccctcctgcccgagctgcggaacggcgcggtcttcggccagatcaccgtgcgcaacctcctcgacatggcgagcgggatcgcggtgccggagaactacgatccccggcatcccctgaccggcaccgccggcatgtacctgacgcgcgatctcacggccttcgtgcgcgacaacgcccacctggcgttcaagcccggcaccaagggccgctaccgcagcatcgacaccgagctgctcggcctgatcctcgcccgggtcgagggcaagccgctggccgacatcctctcggagcggatctggaagccgatgggcgcccaggccgacgccacctggaacctcgaccggcccggcggcatcgagaaggcgttctgctgcatcaacgcgacggcccgcgacttcgcccgcctcggccttctggtggccgaccagggccggtcgggcgaccaccgcatcatcccgggccgctggatcgagcggatcatgacgccggcccggcgcgacgtcgacggctggcagtactcggcccagtggtggcacgccccgggcggcgaggacgacgacatctcggcgatcggcgtctacggccagtacatctacgtgaaccgcgcgaccggcacggtgatcgtgaagctcagcgaccacggcgccgagcaggacgaggtcgacacgctggcggtgatgcaggccatcgcgggcgacctcgccgccggccgccccgccgcccgcaaggac

SEQ ID NO: 4962 - DNA, 528 bp, Methylobacterium sp.
tcggcagaggcgggggtcgccgcgggggcggcgagggcggccacggacgcggccacggacgcggcggcggaggcgcggcactggcccctggccgagcgcccgggcttccttgcccgccgcatgcaccagatccacgtcagcctcttcgccgaacgctgtgccgcgttccgcgtcaccccgctccagtacagcctgctctcgctgctgcgcgatctgggtgaggccgatcagacgacgctcgcgagcgcggtcgccctcgaccggacgacgacgaccggcgccctgaagcgcctcgcggcccgcggtctggtgagccgcacgacctcgcccctcgaccgccgcgcgcaggtctgccggctgacggacgaaggcgccgcgctccacggcgcgatggagccggcggcgcgggcggcgcacgccctcaccgtcgaggccctcaccccggcggagcaggacaccctgactcggctcctgcgccgcgtcatcgcggggcacgagcaccggcgcggccagcccgacatcctgtag

SEQ ID NO: 4963 - DNA, 1323 bp, Methylobacterium sp.
atgccgcccctctggatgctgctcgtcggccgggccgcggtccgccgtcactggcacctcatcgccgccaccggcctgctgtggtcgtcgctcggcctcctggtggtgatcgattccctcgacggcgcgctccacgtcccggagcggtggttcggcctgatcctcctggccgagggcgtgagttccctcgtcgtcggcgcgtccgcgatcggcgccgcgcgccgcctgcgcctcgccaagggcgcgctgctgtcggtcatggccgtgctgatcatgatggccacgaagcacagcaccttcctgctcgccatgatcttcggcgtcgccttcgtggtcgacggcctcgtccggatcacgatcgccggcctgctgaaattcgctggctggcggatgtcggtcgccctcggcggcctcagcatcgccttcggcctgttccatctccagccctggccgacctggtacgccggcacggtcggctactgcatcggcatgttcctgatcctgaacggcgccaacctcgcgctggtcgggctgcgcacccggcgcctgggcaccgccgagccggcggtgtcggtcagcggcgacgagcccggcagcctgacggtctatgtctggacgcccaccgggcaggcgaccacccccgccggccagcggctgatccggcgctacgtcgcctccgtcgacaaggccgggcgcttctccaccggccacgcggccctgcagcagggcgatgacctctacgtcagccactaccccgcggtggagatcgaccgctcccccgccaacctgcgctcgagcctgcgcgcgggcccggagaacgacgtgcccgggcgcttcctgccctcgcacgccgcggaggtggcggactggtgccccgcgacagtggcggtgacgctgaacggcatcgacgccgcccggctgcgggcgttctgggcgcagtacagccgcgacaccacctacaacttcatcagccgcaactgctccaccacggtggcgcgggcgctggacatcgccgtggagggcgcgttcagccgcggcgggcatccctggcggcggctcgcggcggcgctgaccacgccggaattctgggcggcggccttcctgcgcaacggggcgcggtccatgacgtggaccccgggcctcgtgctcgactacacgcgggcgctgagcgccctcgtggatccggcctcgccggtgccgtcgatcgcctggaagcgggtcggctggcggctcctgcgcaactggcgggcgcgggacctcgcgcccctgagcccgatcgcccggcagccctccgtgccgggagccggccctacggaagcctga

SEQ ID NO: 4964 - DNA, 1299 bp, Methylobacterium sp.
gtgagaaccctccggcagaccggcttcgcgcgccgccacgatccggcggcgcgcacgggtccggtgctgcgcgccctcctgcgggcggaatcggtggccctgtcggtctgggccctgctccttgtcggggtctcgggtggcctcctgtgggtgctcggcctcaattacgaggggatcaccggctcggccgcctcgaagatccaccccgccacctacctggcggtcgtcctgatcggctggaccctgatgcgcgcgggcaatccggtgatcccggtggccggggcgctgaaccggcggccggccagcgtgctcctggccgcctgcggcgtgctgctcctcgcgctgatcgcggcccggggcggcgcgggcctcgccggctccatcgacaccttcgtgctcgccggcctcgtcccgatcctcctgatggacagggacgccgaaacgctcgggcggctggagacgatcttccacctcgtgatgctcgccaatgccctgctcggcctgttcgagctcgcgagcggccagcgcttcttcccctaccggttcgacggcgtggcgttcgagtccgacacccgctcggcggccctccagggccacccgctggccaacgcgaccatgacggcgtgctacatcctggcgctggcgaagggcggcggccgcctggcgccgatgccgcgcgccgccatgatcgtcctccagctcgtcgcgctggtcacgttcgggggccgctcggccaccgtcacgacgctgatcctcggcggcgctgtcgggctcgtggccctgaaccgcaccctgcgcaccggccgcgtcccgctggcggcggcggcctgcgcgtgcttcgccgtgacgctgctgcccgtgctggtcgcggtcctcgcctcggccgggttcttcgacaccctgctggaccgattcgtctcggacggcggcagcgcgcaggcccgggtcgacatgctcacggtgttcgacgcgatcccgttccggcagctcctgctcgcccccgacttcctgcaggtgaacacgctgcgccggatctacggcctggaatggggcatcgagaactcgatcatctcggccgtgctctaccacggcatcctggtcacgggggtgctggtgatcgcggtggggctctacctcgcggagatcgcgcgggattgccggcgcggcgtctggctgccgatcctggccttcgtgatcctcgtgaacacgttcgagggtctcgccggcaagacgaccctgctcgccaagttcgccctgatgctcatcgtcctgttcccgccccttccgcgccgcggctga

SEQ ID NO: 4965 - DNA, 1230 bp, Methylobacterium sp.
atggacatcgtacggccgcggatcgacggggcggagcgccgcgtcgagacgctcgaggcggagaacatccgcctgcgcagcctgctcagccaggcgaccgcccaggccgactgggagcggcagcggagccggcggctcggccgaatcatcgagacggcgagccgcgtcgaggccggtcgcatggcggccgagcgggtcgaggcgcccctcgggccgtcaccccgcggaccggccggactcgggctcgaggcgaggccgcgccactccggccgcgcgcgcgcgatcggcctgccgcaggcccccaacgactacctggaactgctggaccgcgacgggcgcctgatcaccgccagcgaggacggtccggccctgtccgccgccggggacgaggcggacgcgatcggccggccctggatcgacgcctggacgcgccccgaggaccgggaggcggtggccgaggcgctcgatcgggcccggatcggccgcccgagccggttccaggcccagtcggaatccggcggcgcgctccgctggtgggacgtggccgtcacgccgatcggcgcggcgccggaccggcccgagcggatcctggcggtgtcgcgcgacatcaccgaccagaagctgtccgaggcgcgccagacgctgctgatgcaggaactcgcccatcggatgaagaacaccatggccatggtccaggccgtcgcgacgcagaccatgcgcaacgcgccgtcgctggaggcggccggcgaggccctggccgcgcggctcctggcgctcgcgaaggcgcacgacgtgctgctccagggctcgttcacccgggcctccctgagcggcctggtcgagggcgccgtgtcgctccacggggacggcgtcgcgggccggttccgcatcgccggtcccgacctgacgctcggaccgcggcacggcatgaccctggcgctgatgctgcacgagctcggaaccaacgccgccaagtacggcgcgctttcggtcgccgccggctgggtctgcatcacgtggaacgtggccgagggaggccagaccctccggttccgctgggaggagagcggcggaccgccggtcacgccgccgacccgcacggggttcggcacgcggctcatcgcccgcagcctcgcccacagcttcggcgggaccgcccacatgagctacccgcgcgagggggcggtgctgaccttcgaggctcccctcgacgcggtgatggtcgcctga

SEQ ID NO: 4966 - DNA, 1725 bp, Methylobacterium sp.
atggcacgaagatcgtccgcaaaacctgacggccgccccgagcggcgccgcgacatcctgcgcgaccgcggcggcaacgtcgccctgctgttcgcgttcctgagcgtgccgatggtgatggtcggcggcgcggcgatcgattacggcttcgccacgcggctggagacgaagctccagtccgcgaccgacgccacggcactgctgctctgccagacgccgctgacgacgaccgaggccgaactcaacgccctggcgcagacgaccatgaccggtgccatgggggccgcgagcctcgtggtcgaccggctggccatcaccagcaacccgcgcaagatcacgctgaccgctcacaagcagtcgacgaccttcttcggcgggctgaccggcacccagcgcatcaacccgggcgccgtctcgcaatgcgccacgccgctgcccaagactttcgagatcgcactcgtgctcgacaacacgggctcgatggccgcctcgagcgggggacagtcgaagctccaggccgtccagacggccgcgaccgacttcgtcaactacgtctacaccagcccggccttctccagcgcgagcaagatctccatcgtgccgttcgccgcgtctgtggccgtcaatccagccacctatcgttatgcgagctggatcgatcaagctgcgcaatccagctatcactggctcaacgtcaacgggctccagggcacgggcatcaccaatcgcttcgacatcttctcgaagttgcaggcggccaactccggctgggcctgggcgggatgcctcgaaacactgccttatcccctgaacgttcaggacggcgcgccgaccgcgagcaacaaggattcttattacctcccgctcttcgcccccgatgagccgggtgacggctcgtcggaatatagcgaatactcgaccaaaacctcatcaaatatcagcttcaacagctatatcgacgattatacgaacagccccgattgtcccaagccgacccgggacacgtccttctcgacggccgaggggcgtgcatgcaagtatctcagcccccgcgatccgtcgccaacctcgcgaaaccgctacacgggtattcccaacgggccgaattccggctgcacgacccagccgcttcagcgactgaccagtgataccacgacgctcaagagcctgatcaacctgatggtagcctcaggctcgaccaatattcacgaaggcttcatgtggggatggcgcacgctttccccgaacagcgtgttcgcagacggcgcgcgctactcctcgaacagcgccaattccgacctcagcacgatcaacaagatcatgatcctcatgaccgacggggaaaatacctggcccgtcaattcgaacccgtcctacaataaatccatgtactttcccttcggctattttacgaatgccgatggatcgaacccgaattcgcggcttccgcccagcaatcaaaatatttcgaatgcccgcaccgcgcgggatgcgctcgacaaactgacagccctcgcgtgcagcaacgcgaagacaaataatatctcgatctacacgatcggcttcagcgtcccggcggatccgatcgattcggccgggcagacgctgctgcggaactgcgcctcgtcaccggaccagttctacctcgccaactcgtccgatgacctcatcaaggccttcaagtcgatccaggccagcatcggcgcgctgcggttgacgcagtag

SEQ ID NO: 4967 - DNA, 1650 bp, Methylobacterium sp.
gtgagcgccgtggccggccaggggagcgcggccgcgcccgggcgcaggccgggtgcgggcaaggccgcgtccgggaaggcgccgggcggccacaatccgtggctgatcgccggcgtggtcgcgctggcgaccttcatggaggtgctcgacaccaccatcgccaacgtcgccctgcgctacatctcgggtggcctcgcggtcggtcccgacgaggcggcctgggtggtgacgagctacctcgtcgccaacgcgatcaccctgacagcgtcgagcttcctggccaagcgctacggccgcaaggcgttcttcatgtggtcggtggcgctgttcaccgtctcgtcgatcctgtgcggcttcgcctggagcctggaatcgctgctgctgttccgggtcatgcaggggctcggcggcggcggcatggcgccgctcgcgcagtcgatcctggccgattccttcccgccggagaagcgcggccaggccttcgcgctctacggggtcgccatcgtggtggcgccggtgatcggcccgacgctgggcggctggctctccgacaacgcctcctggcactggtgcttcctgatcaacgggccggtgggcgtgatcgccctcgggctgatgtactggctgatcgaggacagcgacgcggccaagaaggagcgccgcgccctggtgcgcaagggcatccgcttcgacatcgtcggcttcgtgctggtcgccctgttcctcggctcgctggaggtgatcctcgacgagggccagcggaaggactggttcggcacctcgacgctgatgaacgtgtccggcgtgctgatggtcgtctcgttcatcgccatgatcccgtggctgctgacccgcgagaacccggccgtcgacctccgcctcatcggcaaccggcagttcggctcgtgcttcctggtgatgatgttcaccggggcgatcctgatcgccaccacgcagttcatcccgcagatcacgcaggaatattacggctacaccgccaccctgtcgggcctcgtcctcggcccgggcggcatcgtcacggtggtgatgatgttcctcaccggccggatctcgtcctacgtccagccgaaatggctgatcgccaccggcatgaccatcgtggcgctgggcatgtacgacctgacgcggatcgacggcagcacgaccttcgcgttcttcgcgtggtcgcgggtctatatcggcatcggcctgccgatggtgttcctgtcgatcacctcggcctcgtacgaggggatccgcaaggaccagaccgatcaggcctcggcgctgatcaacgtcgcccgcaacgtcggcggctcgatgggcgtctccctggcgcagaacatcctggcctaccggagccagttccatcagagccgcctcgtggagagcgtcaacccggcctcgccggcctatcaggagaccatgcggcaggcgacgcagtacttctccgagcacggctacgccgggatcgaggcccagaaccaggcgacggcgtggatcgggagcgtcctcagcacgcaggtggcctactgggcctatatcgacgtgttctgggtgctcggcctcgtcgcggcctgcgcggtcccgctggccctgagcctgaagagcgtcaagctcggcggcggggcgccggccggggggcattga

SEQ ID NO: 4968 - DNA, 1656 bp, Methylobacterium sp.
atgctcgccgtgacactcaccgccggcgccatctggatcacggtctcgcggcagacctggtctgagatggaggcgcgccagcgcaccaacggcgagcgtaacctgagaactctggcgctcgtcctggcggcgcgggtcgagggcgcggcggcggatctcgacggcgcgcgcgtcgcccgggtgtcgacgccgagcctgtcgggcttcgccgatgcccgcgtcgtggacgacgccgtcgcctactcgggcggcttggcgacggtgttcagctacgagtccgcctccgacagcttcgtgcggcgccagaccacggtgcgccgggaggacgggacccgcgcggtgggcacggcgctcgccgccgacagcccggcccaggccgcgatccgcgccgggcggacctacgaggggccggccgccctgttcgggcggcgctaccacacggtgtatcagccgacggtcgacgccgccggcaaggtgaacgggatcctgttcgtcggcctgccgatcgagatgtacttcgacgcccatgcccggacgatgacgagcctcagcgtcgccgccctggtcatcgcggtgctggcctgcgccctcgtcggtctggcggcggcgcggctgttccggcccttcgcgacgatcgcggcgcgaatcgaggccctcgcggccggcgacctggatacggcgatcccccacgcggagcgcggcgacgagatcggcacggtggcgcgcggcctcgaggtgctgcgcgtctccggcctgcggacccgggaactcgagagcctgcagagcgcgggcgcggccgacgagacgcggcggcgggccgccctcgaccgcgccatcgaggcgttccgaggccagatcgtccgcctgaaggacgcgctgaccgccagcaccggcgcgatgcgggcccgggccggcgagatggcggccagctccgccgaggcggaggccgccgtcgccgagaccgagcgcggctcgcacgagacctcggccagtgtccagaccgtcgcgagcgccgccgaggagctctccgcctccatcgccgagatcgggacccagctcgaccacgccgaggccctggtggccacggccgccgcggagtcggacgccatgaacgccgagatcggcgagctcgccgaggccgcggggcgcatcggcgccgtcgtcgggctgatccgccagatcgccgagcagaccaacctgctggcgctcaacgccacgatcgagtccgcccgggccggcgccgccggcaagggcttcgccgtggtggccgcggaggtgaaggcgctggcgtcgcagaccgcgcgggcgaccgaggagatcggcagccagatcgccggcgtgcaggcctcgacgtcggcggccgtggcggccatcggccggatgggcgagcggatgcgggcggtcagcgccaccacgggtgggatcgcgtcggcggtctcggcccagggcgccgccaccgccgagatctcccgcaacgtcgccgacacggccggcgccaccgaggccatcgcgggcggcctgaccacggtcgccggcgccgcgcggcgctcggcccgcatggccgccacggtcaccgaggcggctcagaccgtcgacacggtcgcggccgacctcgagggcgagatcgagcgcttcctcggtcaggtcgcggcctga

SEQ ID NO: 4969 - DNA, 453 bp, Methylobacterium sp.
atgctcgattccctcgccggaaccctcggggccctcggggcggcctggagctgggtgatcgccggcctcgtgctcgccggtgccgagatcctgctgcccggcgtgttcctgatctggctcggcctcgccgccgtcgcgaccggcctcgcggccgcggcgctgcccatgccctggcagggccagaccctgctgttcgccggtctcgccgtcgccctggtggcgctcgcggcgcgcctccagcaccgcggccggcgggccgggccggacctgaaccgcgccgaccgcggcctgatcgggcgcgagggcgtgctcgacgagccgatcgtgcagggcgcgggccggatccgcttcgacgacacgctgtggcgggtcgaggggcccgacctgccggcgggccgccgggtgcgcgtcaccgggatcggcggcacggtcctgcgggttgaggcggcctga

SEQ ID NO: 4970 - DNA, 780 bp, Methylobacterium sp.
gtgagcgacacgtacgagacgatcctgacggagacgcgcgggcgcgtcctgctgatcaccctcaaccggccgaaggcgctgaacgccctcaacgcgcagctcacccgggaggtgatccgggcggcgacggaggcggacgcggatccggggatcggctgcatcgtcctcaccggctcggccaaggccttcgcggccggcgccgacatcaaggagatgcagcacgccacctacgcggagatgtacgccggcgaccggttcgcggactgggaccggttcgtcgccgtgcgcaaaccgatcatcgccgcggtggcgggctacgcgctgggcggcggctgcgaactcgccatgatgtgcgacatcatcctggcggccgacacggcgcagttcggccagcccgagatcaagctcggcgtgatgccggggatcggcggcagccagcggctgacccgcttcgtcggcaaggccaaggccatggagatgtgcctgaccgggcggatgatggacgccgccgaggccgagcgcgccggcctcgtctcgcgcgtgatcgccgccgaccagctcctcgacgaggcgctgaaggcggccgagaccatcgcgtcgatgtcgctgccgatcgccatgatgacgaaggaggcggtcaaccggtcctacgagaccacgctgaccgagggaatccggttcgagcggcgggtgttccacgccatgttcgccaccaaggaccagaaggagggcatggccgccttcgtagagaagcggccgccccggttcgagaacacctga

SEQ ID NO: 4971 - DNA, 1338 bp, Methylobacterium sp.
atgaccgattcgatgccgcgtcccggtgatcggctcccgctcccgggcgccggccgcctccgcctgcccggaccgatgcgtgccgtcctctcggggcggttcgccgtgatcctgtcgggcgagctgacccagagcctgttccacttcctcctcaacatcctgctggtgcgcgagctcggcgcgcacgattacggcctgttcgccatcgtcttcgcggtcggggcggtcggcatcacctacatccgggccctggtggcggtcccggcgacgatccacgtcgcccggagcctggggcgtccggcggcgctcggctacgatgtcatgttcggctctggcgcggtgctggtctccggcctcatggcgaccgccgtcggcgtcgtcctgatcccggtgatcggcctcggcgccctcgcggccggggccttcgtgggcctctacgccttccgcagctacctgcggatcgtgctcctcgcccgcggaaggccctggatcgccggcctgagcgacctggtctacgcggtctgcggcggtctcctcgtcgcgcgctggctgaacggggagggcacggcccttctcgatcgggccttcacggcgatcgcgctcgcgcacgcggtcgcgatcgccgtggcctacgcggcgctgcgcgagcggatccgcttctcgctgcacgcgcgggcgcgcgcccgctaccgggcgatttggcggaccctggcgtggtcgctcgccggcgtcaccagcctgacggtccaggggcagggcctgaccctgctgctggcgctcctggccggacccgccgcctacgcgccgatcgccgccacgatcgtgctctacgcgccgctgcgcatccccgcgagcgcgctgctgaacatgatcctgccggagatcagccggctgctcgcggccggtcgggtggacgccgcccgccggctcgtcatccgcaacggaatcctgctcggcggcgcctgtctcgcctacggggcggtgatggcggccgccctgccgctggtcgaggacatcctgttcaagggccggttcgccgagcatccgatgggctggatcgggctcggtgtctgggcggtggtgaccgtgtcgctgctctacgcgatcccgcgggcctacctcgaggcctcggcggcgttccggaccatcacggcgggcgcggtggcgagcgccgccctcggcatggccgtgatggtgccggcgctgctgctgctgccgcccgccaccgcgctcgccggcctgctggcctccgaggtggcgacgctggtctggtcggtctcggccttccggaccctggcgcggcgcccagagtcggggcggcctctcggcgccccgtga

SEQ ID NO: 4972 - DNA, 1260 bp, Methylobacterium sp.
atggtagataatttcggactgagagcggcgcgcgacagcgatcgtgctgccgcccccgcgctgcgggccatcggcaacgccgcggcggagcttcggatcacgtgcgtccaccagggattcgagctgtacggctcggatcgctgcttcatcgagaccgtccgcacgatccgggccgcccatccgggtgcgcggatcgacgtcgtgctgccgcgacgcgggccgatcctggccgcgctggagcccttcgccagcgagatcgtgatcgccccgctctggatcctgcggcgcaagaacctggcgcgcctcgtaaccctaggtctgatggctctgcccatcgcgatgatccgtgcgtggcgccgcatccgcgcgagcgacctcgtctacatcaacaccaccgtggtggccgactacctgctggccgcacggctggtccccggccggagcatcgtccacgtccacgagatccccgaaggcaccgtgctgaaggtcctgcgcgggctgatccgctggagcggtgccaacgtggtgttcaactcgcgcgccaccgagcgggcctacgccctgccccgcggggcgaccgcccgggtcgtctacaacgggatcgcaggtcccgccgagccgaatcggaacacctacgacggctcccgcccactccgcgtgctgatgctcggccggatcagccggatcaagggccaggacgtcctcgtggaggcgctggcctccctgccggagcccgtgcgtcggcggatcgagctgcgcatcgtcggcagcgccttcgaggacgaggcccgcgagcgggccctggtcgggcggatcgccgaggcggggctcgccgcgcaggtcacgctcgagccgttcgtggccgatcccgcggccctctaccgctgggccgacgtggtcacgatgccgtcgcagcggcccgaatccctcggccgcgtggcgatcgaggcgatgtcctacggcgtgccgccgctcgtcacggcgatcgggggcctgcccgaggtggtggaggccgggaagaccggctggatcgtcccgccgggcggcccggagccgatcgccgccgtgctgaaggatctggtcgccgacccggcgcgctggcgcgacttcggccgggcggcccgggcgcgctacctgagcctgttctcggaggcctcggcggcggagggcatcgaggccatggtccggacgacgctgcgccgcccgacggcggcggatccgtcccgcgccgcggacgcgccggcgcgaccggccgcctag

SEQ ID NO: 4973 - DNA, 816 bp, Methylobacterium sp.
atggagtcacgcgtgcgccgcctcttcgccctcgttctcgcgaccctcctgtcggtcggccccgcaatggccgaccgcctagacgacatcagacaggccggcgttctccgggtcgccgccttcgacagcaacccaccgttcggcttcgtcgatcccgcgacgaaacggatcgccggcctcgacgtcgactacgcgcaggccatcgccgacgcgctcggcgtcaagctggagatccggcccaccaacccggcgaatcggataccgctgctgacctccggcaaggtcgatctggttctggcgaatttcaccatcacggaggagcgggcgaagcagctcgatttcagcatcccgtacttcgcctccggccagcagttcctggcgaagaagggcaccctgtcgtcgccggagcagctgaacgggcttcgaatcggcgccgacaagggcaccaccaacgagatcgtcctgcgccgcgacttcccgcaggcggtcgtggtcgccttcgacgacacgcccttcgcgttcacggctctgcgcaacggcaatgtccaggccatcacgcaggacggaccgaagctggtcgggctgctcgcgaaggtgccggaccggcagaactacgagatcccagccttcagcatctccaacgactatatcggcgtcggcatcccgaagggtgaagcgcgcctccgggaccgcgtgaacgagaccctgcgcggcctggaggcgagcggcagggcggcggcgatctacgatcgctggttcgggcccgcgaccgagcagccgctgccgcgcctgttccggatcggggaccgtccctga

SEQ ID NO: 4974 - DNA, 399 bp, Methylobacterium sp.
gtggttgagcgggatctgccggggcggatccgcctcggcccggtcgaccttctcggcgaccgggacctgctccccgtcaccgcgggcggccgccggctgctcctcgtccgggacggcgcgcggatcgtggccgccgagcgcgcctgcccgcacgagggggccgacctcgccctcggacgctgcgtcgcgggccggctgcactgcccccggcaccaggcctcgttcgacctccgggacggcgccgtctcgccgggctggtcgttccgtgccctgcgcctgtccgcggtcgaggcggtgccggacgggctgtggctcaggaccggatccggccttctcgcgccggacaccgcgccgccgggcgggcgcggctccccggccggcccggagatccgacggtag

SEQ ID NO: 4975 - DNA, 819 bp, Methylobacterium sp.
atgagcgcgatcctctccgtcgagcatgtcggcgtccgcttcgggggtctcgtcgccatcgcggacctgcatttcgacgtgcacgcgggcgagatcgtcagcctgatcggcccgaacggggccggcaagacgacggccttcaacgtgatgacgggcttcctcaagcccagccagggcgcggtccgcttccgcggcacgtccctgaagggcctgccgccgcacgcgatcacgcggctcggcctcgcccgcaccttccagcgcaccagcgtcttcccggacgacacggtgttcgacaacgtgatgatcggcctgcaccagatgggcgccgcggcgggccgcgcgcccgttctggacgcgctcctcggccgcgcgggggccggcgagaggcagctgcgcgcccggaccgcggcgctgctcgactgggtcgggctcgccggacgggcgcaggagaaggccggcgccctcgcctacggggagcagcgcctcgtcggcgtggcgctggcgctcgccaccgagcccgccatgctgctcctcgacgagccggtctcggggatgaacgcctccgagacgcgggtcttcgtgcgcctgatccggcaggtccgggagcgcggcgtcaccatcctgctcgtcgagcacgacatgccgatggtgatggaggtgtccgaccgcatcgtcgtcctcaactacgggcgcctgatcgccgaggggccgccggaccggatccgcagcgacccggcggtgatcgaggcctatctcggccagggcagcgccgcccggcaggccgccgccgctgccgcgcaggaggcggtccatgcttga

SEQ ID NO: 4976 - DNA, 942 bp, Methylobacterium sp.
atgctcggctatatcggcaggcgcatcctcgccaccatcccggtcatggcggtggtcgggctgttcgtcttcagcctcctctacttcgccccgggcgacccggcggcgatcatcgcgggcgaccaggcgacgcccgacgacgtcgcccgcatccgcgccacgctcggcctcgaccggccgttcctggtgcggttctgggaatggtcctggcagatcctccacggggatctcggcacctcgatcttcaccaacctgccggtcaccaccatgatcggccagcgggtgcagcccaccgtctcgctgatgctcgtcaccctggtcttcgccatcgtggtggcggtgccgctcggcgtcgtcgccgcctggaaggccggcagcctgatcgaccgcctcgtcatggggctcgccgtgacgggcttctcggtgccggtcttcgtggtcggctacgtgctcgcctacgtcttcgccctcgagctcggctggctgcccgtccagggctacacgccgatcgagcagggcgtgtggccctggctgtccaacctgatcctgccggcggtgacgctcggtctcgtctacatcgcgctgatcgcccgggtgacccgcgcgaccatgctcgacgtgctccagcaggattacgtgcgcacagcccgggccaaggggctggcgcagggcccggtcctgttcgtccacgccctcaagaacgccgcggtgccgatcgtcaccgtgatcggcatcggcatcgcgctgctgatcggcggcgcggtggtgaccgagacggtcttcgcgattcccggtctcgggcgcctcaccgtcgacgcgatcctgcgccgcgactacccggtcatccagggcgtcgtgctgctgttcagcttcgtctacgtgctcgtgaacctcgctatcgacctcttctacaccgtgctcgacccgaggatccgctattga

SEQ ID NO: 4977 - DNA, 546 bp, Methylobacterium sp.
atggccgacaccggcaccagcaacaccccgcggacgcacaagacccgcaacaacaccgactcgaacgccaagaaggtctcgatcgaggcgctcaacgcccggctcgcggacggcatcgacctcgcgctggcgatcaagcaggcccactggaacctcaagggcccgcaattcatcggcgtccacgagatgctcgacgggttccgcacccagctcgacgagctgaacgacagcgtcgccgagcgcgcggtccagctcggcgccacggccttcggctcgacccaggcggtcgccgagcgcaccaagctgccggcctacccgaccggcatctacgccatcgccgaccacatcgccgcgctgatcgacagctacgccgcctacgccaacgcggtccggcagaacatcgacgagaccgacgaggcgggcgatcccgacacggccgacctgttcaccgagatctcgcgggcggtcgacaagcacctctggttcctcgaggcgcacgtgcaggagccgaccggcaccctgcgcgacggcaacgcgggccgctga

SEQ ID NO: 4978 - DNA, 1176 bp, Methylobacterium sp.
atggcgatgcacgatctgatcgccggcgacgcgcaggcgctgtcggccaaactgcagtcgcaccggcagcggcttttcccgcccgaggcgcgcaagcagctgcggcgattctcgtccggcgaggccgccaagctgatcggggtcgacgacggctacctgcggcgcctctcgctcgatggcaaggggcccgcccccgagatcgggccgtccgggcggcgatcctactcgagcgccgacatccaggcgctgcgcggcatgctggacgagggggccaagaccggccggcggtaccggaaggagcggcgggccgaggagcatctccagatcatcgcggtggtgaacttcaagggcggctcgggcaagaccaccacggcggcccatctcgcgcagcacatggcgctgcagggctaccgcgtcctcgccgtcgacctcgacccgcaggcgagcctgtcggccctgcacgggatccagcccgaattcgacgtgcgggacaacgagaccctctacgccgcgatccggtacgacgcggcgcgccgtcccctgaccgacgtcatccagaagacctactttccgggcctcgacctcgtgccgggcaatctcgagctgatggaattcgagcacgagacaccgcgcgccctcctccagcggagcagcgacggcgattcgctgttcttcacgcgcttcgcccaggccctggcgccggtcgccgaccgctacgacgtggtcgtggtcgattgcccgccgcaactcggctacctgacgctctcggccctgtgcgcggcgaccagcgtgctcgtcaccgtgcatccgcagatgctcgacgtgatgtcgatgtgccagttcctgctgatgacctccgagatgctcggggtcgtcgccaaggccggcggcgacatgaactacgactggatgcgctacctcgtcacgcgctacgagccgaccgacggtccgcagacccagatggtcgcgttcatgcggacgctgttcggggagcgcgtgctcaccaacgcgatgctgaagagcacggcggtctcggatgccggcatcaccaagcagaccctgttcgaggtcagtcgcgaccagttcacgcgcgcgacctacgaccgcgcgatggagagcctggacgcggtcaacggcgagatcgaggcgctgatccgcacggcatggggacgctga

SEQ ID NO: 4979 - DNA, 507 bp, Methylobacterium sp.
atgccgccatccgaccccgccgcgcgggagcccttcgccgccgcctgccgccgcctcggcccgcggctgatgcgcgatctcggcctgagcgacgtccaggccgccggcctgctcggcaatctcggccacgagaccggcgggttccgccacctccaggaggtcgcccccgcggtgccgggctcccgcggcggctgggggctcgcccagtggaccgggccccggcgcgtcgccatggaggcgtggtgccgggcgcgcggccgcgatcccgccgacccggaggcgggctacggctacctctgcgccgagctgcgcggtcccgaggcgccggccctcgcggccctgcgggccaccaccaccctcgctgccgccaccgaggcggtctggcgccgctacgagcggcccggcgtcgtcgcgcccgcgcgccgcctcgcctgggcgcaccgggccctcgccgccctgcgcgacggtcccgccgcgatgccggctcagccgccgggccggccctga

SEQ ID NO: 4980 - DNA, 216 bp, Methylobacterium sp.
atgctcggcgcccgcgcgctgatccagctcggcgcccgtacccgcccgctcgtcgtctccggccagtacgaccgcgccgcgatcatggccgccgcctgcaaggccgccaccggcattcaggaacgctgcggcgtctcccgcgccgaggcgatttcgtccgcgctgaaggcaacgtggcaggtcgccaaggccgcccaccgcgctgctgcgcactga

SEQ ID NO: 4981 - DNA, 1242 bp, Methylobacterium sp.
atgaccatcaaactgcgactcgtctcgctgctcggcggactcggcctggtgctggtcgccacggcggcgctcggaaatctctcgctccactggagccatcagagcctgaagaccgtcttcgatgatcgcgtcgtctgtctccggcagttcagcatcatccgcgacgcctacgacgacctgctcgacgcctcgcgccagctgcgcggcaggcagatcgagccggcggaggccaaggacaagatcgagcgcgatctgtcgaagctccacaaggagttgtcggcctatctggcgacctacctgaccccggaggaggaggccctcgtcaaggacctgcagatgcgcgtcgatcggaacgacgcgatcgcggccgagatcctcaagcgcgtcgccgccggcgcggcctcggatttcgaggccacccacgcggacctgctgaagagcatgcaggccaccaacgcgacgctgagcaagctgagcgcgctgcaggtccgggaagccgaggcggaattccgccgctcggaggcaaccgccggctggtcgcgcctcgcgctcctggccgcgcttgcgctcgccgcgctcagcatcgcctacggcgtgtacgtgatcgtggtccaggtcacccgcccactgggcagcctcgtcgctgttctgcagcggatggccaagggcgcggtcgacgccgagatccgcgaggccgcccgcggcgacgagatcggcgccgtcggccaggcggtggagggcatcaggaccatggtcgcccgcaaggccgccgaggaggccgaggtccggcgccgcgccgacgcggccgccgccgccgagcgcaagcgcaccatggtcgagctcgccgacggcttcgagcgcgccgtcggcggcatcgtcggcctggtctcgtcctcagccaccgagctccaggccaccgcccagcagatgaccgccaccgcccaggagaccgcatcccagtcgaccaccgtggccgccgctgccgaggaggcgtcgaccaacgtcaacacggtcgcggccgccgccgaggagctcggctcctccgtgcaggagatcggccggcaggtcaccggctcggcccacctcgcccaggccgcggtcggcgaggccgaccagaccgcccacctcgtccaggcgctcagccagaacgccgcgcggatcggcgacatggtcgggatgatctccggcatcgccggccagaccaacctgctggcgctcaacgccacgatcgaggcggcccgc

SEQ ID NO: 4982 - DNA, 825 bp, Methylobacterium sp.
atgaaggccctggcccgcaccacgaccgcagtcgacaccgcccggctcgggatcatgctcggcgaactccggctgctgaccatcaagaccgtctggccccgctttgccgaacaggccgacaaggagggctggcccgccgcccgcttcctcgcggcccttgccgaacacgagttggccgagcgcgacagacggcgcatcgagcgtcatctcgccgaggcgcgcctgccgccgggcaagacgctcgacggcttcgacttcgccgccgtgccgatgccctcgaaggcccaggtcatggcggtcgccgctggcgacgcctggctcgcgcagggggccaatctgctcctgttcggcccacccggcggcgggaagagccatctcgctgccgcgatcgggctcgccctcgtcgaggccgggttcaaggtgctgttcacccgcaccaccgacctcgtccagaagctgcaggtcgcccggcgcgagctcggcctggaggcggccatcggccggctcgaccgcttcgacctgctgatcctcgacgacctcgcctacgtcaccaaggaccaagccgagacgagcgtgctgttcgagctgatcagcgcccgctacgagcgccgctccctgatgatcaccgccaaccagcccttcggcgagtggggtcgaattttccccgatccggccatgacgctcgctgccgtcgaccggctggtgcaccatgccaccatcttcgagatgaacgtcgagagctaccggcgtcgcaccgcgctggatcggaaacgcggtcccggccggccgccgacccgcgcgacaatcaaaaccgccgatgtgtga

SEQ ID NO: 4983 - DNA, 252 bp, Methylobacterium sp.
gtggccagcatgaacgtctcgctgcccgaagccatgaaggcctgggtcgaggcgcaggccgataccggccgctacgccaatgccagcgactacgtgcgcgacctgatccggcgcgaccaggagcgcttggccaagctcggcgatctgcagcggctgatcgacgaggggctggcgagcggcgtcagcgaccggtcggagcaggatatccgccagctcgggcggacgcgattggcggcccgtgcggaaccatga

SEQ ID NO: 4984 - DNA, 270 bp, Methylobacterium sp.
atggcgaccatgacgatttccctgcccgacccgatgaaggagtggatcgaagcgcagatcagacagggcgattatgccagcacgagcgactacgtccgcgacctcgtgcgccgtgaccgcgagcgacgagcccaggccgatttgacgcttgaggatctgcgccggatcgtcgacgaggcccgcgccggaggaccgagccgccgtaaggtgcccgagatcctcgtccgggccaggaagcacgcgcagtctgatcaaccgctcgatgagtga

SEQ ID NO: 4985 - DNA, 669 bp, Methylobacterium sp.
atgcctatcgtcgccatcgtcaaccccaaggggggcgccggcaagagcacggccgcgctcgtgctcggcaccaccctcgcgcgccacggcgccagcgtcaccgccttcgactgcgaccgaaaccagcccttggtcacctgggcggccggcgacacgcgctcagcgttgcgggtggtctcgcacctcgacccggagacgatcggccgggcgctccgcggcgaggccgcgcgtcagcagttcgtgatcgccgaccttgagggtaccgcctcgatgacggtcgccaccgcgatcgtcgcggccgacctcgtgctgatccccacgcgcggctcgatcacggatgcccaccaggctcagcgcgccatcaacatggtcgaggatcaggcggccgccgtcggggcccggccgtaccggctgctcttcacctgcacacgcccgggcttccagacgcgggacgagcgcgcgatccgggacaccttcgagcaggctggcgtgagcatcttgccgaccgacctcggtgagcgggcggcctaccgcgccatgttctcctaccagctcgcgctggacgagctggacccgggcgccgtcaacggagtcgacaaggcgatcgagaacgccgacgccttcgccaacgacgtcgtctcctgcatccaggcgagggcagccgcgtga

SEQ ID NO: 4986 - DNA, 684 bp, Methylobacterium sp.
atgcccgtgatcgcttttgccaatcccaaagggggcgccggcaagaccacgaccgcccttctcctggccaccgaactcgcccagcgcggcgcccaggtgacgatcgtggatgcggatcccgagcgctggatcagccagtggtctcggctccccggcaagccagagaccatcacgatcatcagcgatgtcaccgaggacacggtagtcgacgtgatcgaggccgcggccgaggcgtctcagttcgtcgtggtcgacttggaagggacggccagcctcatggtcgctaacgccatcgccatggccgacctggtagtgatcccagtccagggctccgctatggacgccaaaggcggcgcaaagaccatccggctcatccggacacaggagaagaccgcccggcgccagatcgcgcatgctgtggtgctgacccgtacgggtgcagcggtcacgtctcgcgccctccgaaacgtccaggaacagctacaggccggcgggatcgagatgttcgcgaccaccatcgtggagcgagccgctttccgagacttgttcgactacggcggcacgctggccagcttgagcccgtccagcacgtcgaacctcgaaaaggcccaggccaacgcccgggagtttgccggtgaggtggtcgccaagctccgggccgccgctcgtgtggaggcagcttga

SEQ ID NO: 4987 - DNA, 384 bp, Methylobacterium sp.
atggcgcggacgaagcattatcccccggacgcgacgatcgccgacgtcctgccggatctcgccgacggcgaggcctacttgcgccaggtcctgagcaccatgcggatgtgccagaagcatcacggcgacgcctgggtacggatcggcgtgaccggccgttccccgacgccgtcctaccggatcgaccggccggacgagaccgcgctcggcgacggtgccgtcgaggcgggcaaggccctgttcggcgcctatggcggacggtcccacgaccgtttcacccaggtcaacgccgcggagacccgctggagctcgcgggcgctcggcatggccgagatgctggcgcttcacgacgggctgcgccgccccaggggcgacgcggcctga

SEQ ID NO: 4988 - DNA, 1251 bp, Methylobacterium sp.
atgatgccgagaacgccccgcggatcccgcctgtccgccctcgcggccgccctgctcgcgagcgcatccctggccgccccggcggcgcgcgccgccgaccccatcaagctcggcgtcctcgaggaccagtccggcgatttcgccgtcgccaccatcggcaaggtccacggcatccagctcgccgcggacgagatcaacgccgcgggcggcatcgccgggcgcaagctggagctcgtgatctacgacacgcagtccgacaacacgcgctaccaggaattcatgcgccgggtgctccagcgagacaaggtcaacgccgtcttcgcgggcttctccagcgcgtcccgcgaggcctacaggccgatcgtcgaccagctcgacggcttcgcgttctacaacaaccagtacgagggcggcgtctgtgacggccacatggtcgtcacgggcgcggtgccggagcagcagttctcgacactgatcccgtggatgatggagaagttcggcaagcgggtctacacgatcgcggccgactacaatttcggtcagatctcggccgagtgggtgcgcaacatcgtcaaggagaacggcggcgagatggtcggggaagagttcatccccctcggcgtgtcgcaattctcgcagacgatccagaacatccagaaggccaagcccgacatcctgatgacgctgctcgtcgggacggcgcaggcctcctactacgagcaggcggcggccgcgaacctgaaggtgccgatgggctcctcggtcaatatcggccagggctacgagcacaagcgcttccagcccccgagcctcgccaacatgtacgtgaccacgaactacatcgaggaggtcgacagcccgtcgagcaaggccttcctggccaagtggaaggcgaagttcccgaacgagccgtacgtgaaccaggaggccgagaactcctacctcgcggtctacctctacaagcagatggtggagcgggcgaacggctcgaccaagcgcgccgacctgcgcaaggtcatcgcggcgggggacgtctgcgtggacgcgccggagggcaaggtctgcatcgaaccgaagagccagcacgcgtcccacacgatctacctcgcgaaggtcgacgagaagcacgcgatctccttcccgaagacctgggacaacatccagccctactggctcgggaaggccggctgcgacctgacgcagaaggatccgatggcgcagtacacgccgagcaacccgccgaagccctga

SEQ ID NO: 4989 - DNA, 873 bp, Methylobacterium sp.
atggatctgctgactcacgccttcacgtttctctaccagatcggcgacgcgttctcgttcctggtcctctccgcctgcggcctcgcggtggtgttcggcatgatgggcgtgatcaacctcgcgcacggcgagctgatcatgtgcggcgcctacgtcacggcggcgtccacacgggccgggctgccgctgccgctggggatcctggccggcgcgctcgcggccggcgccgtcggcatggtgatggagcgcctcgtcatccgccacctctacggtcggcccctcgacacgatcgtggcgacctggggcatcagcctcgcggcgacgcagggcacgctgatcctgctgggctccagcatgccggggatcggcacgccgctcggcagcttcacggtcggcggctactcctactcgacctaccgcgtggtgctgatggtcgccgccgtcgcggtgctggctgggctctacctcgccttcaacgccacccgcttcgggacgctcgcccgcgccaccatccaggtgccgcacatggccgagaccctcggcgtcgacacgcgcaccgtctacgcgctgacgttcggcctcggcgcggcgctggcgggcctcgcgggcgggctctacgcgccgaccatgaccatcgtgccgaccatggggacgaccttcatcatggaggccttcgtcactgtggtggtcggcggcgccgacatcttcctcggcacggcgccagcggccctcgtgctcggcaccgtgcgggcgctgctcaccacgtggcagggccagctcttcggacagattggcctcctcgtcgcggtgatcctagtgatccgggtgctgccgcggggcatctcgggcctgatcctgcgcgagcgggcctga

SEQ ID NO: 4990 - DNA, 747 bp, Methylobacterium sp.
atgaacccgctcctcgagacccgcgacctcagcaagcatttcggcgggctgcacgtcaccaacgacgtgaacttcgccctcgcggcgggggagatccactgcctgatcgggccgaacggcgccggcaagagcaccttcttccgcctgctgctcggcgagtacgcgccggagcgggggcagatcctctatgccggcgaggacatcaccgcgctcaagcccttcgcgcggatccgccggggcatgagcgtcaagttccaggtgccgggcatcttcccgagcctgtcggtggcgcacaacttggagatcgccctgcagcatcatctggagggcgcctcgctcggcgccgagatccgccggctgctcgccttcctcaacctcaccgccgcggcctctgaccgggccggcaacctcagccacgggcagaagcagtggctggagatcggcatggcgatcagcctcaagccgcgcctgctcctcctcgacgagccgaccgccgggatgtcgccggacgagaccttcgccaccggcgcgatggtgcaggcgctcaaccgcgacggcgtcgcggtgctggccatcgagcacgacatggccttcgtccggcagatcgcccagcgggtgaccgtgctccatgtcgggcgcatcttcgcccagggcaccaccgacgcgatcatcgcggacgagcgggtcgccgcgatctacctcggggaggcggacgcgccgccgctgcggagcgtcgccgatgcctga

SEQ ID NO: 4991 - DNA, 1281 bp, Methylobacterium sp.
atgttcgacgatcagcggcacccctccgaggacgaggcgcgcccgcggccggccgacggccgcgcggccgcacgcgagcgcgacgtgctcgatctcggccgcgccgcgccggccgcaggccgcgacacccgccacgagaccgcgcgcaagcccggcgcggaggaggccgacgataccgcgcccgaggcgcaggacggtgaggccgacgacgactcggcgggatccgacgacgacggcgacgacgcgcggcgccccaacgtcctgcgccgccacccgctcgcgttcctgctcggcggcctcgcggtcgtcgcgctctgcgtcggcgtgttcttctactggctgctctacatgcacccctacgagagcaccgacgacgccttcgtcgacgcgcgcagcatctcgatccagccgaaggtcggcggctacctcgtggacgtgccggtcaccgacaaccagcacgtcgaggccggccagatcctcttccaggtcttccagcgcgactacgacatcgccctcgaccaggcgaaggcgcaggtcgccgccgacgaggccggcatcaagaacatcgacgcgcagatccaggcgcagtacgccaacatcgaggtgtccaaggcgcaggtcgccaccgccgaggcggcgctgaagttcgcccaggaggacgcggcccgctacaaggacctcgccgagcgcggctccggctcggtccagcagtcgcagtcggcgacctcgacgctgcagcagcggcaggcggccgtgcagagcgccaacgccagcgtggtcgccgcgcagaagcaggtcggctcgctccaggcccagaaggcctcgacccaggcgcagctcggccgcgaccgggcgcaggtcgagcaggccgagctgaacctcggctacacgacggtccgcgccgtccagggcggccgcgtcgtgcggctcaccggcggcgtcggccagctcgcccaggccggccagaccctggcgatgttcgtgcccgacgacatctgggtgacggcgaacttcaaggagacgcagatcaccgacatgcggccgggccagccggtcgacatcgagatcgacgcgtatcccggccgcaagatccggggcacggtcgcctcggtgcagccgggctcgggcacggccttcagcctgctgccggcgcagaacgcgacgggcaactacgtgaaggtgacccagcgcatcccggtcaagatcgtggtcaagtcctggccgacggacgtgtcgatcggcccgggcatgtcgatcgtcccgaccgtcacggtgcggtga

SEQ ID NO: 4992 - DNA, 534 bp, Methylobacterium sp.
ttgacggcggccatcctggtgaccggggctctcggcctcgggctcgccagcgcggcggtcgcgcgcgatcacggacccgagggcttccgcgggcacggccgctggagcgcgctgacccccgaggaccgcgcggccttcacggatgcccgcatcgccgccctgcatgccggcctgaagctcaacgccgatcaggagaagctgtggccgccggtggagacggcgatccgcgacatggccaagctgcgccagcagcgccgcgaggcgatgcgcgaccggccgaagttcagcgacgacgccccggcggcgctgcgggcgatggcggacgcggcgagcgcgcggggcgacgccctgcgcaagctcgccgacgcgtcccagccgctctacgccagcctcgaccaggaccagaagcggcgcgccatgatcctcgcccggccgatgggcccgatgggcggccacggcatgcggggcggctggcaccgcgaccgcggtgacgatcgcggcgacgatcacgggccgcgcggcgacggccgctga

SEQ ID NO: 4993 - DNA, 609 bp, Methylobacterium sp.
atgacggcgaggacgatcatcggggcggacccggcagcgacggagacgtccccgcagatccacatcgccgaggagatccggcggcgccgccgggagcagggcctgtcgctggagacgctggcggcgcgctcgggcgtcagccgctcgatgatctccaagatcgagcgctccgaggccgtgccgtcgacggtggtgctgtcccgcctcgcggaggcgctcggcgtcaccttctcgcggctgatggcgcccgcgacggagcgcgagatcctgctgatcccggcgagccgccagccgatcctgcgcgacgaggcgtccggctacctgcggcgctgcatctcgccggtcctgcccgggcgcggcatcgactgggtgctcaacacgctgccgcccggcgccagcaccggcgagttcaccgcccatcgccgcggcgtgtccgagtacatctacgtcctgcgcggccgcctgcgggcagtgatcggcgagcgcgcggtcatcatggagaccggcgacagcctgtatttcgaggccgatgccgggcacgccttcaccaatgtcggcacggaggcgtgcgagtacttcctggtgatagacccgtcgcgcgtccgctga

SEQ ID NO: 4994 - DNA, 237 bp, Methylobacterium sp.
atgccgacccatcgctgcctcgacccacaggatccctacgccgaacgcgaggtgcgcgtcgccttcgagtggagcgccgaccatccccgcctgatcgcggccctggacgagcacgaggccgatattctccccgacctcgtggaggtccagcgcgacgatctccgtcgcgagatcgtggccgcccttccgcttccggagccgtgcatcccaggccggaccgagatccgcctgccgtga

SEQ ID NO: 4995 - DNA, 357 bp, Methylobacterium sp.
atgcgcacagccctgatcctgccggtcctcgtcctcgcggcctgcgcgctgttcctgcgcagctacaccctgccgccggccccggaccgccggggcgggaccacgctcctgctgacctggccgaaccgcccggccttcggcagcccccgggccgactgcctcgccggtccgcccgacgagccggtcctgccctgcctcatcgcctccgtcgcccgggtgcgggacgacgggtacacgctgctgcagctgccgttctgcgcgacctgctacgacctgtccgggcggatcgccgtcatgggccgcgacgcggcggcgacgcgggcgcggctggagcagatcgcccgcttcggatggtga

SEQ ID NO: 4996 - DNA, 915 bp, Methylobacterium sp.
gtgagtggcaccgcgcccccgggcggcgtgcgggccctcgtggggttcggccgcacggtcgcggacctcgccgtcacggaggccttctaccgggacgggctcggcttcgcgcgggtcgccccgccggagccggttcccgccgcgcaggcggaggcgatggggctcacggaccggcgcgccgtccagctgcggatgcgcctcggcaggcagaccgtgaccttcctggcggtcgatccgcccggcgcgccctacccggccgatcccgccgcgacggacccgttcttccagcacctcgcgatcccggtccgcgacatggcggctgcggctgcgcggctggcgcggctcgccccgacgccgatcagccgcggcgggccgcagcgcctgcccgcctctacggggggcgtgaccgcctacaagttccgcgaccccgacgggcatcccctggagctgatcttcttccccgacggccccgcggccgcccgctggcgcgacgcgcggggcctgttcctggggatcgatcactcggcgatcaccgtcaccgacctcgacgccaccgtggccttcctgaccggccccctcgggctggcggtggcggagcgcggcctgaaccgcgggtcggagcaggcgcgcctcgacggcgtcgacgatccgcaggtcgacgtgatcgccctcacgccgccggaccccgcgccgcacgtggagctcctgcattaccgcacgcccgcgacagagcggcggctcgccttcgggcccgccgaccgggcctccacccgctacgtgttctccgcagcggatccgcagaccctgtcgcggcgcctgcgcgagggcggacaaactccgcggaactcaaccgacggcgcggcagcctattgcgccggcccggacggacacggcttcttgttcgtgcgcggctga

SEQ ID NO: 4997 - DNA, 903 bp, Methylobacterium sp.
atggacggcttcgaactcacgcagccgcgcttcaaggcctacatcctgccgaacgcgccgctgcagaagcttgcggacgggttccgctggaccgagggcccggtctggttcggcgaccgcgacgagctcctgttctcggacctccccaacaatcgggtgatgcgctggtcggaatccgccggcctgagcgtctaccgcgaggcgagcgacttcgagaacggccacacccgcgaccgtcaggggcggatgctgtcctgctcgcaccgcggccggcgcatccatcggaccgagctcgacgggcgggtcaccggcctggtcgagcgctaccgggggcggcgcctgaactcgcccaacgacatcgtctgcaagtcggacgggacgatctggttctcggacccgccctacggcatccagaccgactacgagggcggcaaacaggaatccgagctgcccgccgccgtctaccgcttcgatccgcgcgacggctcgctccgggtggtggcggacgatttccaggggccgaacgggctctgcttctcgcccgacgagcgcaggctctacatcgtcgagaccgggctgcagttcgacactgatccgctccagcacgtgcgcgtgttcgacgtggccgaggatggcagcctgtcgggtggcgacgtgttctgccggatcgcgccgggaaacgccgacggcatccggtgcgacgagcacggcaatgtctggtcgagcgccggggacggggtccactgcatcgaccccggcggcgagctggtcggcaagatccgcgtgcccgcgacggtcgccaacctcaccttcggcggacgcaacgacagccgcctgttcctgtgcgcctcgcaggcgctctacgcgatctacgtgaacgtgcggggagcaccgctcctgtga

SEQ ID NO: 4998 - DNA, 1605 bp, Methylobacterium sp.
atgacgaagctcgcacagatgttccggctccgcgccaccccgcagacggagccgatccccaacacggtgccgaacgccgccggaggccacgccttcgcggtcggcgactgggcgcggctcgaccgcttcctggtgctcggctccgagggcggctcgtactacgcgagcccgcgcgccctgaccgccgagaacgcggcgtcggtgcagcggtgcatcgcgcaggacggcgcccgcgcggtcgccgccatcgtggcggtgagcgagggcggccgggctccgaagcaggatccggcgatcttcgccctggcgctggccgccgcctcggcggacctcgcgacccggcgcgcggcgctcgcggccctgccgcgggtctgccgcaccggcacgcacctgttccagttcgccgcctccgtcgaggcgatgcgcggctggggccggggcctgcgccgggcggtcggtgactggtactgcgccaagcccgtggaggccttggccttccaggcggtgaagtaccggacccgccagggctggtcgcaccgcgacctcctgcggctggcccatccggagacggaggagcccgcccggaaggcgctgttcgactggatctgccgcggcaccgtgaccgaggccgcccccgggatcgtccacgccttcgcgcgggtgcaggcggagggcctcgacggggcggtggccgccgccctggtgcgctcccacggcctgccctgggaggcgctgccgaccgggctgatgggcagccgcgcggtgaacgaggccctgatcgagcggatgccggtcggcgccctcgtgcgccagctcggccgcctgacggccgcgggggtgctcgcgcccttctcggagggcaccgagcacgtccgggcggtcctgtcggaccgggagcggatcctccgggcgcgcctgcacccgatggcactgctgctggccctcaagacctacgcctccgggcacggtcagcggggcaagctcgcctgggagccggtggcggcgatcgtcgaggcgctgaacgccgcgttctacacggcgttcggcgcggtcgagcccacgggccggcgcctcgtgctggcgctggacgtctcgggctcgatgggcgccagcacggtcgcgggctcgacgctcacggcccgggaggcggccgccgcgatggcgctcgtcaccgcggcgaccgaggagcactggcaggtgctgggcttcacggccgaggccggccgggcctggagccagggggccgcgctgacgccgctgccgatcgggccgtcgatgcggctcgatcaggcggtgcgggcgaccgccgacctgccgttcggcgccaccgattgcggcctgccgatgcgctgggcgctggagcggggcgtcaaggccgacgcgttcgtggtctacacggactcggagacctgggcggggccggtccacccggtccaggcgctgcgggcgtaccgggagaagaccgggatcccggcgaagctggtggtcgtggggctggtctccaacggcttcagcatcgccgacccggaggatcccggcatgctcgatgtggtcggcttcgacaccgcggctccggccgtgatcgcggatttcatccgcgcgtga

SEQ ID NO: 4999 - DNA, 1035 bp, Methylobacterium sp.
atgaaccggctcctccccctcgccctgctcgccggcctcgtggccctgcccctggggctcggcgccaacccctacctcctcaacgcgctgatcgtgaccggcatcctgacgatcggcgccatgagcctgaacctgctcctcggcttcaccgggcagctcagcctcggccacatcgcgttcttcgggatcggcgcctacgtcagcgcgctgaccagcctcggcttcgacgtggatctcggcttcgggatccgcgcggtccacgagccctggccggcggtggccggcctcctgctggcgacggtggcggcgggcggctgcggctacctgatcgggcggctctccttccgggtgcggggcgcctacttcgtgatcgtgacgatctcgttcgccgaggtcgtgcggctcgtggcgctcaactgggtggagctgacgcaggggccgctggcgctgaccaacatcccggccatcaccctcggcctgccaagcctcgggatgtggaccctcaagaccaagctccagaactactacctcgtgctggctgtcgggacgctctgctacgccgtgatcgcccgcctggtcggcggccgcttcggccgggcgatgcggggcctcaaggagaacgagccgctggcgctctcggtcggcatcaacgccacgcgcacgctgacggtggcggcggtgatctcggccgccatggccggcgcggccggcagcctctacgcccattacctgcggatcatcgatcccgacgtgttcctgttcgccaccacggtcaccatggtcatcatggtggtggcgggcggcaagggcaccctgctgggcccggtcgtcggcggcctgatcttcggcctgctgccggtggcgctccgcccggtcatggcgccggaggcgcagtggatcgtctacggcctcgtgctgatcgtgatcctgttcgtgatgccgcggggcatcgtgccgggactggcggcgctgctgggccgccgcccggccccggccgcgccggtcctcgaggccaatccggcggtgcagcgatga

SEQ ID NO: 5000 - DNA, 873 bp, Methylobacterium sp.
gtgaacgaactgatccagcacctcgtcaacgccctcatcctcggcggcacctacgcgctgctggggatcggcctgacgctgatcttcgggatcatgaacgtcgtgaacttcacccacggcgcgctctacacggtcggcgcctacgtcatgtatctcgcggtcgccgcgctgggactgaacttcttcctggcgctgccggtggcgatcctcggcgggctcctgctcggggccgcgatcgagttgctgctgctgcgcccgttccgaggctcggacatcgacaccaccatgctggtgatgatcggcgccggcatcgtcctgcaatccggcacgctctggaccttcggcggcgtcgccaaggcgatccccgcgcccttccccgaggcgccgctccaagtcggcccggtctcggtgtcgtggctgcggctgttcgtgctcggggcggcgctgacgctgatcgccctcacctacgcgctgatcaaccggaccaagctcggtctcgccatgcgcgccgccttccaggattccgacacggcggcgctgatgggcgtcgacgtccgccggatctacaccgcgaccttcgccctcggctcgtcgctggcggcggcggccggcgcgctcctcggtcccgtctacgtggtgttcccgcagatgggcggcctcgccgagctcaaggccttcgccatcgtcatcctgggcggactcggcaacgtcaccggcgcggcgatcggcggcttcatcctggcgctcgccgaggagctgggcgccggctacgtctcctccggctaccgggacgcgatgggcttcctgatcattatcgcggtcctgctctgcaggcccaccgggctgttcgccaaggcggagcgcgtcggatga

SEQ ID NO: 5001 - DNA, 1284 bp, Methylobacterium sp.
atggacaatcgccgctatgatctggttctgcggggcgggcgggtcatctgcccggcctccggcatcgacggcatccgcgacgtggcggtgcgggacgggcgcatcgccgccgtggcggagacgatcctgccctccgccgccgccgaggtggtcgacgtcgcgggcaagctcgtcctgcccggcatgatcgacacccacgcccacgtctaccagtacgtcaccggccggttcggcctgaaccccgacatggtcggcgtgcgctcgggcgtgaccacggtggtggaccagggcgggccgtcctgcatgaccctgccgggcttccgccacttcatcgccgagcgctcggagacgcaggtcctcgccttcctgtcggcctacctcgtcggcggcctggaagggcatttctacccgaacctctacagcccggacggcgtcgacatcgacgccaccgtgaagtcggccaccgagaaccgcgacctcgtgcgcggcatcaagggccatgccgagatcggcggcttcgcccgctggggcatcaaggtgatggagatggccgccgagatcagccggcgcgccgacctgccgctctacgtgcatttcggccagctctggggcctgccggaatcgggcgccaacggcgaggatgccgacaccatcgtcgagcgggtgatcccgctgctgcggcccggcgacgtgctggcccatcccttcacccgccacccgggcggcttcatcaacgagcagggcgaggtccaccacatcatccgccgggccatggaggccgggctgaaggtcgatgtcggccacggcagccatttctcctaccgcgtggcccgcgcgtccctgccggcgggcgtggtcccctacacgctcggcgccgacatgcacggctacaacaccgaggtgcccgaggtgaagaagcccgccggcactccggacgagcaccacgacgacgagaatcacccgttcctcggccaggcccggttcagcctcacccaggcgatgagctcgatgatggcgctcggcatcccgctggaggaggtggtgccgatggtgacgtcgcacccggccgagatgctgtgcatgggcgaccggatcggcgccctcaaggtcggctacgcggccgacgtctcggtgctgcacgacgatcgcggccgcttcctgctgcgcgacaacgaggacacgcgggtgatcgccgaccgcctgctgcgcccggccttctgcctccgcgcggggaagcgcttcgaggccgattcgccgatcctgccccaggcgatcgcggcctga

SEQ ID NO: 5002 - DNA, 882 bp, Methylobacterium sp.
atgaagcgcgtgcgggccggcgtcctggaggtcgcctatctcgagtccggtccggccgacgggccgacggcggtgctgctccacggtttcccctacgacgtccacgcctgcgcggccgcggccgcgcagctcgacgccgacggcgtgcgctgtctcgtgccgtacctgcgcggctacgggccgacgcggttcctggagcccgccacgccgcgctccggcgagcaggcggcgctcggggccgacctgctcgccttcctcgacgccctcggcgtcgggaacgccgtgctcgccggctacgattggggcggccgggccgcctgcgtggtggcggcgctctggccggaccgggcccggggcctcgtcagctgcggcgtcggctacaacatccagaacatcccggccgccgggcagccggtcgcgccggagaccgagcaccgcctctggtaccagtactatctccacggcgagcgcggccgcgccggcctcgccgagaaccgggacgccttctgccgcctgctctggcagctctggtcgccgacctgggccttcgacgcggagaccttcgcgcggaccgcccacgccttcgacaatcccgacttcgtcgacgtggtggtgcattcctaccgccaccgcttcggcctcgttccgagcgatccggcgctggtggcgatcgaggcgcggctggcggcccagccggcgatcgccgtgccgtcgatcgtcctgctcggcggcgatgacggcgtcgggccgccgcccgccacggataccgacgcccgccatttcaccggcccgtaccggcgtgagatcgtcgcgggggtcggccacaactttccccaggaggcgccggacgccttcgcggcggcgatacgcgccctgctgtga

SEQ ID NO: 5003 - DNA, 906 bp, Methylobacterium sp.
cccggcgccatgccgggcgtcctgaagcaggtcgaggccggcgtgctcgacgtcggctacgtcgaggccggtcccgccgacggaccggcggtcatcctgctgcacggctggccctacgacatccacgccttcgcggaggtcgttccgatcctcacggcggccgggcaccgggtgatcgtgccgtacctgcgcggctacggcaccacccgtttcctggcgtcggacacggtccggaacggcgagcaggcggcgctcgcggtggacgtcatcgccctgatggacgccctgaagatcccccaggccgtcctgggcggcttcgactggggcgcgcggacggccgacatcgtcgcggcgctgtggccggagcggtgccgggcgctggtggcggtcagcggctacctgatcggcaaccaggaggccggcaagaagccgctgccgccgcgggccgagctgtcctggtggtaccagttctacttcgccaccagccgggggcgggccggctacgaggcctaccgcgccgacttcgccaagctgatctggcagaccgcctcgccgcgctggcgcttcgacgacgccaccttcgcgcggagcgccccggccctcgacaacccggatcacgtcagcatcgtcatccacaattaccgctggcggatgggcctcgccgagggcgagcgccggtacgacgcgctggagagccgcctcgcgcaggcgcccacgatcggcgtgccgaccatcaccctggagggcgacgcgaacggcgcgccccacccggagcccgccagctacgcggccaagttcaccgggcgctacgcgcaccggctgatcaccggcgggatcggccacaacctcccgcaggaggccccgcgcgccttcgcgcaggccgtgatcgacgcggccgcggcctga

SEQ ID NO: 5004 - DNA, 816 bp, Methylobacterium sp.
atgcggacccacgatctgccgcgcgccgcgcgggcgcgcctcggccgctccggcctgttactcgccgtcggcctcgccctcgcgctggtcgcgcccgcccgggcgaacccgctcaccgaggtgccgggggcccggtcatcgcagccggacgaagcgcccccgccgcgggacccggccgcggagcgggcggagaccgaggaggcgcgggccgcaaatccgggtgcgaccgcgatcatccggtcgctcgcgcccttcgccgacggcaatccgggagcgcccgcgcggccgctggcgatcagccccgacgacggcggcccggcggtccgcgtcgttcccgcccggtcgatcgatctcaccgtgttcttcgcctacgacagcgcgcgcctgacccccgaagcgcgcatccagctcgaaccgctcggcgaggccctgcgcgccgagccgctcgcgggccacggcttcctgatcgccggtcacaccgacgcggccggcggccgcgcctacaatcgccgcctctccctggcccgggcccgggccgtgaaggcgcatctcgtcgagacctacggcatcgcgccggagcgcctgcgcgtccacggctggggacccgcgcggccgaaggatcccgacgcacccctgtcacgggtgaaccgcagggtggaggtcagcctgatcgcgccggcccgcagcggtgccctccgcttcgtcctgccggtcgcggatcgcacctgcaccgacctggccgatccgcgcctgcggacggatctcgacctcgacgatttcggcgcggcgccgaccccgcgtccctgtgccgaatga

SEQ ID NO: 5005 - DNA, 531 bp, Methylobacterium sp.
atgatgtcggaacactcagaagaccagggccgcctgacgaaggtcgccagcgcgatcttcctgcacaccgagcacgcgatctacgcggcgctcggcatcctgctggcgctcacggccctcgtggcgctgatcgaggccgccggcatgacctgggaggcgatgcgggcgctcggcggcgctcagcagatcctcgaggtgatcgaccggctgctgttcctgctgatgctgatcgagatcctgcacacggttcgggtctcgatgcggtcggggacgctgacctgcgagccgttcctgatcgtcgggctgatcgcctcgatccggcgggttctggtgatcaccctgcaatcgtcggagatcatgcacgccaaggactggtcgccggagaagcaggcgctgttccaggcctcgatgatcgagctcggcgtgctggcgggtctgatcctcacaatggtgttcgcgatcttcctgctgcaccgcgcccgcgacgacggcaggccggccggcgaggagaagcccgaacacgtgtcctga

SEQ ID NO: 5006 - DNA, 480 bp, Methylobacterium sp.
atgacgaagatcgcccagcttccggcgagggacgacctctacacgaccgatctctgcctctggactgaggagcaggcagccctgctccgggccgggcgctggccggatatagacagcgccaacgtcgccgaggagatcgagagcttgggcggatcccagaaatccgagatccggagccgtctcgccatcctgctgctgcacctgctgaagtgggaattccagccggagaagcggaaatacggctggcgcgcgaccatcctcgagcagcgcatccggatcgatgacctgatcgacgtgagtcccagccttcagtcctggccggatgcggtgctcgcgaaggcctattccgtcgctgtcctcggggccgcgagcgagacgggcctttccggatcggtctttccgaagtcctgtccctacacgatcgagcagatccgtgaactcggcttctatccgggcgcgccggagacggacgttgtctga

SEQ ID NO: 5007 - DNA, 390 bp, Methylobacterium sp.
atgacgaagcacaccatccgcaccgagaaggccgctccggcggtcgggccctacgcacaggggatccgggccggcgggctggtcttcgcctccggacagctgccgatcgatcccgccaccggcgcgttcccggacgggatcgaggcgcagacccggcggtccctcgccaacctcgccgccgtgctcgaggcgggcggcgccagcctcgcgagcgtcgtgaagacgaccgtgttcctcaaggacatggcggagttcgccgcgatgaacgcggtctacgccgagcacttcccgggcgaggccccggcccgctccacggtcgaggtcgcgcgcctgccgcgcgacgcccgggtcgagatcgaggcgatcgcgctcgccacggaggccgcatga

SEQ ID NO: 5008 - DNA, 594 bp, Methylobacterium sp.
atgacaaccgaggcgaccagcacgatgaccggcgagaccgcaccccgcatggtcgaggccttcgcgcacgcggccggatcggccgccgtccgggttccgggcggcgccgccggctgggtcggcagcctgacccacatccacatcgcccccgcggcgagctacgagatggaggaggtgtccgaggccgtgtgcgtggcaggccgcgggatcgagggcgaccgctacttcctcggcaccggcacctactcgcccaagcccgacgtgcgcgaggtcacgctgatcgagcaggaggccctcgacgccctcaaccgcaacgacccgccgctgcaggaggggccgctgcgcctcctgccgggggaccatcggcgcaacctcacggtgcgcggcgtgccgctcaaccacttggtcggccggcgcttccgggtcggcgcggtgatcctgcggggcgggcgcctcaacttcccctgccgctatctcgaggagctgctcggaatgccggtctacctgccgctctacaaccgctcgggcctgaactgcgggatcgagagcggcggcgtgatccggcccggcgatgcgatcgcgctgctggactga

SEQ ID NO: 5009 - DNA, 564 bp, Methylobacterium sp.
gtgagcacgaacgcgaaggagacgatcctggcggccgcgcggaagaccgcgcaggcgcacggctacggcgggttaagctaccgcgacctcgccgccgaggtcggcatcaaggcagcgagcatctaccaccacttcgccagcaaggcggacctcggcgcggccgtggcccggcgctactggaaggacatcgcggtcgagctcgacgccatgctggaggagaccggcgacccgatggaatgcctgcggctctacccgggcaccttccgccgctcgctggaggacgggaacaggctctgcctgtgcagcttcatgtcggccgagtacgccaacctgccggaggccgtgcagcgggaggcccagggtttcgccgacgtcaacgtcgcctggctcgccaaagtgctggtgatggccaaggcggtgaagcctggggaagcggaggcgcgcgcgcgggccatctttgccgcggtgtccggcgcccaactctacgcacggagccgctcggacgtctcgcagttcgacgacctgatcgagaactaccgcgcctcgggcctgctgccggcgtag

SEQ ID NO: 5010 - DNA, 921 bp, Methylobacterium sp.
cccgaggggatcgcccccaaggcgcccccgccgccgggcctcgccgtcgcggcgccgctgcccgacgtcatcccggcccgcaagcgccggggccgggtctggacctatgtccgccgcaacccgaccatcgtggtcggcggcgtgctgctcctcgtcgtcttcctgatggcggtgctggccccctggctcggcaccgtcgacccgaccgccctggcgcccgccaagcgcacccgggcgccgtcggcgcagtactggttcggcaccgacatgctcggccgcgacgtctactcgcgggtggtctacggggcccgggtctcgctgctggtcggcttctcggtagcgttcctcgcctcggtcgcggggctcgcggtcggcctcgtctccggcatggtgcgctggctcgacgggatcgtcatgcgggtcgttgacggcatgatgtcgatcccgccgatcctgctcgcggtcgcgctgatggcgctcacccgcggctcggtccagaacgtgatcatcgcgatcaccatcgcggagatcccgcgcgtcgcccgcctcgtacgcggcgtggtgctgtcgctgcgcgagcagccctacgtcgaggcggcggtgaccacgggcacccggatgccggcgatcatctggcgccacatcctgcccaacacgctggcgcccatgaccgtgcaggcgacctacatctgcgcctccgcgatgatcaccgaggcgatcctgtcgttcatcggcgcgggcgtgccgccctcgacgccgtcctggggcaacatcatggccgagggccgggccctctggcaggtgaagttctacatcatcctgttcccggccatcttcctctcgatgacggtgctcgccgtgaacctcgtcggcgacggcctgcgcgacgccctcgacccccgcatggcgaaagacgtctga

SEQ ID NO: 5011 - DNA, 951 bp, Methylobacterium sp.
atgaactggaccgattgggtacgcggccgctccatcggccggtcattccggacgggaccgctcgtcctcgccctcgcggcttgggcgctgccggcctcggccaccaccatcgcgttcctgacaccggcgggcgtcgcccggcgcctgcacgacggcctcgacgagcaggcccgcgcgcggggcgtagcgacgcacttcgcctacgcgcccgacggtgccgccgacgagcagatcgcgcaggcgcggcggctgatcgccgagaaagctgacgccctcgtggtcgtgccggtcgattcctcggcgcgcgaggagatcacccggctggccgtggaagccgacgtcccgctggtcctcatcgggcacggcgcacggaccgactggtttgccggacgcgtcacccaggtcgcgccgagcgatctcgtcgccgggcggctgcagatgcgcaagctcgcccagatgtcgggtgagaccgggcgcgtcgcgatcctagcgggcagcgccaccgatcccgtctcggcgctccgcagcaggggcgccagggaggtgctggcggagagcccgggcctccgcctcgtcgcggaggccgcgacggatgccagccgcgcgacggcgcgggccaccgtcgccgggtggctcgcccgaggcatcggcatcgacgcgatcgccgcaaccagcgacgagatggcgctcggcgccgccgaggcggtcgaggctgccgggattcccgcgggccggatccgcatcggtggggtggatgccaccgccgagggcatgcaagcgatgcaggagttgcgcctcgccgtgacgatcttccaggacgccagcgtccagagccgacgcgcggtcgacgacgccctggcgctgatccgtcgcgagccggttccgccctacgactggctcccgtccgagctgatcacggaccgcatgtcgaccacccacttctcgcgctag

SEQ ID NO: 5012 - DNA, 864 bp, Methylobacterium sp.
atgaccgcaccgttcccgccgccgacgcccgtcgtcaccgatgccgacttcgtccgcttccgcgacttcttctaccgcaagaccggcatcatgttcgccgacaacaagcgctacttcgtcgacaagcgcctgcaggagcggatgctcgcgagcgcgctgccggtcttccgcgactacttcaacaccctgcgattccaggccagcggccaggagttccagacgctcgtcaacctgatgaccgtcaacgagacctatttctaccgcgaggagtaccagttccgctgcctcgtccggtcgatcctgccggaggtcacccggcgcaagcggccgggcgagccggtgcggatctggtcggtgccctgctcgaccggcgaggagccctactcgatcgccttccagctcctcgacacgtggccggaggtcgaccggtacgacatcgagatcgtcgcctcggacatcgacaccgccgtcctcgaccaggccaagcgcggcctctacggcgaccgcgcggtccagcacgtcccccgggcgaccctggagcgctacacccggcgggcgcagggcgcccacgaggtgatccgggacatccgcgactcgatcgccttcgcgcaggtcaacctctcggacccgctctcgacccggcagttccgcggcttcgacgtcgtgttctgccgcaacctgctgatctacttcgacgacgcgtcccgccgcggcgccgcccagacgctctacgaggcgctcgatcccggcggcttcgtctgcctcggccattccgagtcgatgagccggatctccgcgctgttcgacctccggaagttcgcggaggcgatcgtctaccagaagcccctcaacgcggaggcctga

SEQ ID NO: 5013 - DNA, 282 bp, Methylobacterium sp.
ttgaccgtcgccgcgctggtgttcgccctcgcgagtcccgcgatcgtcgcgcaggcccagcaggacatcccgatccagcaggatctaaagcgcatggatcgcctcgatcaacggctcgggcgcgaggataccgagttgaaggtcgaccccaacgtgacgccggacaatccggacggtgtcgtcggcttcgacggacctccgttcaactacggggatccgggcgtgatgggtgacggccccctcccgccgggatcgcccgccgatgacgacgactggtactga

SEQ ID NO: 5014 - DNA, 288 bp, Methylobacterium sp.
atgcgtcagccggccgtctacatcatggcgagtcgccgcaacggcacgctctacacgggcgtgaccgcgaacctcgccaggcgggtctacgagcaccgggaggcgctactccagggattcaccagccgctacgattgcaagcgcctggtctggtacgagccatacccgaccatggccgaagccatcacccgcgagaagcagatcaaggcgggctcacggaagaagaagctcgcgctgatcgaggcgatgaatccggactggaacgacctgtatcccgatctcgcgtga

SEQ ID NO: 5015 - DNA, 2277 bp, Methylobacterium sp.
atggacgcgggcgcgctggaaaccgacgaccatctcggccgctcccacccccgggtcgagggccccgacaaggtcaccggccgggccctctacagctccgacctcaccggcccggatcggggcacggcccacgccgccctggtgaccagcaccatcgcccggggccggatcaccgggttcgaccttgaggccgccgagcgggtgccgggcatgctcggcatcttcacccaccgggacttcgcgggcgcggtccgaccggtgaagcacctgatggccggcgggtacgccaacagctcgcaccgtccgctcgattccgacaccgtcgcctatgccggccagatcgtggccctcgtggtcgccgagaccctgggcgccgccgaggcggcggcccatgcggtgaaggtcgcctacgcggaggagcccgccgccggcggcttcgacgcccccggggccgagaccgtgcgcctcgccgacctgaagccccaccacgcggacatcgcccggggcgatgccgaggcggggtttagggacgctgcgctccgcgtcgaggcgcgctacgcgacgccggtccagcaccacaacccgatcgagctgttcaccacccgggccgcctgggacggcgaaaggctcaccgtccacgagccgacccgctacgtcggcgccgtgcagcacgggctcgcggcgcagctcgggctcgatcccgcgcaggtgcgggtggtggcggggctgatcggcggccatttcggctcgaaattcgccctgtcgcagcacaccgcgctggtcgcgctcgcggcgcggcacctcggccggccggtctcgctggtgcccagccggcgacagtgcttcaccatcgccaattatcggccggaatcgcgccaccgcatccgactcggcgccgaccggacgggccggttcaccgccctggtgcacgaggccgagaccgtgacgtcgcgcttcgaccccttcgtcatggagggcgcggaggtgaccgcgagcctctacgcctgtccgaacatccgcaccgaggagcgggccatgcgggtcgaccgcaacacgccggggccgatgcgggcgcccccggaggtgccgttcctgttcgccctggagagcgccgtcgacgagatggcggtggccctcggcatggacccgatcgcgctgcgccgcctcaacgacacggcggtcgatccggtctccgggaaaccgttctcgacccggccgctgatggcctgcttcgacgccggcgcgaaggccttcaactggtcgcgccgggtaccgcgcccgggcgcgatgcgcgacgggccctggcgggtgggtctcggctgcgcgacttcggtgcggcccaccaagatcgcggccgcgaccctgcgggtccggctcggcccggacggcgccgcggaggtcgcctgcgcgcaccacgagatcggcaacggcatcaccacgctgctggcgatgggcgcggcggacggtctcggcgtgccggtggagcgggtcaccgtccggctcggcgacaccgacctgccggcggcggggatctcgggcgggtcgagcacgaccaccagcctgatgagcgccctggcgctcggctgccgccagatccgcgagagcctagcgcaggccgcgaccgggcagggcgggcgcctcgccggccgcgatccgggcagcctgcgcctcgcgggcgaccggctcgcggcgccggacgaggccgggatcgcgctcggcgaggtcgtcggcccggaaggcgtcgagacggtcgcggagttcgtacccgagggcggcgaccgggagaagacgctcgcgggcctgcggcagggccatatcgggctcgccctcggtgggggcgggaaggccgtctcctggggcttcggcgcgcagttcgccgaggtccacgtccacgccgagaccggggagatccgcgtcgcccggctcaccggcgccttcgcggcggggcgcatcctcaacccgctgaccgcgcggagccagctgacgggcgggatgatctggggcctcggctcggcgctgctcgaagagacggtggtggacggcgccgcctaccgcaacccggatctcgccgagtacctcgtccccacggcggccgacgcgccggaggtggaggcgctgctggtgcccgatcccgacgagcaggtcgatgcgctgggcctgaagggcctgggcgagctcgggatcatcggggtgaacgcggccatcgccaacgcgatccaccacgccaccggccgccggatgcgcagcctgccgatccggctggaggacgtggcgtga

SEQ ID NO: 5016 - DNA, 291 bp, Methylobacterium sp.
atgaccttccggacgacgcctcgggccgatgaggacatcgccgaggcctatgtgacgggggcgctgcgcttcggcgtgacccaggccgagcgttaccaggacggcctgttcgacgccttccgcatgctggccgcaacgccgcagatggcgcgcgagcggcgcgaattcacgccacccgtgcggctacatccctatcgagcccacgtcatcgtctacgtcgtggacggattcgccatcctcatcctgcgcgtgctgcacgggcgacaggactgggagcgggcgctgacgtag

SEQ ID NO: 5017 - DNA, 291 bp, Methylobacterium sp.
atgagtgactataccctcacggcgcgggctgaagcggatctgttcgacatcgccgtctgtggttaccggcagttcggtatccgccaagcggaagcctatgccgacgggttggaacgcgtcttccagcttcttgccgagaatccccgcatgggccggacagctgccgcgatccggcccggcgtgcatcggcacgaatacgccgcccacgtcatcctgtacgagccggtggaaggcggtgtcttgatcctggccatcgtccacggccgcagcgtgagggggctcgacctgtag

SEQ ID NO: 5018 - DNA, 219 bp, Methylobacterium sp.
gtgctgatcgcgctcgcgctctggatccaggcgctcgcgccggccgtcgcgctccggacggcgcaggcggatcggggcgcgctgcccggccagatcctgtgcgggcacgcgccgggtcaggccgatgacgcggccgtcggcccgggcgcgccggcgccgggggcctgcgccctctgcgggctgtgccgcgccggcgccgtcccgccgctgctcccgcag

SEQ ID NO: 5019 - DNA, 750 bp, Methylobacterium sp.
atgatcgccacgatccaggcgtggttccagcagctctacgagaccacgggcttcaacttcacggtcttctacgatccctacgactggggccggtacgtggccggcctgcggatgacactgctcctcgggatcagcacgatcctggcgagcctcgtcatcggcgccgtgggggcgctcctgcagagcgggccgtcgcgcgtcctgcgggcgctggtcaacggcttcgtggtggtgttccgcaacacgccgccgctcgtacagatcttcttcttctacttcggcctcgggacgctgcttccggacatcggctcggccgacggcctgcgcgcgccgatcctcaacaatgtccagtgggcgatcatctcgctgtcgctgttcgcgggcgcgttcaacgtcgagatcttccgctccggcatcgaggcggtgccgcggaccacggtcgaggccgccgaggccctgggctacacccgcttcaaggcctaccggtacgtcgtcctgccgctggccctgcgcgtctgcctgccggccctgaacaacaacctgatcaatctcctcaagaccaccacgctcgcctacgccatcgcggtcccggagacgctgtacgcggtcaagcagatctggtccgagtcgcagaacgtgctggagatgatgctggtgctgctggcgacctacgcggtcctcgtcggcgtcctcgtctggatcatgcaccgctgggagcgcgccctgcgcatcccgggatacggccgatga

SEQ ID NO: 5020 - DNA, 852 bp, Methylobacterium sp.
atgagcgccgccgatccgcggggcgggcgaccgggggatctgccggttctcctgcccttcgcgctcccgaaggaccgcgcggcggcgcgcctgcgcccggcccatctctggctgctcaccgggctcgccctcgtcgccgtcccggcctgggcgcagggcggggccgccgcgctgtcgccgctggaggtggtgatcaagtgggcgcccctcctgctcacgggcttcgccttcaacgtcgcgatctcgctgatggcgatggcgatcgggacggtggcgggcatcgggctcggtctggccatgctggcggagggccgggtcctgccccgcctcgcgtggtgcgccacgcaggtcttccgcaacgtgccctggctggtcctgctgttcttcgtgatgttcctggtcccgttccaggtcacggtgttcggcgtccgcgtgccgctgcccgactgggtcaaggcgaccttcggcttcagcttgccggtcatggccaacgtcgccgagatcgtccgcggtgcggtgcgctcggtgcccaacacccagtgggaggccgccgaatccctggccttcacccggcgccagacgatgtggcgcatcatcctgccccagtgcgcgaagcgcatgctgccgccctggatgaacgtctactcgctcatcgcgatggccaccgtgcaggcctccatcgtcggcgtcaccgagatgctgacgctgaccgcgcaggtgcacgccgccgagggcggccgccccgagctgttcgcgccgctctacggcttcgcgctgctctgcttcttcctctactgctacccgatcgaccggttcaccgccgccctggaacgccgcttcgagacccgctga

SEQ ID NO: 5021 - DNA, 780 bp, Methylobacterium sp.
atgacgcgcgcgaccctggccgccaccccgtccccgagctggacccccgatcagccgatcgtccgcgtcgtcgacgtgcacaaatccttcgggacgttcgaggtgctgaaggggatcagcttcgacgtccgcaagggcgaggtggtctgcatcatcggcccctcgggctcgggcaagtcgacgctgatccgctgcgtcaacgcgctggtgccggtgagcgcgggctcgatccaagtcgaggggatcgaggtgaccgatccgcggctcgacaagctggcgctgcgccgcaaggtcggcatggtgttccagcagtacaacctgttcccgcacaagaccgcgctgcagaacgtgatgatggcccccatccacgtcctcgggcaggagaagcgcgaggtcgaggcccgggcgcgggcgctcctcgccaaggtccggctggccggcaaggagaacgcctatccgggcgagctgtccggcggccagcagcagcgcgtggccatcgcccgctcgctggcgatgcggcccgacgtgatgctgttcgacgaggtcaccgccgcgctcgatccggagacggtcaaggaggtgctggtgacgatccgggaactcgccgaggagggcatgacctgcatgctcgtcacgcacgagatgaacttcgcccgcgacgtcgccgaccacatctacttcaccgaccgcggcgtgatcgtcgagcacgggccgcccgcgaccttcttcgcctccgcccaggacgagcgcacgcgccggttcctgtcgcaggtgctctga

SEQ ID NO: 5022 - DNA, 1122 bp, Methylobacterium sp.
atgatcgtgaaggacgaggcccacgttatccggcgctgcctcgattctgttcgtccgatcatcgatcattggatcgtcgtcgataccggctcgacggacggaacccaggatgtcgtccgcgccgcgctcgcggacataccgggtgccctggtcgagcgcccctgggtcgatttcgccttcaatcggaacgaggccctgaaactcgcccggcgtcacgcgcagtacgcgttgatcatcgacgccgacgatgagctgatcatcccgccggacttcacgatgccgaagctgcgtgcgcccggctatcggttcgagatcatcgacgcgcacacgcggtactggcgcaaccagctggtcagcacccgggagaactggcgctaccggggcgtcctgcacgaattcctcagctgccccggcgtgaccgagacaccgatcctccccctcgcgatgcgccggggcgacgacggtgcccgccaccgcgacgcgacggcggacgcgcgggatatcgccgttctcgagaaagcgctggcggtcgagacggaccccttcatgatcgcccggtacacgatgtacctcggcaccacctacgacgccgccggcgagtaccggaaagcgctcgcctgctttctgaagcgggccgatctcggtggatgggacgaggaggtctatttcaacctgctgatggccgcggtgaacgccgagcgcctcgacgagccggaggacagggtgctgcagctctacgagcgcgccaccgcaatccgcccggcgcgggcggaggcgcgccacggggccagtcgattctgcaggctgaggaagcggttcgcggaggggtatcgttacgccgaggcgggcttgaccctcgagcttccgagcgagggcatctccctgaacccgtgggtctacgagtacggtttgctcgacgagttcgccctcaacgcgtaccacagcggccaattcagcgcctgcggacatgcctgcctgaagatcctcgagcgggcgcatgtcccgcgggaggtcgccctacgcgccggcgccctggcccgggacgtgatggcgcagatgatcgatccggtctggggttgccggcacacgccctacgctctgccgttcgtgccgacgtggtga

SEQ ID NO: 5023 - DNA, 1053 bp, Methylobacterium sp.
gtgagcgcggccttgctcggcccgacgacgtcggcgcgggccgacgatgggccgagctacggcgatgaccgacgcggcatcttcctgcccttcctcaacgcgccgcgacccggcgacgccatcacgaagtcgccgcgcctcggcctgtcgttcggcggcgaggctcgtccggtgctcgtggataccggttcgaccggcatcgtagtttcagccgctcgaattcccggcaacgagagcctgccgagcgagcccggacggctgacctactcgagttccggccggatcatggtcggacgctgggtgcgcgtgccggtggctgtcgtcggccgcggcggggagagcgtggtcacgcagcccatccgggtcctcgccgtcgaccggatcgactgcaccgcgcgcgcccgcaactgcacgcccgaggtggcgccggcccacgtggcgatgatggggatcggtttcggccgggaggacgacagccagacgcagagcacgccggacaccaatccgctcctcaacgcggagccgccgggacccggtgcggtgcaccgcggctacgtgctgaccccacgcggcgtgcatgtcggcctgacgcgcgccaacacgcgcggccgctaccgcttcgtgaagctcgacccgcacccgaacgtgccgggcgactggctcggcgttcccgtctgcatcaccgtcgacggccgcgagcccgccgcctgcggccgggcgctcctcgacaccggcgtcaccggcatgttcctgacgctgccgccgtcccaggtcgccgacagcctccgggccgatgcgggcgatcacgccgtcctccgcccgggaacgcgcctgggcttccaattcggcgacgcggccggctacgcgatcgatgtcggcgaccgggccgcgccgctcgctcccgaacgcatcgtcctcaacacggtgcgcccgcagcccttcgtcaacacgggtctgcacgtgctgaacggcttcgacgtgctctacgacgccgaccgcggctattacggcttccgggcccgcgacgcgcagtcggcgtccgacgacccgtga

SEQ ID NO: 5024 - DNA, 534 bp, Methylobacterium sp.
atgccgctctacgccctcgacgagcacgtccccgacctcgccgacccggcccgggtctggatcgcgcccgacgcgcaggtgatcggccgggtgcatctcggcctcgatgtcggcatctggttcggcgcggccctgcgcggcgacaacgagccgatccgcatcggcgaccgcaccaacgtccaggaaggcgtgatcatgcacgtcgatcccggcttccccctcgtgatcgggaccgacgtcacgatcgggcacggcgcgatcgtgcacggctgcaccatcggggacggcagcctcgtcggcatgggggcgacggtcctgaacggggcccggatcggccgcggctgcctcgtcggcgccaacgcgctggtcaccgagggcaaggaattcccggatcacagcctgatcgtcggtgcgccggccaaggccgtgcgcaccctcgacgaggccgcgatcgagggtctgcggcaggccgccctgcgctacgtggagaacgcccggcgctaccgggccgggctgcgccggatcgacggctga

SEQ ID NO: 5025 - DNA, 417 bp, Methylobacterium sp.
atgcgtgacgaccgctccgcggcccgccgccgccccgcgctgcccgctatcgcgaagctcggcctcgcggcggcctgtgccctggggctggcggcctgcgtcaccccgcaggagcgccacgcgctggatcagaaccagtgctacgccttcggcttcgagcccggcaccgacgggttcgccgagtgcatgatggggctccaccagcagcgcgccgtcgcccagtccaacagcaacctgtactggcaggcgcagctcgccgagcagaaccgccgccgcgaggcccagcaggacctctacaaggtgatgagcctgcagcgcgccggcgacgcgcggttccccgtctgcggcgcctcctcggacggcggcatggatcgccggaccatgacttggtacggcccgaactgccgcgcccgctga

SEQ ID NO: 5026 - DNA, 435 bp, Methylobacterium sp.
atgctgcgcccccacgtcctgcacgcgaccgtattcgctgttgccctgatgacgccgagcctgtgccgggcggacaccgtccaggccgacgcgcagagcgccgcgagccagtgggacgcggcgtataacggcggcgacatggacgcgctggccaagctctacacgcccgacgcgatcgtcgtcacgaagggctcgccgcagaccagcgacggcatccagaagttcttcgccgggctgaaggcgaaggggtgggacgagcacaagacgacggtgaaatccgccctgccgaaggacaacctgctcatcgtgtccggccgctgggagatgaccggccccggggacgggggcgcgaagaagaagttcgagggcaactgggtgaacgtgctggagaagcgcgacggcgcctggcgcacggtcctgcacacttggaactga

SEQ ID NO: 5027 - DNA, 948 bp, Methylobacterium sp.
atgacggcccgcctgatcatgaagctgcgcgtcgccgacgcggtcgcgacgacgccggaggtgctgcacctcggtctggtccatcccgcgcgcccggaactccccgcctggacggccggcgcccatgtcgacctgcgcctgccggacgggcgggtgcggcagtactcgctgtgcggcgacccggccgaccggagccgctatgagatcgcgatcaagcgggaggcggccggccggggcggctcggcctgggcgcacgagacgctcgcgcccggggcgttcgcccacgtctcggcgccccgcaacaacttccccctcgaccccgaggcgcgccgccacctgctcgtggccggcgggatcggggtgacgcccctgctcgccatggcgcgcgcgctcgccgcgtcgggagcggagttcgcgttccacctctgcgccccctcccccgaggcggcgccgctgctggcagcggtgcgggcggtctgcgggccgcgcctccggtgctggttcgggtccgaggggcggcgcttcgaccccgacgccctcggcccggccgagaccgggacccacgcctacgcctgcgggccgcggcgcctcatggacgcggtccaggagggcctggtcgcgcggggctggcccgccgagcgggtgcacagcgagcatttcgagccgctgcgcgacgagggcttcgtaccggagccgttcgaggcgcgcatcgcctccaccgggcaggtgctccacgtgcccgccgaccggtcgctgctcgacgtgctgcgcggcgcggggcttgacctgccctcctcctgcgagctcggcgtctgcggcgcttgcgagtgcggctatcgcgacggcgcggtcctccaccgcgacgcggtcctgccgctcgccaagcgccggagccgcatgatgccctgcgtctcgcgtgcgcgggacgccgtgacgctcgagctctga

SEQ ID NO: 5028 - DNA, 279 bp, Methylobacterium sp.
ttggttcaggcggacggcgcgatggcgaagtggatacctggcgcggccgtcttcggtctcctgtgcctgatgatcatcccggcccccgggatctggggggtcctgatcggggccgcctgcgtgctcgccatcgtcggcagcctgtgcatgctcgtcctcgatcgggtggcgagcgccatcctcgtctggcgccagcgggtgcgggtgcgacgcccgagctcgggccggagccgcagccgggtggtccatgccggctccagggtgacccggaaggtctga

SEQ ID NO: 5029 - DNA, 1227 bp, Methylobacterium sp.
atgaccgagatctccaggcgcgccgtcatcgcagccgccggcggcgcgatggccgcgtcctccgccgcggcgcaaaccgccgggccggccccgcgcctccccgagcgcggcggcaagggcgccgacatcctgggcccgcagaaccggccccgcgccgccgaggagccgttcaccctggcgccgcccgccaccgaccacggcacgatgccgaacctgaaatggtccttcgcggacagccacatgcggctggaggagggcggctgggcgcgccagaccacgatccgcgagctgccggtctccaaggccatggccggggtcaacatgcggctcaaggccggcgctgtccgggagatgcattggcacaaggaatccgagtgggcctacatgatcaagggcaacgcccggatcaccgcggtcgaccaggacgggcgcaccttcgcggacgatgtcggcgcgggcgacctctggtacttcccgggcggcatcccgcactccatccaggggctcgccgccgacgggatcgacgggtgcgagttcctgctcgtcttcgacgacggcggtttctcggaggattccaccttcctgctgaccgactggctggcgcacacgccgacggacgtgctcgcgaagaatttcggtctgcccgagagcgccttcgccaaggttcctcagaaggaactctacatcttcccgggcccgaagcccggcccgctcgcggccgacaagatgggcggctccgggccggtgccgaagaccttcagccaccgcatgctggcgcaggagccggtccgcacccggggcggcagcgtgcgcatcaccgattccacggtgttcccggcttccgtgacgatcgcggcggccctggtcgaggtcgagcccgggggcctgcgcgagctgcactggcacccgaacagcgacgagtggcagtactacctctccggccagggccggatgacggtgttcggctcggaatcgaaggcccgcaccttcgactaccgggccggcgacgtcggctacgtgcccttcgccatggggcactacatcgagaataccggcgacacgaccctcacattcctggagatgttcaagagcccgcgctacgccgacatctccctgacgcagtggctggccctgactccgcaccccctggtccaggcccataccgggctggatcccgagcgcgtcgaggccctgccggagacgaagtcccccgttgtgccgggttga

SEQ ID NO: 5030 - DNA, 225 bp, Methylobacterium sp.
atgaagcgcgctcccttccgcatcctgatccgcatcgagggcgatcggcgcgtcctgcgcgcgacctcggagcgcgaggcggcgctcaaggccgaatccgttctccggcgctacgacgtcctgcccggcggcgccggcctcatcatcgaagcgtcggacacccgggcgagcgcgcgcatcgcggcctatctggccgacgttgcgctcgagatggaaatcgcgtga

SEQ ID NO: 5031 - DNA, 1482 bp, Methylobacterium sp.
gtgaagacctaccagctctacatcgacgggcagtccgtcgatccggtcgagggctcgtggttcgagtccatcgacccctatcgcggcgcgccctgggcccggatcccgcgcgcggggcgcgtcgacgtcgaccgggcggtggccgccgccaagcgcgccatgtgggacggtccttgggggaccatgacggcctcggcccgcggcaaagtcctgcgccggatcggcgacctcgtcgagcgcgaggccaaggcgctggccgaggtcgaagtccgcgacaacggcaagctgttcgccgagatgtacggccagacccgctaccagccggaatggtggtggtactacgcggggctcgccgacaaggtcgagggcgcccaggtgccgatcgacaagcccgagaccttcgcgttcacgcggcacgagccggtcggcgtggtcggggcgctgacggcgtggaactcgccgctcctgttcgtcgcctggaaatgcgcccccgcgctcgcggccggttgcgcggtcgtggtgaagccctccgagttcgcctccgcgagcacgctggaattcgcccgcctgaccaaggaagcggggctgcccgacggcatgttcaacgtcgtcaccggtttcggcggcgaggccggcaccgccatcgtcgagcatcccgacgtcgccaagatcaccttcactggctccgacgtcaccggcgcgaaggtctacgaggcggccgcgcggcagatcaagcgcgtctccctggagctcggcggcaagtcgcccaacatcgtcttcgccgatgccgacctgaaggcggccgccgcgggggcgatctcgggcatcttcgcggccaccgggcagacctgcatcgccggctcgcgcctcctggtccagaacagcatccgccaggaattcacagagcgcctggtcgagctcgctcgcaccgccaagctcggcgacccgatgcaggccgacaccaatatcgggccgatcacgacgccgccccagtacacgaaggttctcgactacatcgcgctcgccaagagcgagggcgcgcgctgcgtgttcggcggcaaccccgcctccggtcccggcgtcctcggcggccagttcgtcgagccgaccatcttcaccggcgtcaccaacgacatgcgcatcgcccaggaggaggtgttcggcccggtgctgtcgatcatcggcttcgaggacgaggccgaggccctgagggtcggcaacgacgtgatctacgggctcgcggccggcgtctggacccaggatatcggccgcgcaatgcgcatgtcgaaggggctgcgggccggcaccgtctgggtgaacacctaccgggcggtgagctacatgatgccgttcggcggcatgaagcgctcgggcatcggccgcgagagcggcatcgagtcgatccgcgagtacttggagaccaagagcgtgtggatctccacgagccgcgacgcgccggagaaccccttcgtcatgcggtga

SEQ ID NO: 5032 - DNA, 537 bp, Methylobacterium sp.
atgacgaccgtcgatcaggccaagaccatggccaagcggctgcgcgccgcgctggcagcccgcgacctcgccgtcccgcacgcggccgccctcgaactcgtcgccgccgggctgggctacgacgactggaacaccgcctgcgccgtcctggaccgggacgcggatgacggcccccgcttcctggaggcggtgccggttctgcgcatcttcgacgaggccaaggcgcgcgcgttctactgcggctttctcggcttcacgcccgggttcgagcaccggttcgagccgggtctgccgctctacatggaggtcgcccgcgcgggattgcggttgcacctgaccgagcaccacggcgacgccacccccggctcgaccgtgttcgtgccgatgcgcggcatccgggcctatcaccgggcgctcaccgaccagcgctacggctatgcccggcccggcatcgagcaggcgccctggggcgaggtgctggaggtggcggatccgttcgggaaccggttgcgattctgcgagcgccggaccgcgtga

SEQ ID NO: 5033 - DNA, 1080 bp, Methylobacterium sp.
atgacgaagacctacaccatcgcggccatccccgcggacggcatcggcgtcgaggtcatcgccgccggcatcgaggtgctcgacgtgctggccgagaagaccggctccttcgccttccggttcgaccatttcgattggggatcggactactacaagaggcacggtgcgatgatgccggccgacggccgcgagcagatccggaaccacgacgcgatcttcttcggcgcggtcggggcgccggacgtgcccgaccacatcaccctctggggcctgcggctcgcgatctgccagcccttcgaccagtacgccaatgtccgcccgacccggatcctgccgggcatcaccagcccgctgcgcaacgtctcgggtccggagctcgactgggtgatcgtgcgcgagaactcggagggtgagtacgccggcgtcggcggccgggtccaccaggggcatcccaacgaggtcgccaccgacgtctcgatgatgacccgctcgggagtcgaccggatcatccgctacgcgttcgagctcgcccgctcccgtccgcgcaagctgctcaccgtcgtcaccaagtcgaacgcccagcgccacgccatggtgatgtgggacgagatcgccgccgcggtcgcgaaggacttcccggacgtgacctgggacaagatgctggtcgacgccatgacgatgcggatggtgacgaagcccgagaccctcgacacgatcgtggcgacgaacctgcacgccgacatcctgtcggacctcgcggcggcgctcgccgggtcgctcggcatcgcgccgaccgccaacatcaacccggagcggacctatccgtcgatgttcgagccgatccacggctcggccttcgacattgccggcaagggcatcgccaacccggtcgcgaccttctggacggcgtgccagatgctggagcacctcggcgagaagccggcggccgatcggctgatgcgcgcggtggagcgggtcaccgcggatccgagcctgcacacgccggacctcggcggcacggcgacgacccgtcaggtcaccgacgctgtcatcgcggcgatccggggcgacaacgcctga

SEQ ID NO: 5034 - DNA, 333 bp, Methylobacterium sp.
atggccgaaaggcggaaggccaccgggtccggcgaggatagcctgtcgcgccacatcctgcccaatgccggcacgatggtcggcgtctgcaccacgctgatcggcctcgtgaagatcgccgagggctggatcgggccgagccacgtcgacgaggccgccgccctgacggcgatcctgttcctggtcagcgcgatcgcgtcctacctgtcgatccgtctggacgacggcggcgatctctcggttaccctggagcgctgcgccgacatctgcttcgtcatcgggctgatcggcctgacgctgatctcggtcctgttcgcctacgagacgatctga

SEQ ID NO: 5035 - DNA, 234 bp, Methylobacterium sp.
atggcgttcgatcgcgaagatacgctgttctacgtggtggtgaatcacgaggagcaatactcgatctggccgagctaccgcgacatccctgacgggtggcgcgccgtgggcgatccgcgcgcgaaggccgattgcctggcccatatcgacgaggtctggaccgacatgcggcccctgagcctgcgccgacacatggaggcacaggagcgggacgcgggcggcgcgcgggcgtga

SEQ ID NO: 5036 - DNA, 1929 bp, Methylobacterium sp.
atggccctcgtgaagaaagccgccctgtcgggatcgcacgcgcaggtccggaagggcgagcaggccagtctgagccatctcgggcgcctcaacgaggagagccggcgcaaggcccggaccttcgccaagcagcagaaggcggcggagcgcatcgcggcggcgaccacccagctcgccagcggcgtcgccgaggcctcgtcggcggccgaggagttgcgcaaggcgatggagcagatcgccgccggcgccgaggaggcggccggggcctccgagcagtcgcagcgcgccgtcacgaccgtgtcggaggcgatcggcaccgcccgcaccgaggccgagacctcgcgccagaaatcggagtcgctccaggggctcatcgccggcgtcagccagcagatccggctcagcgtcggctcgatcgccacggctgcggagcgtcaggcggcctcggtcacgctgatcgtcgagctggagcggcaggcggccaatatcggcgacatcgtccgcgccgtcgcccgcatcgccgaccagaccaatctcctggccctgaacgccgccatcgaggcggcccgcgccggccagcacggcaagggcttcgcggtggtcgccgacgaggtccgcaccctggcggagacctccgagcgcagcgcccaggagatccaggcgctgatcggccggatccaggaagacgtgaaggtcatcgccgagggcatcaaccgcgcggccgagggcgcgcgccaggaggtcgcgcggggcgagacgatcaccgcccagctcgaggcggtgcgccaggccatggtcgagatcatgcgcggcgccgagaccatcgcccgggtggccgtcgagtccgagagggccgcggtcgaggcgcagaaggggtccgagctgatcgcggcggcggccgaggcgcaatcctccgcctgccagcaatcgctcaagaccatcgagcagcagaccaccgccctcggggagagcgagcaggccgcgaccgagctcgcgaccctggcggacgagctgaagaacgccaccgacgtcggcaagagcgccgaggaggtcgcctcggcggccgaggagctatcctcggcggtggaggagatcaaccgggccgccgcgcagatcaccacggcgctcgaccagatcgaccggggcgcccagcagcagacggcggccgcgcagcagtcggcggccgcgatcgcgcagatcgagaagggggcgctgctcgcccaggacagcgcccgcgacgccctggagaagggcggcctgatcacgagccagcttcaggagaaccgggccgcggtggacgggctggtcgcgggcgtcggcaacgccctcgcggagaccgaccggagccgcgagcagatcaacgccctggagcaggtgagccggaagatcgacaagatcgtcgacgcgatcaccacggtggcgatccagaccaacatgctggcggtgaacggctcgatcgaggcggcccgggccggcgagttcggcaagggcttcatggtggtctccaccgacatccgcaacctcgcccgggattcctcggagaacgcggagcagatcaaggacctcgtgaaggcgatccaggaccagatcgtggtggtgcgccgagacctggaggcgatctccgcggcggccgccgccgaggtcgagaagaaccgggcgatcacccgcgacctcgagaccaccgccgacgacatgggcgcggtgctcgacggcaaccggcagatcctccagggcgccgacctgatcatccgtaacgtcgaggaggcgaggcgcggcgtcgaccagatcgccacggcggcccgccagggcggccaggcggtgaacgaggcgcagcaggccgcccgcgagcaggcgaacggcgcggaggaactcgccgccgccatcgaggaggtcgcgtcgctggccgacgaactccagaatcaggactga

SEQ ID NO: 5037 - DNA, 510 bp, Methylobacterium sp.
atgcgggtgctgctgagcccctccccggcgacggcgccgcacgtcctgatgagcgcggacgcggtgggcggcgtctggcagtacagcctcgacctcgccgccggcctcgtgcggcggggcttggccgtgaccgtcgcggtcttgggacccgcgcccgccgacgcgcggatctcggcggccgagagggacaccggcgcccgcatcgtcgccaccggcctgcccctcgactggaccgccgggacgccggacgccgtgctcgacgccgcgcgggcgctggcggacctcgcccgcgcctgcggggccgaccgcgtgcacctgcacagccccgccctggccctggcggcgtttcccgtgccggtggccgccgtgtgccattcctgcgtggcgacgtggtgggacgccgtcgagaccgggccattgccggccgacctcgcgtggcgccacgacctcaccgtgcgcggctgccgcgccgccgacgccctcctcgcccccacccgcgcgcacgccctg

SEQ ID NO: 5038 - DNA, 648 bp, Methylobacterium sp.
ccgcagacccgcgcgcacgccctcgccaccgcccgggtctgcggcctcgcgcggccgcccgtcgtggtccgcaacgggcgcgacccgagcggcctgccgccccgggccgccgcccccgtcgccttcacggccggccgcctctgggaccgggcgaagaacgccgccgccctcgaccgcctcgcggcccgcctgtccgtgcacctgcgcgccgccggctccgtcgacgggccgaacggcgcccgggtcgagacgcgccacctgcagcgtctcgggcggctcgacgacgcgggcatcgccgccgaactcgccggccggccggtcttcgtctcgctcgcccgctacgagcccttcggcctcgccgttctggaggccgccgcggccggctgcgccctggtgctctccgacatcccgagctttcgcgagttgtgggacggcgccgccgccttcgtggacgcggacgacgacgaagcggcggccggtgccgtgcgggtcctcctcgacgatcccgtccggcgtgaggccgccggccaggccgccgcgacgcgcgccgcccgctacggcgtcgcgccgatggtcgagggcgtgctcggcgtcctgcgcggcctcggcgcccgggcgccggtccggctcgggggagctgccgcatga

SEQ ID NO: 5039 - DNA, 1434 bp, Methylobacterium sp.
gccccccccgccctggcgggactggccaacctgcgcggctcggtcctgccggtggcgagcctgcggcggctgttcgatctgcccgatcgggtccacgacgacgccacccgggtggtcgtggtcggccagggggccggccagggcggcggccccggcgggacctccggcttcgtggtggaccggatggcgagcgtgatcaccgtcgagcccggagagatcgaggggaccgacggcctcaccgccaccgcggcgacagagctgctggcgggcgtgatcaagcggccggccggcatggtgctgatcatcgatctcgggcgcctgctgcagcgcagcgggtccgggcgcgccggcgcagagggcggatcgggcgggtcggccggacggaacgcggtcggaccggtcgaggccggcggcgcggcctcggcgcggccggagggcgaggtcgggctctccgacgagatccagctcgtgtccttcgagctcgcgggccaggaatacgccctgccgatcgagcaggtgcaggagatcgtccaggtccccgaccgcgtcagcgagctgccgaaggccgagcgccacgtcatcggcgtgatcaacctgcgcgaccggctgctgcccctggtcagcctgcgggcgctgttcgggctccccggcgtgcccctgggtgagcagaaccggatcgtggtggtcgcctcccgggaatccgccggctccgtcggcatcgtcaccgacacggtgaaggaggtgctgcgggtgccccgcgcggtggtcgatccgctgcccgacctgctcgcgcagggcgacgcgctgcgcgaggtcgaggcgatctgccggctcggcggcggcaagcggctggtctcgatcctgtcggccgtccgcctgttcgccaccaccgggatcgccggcggcctcgccggcctcggagccgcagaggagggacccgtgcaggaacgtcagatcgcgaccgcgccgacgcgcgccgacgaggaggaacagttcgtcgtcttccgcctggcggacgaggagtacggcgtgccgatcgacgccgtgcacgagatcgtccgcgtccccgagcagctcacccacgtgcctcggacgcccggcttcatcgagggcatcgtcaatctacggggagcggtgctgccggtggtcgaccagcgccgccgcttccggctcccggaggccgcgcgcaatgaccgccagcgcatcatggtcttcgcgatcgcaggggtgcggaccggcttcatcgtcgactcggtctctgaggtcctgaagatcccccgttcggccatcgtgccggcgccggacctcgcgcaggacgacgacagcgccgtggagcgggtcgccaacctcgccgccgccaagcggatcatcctgatggtgaacgtcgaccggctcctcagccggcacgaggtcgcggatctgcgggcggcctga

SEQ ID NO: 5040 - DNA, 291 bp, Methylobacterium sp.
ttggccgaggcgcccggccggatccgccgcctgagtgccgacaagggctacgacgccgattggctgcgcaccgacctgcgcaggaacggcatcacgcccgtcatcccgggcaaacgcggccgcaaacgccggatccgccatgacaggtcccgctatcgggagcgctggcgcatcgaggcgatgttcaaccgcctcaaagacttccgtcgcatcgctacacgctacgacaagctcgcccgcaactacgcctcagccatcgctctggtcgccgtcgtcgcgttctggtgctga

SEQ ID NO: 5041 - DNA, 189 bp, Methylobacterium sp.
ttggccgaagcgcctggtcggatccagcgtctggccgccgacaagggctacgatgccgactggctgcgcgctgacctgcgcaagagcggcatcacgccggtcatcccgggcaagcgcggccgcaagcggaagatccgccatgacaggccccgctatcgggagcgctggcggatcgaggcgaccttcaac

SEQ ID NO: 5042 - DNA, 606 bp, Methylobacterium sp.
gcgccgccgccggtgttcacgccggtgccggtgttcacctggaccggcttctacttcggtgtgaacgccggctacggcttcgacgccaacagccgcaacaccaccaactacgctctgcccggcggctcgctgatcaactcccccggcaccgccggcgtcgtcagcgtcaacaaccgcagcaacaacgacggcttctcgggcggcgcccagatcggctacaactaccagttcaccccgggctccggcgtcgtgatcggcttcgaggccgacgcccagtacgtcgacttcgcccgtcgcgccaacggcacccagaactacgccttcggcggcgccccgggcatcgcgttcgccgccccgcgcgccttcgtcgccaccagcggcaacggcctggactacttcggcaccgtgcgcggccgcctcggctacgccttcgaccgcaccctcgtgtacggcaccggcggcttcgcctacggctcgggcagcgccgaccgctccttcggcggcttcgccggcaacgacagcttccgcaccggctgggccgccggcggcggcgtcgagtacgccctgcccaccgactcgttcctgaacttcttccgctcctcggcc

SEQ ID NO: 5043 - DNA, 1665 bp, Methylobacterium sp.
atgaacttcgtccatcgctacctcggcgagagccgggccgtctcggacgcggacgcgacccggctcggcttcgtccccgacaccctgcgcgagccgacctacttcgccgggacagtggcgcggcatctgccgttccgggaggcgatctccgccctgcaccacgtcgtcgtgtcggacctgcgcttcaagccgaaggaccgcaccgcctacttcgcgtggctccaggcccacgagcaggagctcctggccgaggccctcgccgagaaggacagcctgcgcgccgagatcgaggcgctgcgcgccgagtcccgggacatcgcggcgcgctccgacgcggtgatgcggtcgttctacgacgcgcggaagcggtacttcgactatctctaccgggagaacctcgacgcctggatcgtgctcgacccggtcatcacggtccatccggacgagatcttcttcgaggcgttcagcctcgacgaatcgagctacgggcgcctgtcctgcgaccacgacacgttcgcgcgcatcggcgacatggcctgcggtacgaccaacatcgactacagccacgccctctacgacgaattccagaagatccgcagctaccgcgacaccgagctggcgatcgacccgaccggcttcgcggtccagacctccggcgaggccgcctaccgcgaggacaagatcgacctgcccgattcctggatgcggggcttcctgcaggtgtcgagcgccatggcgcagcccgcccacgtggtggacctgcacccggtcgacatgcacgcgatcctgacccgcctcgccgcgcgccgggagcgccacggcccgcgctccctgcggttcctgctcgagcccggccggccggtcagcgtgctgatcgagccctggaacgagcggctgaccttccggcgctcgatctaccgcgggggcgagacggcggagatccgcctgtggggccggcggcgcctcgcgatcctggcccggaccctgccgctcgcccggtcggtgcggctgcacctcctcggcaccgggctccccgccttcgcggtggtggatttcggcggcctgcgcttcaccctcggcctgtcgggctggaccgccaacgactggtcccgggccgggcagttcgacctgctcgcgccccgggccgacgtcgatgccgacaccgccgcccgggtcttcgcggcgctccggcgccaccacgccgccgacaccgggcaactcgccgccgagaccggcctcgaccggtcgaccgtggaggcggcgctcggcggctacgtgcaggcgggccgcgccatgttcgacctcgacaagcgggtctaccgcctgcgggagctgacccgggagccgctggcgccgggcgccctgcgcttcgcctccgagcaggaggccaaggccgaccggttcctggcggccggactggtcaccctcgggcccgtcgagcaggccggcgacaggcggcgcctgagcgggaccgtgctggacgacggccggagcctgacgcccgcggtggagctcgattccgacgaccgcatggtcggtggcagctgccagtgcgggttctacacccacaaccggctgacccgcggcccctgcgagcacatgctggccgtgcgccgcctcgtccacgcccaggtcgagggcaagccggtgcggtggcaggcgtga

SEQ ID NO: 5044 - DNA, 1122 bp, Methylobacterium sp.
atgcgcaacaacatccccgccaccgtcgggatgccggtcgaggaggtggacaccccctgcctgctggtcgacctcgacgccctcgagcgcaacgtcgacacgctcggacgcttcatgaaggcgcacggcctgcgccaccgggcgcacgccaagacccacaagtcgtccgacatcacggtcctgcagatcgagcggggcggggcctgcggcgtctgctgccagaaggtcagcgaggccgaggcgctggtgagcgccggcatccgcgacgtgctggtctccaaccaggtggtggcgccgaagaagatcgagcgcctcgcggcgctcgccacccgcgcgcgggtgctggtctgcgtcgacgacctcggcaatgtcgacgacctctcggcggcggcggtccggtacggcgtcaccctcgagtgcctcgtggagatcgacgtcggcgccggccgctgcggcgtcgcgccgggcgagcccgccgtggcgatcgcgaagaagatcgccacggcgccgggcctgcgtttcgcgggcctgcaggcctaccagggcaaggcccagcacgtgcgcgatttcggcgagcggaaggccctgatccagacggcgatcgacgagacgaagcgcaccgtcgacctgctcaagaccgaggggctcgactgcgccatcgtggcgggggccggcaccggcagcttcgccatggagggcggcagcggcgtctacaacgagctgcaatgcggctcctacgtcttcatggacgcggactaccagcgggtgaaggacgcggacgggcggccgatcgcggagttcgagaacagcctgttcatctacacggcgatcatgagcaaggcgaaggcggacgtcgcgatctgcgatgcgggcctgaaggcgcagagcatcgacagcggcctgccggtggtcttcggccgggacgacgtcgagtacgtcaagtgctcggacgagcacggggtgatcagcgatcccggcaacgtgttgaagctcaacgagcgcctgaaactgatccccggccattgcgacccgacggtcaacgtctacgactggtacgtgggcgtgcggaacggccgcgtcgaggcgatctggccggtcaccgcccgcggcatgacgttgtaa

SEQ ID NO: 5045 - DNA, 1173 bp, Methylobacterium sp.
atgaacgcccggcacatgaatgcccggaccgccgatctcgaagtcggcttcgacgtccctgcgctgcccggcatgcgcgaggacgagatccagacgccctgcctgatcgtcgatctcgacgcgctggaaggcaacatccgcaagatgggcgactacgccaaggcgcacgggatgcgccaccgcgcccacggcaagatgcacaagtccgtcgacatcctgaagctccagcagagcctcggcggtgcctgcggggtctgctgccagaaggtctcggaggcggaggtcttcgcccgcgcgggcatcaaggatatcctggtctcgaaccaggtgcgcgaccctggcaagatcgaccggctggcgcggctgccgctgcacggcgcccgcatcatcgtctgcctcgacgacgtggcgaacgtcgccgacctctcggcggcggcgcagcgatacggcacgcggctcgactgcttcgtcgagatcgattgcggcgccggccgctgcggcgtgaggacggcgcccgaggtggtggcgatcgcccaggccgtcgcggccgcgccgaacctgcgcttcgcgggcctccaggcctaccagggcgccatgcagcacatcgacggctacgaggagcggcgggccaagctcgacgcggccatcgcccaggtgcgcgaggccgtcgaggcgctgatccgggagggcctggagccggaactggtcagcggcggcggcaccggcagctactatttcgaggccggatccggcgtctacaacgagctgcaatgcggcagctacgcgttcatggacgccgattacgggcgcatccgcgaccgggacggcaaccgcatcgacgcgggcgagtggaagaacgccctgttcatcctcaccagcgtgatgagccacgccaaggccgacaaggcgatctgcgacgcgggcctgaaggtgcagtcggtcgattccggcctgcccttcgtcttcggccgcgacgacgtgaaatacatcaagtgctcggacgagcacggggtgatcgaggaccccgagggccggctgaaggtcaacgaccgtctgcgcctcgtccccggccactgcgatccgacctgcaacgtccacgactggtacgtcggcgtccgcaacggccgggtcgagacgctctggccggtctcggcccgcggcaaggcctactga

SEQ ID NO: 5046 - DNA, 696 bp, Methylobacterium sp.
atgacgcagggtcctgcactctccgagatcggcgcgctcgtcggagatcccagccgcgccaacatcctgtcgaccttgatcgacgggcgagcgctgaccgcgaccgaactggcctggacggccggcgtcgctccagccaccgcgagcgagcacctgacgaagctcgtggcgggcggcctgctcacggtgtcgcgccaaggtcggcaccgatacttccgcctcgcctccgtcgaggtcgcccgcatgctcgaggccatgatggtgatcgcgaaccgggccgagccggagggagcatcgcgccgagcgacgccgcggatcgatccagccttgcgcgaggcccgcacctgctacgatcacctcgccggacggctcggcgtcgggatcgccgatgcactggtctcacggggaccgatcgtcctgggtgaggaagcgggtgaagtgaccgcatccggcagcgcgtggctggccgcgttcggtgtcgaggtcgaaccggccggacgaacgcgccgcctgctctgccgcccctgcttggattggagcgagcggagaccgcacctcgccggccgtctcggagccgccctgtgccgccgctgcgaggatctcgggtggatcgagcgtcagcgcgacgggcgcgccatccgcgtgaccgagacgggaagactcggcttcgagagcgagttcggcttggtcgcgtga

SEQ ID NO: 5047 - DNA, 393 bp, Methylobacterium sp.
atgcctctgacccgcatctccctgcgtgccgggacgaccgagacctaccgggccgctctcgtggcgggtgtctacgacgccatgcgcgagaccttcgcggtgccggagggcgacctgttcgccctggtgcaccagcacgacgcgtcggacttcgcctacggtcccgactatctcgggatccggcgcagcgaccgcctcgtgatcgtccagatcaccgccaacgcgacgcggggcaccgcgcagaagcgcgccctctacgccgccgtgacccgcaacctcgcccgcgatcccggcgtggcgccgggggacgtcttcatcaacctcgtcgaggtcaacccggagaactggtcgttcggggagggactgatgcagtacggcccgcccgagccgtga

SEQ ID NO: 5048 - DNA, 1050 bp, Methylobacterium sp.
gtgagcccgctggcgctcgggaccatgaccttcggcgccgcccgctggggcagcgacgcgacggtctcggcggccatcttcgaccgttacgtcgaggcgggcggcaacttcctcgatacggccgatgtctacgcgggcggcgcgagcgagacgatgctcggggacctgatcacggcgcgcggtctgcgcgaccgcttggtcgtcgcgacgaagtccggctttccgcgcgcccagggcacgccgctggccggaggcaacagcgcgaggaacatccgctccggtctcgagagctccctgcgccgtctcaagactgattggatcgacctgtactggacccatgtctgggaccggaccaccccgccggaggaggtcctccgggcgctgaccgacgccgtcgcgcgcggcgacatcctgtattacggattctcgaacgcgcccgcctggtacgccgcgcagatcgccgcgctggcccgcgcccacggcctcccggaacccatcggcctgcaatacgcctactcgctgctcgaccggggcgtggaactcgatgtgctgcccgcgggccgcgccctcgggctcggattgatgccctggagcccgctggcggccggactgctgaccggcaagtacgggcgcgagaagctcgctcaagccgggccggcaggctcgctcccggaccgggcaggcgacgcggccgagggcggcagcgacagccggctcaacggcgacaaccccttcggcggcatgctgttcaccgaggcgaatttcgcggtcgtggacgtgctgcgggcggtcgccgcggacgtcggccgaccgatggcgcaggtggcgctggcctgggtcgcgcggcgccccggcgtcgcctcggtcctggtcggggcgagccgcccggagcagctggcgcagaacatcgccgccctcgaggtcgtcctgacttccgagcagcaggcccggctggatgaggccgcggctccgccgcagctcaatccctacttcatcttcgagttgccgacttcgcgcatcttcggcggtgaacgggtcgaggcgtggtag

SEQ ID NO: 5049 - DNA, 225 bp, Methylobacterium sp.
atgaggatgttgtcgatgcggggcgccgcgctgattttcgggacccttctcgtcatcgcgaccttcgtgtggttcatgtacttcgtccccctgggatgtgtgatgaacacgacgggctgccgggagaccttctcggtctggagcggcctcggcctggtccatttctggtcgccgctcctggtcgcgggcgcggcgatgcttttcggattgtccggctccaggtag

SEQ ID NO: 5050 - DNA, 243 bp, Methylobacterium sp.
atgacgcgtggagcgatcatcggcctggtcgcgccgttcatctgcatccatgcggcgctggcagcggcgttcacggggacgggcggcggccctgagaccacgatcaacgcgccgtaccgctcgtcggtggggcagacggtgccgcccggcgcgggggccgcgccgctgcacgatccgcgcgaacggacgcgacggcagaaggacctcgacgcggtcctcggcagcgtctgcgacaagtgctga

SEQ ID NO: 5051 - DNA, 450 bp, Methylobacterium sp.
atgcgcagggctgcccccgaccccgcgatcgaggcgaagcggcgcgggccgcccccgcaggacgtcgatcccgcgatcgaggcgctggtgaacgacatcatcggccaagtggccgacaagtggaccatgctgatcctcgaggccctggaggagcacggcaccctgcggttcacgcagctcggccgggccgtgggccggatcagccagaagatgctgacgcagactgtccgccagatggagcgggacggcctcgtccggcggacggtccacccggtgatcccgccgcgcgtggactacacgctgacgccgctgggccggagcctgggcgccgccttctgcggcgtgtggatctgggccgagacgcaccacgccgagatcgagcgggcccggcgggcattcgcagcggcggccgaagctccggatcctcccgccgatgccgaggcaccgtga

SEQ ID NO: 5052 - DNA, 354 bp, Methylobacterium sp.
atggcgggcatcacaacacacgtcctcgacaccgatcgcggccgccccgccgcgggggtccggatcgacttctccgtcctcgagaacggccagtggcggctcgtgaagagcgtcgtcaccaacgccgacggccggaccgacgcgccgatcctcccggccgacagggccgagaccggccaataccagctggagttcttcgtcgacgcgtatttccagggccgcgccggcaccgcggaggccgacatcttcatcgacaacccggtcgtgcggttcgccgtcttcgacgccaagcagcactaccacgtgccgatgctgtgcgccccgtcgagcttcaccacctatcgcggaagctga

SEQ ID NO: 5053 - DNA, 567 bp, Methylobacterium sp.
ttggaacacggacccgatcgacacgctctgacgcggcgcggcctcgtcgcgacggggctcggcgccgcggccgcggtctccgcgggcccgacgctggcgcagggcacgcccgctccggcggcggctccggccaatgctccggcggcggctccggccggtgccccgaccaagcccggcacgctgaacaccgcgccggtgtcgcaggccggcctctcgccgcggctgaccctgcacgccatcgacaatttccacggcacgcccggcgccgggatggtctgcgacctcgcgatgcacgacggcaccggctaccggccgatccggacggtcaccaccgcgccgaacggccggaccgccgagccgctcctggtcgacgaggccttcaaggcgggccgctacgagctggtgctgcacctcgaggcgtatttcgcgaacctgggcgtgaagctcccgaccccgaacttcctcggcctcgtgccgatccggttccggatccgcgacgcgagccagcgccaccacctgccggtgctgttcacgccctggggctattcctactaccgcggcagctga

SEQ ID NO: 5054 - DNA, 2094 bp, Methylobacterium sp.
ttgccgagagccaacccggtatccgcgctgcggcgggccgcccgcaccgcgctcatcctgctcgggatgacctgcctcgccccgctcgcgccggccagggccgccccggatccggcagccttcgccgacaatgccgacgccgtggcggtggtgatcgggaaccgcagctacaagcagaccgtgcctgtcgactacgcgcacaacgatgccgacgcgatccgcgcctacctgatcgagcgcctgggctaccgcgagagcaacgtcttcctcctgaaggacgcgaccctcaacgagttcaaccaggtcttcggcaccgagcggaacccccaatccggccgcctctggcgcagcgtgcgcgagggccgctcgaacgtcttcgtgtactattccggccacggcgtcccggatctcgccaccaagcagccgttcctgctgcccgaggacggcaacccaaaccagggcgagagcgggtacgcgctggagaccctgtaccgcaacctcgagctcgtgaagcgcaagatcggcgccgaccaccagctcgtcgtgatggtcgatgcctgcttcaccggcgagaccggccgcaagggcgagagcctgctggcggtgtccgcgcccggcttcgcgcccgcgcggccgaagacggagggcggcatcgtccggctggtggcgacatcgggcgcgacaccggccaactgggacgaggcgaacaagctcggcctgctgaccagccggttcctgatgggcgtgtcgggcctcgccgacgcgcgggaccatcagggcgacggcgacgggctcgtgcagtggacggagctgaagcgctacctccgccgcgaggtggaggacgcggcccgccgcgcgtcgggccgcgagcaggtgcccgagatcgacgaggccccgatcgtcctcaaggcatccctgccggtggcggccgtcgcgaagggggtcgaggccatccgggacgaggcggcctggcggcgggccgaagcgctcgggacccgggaaggcttcgaggcctatatcggcgcctgcggcgagacctgcctgtaccggcctcaggccatggacaggctcctggccgggcggcgccgggacgcggcggtgatcgaccaggagaactgggccaagttcgggacccagcggcagtatcaggcctatctcgattcctgcggcgaggtctgcgcctatcgcagccttgccgagggctatctcggcggcaagaacccgagcgccgatccgcgcgtcaagcgctgcgacgagctcgcggccggcacggacgatcccgaccgtccgagcggggtcgcgggcgtgaagctcggccggatcgagcctgcggccgccatcgacgcctgccgcggggccgcggccgcctatccggacctgcgccggctctcctaccagctcggccgcgcctacgaccgggccgaccgctacaaggaggccttcgccgcctacgaccgcgccgccaaggccgggagcatctcggcgctgaacaacctcgccgccctctacgagaacggccagggcgtgaagcgccagcaggccgaggcgttccgcctctaccggcaggcgggcgaaggcgggaacgtggtggcgctggccaacgccgcccggatgctggaatacggcaacggaatcccgaaggacgaggcgcaggcggtcgccctgtatcgccgcgccgtggccgggggcgacgtcgcgtcgatcagcaagctcgtgccgcactacgccacgggtgcctacggcttcccgaaggacctgcgccagggcttcgacctcttccggcaggctgcggaccggggcgacccggtggccatggccacgatggcgacgctgatcgacaacggcttcgggcggtatttccccggcgtgcgctcggccgacatggtcctgcgcgcgctgaagcacggagaactcggcgccgcctccgtctcggcgaccgacaccgccgcccagaagctcaagcccgagacgatccgctcggtgcagcgcgcgatcaaggacgcggattactacaccggtgccctggacgggcggttcaatccggtcttcgtccgcgccctcgatcagtacgcccgggcgaacgagaccgaatga

SEQ ID NO: 5055 - DNA, 318 bp, Methylobacterium sp.
atggccatccgcacgatggcgcggccgagcccgtcccggcgacgcctgcgcgtgatcctcatcctgctgctgatcacgtggctgccggtcgtacccttcgcgctcggcctcgcgctgacgagcctgaccggctgcaccgtcaacgaggcggggacgcacccctgcccggtggccggacacgatatcggcggcctgctctacacgctgacgatgacgggctggctgctgatcccgttcctgcccttcatggccctgacactgctgctcaccgtcgtgcagggcctgctgatgatccttcgagcgtggttgcggcgatga

SEQ ID NO: 5056 - DNA, 363 bp, Methylobacterium sp.
atgttcgagaccgagaccatcatggctggctccgcctctccgaccgcgttcgacatcgaggagcagcgcgcccggatcgagcgcgcgcacgaggagacgcggaagttcgtcgccgagcagcacaagctgatcgccgagcagtcgaacctggccgcggagcagaccaagctggcggccgagcagttcaagatgacggccgaggcttcgaagacggctgtcgagcagaccaagctcgcggccgaggccgccgagatcggccgggaccggagtctcgcgccctggcaggtggcgctgtctggcatgacggccggggccgcgctgttcggcgccggggcggccttcgtcaagcttctcggacggtga

SEQ ID NO: 5057 - DNA, 900 bp, Methylobacterium sp.
atgcacgaccagagcgacctggagatcttcgcccgggtggtccgcaccggcagcctcacccaggccgggtcggagctcggcctgtcggtcgcggtggtgtcgaagcggctgaagcggctggaggaacggctcgccgtgcgcctgctgcatcgcaccacgcggcgcgtggcgccgacggatgtcggggcggccttcttcgagcggatcgccccgatcgtcgacgccatcgcggaggccgagagcctcgtgtcgcagacggcgacgcgggcccgggggacgctccgggtcacggcgccgagctccttcgggcgcctgcacatcgtcccgcacctgcgggccttcttcgccctccatcccggcatcgtgctcaacttggagctgagcgacgatttcgagtcgatcgtcgagcgcggctacgacctcgcgatccgggtcggcgcgctggagagttccgggctgacggccgtgcgcctcgcgccggtgcagcgggtcctctgcgcgcggccgagctacctcgacgcggccgggcggccgcagagcctcgacgacctgcgcggccatgtctgcctcgccaccgagaaccagaatccctggcggctggtcgggccggaggggccctgcacggtcagcgcgtcggggccgctgcgcacccattccaacgaggtggtgcgcgaggccgtgatcggcggcctcggaatcgcgctgcgctcaacctgggacgtgcacgcggagctgcgcgacggcctgctggaagtggtgctgccggcctacgcggcggcggcctccgccggcatcttcgcggtctacccgagccgggccttcgtgccggccaagacccgggccttcatcgcgttcctcaagcagacctaccggtcgagcggggcctgggcagacgggtga

SEQ ID NO: 5058 - DNA, 1164 bp, Methylobacterium sp.
atgcgcatcgtcgacgtccgcgaggtcaccaagccgatcgcatcgccgatccgcaacgcctacatcgacttctcgaagatgaccacgagcctcgtcgcggtggtcaccgacgtggtccgcgacggccggcgggtcgtcggctacggcttcaactccaacggccgctacggccagggcggcctgatccgcgagcgcttccgcgaccggatcctggaggccgaccgggacagcctcctcgtcgatgcgggcgacaatctcgacccgcaccgcgtctgggccgcgatgatgcgcaacgagaagcccggcggccacggcgagcgctcggtggcggtgggcaccctcgacatggcgatctgggacgcggcggcgaagatcgccggcaagccgctgttccggatgctcgccgagcggaagggcgtcgccgccgacccgcgggtcttcgtctacgcggccggcggctactactatcccggcaaggacgattccgcactccgcgccgagatgcgcggctatctcgaccgcggctacaccgtcgtgaagatgaagatcggcggcgcgccgatcgacgaggaccggcgccggatcgaggccgtgctcgccgagatcgagggacggggccgtctcgcggtggacgccaacggccgcttcgatctcgagaccgccatcgcgtatgcccggatgctgcggcagtacccgctgttctggtacgaggaagcgggcgacccgctcgactacgcgctccaggcggcgctcgcgccatactatcccgggccgatggccaccggcgagaacctgttctcgcaccaggacgcgcgcaatctcctgcgctacggcaacatgcggcccgaccgcgactggctgcagttcgactgcgccctgtcgtacgggctcgtggagtacctgcgcaccctcgacgtgctggccgagttcggctggtcgcccgcccgctgcatcccgcacggcgggcaccagatgtcgctcaacatcgcggccggcctcggcctcggcggcaacgagagctacccggacctgttccagccctacggcggcttccccgacggggtgcgggtcgaggacggccacatcaccatgccggacctgccgggcatcggcttcgagggcaagtcggacctcatcgcggagatgcgcgccctcgcggcgtag

SEQ ID NO: 5059 - DNA, 978 bp, Methylobacterium sp.
atggccgagggttccgaactgaaggcggacgggtggacgctggcgaacttcaccggcgccatccaccgtggcggcgtgggcctgtgggcgtggtccccgagccgccgggtcgcccagctcgacgccctgtgccgcgagttctggggcgtctcggagcccgaggtcgacatcgacgcgctgttcgcccgcgtgcacgccgaggaccgccccgggatggtggaatcgtgggcggccagcgagcgggacccggacgcctacagcttcgacttccgcatcggcgagggtccggacgcgcgctggatctcggcgcggggcgtgggcggggatgccggacgggtcggggaatgggtccaggccatcttcatggacgtcacggagcgcaagcgcgccgaggaggccgagcggctgctgaccgccgagctcgcccaccgggtctcgaacatgttcacggtggcccgtgccctgacctccatcgtcgcccgggacgccaagtcggcgccgtccttcgccgaggacctgtcgcggcggttcggcgtgctgcacgaggcgaccgccctggcgacgcgcgcgcaccacggggaccacgggcacgtgccgctgggcacgctcgccgagcgcatcctggcgccgtaccggaacggcgccaacgtcgaggtcgacatcgaggacgcggtggtcgcgcccccgggccacgtcaatgactacgcgatgatcttccacgagctcgccaccaactcggccaagtacggcgcgctgtccggcggcggcacgctttcggtgcgcgggtcggcgacgggcgacgcgacgcggatcacctgggtcgaggggccggccccgtccggggcggccaaggcggcgggcaccgggttcggctcgcgcctgctcaagcagaccatcgagcgcagcctcggcggccggttcgaacgcagcatcgatgcggacggcctgcgtttcgagatggtcgtcggcgccggctga

SEQ ID NO: 5060 - DNA, 255 bp, Methylobacterium sp.
gtgctggccacggccctggtgctgctcgcgggaagtgcgcgagcggaggacttcacgggcttctacgctgggatcaacgccggctacggctggggacacgcgcgcgacggccgcgcggccggcccggcgcccggagcggccgcggcgttcagcaagaccgatcccggcgccgatctgccgccgagcgcgcgggatgcggccgtggcgatccgcagagccggccgcgtcggcacgtcgggaaccgccggcccgtag

SEQ ID NO: 5061 - DNA, 1551 bp, Methylobacterium sp.
atgaaccaggacgagccccgcgagatccgcctcgccctcgacgcgatccccctcggcggcaaggccgagggcaaggccggcgatgacgcggtgctgttcgtgcgcgacgccgacggggtgcgcgccttccaggcgaagtgcccgcatctcggcgcgccgctggccaagggcgagatctgtggcggccggctctactgcccctggcacaaggcggccttcgcggtcgccgacggcggcctggaggagccgccggcgctggaggcgctcacccgctatcccgtccggatcgagggcggcgaggcggtggcgaccctcagccctgagcccgctccggccaagcgggcggagacgcccgtcgcgcatgtcctgatcgtcggcactggcgcggcggcggtcgcctgcgtcaccacgctccggcgcgagggcttcgcgggggcgatcaccctggtcggccgcgagggccacccgccctacgaccggaccaagctgtccaagcagttccttgccaagcccaccccggccgagaagaccctgctggagtcggatttcgccgccgcccaccgggtcgagcggatcgaggccgaggcgacccggatcgatccggccggccgcagcgtcgcgctggcggacgggcgcacactcaccggcgacgcgctgctgatcgccaccggcagccgcgcggtggtgccggacttcgaggggagggatctcgacggcgtcatgaccctgcgcagcctcgacgacgcggtgcgcctcagcgccgcggcggaacgtgcggcgcgcgtggtggtgatcggcgcgggcttcatcggcctggaggccgcggccttcctgaccaagcgcggcctgtcggtgacggtcctgtcccgggaggaggttcccttcgccaagcgcttcggcgaggccgtgggcgcggcgctgaagcgctaccacgccggcaacggcgtgaccttcgtgaccggcacggtcgcgcggatcgccggcaccggctccgtcgaggccgtcgagaccgagggcggcgcgcggctcccggccgacctcgtgctgatcggcgccggcgccgcgccggagaccgggatcgtcgccggggtggagccggacgagtccggcggcctcccggtcggcgccgacctgaggctcgccgacaacgtctgggtcgcgggcgacatcgcggccttcccggagcgcggcagcggcgtcacggcgcggatcgagcactggcggctggcgcagcagcacggcacgcacgtcgcccgggcgatcctgggtgccactggcgccttcgcgggcgcgccgttcttctggagcaaccagggcgacaagcgcctggattacggcggctacgcgccggatttcgagcggatcatcctgcagggcgacccggcggcgctcgacttcatcgcctactacgtccgcgacaaccgcgcggtggccgcctgcagcgtcggccgcaacccggccttcacggcgttcctccacctgctgggcgagggccgcgtgcccgcccccgaccggatcgaggcgggtgcggatctcgccgcgctggtgtga

SEQ ID NO: 5062 - DNA, 912 bp, Methylobacterium sp.
atgatcgactcggtgatgctctggaacgagcccaacaacaagtcgcactgggatcccgagatcgaccccgactggctgctcttcgccgagatggccaaggaggcgggccacgcggtccgggcggcgaacccgaacctgatccgcgtgctcggcggcatctcgccgatcgacccggtcttcatccgcaacatggcgggccgtggggtcctcgacgccgtcgacgccgtggcggtgcacggcttccccctcgactggaacctgtggtcgatccacgattggccggccaagctcgacgagatccgcgccgtcaccgacctgccggtctgggtctcggaggtcggcgtctcgaccttcggcgccgaggaggtccaggactggggcctgcgccgcactctggagctgctctccggccgggcgccgcggatccactggtacagcctctacgacctgccgcgggaatgggaggccaccacccgccacaaggaggccgagggctcctcctattaccggcacttccacatgggcctgctccggcaggacggcaccccgaagatcgccctggagagcttcgcccgccacacccccgagatcggcctgtgccagtggttccacttcgaggaccaccggctcgacgaggccgtcgcgtggatgaagcggctcggtgtccgctacctgcgcaccggcctgtcctgggccgacagcttccggcccggggcgctggactggttcgaccggcagatggcggcgctgcaggatttcgacgtcaccgtcacgttctgcttcaccccggagcaccggggcatctcgccccaccacaccagcgcgccgctggtccgcgccgagttcgcggagttctgcgccgccatggtccggcgctacgcgcccgggcccctgccgggcacgacctggtag

SEQ ID NO: 5063 - DNA, 789 bp, Methylobacterium sp.
atgacggaccgcatcctgacggcttccgacctgcgccggcaggccgacgccctcggcccctggttccacaacatcgacctcggcgacggcgtctggaccgccccggaccatttcctgggcgactatccgggcgtgaagtggcggcgcttcgccgacgcgctgcccgccgacctgaccggcaagagcgtcctcgacatcggctgcaacggcggcttctacgccatcgcgatgaagcagcgcggcgcggcccgcgtgctcggcctcgattccgacgagcgctacctcgcccaggcccgcttcgccgccgccagcctcggccacgacatcgagttccggaacctgtccgtctacgacgtcggcaccctcggcgagcggttcgacgtcgtgctgttcatgggcgtgctctaccacctgcgccacccgctgctggccctcgacctgatccgcgagcacgtggccggcgacctcctggtgttccagtcgatgctgcgcggcagccggatggtcgagccggtcgccgaggattacgacttctgggacatggaccagttcgagcggcccggttacccgcggatgcacttcgtcgagcgcgcctacgcgcacgactggacgaactggtggatccccaaccgcgccgggatcgaggcgatgctgcgggcgagcggtttcgccatcgcggcccagcccgaggcggaggtctatctctgccgcaccgcgccggtcccctacggtctgggggccgaatatcccgcgcgggcgcaggctcacggacgcgggggaacgcgatga

SEQ ID NO: 5064 - DNA, 603 bp, Methylobacterium sp.
atgaggcaggtcttcctcgtccgccacggcagccacgaccggctcggccgggtcctgtgcgggcgcatgccgggcgtctccctgagcgaggccggccgcgccgaggcgcgggcgctggccgacgccctcgcccgccgcctcgccgggcgcggcgccgggaccctgctggcgagcccgcgcgaccgcaccgccgagaccgccgcgccgatcgccgcggccctccggctgacggtcgcgaccgagcccgacctcgacgagatcgagaccggcgcctggacgggccgcagcttcgacgccctcgctgccgatcccctctgggccacctggaacgcggagcgcgcgaccgcccgcccgccgggcggcgagagcatgggggaggcgcagggacgggtcggccgggtcctcgcccgcttcgccgtggacggcgcgccggtggtcctcgtgagccacggcgacgtcattcgggccgccctcctcgggctcctcggcctcgggctcgacgcctacgaccggatcgtcgtcgacccggcctcctgcagcgagctcgccctctggcccggcggcgggcgggtcgtgtcgatcaacgaacggaccgcgccatga

SEQ ID NO: 5065 - DNA, 1083 bp, Methylobacterium sp.
atggccgccgcccccatccgcgtcggcctcgtcggggtcggcaactgcgcctcgtccttcgtgcaggggctgcaccattaccgcgactcggcgcccggcgagcccgtgcccggcctgatgtcgccggacctcggcggctaccgggtgcgcgacatcgcggtcgtcgcggccttcgacgtcgccgccgccaaggtcgggcgggacctcgccgcggcgatcctggccgcgcccaacaacacgcaggtcttcgccgcggtgccggagaccggcgtcacggtgcggcgcgggccgacccacgacgggatcggccgctacctcgagggtgtggtcgcggaatcgcccgagccggcggccgacgtggtcgcggagctgcggcgcaccggcacgcaggtgctcgtctcctacctgccggtgggctcgcaggcggccacggagttctacgcggactgcgccctgcaggccggatgcgccttcgtgaactgcatcccggtcttcatcgcgtcgaacccggaatgggcggagcgcttcgccgcgaaggggctgccgatcgtcggggacgacatcaagagccaggtcggcgccaccatcgtgcaccgggtgctggcgaacctgatgcgcgagcgcggcgtccggctggaccggacctaccagctcaacttcggcggcaacgccgacttcctgaacatgctggagcgcgagcggctggaatcgaagaagctctcgaagacccgggcggtgacgagccagctcgacggagccctggcgccgggcgacgtccatgtcggcccgagcgaccacgtgccgtggctgaccgaccggaaatgggcgcatatccgcctggagggcacggcattcggcggcgtgccgctcaacatcgagctgaagctcgaagtgtgggactcgccgaactccgccggcatcgtgatcgacgcggtgcgctgcgcccgcctcgccctcgaccggggcctcggcggcgcgctggaggggccgtcgagctacttcatgaagtcgccgccccggcagttcaccgacgcggaggcgcgggaccgcaccctgcgcttcgcggcgggcgagggcgtgtga

SEQ ID NO: 5066 - DNA, 2583 bp, Methylobacterium sp.
gtgacaaacgccctgctcgcccagttcatccccgaggcccgcgagctgctggagcgcgcggggagcggcatgctggccctggagaagtcgccgggcgccgaagccctcgacgacgtcttccgggcggtgcacaccctcaagggcacgtcaggcctgttcgagatcgcgccgctgacccatctggtccacgcggccgaggatcttctggtcgaggtccgggccggcaagctcgtcctggaacccgcgatcgtggacgggcttctcgacagcctcgatctggtcggccactggatcgacgtcttggaaagccgcgcggtccttccggacgacgccgacgtcgtcatggcgggacgggtgacgaccctgcgggcctggctgcccgcggcgatcgacaccaccgtcgcgcgggccgaccacgggccgccggactggctcgccgaccttcccgaggcggatcggcaggccgcctggcgccgcgccgcggcatcgggcgagcccctgaccgcctggcactacgagcccgacgaagcctgcttcttccgcggcgacgacccggcccatctggtggcgcaggccccgggcctcgtcgcgctgcgggtacggccgcgcgccgcaaccccgtcgccggagacctgcgacccggtgctgagctggctccgcttcgaggttctgtgcgtcgccgacgccgaggcggtcgccgaccatctgcgctacgtcgccgatcaggtccgggtcggcgcgatccgacccgacgacctgatcgtcctgaccgggacggaggatgaggccgagatgttcggcgacttcgccgcgcgggccgggactctcctcgccggggacgagcgggcggacctcgccgcctccgccgacgccctgctggggatcatcggtgccgggacccggcaggcctgcgccctgcgctggatcgcggcgctggccgccacggcggagaccgagacgctgcgccgcctcgccgccgacctcggcgggccgcggccggcctcgggttcaccgccgaccgatcggccgcccgcagacgcgcccgccgcgggtggcaccctgcgccagcaggcagaggcgatcctcgccgcgcaggcggagatgctggccgtgcccgcggacccggccgtcgcggagggccggttcgagtccgtgcgcacggtggtgcggcgctgcctgccgcatctggcgccagtccgggccgccgccgtggaggcagccctgggccgatcgcgcgcgggcgccaccgaggccctcggcgccgtcctccgcggcgcggcgagcggcgcgcccgccgcgccgccgatgccgcccctcgctggagagcccgcgccgcggcccagcgcggccccgccgccggcgaccgagccgcgcgatgccccggagggagccggccccgacgccaagggtccggcgcgcatgctgcgggtcgagcagggcaaggtcgacgccctgatgaacttcgcggccgagctgacggtcgccaagaacgggctcgcctatctcgccgggcgcgtcgagcaggtcagcggctcgcgccagctcggtcgggagatcaaggagcagtacgcggtcatcgaccggatcgcccagagcctgcaggtcggcgtcatggcgatccgcatgatgccggtgagccaggtcttccagcgcttcccccggctcgtccgcgacatcacgcgcaagctcggcaaggaggtcgagctggtgatcctgggcgaggagaccgaggccgacaagaacgtgctggagagcctcgccgacccgctgatccacatggtccgcaacgccctcgatcacgggatcgagacccccgcgatccggatcgccgccgggaagccggcgcgcggcaccctgcggctcgcggcgcggcaggagaacgacaacgtcatcatcgaggtggccgatgacgggcgcggcatcgacccggaggcggtccgcgcgaaggcgctgcgcagcggcctgatcggcccggatcaggccgcccagatgaccgcggaggatctcgtcaacctcgtcttcgcgcccggcttctcgacgcgggatcaggtctcggacctctcggggcggggcgtcgggatggacgtcgtgcgcagcgcggtgcgcagggcgggcggcgacgtctggctcgcgagccagcccggcgcgggcacctgcgtgaccgtgcagctgcccctgaccatggcggtgacccgcatcgtcaccgtggtggcgcggggccagcaatacggggtcgccatggacgcggtggccgagaccgtgaaggtcccgcgggaccagatccaccggatcaagcggcgcgagaccttcgtcctgcgggacgcgatgatccccctgatccggctcgccgacagcctgggcctcccggcggccgcggacgcgccgccggaggaggaggccgtcatggtcgcccgcgtcggacgcgagcgggtcggcatcgtggtcgacggcttccgcgagcgcatggaggtgatcgtgcggcccctcgacggtctcctcgccggcctcgcgggcttctccggcacggcgctcctcggcgacggaagggttctcctcgtcctcaacctgtcggatctgctctga

SEQ ID NO: 5067 - DNA, 891 bp, Methylobacterium sp.
gtgcatcagcgcctcccgaacgccccccgatccgcggcaacggcccgaccgcgtcggcgcgccggcgccggcgtcctcgccccaggatcggcgctctgcctgcagctctgcatttcgctctgcctcgccctgccggcccgggcggaggtggagaacaagaccgcgcgccccggccagcggatcttcctccagggcttcacctactacttcgccacgcaggggtgccgctcgcgcgcggccacgatcgagctcgtcaggccgccgcgcggcgggcgcatcgagcagcggcgcgagttccggatcctcagcggcaaggtcgacgagaccggggcgcagatccggcagccggacggctgcgaggacgccaagaaggactcgatgtcgctctactacacggcacggcccgacttctccggactcgacaccctgtcgatcgacgtcaccttcggggacgggtccacggtgccgtacacgttccggatcaccgtgccgccgggcgagccccgtcgggccccggcggtgtcgcaggcgccggtcccgcgcgcgggcggcgccgggcaggccgcgccggcggcccgggcaacgccggctccggccccccgggaggccggcaccagcaccggcgacttcctgcgcgacacggtccgcgacaccgtccgcggctcggtcgcccggcgcgccgccgcggaccgagcctccgccgccgcgcgcgatggcgccggcgccgcgcccccggccagcggccacgccgcagctctgagaccccggggctggccggtgcggcccggcctcgctcatccgacgaatccacgcctgaccgggccccccgctgcacaggtccggcaggtcaccgacagagccaccggcagagccaccagcagagcgaagtga

SEQ ID NO: 5068 - DNA, 1065 bp, Methylobacterium sp.
gtgagcggccggccgatcctcgtcaccggcggcgccgggttcatcggcgccaacctgtccgacagcctcgcggccgacggccacgcggtgatcgtctacgacatcctctcgcgccccggcgtcgaggccaacctcgcgtggctgcggcagcgccacggcaaccggatcgtcccggtcgtcgccgacattcgcgacatccaggaactcggccgcgcggtggcggaggccggcgcggtgttccacttcgccgcccaggtggcggtgacgacgagcctcgtcgcgccgcgggccgacatggagatcaacctcctcggcaccgtgaacctgctggaggcgctcagggcgcaggcgcggccggtgccgctcctctacgcctcgaccaacaaggtctacggcgacctgcccgacatcgccctggaggcggtcggcgacgcctacctgccggccgatccggacctgcgccggcgcggcatcggcgagacccggccgctggatttccacacgccctacggctgctccaagggagcggcggaccagtacgtcctcgactacgcccgcagcttcggtatcccggcggcggtgatgcggatgagttgcatctacggcccgcgccagatgggcaacgaggaccagggctgggtcgcccacttcctgatccgggcgctcgccggcgaggcggtcacgctctacggcgacggacggcaggtgcgcgacatcctgcacgtgcgcgacgtggtggcggtctaccgggcggcgctcgcccgcatcgacgacgcggcgggccacgccttcaacgtcggtggcggccccggcaacgcggtcagcctgctgcagctcctcgaccatgtcggcaccctgctcgggcaccccgtatcgcgcagcttccaggcctggcgaccgggcgatcagcgctactacgtctcggacacgcgccgggccgtcgcgcggctcagcctcgcccccttcacgggttggcacgacggcgtcgccgacctcgccggctggctcgccgccgcgcgcgcgtcgtcggacggcgcggcaccgatcgcgggagcggccgcatga

SEQ ID NO: 5069 - DNA, 1308 bp, Methylobacterium sp.
atgagagtcgccctggtcaacccgccctgggactaccgcaacagcatctatttcggctgccgcgagcctcacctgccgctcgaactcggctacgccgccgcgctgctggtggccgccggccacgagacgctgctcgtggacgcccatctcgagggcctgaccgccgaggccgccgccgaccgcgtggccgccttcacccccgccatgacggtggtggcgaccgcacccacctacctgttctggcgctgcgccccgccggagctgcgggtgccccgcctgttcctcgacaccctggcgggccggggcgggacgaccgtggcggtcggcccccacggctcggcgacgccgcggccggtcctcgacaagctcggctgcgccgtcgtggtgcgcggcgagtgcgaggaggtcgtcgcccggctcgccggcctgcccgaccagcgcccggataccctgcggaccgtgcccggcctcgccgtccgagacggcgaggccgccatcgtgaccggcccgccccaggccggccgcttcaccgacctgccggccctgcgctggccggagggctgggtcgcccggcaccggcaccaccaccaccggttcgacgccgcgccggacggcccgggcgccgaggtcgaggcctcgcgcggctgcccgtacacctgctcgttctgcgccaagatcgacttccgcgacgcctatcgccgccgggaacttcccatcgtcctcgacgagatcgacgggctgatcgcgcagggcgtcacctacgtctacttcgtcgacgagatcttcctgccgcagaagccgctcctggaggcgctcgtcgcccgggacctgcgcttcgggatccagacccggatcgacctgtggaagcccgacatgctcgacctcctcggggcggcgggctgcgtctccatcgaggccgggatcgagagcctgaccgaggcgggccgcgccgccctcgacaaacgctgccgcgcgtcgaccgacgacctcgcggagcgcctgatccacgcccgccgcaccgtgccgttcgtgcaggcgaacctcatcgccgtggcgggggacgatcccgacctcgtggccgcgtggcgcgaccgcctgcgcggccagggggtctgggcgaacgatcccgtcccgctctacccgtacccgagctcccccgattaccggcgcctctggggcgcgcccgacgaccaggcctgggagcgggcgcacgcccactacctcggccagttcacccagttcagcgacatccaagacgagcgccccctcccgctatccgagctggaggccgcatgcgggtgctgctga

SEQ ID NO: 5070 - DNA, 1113 bp, Methylobacterium sp.
atgaggatcgcctacttcacccactcgctcgcctcgtgctggaaccacggcaacgcgcatttcctgcgcggcgtgctgcgggacctgatggcccgcggccacgccgtgaccgcctacgagcctgagaacgcctggagcctcgcgaacctcctgcgcgaccacggcgaggccggcctcgacgcctaccgggcggcctatccggagcttgcctccacgcgctacgcggatgtcgacgcggtggtcgagcgcgcggcggacagcgacctcgtgctggtccacgagtggaacgagccggccctggtggcggccctcggcgccgcccggcggcgcggggcgcgctacacgctcctgttccacgacacccaccaccgggcggtgagtgcccccgaggagatggggcggttcgatctctccggctacgacggcgtgcttgccttcggcgagacgctggccgcggtctaccgggcgaaaggctggggccgccgggtcttcgtctggcacgaggccgccgacacgcggctgttccggccgcccgctcgggagggcacccgcgccggcctgatctggatcggcaactggggcgacgacgagcgcagcgcggagctggagagctacctgttccgcccggccgcgcaggtcggcctgccgttggacatctacggcgtgcgctaccccgcggcggcgctcgcgacgctcgagcgctacggcgcccgctatcacggctgggcgccgaacgccgccgcgcccggcctgttcgcccgccatctcgccaccgtgcacgtgccccggcgcttctacgtggagcgcctgcccggcatcccgacgatccgggtgttcgaggcgctcgcctgcggcatcccgctggtctgcgcgccctgggacgacgcggagggcctgttccggccgggcctggactatctcgttgcccgcaccggcgccgagatggagagccacctgcgcgccctgcggtcggatcccggcctccggcaggcgctcgccatcgccggcctcgccacgatccgggcgcgccacacctgcgcgcaccgcgccgaggaactcctgtccatcgccgcgagcctgcgggcgcccgccaccctggaggccaccgcgtga

SEQ ID NO: 5071 - DNA, 684 bp, Methylobacterium sp.
gtgaagatcgccttctacggctcctccctgctgtcgtcctactggaacggcgccgccacctattaccgggggatgctcgccgccctggcgcggcacggccacacgatcaccttctacgagccggacgccttcgaccggcagcagcaccgggacatcgagcccccgccctacgcggcggtgacggtctacccggcgaccatcgaggccgcccgggcggtcatcgccgaggcggcgacggccgacgtggtcgtgaaggcgagcggcgtcggcgtgttcgacgatgagctgctcgaagggatcatcgcggcctcccgcccggaggctctgcggatcttctgggacgtcgacgccccggcgacgctcgccgagatgcgcgccgatcccgaccacgccctccgccgcgccctgcccgacctcgacctcgtgctcacctacggcggcggcccgccggtggtcgcggcctacgagggcttcggcgcccgggcctgcatcccgatctacaacgcgctcgacccggagactcatttcccggtgccgccggagccgcgcttcgccgccgacctcgccttcctgggcaaccgcctgccggatcgcgaggcccgcgtggaaaaattcttcctcgcggcggcggcgcgcctgccggagcggtctttcctcatcggcggcaacggctgggagaaccgc

SEQ ID NO: 5072 - DNA, 702 bp, Methylobacterium sp.
atgcccaagctcctgatcgtcgacgactccgccctgatgcgcaaacacctgcgcctgatcttcgaggagacgggccagttcgaggtgcgcacggcgcgcaacggccgcgatgccctggaccagatcgacaccttcgagcccgacgtggtcaccctcgacatcaacatgcccgagatggacgggctcacatgcctcggcgagatcatggcggcgcgcccgcgcccggtggtcatggtctcgtcgctgacccgcgagagcgccgccgtgaccctggaggcgatgcagctcggcgccgtcgattacgtggagaagcccggcggcaccgtctccctcaacatcggcgaggtccgggacgagatggtcgccaaggtccgcgtcgcggcccgggccaagccccgccgcgcccgcggcctcctcgaccgggtccggcgcgggcgcggcgagatcgcgacgcgccgcccggcgccccgagccgcggcccgcgtcgagggctgcgtcctgatcggcgtgtcgaccgggggaccccggacgctggaggaaatcctgccggagcttccggccgacctgccctggccggtcgtgatcgcccagcacatgccgggctccttcacgggcgccttcgcccagcgcctggaccgcctctgcgccctggaggtggtggaggtgaccgccccggcccccctcgcggcgggccgggtctac

SEQ ID NO: 5073 - DNA, 582 bp, Methylobacterium sp.
ccgatctacaacaagatcgaggcggccaagcccgacctgatcgtcaccggcatctcgcatgtcggcgttcagccgaccgtgcagtggcagaaccagaaggtgccgctcgccatgaccggcatgaactcgcaggcgacctcctcgaccttctggtcgaacaccaacggcgcgacccagggcgtgatcttccagagcatcgcggtgccgggcgcggcgatcaccgacaagtcgctcgccttcagcgccgcgttcaagaagcgcttcggcagcgacccgtcctacgccgggtacatggcctacgatcaggtctactacgccgccgacgcggtgaagcgggccggcaccacggaggccgacaagctggtcgacgccctggagaagaccgactgggtcggcaccgtcgggcgcacgcagttctacggcaaggacgacccgttcacccactcgatcaagtacgggccgggcttcgtcaccggcctgatggcgcagtggcaggacggcaagcaggtcgcggtctggccgaagagcctcgcgcagggggcgatcgtgctcccggccgccgtgaaggcggcggcccgctag

SEQ ID NO: 5074 - DNA, 582 bp, Methylobacterium sp.
ccgatctacaacaagatcgaggcggccaagcccgacctgatcgtcaccggcatcgcccatgtcggcgtgcagccgaccgtgcagtggcagaaccagcaggtgccgatcgccatgacggggatcagcggccaggcgacttcctcgaccttctgggccaacaccaacggcggcacgcagggcgtgctgttcgacagcgtggcggtgccgggcgtggcgctcaccgagaagacgatcccgttcgccgaggccttcaccaagcgcttcggcggcgcgccgtcctacgcgggctacatggcgtacgacgccacgcattacgcggcggaggcggtcaagcgggcgggctcgacggaggccgacaagctcgtcgacgccctggagaagaccgactacgtcggcaccgtcgggcgcctgaagttctacggcaaggacgagccgttcacgcactcgatccagtacgggcccggcctgatgaccagcgtcctcgggcagtggcagaacggcaagcaggtggcgatctggccggccaccaccgccaacgggaccatgatcctgccccctgcggtgaaggcggcgggccggtag

SEQ ID NO: 5075 - DNA, 528 bp, Methylobacterium sp.
ggcggcgtcgacgggcgccagatccaggtcgtcacctacgacgacaagtcctccgcctccgacgcggtccgcgccttccagcgggcggtctcggaggacaaggtcaacctcgtcatcgccagctacatctcggaggtggtgctggcgctgatgccgtgggcggcccggctcaagacgccgatgatcacgcccggcgcggcctcgaacgagatcagcgccgcggtccacaaggactacgcgcgcaacaagtacaccttccacggctacctgacctcggcggcgctcgcccagtccatctgcgattccaccaaggacatgctgatcgacctgatgaaggtgaagaccgccgcgatcatgagcgaggacgcggcctggacccggccgctcgacgtcggctacgagaagtgcctccccgagatcggcgtgaaggtcgtcgaccacatccgcttctcgccggacacgggcgacttcacgccgatctacaacaagatcgaggcggccaagcccgacctgatcgtcaccggcatc

SEQ ID NO: 5076 - DNA, 1050 bp, Methylobacterium sp.
gccgaggccatggggatcggcctcggcgagctgcgcttcctcgcctacgaccgggcgctcagcgcggtgagccattaccggcgcttcaccatccccaagaaggcgggcggcctgcgccgcatctcggcgccgatgccgcgcctgaagcgggcgcagtactggatcctcgacgcgctcctcgcccacgtccccgtgcacgcggcggcccacggcttcgtgcccggccgctcgatcgtcaccaacgccgccgcccatgtcgggcgggacgtcgtggtcaatctcgacctcaaggatttcttcccgagcctcgactaccggcggatcaaggggaagttccggggcctgggctacgccgagccggtggcgaccgtgctggcgctgctctgcaccgagccggacgtggacgcggtcgagatcgacggcgcccgcctctacgccgcccggggaccccgccggctgccgcagggcgcgccgacgagccccgcgctcaccaacctcgtctgcacccggcttgacgcccggctcgccggcctcgccggcagcctcggtttcacctacacgcgctacgccgacgacctgaccttctcggcctccggcgaggccgccgggaaggtcggcgcgctgctcaagtacgtccacgccatcgtcgccggggagggcttcaccgtccatccggacaagacccgggtgatgcgccgcggccggcaccaggaggtgaccgggctcaccgtcaacgagcgggtcggcgtgcctcgcgagaccctgcgccgcttccgcgccctcctgcacgggctcgagcggcacgggccggccgggcgccgctggggcgcggccggcgaggcgggcgtgctccgcgccgcggtcggcttcgcgcagttcgtccggatggtcaggccggagaccggcgcgccgcttgtcgcgcaggcccgcgccctcgcggaccgccattcggccccggcgacggcgccccggcagccggacttccgcgcccggtccgcgcggggcgaggtgcccctcgcccgctggtgggtgccggccccccgccccgcg

SEQ ID NO: 5077 - DNA, 3123 bp, Methylobacterium sp.
atgagggtcgtccgcgcggcgcgcctccacctgcgggacgccacctccgacaaggtctacgacgtcgacctgatcgagaacgaggccctcgggacgcccgagcgctacttcgtcaacacgcgctacggccggcgcggcgcgaccctgcgcgagggctccaagacgccccagcccgtgaccgccgaggcggccgcacgggtgttcgacagcgtggtcgtctccaagatcaacggcggctaccggcgggtcgacggcccggagaccgccgcacccgaggcgacgcccgacgggcgcgaaggcgtgctgcgggcgcggctctccgcctgcctgcgcgagagctgggccgagcgcgaccgcgaccgcctgctctggcgcatcggcgagctgcggctggccgcggccgccccggacctgatcgccctcgcgcggggcctcggcccggcgcgggcgagctacgccctggtctgggcgctcgcccgggcggcgggcgcacaggccggtccggcgctcgcggcgatcgccgccgaggcgcccggcagcgtggtccgcgacctcgcccgcttcgcgctcgccgccccgctcaccgggccctaccggccgccggaggccgagccggacctgcccggcatggtcgcccggccggccgaggcgggcgacgtcgacgggctgtgcggggcgctggacggcctcgcccggcacgatccgggccgggtcgggccggccctggtggcgctcggccggcgggcgcaggcggcgcccggcctgcacgcgacgctctgcgccgccctgctccggctgccggcgcggccgccctacctgatcggcctgcggcgcctcttcaagcacgccgagatggccgacgatgccgccctgttcggcgccaccgcccagcgcttcgagaccgcgcaggcgatgtaccaggccggccggagccacgcctacgtccccgacctccggcgctacgtcgcggtggacgcggcgcgccaggggccggaggcgcggctcggcctgtccaccgccacccgcgcctacatgaagcggcggatctggcgcgccctgcgcaagcgcggcgccgtcggggatccggccttcgcggcgctggcggcgggcttcctgctggcgctcgggccggaggacctcgacccgccgacgcgctggaccgcctgggggcggcagccggacgggacctggggccggcaggcccgggcgcgggggccgctcgcccgcaactggaccgcgagccagctcctgtatcgccacgccccggaggcccggccgcggacgggatcgctgaccttcctggagaccggcgccgtcgatcccgaccggcgtgacgaggccttcccggatctctggagcgcccgcccggacctagcgctccgcctcgccgcggagggacggatcgagccggtggcgcggctgggcctgcgggtgctgcgcgcggacccgcgggcctgcgcggccctgacggccagcgagatcgggcgcctgctggccgcgccgcacgacgccgtgcggaccttcgcgttccggaccgcccaggcgcgtctcgccgccgggatcgccgagcctgccgaactcgccgccctggtggcggcgctgctcgcgagcccggagccggaggcgcgggtgctggcccttcggcgcctcgaggcggggactccgatcgtctggtcggaccccgacctcgccgccgcgctgctcacgagcccggagccggacgtccaggcggccctccccggcctcgccggagcgcgggcgctgcccaccgggctcgcggcgcccctggtggcgcggctggtggcgtggctgcgggcgatgccgccggagcccgacgcggccgcgacggccgcgatccggggtctgcgcgccgccctgcccctcctgtggccggaccacgacctgccggtcgcgtccgagaccgccgccgccctgatcgcccacccgtccgccgcggtcaggtccgccggcctcgccctcctggcgcagtccgaggccggggccgcgggcctgccgccggagagctgggacgcgctgattggcgcggaatccgaggacatccggatcgccgccctcgtcctgctggcgcgcctcgacgacgcgcggctcgggccctacgcggaccggatcgtcgccttcgccagcgggcccgacagcgccgtccggcgggccgcccggcccctggtggcgcgcctcgcggcggcggatccgggcctcgccccccgcctcgcccgggagctgatcggcagcctgttcctcgcggcgcccgacgacgcctacgccgccgacaccgtggccctgctgcgcgaggccctgccgggggaatgcgccgccctcgacgacggcaccctgtggcgcctgctgcaggcgcgggccgacggcgcccgccgcctcggcgccgccctcctgcccgaccggcgccccgaggccctcagcgtccgccagatcgcccggctcggcggccacccgtaccgggcggtgcgggactgggcgacggcggctttcgcggtcgacccggcccggttccaggccgcggcggccgaggccatcctcctcgtggagagcgactggcccgacaccctcgccttcgcccgcagcctgttcgacgcgtggccggagaccgcctggacgcccgaggcgctcgccgtcgtcaccgacagcgtcaagccggaggtcctggccctcgcccgccacctcctgcgcagccggctccggcccgaggacgcggaggcgcaggtcctgcgcctcctggagcaccccgccccgtcgatgcacctcctgctcaccgagctgctgaccgagcaggccgtggcgagcgaggcggccttcgcgcggctgatccccctcgcccgcatcgtgatgctccaggtgctgcgcggccgggtcgccaaggaccggatggccgccttcctccgggccgaggccctgcgcagccgcacccgcgccgaggcgctgctcccgctcttcgccgacctgaccctgagcggcacggcccgggaccgcagcgccgcgatcctggccctgcgcgacgtcgccgacgcgcatcccgatctcgccgtgcccctcgtccggcgcccgccggaggcgcggggacccgtctccgtctcggaagaggcccgatga

SEQ ID NO: 5078 - DNA, 738 bp, Methylobacterium sp.
atgaacgcacgaacctccgcagccctcgcgggcgccgcatgcggctgcctggccctcgccgcccaggcggccgacctgccccgccgcgcgccgccgccgccactgccgtcgctcccggtcttcacctggacgggcttctatgccggcgtgaatgcgggatacgcgttcccgaccgggagcggcggcttcaccgacccaacctacggcaccgtcacgggcggcgggcggtcaggcggcttcgccggcggcgggcagatcggctacaatcaccaattcacgccgggctccggcgtcgtcgtcggcgtcgagaccgacatccagggcgcggccttcgccaaggcggacgctgcctatctcggcaccacgccgtattacagtgtccgaccgagcctcgactatttcggcacggtccgcgcccggctcggctacgcgttcgaccgggttctcgtctacgggaccggcggcttcgcctacggcggcggggcgcgcgcgacctacgcgggcgcctatccctacaccctgccgtcgaccgaccggaccggatacgcggccggcggcggcatcgagtacgccttcaccgagaagctctccgccaaggtggaggcgctctacctccatctcggccgcggaacgaccgccgccacgtactacaacgccagtgttccggcgttttatggtgccggcaaacaggattccggttttgcggtggttcgggccggtgtgaattaccgattctga

SEQ ID NO: 5079 - DNA, 702 bp, Methylobacterium sp.
gtggtcctgaaggcgccgtccgacgcgagccccggcatcgccgccatgccgcagatcgccgcgccggccgacgaggccgagcgtcggatcaacgcggcactgaagcgcctcgacgcgcgggccctcaaggccgagcaggcgtgcaaggatcagggcgggaagaacagttcctgggagcgcaccgtcgaggccccgatgcgcggcccgcgcttcctcagcttcgtcatcttcgacagcgggttctgcggcggtgcgcacccgaacagcggcacgatgtcgatcgtctacgatctcaccaccggcgcgccggtcgactggacgaccctgctgcctctctccctgaccgggaagctcgccctggcggagggcccgggcgggaccaagatggtgacgctcgcgtcgaagaagctgcacgccctctacctcgcgggctatcgtccgaagacgggcgatccgaaggcggacgacgccgacaaggagtgccgcgaggccgtcgccgagacctatgacgggcagccgccggccatgatggcgtggctcgacgcgaaggccggcggcctcgcggtgcagttcgacctcgcgcacgtcgtccaggcctgcgccgatccggtggtgattcccgtggcgaccctgcgccgcgagggtgcccagccgctcctggccgtcgcgctggaggccgcccacgcgcaagccggaaagtga

SEQ ID NO: 5080 - DNA, 258 bp, Methylobacterium sp.
atgaccaagaccaagatcctcgtgctcgccgccagccttctctgcgccgcgggtcccgccctcgcccaggaggccgcgccgcagcacggaaaccaggagttcctcggcgtcgatctcgacaacggcggcgtctactacaacggtcgcaactctggccgttactgcgtctaccgcacggtcgaggtctacaatcgctacaccggctacttcgaggcgcggcgtgcccgccgctgcggccgcggtctctacctgccgtga

SEQ ID NO: 5081 - DNA, 513 bp, Methylobacterium sp.
gtgagcgacgcggcacggctcctcgccgagatccacgcggcccgcgccctcgtgcgcgatgcggcggcgaccgcccggccggaccacgcgggcctctgggctcacgcgacccgggcgcccgacggaccggtcgacctcgccactgtgcgggcgatccgcggcgacccggcgacggcccggcgctaccggacgatgctcggcgccctggcgctcgcccacgcgccgctcgccgcggccgcctcggacggcgcgatcctccggcgccgggtcggcgccttcgcgctggagatcctcgaggccgcggacggcgcgccgccgctcctcgtcctgcgcggcgagtccgggcagatgccgcgggtgatcgaggcttggctcggtgacgagacggtccgactcgacctcggtcctgcgatcgagggcgcggcggtgctcgccctcgacccggccgtgccggaagcggccctcatgggccgcatgctccgcgacccggcctgcgcggtgttcctgctttga

SEQ ID NO: 5082 - DNA, 1131 bp, Methylobacterium sp.
atgacgcgtccggccatcctcgtcgtcgtgcccacgacccgcggaccgctggtgctgcgcgggctcaggccgcgccccggccttccggccccggccgccttcgcggacggcgattatcgcccgctgccctggtcggccgattacgcccgactctgcggggccgccggcccgctcgcccggtgggcgggtcggacgcccgagccccacgagctgcggctgtcgggctccttcgacgccggacgctcctgggaggttccggtgtgtttagcgcacggcctcgccgagggcggccacccgctcgccgcggcaccggaagaggccgacctcatcctctgggcgaccggcgcggtcgatctcgacctcgcggtcctgcccggcgactacgcgctcctcgacaaggtcgagcgctccaccgcgatgatcgccgaggctccggacgccgcgctggccgtcctcctgccggacgggccggagcgcgcgcaggccgaggccgtcttccgcggcatgggccggaacgtgcggatcctgccgtcgcacagcgtgcccgaagccctggccgcattgaccgcgctgcgggatccggagagggccgagacgccgccggcgcggcggtggcagcgtctggcgctgccggccggcgccgtcgcggcggccggactcgccggtgtgctcgcgctcggggccacgcggcccgatccgatcagcgagccgcgccccgaggcgccggccggtcctgccggccctcaccccggggccgaagcccggatcgcaccgccgatccacgtttcggagctgcgcgccccggcgggatcctcctgccgccgcgtggccttcggggccgacccgcccgagcggcgcccggtgccggcggaatcgggcgaccacctggccgcgagccggctcacgccggacctgtgcgggctcgccatcggtgtggagccgggcctgcgcgcgcaggtcggaccggaactgcgcgacgccgccctcccggccgtccggctggcggacggcgcgctcggctatttcctgcgcgagggcgcgcggcagaacctcgtctacacggtccaggccgttccggaggccggaaccggcgcggttgccggtcgcctggtccacaccctggtgcgctga

SEQ ID NO: 5083 - DNA, 981 bp, Methylobacterium sp.
atgatctcgatgcgccggagaggccctctcctgctggggacggcctgcgcgctgatcgtgctcggccgcggcgacgccgcgcgggcgcagagcgtcggcttcgatcccgccgattacggccgggcgcagctgcccctgcgccagacgaccggcgacgcggccgcctatgtcgaccagaacaagggcgctttcgagcccgtgagcgagctcgacccgaaggacggcctcgcggccctcgcccggccgatcggccgcgtcgacatcgtgctccagaacggccgcaccgggcagcaggtcggtgcatcctgcacggggacgctcctgcccggcgactacgtgctgaccaaccatcattgcctgccgcaatcgggcgacctgcgcccggtcaaggcgtcgatcctgatggattacctaactctcgacgggaaaggctcccgccgcttcgagatcgacccgaaacccgtcgagttcgacgcccgcctcgacttcgccctcgcccgcgtcgcgggcaatccgacggcgacgtacggcgccgcgcggctctcgggcgagccagtgacggccaaccgctcgatgctggtcatccaccatcccctcggacgtccgaaggtgatgagccgcttccgctgcttcgccatgaaggaccaggcggagggcccggacctgcgccaccgctgcgacacgctcggcggctcgtccgggtcgctgatgttcgacgcctccgtggccggcatcgcgctccacaaggagggcggcctcgatcccaaggatccgacgagcttcaacagcgcgacccggctctcggcgatcctgggccggagcccgaccctggcgcggatcgcggcggcccaggggcgcccggtcgccgccgcggatccggggaccaggccggtcgcgcctagcccgacacctcagcccaagccggcgaccgacggacccctcgatccggccgggatgaacgccatcctgcggggacgctga

SEQ ID NO: 5084 - DNA, 954 bp, Methylobacterium sp.
atgcccctcgtccgcaccacggcgttccgcgccgcctgcctcgccgtcctggccctcgggtccgcctacgcggcgccggcccgggcgcagaccaagcccaacgtcgtcgtgatgggcgaggacgctgacgaggacgcggtgccccgcggcaaccgcatcttccagcgggtgattcacgagctgtccgagaccatgaacctgcgcggctacaacgtctacgacgagaccgccgtcgcgatggggttcacccaggccaaccgggtgcgccggcgggatgccgagctgatcgaggtcgcccgcgcggtccagaatccgccgctcgacgtggtggcggtgttccagatctacgcgtcggcgtcgaaatccgcctactcggatatcgtccgtccggagatccgtatccccggccgcctcctcaacgtccgcaccggtcagtcgctcggctcgttcgaggtggccgggctccagctgccgcccctgccccaggggtgcgaccgcgagtgcctgctcgagcgggtcggcgccgaggcaaagacggtggccgccgacctcgcggccgcgctcaccgcgaagctcgacggcgtgatcgcgccccgccgcggtgccgatgccggcgctgcgccccctgacgccgcgccggtcggcggcgccgtggcggcggcgcccggcggcgagagctgcgggggtttgcccagcgcctacgtcgtccgtctgagcggcttctcggcccaggaggtccaggcggccgaggagtatatggcggctttccgctgctacgagcaccatcgtccggtgcgcgcgagtggggccagcaccgagtactggtacgagacccgctcggattccgcccggctcggccggaacctgcgcctgatgctggagcacatgagcgcgccgggtcaggtccagttctcgggcaacaccttcgtcatcagccgcgtggcgacgcggtag

SEQ ID NO: 5085 - DNA, 1125 bp, Methylobacterium sp.
gtgagggcggccccgatacgcctcgtcgtcctggggctcagcctatcctcgtcctggggaaacggccacgcgaccacctaccgggcgctcctcaaggccttcgcggatcgcggccacgacgtgctgttcctggagcgcgacgtgccctggtacgcccagcaccgcgacctgcccgagccgggtttctgcgacctcgccctctacgccgatctcgacgggctcgacgcgcaccgcgccgctatcgccggggccgatgccgtgatcatcggctcttacgtgccggagggcatagccgcaggcgaccgcgtgctcgactgggcgcggggcgtcaccgccttctacgacatcgacacgccggtcaccctggcggccctggaggccggcacctgcgcctacctcgcggccgggcagatccggaattacgacctctacctgtccttcacgggcggcccgacgctgaggcgcctggaacgggattacgggtcttccgccgcgagagccctctactgctcggtcgacccggattcctacccggccctcgaccgcccggcgcgctacgacctctcgtatctcgggacctacagcccggaccggcagcccacgctggagcgcctgctgatcgaaccggcccgccgagcgcccgatctccgcttcgcggtggcgggcccccagtacccggccggcatcgactggcccgccaacgtcgagcggatcgagcacctgccgccggaccggcacccggatttctacgcggcgagccgctacaccctgaacgtcacccgcgccgacatggtccgggccggctggagcccgagcgtgcgcctgttcgaggcgggcgcctgcggcacgccggtgatctccgaccggtgggacgggctcgacagcctgctcgtcccggagcgcgagatcctgctgccggacggcccggacgccgtcctggtcatcctgcgcgggcgcgccgagctggaccggcgcagcctcggcgcggccgcccgcgcggcgatcctcgcgcggcacaccgccgccgcccgcgccgaggagctcgaacgcttcctcggtgagtcgggcgcgcggtccggatccgcgcgctccggcgcgcccgatctcgcgatcatcggtcactag

SEQ ID NO: 5086 - DNA, 798 bp, Methylobacterium sp.
atgaccgagccggggaccgggcgcatcctcgccgtggcgaaccgcaagggcggcaccgccaagaccacgacggccgtgaatctggctgcgacgctcgcggagcgcggccggcgggtgctcctcgtcgacctcgacagccagggccatgccggcctcggcttcggcgtgcgggcgaggcccggcgagccgacggtgcacgacctgttccgcggcgccggggtgacggatctcgggcgcgccgtcaggcgcaccgccgtgccgaacgtggacctgctgccggccgatcgcggcttctcgggccccgacggcgccgtcgcgcccctcggcctcgcggcgacgctgaaacccgtggcggcggattacgcggtgatcctgatcgacaccgcgcccacggccgacgccctgctgatcagcgccctggcgagcgcgcaccacgtcctggttccgacgcagctcagccacctcgcggtggacggcgtcgggcagttcgcgcgcgcgttcttccgggtggcgacgagcctcaatcccggtctgcgcggcctctcgatcgtgccggtgcaggtggatctccggatcacgatgcagcgggaggccctcgagcagctcgcgagccggttcggccgggagcgcctcctgccggggatccgcacggacattgccctggcggaagccttcgggtgcggacggccggttcggcacgtgaagccccgtgcgcgggcggtgcaggatttcgagctgctatgcgaccacgtcatggaaaaatgcgttgccggccagattggaacgattaaaacttag

SEQ ID NO: 5087 - DNA, 1956 bp, Methylobacterium sp.
atggaacgcctcgacaagcatccggtcgcgctcttcgcggtcatcgtgctgggtgccaccggcctgctggtcgccctgcggccggacgtgctcgggtcgctcgccgcgacgccgtcggcgctgctgcgcaacggcctgatcctcgggggcctcgtcggcggcctgctcgcggcgagctacatcccggcgcggatcgaggcgacgcggcgcgccctggaccgggcccgggcgagccgcaagatccgcccgatccgcttcgtcgacgacggcgcggccgcggagaagaaggaccttctggccaccgcgctcgcgaccctcgacggcatggtcgggctcgaccccgtgaagctggaggtgaagggcgtcatcgcccggatgcaggtggagcagcagcgccgcgcccagaacctgccggtggcggccatgagccagcacatggtgttcaccggaccgcccggcgtcggcaagaccgaggtggcccgggtcctcggcagcgtcttcaaggcgctcaaggtgctgcgcaagggccacctcgtggaggtcgaccgggccgggctggtggcgggctacgccggccagaccgcgatcaagaccctggagcgctgcaaggaggccctcgacggcatcctgttcatcgacgaggcctacgcgctggctcccggcggggggagcggcggcgagttcggcaaggaggcgatcgacaccctcctcaagttcatggaggacaatcgcgaccggatcatcgtgatcgtcgccggctacaccaacgacatgcgccggttcatcgacgcgaatcccggcctcgccagccgcttcaccaagaccgtcgagttcccgccctacagcccgccggagctcgccgagatcctgaagcgcatggccgcgggccagggcttcgtcatgccggaggggttcgagaaggacctcgccgcctatgtcggggcccggtcgaaggccgaggactgggccaacgcccgcgagatgcgcacggtcctggagaaggcccgccaggcgcaggcgctgcgcctcgccgccagccccggcggcgacatcaaccggctcgaacccgccgacatcgccgcggccctcggccgccaggccggcggcgcggtcgacatggacgcggcccggaaggtcatggcccgcctcgacgcgatggtcgggctcgcgccggtcaaggagcaggtgaagaccgtggcggcgcgggtgctggtcgatgcccggcgccgcgccgaaggcatcgaggtcggcgcggtgagccagcacatggtgttcaccgggccgcccggcgtcggcaagaccgaggtggcgcgcatcatgggcgacatcttccggacgctcggcgtcctgcggaaggggcacgtggtcgaggtcgaccgggccgggctggtggcgggctacgtcggccagaccgcggccaagaccctggagcgctgccgcgaggccctcgacggcatcctgttcatcgacgaggcctacacgctggccgagggcggcgggggcggcagcgacttcggcaaggaggcgatcgacaccctcctgaagttcatggaggacaaccgcgaccggatcatcgtgatcgtcgccggctacaccggcgacatggcccggttcatcgacacgaatcccggcctcgccggccggttcaccaagaccgtggaattcccggcctacgacccgtacgacctcgtcgagatcctgcgcctgatggcgtcgcggcaatcgttccggctgccgccgcgcttcgagaccctgctgatcccgtgggtcgagcagcgcgcgcagcggcacgactgggcgaatgcccgcgagatgcgcacgctcctggagcgcctgcgcgaggcccaggcgatgcgcctcgccagcgatcccctgggcgattacggccagttcgagctcgtggatgtcgagcgggcgctcggcggcggggccccgcgccccgccgccctgtcgtga

SEQ ID NO: 5088 - DNA, 1392 bp, Methylobacterium sp.
gccggggcctcgccgctctggcgcggggcggggctcctcgccctcgcgctggcggtgagtgccgcgctgctgcacgccaacctggcggccgtcctgccgcccgggcagtggtgggccgccctgctccatccgaccgacagcgacatgccgcagcttgtcctgcgcgacagcctgctgccgcgcctcgccatggcggtcctggcgggcggcggcctcggcctcgccggcgtgctgttccagcaggtgctcgacaacccgctcgccgagcccggcaccctcggcgtgttcgcgggggcgaagctcgccctggccctcgcgaccctgtggtggccggccctcctgatctacggctacgagcccgtggccggcgccggggcggccctgtgcacgggcctcgtgctgctgctgagcgggcgcagcggctacgcgccgtccaccgtcatcctcgccggactggtggtcgggctgtccgccgaggccgccaaccggatgctggtgctcgcgcatttcgacgcgctctccgacctctacgcgtggcaggccggcgcgctgaaccagaacaactgggacggcgtccgcggcctcgtcccgcgcctcgccctcgcggccctcgcggccggcctgctggcgcgcccgctgaccctgatcgagctcggcgatgccggggcgcggggcctcggcgtctccaccgccggcacgcggcttgccgccctcgccctcggcgtcgcggtcggcgccagcgtgaccgggtatctcggggtgatcggcttcgtcggcctggcggggccggccctcgcccgctacggcggcgcccgccggctccgcgaccgcctgctctgggggccggtcgccggggcggtgctgctcgtcctgaccgatcagcttgtgcagcggctcatcggccgcagcggtgtcccgaccggcgccgtcaccgccctcgtcggcgcgcccctgctggtcggcctcatcctgggtctgcgcaccgcgcgcgaggcgccgccggcgccggggcccgtcccggtccggctcgcccggccgtggcccgccatcggggcgctcgcgatcctggccctcgcgggcgtcggcctgtcgctcaccctggggcgggatgcccagggctggctgtggagccccgatccgggcgccctcctggcctggcgggcgccgcgcgcgctggccgccctgggggccggggccatgctcgcctacgcgggcgggctgctgcagcggctgaccgggaaccccctcgcgagccccgagctgttcggcgtctccgcgggcgcggccctcgtggtggtgctcgtcctgttcctcgcccccggcctcggcccggccgcgatgctggccgcctccgcggcgggcgcgctcgcgacgctgctggcggtcctggcc

SEQ ID NO: 5089 - DNA, 495 bp, Methylobacterium sp.
gtgccgacgattttcgatgcccataccttcgccctcacggcgcatgcgggtcagctcgacaagggcggcgagccgtgcatgcggcacctggaacgcgtcgcgaacgccgcccagacccgggccggtcacgcccgactcatcgacgggctcgacatcgacccgatgcgagtcatgcaggcggcgctcctgcacgatgtgctggaggacacgtcgcgcacggcggcggacctccgcgccgccggcttcgaggccgacatcgtcgagacggtgacgcttctcacgaagccgcagagtcggatcgcctattccgagcggatcaccgccctgatcgcggccggcaacctcgcggcgctgctgatcaagatgtccgataccgaggacaacctctgcccgacccggatcccgcccaacgccgcgttcctgcgcgagcgctacgcgacggcattcgagcgcctgaaggcggcggcggcggcgcgcgggtacaccggccgctga

SEQ ID NO: 5090 - DNA, 1068 bp, Methylobacterium sp.
gtggatgagcgtctgaaggatctcacggccaagggtgacgcgctgcagcggttgagcggcatcgtcgatttcgagctgttccgggacgatctcgcccgggccgtgcctcgctcggacgggtcgaagggcggtcgcccaccgttcgacctcgtcttcatgttcaaggtgctgatcctccaggccagccactcgctgtcggacgagcgcacggagttcctgatcaaggacaggctttccttcatgcgcttcctcgggctggggctgtccgatccggtgccggacgccaacacgatctggaccttccgcgaggcgctcacccgggccgagatcgcggggaagccggccatcgcagtgctgttctcggcctacgaggcggcccttcggcacgccggtttcctggcgatgggcgggcagatcatcgacgcgaccgtggtggccgcgcccaagcagcgcaacacggaagccgagaagacggatctgaaggccggccgtgtgcccgacgcctggaaggccaggccggccaagctcgcccagaaggaccgcgatgcgcgctggacgatcaagtggtcgaaggccaagccggccgaagatggatcgaagcggatcgacctcgcggtgccggccttcggctacaagaaccacgtcggcatcgatcgccgccatgggctgatccggacctggaccgccaccgacgcggcccgccacgacggggcgcagctgccccggctcctctcgaaggccaataccggcagcgacgtctgggccgacacggcctaccgctcgaaggccaacgaggcacacttggcgagcaacggcttccgctcccgcatccatcgcaagaagccgccgggcaagccgatggcgaggaacgtcgcccgggccaacggcgagaagtcgaaggtccgcgccgccgtcgagcacgtcttcgcccggcagaaggggccgatggggctcgtggtgcgcacgatcggtttggcaagagctcggatgaagatcgggctggccaatctcgcgtacaacatgaaccgggcggtctggctcgccggctcccgcgcgaggactgcctga

SEQ ID NO: 5091 - DNA, 279 bp, Methylobacterium sp.
atgaagcacgtccgtatccccgatttcagccagcccgttccggtccgcatcgcggccaacggcaagccggtccgcgttccggtcgaccgccgctatcgcaatcttccggacgagcagcagccgggcactatcgagccctggcaggccgtaaccccgatccgtccggacaccgcgcacagccggtccctgcgcttcctcgacgccacgggcgaactgctggccgcagtcgccatcatcggtggcggcatgatcctgaccggcctcgcctcgctcctctaa

SEQ ID NO: 5092 - DNA, 276 bp, Methylobacterium sp.
atgctgttcatggctacccgtcattctacagcaccggcacgagccggtgaacgctctcgctcgcccgcagccctctacaatcgcaccaagccggcctttgagagcgacgagttcgcccccggtaccgtcgaggcctgggaggccgtcgcaccgatccgacccgacacagctcacgtccgagccccgcgcttcctcgacctcgccggcgagctcgccaccgccgccctcatcatcgccgggggcgtgttcgcctacggcttcatgccgatcgcgtga

SEQ ID NO: 5093 - DNA, 681 bp, Methylobacterium sp.
gtgagcacgccgcacacgctcgttcggtttctgaaggccaacgcgttcttcgctgagcttggtccggaagcgatcgagaccatcgccgggctctgcacaacgcggagcctcgcgcgacacgagatcctcttccagaagggcgatccgggcgatgctctctacgccgtgcgtcgcgggcagatccggatcggggccggctccgacgacgggcgcgcggtcaccctcaacctgctcgggccgggcgacgtcttcggcgagatcgccttcctcgacggccatccgcggaccgccgaggccgtggcgctcgagccggccgacctgttcgtggtcgaggggcgggccttcctcaagctcctccacggcgatcccgccctggcggtccggatcatcggcctgctgtgccagcgcctgcgctggatgagcgcgcgcatggaggaggcgacgctgctgccgctcgacatgcgcctcgcccggcgcctgatcatgctgtcggaggattacggcgccgagatccaggtgacgcagcaggaactcgcggccttcgtcggcgcggcccgggagagcgtcaaccgcgtcctgcaggactggcagagatcgggcctcatcgatctcggccgcgcgcgcgtcaccgtgcgggcctcacaccgactcgtcgcgctcggcgcgcgggcgcagacatga

SEQ ID NO: 5094 - DNA, 780 bp, Methylobacterium sp.
atggctgcggctctcgtgctcaccacaatcctgggtggaactgcctacgcggcggagcaggccgtccagaccaacggcacgcagatcagcgcgagccaggcggcggtcgacaaggatgtcggcaagctctcgaaggacggcgcacagggcttcagagatctccagctcacccgcctcgcgatcttcgaggccaatcccggccaggccaaggacatgatcgccaaggcgcaggccgccttcgccaaggccaagaccgacgatgcggtcttcaccaaggccgaggccgacctcaagtccccggccgacatggccgcccacaaggcgaatgcgccgagcgacaaggccgacaccaaggccgataccaagacggcctccaaggagcaggtggcctgggttccggtcgacgcgcagctgaccctcggcgacgacttcgtggccacgcccgcgaaggcctctgcggtgaccgaagcgaacaagaatctcgctcagggcgaccagaagggtgccctggagaagctcaagctcgcccacgtcgacgtcaacttcaccatggcggtcctgcccctgaaccagaccatcaccgacgtcgatcaggcagcgacgctgatcaatcagggcaagtattacgaggccaacgccgccctgaagtcggcccaggacaacatgcgcttcgacgtgatcgacgcgatcgcggtgccccagaaggcgaccgccgccacggccgacaagggcgcgccgcaggcgaccggcacgacggcgggtgccaagaccagcaagtga

SEQ ID NO: 5095 - DNA, 930 bp, Methylobacterium sp.
atgcgcctcttcgtcatcggaagcttcgtgatcgcctgctcggtcaaggtcgcgcggctgccgcaggcgggcgaatccctcgacggcttggccttcctcgccgagcctggcggcaagggcttcaacctcgcgctcgcctcgcaccagctcggcgtcggggtcgacggactcttcgccgtcggcacggacgtgttctccccgatggtccgcgccaccttcgcgcgggtcggattcgccgaggacatgctggtgccgcatgccggctcgacgggcgccggcgtcgcgttcgtcgacgcggctggcgagaactgtctcgcggtctgcctcggggccaacctcgccctcggtgcggaggacatccgagccgccgccgcccgactcgagcgagcggagctcgtggcggcgacgttcgaatcgcccgacgcctccatccgagcggcgttcgcgctcgctcggacggctggcatcccaactctgctgaatccctctccgatgcgccccatcgacccggcgatcttggccgataccgcgatcctcgtcgtcaatgcggtcgaggccgccgacctcggcctcggaactcccgacgccatcgcggacgccacggccgcgacgccggcgatcgccgccctgctctccggaggcctcgaactgctggtcgtgaccctgggcgagcgcggcgcggtcgcgttccgctccggactgcccgccctacgccagccggccttcgcggtcgcggcggtcgatacggtcggcgcgggggacgcgttcacggccgggctgatcgcgggcctgctcgaaggacagcccctcgacgcgactttacggcaggctgcggcctgcggtgcgctgacgacctgccagttcggggccttcgaggcctttccgaccgcgcaggtgctggccgccttcctccgcgacgccgacatgtga

SEQ ID NO: 5096 - DNA, 207 bp, Methylobacterium sp.
atgacgaaccgcaacatggtcaaggatgccgctccgggggcacaagccacgcagcccaacacgccgccgctgccgccgatgccggcgccggaagattccgccaccccgaccacccgcgaggagccgacggattcgccgcacctgaacgccagtctcaagcgcgacgcgccccctcccgggggacgggggctctcgacgaagcgctga

SEQ ID NO: 5097 - DNA, 1335 bp, Methylobacterium sp.
atgaggcgcctcctcctcgccgcgctgctgctcgccccggcggcggcgcgcgccgaccccgcgacgcaggcgctgacaccgttcctcgacgcggtggcggcctgtaccggccggccggacctgacgctcgcggtcgtcggcgtcgagcccggccagacggccctgtcgcgcgagcagtccgaggaggtgcgcctagccgtcgagacgcggctccaggcgaccggccgggtcaggctggcggcggcggccgacgtcgtgcggatcaaggccctgcacgagggcacgacgggcctctcgggcgcggaggccgaggcgcagatccggtccgccttcgcgggggatgcggccgtgttcctggtcgagccccgtcgggccggcgagaccgcctccgtccggctccaggccgtgacgcagagtgccgcctgcaaggcgacgagcgaccctctggtcgtaccgatccatgtcggcgccggcgtcgcagacgtcgacgcggtcatggacggtgcggtgaaggctttcgcgcaggccgcaccgaatgccggcgccgtcgaagtctgcccgttcgtggcggagggcggccattccacctgcgccggcgccctcacggaccgcctcgtcatcgccctcgacgcggaggcccgctcggccaaccggatgctccgcggcgcgcgcctcgacgtgcgccgccggccgcccggcaccgcctgcgccggcaccgtcaccgcgcgcggccgcttccgcaccgaccacgaccggcaatcctggatggaggtcgagttccagcgcgagggcgccgtcctggccccgacggggcgacgccggatcgcgacggaggggctcggatgcgatcccgtcccgcggccgttcctggatcacctcgccgccaccgcgcgcaccgatgccggccgcctctcggtggcggctgccgccacgccgttcgcggccggtcagcgcctggagatgcgcatcgagtcccgcgtcgcgcagaacctgtactgctgggtggtcgcggccgacgagaccgccttcgtcgccctgccggtgcgcgacaacgcggcctcgcagctggccctcaagccgggagactcgcggcgctatccgcggggctacggcctcgacgagatcgtcgcgggggagcccttcgagaacctgttcgcctgcttcggcgtaccgggcggcctgccgccggaactcgccgcgcggtggctggcggcggcgccgggcgccgacggcgaggcgcgtctcctgcagcccccggacgtgctggacctcctcgaccggatccgggccacgcccggggtcaccgaggccgccgcgcgcgtcgtggtgcgctga

SEQ ID NO: 5098 - DNA, 1392 bp, Methylobacterium sp.
atgacgggcggatacgatgagcgctgcgcggccgacctcgccaatgtcggcgacggccgcgatctctcccgcgccgaccgtgcctggctcgcccgcgtggtcacgggtgccgtgcgcccgaaccgcgacaagcccctgtgggacctcgcccacgccctcgcggcgctggccggggcggccggggcccgcgacgggcgcgatctcatcaccctcgccctggacccgggcctcgcgcgaccggccgccctctcggcgcgcttcagcggcggcccggccgtcgacgaccgcggccccgtgctcggcaccgcctggtccaccggctgggccgggctcgcccggctcctcgcgctggccgagttcgtgctcaccgccgaggacctggcacagttcgcgaccgtcgcgggctggctcgacgagctcgccgccgcgcccgacgcggaaagcgcggcgatcctggccaagcggctggcccggcatctcgccgcctaccggaacgcccacctgccgctggcgccgctggaacggcgcttccgggcgctcctgaccttcctgggcggccgccggtccgtcgcggacgacgacatcctcgatttctggcgcgccgagatggcgacgggcgagcggccgggcttccgcatcgtcgcggagcatttcgtgaccttcgaggcggccggccgtctcctcgaaggcctcgatgccctctcggcgcccgccgccctcgacgcccacgcgggctgggaggagcggctggacgcggccctgggcgatctcgcggccgccgaacccgccgcggcgctggcgaccgtcctggcggactggccggagggcccgaagatcctcaccggcgccgagcgcgaggatctggccgacttcctgcgcctcgagccctaccaccggacccgcccgctgacgacgctccgggccgtgagcttcggccgggtccagtcgggcatcgccaaccgcctgcgccgcggcggcggcggcgccgccatcgccgagcgggcgacctgtttggaggccgagagctacgccgaactccggacgcgcgcgggactgctcgcggcccatctcggccggatgctgcgcatcgcggcggccctccggatcgccgatcgcgacgcgctgcccgaggcggtgcgggccgcgctggaggccgccgaggccgacctgcgccgcgtccgacgcgccggattcgacgatcgggagggcctctcggccgggttcgcggccgccgaaccggcgctgctgcgcctcgccgaggcggcggccgatctggagcggtcgctcgacggcctcgcccggcaccggccgctggacgcgctgttcccggcggatcgggacgtcttcgcggtcgcgttcgcggcggcctatgccggggaggccgcggcgtga

SEQ ID NO: 5099 - DNA, 561 bp, Methylobacterium sp.
atgagcatcgatgtcggcgcgcggctgcgcttcgtgcgggcccgccacggcctgtcgcagcggacgctggccaagcgcgccggcgtgacgaattccgcgatctcgctgatcgaagccaaccgggtgaacccgtcggtcggcgccctgaagcggatcctcgacggggtgccgatcggcatggccgagttcttcgccctggagccggagccggagcgcaaggcgttcttcgccgccgaggagctcaccgagatcggccgccgggccgccaagggggcgatctcataccggcaggtcggcgacagcctgttcgggcgcaagctccagatcctcaaggagcgctacgagccgggcgccgataccggccgggtgccgctctcccacgagggcgaggagggcggcatcgtgctgtccgggcgcctggaggtcaccgtggatgccgagcgccggattctcggccccggcgacgcctacagcttcgacagccgccgcccgcaccggttccgctgcgtcggtcccaacccctgcgaggtggtgagcgcctgcacgccgccgagcttctga

SEQ ID NO: 5100 - DNA, 1914 bp, Methylobacterium sp.
atggatgtgccttcacctcacgcgctcgcggaagccggaccgaccgacgggcgctggagcgccgccgaccggatcgccgaactgcgcgatctcgcgatcctcgattccgagcccgagccgctctacgacgacctcgtgcaggtcgccgcctacgtctgccgggcgccggtcgcgctggtcagcctcgtcgatgccgagcggcagtggttcaagtcggaggtgggcctcggcaagcgcgaactgccgatcaattgctcggtctgcgcccacacgatcgaggccggcgaccttctcgtcatcccggacctgaccaccgacccccggaccaccgagaatcccctcgtgaccggggcgccggccttccggttctacgcgggcgcggtgatccgcggcagccgcggcatcccgctcggcgccctctgcgtgctggaccgggtcccgcgcctcgacgggctcgattcggagcagaccgcgaccctgctggcgctggcgcgccagatctccagcctgctggagcaccgtaggacgctggcgcaggtcgccgcccgcgaggcggagatcgccgcgagcgagcgccgcttccgcgtgatgacctcggcgatgccccaaatggtctggaccacgcggccggacgggttccacgactactacaacgaccgctggtacgagttcaccggcgtcccctacggctccaccgacggcgagggctggaacggtgtgttccatgccgaggaccaggacagggcctgggcgcgctggcgccactgcctcgcgaccggcgagccctacgagatcgagtatcgcctgcgccaccacagcggcgactaccgctggaccctggggcgggccatgccgatccgcgacgccgaggggcggatcgagcggtggttcgggacctgcaccgacatcgacgatttgaagcgcgccgaggccgaggcccgcaagctcgcggcgatcgtcgagacctccaaggacttcatcgggctcagcaccctcgagggcgcgatcacccatctcaacgaggcggccatggccctggtcggcctgcccgatctcgccgccgcccgcaccaagaaggtgcccgacttcttcaccgacgacagccgccggatcctggccgagaccgtgatgccggcggtgcgccgggacgggttctgggagggcgagctcgccttccggcacttcgtcaccggcgagcccctggcggtgctctacaacatcttcccggtgcgcgacccgaccggggccgagatcggctacgccacggtcacccgcgacctgcgcgaggccaagcgcgccgaggaggcccgcgatctgctgatccgcgagctgtcccaccgcatcaagaacatcttcgcggtcgtcggcggcctcgccgccctgaccgcccggaccgaccccgcggccaagcccttcgtggccgcgttccgcgagcggctcggcgccctggcccgggcccacgaatacgtccgcccgcactctcccgacagcgccccgccggtcgccggccagaccgtgctcgggctgatgcgcctgatcatggccgcctacgaggagaacgggcgggcgcgcgtggtgatctccggggacgatgccgagatcggcgagcgcaccgccacggccctcgcgctgatcatgcacgagcaggcgacgaacgcggtcaagtacggcggcttgtcgacgcgggagggcggcgtctcgctgagcgggacccgcgaggcgggccgctacacgctgacctggcgcgaggagggcggcccgcagatcgccggcgcgccgtcccggaaggggttcggcacggtgctggccgagcgcagcgtcgccggccagctcgacggggtgctggagcacgactgggcgccgggcggtctcctgatgcggctcagcgtcccgctcgagaacctgcggacctga

SEQ ID NO: 5101 - DNA, 1260 bp, Methylobacterium sp.
gtggccctcatcttgccggcaatcgccgcggccttcgatctcgacgtggcggcggccgcctgggtcgccgagacgtacagcgtggccttcatgagcacgctgctgatcgcgggggcactggcggaccgatacggccgacgccgtgtactgctggccggcaacatggctttcgccgtcatgtccctcggctgcgctttcgccgggggctcggctacactctgcgcggcgcgagcattgcaaggagcgtccgcagccttcgtcatcaccggggcattagcctcgctttccttagcctatccgcgtcccactgagcgggcgcgagccttcggactgctgggcatgacgaccggggccgccatggtcctggggccgagtttcggaggatttctcgctgccgcgttcggctggcgagcggtgtttctcgtcaacttgccgatctgtcttgcggtcgcgcgcactgttcctctgagggtgtcagagacgttcgatcccgagggcaggcccctggacattcccggggtcgccctcttgagcggcagcctcctcgcgtgtgtgctggccctgctggatggaagcgcctcggtcctgacccgcgccatgctgctgtccggcgccctcggcctaggctttcttttcgtccgcaggcaattccgccaaacgcgcccgatgcttgatccggcactcgtcacgcggcgcgagcctcttggcattgcctgcgtgctcgtggccctctcaatcggatactggtccgtcctagtctacctgccgttagctctcaaagccgtctatgcaatcagcaccgaggcgatcgggttggcgatgctcgcgctgactatgccgatgctggggctgccaccgctcggtgcacgcctcgccgtcctatggggatggccgaggcttttcgcctttggtctcttggttctagcggcgggtacgaccgcgctggccctgatgctccattggcaccggcccctcgccgaaacgctcaccgcgatgttggttgccgcgagcggcgccggcttaatcaacgcgcaagtctccagcgctctgatcgcttcgggaccagccgcacaggccgggatgacatcaagcttctcatcgacccttcgccagatcggcttcgccctcggcatcgcgttgctaggcgcagttgagagcaccgggacagaaggaggttcattcgccttggcgtttgccgttgcagcatcggcggctgttctcggtgcctttgccatcatggccgctcgtcaagctggctaa

SEQ ID NO: 5102 - DNA, 795 bp, Methylobacterium sp.
gtggactgggtgatcgtgcagcggttccacagcctggagcaggccatgacctggatggcctcccccgagcggcaggcccgcatccagggtgccacgccgatgctcgtcggccgcgacgacgtccacatcgtcaaggacgacgccggcgcggcccggacctcgccggtcagcgcggtgatcagcacccgcgtgaagcccggcatggaggccgcctacctccggtgggagcagaagatcgcggccgcgcagtcgcgggcgcccggcatgcagggctaccggttcgagccggccgtgccgggggtgcaggaggactacgtggcgatcctgcgcttcgacagcgaggcgaacctgcgcacctggatggactcgcccgagcggcgggccctggtcgccgaggcggcgccgatgaccgcggaattccacacgcggacggtgcagagcggcttcgagcagtggttccgcaacgtcgcgccgccgggagagggcgcgcccgcggcgtggaagatgaacatgatcgtcgtgctgaccctctacccgaccgtgttcctgtggggcgtcctggtcggcgcgccgatcctggccggaatgctgaaggtggatttcccggtcgccctgttcatcggcaacgtgttcagcgtgctgctcacctcgctgatggtgccctggacggccaagcggctgggctggtggctgacgccggatccggcgcgacggacccgggtcaacctgcagggcgccgcgctgctgatcgccgcctacgcgctcatgatcctcgtgttctggaagctgttttga

SEQ ID NO: 5103 - DNA, 459 bp, Methylobacterium sp.
atgatcgtcctcggtgtcgccctgctcgccgcctgcacgctgatcggcgtgtatctcggtgacctcctcggcctcgccctcggcgtgaaggccaatgtcggcggtgtcggcatcgccatgatcctgctcatcaccgcgcgcctgtggctgtcccggcggggccgcctgaccaagggcgtccagttcggcgtcgagttctgggcggggatgtacatcccgatcgtggtcgccatggcggctcagcagaacgtcgtcgcagccgtgagcggcggcccgatcgtgctgatcgcggcgaccggctccctggtcctgtgcttcggcgcggtcgccctgctcagccggattggccggcgcgatcccggcggcggcgccgtcgcgcacggcggctccgtgatcggcggcgacgccgagcccgacgcggccgcgccggccgccgtgcccgtcgccaggaaggtgtga

SEQ ID NO: 5104 - DNA, 432 bp, Methylobacterium sp.
gcggaccggagcgtcagcgaggcgatcctcggcgccctcggccgcatcggcaccccggcggcggccgagcgcctgttcgacctgctgggctcggatgacgtctggctgcgcaacgccgccatcgagaccctgcaggagatggacgcggcggtgctcggcgcccttgagcgggccctcgccgatcccgacagcgaccgccggatcttcgctgtgaacgtgctggtctccctgcgccacccggcggccgcgacctacgcccgccgggtcctggccgaggacgggcacgtcaacgtctgcgccgccgccctcgacgtgctcgccgagatcggcacgcccgagatggtgccggagatcgaggccgccgccgcccgcttccccgacgcgccgttcctgcgcttcgcggccagggccgcctgccgccgcatcacctga

SEQ ID NO: 5105 - DNA, 372 bp, Methylobacterium sp.
atggccaggatcctcgtcgtcgacgacgccaccacggtgcgcctgtactaccgcgacgtgctggaagaggccggcttcgcggtcgaggaggccgtgaacggctacgagggcctggagaaggccgtcgccgaggccttcgacctcgtgttcgtcgacgtgaacatgcccaagatggacggctacgccttcctgcggcagggccggaccatgccggagctccaggcggtgccggccgtgatgatctccacggagagcgccggcgccgaccgcgcgcgggccttcgcggcgggcgccaacctctacctcgtcaagccggtgcgtccggacgccctcgtcgcggtcgccaccgtgatggccggagccgcaccgtga

SEQ ID NO: 5106 - DNA, 873 bp, Methylobacterium sp.
atgagcggcgtcacgatcgggaccgaccgggtccgggcgcacgcgacgctctggtacgcggacgcgcgctaccgcctcgcctggctggtcctgccccaggccgcggtcgccctcctggccggcctcgccctggcgctgctgaagcccgcgggtgagtggggcaagcccgccgacagcaaggagaacgagaagctctatctcgacctgctcgacaaggccggcaaggacggcgaccgggccgccttcgagaagctgcggacggccgccgaggccggcgacgtcagcgcccgctcgttcatgggcgccctctacaatcccgaatgggccgcggtctacgccaagaacccggtcaagcccgacgccgccaaggcgctgacctactaccagaagcccgccgacctcggcttccccggggcccagcgcggcatgaccgagctcctgctcgaccccgcccgcggccagcacgatctcaagcggggctgccgctacgggctggccttccaggcgaacccggtcgcggcccggaacaactacctcgattcctggtcgacgctctactggatcgccggctgctacaccgatgccgggagcggcgtcccgcgggatccgcagaaggccgccgacctctacatgaacacggtggcggccaagctgccgcgggcggtcaccaccttcacggacgagctcggccgccagccccccgacctcgtggcggcgatccagcgcgacctcgccaagcgcggtttctacaccgggccggccgacgggacggcgacgccgcagacgcgcgcggccgtgcaggccctggccggccggggtgccggcccgcagggcagtgccggggccggcaatgcgggggcgggcaatccgggg

SEQ ID NO: 5107 - DNA, 1368 bp, Methylobacterium sp.
atgggtccccgccgcaaggatcccgcgcggttcccggccccccgggccggaaaccgcatcggccatcgcatcggccatcgcactgcccgccgcgccgccgccccgatggcggccttgatggcggccctgctggccggcctcctgatgcccgccgccgcgcaggcgcagatcaaggtccgcaaggccgactgcttcttcgcggccgacggcaggaccgtcatcgacggggtctgcgagttcctgaccgacgcgcgcagctacggcgtgggcgggttccgcctcgccacctacaccaacggctacctgcgcgacggcgtggtcgtgtcggtgacggcgcccggccagggcacggcgacctggaaccgggagcccggcggcaagcccgaggacggccccgccgacagcgtcaccgcggagggcgcctgctggaccgggtcccggagccggatctgcgcctggaaggtcggcgagggccgccccggcttcggcggcgcccccgcggcggcgcccgaggccggcgctccgcgggccgccgactgctacctcgaggtcgcgggcgatgtccgcctcgacggggcctgccagttccggtcggagaccgggcagaccggcgcccgcggcttcgagatccgctcctacgccgcgggcaagctcgacgtcgtggcgcagctcgtccgcgacccgcagaacccgctgaaggccacggccttctggaacgggtcgtccgggggcctgcgcgccgccgaggccctcggcgccctgtcgccgagcggcccctgctgggacaatgacggcgctcgtctctgcgtctggcagcccggccagccccgcggcggctgggaccggcgggccgaggcccgggctccggccccgcccgagacgccgccgtcgccgccgccgtcacaggcgccgtcacaggcgccgcctccgccgcgcgacggcgcggaggggcgcgatccgccgccgggcacgttcctgaagctgtccttcaagggccgctgcgagtccctgatgatggacggggaggacctcaccgcgacctgcgcaccggaggcggtgaacacctccgtcgtcggcagcccgaaggccgggttcatcttcggcaccaccgacggcaaggccatggcgttcatggcctcggccaagggcttcgtcgagggcggcaccctgcaccagcccgtcgacgagctgatgtacgccgagcgcgaccagtccaccttcaaggtcaagggcacctgcgagatgcccaacccgatgggcggcccggtggtcatcacctgcaatgcccagtcggcgaacagcacctacgcggtccggttccgcaccgacggcggcaagccggtcctgacgcgcggcgacgcgaagtga

SEQ ID NO: 5108 - DNA, 537 bp, Methylobacterium sp.
agccgcgcgcccccgagcgccccgcccgccgccaagccgggcctctcgccgagcctcatcgcgatcgtgggcggcctggtggcggcgggcgccgtcgcgggcgtgctgctctcgggcagcggcgagaccgccgggacggccgcgcgcccggccctgacgctggtcaaggcgggcgagatcgacaaggccgccgagaccctgccctccgacgagaaggacaagatcgtcgcggaggccaaggcctgccgggccccgctgggccagatgcgcctgtcgaagatggcagccgatgccggcggcgtggtgcgcatccgggccgggaactacctgtccccggccttcaacgtcgccgacggaccgatcaacatcgcggtcccgttccccgcgccctacgagaccggcaagggcgagatcaccatcgagggcgccgccaaggacgtcttcgtcgagctgacgccgggcctgaagatcgacacgaccggcggcgtccagcggatccccgtgatctggaataccagcaagccctgcggaggctga

SEQ ID NO: 5109 - DNA, 888 bp, Methylobacterium sp.
gtgagacgcgccgacctccccgccctgtcgctcttcgccgcggtcgcggcgcgccggagtttccgcggcgccgcgcgcgatctcgggctctcggtgtcggcggtgagccacgccatcaacggcctggaggcgagcctcggcgtgcgcctcctcgcgcgcacgacccgcagcgtcgccccgaccgaggcgggccagcgcctgctcgacgggctcgagcccgccctcgcggcgatcgccgacgccgtcgaggtggcgaccgccgcggagcggcggctcaccgggacgctgcggatctcggtgccgcggtcggccgccgagatgctgctggtgccgctcgccgtcgcgttcacccgcgcgcatccgggcgtcgagatcgagatccgcgcgcaggacggcttccgcgacatcgtcgccgaggggttcgatgccggcgtccgcttcgccgagagcctggaccaggacatgatcgcggtgccgctcggcccgccgcagcgcggcgcgatcgtcgccgcgccggactatctcgcccgccacggaacgcccgcggacccgcaggacctgcaccggcatgtctgcgtccggcgccgcttcccgagcggcggcctctacctctgggaactcgagaaggacgggatcgcccagtcgatcccggtcaccggcaccctcgtcctcgacgatgacgggctggtggccgaagcggcgcgcggcggcgccggcctcgcctacctcttcgaggcgcaggtggcggccgacatcgcggccggccgcctgatccgggtcctcgacgcgtggtgcccgcccttcccgggcttcttcctctactacccgagccgccgccagatgcggccggtgctccggagcttcgtcgatcacgtccggggccgctag

SEQ ID NO: 5110 - DNA, 924 bp, Methylobacterium sp.
acgggccaggacggcgcgtatctggcgcagctgctcctgcagaagggctacgccgtcaccggcatcgtgcggcgctccagccatgccggcgtcttcgaccaccggttgaagtggctcggcatcaccgacgacgtcgagctggtcgacggcaacctgctcgaccaatccgccctgctgcgcatcgtccaggccacgaagcccgacgagatctacaacctcgccgcccagtcgttcgtgacctcgtcctggcagcagccgctgctcaccgggcaggtcaccggcctcggcgcggtgcacatgctggaatgcctgcgctcggcggcgccccaggcgcgctactatcaggcctcgacctcggagatgttcggcctgatccaggaggccaagcagagcgagtcgacgccgttctacccgcgctcgccctacggcgtggccaagctctacgcgcactggatgaccatcaattaccgcgagagcttcgggctgcacgcgtcgaacggcatcctgttcaaccacgagagcccgctgcgcggcgtcgagttcgtgacccgcaaggtcaccgacgcggtggcgcggatcaagctcgggaagcagaaggagctgcggcttggcaacatcgacgccaagcgcgactggggccacgcccgggactacgtgaaggcgatgtggctgatgctgcagcaggaccgcccggacgattacgtgatcgccaccggccggactacgacggtgcgggacatgtgcgagatcgcgttcaagcacgtcggcctgaaggtggacgaccacctgatcgtcgacccggcactgttccgcccggcggaggtcgaggtgctgctgggcaaccccgccaaggccaaggcgacgttcggctgggaggccgagaccagcctcgaggcgctgatcaccgagatggtcgacgccgac

SEQ ID NO: 5111 - DNA, 633 bp, Methylobacterium sp.
atgtccgctctctcgatcctcgacatctccgccgtgcgcgccgcgcccgtctcccgcgagccctacgcctacacgctcggcagcaacgtcctgaatcccgaagcgatcgacgacatccggcgcgacttcccggacatcgccaagcccggctacctcacggtggacgaggtcgccctgaagggccggttcaaggcgctgatcgacgagctggagagcgacgccttctcgaagatcctcggcgagaagttcggcatcgacctcgtctcctgcccgcgcctgacgaccatcatgcgccgcagccagctgaaatacggctcgatccacaccgacggcccgtcgaaggtgctcaccctgctcgtctacatgaacgacgcctgggacgccccggcggccggccgcctgcgggtgctctacgacggccgcaactacgagcccttcgcggtggaggtcccgccgaccatgggcacgatgttcgcgttcctgcgggcggacaattcctggcacggccacgagcccttcgagggcgagcggcgcgtggtccaggtggcgtggctcaaggacgcgtcggagctggaccgcaagcgcaagcgcaaccgcacggcgcagttcctgaagggcatcttcggccgctga

SEQ ID NO: 5112 - DNA, 885 bp, Methylobacterium sp.
atgctcaagcgcctcgccctcgacgtgatcttcgccaacgtcgaccagccccgcaaggaattcgagctgaagaagatcgcggaactggccgacagcatcgcagagagcggcctgatccagccgatcactgtccgcacgatgggcaacggccagttcgagatcgtcgctggcgagcgccggtaccgcgcccacaagctgctcgccgagcagggtcgcctggagaccccgaccattctggcccacgtccgcaagctcgacgaggatcagcgcgacgtccaggcgatcgtggagaacatgcagcgcgccgacgtcaccccggtcgaggaggcccgcgccttcgcccgcatgctcgccaagggctggaccatggaagagctgggcaaggcgatcggccggaaggcgttccggatcgaggagcgcacccgcctgctcgacctggagccgaccctgctcaagctcctggagaccggcaacctgagccaggaggccgccctggagatctcccgcgtgaaggatcacgccgcccagacccgcctcgtccagctcatcagctcgggccgcctggtcgggttccgcgccatccgcaccgcggtccagacccagctcggcgagatcgcgcagaacgatatgttcggcgccgcggccccgaaggtgacggacgaagaggccgagaccctgtccgcgatggagcgcaaggtcgcggccgtcggcgacctggtcgcccgcggctggaaggacggcgagtgcgtcatcgccgcgaaggtcgacccgaaccgggcgaagatgatggccgaccggctcaagctgatgcaggcggcgatccgggcgatggagagcgagctgcgcgccgtctccgcccaggcggaactcgccgtcgcggcctga

SEQ ID NO: 5113 - DNA, 810 bp, Methylobacterium sp.
gtgcgccccaaaaatcggacgatcaagggtgatgtcgaggcggacctcgcggaaggcgagcgtccctcggtgctctctctcctccgcctgcgcgccgacacggcgatgccgctgtaccggcagatcgagggtcagcttcgcgaactgatcctgtcgggctcgctgccgccgggcgtcaccttgccggccgagcggcaactcgccgacagcctcggggtcagccgcgtgacggtccaacgcgcctatgccgagctcagcgacaacgagctgctcgtcccgcgcgggcgctgcggcttcctcgtgcgccgtccccccgagcccgtgcgcccgggtatggaccggctcaagggcttcacggaggagatgcgggagctggggaagatcccatcctcgcgcatcctcgatcggtcggtcgtcgaggaccgctcgatcgcatcgatcttcggtctgccctcgacggccccgttcctgcgtctgacgcgtgttcgctccggcgacggcgtgccgatgtcgcgcgaggttgcctggtacaacatccgcgccgtgcccgccctcgagaccggcgacctctccggttccgtctacgccttcctgagcgcgcacccgggcggccgcctcgtgcgctgcgagcagacggtggaggcgaccatgccgacggcggacgagtgcgagatcttcgccttcgagcagccgctcccgtgcctgctgatcaagcgccacagctacaatcaggactcggtgatgatcgagtacgtggaaggcctgttccgaggcgatgcctatcgctatcggctcaatctgcgcgcgtag

SEQ ID NO: 5114 - DNA, 1230 bp, Methylobacterium sp.
atgacgacgcgcttcccgcgcctgcgggcgttcctgaacgcccagatgtgggcgctcgacccggtctggcacgccttcatggtcgagatcgtcgagaaccgtgccgagggcatcgtcctgacgcccgagcagatccgcgagcgggccgcgcagcactcgcagctcgccgaggggctggtagtggccggcgtcgacgtgccgaacgggtcgctcgccctgttcgaggtcagcagcggcggtcggatctacgcggcgcgcggcggtggctcctcccgggtggcgggcgaggccgagccaggcagcctgatcgcggtgatcaacgtcatgggcgtcatcgcgcaccacgccagccaggtcgacaacatcagcggacccggcggcacctcgaccgcccgcgtcggccaggccttcgacgccgcgatggatgatccggccgtgaaggcgatcgtgctgcacgtggattcgcccggcggcggcgtcccgggcgtgcaggagctggccgacaagatcttcgcggcccgcgggcgcaagccgatcgtcgcccaggtgaacagcacggccgcctcggcagcgtactggatcatcagccaggccgacgagatcgtcgtgaccccgagcggtcaggtcggctcgatcggcgtgtacggctcgcaccgcgacctctcggccgccgccgagaagcagggcctgaaggtcacgttcttcgcgtggccgccccagaaggtcgacggcaaccagttcggtccgccctccgccgagttcaccgacaaggcgatggccgacgtgaagatggtctacggcgacttccggaacagcgtcgcgcgcggccgcggtgtgaagccggccgacgtcgaggccggcttcggcaagggcggggtcgagctggcgaggaacgccctgaagcagggcatggtcgaccggatcgcgaccatggaggacacccttcgccgggtcgcgaagatgaagccggcgccggcgcaggcccgggcccatgtcggcgaggtcacggtcgacgaggcccgcgcggaagccggtctcccgccgctcgacgcggctccggatgctccgcagccgggcgaggccgaggaaggcagcgaggaagccgtcaaggccgcggccgaggaagaagagcgacagcgcgccgaggcggcggatgccgagcggcaggctgcggccgagcgcgacgctttccgccgccggcggcacgcgcaccggatgcgcctcgcctga

SEQ ID NO: 5115 - DNA, 1143 bp, Methylobacterium sp.
atgatcccggacctgtccttcgacgcgcgcgagatcctcgcgaccctgcagccctgggtgctgtgcgagagccccacccacgacgcggcggcggtcaaccgcatgatgggcgtcgccgcccgcgacctcgcgctcctcggggcggccgtcgagacgatcccgggccgcatgggcctgagcgactgcgtccgcgcccggttcccgcaccgggaccgcgacgcgcccggcatcctggtgctcggccacctcgacacggtgcatccggtcggcaccctcgggagcctgccctggcggatcgagggcgaccgcgcctacggtcccggcatcctcgacatgaagggcggcaacgtcatcgcgctggcggcgatccgcgccctggcggcggccgggatcgagacgccgctgccggtgaccgtcctgttcaccggcgacgaggaggtcggcagcccctccacccgcgacctgatcgaggcggaggccgcccgccacgccttcgtgttggtgcccgaacccggccagcccgagaacggggtcgtcaccgggcgctacgccatcgcgcgcttcgatctcgaggccctggggcgcccgagccacgccggcgcctcgccccacgaagggcgctctgcgatccgcgcgatggcgcggaagatcctcgccatcgacgcgctttcggatgccgactgcaccgtctcgaccgggatcgtctcaggcgggcagtgggtgaactgcgtccccaccgtctgccgtgggcaggcgctcagcatggccaagcggcaggccgacctcgaccgcggcgtcgagcggatgctggccctgtcgggcgaggaggacggcgtccgcttcaccgtgacccgcggcgtgacccggccggtctgggagccggatgccggctgcatggcgctctacgagcaggcacgggcgctgagcgaggcgctcggccagcccctgccccatcgcagcgccggcggcggctcggacggcaacttcaccggcgccaacggtatcccgaccctcgacgggctcggaccgctgggccatggctaccacaccctggaggagcacgtgctgatcgagaccctgccgcagcgggcccggctgttcgccgccctgctcgccaacctcggcgccgccggccggccctga

SEQ ID NO: 5116 - DNA, 648 bp, Methylobacterium sp.
atgtccgccatcacccgcaatccgccgccgcccgccgtcgacccggccgtgctggcggccttccgcgatgtctcgacggccacgatcagcgactgcctggcgcggatgccggtcctggctggcctgcgcccgttccatcgcggcggaacgctcgtgggaacggccttcacggtccgcgtccggagcggcgacaacctggctatccatcaggcgctggaagaggtccgccccggcgacgtgatcgtggtcgacggcgccggcgacacgggccgcgcgctggttggcgacatcatgaaggccatcgccgagagccggggcgtggccggtttcgtgatcgacggcgccgtgcgcgacacggcggcgttcgcgggctcggactttccctgctacgcccgcgacgcgacgccgcggggtccgttcaagacgggtcccggcgcgatcaacgtgccggtctgcgtcggcggctggacggtgagcccaggggacgtggtggtcggcgacgccgacggcgtcgtatccttcccgccctgcgacgcggcggccctgcttgacgccgtgcgggcgcaggcggcgcgcgaggcggaggtcctggagcagatccgggccggtcgctacgacggccgctacgcccgggcggcgaaggcctga

SEQ ID NO: 5117 - DNA, 615 bp, Methylobacterium sp.
atgtcaggctctccgctcacggccggcaaggcgccgaccgcgctgcccgccacctacgtcacggcatctggactgccgcgctaccatccggtctcgcaggcgctgcactggctgaacgccgccctcgtcctggcggtgctgccgctcgcctgggtcgcgatcagcctgccgccgacgcccgccaagggcagcatgttcgtgctgcacaagtcggtcggcctgacgatcttggcgatcgtggtcgtgcggatcgtctggcggatgatccggccggcgccgccggacccgcaggcaccccggctcctgacgctgatcgggcgcgtcaaccacttcctgctctacgcgattttcctgatcatgccgatcagcggctacctgctgagcgcgctgtcgggacgcgacacgccgtacttctggctgttcacgatcccgggactgccgaaggacgaggcgacgcagaagatcttcgagtcgatccacgtgttcggccagtggctcgtctacgccctggtcctgctgcacatcgccgccacggcgtggcacttggtcatccgccgcgacggtctgctggagcggatgctgccggtccaggatgggcgcggctcgtcgcgctga

SEQ ID NO: 5118 - DNA, 306 bp, Methylobacterium sp.
ttgccgcccgtccggctttctgagcggttcatcgacacgaggaacagcatcgctatgccggtacgtctgatcacgactgctctgcttctgtcagtgggagccacggccgcgctcgccgcgcccatgtcggccgacgacaaggcggcgctccagcagcaatgcatgggcgacttcacgaccttctgcggtggcatgccgcccgatgatgggcccgagactcaggcctgtttcgagaagaacatggccaagctgtcgccgggctgccagggcgccatccagagctacaagcagggcaagaagggctga

SEQ ID NO: 5119 - DNA, 978 bp, Methylobacterium sp.
atgaacacggcagatctcgccccgcacgcgcatcaggtcctgcgcgacgcgaccctgcccgagctgccccggcattaccgcggcaaggtccgggacaattacgaccttcccgacggccggcgcatcctcatcacctcggaccggatcagcgccttcgaccgggcgctcgcggcgatcccgttcaagggccaggtcctgacccagaccgcccgctactggttcgagcagaccgcggacctgtgcccgaaccacgtcctcgcctatcccgatcccaacgtggtggtcggccggcgcctggagatcctgcccgtggaggtggtggtgcgcggctacctcgcgggcaccacgtcgacctcgatcctgacgcgctaccgcgcgggcgaacgggacatgtacggccacaccttccccgacgggatgcggccgaaccagcgcctgccggaggcgatcatcacgccgaccaccaaggcgttcgacggcggccacgacgagccgctcaccgaggcggagatcctcgagcgcgggttgctgacgcgcgcgcagtgggagaccgtgtcgggggcggccctggcgctgttcgcgcgcgggacggcgctcgcggcggagcgcggcctgatcctggccgacacgaagtacgagttcggcacggatcccgagggccggatcgtcctcgccgacgagatccacacgccggacagcagccggtactggttcgcgcagagctatcccgagcgcttcgccgcgggttcggccccggagagcttcgacaaggacttcgtgcgcaactgggtcgtcgcgcgctgcgacccctacaaggatccgatccccgagatccccgccgaggtcgtcctggagaccgcggcggtctacatccgcgcctacgagacgatcacgggcgcgcgcttcgtcctgccggacccggccgaggagcccctggagcggatccggcgcaacatcgccgcctatctcgcggcgtag

SEQ ID NO: 5120 - DNA, 633 bp, Methylobacterium sp.
atgcagaccatcctctacgcccgcgtgagcaccgcggaccagaccatcgcccaccagcggaagcaggccgaggcggtgggcttcaagatcgaccaggtcgtggccgacgagggcgtgtccggcgtgtcgacggtcctggcggatcgtccccagggccggcgcctgttcgacatgctgcgggccggcgacgtgctggtagttcgctgggtcgaccgcctgggccgcaactacgccgacgtcaccaagaccatccgcgagttcatgggccgtggcgtcgtcgtgcgcacggtgatcaacagcatgaccttcgacgggtcgaccaccgatcccgtccagatggcggtgcgggacgcgctgatcggcttcatggcggcgaccgcccaggcgcaggctgaggcgacgaaggaggcgcaacgggccgggatcgagcacgcgaaggagcgggacgacgcctacctgggccggaagccgtcctacacccgcgagcagctcgacgacgtggtggcgcgcctgagccatggtgagcccgtcctgtcgatcgcgaaggtcaccgggatcagtcgggggaccgtctaccggatccgagacaaccgtgctgaggccgaggctgcgctcgcccgttgggccgcctga

SEQ ID NO: 5121 - DNA, 1263 bp, Methylobacterium sp.
atgaccgttcccgcgatgcagattgctgcccgtccctccgcgaagaccgagctgcggacgctcctgctcagtgccgcggccggcggcgcgatcgggggcgtgccgctgatcctggggatcgcgcagccggcgcagctcctcttcgcggccgccgccgcgctctgcgggggcctggtgacccgcgggctgcaaccgtcctgccgcgcggtcgagccggatgccccgccgatggcggtcacgcttcgggccgaaccggcggcggccccgatgcccggagcggcctgcgccgaggccgtggcccgggatctcggcgacctcgacccctatttcgccgtgacgggcgagcagctgcgcagcattgccgcgcagaccgaggcggccgcctccgcgatcctcgcctcgctgcagacgctcgacgccgcccaggcgcgcagcgccgcctgcatcggcggcgcgcacgaccgcatcgtcggcttcgccgagcagagcgacgccgcgctgcaatccctggcggcggccctcggcgcctatctcgaccggcgcctgaacgagacccgcgaggaacgcggcaccgtcgaggtggccgtcgggcagatgcgcgggctcgatgccctgatcctcagcctcgagaaggtcggggcggcgacccggatgctggcgctcaacgccaacatcgaggcggcccgcgccgggtcccacgggtccggcttccgggtcatcgcccgggagctccaggatctcgcgcagaccgcccagaccgcgatggccgaggcgcgcctgcaggtggcggacgcgcagcagacgatcagccgggtgctggtcgccgatcggggcgacgacgcgacccgcaccgagcaggagcgcctccgcgcgctgatggccgaactcggcgggatcgccgagacgaccacccgggtcctcctcgggatggcgcggacggacctcgctgaggtcaaggcgcagaacgcggcggtgggcgacgaggtgctgtcggtcttcggccaggttcagttccaggacgtcgtccgccagcagatcgaggcggtcgacgccgccaacgcggcgctgcagctctgcctcgacggcctgcgcaagcggctgatcggcaccgaacaggagcgggcgatcgcgccggcggcgatcctcgagaccgcgcgggcgcgctacgtcacccagatccagcgccgcgtcgacgcccaggccctcgaccaagtccagggccaagccctcgacccggcggcgcccgacatcgagctgttctga

SEQ ID NO: 5122 - DNA, 1362 bp, Methylobacterium sp.
atgagcatcgcccgcgaggactggctgcgcgcgcacgcggccctctggtacgacgatcgccgctaccgcctggcctggctcgccctgccgcaggccgtgacctgcgcggtggcgggcctgtgcatggcgctggccgcgcagggtgtctggggtcagccggccaccgcctcgaaggcgcggctcgccgagttgagcgccctgcgcgactgggccggcaaggacggcgaccgcaaggcgttcgacgcgctgaccgccgcggccacccagggccagatcgacgccgcgaccaagctcggcacgctctacgaccccttgaccgccgcctacttcccgaacaagcccgtgccgaacgatttcgcccgggcggccgccctctacggaccgggcgccgcgatcggcgatctcctggcggtcacgcgcctcgcggacgtgctgctcgacccggccaaccccaaccgcgacctccggcgcggctgccgcctggcccagacctggatcgacgcccccgagacgctcgagcgcacgatcaccggcgaggagcggctgaccgtcaagctcgccacctgctacgtcgagcccgagagcggcctgccgcaggacccggtgcgggctggggggctggtgaccgcggtgctgtggcgccgccaccggccgacgatggacgccttcatcaacaatctcgggcagcagaaccccgccctggtgtcgggcatccagcggcacctggccgagcagcgccggtacatcggcccggtggacgggcggcccaatcccgggatcatcacggccctccaggtggaggcggggatcaccaacacggtcgcgaccccgcggcccgagccgcggcgggtgacgcccaagggtccggatccggaggtgctggccctccaggccgccgcccggaccggcgaccggcggaagatggccgagctgaagagccgcgccgaggccggggacgcggacgcgctcaccgcctacgcgcgcctgttcaacccggtgatgaacaagggcgacgtcttcgcgccggacgcgcaggtcgccgtcgccgcctacgagcgcgccgcggccgccggcaacggcatggcggccggcgaggcggcggtgctgtacgattccggctacggcaacgtcgccaaggatccccggaaggccgccgccctcgccctgcggggcgtcgacctcaaggacgaccagatcaccttctggctgctgttcccggaggcgggcaactggagcgacgggttctggggcgcgatccaggccgcgctgaccgcgcgcggcttctacacgctcccggtcgagaacaagcgcaatgccgcggtcatcacggccctgcgcgcctacatgaaagccaagtcatga

SEQ ID NO: 5123 - DNA, 504 bp, Methylobacterium sp.
atgcgcggcctcctgcttctcgtgttcggcctctgggctcaggcggcgatggcccagggcttcgcggtccacgacctgaccggcctggccgaagccgcccgatcggcgctcggaccggcggccacggcgcgggcggaggccgggcagctcgacctgcactgcgccccctgcacgggcgccccgtcgatcgcgttgcggatcgggcgcctgaccgacgggaccgaggcccgggtccgctcgggccggaccaccctcgcggcgctcgaggcgatctgcgtgcggcgcaatccggattgccgactctcggccctgcccgccggcccggcgatcggctggttgagcgtgtacgcgctggacggcggcgccggggcgaccgcggtcatcctccgggacggcgatctgctgacgatcgaggcccgggcatcggatcgcggggccgcggaggatgcggcgcggcgcctcgtacaggccgtcctgtcccggatcgtcgggccggaaacctga

SEQ ID NO: 5124 - DNA, 1173 bp, Methylobacterium sp.
gtgtcggccgtgagccgccgctacgacgttgccgtgctgggtctcggcgcgatgggcagcgccgcgctctaccagctagcgaagcggggcgccgcggtcatcgggctcgaccgcttcgcgccgccccacgcgctcgggtcgagccacggcgagacgcggatcacccggcaggcggttggtgagggtgccgactacgtccccttcgttaccgcctcgcaccgcatctggcgcgagctggaggccgagacgggcgagaccctgctgaacgcctgcggggcgctcgtcatggccccgggccacggcgtctcctcgcatcacggcaagccggacttcgtcggccggtccatcagcgccgcggagggtgccggcatcgtccacgaggtgctcacaggcgcggaggtggcccgccgcttcccgcaattcctgaacctcgcgggcgacgagaaggcctatttcgagccgggcggcggctacgtgttcccggagcgctgcctcgcggcacagctcggccgcgcgggtgccgcgggcgcggagatccgcacgaactgcacggtggtcgggctgcagcaggacgggagcggcgtccgcatcgagacggcggaggggaccatcctggccgaccgcgccgtcgtggccgcgggcgcctggacggccccgctgctcgggagcccgttcgaccggctcctgaccgtccggcgtcaactcctgcactggtacgcgctcgcggacgagaccgcctacgggccacacgcgccggtcttcatctggatgtacgggacgagcgacacggaatacctctacggcttcccgccgctcgacgggtccatcaaggtcgctacggagcagtacagcaccaccaccagcgccgacggggtggagcgccgcgtcgacccgtcggaatccgacgacatgtaccggctgcgcgtcgcgaaccggctcgccggcgcgaccccggaggtcgtccaggccgcggcctgcgtctacacggtgacccccgaccgcggcttcatcatcgaccggcatcccgcgatggagcgggtcctggtcgtctccgcctgctcggggcacggcttcaagcactcggccggcatcggcgaggccgtcgccgcggagctggccgggaccggaagcaccgtcgatctcaagcccttcgctctggcacgtttcagttga

SEQ ID NO: 5125 - DNA, 849 bp, Methylobacterium sp.
atgctggttatcgaggatctcacgcgccagtacggcgaccgacgcgccgtcgacggcgtgtcgctccggatcgagcccggcagcttcgtcggggtgatcggccggtccggtgccggcaagtccacgctgctgcgcctcatcaaccggctggcggatccgagctcgggacgcatcctccacgacggccgcgaggtcaccaccctgcgcggccgcccgctgcgcgagtggcgcacccgctgcgccatgatcttccagcaattcaacctcgtcggccggctcgacgtcatgaccaacgtgctgatggggcgcctcagccacgtgccgacccaccgcgccctgctccggcaatggtccgccgaggaccgcgccatggccctcgccgccctggagagcttcgacatgggcgagttcgccggccagcgggccgacggcctgtcgggcggccagcagcagcgcgtcgccatcgcccgcgccctcgtgcaggagcccgagatcctgctcgccgacgagccggtcgcctcgctcgacccgcgcaacacgcggctcgtgatggacgcgctcgccgacgtgaaccggcgctacggcatcacggtgctgtgcaacctgcactccctcgacctcgcccgcgcctactgcgaccgcctcgtcggcctcgcggccgggcgggtcgtgttcgaagggggccccttcgacctcaccgaggacgtggcgcgccggctctacggcctggaggccggcgaggtgctggacgattccgcgcagcgcgaggcggagcagcgggccgcgatgccgggccggcccggtctcgtaccggtacgcccggtccgcgaggccgccctcggcgcctga

SEQ ID NO: 5126 - DNA, 2358 bp, Methylobacterium sp.
gtgagcgggacggcccacgctctccccggcctcgacgggccggcggagatccgcgtcgaccgctggggactcgcgcatatccgcgccgggaccaagctcgacgccttccgcgcgcaggggttcaacgcggcgcgggaccggctctggcagctcgacctctggcgcaagcgcggcctcggcctgctggcggcggatttcgggccgggctacctcgcccaggaccgggccgcccggctgttcctctaccgcggcgacatggcggccgagtgggcggcctacgggccgcaggacacgcgggcgatcgtcaccgccttcgtggcggggatcaacgcctacgtcgccctcactgaggcgcggcccgagctacgcccgccggaattcaccctgaccgacacgcgcccggccctgtggcagccggaggacgtggtgcgcatccgaagccacgcgctgatccgcaacgtcctgtccgaggtcgcccgcgcgcgggttctggcccgcggccggagcccggcggacgggctggccacggacgacctgcgcaagcggatcagtccgccgcacgatccggtcatccccgacgggctcgacgccgccgactggccggacgatctcctcgacgccttccgcctggccacggcgccggtcggattcagccccgagcggagggcggcgtcccgcgcggaggcctgggactggtcgaaggtcgacgcgcacgggaccgtcacgcgcggcccccgcggcccggcgaaggagccggccgagggctcgaacaactgggctgtggcgccgtcccgctccgccaccgggcggccgatcctggcgagcgacccgcaccgggtctacctgcagccctcgctgcgctacgccgtccacctcaccgcgccgggcctcgacgtgatcggcgcgggcgaaccggcgctgcccggcatctccatcggccataacggccgggccgccttcagcctcaccatcgcgccgatcgatcaggaggacctgttcgtctgcgagaccgacccggccgatcccgaccgctaccgctccggcgacggctgggccccgatcacgcgcgtcgccgagcggatcccggtgcgcggcggtccggacgagaccgtcatcctcggcttcacccggcacgggccggtcctccgcgagggcgggggccgcgccttcgcgctgcgcaccgtctggtcggagcccggcgctgccgcctatctcggcagcctcgcctatctcggcgccacgacgcccgaggccttcggcgaggccctgcggcactggtccgcaccttccgtgaaccagctctacgccgacacggcgggccggatcgcgtggttcatggccggcaaggcgccggtgcggcccggccacgacgggttgctgccggttccgggcgacggcccctacgactgggccggcttccacgatcccgccgccctgccccggagcgtcgatccggaagcgggctggctcgccaccgccaacgagatgaacctgccgccggactatcccgcggtggaccggagggtcgggttcgagtgggccgagccctggcgcgcccgccgcatccgggcggtcctcggcggccaggaccggcacagcctcgcggattcgcgggcgctccagggcgacgtggtctccgagccggcccggcggctggccgacctgatgcgcgacctgccggccgcgggcgatcccgacgccgccgcggcccagaccgtgctggccgcgttcgacggcgcgctgcaccacggctcggcggcggcggccctcatcgaggtggtctgggtgcggcacctccgcccggccttgctcgcggcgctcgtgcccgatgccgggacgcgccgcctcctcccgcccggcgacacgcagagcctgatcgagcggctggagaccagtctcgacccggcgacccgcgcgtccctgctcaccgacgccctcggcgccggccttcgcacctgccgggagcggatgggcaccgaccccgcgggctggtcctggggccgcctgcaccacgcgctgttcgcgcacccgctgacggccctggcgcccggatccggctgggacgtcggcccgctgcccgtgggtggcgccgcggcatcggtcatgcacgcggagtaccggaccgacacgttccggctcacccacggcgcctcgttccgcatggtcgtggacgtgggcgactgggaccgctcggtcttcatcaacgtgccgggccagtctggggacccgggcagtccgcactacgccgacctggccccggtctgggggcgccaggactacgtgccgatgctctacggccgcgcggccgtggacgcggcgaccgagacggtcatcacgctgaccccgagccccgcctga

SEQ ID NO: 5127 - DNA, 447 bp, Methylobacterium sp.
gtgtacctcgtcgacaccaacgttctctcggccggcgcgccgaccaaggccgttccagccgtcgaactgatcgactggatggaccggaacagcacggggctccacctctcggtcgtcacgatcgccgagatcgaggacggcatcgcgaagagccgcagggaaggtgccgcgcgcaaggccgagcgcctcgcggcgtggctggagaccttgctgcacctgtacgccgccaaggtcctcccgatcgacctcgccgtcgcgcgccacatcggcgggttgtccgatctggcgcgcggacaggggcacgcgcccggcttcgcggacctcgcgatcgccgccacggcgcgctgcaacggctggacggtcctgacccggaacgtgcggcacttcgcgccgctcggcgttcccgcctgcgatcccttcgtcgcgctgccggccgatgggcggtga

SEQ ID NO: 5128 - DNA, 315 bp, Methylobacterium sp.
atgatccgcactctcgtcctgcccgtggcgctcgccgcgggggtcctgttggccggctcgagcgccgaggcgcgcgacggctgcgggcccggcttccaccgcaacgtctacggctggtgccggccgaatctgggctacaggccgttcgtctacgtcccggtctatccccgcgtcggctaccggtggcactacggctaccgctggcaccgacgcttcgcgtggggcggcggcttccgccatgccggctggcatgggggatggcatgggggctggcacggtggctggcaccacggcggctggcaccatcgctggtga

SEQ ID NO: 5129 - DNA, 738 bp, Methylobacterium sp.
atgggactgacgatggcgagcccgggtgcggcgcccgacgaggccctgctgcgcgcggagaccgcccgcagcgccatggcccggctgctcgccgtggccggacacgacctgaagcaacccctgcaggtggccctcatggccatcgaccgcgcggtctcggacggcgtcggtccccgggccgcggcccggctcggcctcgccagcgacgcgctggtgcggctcggccgcgaactcgacgatctggcccgctcctcccaggccggcagcgtggcgccccggctcggtcccgtcgcggtcgccccgctcctggaggcggtggcgaccgagtgggggccctacgccgacgccgtcggggtgcgtgtccgggtctgcgccacggcgctgacggtcacgagcgaggtcgccatgctgacgaccatcctgcgcaacctcgtcgggaacgccgtgaagtatgcgggcccgggcggccgcgtcgtcgtcggatgccgccgccggcaggggcgcgtggcgatcgaggtgcacgacggcggtccgggcatcgcgcccgaacggatggcgggcatcttcgatgccttcgaccgcgccggacgccgggacggggccggtctcgggctcggcctccatatcgtccggcagaccgccgcggcgctcgatcacccgatcgccgtgcgatcccggcgcgaccggggctcggtcttcggcgtgaccgcgccccgccaccgtccggcatccgcgtag

SEQ ID NO: 5130 - DNA, 594 bp, Methylobacterium sp.
gtggcgatcggcttcggtcaggcgatcccgatcgccgtgctggggctcgccgtgaacctcgcgagcgtctggctgctgcacgacgaccacgacgaccacggccacgacgaccacgctcaccatcacggaggccacgcgcacggaggacacggcggccacgacacgaacttccgggccgcctacgtccacgtcctggccgacacgctgacgtcggtcctggccatcgtggcgctgctcggcgggcgctatctcggcctcgcctggctcgacccggccatgggcctcgtcggcaccgcggtgatcctggcgtggtcgtggagcctgctgcggacggccgccctcgtgctcctcgacgcgcggccctcgccggcggccacccgggagatccgggagcgcctggagatcgacggcgaccgggtcagcgacctgcatctctggcaggtcgggccgggccaccgggccgccgtgatcgccctcgtcagcgacgatccgcagccgcccgcccactacaaggcgcgcctcgccgggctgaagggcctgagccacgtcaccgtcgaggtccagccctgcggggggcacgcggcggcggcctga

SEQ ID NO: 5131 - DNA, 939 bp, Methylobacterium sp.
atggggatgagccgcccgcgcggcgatcgtcgcgccctcctcgccggcctcgccgcgggcgtcctgggtctcgtcccgggcggctgggccgcgtcccccgcgggcgcgtccgacgacccgcggcgcgcggagacgggcggcgcgcccgccgcccgcgtggtcgccctcgacgggttgttcgccgagacgctcctcgccatcggcctcgtgccggtggcgatcgccaaccggccgctctacgagaagctcatcgcgcagccgcccctgccggactcggtcctcgacctcggcccgctgcaggagccgaacctcgagttcctcagcctgatcgcccccgatctcatcctcgccgcgccgtggcaggcgcagatccaggtcgcgctgacccggatcgccccggtcgtggcgctgcccatcgtcgcgggcgcgcgggagccgatcgaccacctcgacgcgctgacccgcgacctgggggaccgcgtcgaccgcgccgcggcggcgcgggcgctggtcgccgggaccgacggggcgctcgcggaggcccgggccgcgctcgcgggccggaccgggcgcccggtctacatctgccgcttccgcgacgacgggcggcagctggccgtcttcggcacgcgcagcaccgtcggcgcggtcgcccagcgcctcggcctgaccaatgcctggaccggccggcagagcggcgcgggcacggtgctcgccgcggtcgaggacctcgcggaggtgcccgacgcgacgctgatccacttcgaccgcggcgccgagaccgcgcgcgccctcgggcgcctcgacgacagcccgctctggcgggcgctgcccgccgtgcgcgccggccgcgtgatccgcatgccggtggtccatccgaacggcgggctgccgtcggccgcgcgcttcgcccgtcaggtcgccgcggcactcgggaag

SEQ ID NO: 5132 - DNA, 1011 bp, Methylobacterium sp.
atgatggtgggaaccaggagcggcatccgagtcctcgtcgccggcggcgccggattcatcggctcgcatctgatcgacgcgctcctcgccgacggggcgcgcgtcacctgtgtcgacagcctgctgaccgggcggcgggcgaatctcgcccatctcgccaacgaggcgcggttcgacttcgtcgaggcggacgtgacggagccgctgccggcgctgccgcggttcgactgggtgttcaacctcgcctgcgcggcctcgccgccgcactaccaagccgacccggtccacacgatgatgaccagcgtgctgggcaccggccggctgctcgggattgcccgggacgccggggcgcgcttcctccaggcctccaccagcgaggtctacggcgatccggagcggcacccgcagcaggaatcctactggggcaacgtcaacccgaccgggccgcgggcctgctacgacgagggcaagcgctccgccgagaccctgaccttcgatttcgagcgccagcacggcctcgacatccgcgtcgcgcggatcttcaacacctacgggccgcggatgcgcgccgacgacggacgggtcgtctccaatgtgatctgccaggcgctcgccggcgacgacatcacggtctacggcaacggcgagcagacccgctccttctgctacgtcagcgatctggtggacgggctcctccggctgatggcggtggagacgcccctcgccggcccggtcaacctcggcaacccccgcgagctgacggtcggcgcgctggtcgatctcgtggtgcggatgaccgagaccccgtcccggatcgtgcgccggccgctgccggtggacgatccccagcgccgccggccggacatcacccgcgccgagaccctgctcggctggtcgccccgggtgcccctggaggagggactcgaggcgacgatcgcgtggttctcccgcgagatcgccccgcgccgggcccggcccgtgatcgaggagcgcgccgttgtcgccggctga

SEQ ID NO: 5133 - DNA, 954 bp, Methylobacterium sp.
atggcctggaaccccacggtctggggctacggcaccgagagcctcgaggcgatcgagctcgtcaccgcccagggcgagcggatccgggccagcgagaccgagaacccggacttcttctgggccgcgcgcggcgccggcccgggcttcttcgggatcgtcacgaagtatttcctcaagctccacgcgctgcccaaggccattcacgggagcgagtatttctatcgcctcgaggatgcgccggccgtcggcacgtggctcggcgaggcggcgcccacgatcgcgccgagcgtcgagctgacccagttcctcgtgaaggcgccgcccgcgctggccgaggcggcggcggcccggaacggctgggtctgcatggtcaccgccaccgccttcgaggacaccccggaggcggcccggcgcgcgctggcgccgctcgatgacgcaccggtcgcgcccctgtcgagcgcgcgggcgacgcccctcgacttcgagcagctgttcgacgcgtccggcgcgctcttcccggagggcgtgcgatcccgggtcgaggccgccttctccaatcacagccctggcgcggtcatggcagccatcctgcccctgtggcagcgggcgccttcggcgacctcggtgttcctgtcgacgatcttctgcggacccgacgtcccggggccgcagcggaacatggcccgctccatgaccgcgaaggtctatggcggcccctggaccatgtggcacgcggcggacgacgataaggccaacgccgcctggcatcaggcggtgatcgccgcgctgaagccgctcaacgtcggctactacatcggcgagaccaacacggtcgagcagcccgagatcgtcgcccaggcgttcacgcccgagaagtggcagaggctgtgcgcgctgcgcgacgagcacgatccggaccgcgtgttcttcgactatttcgacggtctccactga

SEQ ID NO: 5134 - DNA, 702 bp, Methylobacterium sp.
atgctgccgcgcgccgcggtgctggcggcgatctgcgggcggcccgccgacaaggaggccgagacctgccggatgaaggacggccgcacggcggaattctggaccgccgcgatgttctccaccgagaccgggagccggttcaccggcttcgtcacgatgccggccccgggcgcggacgccgcggcgcccgaccggctgagcgtcgcggccgccacctacgtcctcaaggatatgcgctggcgcctcgaagacgtgcaggtcctgtccggccggatcgggaccgggaaccgcaacggcggcgccccggaggtggacgagcggctcggcgccgtgttcaggccgctgagccggggccgcctcctgatgggcctgcgcctcacggtctacgggacggccggatcgcagggtttctcgtacctcctcctgcagttccgcgacgcgccggcccgctggacgctcgcgggcgaggtcgcggcgggcgccgacgagacggccggctgcgcggaggatccctgccggctgggatcgagcacgggacggctggagatcctgccggaggatccgcgcgaccccgccgcgtggcccccggtccgggtcgccctgagcggcaccgtgctcggcgcggacggggcgctgcgtccggccacggaccgggatgcccgggtctatcgattcgatccgggcgccggcacctaccgctga

SEQ ID NO: 5135 - DNA, 327 bp, Methylobacterium sp.
atggcgaagacgagacgcgagttcacacccgagttcaaacgcgaagcggtcgccctgctggagagcagcggccggccgcagatgcaggtcgcggccgagctcgggatccagccctcgatgctgaggcagtggcgcgccacgctgaacggggcctcaccccgaccgcggccggccggatcgacggggagtgcgccaccaagcccggtcgcctcgccgtccgatcaggccgccgagatcgcccgcctgcggcgtgagctcgaccgtacgcgcatggagcgcgacgtactaaaaaaagccatcggcatcttcgcggagatgcccaagtga

SEQ ID NO: 5136 - DNA, 273 bp, Methylobacterium sp.
atggtccgcttcgaggtcgggaagacggggcgcggcggctgcgccgggttcgtgatccgcgccgtgcaggccgtcgcgcccggcgcccggatcgaggtcgacatagaggtcgacctggcgacgaagcgcgtcaccgcggccggcttcccggccgagcccgtgctcgcggcgccccgaggtggcgccgcagcgaccggaatctcacgtcggcgtccacgtctcggccgcggacatggtcccgccgccagaaccggtgtaatcccgtacccatga

SEQ ID NO: 5137 - DNA, 273 bp, Methylobacterium sp.; identical to SEQ ID NO: 5136

SEQ ID NO: 5138 - DNA, 420 bp, Methylobacterium sp.
atgacgcaggctctggatcgcgcgacgctcgaccggctggtcgccctaggccgcgaccggggcctcctcaccgccgacgatctgcgcgccgcgctgcccgtcgagcgcatggacgtcgacgccctggtcctcgtgatgctggagctggaggcggcgggcgtgagcgtcgagccggaggccttcggccccccgacggaccggccgctcccggtctctgtcacccttccgcctccgcggcccggcacgccgccggcccgggccgcggaggcggggccgggcgcgtccttcgcgccgcccgtatccgccgcgccggccgccccggagccggtcccggacgacggcgtcgatgccggccgggccgtcctcctggccggcctggcgaccgtgctgatcctcggtgccctgctcctgatgctgtga

SEQ ID NO: 5139 - DNA, 1668 bp, Methylobacterium sp.
atgatcaacgacctgtggtacaagaacgcgatcatctactgcctgtccgtcggcacgttcatggacgccaacggcgacggtatcggcgatttcgccgggctggagcgccggctggactacatccagggcctgggcgccaccgcggtctggctgatgccgttccagccctcgcccaagaaggacggcggctacgacatcgccgactattacggcgtcgatccggattacggctcgctcggggacttcgtcgccttcacccacgccgccaagcagcggggcctgcgcgtcctcatcgacctcgtcgtcaaccacacctcggaccagcacccgtggttccagtcggcccggtccgaccccagatcgccctaccgcgactggtacgtctggtcgaaggaacggcccgcgaccgccgacgagggcatggtcttcccgggcgttcaggagaccacctggacctacgacaccaaggccaaggcctggtacttccaccgcttcttcaacttccagccggatcttaacaccgccaatccggaggtgctggccgagatcctgaagatcatgggcttctggatccagctcggcgtctccggcttccgcatggacgcggtgccgttcgtcatcgccgagaagggcgccgatgtcggcggcaagccccgcgagcagttcgagatgctgcgcgacctgcgcgagttcctgcagtggcgccagggcgacgcgatcatcctggccgaggccaacatcctgccgaagcaggacctcgactatttcggcgacgacgccgaccgcatgcacatgatgttcaatttccaggtcaatcaggcgaccttctacgccctggcggcccacgatgcgcgccccctcgtcaaggcgatcgagcggacgaagccgcgcccgctctcctgccagtggggcatcttcctgcggaaccacgacgagctcgatctgggacgcctcaccgacaagcagcgccagagcgtgttcgacgccttcggacccgagaaggggatgcagctctacgaccgcggcatccgccgccgcttcgcgccgatgctggcgggcgatccccgccggatccgcctcgcctactcgctgatgttcaccctcccgggaacgccggtgctgcgctacggcgacgagatcggcatgggcgacgagctggctctgccggagcgcgactgcgcccgcacgccgatgcagtggacgagcgagcaccagggtggattctcgacggccgagcgcaccgtgctgccgctgatcgaccacggcccctacggctacgcgcacgtgaacgtcgccgaccagcgccacgaggaaggttcgctgctcaactggatgcagagcatgatccggcagcgcaaggaggcgccagagatcggctggggcaacgtcgtcgcgatggagaccgggcgcccgtcggtcctggcgctgcgctacgcgtggcgcggcaatgccatcctgtgcgtccacaatctcgcgccggagcccgtcgaggtcgcgatggcgtcgggatccgaggatcgcgcgcacgacatcctcgtcgacctgctcaccggcgcccgcagcgaggtcaaggacgacggccgccactgcctgttcctggagggatacggctaccactggttccgcgtcggcgggctcgacgcgctgctgaagcggcgacccacgtga

SEQ ID NO: 5140 - DNA, 1887 bp, Methylobacterium sp.
ttgagcgaggccggtcggccggcggctccgacgcccgaccggaccttccggctggcgcggcgcctcttcctgctcgccgcgtcgctcggtgcgctcgcctggggcgcctggctcggccatctccatctcgccgggcgcgcgacgcccctcgatcgcctggaatccgccctcacggacctgcgcctgcggctcgccggcccgcgcacgccgccggccaacctcacggtggtggcgatcgacgacgcgacggtgcggcgcgaaggcggcttcccggtctcgcggaccacgatggcgcggctcgtcgagcgggtggcggaggcccgcccgcgcgtgatcgccgtcgacgtgctcttcctcgaggcggggcggcagccggaggcggacagcgcgctcgccgacgccctcgggaagaccaccgcgatcctggcttccgctgcggtcttcgacgggagcgccagcgaggacggcatcccggtcgccaccgcgctccaccgaccgacgccgaagctcggcgaagacgtcgcgtcgggcgtcgtcaacgtcgccgaggacgcgtcgggcgtaccccgccatctccccctggtcgtgcggacggccgacggcgtcgccgcgtccttcgtgctgcgcgcggcggccctggcggcgcgcagcgaccccgtgctcagcaaggggcgggtccggatcggcgaccgcgccctgtcgctggacctcggctaccatctcccgttgcggccctacggtccgcgacgcacgatcgcgacggtgagcgcggcagccgtcctcgacggtacggcgccggccgcggcgctctcggacggcatcgtcgtgatcggcgtcaccgcgctcggcggcggcgacaccttcgccaccgcgttcgatcccgtcttgcccggcgtcgagctcctcgccaccggcatcgcccacctcaccacgggggacgccctcgtccgggacgccggcgttcggcagctagacgccgcggcctcggtcctcctggcggtcggggccgcgctcgccatcgcgctcctgccgccgggcccgggcctaattctggtcctgctcgcgacggcaggatggctcgccgcgggcgccgtcgcgttcgcccacggcatctggctgagcgccgccctgccgctcgcggcggtagggctgccggcgctggtctgcgcggtcggccgccagacgctcgagcgccgccagagcgcgcgcgtggcgcggtccgagcaggtactgcggcggatgcagcctgccgccctggccgagcggctcgcgcgcgatcccggttacctcgccgagccggtcgcgcgcgacatccccgtgctgttcgtcgatctcaccggcttcacgcgccggagcgagcagctcggcccggcgcggacgcgggcgatgctcaagacgttccacgatctcgtggacgaggcagtgaccctgcgcgggggcgtcgtggtgaacttcatgggcgacggcgccatgatcctgttcggtgccctcgatccggacccggaccaggcggcgcacgccgtccaggccgcggaggagctcatcgtccgcacgcgcgcctggatcgcgcagagcccggtcctgcacggggccgggccggccctcgatctgcgcatcggcgctcattgcgggccggtgatcctctcgcgcctcggcagcgacaccaaccagcacatcaccgcgacgggcgacacggtcaacgtggcgagccgcctgctggcggtcgcggcggacgcccacgcccgcttggcactcagcgccgagctggcgcaggcggccgggatcgaccggtcggagggcgcgttcgagagccggaccgcggcgatccgcggccgcagccagcccctcgaggtctggctgcgccacccgcgcgcgacgacgtcctag

SEQ ID NO: 5141 - DNA, 1089 bp, Methylobacterium sp.
atgatctacaatcttcaaatcctgcgcgccgtcgcctcgtacctcgtcttcctcacgcatttcggcctctacatcggccccgtcctgccgaggccggatctgttcgccttcggcgcgagcggggtcgacgtgttcttcgtgctctccgggttcatcatgttcgtgagcacgagcgggcgccgcgagagcccgggcgagttcctgctccgccgcgcgtcgcgcgttgtcccggtctactggctcgtcacgctcgccctggcgctgatcgcgctgacgggcctgaagcccatcgggatcgtggagatccggccggactatgtcgtccagtccctgctgttcctgccgttcgcccgcggcggcttcgtcgagccgctgaactccgtgggttggacactcaattacgagatgttcttctacgtggtcttcgcggggctgctcatggtgccgagacccgccttccgggcgctcggtgcggccgcgatcttcctggcgctgatcctgctcggattgctgcccgcgtcgaatctctactgggcgtactacacgaagccgatcctgatcgagttcgccgccggcatcgggctgggatacgcctatctgcggctcggggcgccggccgcgggcttcccggtccggcgcgtggcgtgcgcggccgtcgcggcggctcttctgctcatcctcggcggccagatcgtgaccgacgcgctcggcgtaagccccgagctctccgggttcgcgcgcccgctgatctgggggtccgcggccgtcctgatcgtcggtgcgatgctgctgctggaacggggcggcatcgccctgaagtcgcgctggctgctgtcgcagggcaatgccagctactccttctacttggtccacaacctgctactacacagcgccgccaagatcgcggcgctcgtcgtcgcgcccggcttcgcgcgcgccgccctgatcttcgcgatcgcgttcccagcggcggtcgccgccggcgaactgctgttccggtatgtcgagacaccggtgatcgcggccctgcggcgccggctcgaccggcggccctcgcccgatcccgtgcccgttccggccgcttcgtag

SEQ ID NO: 5142 - DNA, 1305 bp, Methylobacterium sp.
atgaccacgcggaacgacgaccccgatttctggacgcgcgcgcgccggcacctcgtgcgctacggcggcgccttcgcgccggtcatcatcgagcgcgcggagggcagcttcgtctacgacgcggatggccggaagatcctcgacttcacctccggccagatgagcgcgatcctgggtcacgggcatcccgagatcgccgccgtcgtcgccgaccatgtcgggcgcctggatcacctgttcagcggcatgctgagccggccggtggtcgacctcgcgaccgcgctggccggcctcgcccccggcgggctggagcgcgcgcttctcctgaccaccggcgccgaggccaacgaggccgccctgcgcatggccaagctcgcgaccggcggctgggagatcgtcagcttcgcgcagtcgtggcacggcatgacggcgggcgccgcctcggccacctacagcgccggccgcaagggctacggcccggcccccgtcgggtccttcgcgatccccgcgccgaacgcctaccgcccgactttcgcgcgggacggggccgccgactggcagaccgagctcgactacgccttcgccctggtggaccggcagtcgaccggcaatctcgccgccttcctggcggagccgatcctcagctccggcggcatcctcgaactcccgcccggctacctcgcggcgctcaagcgcaagtgcgccgagcggggcatgctgctgatcctcgacgaggcccagacgggcatcggccgcaccggcctgatgttcgcctgcgagcgcgacggggtggtgcccgacatcctcaccctgtcgaagaccctgggcgccggcctgcccctcgcggcggtcctgaccacgccggagatcgaggatctctgccacgcccgcggcttcctgttctacacgacgcacgtctccgacccgcttcccgccgcggtcgggctcaaggtgctggagatcgtccggcgcgacggcctggtcggccgggccgaggcggccggcgcgcggctggcggcgcggctgcgggcgctgcagcagcgcttcgcctgcatcggcgacgtgcgcgggcgcggactcctgcagggcgtggagatcgtggccgaccgggacacgaaggtgccggccccggaactcggcgacgcgatcacgcggcgctgcctcgagctcgggctgagcatgaacatcgtgcagctgcccggcatgggcggcgtgttccgcatcgccccgccgctcacggccacggacgcggagatcgacctcggggtcgacatcctggagcgggcgatcgaaggctcggtgtga

SEQ ID NO: 5143 - DNA, 822 bp, Methylobacterium sp.
gtgatcgcggattgcgatccgggccgccgcgtctccctgagagagatcgtcctgcgattcgatcccagcgcggtgatcgatgaggcgacctcgggtcaggcgctctgcgatatcctcctccgccaccgtcccaccctggccttcgtgggaatgcagcttgacgatctcagcggccccgaagccgtcgccgtcgcgcgccgggcgggtgcggagcccccctgcctggttctggtggcgacccgcgtgctgccgcaatggcaggagatcgccacgagcctcggcgcctacgaagtcctgaagacgcccctcgacccgagccatatcgagccgctgctccacgcggatgcccgccgtcgcgcaccgacccgggccctgctcgcctgctcgactccggccgggcggtcggccatcagccgcgtcgtggcgcgcagcgggttcgcgatcgagctcgacgagacggatgacggccgccacgccctcaagcagctgaagctcgccgcctacgacttcgccttcatcgacgtgaagctcggcggcatcgacgggctcgaactggcctgccagatccagcccctcggcctcccgacgcggatcaccctgctgaccacgtccgagttggagcccgtcgcccaggcgggccgctacttcggtgtcgacgccgtgctgcggatgccgttctacgcccgcgacatcgacctcgccctgcacaacgcgctgggcctgcgccggccgtatctgctgaacgccctgacggccccgcccgcgccgagcgcgctgctgcggatcgccgacctgcccaattccaggcgcaagatcgcctga

SEQ ID NO: 5144 - DNA, 411 bp, Methylobacterium sp.
gtgcttgcggaacatattttccagcgcagcttgtttggtttttcggtaaccgccgtggagaatggggccgccgccctgcgtgctgccagacttcaaagtttcgacctcgccttcttgagctttggtgtcatagacgtgccggcgctggaaatcgcctgccgtatcaacagccagtacccaactacgaaaatcgtcatgctcggccgaaaggcagatgcgatctcgccagcgcagctcgcgctattcggcgcccatgccttcctggctctgccctttactgcctccgatgttgatcgcctcgtctacgaggtattcgacctttggcagccatatctcgtgaaagctttgcgtgacgaggaagccaaacaggcccctgcgcagcagattaccattaatcgtgtgtcggcatga

SEQ ID NO: 5145 - DNA, 975 bp, Methylobacterium sp.
gtgccggagtgcgacgtgagagcgctgaagcctgtctgtatcctgctggccctcgcctgcgcggcgtccgggatcggggccgatcccgcgcgggcgcaggacgcggcagcggcgccgaaggccttcacgctcgattccgttcccgtctcggacgcgccgctcggtcgctttccctacttcgcgctgcccgacggctaccagccggtgaacccgcccgagacgcgggaattcgggcatttcctgttctggaccggcgcggcgctccacgaggtcgagggcaaggtcttccagtccctgatcggtcccaaggacggcaagacctactccgcctacgagctgaagaagaacatcgaggccgtgctgacgcaggccggcggccggaagatcgcggacggccggatccccaactccgtgacggagacgctgccggaggacatccggatcgggatgtatgagggcctgggcgacgtctacaacgtgcccgcccagacctgggtgatccgccggccggaccgggaggtctgggtgcatttcgtgcccgacagcttcaccgcggcctggacgatcctcgagacgaagccgttcgtccagaccgccgccctcctgcccgccgagcggctgaagcaggatctcgacaagaccgggaaggcggtgatccaggtcaacttcgccaccgacaggaccgagatcctgccggcctccgccccgcagatcgacgcggtggcggccctgctgcggacggatcccggcctgcggctcgcgatcaacggctacacggacgggaccggagccgccgcgcacaaccaggccctgtccgacggccgtgccagagcggtcgtggcgaggctcgtcggcgccggcatcgcgaaggaccggctgaaggccaagggcttcggcgccgccagcccgatcgccgccaacgacagcgaggcggggcgggcgcagaaccggcgcgtcgagctggtcaagttctga

SEQ ID NO: 5146 - DNA, 456 bp, Methylobacterium sp.
gtggccgccatgctcgtgctggcgttcgccgccccgccggcgcaggccggggagggcctggtccccaccgcgatcgtcggcgacgccatccccgagagcctgaccggcgcgctgggcgatgccgcgcgcggccgggccatcgtcgtggaccgggcccgcgggctctgccttctctgccataccggacccttcccggaggagcggttccagggcaacctcgccccggatctcgcgggcgtcggcgggcggctgggctcgggtcagctgcgcctgcggctggtggacggacgggtcttgaacccggagacgatcatgccaccgtactatagcctgacagggctcacccgcgtggggcggccgtggcaggggcggccgatcctgagcgcggccgagatcgaggatgtcgtcgccttcctggcgacgctgcgcgaggctggtcccgaggagagccgatga

SEQ ID NO: 5147 - DNA, 477 bp, Methylobacterium sp.
atgcgcaggccgatcacagcctttgcgctcgcaggactgtgtgtcctcgcgaccgccgccggagccgagacggcttcaaccgggctcgcaccgttcaaggtcgtggccgtcgacggtagcgacgcgatccccgagccgctcaccgacaagccgggggatgcagcggctggtgccaaggttgtggtgaaccgccgccagggcaactgtctcggctgccatcaagtctcttcgctgagtgctgagtcctttcacggcgagatcggtccctccctcgacggcgtcgctggacgttgggacgcggcgcatctgcgcatgatcgtcgtcaacccgaagcacgtcttcaccgaggcgaccgtgatgccggccttctaccggatcgagggccttcatcgcgtgcgtcccgagttccagggcaagccgatcctgaccgcgcagcaggtcgaggacgtcgtcgcctacctcacgaccctgaagtga

SEQ ID NO: 5148 - DNA, 453 bp, Methylobacterium sp.
atggaccggcgcggcgtgctcgccggggcggtcggcaccgcgctcgccgtcgcgctgcgccccgccgccgcggcgacgctcccgcgcacggaaacgacggaatccgccatccggcgcttcgcgggtgacaacccgatccgaccgggccgggtgaccctcgacctgccgccgctcgtggagaacggcaatacggtgccgctcaccgtcgccgtcgagagcgcgatgacgccagaggatcacgtgcgccggatcggggtgttcaacgagaggaacccgcagccgaacgtcgtgacggttcacctgcggccgggcgccggccgcgcgcagttctcgacacgcatccggctcgccgacacgcagcgcatcaccgccatcgccgagatgagcgacgggacctactggtcggcgagcgccgatgccatcgtgaccctcgccgcctgcctggagggctga

SEQ ID NO: 5149 - DNA, 447 bp, Methylobacterium sp.
ttgaaccgccgccaagccctggccttcggcaccggcgccgtcgtggccaccgccttcgccttccgcgccggcccggccctggccgcgaagcctgcgaccgatgaggccatcaaggccttcacccgcggcaaggagccggtgaaaggcaaggtcaagctcgaactccccgagatcgccgagaacggcaacaccgtgccgatgacggtgagcgtcgacgggccgatgacggcggaaagctacgtcgaggaggtgatgatcgtcgccgagggcaatccgaaccccggcgtcatcagcttccacttcacgccgtcgagcgtcgcggaggcgaacacccggatccgtctcgccgagacccagaacgtcatcgcggtcgctcgcatgaacgacggctcggtcttcagcgacgtccgccaggtgaaggtcaccatcggcggctgcggcggctaa

SEQ ID NO: 5150 - DNA, 321 bp, Methylobacterium sp.
atggcccggacgctgatcaacctgccgaagaccgcaaagcccggcgacacgatcacgatcaagaccctgatctcgcacccgatggagacgggcttccgccccggtgccgacggccggatcctgccgcgcaacatcgtgacggacttcgtctgccgcttcgaggacgaggagatcttccgggccgagctgtttcccgcttcggcggccaacccctacgtgaccttcacctgggtcgcgacgcgcagcggccgcttcagcttcacgtggcgcggcgacggcggcttcgaccagaccgagtccgcggcgatcaccgtggcctga

SEQ ID NO: 5151 - DNA, 330 bp, Methylobacterium sp.
atggccgacgtgaagccgcggatcaaattggacaagaaggaagtcgccaagggaggcatcatcgaggtgaagacgctcgtctcccacacgatggaatccggtcagcgcaaggacaaggacgggaagacgatcccgcgcaagatcctgaacaagttcacttgcgacctgaacggcaagacgatcttcagtgccgatatcgagagcgcggtctccgccaatccctacttccagttcaagatcaagcccgaggagtccggagcgctgacctttacctgggtcgatgacgacgggtcgaagattcaggccactgagcagatcaaggtcgcctga

SEQ ID NO: 5152 - DNA, 792 bp, Methylobacterium sp.
gtgccgcgccgctcgggctccctgccgcagacggcgctcgtggccctgctcctctccagccctctcgcgcggtcggagccggtcccgccggccgagcgacgctcgggcttcgaccagatgagccccgagatccaggcgatgcagcgggacgacggggccaatcccggcatgctcgcggtcgcggacggggaggacctctgggcgaaggcgcccgtctccgggggactcgcctgcgccggctgccacggcgaggcctcgtccacgatgcggggcgtcgcggcacgctatcccgcttgggacgcgcggacgggcaggcccatcgacctccagtctcgcgtcaacgcgtgccgccgcgagcatcagggctccgaggtcctcgcctacgagagccccgacctgctggcgctcacggccttcgtcgccgcgcagtcccgcgggctgccgatcgctccgccggacgatccccggctcgatcccgcgcgggcggcgggtcgcgcgctgttcgaggcgcgccagggccagctcggcctgtcctgcgccatctgccacgacgaccatcggggtcaccgcctcggcgcagcgacgatcccccagggacacccgaccggctacccgctctaccgcctcgaatggcaaggtctcggctcgctgcaacggcgcctgcgcaactgcctcaccggcatgcgcgccgagcccttcgggtacggcgcgccggactatgtcgcgctcgaactctacctcgcgacgcgcgccgcgccgctgccgctggagacgccggccgtgcgcccctga

SEQ ID NO: 5153 - DNA, 867 bp, Methylobacterium sp.
atggtccgccccacccccattgccttcaccgcgctcgcgctcgtcgcgctggccgtcgcaccgcacgcgcaggacatgccctcggcgcccgccgcgaaggaagcgtccgagcgcccggcatggcaggcgcacggcctgaagccccagaactccggatccccgttcgaggaggtcgtctccggcctgtatttccgctccaaggaaacgcaggacatgcaggccgacgacttcaacaatccgggcttcctcgccgtcgagcagggagaggaactctggtcgaaggtcgatggcacagcgggcaagtcctgtgcgagctgccacaacgaggcctcgacctcgatgaagggcgtcgcggcggcctatccgaagtggaacgagaagctcggcaagccggtcaacctggagcagcggatcaacatctgccgcagcggcgccctgaaggccgagccttacgccttcggctcgcccgaattcaccgccatgaccacctacatccgcaaccagtcccgggggatgccggtcgccgtgaaggtggacgggccgatgacgccctggttcgagcgcggcaagtcgctctactaccagcggaacggccagctcgatctcgcctgcgcgagctgccacgagaagaaccacggaaagtatctccgggccgacttcctcagccaggggcagagcaacggattccccgtctaccgcctgcgcgaccagcggctggtgccgctccatgagcgcatggagggctgcatgcaggacgtccgggccacgccgttcaagccgctctccgacgagttcctcgccctggagacctatgtcgcgtggcgcggcctcggccttccggtcgagacgcccgccgtgcgcaactga

SEQ ID NO: 5154 - DNA, 1347 bp, Methylobacterium sp.
atgccgcacacgccgtcccccgccggggaggatctcgccgcgagcaccgtccggaccgtgaccctgcggctgatgccgctcctcggcctgctctacctgatcgcctatatcgaccggcagaacgtctcctacgccaagctggagatggtcggcagcctcggcctctccgagaccgcctacgggctcggggcctcgctgttctttctcggctacttcctgttcgaggtgccggccaacgtcttcctggagcgggtcggcgcgcggatctggttcgcccggatcatgatcacctgggggatcgtcaccgtcctgctgggcttcacccagggcacggcgatgttctacgtgctgcgcttcctgctcggcgccgccgaggccggcttcttccccggcgtgctgttcgcgctgaccctgtggttcccgcaagcgcaccgggcgcggatgatcggctggttcatgatcgccagcgccatcgccaacgcggtcggcgcagcgatcggcggcgcgctgctgggtctcgacgggctcctcggcctccagggctggcagtgggtgttcctggccaccggcgcgccggcgatcctcatggccgcggtggtgctgttcgtcctgccggacggccccgagaccgcgccctggctgtcgcaggcccagcgcgactggctcgcccgcacgctccaggccgagcgcgaggacggcggccacgtcgaccacggcaacccgttcgcggcgctcctcgaccggcgagtgctgatgctcgccggggtctacgtctccctgccgctcgccgcctacggcctgggctactggctgcccaccgtggtcaagggcttcggcgtctcgaacctcaccaacggcttcctcaacatcatcccgtggctcgccacggccttcgccctgtggtgggtgccgcgccacgccgcccgcacgggggcgcagggcaacgccctgacctggcacgtggtcggaccggcgctggtcggggcggcgggcctcgcgctctccgtcatcctgccgggcaacgccgtgaagttcgcctgcctgtgcgtggccgcggccgggaccttcgcggcccagccggtcttctggtcgatgcccgggaccttcctgcgcggcgcctcggcggccgccgggatcgcggcgatcaattcggtcggcaatctcggcggcttcgtcgcccagaacgccgtgccgttcatccgcgaccagacccagagcgacctcgtgccgatgctgttcctggccgcctgcctcgccgtgggggccggcctcatgttcgtggtgctctccgccctgcgccgcgacgcggcgcggcgggcggtgccgacggccgcaagaccggcctga

SEQ ID NO: 5155 - DNA, 1131 bp, Methylobacterium sp.
atggctgaggacgccgtcaccgggatccgcctgcggtccgtcgccctgccgctgaagaccccgatcagcgacgccaaggtgctcaccggccgccagaagccgatgaccgagatcgcgatcctgttctgcgaggtcgagagccgggagggccatcgcggcctcgggatcagctattccaagcgcgccggcgggccggcccagttcgcccatgcccgcgagatcgccccggcgctgctcggggcggatccgagcgacatcgccaaggcctgggacacgctcgcctgggccggcgcctcggccggccgcagcggcctcgccgtccaggcgatcggcgccttcgacgtggccctgtgggatctcaaggcgcggcgggccggcctgtcgctcgccaagctcctcggggcgcagcgcgactgggtgcgctgctacaacacttcgggcggcttcctgcacacgccgctggaggaactgctcgtcaacaccgaccgcgcccgggcgaagggcatcggcggcatcaagctgaaggtcggccagccggactgggccgaggatctccgccgggtctcgcgggtgcgcgagcatctgggcgacgccttcccgctcatggtcgacgccaaccagcaatgggaccggccgaccgcgatgcggatgggccggactttcgagcgcttcaacctgatctggatcgaggagcccctcgactgcctggacgccgccgggcacgcggccctggccgccgccctcgacacgccggtcgccaccggcgagatgctgacgagcgtcgccgagcactgggacttcatccgccagggcggcgccgacttcctgatgcccgacgcgccgcgggtcggcggcatcacgccgttcctcaaggtggcggcgctcgccgagttcgccggcctgacgatcgcgccgcacttctcgatggagctgcacatccacctcgccgccgcgctgcagcgggagccctgggtcgagcatttcgagtggctggagccgctgttcaacgagaggctggcgctggaggacggccgcatgcgcgtgccgacccggccgggcctcggcctctccctgagcgagcaggcgctggcctggacgcgcgagaccgccgggttcggcagcctcggctga

SEQ ID NO: 5156 - DNA, 345 bp, Methylobacterium sp.
atgagaatccgtgtccgcgtcgcccggctggcgatcctcgtcggcgggctgtcggtggccgccgcgcccgcgcaggccgagacgatcgacgtgaccttcgactgtccgaacggtcggacgctggccgtcacgttcgtgaacgcggcgggtccggacaaggcgatcgtccggccggacaacggcgccgccgtcaccctgccggtgcagctgagcgggtcggggttccgctacgccgacgccacgcacgagctgcggggcaaggggcggtcggtcacgtggaccgacggcgccggcacgccggtcacctgcaccgaccggacgccggccgacgccaagccgcgctag

SEQ ID NO: 5157 - DNA, 564 bp, Methylobacterium sp.
gtgttccaggtgatcttcgttgcgaaggcggacggcggcgtgacttacgtcagctccgagtggaccgcgtttaccggccaagccgccgaggaggctgtcgagcacggctggttcgcatgcatgcaccctgacgaccacgaaacggccgtcaccttcctgcgaagtgcccgtgatcagcagagcgagtacagccttcgcacccgcctgcgccgggccgacggcagctacgcctgggtgatgatcggcgccgtgccctcctacggccctccaggccacaccttcctgggctacctggggtcactgacggaaatcatccccagcggctcggagccgctcagtgcctacggcacgctctcgcgctttgtcccgccacccatgagcccgacgacgccacccggctcgaccctggaagctgtggctgactatctgctgatcgctcacggactcgttgagcaggacggcgccaaggagatgctgccggtattgaggcaggcactaatggtggcgggcatgctgctggcccggaacatgacttcggtccaaccaagcgaccgcgcccattaa

SEQ ID NO: 5158 - DNA, 1284 bp, Methylobacterium sp.
atgtcgacgaagaccgcgggaacacgcgccaccaccggccgcgccggtctcgcggcctgcctgctcgccctgtcggcgctgccggcggccgcggagtaccgcatcgggcccggcgacacgatcgaggtcacggccctcagcatcccgaccttcaagcaggaggcgacggtctccaccgacggcaccgtcatggtcccgctgctcggggacgtgccggccgccgggctcaccgtcgcggagctgcgccagagcctgcagaagtcgctgcccgccaaggcggtgcggcagcgcaactccgagggcaaggaatcgatcgccgtgctcgagcccgacgagatcggggtgcggatctcgaagtaccagccggtctacctgagcggcgacgtgaccaagcagggcgagcacccgttccatccgggcatgaccgtgcggcaggccatcgccctggcgggcggctacaacctcctgcgtttcaggatggagaaccccgtcgtcgagacagcgaacctgcgcgccgagtacgacagcacctgggcgagcatccagcgggaatccgccacgatctggcgcctgaaggcgatcgtcgccgcctcgcggggcgataagtccccgccgccggcggacgtcgccccgggcatccgcgcgacccccgcgcagaagctcgccgagcagcaactccgggtgcagatgaccgacatcgccaaggagaaggaccatctgcagcgctccctcaaccggacgcagacgcagttcaccagcctcagcgagcagcaggtcaaggagaaggagggcgtcaccgccgacgccgaggactacgatacggtgcgggcgctgttccagcgcggcgccgtggtcacgacccggctgaccgacgcgcggcgcgccgtcctgctctcctcgacccgcgccctgcagacgacggtccagctcacccagctcgagcgcgacaagagcgaggtcggccgcaagctcgagcgggtcgacgacgtgcaggccatggacgccctggagaagctccaggccgcggagaacaacctagcgacgtaccggtcgcgcctgaacagcatcaacgacaagctggtctataccggcgccctccgggcgcagctcctgtcgggaagccgcgcccaggcggcgatcgcggtcttccggcagagcggaccggccaagacgcagatcgacgccgccgaggacacggagctcctgccgggcgacgtcgtggagatcgcgctcaagccggatcccgccatgcggggcgtcggcgacggggccggccagaactga

SEQ ID NO: 5159 - DNA, 450 bp, Methylobacterium sp.
atgagcccggaccggcagatcctgcgcctgatggcggcgatgatcctcgcgatcatcgcctacgtcgcgccgtccgccgcccaggcccacgagggccatgcccaccacggccaccgcgcggccgcggcgcagccgagggcggtcgccccggtcgccgcgtctgtaccggtgacgcccgccgcccggtcggcggcgccggcatggtccaaggtcgcccgcgccaccgtcgcggcggcgcgcgtcgagccgaccgaggacgggtgctgtcgtccgggccgcgagacccgctgctgcgggacgatggcctgctgcgccaccggcgtcctcggggagccccctggcctgtcgccggacctgttcggcgccgtcacgctggtcccgggcgacgtcgccggccgcaccggcctcggccccgaggccctgcccgagcccccacgaacccgcgcgtga

SEQ ID NO: 5160 - DNA, 450 bp, Methylobacterium sp.; identical to SEQ ID NO: 5159

SEQ ID NO: 5161 - DNA, 522 bp, Methylobacterium sp.
atgagaacgacagcgcgcctggcggccacggccgccctcaccctcgcggcatcgagcgccgccgcgcagacgcgatgtacggagacgacgcgcttcgatccgcccttgcgaatcctgcactgcgccgacggcctaacgctcgaaaccgagcgcgcgggcagcctgcgccccgtggggccggacggagacggacatctcaagggcgccgagatcggcggcaacgcggtcttcgtcaccatcccggcgagccgccgcgtccgccgcgacggcttccagatcctcaccccccacgcggtggcctcggtgcggggcacggtctacgccgtggacgtgacgcgggcgcgcacctccgtcttcgtggcgcagggacgggtcgacgtcgcccggcgcaccgacccgcaggtcgccgtcacgctcggaccgggcgagggggtcgacgtcgatgacggccgcgaccctctggaggtcaggcgctggccccaggagcgcgtcaggagcctgctcgagcggttcgggcgttga

SEQ ID NO: 5162 - DNA, 429 bp, Methylobacterium sp.
atgcccaagatgatcttcgtgaacctgcccgtcgccgacgtggagcacgcggccggcttctatgtcgccctgggcgcccagcgcgacccgcggttctcgcaggccgggacggtcgccgcgatggtcttctcggacgccatcgtggtcatgctcctcagccacgcccaattcgcgaacttcgcgccgcgcgccatcgccgatgcccgcgccgccaacgaggtgctggtctgcctgtcggaggagagccgggccgcggtcgatgcgagcgtcgagcgcgccgtcgccgccggcggtcgtgccgacctccgcccgccgcaggagatgggcacgttcatgtacggccggaacatcgaggatccggatggccacgtcgtcgaggtgatttggatggaccccgaggccatgacgcgagggcaggctccggcctga

SEQ ID NO: 5163 - DNA, 657 bp, Methylobacterium sp.
atgttctccgtgatcttcgaagtccggcccggcgacgatcgcaaggacgcctatctggaacacgcgcgcgtcctgaagcccgagctcgagggcatcgacggcttcatcgacaacgagcgcttcacaagccggacgcggccgggctgggtcctttcgcactcgacgtggcgggacgagaagtcggtgatccgctggcgcacccatgccggtcatcactcgatccaggggaaaggccggtccgaggtgttcgcggactaccatctccgcgtcggcgaggtgacggctgacacccacccaccggcgggacatccggtccgggaccaacgcctcgacgagacggaagtcggccaagccaaggcctgtacgctgtcggaggcgatgttggcagaccggcccacgccctccgatatcgaccccatggccatgcttggtctcgaccagcggagcgaggggctggtgagttgggacgcgttcgattctttcaccaatccggggaaggtgctggtgctgctgtcgtggagagatgccggcgcggcgaacgcggtctcctcggtcgcgggcactcgactccgagctgtccggatcattcgcgattacgggatgttcgaccggcgggagagcccgcaatatcaccctgccgtgcaagccccgggatag

SEQ ID NO: 5164 - DNA, 843 bp, Methylobacterium sp.
atgcgtctcaccgtccgcacccttctgaccaccggtgcgctggccgcgctcgcggcgttctcgaccgtcgcgctgcccggccgggccaccgccgccgacggcgtcgacgcgatcaagaagcgcgggacgctgatcgtcggcgtgaaggcggattacaagccgttcggcttccgcgatccgagcgggacgatcatcggactggagcccgacctcgccgccgacctcgccaagcggctcggcgtgaagctcgagctcgtgccggtcgtctcggccaaccggatcgagttcttgcagcagggcaaggtcgatctgctgatcgccaccctgtcggacaagccggagcgccgccgcgtcgtgcaggcgatcgacccgaactactattccgacttcgtcaacgtcctgctgcccaagtcgtccggcatcaccgactgggcgcagctcaagggcaagccggtctgcgccacctcgggggcctggtacaacaaggacgtcgcgcggacttacggggcggagatcgtcgccttcgacgggtccgagaagccgctcttcgcgctcaagcagggcaactgcatcggctacgtctacgaccagagcatgctgcagggtaagctgctcgacgacgactggaaggccaactacgcgctgccgctcaagggcatcctcgacgccccgtggatgatggcggtggcgcagggcaacaccacgctccaggccgcggtcgaggacgccaccaaggactggatgaagaccggcttcatcgtcaacgaggagaagaagtggggcatcgagccgaccgcttactcgaaggcgatgcacgagaagtacaagaacgcgaccaactga

SEQ ID NO: 5165 - DNA, 447 bp, Methylobacterium sp.
atgaatgacaagcgcccacgccggctgcaggcctcggcccccgtcctcgccgggctgctcgcctgcctcgccgtaccgacgaccgccggagccgaccagccgtccgcgaaactgtgtctgaccgagacctccacgccgggcacgacagcgtgcatgacccgcgccctgcaggaggcggacgcgaagctcaacgcggcctacaagaaggcgatgtcggtgatcgatcacgatgaccgcacgcaggatcccgacgcccgggcgctctggaagacgcgactcgagcgggcgcagcgtgcctggatcgcgttccgggacgcggattgcggcgacctgaccgacagcgagtgggccaacgggagcggcgcgaatgcggcgctgtccgcctgcctctacgacaagaccgtccagaggacggcggaccttctgagccgctacccgctgcattga

SEQ ID NO: 5166 - DNA, 948 bp, Methylobacterium sp.
gtgctcgtcccgagcctcgtcgagacgacgagtcacgtcgaccccaaacaggccttcgagttctggcgctgcacggccctggccgggttcggcgatatcgggcggcagcacccccgggagcggttcgcggccaagcgcctgaccgtggtctcggccggctggtcgctgacccacacggtgagcagcccggtcgaagtggagttccgcacccgccacgtcgaccggaacgcccgcgggatggtggtgatcggcctcgcgctcgacggtgtcggctaccaggcgcaggacggccgcggcgcccagctgacccccggcgatatcggcttcctgtcgcggaaccggcccttcgtggccggcacccagagcgcctacagcgagatccgcctcgccgtgccgcgcgagatgttcgagacctgggtcggcgacgccgacgggttcgcgggccgcagcctcaccccgcacccctccggagcggagttccgggcgcggctgcgcggcgtggccggctcggtcgcctggatgtccgccgacgaggcgcaggcggccatcgagggcctgctccacctcctcggccacctcgtcgacggctcggcccggcgcggcgatccggaggcggtctcgcaggcggccgtcgtgtcgctcgcccgcgcccatatcgcgcggcggatgcaccatcccgacctgaacccgcaggacatccagcgcgcgctgggcctctcccggaccagcctgtaccgcgccttcgcggagaccggcggcatcgcggcggcgatccgcgacgcgcgcctcgatctcgcgtgccgtcgcctcgaggcccgccgcgacgacaaggtgcggatcgcctcgatcgcctacgcgtgcgggttcaccgacgtgccgaccttcaaccgcggcttccgcaagcgcttcggcctggcgccgggcgacctccggcccgcgctcccctag

SEQ ID NO: 5167 - DNA, 912 bp, Methylobacterium sp.
gtggagacgaccgactcggtcgatcagaagcgcgccttcgactactggcgcagcacagcgctggcgcgcgtcgacgcgacgccgctggcgcccgacatcccgttcgcggcgggccgccggctcgcgatcacccgccacggcgcgatcctgcacaccctgagcaaaccgatcggggtcgagcgcaccgcgcagcacgtgcgccgggacgggcgcgacgacatcgcgatcgtgctccttgtccagggcagcggctacatcgagcagggcaatagcggcgccgtgctgggcgccggcgacatcgccgtccatgccatggaccagcccttcgcgatcggcagccgcgactcctacgaggagatccgtctccaggtgccgcgcgccgccttcgtgagtcaggtcggcagcgtgcacgccttcgccgggcgcggtctccgcgcgacgccgctcagcggcctgttcgcgacctatctgcgctcgttctccgagacggtcggtggcatgtcggaggcagaggccggcatcgccctcgagggcgtcctgcacctgctgcgcgcccttgccgaccgtcaaggcgaggcggccggcgacgacctgtccggggacgccgtgcgggctctggccctcgcccatatcgagcgccgtctgcacgatcccgccttcgggccggaatcgcttccggcggctctgcgggtctcgcgaagccgcctctacgcggccttcaccggcgacgaaggcgtggcggcgaagatccgcgacgcccggctcgaccgggcctacaggcggctccgcggcggcacgcggatcgggtcggtgatgacgagttgcggcttcaccgacgcggccaccttcagccgtgctttccgccgccggttcggcgtggcgccccgggacgtgctggaacgccgcccctga

SEQ ID NO: 5168 - DNA, 1644 bp, Methylobacterium sp.
gtgaccggcgggggcgggcgcctgcgccgcttcggggccgcgcgcggcggcaacgtcgcgatcctcgtggcgctcggcagcgcgatgctgatgggggcgggcgcggtcgggatcgatctcggcctggtcttccaggcgcggcgcaaggcgcagggggcggtggacatcgccgccatgctggcggccgtcgatccgagccaggccgacacggtcgcccgccggtccctcggcgacaacggctacggcgcggcgaccgccacggtcgcgcccggcagctacgacgcgagcaccaagggcgtcgccccgggcggccggttcagcgccggcggcagcccggcgaacgcggtgcgggtcggcctctcgacctcggtcccggtgacctttggccgggcgatcggcctgcccgccgcggtgccgctgcgggtgaccggcaccgccgcgagcgcgcaattcgccgccttcacgatcgggtccggcaccctgaagctcgacggcggcatcgccaacgccctgctcggcgcgctgctcggggccaagctgtcgctcagcgtcagcgactacgatgccctggccagcgcccgcgtcgacgggctgcgcgtcctcgacgccctcggggcgagcctcaacatgcaggccgcgaactacaccgacatcgttcaggcgaatgccagcgtcggtcagatgctgatggcgctccgggtcgccgcggcggacaacggcagcgcggtgtcggccctgtcggggatcctcaacgcgctgccgaatgccggaaacctcgtcgcgatcggccaagtggacgggctcggcgacgccgccgcgctggcgccgccgcggggcttcgccggcccctcgctcaacgtgctgaacctgctgggcgcggccgcctctctggcgaacggccagaatcaggtggcgatcgatctcggggccacggtgcccggcctgctctcgacccgcctgaccctggcgatcggagagcgcaagcgcagttccggctgggtccggccgggcagccggaacgccaccgtgcagacggcgcagacccggctgctgatcgagaccaccgtcacggcgctcgggctcggaaccatcaccctgccggtctacgcggaggtggcaccggcgcaggcgaccctgcggtcgctcagctgcgccgggtccggcggacgcaaggtcaccctcgacgcgcagactggactggcgacgctggcgatcgcgcaggtgccgcgcaccgcgatcaacgggggcagcgcgagccccgacctgtcgcagcccgcgcccctgatcacactgccactgttggggatcaccgtctccgggcgcgccctgacgacgctcggcaccgcgtcgcagaccctcgtgttctcggacgcggacatcgccaaccacacggtgcgcacggtcgcctcgggcaacctgactcagtcgctcaccggcagcctgctgcgcaatctcgtgctgagcgtcggcgacgtcggcgtgccgccgctgatccagtcgaccctgacgaccgccctgggcaccgcgacgccgggtgtcgacctcgtgctcgacaccgtcctgcgcagcctcggcctgcgtcttgggtacgccgacctcgacgtcgacggcaccctctgcaaccaggccgtgctggtgcagtga

SEQ ID NO: 5169 - DNA, 621 bp, Methylobacterium sp.
ttgaagtcgattctcgccaccggcctgctggccctgctggtcgccgccccggtcgccacccccgcgctggcccagaccccgccgacccgcgacccggcccagatccaggctggcacctacgcggtcgatcccggtcacacccaggtcggctggcgcgtctcccacatgggcttctcgaactacgccggcggcttctcggacgtctccggcacgctggagctgcagccgaagaacccggccgccgccaagctctcggtgaagatcccggtcgcctcggtgacgaccaccagcgccaagctcaccgacgagctcaagggcgaccagtggctcgacgccgccaagttccccgacatgacctttgtgtccaccaaggtcgcccccgcgggcaaggaccacgcgaaggtgacgggcgacctgacgctccacggcgtgaccaagccggtgaccctcgacgtcaccctggtcggcgccggcgtgaacccgctgagcaagaaatacacggtcggcttcgaggccaccggcacgctcaagcgttccgagttcggggtgaagacctacgtgccgctgatcggcgacgagttgcacctcaccatcgcgggcgccttcgagaagcaggactga

SEQ ID NO: 5170 - DNA, 1476 bp, Methylobacterium sp.
atgttctctgccctgaacgtccgtgaagcgcacgccaagctcgcggccctcgaccgggttcagggcgtgatcgagttcgacctggcggggcggatcctgtcggcgaaccggaatttcctcgacgtggtcgggtacacgctgccggagatcgtcggccagcaccacagcatgttcatggagccggcccagcgggacgccccggactaccgggccttctgggagcgcctgcgctccggcaccttcgagtcgggccagttccagcgggtcggccggggcggccggtcgatctggatccaggcctcctacaacccgatgctcgacgtccgcggccggccctacaaggtggtgaagttcgccaccgacatcacgcagcagcgcaccgaggaggccgaccgcgccgggcagatcgccgcgatcgacaaggtgcaggcggtcatcgccttcgacctcgacggcacggtgatcgcggtgaacgacaatttcctcgccgcgatgggctacagccgcgccgaggtgctcgggcagcatcacagcctgttcgtggagcccgcctaccgggagagcgaggcctaccgggccttctgggcggccctgcggaatggcacctatcaggcggcccagttccggcggatcggcaaggacgggcgcgaagtctggatccaggcctcatacaacccgatcctcgacgccgccggccggccctacaaggtggtgaaattcgccaccgacatcagcgaccaggtccggctgttcgccaacctgcggaccctgatcgatcagaacttcggcgagatcgagcaggcggtgacgcactcgaccacggcggcctcgctggcctcgtcggcggcggactcgacctccgggaacgtccagaccgtggcggccgccgccgaggaactggcggcctcggtggcggagatgtcccagagcatcgtgcgctcccagagcgccaccgacaccgcctatgcctgcgttcaggacgcggacggccacaccaagcggctggccgagaccgccaccgccatgaccggcatcgtcggcctgatccaggacatcgccggccagatcaacctgctggcgctgaacgccaccatcgaggccgcccgcgcgggcgcggcgggccgcggcttcgcggtcgtcgcctccgaggtgaaggcgctggccgaccaggccgcgcgcgccaccggtcagatcaacggcgagatcgccagcgtgcagcgcgtctcgcaggaggtcgtgcaggctctcagctcgatcgggtcctcggtctcggtgatgcgcgagaccgtggtggccaccgcggccgccatcgaggagcagagtgccgtgacccgggatctggccgagagcatgcagagcgccgcgggggccgtcacggcgatcaccggcaatatcggggcgatagtccagtcggtggccaacgtctcgcaggcggtcgacaccacccgcgacgccgccaaggttctggcgcgctga

SEQ ID NO: 5171 - DNA, 450 bp, Methylobacterium sp.
gtggacgcgatcgaccgccgcatcatccaggccctgcgcggcgacggccggatcagcaacgcggatctcgccgcggcggtcggcctgtcggcgtccgcctgccatcgccgcgtgcggctgctggaggaatccggcgtcatccggggctacacggcgctgatcggcggcgcggtcgacgggccgggcctcgtggtcctcacgcagttcaccctggaccgccagaccgaggactatctcaaccggttcgaggcggccgtgcggcgctgtcccgaggtgcaggattgctatctgatgaccgggacggccgattacctcgtgaagctcaaggtgatcgacgcggccgactacgagcggctgcacaaggatgtcctgtcgcggctgccgggagtcgcccggctgcaatcgagcttcgcgatccggaccgtcgtggccgccggccggccgctctga

SEQ ID NO: 5172 - DNA, 243 bp, Methylobacterium sp.
atgtcggcggttcggcgggtcgggaacttcctccaggtgcaggacggcgacggctgccggcacctgctgcgcgtgaccagcgtccaggcgctgagcgacacggacctgatgcgcaacgaaacgttcatcaccgcggcggggcgaacgatccgggtgacgcagccgctcgacgagatcgtggacctcgtggcgccgggcgagcggacggcgccggggccgcaggaggagccgtggccgttctag

SEQ ID NO: 5173 - DNA, 318 bp, Methylobacterium sp.
atgatgcgtcatgccctcttcgccatcttcgcgctggtcgcggcgtcgcccggttcggcgcagaccagcaccggtcccgcaccgatccggcaacccggaccagcgcagccggtgacgccgggcaccccggccgggaccgtcgtcgttcccggcggcagccagaacagcggtccgggcagcaccgccgtcgtcgcgcccaccgggacgggggcgacgaccatcacgacggattcggccgccggcgggaatgccggccagccggagcgcggcgtaccccaggtcggcaaggggagcggggatggcagcggcggcagctga

SEQ ID NO: 5174 - DNA, 4845 bp, Methylobacterium sp.
atgacactcgagaccgcgacggcgttgtcctcctcggagcagaagacggcccgcaccgggctgatagaggcggccgccgacctcgtcaccgagcaaggcggaccgggcggcttcgtccgcgacctgttcggccgcgtgacaccggaggatctcgccccctacgacccctccgtcctggcggacctcgccgcccgcgcccgcgccttcctgtccgagccccgcaggccgggcgacccggcgcggatgcgcctgagcgacagccagcttgtccgcgacggccgtgcgcgcgagacgaccgtcctcgaaatcatcaacgacaaccggcctttcctgctggactcgaccctggccgagctgaccgagcagggcctgtcgccgcagctcgtcgcacacccgatcctcggggtggagcgggacggcgccggcgggctcatccgggtggtcggggagacgaccgcggacgcgcagggcagtctcgcgcgcgagagcttcatccacatccacctcgaccccgtggcggccgagaccggcgagcggctcctgaacgccctcgcgaccgtctaccgggatgtcgccctggcgagcgacgaccacgacgccatgctggcgcgcctcaccgacctcgctgccgatctcgggcgcgggccgaccccgatgccggaaccggagaccgaggaggcgcgcgccttcctcgaatggctgaccgacggccagttcctcatcctcggcatgcaggagcacggcatcgccggcgacgcccacccgctggtcgagggctcgagcctcggcgtgctccgcgatcccggcgcgacgcccctgcgccgcggccggacgccggtggactacacgccggagatcctcgccttcctggaagagccgcagccgctgatcatcaccaaggccagcgtgaagtcccgggtccaccgctcggcctacctggactatgtcggcgtcaagctgttctccggcctcggcaaactgtcgggcgaggtgcggatcgtcggcctgttcaccgcctccgcctacacgagcccggcccgcgaggttccggtcctgcgccggaaggtggaggccgtcgttcagcgcgccggcctcgacccgacgagccatgccggccggagcctcctcgccgtgctggagagctacccgcgggacgagctcttccagatcgacggcgagcggctctaccggttcaccctggccatcgccgccctggccgaccgcccgcgggtccgcgtgctgtcccggcccgaccggttcggccgcttcgtgtcgctgctcgtctacgtcccgaaggaccgctacgattccgcgatccgcggccggatcggcagctacctcgccgagacctacggcgggcggctcagcgcgtcctaccccgactacccggaaggctcgctcgcccggatccactacatcatcggcctgcccgatcagggcagccccgagcacgatcccgcctccctcgaggccgggatcgtcgcgctggtccggacctggggcgacgcgctgcgggcggcgctggccgaatcccagggcggcgaccgcgcgcggcagctcgccgcccgctacggcgacgcgttctcggccgcctatcgggacaatttccagcctgaggtcgccgtcgcggacgtgacgatcctcgacagcctcggcgagacgcagccgcgggccgtccatctcgatcggcggcccagcgaccccgccgcgcaggtccgcttgaaggcgttctcgcgcggcacggcgatcgcgctgtccgaccgggtcccggcgctcgagaatctcggcttccgcgtcatcaacgagcgcacgtaccagatcgcgccggccgggatggacgaggccgcgcgggtctggctgcacgacatgctgatcgagcgcgccaccggcgccccgatcgacctcgcggcgctggaacgcccgctggaggccgcgatgctcgccatcgcggacggcatcgccgagtccgacgggtacaaccggctcgtcctggaggccgccctcgcctggcgggaggcggccctgctccgggccctgggccgctacctgcgccagctccgcgtccgctacgggcaggactacctcgcgggcacgctgagccgccacgccgggatcgcgcgcgcgatcgtggcgctgttccgcgcccggttcgacccggccctcaccggtaaccgtaccgcgcaggaggccgaggtgcgcgccgagatcgagacggcgctcgccgaggtcacgagcctcgacgacgaccggatcctgcgccggttcgtcaacctcgtcgaggcggcggtgcggacgaacttctaccagaccggcgccgacgggcagccgcgggagacgatcagcttcaagttcgcctgcgcgaaggtgacggcgatgccgctgccgcggccgttcttcgagatcttcgtctactcgccccgcgtcgagggcgtgcacctccgcttcggctacgtggctcgcggcggattgcgctggtccgaccggccggaggatttccgcaccgagatcctcggcctcgtgaaggcccagcaggtgaagaacgccgtgatcgtgccggtgggcgccaagggcggcttcttcccgaagcggctgccgccggcctccgaccgcgccgcctggatgcaggaagggaccgagagctaccggatcttcatccgcacgctcctcgaactgaccgacaacatcgtcgacaacgccatcgtgccgccgcccgatacggtgcggcacgatcccgacgacgcctacctggtggtcgccgccgacaagggcaccgccaccttctcggacatcgccaacgccctctcgctcgagaagggccactggctcggcgacgccttcgcttccggcggcagccagggatacgaccacaagggcatgggcatcaccgcccgcggcgcctgggaggcggtgcgccggcatttccgcgagatcgacgtggacgtgcagaccgacccgatcaccacggtcggcgtcggcgacatgtcgggcgacgtcttcggcaacggcatgctcctctccgagagcatccgcctgatcgcggccttcgatcaccgcgacatcttcctggacccgaacccggacgccgcccgcagcttctcccagcggcggcggctgttcgatctgggccggtcctcctgggcggattacgacaggagcctgatctcggagggcggcggcgtgttcccgcgcagcctgaagaccgtgccgctctcggaggcgatccggtccgcgctgggcttcgaccggtccgaggcgacgcccaccgagctgatgcaggcgatcctgaaggcgcccgccgacctgctctggttcggcggcatcggcacctatgtccgggccaccaccgagaccgacgaggatgccggcgaccgcgccaacgacgccctgcgcatcaccgggccggagctgcgcgcaaaggtcgtcggcgagggcgccaatctcggcctgacccagcgcgggcgcatcgaggcggcgcgcgcgggcgtccgcctcaacaccgacgccatcgacaactcggccggcgtgaacacgtcggacgtcgaggtgaacatcaagatcgcgctgatgacgccggagcgggacggcaggctcagctacgaggcgcgcaacaccctgctcgccgacatgaccgacgaggtcgggcgcctcgtgctgcgcaacaacgagctgcagacgctcgccctgtccctcgcccagcgcggcgggctgggggagaccggcttcgccatgcggacgatgcaggcgctggaggcggagggccggctcgaccgggcggtggagttcctgccggacgacggcacgctcgccgagcgcatgcggcggaacgagggactgacccggccggaatatgccgtgctgctcgcctacgcgaagctgtcgctgcacgacgcgatcctcgagagcgccgttccgaacgacccgtacttcgatagggagctgcagcgctacttcccgaaggccctgcgcgagcgcttccccgacgccgtcaagggacaccgcctgcgccgcgagatcatcgccacggcgctcgccaacatcatcgtcaatcgcggcggcccgtcgctggtgacgcgcctcgtcgacggcaccggcgcagacgccgcgaccattgcgaaggcctatgcggtgacccgcgacgccttcggcctgatggaactgaacctcgccatcgacggcctcgccggtcggattcccgggcagggccagctcgacctatacgcggaggtgcaggatctgctgacgaaccggatcgtgtggttcatccgcaacctcgacctgggcggcggcctcgccccggtggtcgcccgctaccgggacggcatcgccgctgtggaggccgccctgcccaacgtgctcggcgacgaggcccaggcgacgatcggcacccgcgcggcggagctgaccgggcacggcatggccgcggcccaggcgcgtcgcctcgcctcgctcagcgcgctggtctccgcccccgatatcgtccgggtcgccgaggcgagcggacggccggtcgaagaggtcgcggccacgcatttcgccctggagcacgccttccgcttggacgatctcgccgccgcggcgcggaccgtcccggtggccgacacgttcgaccgcgtggcgttggagcgcgcgggcgccggcatcgccgcagcgcaccgcaagctgacggccgaagtggtggcggatctcggcgccgggccggaggcggtggaggcgtggatccgggcgcgcggcgcctcgctcgcccggatccgcgaggccgtggacgcgatcagcgcctccggcctcacggtctccaaggcgacggtggcggcgagcctgctcggcgacctcgtccgggccgactga

SEQ ID NO: 5175 - DNA, 237 bp, Methylobacterium sp.
atgagcacgatcgcgatcctgatcggcacgaaggcgggggcgcgcctcctggccgctgcctccgagcgggaggcggccctctcggccgaggccttcctgctgcgcctgcccgtccgcgccctcccggcgccgctctgggtgcagtgcgccgacccggcggtcagcggccgcctcaccggttacctgaacggcctgcaggccgagcaggtgcgcgagcgcgacccaagccgggtctga

SEQ ID NO: 5176 - DNA, 342 bp, Methylobacterium sp.
atgatgaaggactggaatcagtacggcgccgagctcgtcagcacgctcgggcgcatcggtgcggtgagccccgacctcctcaaggcccacgaccagctcgccgcggcggccccgaccgagcgcaagctggacgcgaagacccgcgagctgatcgccctcgcggtggcggtgacgacccggtgcgacggctgcatcgcggtgcattccgacgccgcccgcaaggccggcgcgagcaaggaggaggtcgtggaggcgctgggcgtggcggtggcactgaacgccggcgccgccctggtctacaccgcccgcgccttcgaggcgttcaccggcgagtccggctga

SEQ ID NO: 5177 - DNA, 348 bp, Methylobacterium sp.
atgcacatgatcgattggaacagctaccgccagcaggtcaccgccggcgtcggacacttcgccaagctcagccccgaaacggtgcggggctacggcaccctcagcacggcgggccagaagaccggccagctcgacgccaagacccgtgagctgatcgcggtggcggtggcgatctccctgcgctgcgacggctgtatcacggtccacaccgacgccgcccgcaagctcggcgccaccgaggccgagctggccgaggccctcggggtcgccaccagcctcaatgccggtgccgcggtcgtctacgcgacccgcgcgctcgacgccttcgcggcctccgccgaggcgtag

SEQ ID NO: 5178 - DNA, 216 bp, Methylobacterium sp.
atgggccgagcagcgctcgggtggaccacacaggatctcgcgcgcgaggctggtgtaggagccaacacgatcaatcgatttgaggccggtcaggacgcgcggatcagcagcgtcgataagatgcgggcggcgcttgaggccgccggcctggagttcatccccgagaacggcggcggcgcggggatccggttccgggagcggaaggcacaagcttga

SEQ ID NO: 5179 - DNA, 483 bp, Methylobacterium sp.
gtgagcgacggtcccgagcgcgacccgggcgggcgcctgcccgagatcctgcgcggccggctcgccctgccggtgatctgcgccccgatgttcatcgtctccggcccggagctggtcatcgcccagtgcctgtccggggttgtcggctccttccccgcgctgaatgcccggccggccgaactcctcgacgagtggctcgcgcggatcacacagacgctcgcgcaggcccgcgccgccgacccgtcgcggcggatcgcgccgttcgcggtgaaccagatcgtccacgcctccaacgaccggctggcgcaggatgtcgaggcctgcgtccggcaccgggtgccgatcatcatcacctcgctgcgggcgccggacgcggtgatccgcccggtccacgcctatggcggggtggtgttccacgacgtcaccaatgtccgccacgccgagaaggcgctggaggccggcgtcgacggtctgatcctggtc

SEQ ID NO: 5180 - DNA, 528 bp, Methylobacterium sp.
ctgagccccttcgccctggtgggcgagatccggcggttctacgacgggccgctgatcctgtcgggggcgatcacctcgggctccgcgatcctggcggcccaggccatgggcgccgacctcgcctacatgggcacccgcttcatcgccacccaggaggcgaacgcggcggcggcctacaaggacatgatcgccggcagcgcggccgccgacatcctctacaccccctacttcaccggcgttccgggcaactacctgacgccgagcatccgcgccgccgggctcgatcccgaggccctgccggtgcgcgacaagaccgcgatgaacttcggcagcgccagcgtgaaggcgtggcgcgacgtctggggcgccggccagggtgtcggcaccatcgcggacgcgccggcgaccgccgacctcgtcgcccggctcgcccgggaatacgcggcggcccgggcgcggacggccggcagctccgcggactacgccgaagactacgtcgcggaccgcgacggcggggccgttccgtga

SEQ ID NO: 5181 - DNA, 1578 bp, Methylobacterium sp.
gtgatctaccggttcggatccttcaccctcgattccgcccggcgcgagctgagccgggacggcgccgagatcgccgtcgagccgcaggtcttcgacctcctgcgggtgctgatcgagcggcgcgaccgggtggtgagccgcgacgacctgctggaggcggtctggaacgggcgcatcgtctccgaggcgacgctcggcagccggatcaacgcggcccggaccgcgatcggcgacacgggaaccgagcagcgctggatccggacgctcccgcgcaagggcgtgcgcttcgtcggcgccgtgcgggaggcagcatcggaggtctcgcccgcgatcgctccggaagacgcggcggaggcgggcgtcacgtggcgcaccgggccgcgcctgcccgcggtggcggtcctgcccttcaccaacatgagcgcggatccggaccaggactacttcgccgacgggatcaccgaggagatcatcaccgcgctgtcccgcgtcagcggcctgttcgtgatcgcgcgcaactcgaccttcacctaccggggcgcggcgatcgacgtgcgccgggtcgggcaggagctcggcgtcggctacgtggtcgccggcagcgtgcgccgcggcgggtcgcgcctgcggatcaccggccagctggtcgatgccgggaccggcgcccatctctgggccgacagcttcgacggcgggctcgacgacgtcttcgcccttcaggagcgggtcgccgcgcgcgccgccgccgcgatcgagcccaccctccagctggcggagatcggccggctcggccgcgacgcgccggcccatccggacgcctacgaccggctgctccgggccaatgccaggctcgccgacttcaccgccgccggcatggcggcggcgctcgatcacctggacgaggccctggcgctcgacccgggctacgcaccggcgatggccgcggcggcctattgccgggcgcagtgccattttcagggctggatcgcgcagggcgaggcggagcgcgcggcggccgtgcggctggcctggggcgcggtcgagcgcgcgcccggggacgcgcaggtgctgtggatggcggccttcgcggtctggaacatgtcggagaccgggcgggaccgggcgcgcgacctgttcggccgcgcgctgctcgtcaacccgaactccgccctggcgctcaccctcgcgggctggatcgagaccatgtgcggccgcgcggaggcgggacgcgtcatggtcgagcgggcgctgcagctcaacccgcgggatccgcgcggctggctgatgtcgggcgtgatggcggtcgcggcggtcagcgaggccgactatcccgaggcgatccggtgggccgagcgcgcgctggcgcagaaccggcgtttcgccgtcgccctgcgggcgctcgccgtggcccatgtcgggctcggccagccggggcgcgcccggcaggcggtcgacgagctcctggagatcgagcccggtttgacggtctcgggcttcctggcgcggatccccttcccggtcgccgccctggggcggcgctacgccgaggcgctggccgaagccggcctgcccgcctga

SEQ ID NO: 5182 - DNA, 360 bp, Methylobacterium sp.
gtggcgacggaactcgcaccgggcctgatccaccatccgggcttcctcgacgcggcggcccgcgcgcggctcgccgccgagatcgccgcgatcctcgccgaggcgccgcccgtgacgccgcgcatgccccgcaccggcaagccgttctcggtgcggatgtcgaatgccggacccctcggctgggtctccgacgtcgcgggctaccgctaccagccggaccatccggacaccggtcgaccctggccggccctgccgccgaccgcccgcgcggcctgggagacgctggcggcctatccggccccgccggaagcctgcctcatcaacatctacgcgccgggcacccgcatgggcctccactag

SEQ ID NO: 5183 - DNA, 1602 bp, Methylobacterium sp.
gtgagagacttctccgcccccggccgctccccggtctacgccgccaacgccgccgtcgcgacctcgcacccgctctcgacgctcgccgccatcgaggtgctgcgcgccggcggcaacgccgtcgatgccggcatcgcggcggtggccgtgcagtgcgtggtcgacccgctgatgaccgggatcggcggcgactgcttcgccctctacgcccccgcgggcgccaccacgcccatcgccctcgacggctcgggccgcgcgcccgccgccgcgacgccccactggtacgccgagcacgatgtcggcatcacgcccacctccccccacgccgtgacggtgccgggcgcggttgcggcctgggagcttctggtgcgcgagcacggcacccggtcgctgggcgagctgctccagccggcgatccgctacgcggaggacgggttcgtcgtccagcagcgggtcggctgggactggctgcgcggcgccgagcgcgtcgccgccgatccccacgccgccgcgacctacctgcccggcggagaggtgccggcgatcggcagcgtcgtccgcctgccgaagctcgcggcgacgctcagggggatcgccgaggcgggcgcgcgcgccttctacgagggcccggtcgccgaggacatggtgagtcggctgaacgccctcggcggcctgcacacgctggacgacttcgccgccgcgcggcccgacgtggtcgtgccggtctcgacccgctaccgcggctacgacgtctacgagtgcccgcccgccggccagggtctggcagcgctgatgatgctgaacgtgctgtcgcactacgacgtcggcgcgctctccgacctcgaccggctccacctcttcgccgaggtgtgcaagcagggctaccatcaccgcgacgtgctgttcggcgacgcggctctcgccaacgttccggtcgagcacctgctatccgacgcctggaaggccgccgcccacggcgcgatcgacatgggccgggcccgcgagcccgagatctatcccgagatcgcccgggagatggccgagggccgcgcccacaaggacacggtctacctctgcgtggtcgaccgggacggcaacgcgctgtcgctgatcaactcgatcttccagggcttcggctccggcatcctggcgcccgagagcggcgtgctgctgcacaaccgcggcctgtcgttccgcacggagggcggccacccgaacagcgtcggcccgggcaagcggccgatgcacacgatcatccccggcatgctgatgaaggacgggcaggccgtcgcgccgttcggcgtcatgggcggccactaccaggccatgggccatgtcgagctgctcaccggcctcctcgaccggggcctcgacgtgcaggaggccctcgatgccccgcgcagcttcgcctacggcggcagcctggaggtggaaggcggggtctccgacgcggtgatgacgggactcaaggagcgcggccaccctgcgatccgtgcgccgctgccgctcggcggggggcaggtcatctggatcgaccggaaggccggcacgctggcggccggctcggacccgcgcaaggacggggcggcgctgggatattga

SEQ ID NO: 5184 - DNA, 1536 bp, Methylobacterium sp.
atggtgagctttgcgccgagacggtgcggacgggcaaccgcgtggctggcggcctccctgggcctgtcggcctgcgcggtcggcccgaacttcgtggcgcccgaggctccgccggtcggccgctacaccagggagccgctgcagaacccctccgcggccgacaacatccggacccggcagggcggctcggccgaccagagcttcgtgtccggcgccgacatcccgggcgagtggtggaggctgttccactcgaaggccctgaaccgcgtcgtggagcaggcgctcgccaacaacccgacgctggaggccgcgcaggcctccctgcgggtggcgcagcagaacgtgctggcccagaagggcaccctctatccgagcctgaccgcgacgccgcaggtccagggggcgctggcgcccggcctcgacctgcaatcgcccctcaacaaccagagccggtacctctacagcctgtccacgccgcaggcggtggtctcgtacaatcccgacgtgttcggcgggaatcgccggcagatcgagtcccttgaggccaccaccgagaaccagcgcttccagctggaggcggcctacctgagcctgaccgccaacgtcgtcgccgccgcgatccaggaagcgtccctgcgggcgcagatcgacgcgacccgcaaggtcatccaggcgcagaccgaggtgctgcagctctacaacaagcagctctcgctgggtcagatcgccggggccgacgtggtgcagcagcaggcggcgctggcgctgtcgcagcagctcctgccgccgctggagaaggcgctcgcccagcagcgcaacctgctgaccgccctggcggggcgcctgccctccgacgaggtctccgagaccttcgacctcgccgccctgcgcctgccgacccggctcccggtgagcctgccctcgcggctcgtgcagcagcgccccgacgtgaaggcggcggaggccctggtgcagcaggcgagcgccaatgtcggcgtcgcggtggcgaaccgcctgccgcagttcagcctgaccgccacgggcggctccagcgccacgcggatcgcccagatcgccaacccgggcgcggcgttcttcacgatcatcgggcaggcgacggcgccgatcttcgatgccggcaccctgttccggcgccagcgggccgccgaggaatcgctgacggaggcgcaggcgcagtacaaggcgacggtgatcaccgccttccagaacgtcgcggacgcgctgcgcgcgctccaggccgacgcgaaggccgtggccgccgccgacgccgcggtgagcgccacgaaccagagcctcgcgctgatccgcaagcagtacacggccggggcgatcacctcctcgcaggtgctgatcgcccagcagggctacctctcggcgctggtgacctcggcggcggcgcgcgccacccagtacgccgacaccgccgcgctgttcgtggccctcggcggcggctggtggaaccgcgccgacgtggcgccgcccccgcccgagaaggacccgctgaagttcctctga

SEQ ID NO: 5185 - DNA, 447 bp, Methylobacterium sp.
atgggcatgcggcgcttgcgccggcggagcgcgccgaacgggtggacctgccggcgcggcagttccgcggtggagttcgccctcgtggcacccgtgctgttcctgctcttcgccgggatcgcggtcttggggatctgcctcggcgccgcccacaacctccgccagatcgccgccgaggcggcccgcgcctccgtggccggcgtcaccgacgccgagcgcgcgaacctcgcccagtccatggtgaaccggagcctgagcgccggcgcgatgttccggccgggcagcatcgtcgtgcaggtcgggccggatcccagcgacgcgacggtgtacacggtcaccgtcaccctcgacgccaacacgctcggcatcaacgccttcgcgcgcctgctgccgatgctcccgaccgtgctgcgcagcagcgtcagcgtccggaagggcggcctgtga

SEQ ID NO: 5186 - DNA, 198 bp, Methylobacterium sp.
atggattcgatcgccgcagccgccgtccagatgctgggttcgtcccagagccagcagatcggcatcgccgtcgccaagcagcagctgtcggccgacaaggcggtcgccgggctggtggcggacagcgccgcccaggcggcgagcgccggcccgccggcccctcccggacagggccagagcgtcgacctgcgggtctga

SEQ ID NO: 5187 - DNA, 285 bp, Methylobacterium sp.
atgacgccggcgctcgcgctgctcgccgccctcgccgggggaacgggcgcgggcgccgccgagatgcggccgccgcccggcgcctcgtcctgcaccggatgccacgccgcgggctccgcgatgggcgtgctcgcggggcggccggaagccgagatcgtcggcgccctcgatgccttccggaccggcgcgcgcccggcgacgctcatgaaccgcatcgccaaggggttcggcgcgcaggagagccaggccatcgccgcctggttcgcggcgcagggatcgcggtga

SEQ ID NO: 5188 - DNA, 1260 bp, Methylobacterium sp.
atgcgcgctccttctccgacccgccgcgccctgatcggcggagccgcggcggccgcgctggcgcgcccggccctcggtggcacagcgccgcgcgtcgtggtcgtgggcgccgggttcgggggggccacggcggcgcgctgcctcgccgcgggcggcgtcgatgtgaccctgatcgaggcggccgagcgctacgtcgcctgcacgggcagcaacgcggtcgtcgttggcctgcgcgggatcgaggcccagaccttcggctacgaggccctcggccgagctggactgcgcttcgtgcgcggaacggcggatgcggtcgacccggcggggcgccgggtgaccctcggcgacggcacagtcctgtcctacgaccgcctggtgctctcgccgggcatcgcgctgcgcttcgacgcggtgccgggctacgacgcgaaggccgccgaggcgatgccccatgcctggaaggccggagagcagacggtgctcctcgcccgccagctcgaggccatgccggagggcggcacggtggtcctctcggcacccgccaacccgtatcgctgcccgcccggcccctacgagcgcgcgagcctgatcgcgcatttcctgaagacccggaagccgcaggcgaagctcgtcctgctcgacgccaaggacacgttctcgaagcagaaactgttcgaggcggcctgggcgaagctgtacccggacgtgctcgaatacgtgccgctcgcctcgggcggtgcggtcacggaagtcgacgccgccgcgatggtcgttcgcacggacttcgccgagtacaaggccgatgtggcgtgcatcatcccgccccagcgcgccggccccatcgcggcgcaggccggctgcgccgaccgcagcggctggtgcccgatcgatccggtgaccttcgaatcgcgcctcgtgccgggcatccatgtcatcggcgacgcggcgatcgcaggggcaatgccgaaatccgccttctcggcgaacgcgcaggccaaagtctgcgcgcaggcggtgatcgacctgctggccggacgggagcccgagagcccgaggctcatcaacacctgctggagcctcgtcgcaccgggcaacggcatctcgatcgcgggcgtcttccgcccgaccgacggcctcctggcggacgttccgggagccggcggcatcagccccctcgacgcgcccgacgcggtgcgcgcgcaggaggcggcctacggcgagagctggtaccggacgatcacccgggacgtgttcggatga

SEQ ID NO: 5189 - DNA, 501 bp, Methylobacterium sp.
atggtcggcatcgcgggcgccgccgtcctggtctcgggctgtctcggcatcacgcctggatgggcggtggacgcggacgcggtcgtcgggacctggcgcctcgccacggccacgcgccggatcgtggacacgggcgagaccatcgacgcctacggcggcccgaagccgaccgggtggatccattacggccgcgacgggcgcatgatggtggtctgcgcccacgaaggccgggagcggccggtcgccaacgacaagatgtccgacgcggaccggatcaagctccacaagaccttcttcgcctatgccgggacctaccggctcgagggcgaccggatcgtccacgacatcgacacgtcttggaacgaggcctggaccgggacctcccaggtccggcacgtcgcgcaggagaacgggcggctcgtcctcacgacggtgccgttcaagttcaacgtcgacggcaggatgagcgtcatcacgctcacctgggagaaatacccctag

SEQ ID NO: 5190 - DNA, 186 bp, Methylobacterium sp.
atgcccacgctctccgccccgcgcctgctcacgttccttgtgtcggccgtgctgatcggcctcgccgtcgccagcctgtacacgcgcatcccgatggtcggaaaagccgtcgtggcgcaccggcaatggttcttcatcggcgcctacgccctgctcgccctcggggtgaccacccgcagcctgtag

SEQ ID NO: 5191 - DNA, 231 bp, Methylobacterium sp.
ttggtcctcgccgcggatcccgacacctccgatcacgcggcgatccatgcctggatcctcgacttcatggagacaggcgcggacgatcccgatcaggacagcatccgatccctgatctaccacagcctgaacttcgatatcccgttccaggcgaccgagcgcgtccggcaatccttgatcgccaccgtgcgggcgcgtctcgcggcccaggcgtcgcgtcgcggcctctga

SEQ ID NO: 5192 - DNA, 2127 bp, Methylobacterium sp.
atgggcgacgggtcggggccggcgcgcagcgtgtccgcgcacggccgcatgaatgttcgcgcccgcgagaccgcgatccggaagcccgagctccagctgagccgcggcagccgccgcaccttcgtcgccctcgccctcgcggccgcgatcccggtcctgctgctcagcggctgggtcgcgacgctgatggcgcagcagcagcgcgacctcgcccggagcgccgccgtcgccagcgcgacccgggtggccgagcgcgtcgcctcggacatcgccgcccagatcgcggtcctcgaggccgaggccgcctccgcgaccctcgaccgaccggacctcgcggccttctacgccgaggccgtgcgcctccggcaggcgcacccgctctgggagacggttgagctcgcccgaccggacggcgcccagatcgtcaacctgctccgctccctcgaggaggaactcggtccgacctcggaccggacgagcttcgacgcggtggtgcgcacgcggcagccggtgatcggcggcatcggcccggccggctcgatctcgggcaagcgcctcgtcgcgctgcgcgtgccggtcatccgggacggcacgctgcgctacgtcctctcgatccggctcgccacgaacgcggtgagctcgatcctgcgcgacgccggcgcccccgagggctgggtcggcaccatcgtggacgcggagggcaacacgatcgcccggacccgggccgaggtggaggagctcggccacccggcgaacccggcgctccaggcggcgatccggaacgccccgaacggcttctacaccggaccgacgctggaaggcgccgatgtcgaggtggtctaccggaccctacagcataccggcggctggtcggtgcatttcgggatgccggtcgccacgctcaacgcgccggtctcgcggtcctacgccgtcctgggcggtggcagcttcgtcagcatcgggctcgccctggcgctggtcggtctcgtcggccgcgacatggcgcagcgccgggcgggcgagcaggcccggttctccctcgcgctccgctccagcgaggaacagggcgccgtcgcagccgaggccgcggaactcggcacgctgcgctgggacaccgtcgcgcaccgggtcaccggctcgccccgcgcggccgatctcctcggttggacggccgccgccgaggggcgcgacagcgccgtggacgccgacaccgtcctgcaggcggtcgatcccgaggatcgcgggcgcctgagcgaggccctgcgccggagcctcgccgagggcacgccgctcgacgtcgagttccgcgtcacccaggatggccgggatccgcgctgggtccgggtcgccggccgcgtgccgcagctccacgagcataccccggccgggctgatctacggcgtggtgtcggacatcgagccgcgcaagcgcgcggaggccgagcgcttcgcgctgctgcgccgcctcggcgaggcccaggagaacgagcagcgccggatcgcccgcgaactccacgaccaggtcggccagacggtgaccggtctgtcgctgggcctcaagagcatggagcggctcctggcacgcggcgcgacggccgaggccggccggcaggtggagtggctgcaatcgctcgccggggagatcggccgcgacatccaccgggccgccgtcgacctgcggccgaccgccctcgacgatctcggcctgcgcgaggccctggccaccctgctgcgcgactggagccagcggcacgggatccgcgccgacctggagttcctgagcgaggcgacccggctgccggccgcgatcgagacggccgtctaccggatcgtgcaggaggccctgaccaacgtcctcaagcacgcccgggccgcgagcgtcagcgtctcggtggagaagcgcgcgggcgagatgcgggtcatcatcgaggatgacggcaccggcttcaacgccgaggagcagcgtgagcgcgccagcggcgaggcgccggccaagctgcggctcggcctgtcgggcatccgggagcggctgtcgctcctgagcgggaatctcacgctggaaacgtccccgggcatcggcacgacgctgttcgtcaccatcccgattccggaacatcccgagacctga

SEQ ID NO: 5193 - DNA, 273 bp, Methylobacterium sp.
ttgcggctgacccgcaccgtagcgcgccagcttgatcaggtgctgggcgatctcacgcggcatagcccatcgggtgccgacggcgtcctgcagcggatcggcgtgtgcttagagctccttctccgccatccctatgcgggccagacgaccgaccggcgcggcattcggcgcatcgtagtgtctccttacctctacatcatgacctatcgcgtcggtgccgatgaggtcatcgtgcgcaccatccggcacgcggcgcggcgtcctctcgcttga

SEQ ID NO: 5194 - DNA, 1218 bp, Methylobacterium sp.
atgctcggacgcatcgcccggcccgtgaccctcgccgccctcgctggcgccctgatgatgggcaccgcagccgcgcagacgaacgtgaagatcggcatcctgggcgaccgctcgggcgcctattcggacatcagcggcgagggctccgtggtggccgccaagctcgcggtcgaggatttcaagcccgagcagcacgggctgaaggtcgagatcgtctcggccgatcatcagaacaagccggatgtcggtgcggccatcgcccggcaatggtacgatcgcgacgccgtcgacatgatcacggacggcgtcacgtcctcggtggcgctggcgatcagccaggtcaccaaggagaagaacaaggtcttcatcgataccggcgccggcaccgccgacctcaccggcccgcaatgcacgccgaacacgatccactgggtctacgacacggtggcgctggccaacggcaccggcggcgcgatggtcaagcgcggcggcaacacgtggttcttcctcaccgccgactacgtcttcggccagaccctccagcgcgacaccagcacggtcatcaccaagaacggcggcaaggtcgtcggctcggtgaagacgccgttcccgacttcggacttctcgtccttcctgctgcaggcgcagggctcgggcgccaaggtgatcgggctggccaatgccggcaccgacacgatcaacgcgatcaagcaggcgggcgagttcggcatcaccgagggcggccaggcgctcgccggcctcctggtcttctcgtcggacgtgcactcgctcggcaccaaggtcgcgcaggggctggtgctcaccgagccgttctactgggacctgaacgaccagacccgcgccttctccgatcgcttcgccaagcagatgaagaacggctcgaagccgaccgcgaaccacgcgggcgtctactcggacgtgctccactacctgaaggcggttgccgagacgaagtcgaccgccgacggcgccgccacggtcgcaaagatgaaggcgatgccgaccgacgacccgctgttcggcaagggcgtgatccgcgcggacggccgcaagatccacgacatgtatctgttcgaggtcaagaagcccgccgagtcgaagggcgagtgggacctctacaagaagctcgagaccatcccgggcgaacaggtcttccggccgctcaacgagggcaactgccccctggtgaagggctga

SEQ ID NO: 5195 - DNA, 1149 bp, Methylobacterium sp.
atgccactgatcggtcagatcaaggcggcgggcggcacgccgatcgatctcgcgaacgccatcggtgtcgcgctgaaacaggtcgccgatctcgctgagaagcccgcggcatcggtcgaagtcgcgacctaccgtcccttctacatcatcggtgcggtccagcagcccggcaagtacgagtatcaacccggcctgaccgtactacaggccgtcagcacggctcagggactgatgcgcggcaccgacccgcgcagtatccagcgcgacgcggtcacgacgcgcggcgagttgcgaaatctcgccgcggagcgggtcgccttggccgccaagctggcgcgtctcgaagcggaggtcggcggcgcggagacgatcgcgttcggcggcgatctgaaaggcacggtggacaggacgtacgcggagcatgccgtccggggtgagcaactcctgttcgacacgcgtcggaacgcgctgaaggccgagatcaagtcgattgaacagtcgatcgccagctttcaaaatgaaatgagcacgctcgatagtaagtccaagacgctggaccgccagatcgagctgagtcgcggtgagctcggcctgatcaacgatctggtctcgaaggggctcacgatcgcgccgcgcaagctcgccgcggagcagagtcaggcgtcgttcgagagcagccgactcgacgtgcaggtcgccatgctgcgcgctcagcagagcctcacgcgcgccgagcgcgacatcattgacctcaaggcccggttccgccgcgaggctctgtcggaggccgcggatgcccgtcagaagctcgcctcgatcgacgagaaggcgcggacagccgagcgactcgcggccgatgccgagtctcagatggttggcagcaccgacgacgcggccgaagccgtgagcgcgcgctacgagattacccggaagcagggggtaaaggcgggcacatggctcgcctccgaggaggccgtcgtcgagcccggcgacgtcgtgcgggtgacgctcgtgcgccagccggccgacaagtccggggagacgcggccgtccccgtcaccgcggcccggatcagcgggcgctccggtgagccgcggtccggccgcttcggatgtgccactgcggccaaccgagagcgcgaatcgctga

SEQ ID NO: 5196 - DNA, 1665 bp, Methylobacterium sp.
atgaacatccacaacaccaaccggatcccgccggaccagtcccaatcggtctcccactttccggagacgacgtccatcggcgtgcaggacggcccactggccgtcatctcggcggccctcaaggcggcccgccggcacaaaatggcggtggccgtctgggtggtcttctgcatcggctgcgcggcgctctacacggtgaccgcgacccccttctacacggcgaccgctgtgctgctgctcgagccgcggcgcccggtgggctcgggctcctcggatggcgccgcgatgccgagcctcgatgtgggccgggccgagagtgagctccaggtcctccgctcggaacggctgctggcgaacgtgttcaacagtctccagctggcgaacaatccggaattcggtcctgcggaagccgagagcccgaaggagccgggcccgggcgcgtccgaattgtcgggattgcggaccgccccgccgtcgatggcagccatcctgcagcagaggaagttcgagaacttcgccgagcgattcaccgtcaggcgcgtgggccagtcgtacgttgtcgaggtctcgtacacgtccagagacccgaacctggcgcggcgcgtcgcgaacgcggccgtctcggcctatctcctgcaatccatcgcggccaaagccgatgcggccaagaacggcgccgagttcctccagggtcgtgtcaacgccctcgcctcccaggcgcggtccgccgcggcggccgtcaccgagggcacgctgccggacgcgccgacgcccgatgccgacgcacgggtgatcggcgcggcgctgcagcccctcaaaccctcggccccgcggaagaccctgatcctcggcctcggcgcgatgatcggcctcgtcggcggcttcctggccgtggcgctgctgcaggccttcgaccgccggatccggacgccgcaggatctcgtccagagggccggcatcccctgcctcgccgtgatgcccgaggtcctgcgcaagacggccgacgggcgccgcgagaccgtggatctgcgcaacgtcaacgcgccgtggttcctcaacgtcagattctccacgggcgtccgcgacctccggacgtcgatccagctggccctctccgcgcgcggccacgattccgactgtgtcatcgccctggtcggctgcaccccgcgcaccggcacgaccctgatcggcctgagcctggcgcgcctgctgcaggaaggcggccggaccgcccggctgatcgacacgaacatccacggcgccggaaccttcttcctgaccccggactccaaggccggggtcggcgcgagtctcgccgacctgatcatcaatccgagccatctggccctcgccaagttcgtggatttcgggggcgtctcggtcctgccgtcgcggtcgccgtacacggcggtcgggaccggcatctccctcagctcctcggtcttccagagcgtcatcgaccagatgcgccgggggggctacgtcatcctcgacctgccgccgctctccgtctcggccgagtcccgcgtcgcggcccgtcgagcggatgtcgtggtgatcgtcgccgaggccgggcggacgaccgtcgacgagctgtcggacgcggtgaacggcctgatcggtgccggggcgaacgtgatcggcgccgttctcaatcgcgcgtga

SEQ ID NO: 5197 - DNA, 444 bp, Methylobacterium sp.
atgagacaggtgttctgcaccgattgcggtaccgaggccgagctggtcgacggcgccaccatcggccgcgtcgacccggaccgggccgggcgccggttctggcgctgcccggaatgtccggactcgtggagctgccacatcgacgcgctagaggggcccggcgagcctccgtccgggccagccacgaaggccgcccgcgtcctgctgcaggagcggcggatcgagccgctgatccagcaagcgctgcgcggcaatcagaacgagcgcgccctggcacagggccgcaccgtcaactggctgttccagcagctcggcctccccacggccggcgccgggctcggactgctcggccttgagcagctccggcaggcctacgcgctcttgggccgaacggattacgccgccatccgccagtgggcggccaaccataggcgcgtcgcatga

SEQ ID NO: 5198 - DNA, 513 bp, Methylobacterium sp.
atgcgccctctgaccgatcgcgagcggatcgaactcgccgtgccatgcgtgctctggcacggcctggtgacagccggatgcttcggccgagaccccaacgtctcggaggaggaggccaaggcggagatcgccgtcctggtcccgaagctgacggcgctcctcggcgctgcctgcaaggagcccctggacgacctgccgccgaagaaacggcgccagttgtccgcccggatcacgcgcgagtcggccgcgtgcagccgcgagctggaccagcagccggccgtgaaggtggcgctgaccttctaccacttcaccaaggcgctcctagaggagggcgtgctggagctgtgggagggctcggccatgggcgaggcgatgaacctcctgttcccgtgcttcgagcacgggttcagcgaggctgcgctggacgcgagcgcccagaaacaggcgcgccgggtgctgggccacctgcagcgcgccggcttctaccagtccgcggccgccatggccgcctga

SEQ ID NO: 5199 - DNA, 633 bp, Methylobacterium sp.
atgtccggctcctggcccttcggcgccctgacgcccctctcctacgacgtcatcatggcggatccgccgtgggactatgcgaactggtccgagggcggcaacgccaagaacgcgaaggcgcagtacgcctgcatgccgctcgccgagatcgcggcgctgccggtcggccacctcgcccgcggcgactcctggctgtggctgtggctgtggggcacgtacccgatgctcccgcagtgcatccagaccatgtccgcctggggcttcacctacgtcaccgccggcccgtgggtgaagcgcggcgtctccggcaagctcgccatgggcacaggctacgtcctgcgctcctgctcggagatcttcctgctcgggaagcacggctcgccgcgcaccttctcccgctcgatccgcaacgtgatcgaggcgccccgccgtgagcactcgcgcaagcccgacgaggcgtacgcgatggcggaggaactgttcgggccggcgcggcgcgccgacctgttctcgcgccaagcgcgccccggctgggagccctggggcaaccagaccgaccacttccccccgggcccgccggtgcagcggccccagtcttccaccctcgacctttgccaggaggttgcagcatga

SEQ ID NO: 5200 - DNA, 960 bp, Methylobacterium sp.
atgctctcgaccctgctggtcgtgctgccgatcttcgcgctgatcttcgccggctggctggcccggcgcgtcggcgtgctcggggccgccgccaccaccgaactcaaccggttcgtggtcttcctggccctgccggcgctgctgttcgacgtgaccgcgcacgcccactggagcgccatctggaagcccggcttcatcggcgccttcggactgagcagcctcgcgatcttcgccctcgccgtgctgatccgcggcggggcggggcggccgctggccgacgccgcggtcgacgggctcaacgccggctacgccaataccggcttcatgggcttcccgctggcgctcgtcgccttcggcccggaggcgctcgcgcctaccacggtggcggcgatcctcacggtctgcggcgtcttcgcggtggcgatcgtgctgatcgagaccggactgcggcgcgaggcggccgcgtcggggaggggcggcggggcgcgccggcccgtctggtggacggtcggccgctcgctggtgcgcaacccgctgctggtggcaccggcgctgggcgcgttggtgccgagcgccggcctcaccgtgccggacgcggtggccacattcctgaagctcctcggcggcgcggcggcgccctgcgcccttgtggcgctcggcctgttcctggcccagccccgccgtgccgggggcgggcaggggcgcattgccgcgctgctcgtcggcctcaagctggtgctccatccgctcctggcctacggcctcggccgctacgtgttcgacctgcccccgctcctgctgcacaccgccgtgctcatggccgccctccccaccggcaccggcccgttcatgctggcggagttctaccggcgcgaggccgacctgaccgccaccgtggtgctggtctcgaccgtgctggccgtcgtcacggtctcggcctacctcgcggcgatcgcctag

SEQ ID NO: 5201 - DNA, 321 bp, Methylobacterium sp.
atgatcatcgtcaccaccgagaacattccgaactaccacgtgcgcgaggtccgcggcccctgcttcggcgccgtggtgcacagccgcggtgcggtgggcaatttcaccgccgggctgcgcagcatcatgggcggcgagatcagcgagtacagccagctgatcgagcaggcgcggtcgcaggcgatcgaccgcatggcgcagaacgcggcgcatttcggcgccaacgccgtcgtcatgatgcgcttcgatacggcggacaccgaccagtcgatgatgggcgtcgtcgcctacggcaccgccgtgatcgtcgaggcacgctga

SEQ ID NO: 5202 - DNA, 1230 bp, Methylobacterium sp.
atgatcaggacaatcggcggcgcggtgatggcggccgcactcgcggggaccgcgctcggctccgctccggcggccgcgcagggaagcttctcggacaacgcgatacggatcggcgtcctcaacgaccagtccggcctctacgccgagtacggcggccagggctcggtcgaggccgcccggatggctgtggaggacatgggcggcaagatcggcagcgtgccgatcgagatcctcacggccgaccaccagaacaagcccgacatcgcctcggcgatcgcccggcaatggtacgaccgcgacaatgtcgacgcgatcatggagctgaccacctcctcggtggcgctggcggtccagggtctgtccaaggagaagaagaagatcaccatcaccaccggggccgcgaccagcgacctcaccggcaaggcgtgctcgccctacggctaccattgggcgttcgacacgcgggcgctggctgtgggcaccggcggcgcgctgacccgggcgggcggcaacacgtggttcttcctcaccgccgactacgccttcggctcggcgctggaggccgacaccagcaaggtcgtgctcgccaacggcggcaaggtgctgggcagcgtccggcacccgctctcgaaccaggacttctcgtcgttcctgctccaggcgcagggctcgaaggccaaggtgatcgggctcgccaatgctggcctcgacacctcgaacgcaatcaagcaggccgccgagtacggcatcgtggacggcggccagaagctcgcggcgctgctgttcaccctctcggaggtgcacgggctcggcctcaaggtcgcgcagggcctgacgctcaccgagggctggtactgggacgccaacgacgagacgcgcgccttcggccagcgctacatgaagcgcaccggccggatgcccaacatgatccaggccggcacctactcggcggtcctgtcatacctgaaggccgtcaaggcggccggcaccgacgagaccgacgcggtcaacgccaagctcaaggagctgccggtggacgacgtgttcgcccatggcggcatcgtgcagccgaacggccgcatggtccacgacatgtacctgttcgaggtcaagaagccggccgaatcgaagggtccgtgggacctctacaagctgatctcgaccatccccggcaaggaggccttcgcctccgcggccgagagcggctgcccgctgacggcggcgaagtag

SEQ ID NO: 5203 - DNA, 1818 bp, Methylobacterium sp.
atgatcggcgggactgggagcgggagcgaggacggcaggccgtcgcgccgggcgctgggggatttcagcgcggaccggcgggtcctgacgctggccggcatggcggtcgtcaccgggaccgccgcgagcggcaccgcctggatcctgctcacgctgatcggcctcgtgaccaacctcgcgtggtacggccggctcgacagcgacctgacctccctggccggcgcggcgccaagcccctggatggtggcgatcccggtgatcggagcgctgatcgtcggggccatggcgcgctacggctcggagaagatccgcggccacgggatcccggaggcgatggaggcgatcctgatcggtggcagccggatgtcgcccaaggtcgccgtgctcaagccgctctcctctgcggtggcgatcggcaccggcggtccgttcggcgccgaggggccgatcatcgtgactgggggcgcggtcggctcgctcttcgcccagttcttccatctcagcgccgccgagcggaagaccctgctggtggcgggcgcggcggccggcatgaccgccatcttcgggacgcccgtggcggccgtgctgctcgccgtggaggtcctgctgttcgagtggcggccgcggagcctcgtcccggtgaccgtcggggcggtcaccgcggcctgctggcggccggccctgttcggcgccggcccgctcttccccttcgccgacaatccggccctgccctggtgggggctgcccgcctgcgcgctgctcggcgtcgcctgcggcctgatctcgggggcgctgacccgggcgctctacgcgctggaggacggttttgggcggcttcccctgcactggatgtggtggcccgccctcggcgccgtcgtggtcgggctgggcggcctcgtggagcccagggcactcggcgtcggctacgacgtcatccacgacctgctctccggccacatgctggcgagcgccgtggtgctgatcctcgtggtgaaggcggtgatctggctcgctgccctgtcgtcgggcacgtccggaggcgtgctcgcgccgctgctgatcctgggcggtgccgtcggctggctgatcggcctcctcctgcccggcgcccacggcttctgggcgctcatcggcatggcggcgatgctcggcggcaccctgccggcgccgctgaccggcgtcgtcttcgccgtcgaggtgaccggcgacgtcgccgccctggcgccgctgctcgccgccaccatggcggcctacgcggtgaccgtcctcctcctcaagcgctcgatcctgaccgagaagatcgcccggcgcgggcagcacgtgacccgggaatacgggatcgatccctacgaactcgcccgggtcgaggcggtgatgacccgcacggtcgagaccctcgacgcggacctgcccctggccgacgccctcgcggcgatcgagaccggtgcccaccacgcctacccggtggtcgacggcgcgggccggcccgtgggcctcgtctcgcgcagcgacgccctgcgctggaccctcgaggagagcgacggcgaggccgaggcgggcaccctcggcgagcgcgtctcggacgccgatctcgccgtcgtccatccgggtgacgtggtctcgcacgccctcgacgtgatgctgtcggccgggcaggggcgtctgccggtcaccgatccgcgcaccgagggcctcgtcgggctgctgacccgcaaggacctgctccaggtgcgcgccacggtggtgcgggccgaagccgagcgccgcgcgttctaccggacggcgcggggtcagcggcgcgcgcgggcggacgcgtga

SEQ ID NO: 5204 - DNA, 1134 bp, Methylobacterium sp.
gtgaccgagaacaggacgacggcggcgctcctcgccgaacggctccacgcctttcggagcctcggcgacaattgcgagttcgggttcgtgcagcgctacggcggagtcgagccctccggcctgctgcgcttctcctacacgcccatggaggacctgatccgcggcctgcgctgcggcttcgcggatttcggcgtgccgggtgacctgcggctctccgtgagttccggcggcacctattactgccacagcgtcgcctacaacatctgggcgaatactgggcacccggccggctcgatcgagccggaggtgctgctggagcgggaatacggccggctggcccatctcaagcgcaagctgctggaggagctcgccgacgggtcgaagatcctggtgcgcaaggtcggccgcgacgagcccgaggccgatttcgcccgcctggccgaggcggtccgtgcgcacgggccctcgacgctgctccgcgtgaccgaggccgggccggactgggttcccgagcccgcccggcgcgtcgccgaccggctgatcgagggacgggtccgccggttcgcgccggtggagcaggcctgggaggtcgacctcgaaccctggatgcacctcgtggacagcgtctacgcgctggagcgcggcgcggcaccgacccgcctcgacgccgccgccttcccggaggcgctggcgctgccggggcgcctgcgccggcatgtcggccggcaccgggcaacggctctgagcgcctacacgcgggcggtggacccggccggcttccgcgccgacacggtccacgtgttctcgagctgggtgtggattccggaggacttcgccggagaccgggtcttcgcggcggccggctacgcgcggctgggctggcgggacgccgacctgtcgcggcgccggtgctggcagcgcgtctgggcggcgggacggctgcgccccgacgcgacgcgtgaacccgtcgggctcggcatgatcggaacgcggcgggacgggttctggtccgccggggcccgcttcgccgaggggccgatccccggcgatgagccggcgccggcgctgcggatgccgccggtccggttcccgggccgggatctcctcggccggctgctgccgcgggtcctgtag

SEQ ID NO: 5205 - DNA, 519 bp, Methylobacterium sp.
atgaacttcctcatcgacaagctggccggctcgttcctgctccggcgcgacctggactaccacctgctccgggccgcgatggtcgtcatcttcgcttggttcggatacgacaaatggttcgaggccgagatccggggattgcttcccttgatcacgcacggccccttcaccttctggaccatcccggtcctgggcattcgcggcacggccatctttctgggcgcctcggaatggacctttggcacgctcctgctcctgggcttctggaacaagaagctgggagtgctgggtgccctcggctccacggccaccttcgtctcgaccttgacgatccttccgttcgtgcccgatgcctgggatgcgggcgcaggtggcttccccgccatggcgatgaatgccgccttcctcctgaaggatctcgtcctgctggtcgtctcggtctatttgcttagacaggatgtggctcgcgtcgtcgcggctcgcgacgccattgttgggcgtgtcgctttcacccgctga

SEQ ID NO: 5206 - DNA, 624 bp, Methylobacterium sp.
atgaacacgcaggttcgccgcgtcctcggcctcgtctccgggccgggctcgaaccgcctcggcctccaggccatgcgggtcgccatcgcggtcatcttcctctggatcggcgcgctcaagttcgtgccctacgaggccgacagcatcacgcccttcgtcgccaacagcccggtgatggcgttcttctacgcccaccccgaccagtacgcgcagcacctcacccacgagggcgagctcaacctcgccgcccgcgcgtggcagacggccaaccacacctacgcgttctcccgcggcctcggcacggtcgagctgctgatcggcctgctcgtcctggtcggcctggcgtcgcggcggctgggtctggccggcgcggtgctggccttcctcaccccggtggtgaccctgtcgttcctcgtgaccacccccgaggcctgggtcgccgcgctcggcgacgccgagcacggcttcccctacctgtcgggcgccggccgtctcgtcctcaaggacgtcaccctcatggccggcgcgtggctcgtcctcgccgacagcgcccgcgccgtcctcgtgcggcaggcccgggcgccgggcgcccccgcccgcctcgacctcgcggcaagccgctag

SEQ ID NO: 5207 - DNA, 2436 bp, Methylobacterium sp.
atggcccgcatccgcagcgccgacgaccgcgcgccggaggtccggttcgggccctggcggctcgccgcgacgccgccgggcgcctgcgcgggccccggcgatctggatggtatcaccgactggatcgccgccgaggttccgggcaccgccgccgccgcccttcgagcggccggactctggagcgaggcggcgccggagccgatccacgaccgcgacatctggtatcggacacgcatcaccggttccggcccgtttcggctgcgcttcgggggcctcgccaccctcgctgaggtctggctcgacggcgtcccggtcctgtgcgcccgcgcgatgttcgaggagcacgccgtcgacgtggacctgggcggcacctgcgagctcgcgctatgcttccgcgcgctccgggcggagctcgaccgcccggccaagcgcgggcgctggcggccgcggatgatcacgccagggtcgctgcgccacgtgcgcaccagcgtcctcggcttcatgccgggctggtgccccgcgatcgacctcgttgggccctaccgcccgataaccgtcgagccggtccgcccccgcgcgagcgccgcggacgtgcgtacgaccctcgacggcgacgtcggccgggtggccgtgcgcctgcgggtcgacggtccggtcggtaccgtcctcctccggtgcggcggcggcgaagccacgctcgcggaggtcgagccgggcctgttcgcgggcgcgctggcgctgcccggcatcgcgccctggtggccgcatacccacggtaatccgaacctccacccggtcgaggtccgcgtcgacggggcgcgggtcgacctgggccgcgtcggcttccggaccctgtcgctcacgcggccgttcgaggaggggctcgcgctcgccgtgaacggcgtgccggtcttctgccggggcgccgtctggacgccgccggacctcgtcgggctgggttcggacggcacccgcacgctgctcgagctggcgcgcgaggccggcatgaacatgctgcgcgtgcccgggacgacgctctatccggcgcaggacttcttcgatctctgcgacgagctcggcatcctggtctggcaggacctgatgctcgccaatttcgactacccgcacgccgaaccggccttcgcggccgcgctcgaccgcgagctgaccggactcctcgaccgcacgcagaccgcgccctcgctctgcgtggtctgcggcggcagcgaggtctggcagcaggcggcgatgctcggggcgccgcgcgccgtctgggccgacgcctactgcgcggagacgctggcggagcgggtggcggagcggaggcccgatctcgtcgtcgtgccgaactcgccctccggcggcgacctgccgttctcgccgcgcgggggctgcacccactatttcggcgtcggcgcctatcgacggcccctggaagatgctcgccgggccgaggtcggcttcgccagcgagtgcctcgccttcgctaacccgcccgaacccggcacgccgggcccgaccggaccggccgacccgctctggcaggccggcatcccgaaggaccggggcgccgactgggacttcgagacggtgcgcgaccactacgtcggcgcgctctacggcgtcgatccggcgacgctgcgcgccgaagacccggaccgctacctcgagctgggccgcgccgcggtagccgaggtcatggaggcgaccatcgccgaatggcgccggccgcgctcgccgacggccggcggcctcgtcctgatgctgcgcgacctcgcatcgggcgccggctggggcgtgatcgactggacgcagcgcccgaaatcggcctggtacgcgctgcggcgcgccttccgctcggtccaggttctcctcaccgatgagggcctcgacggcctccacgtccacgtcctcaacgagacggcgacggtccaagcactgacgctgtccctgaccttctgcgatgtggcgggccgcgtcgcggcgcacgccgtgcgcgatctcgtggttgggccgcgggcggcgctcacgttcacctccgcgacccttctcgggcgcttcttcgacgccaccgacagctaccggttcgggccccggatccacgatctcgcgcacgcgcgactgaccgacgccgacgggcgcgcgatcgccgagagcttccacgtcccgggcgcggggccgctcgaccggtcggccgtcggcctccgggccgagccggtcgcgactgaggcggggccgggtctccggatcagcaccgagcgcttcgcccgcggcgtccaggtgctggccccgggggcacggccggccgacagcagcttccacctcgccccgggatcgagccggatcatcaccttcgcggaggccgcccggctcccgcgcgggcgcgtacgggccatcaacagcgacgagatcgtggaattcggtcatgacgggtga

SEQ ID NO: 5208 - DNA, 219 bp, Methylobacterium sp.
gtgagcgcccgcgaccgcgcttcgggtgacgcggcgaccgaggtcaccttccgggggcgcgggctggctctgcgcaccggctcgcgcctgatcctgctcgtctgcccgctctgctcgcagcgcaacgcgcgacggggcgccgaacgcggcatctgcgagtggtgcgcctatgtgccgtcgccggatcaggccgagcccgtggatcgcgggtgttcctga

SEQ ID NO: 5209 - DNA, 699 bp, Methylobacterium sp.
atgctggtccacgaaggcgagacgcgcaccccggaggccgacagggcgctcgccctctccctcgccggagtggccggcgcgttgaacaccgccggcttctacgcggtgggcctctacgcctcgaacatgaccgggaacgtctcggccatctccgaccggaccggcacgggcgacctgctgctggccctgcaggccggcctgctcgtcgtcctgttcgtgctcggtgccgccaccgcgacgctgctgatccgccggcgccgtcgcgggcaccgtccgggcgcctacgcctacggggtctgcgcggaggcgatcctcctcgtcgccgtcggcctgcttgtgctgccgctccacgagccggcgcggagccacgccctggtgctcggcctgagcttcgtcctcggcctccagaacgcggccgtgaccaagatctccgaatcgcgggtccggaccacgcacgtcaccggcatgatcaccgatatcggcatcgagctcgcgcgctggctggaccgcggcccatccgccgcagatccgctcaagccccacgatccggagcggctgcggctgtacctgctgaccgtcggcgccttcctgacgggcggtgtggtgggggtcgtggcctaccgcctcgtcggtgtggccctgctcttcgcggcggccgcgatcctggccggcctcgccctccccgctctcaggcggtga

SEQ ID NO: 5210 - DNA, 1659 bp, Methylobacterium sp.
atgttgctcatcgaggagatgcttcaggagtcctccagcttgtcccgaacgttcgacgcgactgatctctcccgccgcacagttctcgcgcttcctctcggcctcgcggtcgcgacgagcagcgcgcgcgccgccgagccgaaacgcgggggcacgatggtgatgatcgtccatccggagccctcgaccctggcccattacgcggtgtcggcgggcaacatcccgccgatcgccacgcaggtctatgaggggctgtgcacctacgattgggatcagaacccgcagccgaacctcgcgaagtcgtgggaggtcgcgcccgacggcaagaccatcacgttcaagctccaggacggcgtgaccttccacaacggcaagccgttcaccagcgccgacgtgcagtattccttcatggagatcctgaagaagtacaatccgatcgcgccggtcatgctggccgagctggtggccgtcgacacgccggacccgatgaccgcggtgctgcggctggctaatccggcgccctacatcatgaaggcgctctccgggcgggacctgccgatcctgtgccgctcggtgttcgagggcacggacgtcctccaaaaccccagcgccaacaagccgatcggcaccggtccgttcaagttcacgagctgggagcgcggccagttcgtgcgcctcgatcgcaacgaaaagtactggaagccgggcctgccgtacctcaaccggatcgtcgcccgattcatcccggacgccgccacccgctcggccgccatggaggcgggggaggcgcatttcgccgggtacagcgcggtgaactacgccgacctcgcgcggatgaagaccaacccgatcctcgatctgacgaccaagggctacgagatgacgccggcccagagcgttctggagctgaacggccgtcacccgcatctccagaaaaaggacgtgcgccaggcgatcgcctacgccatcgaccgcaaggtcatcctcaaggacgtgatgttcggctacggcctgcccgccacaggcccgctcagccgcaagttcaagaccgccggcctctacaccgacgacgtccgccagtacgatgtgccggaccggctggacatcgccaacaagctgctcgacgaggccggcgccctgcgcggcgcggacgggacccgcttcgccctgcacctggaggtcaattccttcggcgagcagtggctgcggcaggccgagtacctgaagcaggcgctcgccgtcgtcggcatcgccgtgacgctccgctcggaggacaccgcgacctggctgcggcgcgtctatacgaactacgattacgacctgaacgagccgttcctcagccagggcgtcgacccggtctacgggctgaacaagcagttcctcaccagccagatccgcaagggcgtgaccttcgtcaacgacaccttctacagcaatcccgaggtcgaccgcatgctcggcgagggcgcgcgcgagccggatccggagaagcgcgccgcgctctacaagaaggtccagcagatcctggcggaggacagcccgatgatctggctcatcgacgtgcaatacgtcagcgtcttcaaccggcgcctcaaggatcacacgaccggccccctcggaacccagcaagccttcgagcgggcctggatggacacgtag

SEQ ID NO: 5211 - DNA, 1218 bp, Methylobacterium sp.
atgcgccctccgggcagcgcctccccgtcggccccggcctcggcccgcttcgtctgggacgatcccttcctgctggaggatcagctcaccgaggacgagcgggcgatccgcgacgtcgcccagagcttcgcgcaggagcagctcctgcccgggatcgtcgaggcctacgcctccgagaagaccgatcccggcctgttccggaagatgggcgagctcggcctgctcggcgtgaccctccccgaggagtacggctgcgcgggcgcctcctacgtggcctacgggctcgtggcgcgggcggtcgaggcggtggattccggctaccgctcgatgatgagcgtgcaatcctccctggtgatgtacccgatccacgcctacggctcggaggagcagcgcgagaagttcctgccgaagctcgcctcgggcgagtggatcggctgcttcggcctcaccgagccggatgccggctcggacccggccggcatgaagaccaaggccgagaagatcgacggcggctaccggatctccggcgccaagatgtggatctcgaacgcgcccttcgcggacgtcttcgtggtctgggcgaagtccgacgcccacgagggcgcgatccgcggcttcgtcctcgagaagggcatgaagggcctgtccgccccgacgctgaagggcaagctgtccctgcgcgcctccaccaccggcgagatcgtcatggagggcgtcgaggtcggcgaggacgcgctgctgccgaacgtctcggggctgaaggggccgttcggctgcctcaaccgggcgcgctacggcatctcgtggggcgcgatgggcgccgccgaggattgctggcatcgggcgcgcacctacacgctggagcgcaagcagttcggccgcccgctggcgcagacgcagttggtgcagaagaagctcgccgacatgcagaccgagatcgcgctgggcctccaggcctcgctccgggtcgggcggctgatggatgagggccggatggcgcccgagatgatctcgctggtcaagcgcaacaattgcggcaaggcgctggacatcgcccgcaccgcccgggacatgcacggcggcaacggcatcatgggcgagtaccacgtgatgcgccacgcccagaacctcgagacggtgaacacctacgagggcacccacgatgtccacgccctgatcctcggccgggcccagacggggctgcaggcgttcttctga

SEQ ID NO: 5212 - DNA, 588 bp, Methylobacterium sp.
atgcgcatcaacgtcatcgacggctacgcggagaacgccgaccgtctccgggcggctctcgaagcctcgtgcgttgtgggagcctgggagtgggaccacgtccgcggcgtggtcgtctacgacgcgggcgcggcccgcctgctgaccggcaatcccgacctcgccgaccgtccaatcaacggcccgatggccctggccgcggtgcatcccgaggacatgacgtggttgatggaccacatgctccgggcggtccggtcgagcgggctggtccttgccgagtaccgcgtgttcaaggcggacggcaccgtgcgctggctcctcagccggggacggacccatcggaacgaggacggcgagccgcagcgctcgcacggcatcctgatggacatcaccgagatccgcgacggcggcgaccgctacgtggtcggcaggcccatggcgggcggcgacccgctggagcgggcggccgacctcgccgtcgcgctcaaggagacgctcaccgacgacatgcccgcggaggtgcgggcggccgccgacctgatgctgctgggtctgggccgcgccctggcccgccggatgacgcactga

SEQ ID NO: 5213 - DNA, 927 bp, Methylobacterium sp.
atgagcggcgacgccctgatcgtccaggaggtcgcgacccgcgacggcttccagatcgagccggtcttcgtgccgacggcggagaagatccgtctgatcgacgccctggcggaggccggcttcggccggatcgaggtctcgtccttcgtatcgccgaaggcggtgccggcgctcgccgacgcggccgaggtcttctccgggatccggcgccggcccgggaccgtctacgtcgccctggtgccgaacccgaagggcgccgagcgggcgctcgccgccagggtcgacgagatcaacctcgtcgcctcggtgagcgagacccacaaccgcgccaacatgggcatgagcccggccgactcgatcgccggcttcgcgcggatcatggattcggtgcggggcgcgccggtcagcaccaacgccacggtggcgaccgccttcggctgcccgttcgagggcgaccagccggccgacacggtcgtcgcgcaggtggagcgctacctgtcgctgggcgtcgacggggtgacgctggccgacacgaccggcatggccaatccccggcaggtgagccgcctcgtcgcgcgggtcctacccctggtcggtcccgggcgcctgacgctccacttccacaacacgcgcggcctcggcctcgccaacgtgctggcggcctacgacgcgggcgcccggcgcttcgacgcggcgctcggcggcctgggcggctgcccgttcgcgcccggcgccaccggcaacatctgcaccgaggatctcgtcagcatggcccacgagatgggcgtgccgacgggcctcgacctcccggcgctgatcggcctgtcgcgggacctgccgcgcctcgtcggccacgacgtgcccggccaggtcgccaaggccggacggccctgcgacctgcatccggcgcccgccagggcggcctga

SEQ ID NO: 5214 - DNA, 288 bp, Methylobacterium sp.
atggaccgcccccgccgcgtcggactgccctggtacaccccggagcagtacccagccctgcgcaccagcctcgcggacggcgccaagctgccccccgactacgagacctggcgcgtcgccacggagcagatggaacgggaggtgcagcgcagcggcgtcgaggtcgtgcgcgtgccggtcgagccggagatcttcgcggcgtggtgcgagcgcgccgggctcccgcgcgacgccgcggcacgcgcccggtacgcggccgccgcgctggcggcggactgggccgtctga

SEQ ID NO: 5215 - DNA, 2070 bp, Methylobacterium sp.
gtggttcgtcaggaggtcgacggcggcgtggccgtgctcacgctcgccaacccgccggtcaacgcgctgggcgccgcgctgcgggcggccctcgacgaggccctgacgaacgccatcgcggacgcgtcggtccgggccgtcgtcctggccgcggagggcaaggtgttcgtcgggggcgccgatatcggcgagttcggcaaggctcagcgcccgccgagcctgccggacatcctggaccggctcgacgccagcccgaagccggtggtggcggcgatcggcggcgcggccctcggcggcggcctggagctggcgatggcctgccacggccgcgtcgcggccccgtcggcgcggatcggcctgccggagatcaagctcggaatcatcccgggggcggggggcacgcagcgcctgccgcggctgatcgggcccgacgccgccttcgcgatgatgctcaccggcgagccggtgtctgccgagaaggcggcggcgctgggcatcgtggacgccgtggtgctcggcgacctcgtcgcggaagcccgcaagcgggcgctggaactcgccgattccggcgccctgccgcgggtgcgcgaccggtccgagacgctgacgccgggggcgcgggagaacttcgaggcgcaggccgcggaggcggtcaagcgcgaccccgacgccaccaacgtccacgccctggcgcgggcggtgcgcgccggcctggagcaggatttcgatgccgccgtggcggtggagcggtccgagttccgcgccctggtggaggatccgcgctcgaaggccctgcgctacgccttcttcgccgagcgcgaggccggccgggtgcccggcctgccgaaggacacgccgcgccgccccgtccgcacggccgcggtgatcggcgccggcacgatgggcgggggcatcgccatgtgcttcgccaatgccgggatccccgtgacggtgatcgagacggaggagggcgccctggcgcgcggcctcgaccgggtgagggggctctacgccggctcggccaagcgcggctcgatcaccgaggcccagcgcgacgagcgggtcggccggatcacgggcgtgctcggcctggagaacgccggggaggccgacatcgtcgtcgaggcggccttcgaggacatgggcgtcaagcgcgagatcttctccaaactcgatcaggtcgccaagcccggcgcgatcctggccaccaacacctcctacctcgacgtgaacgccatcgcggcggtgaccaaccggccgcaggacgtgctcggcctgcacttcttcagcccggccaacgtcatgcgcctcgtggaggtggtccgtgcggaaagaaccgcgccggacgtgctggccaccgcgctggatctgggcaagcgcctcaacaagctgccggtgacggtgggcgtctgcttcggcttcgtgggcaaccggatgctggagcgccgcagccgggccggcgagcgcctgctgctcgagggcgcgctgccgcacgaggtcgacgcggcggtgaccgggttcggcttccggatgggccccttcgccatgagcgacctcgcggggctcgatatcggctggcgctcgcgcaaggatttcggcggccgggcgccggtggcggactcgctcgccgagcagggccggttcggccagaagaccggccgaggcttctacctgtacccggacggcgcccgcgccggcacgcgcgacccggaggtggaggcgctgatcgcgcgcgtcgccgccgagcacggtgtcgcgcgccgcagcttcacggcggacgagatcgtcgcgcggctgatgtacccgatggtcaacgagggcgcgcggatcctggaggagggcatcgcggcccggcccggcgacatcgatacgatctggatcaacggctacaactggccggcctggcgcggcggcccgatgcactgggccgacacggtcggattgaagaccgtcgccgaagccttatcgcgcttcgcggccgagaccggcgacgacagccaggagccggcgccgctcctgaagcgtctcgccgccgagggcggcagcttcgccggcctgaagaacagctga

SEQ ID NO: 5216 - DNA, 1209 bp, Methylobacterium sp.
atggatgccgttgccgacctgccgctcgccggaatccgcgtcctcgacctgtcccgggtcctggccgggccctggtgcgcgcaggtgctgggcgatctcggcgccgacgtgatcaaggtcgagcacccggagcgcggcgacgacacccgcgactggggcgtgccgacgagccccggcaacacctcgtatttcgacagcgtgaaccgcaacaagcgctcgatcggcgtcgacctcgccacgtcggaggggctggcgatcgtcaaggcgctcgcccgcgagagcgacgtgctggtccagaacttcaagaccggcggggccgagaagctcggcctcggctacacggacctgtcggcggagaattccgggctgatctactgctcgatcgccggctacagctccgacggctccgaggccggccggcccggctacgacctcgtggtccagggcgaatccggcgtgatggcgctcaacggcgaggccgggggaccgcccctcaagttcggggtcgcggcggtcgacctgttcaccggccagttcgccgcccaggccgtgctggcggccctgtaccagcgggagcggaccgggcgcggccggaccgtcgacctcgccctgttcgactgcggcgtggcgctgacctcctattacggcctggaggcgctcgcccgggggatcgatccgccgcgctacggcaacgcccacccgtcgatcgtgccctacggggtgttcgaggccggcgacgggccggtggtgatcacggtcggcaacaacgggcagtaccgccgcttctgcgagcaggtgctggagcgcccggactgggtcgccgacccgcgcttcgccaccaacctcgaccggtcgcgcaaccgcgccgccttcatccccgtgctggaggccgagctcgccaagtgggagcgcgcgccgttgatcgcccggctgcgggcggcgggcatcccctgtggcgaggtgatgggcctgcgcgaggcgctcacctgcgaccgggcccgggaggccgggctggtggtcgcggcaccggaggcgacgcccgcgaacgcccacgtcatcgccccgccctaccggctcgacggccgccggctgccggtgcggcgcatgccgccgggcctcggggattcgagcgccgagatcctggccgagcacctggactacccggaggccgcgcgcgacgcgctgcgggccaagggcgtggtccgctag

SEQ ID NO: 5217 - DNA, 1806 bp, Methylobacterium sp.
atgagcgacaaacgccggatcacgcccgccgacctgcgctcgaaggcctggttcgacaacccgcacaacccgggcatgaccgccctctacctagagcgctacctcaattacgggctgacgccggaggagctgcgatcgggcaagcccctgatcggcatcgcccagacgggttccgacctgtcgccctgcaaccgccatcacgtcgagctcgccaagcgggtgcgggacggcatcacggcggccggcggcgtcgccttcgagtttccctgccacccgatccaggagaccgggaagcggccgaccgcgtcgctcgaccggaacctcgcctacctgtcgctggtggaggtgctgtacggctacccgctcgacggcgtcgtgctgctgaccggttgcgacaagaccatgccggcctgtctgatggcggcggccaccgtcaacatcccggcgatctcgctgaacgtcgggccgatgctcaacggttacttccagaaggagctgacagggtccggaacgatcgtctggaagacgcgcgagcggcacgccgccggcgatatcgacttccagcagttcatggatatcgtcgggtcgtcggctccgtccacgggccattgcaacacgatgggcacggcctcgacgatgaacgccctcgccgaggcgctcggcctcgcgctgcccggctcggcggcgatcccggcgccctaccgcgagcgcggccaggcggcctacgccaccggccagcggatcgtcgagatggtctgggaggacctcaagccctccgacattctcacccgcgaggccttcgagaacgcgatcgtggccaacgccgcgatcggcggatcgaccaacgcgccgatccacatcaacgccatcgccaagcatatcggcgtgccgctgagctgcgacgactgggagcgggtcgggttcgagatcccgctcctcgtggacatgcagcccgccggccgctggctcggcgaggagtatttccgcgcgggcggcctgccggcggtcttcgccgagctgatcgaggccgggaaggtccacgagggtgcactgacctgcaacggccggaccgtaggcgagaactaccgcgggcggcacagctggaaccgcgacgtgatccgcgcctacggcgagccgctgatggagcgcgccggtttcctgaacctcaaggggagcctattcgattctgcgatcatgaagacgtgcgtgatctcggaggaattcgccgcccgctacctgcgcaatccgaacgatccgatggccttcgaggggcgggtgatcgtgttcgacgggcccgaggactaccacacgcggatcgacgacccggcgctcgacatcgacgagaacacgatcctgatcatgcgcggggccggtccgatcggctatcccggcgccgccgaggtcgtgaacatgcagccacccggcgccctgatccggcgcggcgtgacctcgctcccctgcatcggcgacggccggcagtccggcacctccggcacgcccgccatcctgaacgcgtcccccgaggcggccgcgggcggcgggctggccctgttgcagagcggcgaccggatccgcatcgacctcaaccgccggagcgccgacatcctgctgccggccgaggagatcgcccgtcgacgcgcggatctggcggcgcgcggcggatatccctacccggcgacgcagacgccctggcaggagatctatagggatcaggtcgatcagctcgaccagggcatggtgctgaggggcgcggtgaagttccagaaggtcgcgcaggcctccggggtgccgcgggacaaccactga

SEQ ID NO: 5218 - DNA, 1800 bp, Methylobacterium sp.
atgaccgaccgaccgattgcacggcccctgcgctcgcgcgcgtggttcgacaaccccgacaacatcgacatgaccgcgctctacctggagcgctacctgaacttcggcctcagcctggaggagctgcgctcgggcaagccgatcatcggcatcgcccagaccggctcggacctgtccccgtgcaatcgccaccacctcgtcctcgcggagcggatccgcgagggcatccgcgaggcgggcgggatcgtcctggagtttcccgtccacccgatccaggagaccggcaagcggccgaccgccggcctcgaccgcaacctcgcctatctcgggctcgtggaactgctctacggctacccgctggacggggtcgtgctgaccacgggctgcgacaagaccaccccggcctgcctgatggcggccgccaccgtgaacatcccggccatcgccctgtcggtggggccgatgctcaacggctggttcaagggccagcgcaccggatccggcacgatcgtctggaaggcccgtgagatgctggcggccggcgagatcgaccacgacggcttcatcaagctggtgacctcgtcggcgccctcgaccggcttctgcaacacgatgggcaccgccaccacgatgaacacgctggccgaggcgctcggcatgatgctgcccggctcggccgcgatcccggcgccctaccgcgaccggcaggaggccgcctacctgaccgggaagcgcgtcgtcgccatggtggccgaggacctgaagccctccgacatcctgacccgcgacgccttcctcaacgccatcgcggtcaattccgcgatcggcggctcgaccaacgcgccgatccacctcgcggcgatcgcccgccacatgggggtcgagctcgacatcgcggactggcagacccacgggctcgacgtgccgctcctcgtcaacctgcagccggcaggcgcctatctcggcgaggattactaccgcgccggaagcctccctgcggtggtggcgcagctcatgcgccgcggcctgatccgcgagggcgcgctgacggtgaacgggcgcaccctcggcgagaattgccgcggcgccgcgatcgaggacggggacgtgatccggccgatcgaccggccgctcaaggaggcggcgggcttcctggtcctgcgcggcaacctgttcgacgccgcggtgatgaagaccagcgtcatcggcgcggagttccgcagccgctacctgtcgaacccggaggatccggacgccttcgagggccccgtcgtggtgttcgacgggccggaggattaccacgcccggatcgacgacccgagcctcggcatcaccgaggagaccctgctggtcatgcgcggggccgggcccgtgggctacccgggggcggccgaggtggtgaacatgcgcccgcccgcgcagctgatccgcgccggcgtgcacgcgctgccctgcctcggcgacgggcgccagtccggcacctccggctcgccgtcgatcctcaacgcctcgcccgaggcggcggccggcggcggcctcgccctcctgcgcaccggtgaccgggtgcggatcgacctgcgccgcggcaccgccgacatgctggtcgacaccgacgagctcgcgcggcggcgcgcggccctggaggcggccggcggctacgcctacccggcctcgcagaccccctggcaggcgatgcagcgcgccgcggtggggcagatgcacaccggggcgatcctggagggcgccgaggcgttccagcgcatcgcgcagacgcggggcgtgccgcgcgacaaccactga

SEQ ID NO: 5219 - DNA, 873 bp, Methylobacterium sp.
atggatctcgacatccgcgaattcgaagaggtctgccgcgacctctacgtccgcgccctgaagatcctgccgcccgacatcaaggcgggcttcgccgacctgcagcgggccgagaccagcgccaccggccgcgccatcctcgacacgatggtggagaacgtcgcggtcgcggagcgcacgaagaatatcctctgccaggataccggcatcccgatctacaacgtcgtgatcggcgccgacgtgcgcttcgacggcgccgccctgaaggccgcgatccggcgcggctgcgaacgggccacgaaggagttctccttacgctcctcggtggtccacccgatcacccgaaagaacgagcagacctcctgcggcatccgcgtgccgatcatccacgtcgatttcgacgaccggcccgagaccgtcgcggtggagatgatcccgaagggctccggctccgagaacggctcgttcctgcagatgctgctgccctcggacgggatcggcgcggccaagcgcttcgtcatcgaccgggtgatcgagctcggcggccgggtctgcccgccgaccatcgtgggcgtcgggctcggcggcacctcggacctgtgcatgcatctggccaaggtggcggcgacccggccgctgcgctcggtctgctccgatcccgaaggcgcccggatcgaggccgagctgtcgcgggcggtgaacgaactcggcatcggcccgcaggggctcgggggccggtccacgagcttcgccgtccatgtcgagctcgccgcgacccacatcacccagaacccggtcgcggtgaacatccagtgccactcggcccgccgcgcccgcgcgacgctcacgcccggcggcatcgcgttcgattga

SEQ ID NO: 5220 - DNA, 390 bp, Methylobacterium sp.
atgcgtcagaccccggacggaaccctcgccctgctgatcgcggccctgcgcgagggcacggcgcatgtcgaggcgctgctcacgctggcgcggacggaggtcgacggcaatttccgggcgatcgtgtcgctgatcgccatcgtcggcacgatcccggtgctgctgatcgtcaccttcttcctcggcctcgacgccgtggtgaagctgctggccgtgccgttcggtgccgaggcgccggccgcgctgatcgtcgccgcgccgttcctggccatcgcgctcggcctcggctggatgggtgcccgccggatggcgctctcgaacctcgagccctggcggacgtggcggcaggtgaagcgcgacgtccgggaggtgacgcgcgccggcgcgtga

SEQ ID NO: 5221 - DNA, 732 bp, Methylobacterium sp.
gtgcgggcgcggggcccggacatcctgcccgggtcgttcagggagagcgccgtgattcgattcttctacaatctcagccccaaccccatgaaggtcgccctctgcctcgaggagatggggctgccctacgagccggtgccggtcgacacccgcaggggcgagcagttcgatcccgcctacacggccgtcaatccgaacgggaaggtgccggcgatcgtcgacggtgacgtcaccgtgttcgattcgaacgcgatcctgatgtacctggcgggcaagaccggccggttcctgccggagggcgaaccggtccgcggcgagatgctgtcctggctgatgttcgtggcgaccggcatcgggccgttctccggccagtgcgtgcatttccgccacttcgcacaggacgggggcgcctacgccaccgagcgctacgccttcgaggcgcgccggcactggggcatcctcgaccagcgcctcgccgaccgcacctacgtgctgggcgacacctacacgatcgtcgacatggcggtctggggctgggcccggatggtgcccttcgtcctcggcgagggcgccttcggggacctgcccagcgtcaagcgccacctcgacgcgctcaacgcgcggccggccgcccaggccgccgaggcgctgaaaggccgccacgccttcaaggcggagatggacgccgaggcgcggggcttcatgttccgcgccgtgaagggcgccgcctga

SEQ ID NO: 5222 - DNA, 906 bp, Methylobacterium sp.
atgacgatgcggctcgtcgcggttctggcgctggcgctggcggcgacgcccgcctccgccgtcgaggtgctcaccgggacgctcaggagcgtcgccgagcgcggggagatcgtcctcggctaccgggagagctcggtgccgttctccttcgtggagggcaagcagtcggacgggagcccccgaccgatcggctacgccatcgacctctgcggcgagatcgcagacgacatccaggcggcgatcggccggccggtgaggatccgctacgcaccggtcacggccgagagccgcatcgaggcggtgacctccggcaagatcgacctcgaatgcggctcgaccaccgccaatgccgagcgccgcaagcaggtcgccttctcgccggtggactacatcagcgcgacgcaactgctggtgaagcgcggatcgggcatcgcctcctaccgggatctcggcgggaagaccgtggtggtcacggccggcaccaccaacgagaaggccgtgcgcgacctcctcgcccgcctgaagatcgacgcgcaggtggtgacggcgcccgaccacgccgcctcctacgcgatggtcaaggccggcaaggccgacgccttcgccaccgacgacgtgctgctctacgggctgatcgccacggacgcgaaggacggggcgaactacacggtgctgcccgacaagctctcctacgagccctacggcatcatgttccgcaaggacgacccggaactcgccggcctcgtgcagcagaccttcacgcggctcgccgagtcgcgggcgctgcgctggacctacgagcgctggttcctcaagcgcctgcccaacggcgaacgcctggacatcccgatgtcgaacgacctgcgggtcagcttccagctgatgggcctcgacgggggcgagtga

SEQ ID NO: 5223 - DNA, 978 bp, Methylobacterium sp.
atgcacgccctgattctcggcgccgccggcatgatcggccgccgcctcgtggacgccctggtgagggatggccgggtcggcgggcagccgctcaccgccctcacgctcctcgacgtggtcccgcccgcggcgcccgagggcttctccggaccggtgcgggccgaggccgccgacctcacggcgcccggcgccgccgaggccgccatcgccgagcggccgggggtgatcttccacctcgccgccgtggtctccggtgaggccgaggccaatctcgagctgggctaccgggtcaatctcgacggcacgcgcctgctcctcgacgcgatccgggcggccagcgcggcggacggctaccggccgaagctggtctttacctcctcactcgcggtgttcgggccgcccttccccaaggtcatcccggacgaccacatcctgcgtcccgcctcctcctacggggttcagaaggccatgggcgagctgatgctcgccgactacgcccgccgcggcttcctcgacgggatcggcctgcggctgccgacgatctgcgtgcggccgggcaagcccaacaaggcggcctcgggcttcttctcgggcatcatccgcgagccgctcgccggccagcaggcgatcctgccggtgcccgacacggtgcggcactggttcgccagcccggcggcggcggtgggcttcctcacccacgcggccgggctcgacctcgcggcgatcggcccgcggatcagcctgaccatgccgggcgtctcggcgacggtggcggaggagatcgaggccctgcggcgcgcggcgggcgacaaggccgtggcgctgatccggcgcgaacccgacgccacgatcgcgcggatcgtcggctcctggccggaggcgttcgagccggaggccgccctggccctgggcttccgggcggacgcgtccttcgacgcgatcgtcgcccagcacgtggccgagttccacggcggctga

SEQ ID NO: 5224 - DNA, 1284 bp, Methylobacterium sp.
atgcgatctctgcttctcgccgcgctcttcgcgggcgtggccatgccggcggcggtgctccccgccctggcgcagggtgcggcccctgccgagaccaaggccaagacggacgacctcgagaagcttcagggcttccacagcacggacacgcaggccgccgccgagatcccgcagaccggccgccgcgccgacgcgatccgcaagaacctgtcgaaggtcaagctgccggacggcttcaagatcgacctgtacgcggtggtgccggacgcccgcgccatcgcggtcggacccaatgccggggtgctgttcgtcggtacgcgcaagagcaagatctacacggtcaccgaccgcgacaaggaccgggtcgccgacgaggtccgtcccttcgcgccgggcatcacgttcaagatcccgaacggcgtctgcttctcgaaggacggcgtgctcaccgtggtcgagcagaaccgcgttctggccttcccggccgccgagttcttctacgagaacccggacgtcgccgccggcgtgctggtcaagcagggacagctgatcccggcctccgaggagagcttcaaccacacggcccgggtctgccgggtcgggccggacggcaagacctacatcgcgctcggccagccctacaacgtgccgcccgccgagaaggcggacctctacaagaagaccggcatcggcggcatcatccgcatcgacgccgacggcaagaaccgcgaggtctacgcgaccggcatccgcaactcggtcgggatggacttcaacaccgacaagtcgctgtggttcaccgacaaccaggtcgacggcatgggcgacgacaagccgccgggcgagctgaaccgggccaccaaggcgggcgagaatttcggcttcccgtggttcggcggcggctcggtccgcacggtcgagtacaaggaccagaccccgccggccgacgccgtcgccccgcaggccgaactgccgccgcacgccgccgatctcggcatgaccttctacaacggcaagcagttcccggctgcctacaagggcgggatcttcatcgccgagcacggctcgtggaaccgcaccgagccggtgggcgcccgggtgatgttcgccaagctcggggccgacgggaaggtcgagtcggtcaagccgttcgcggaagggtggctcaccggcgacggcgagtatctcggccgcccggtggacgtcgcggtgatgctcgacggctcactgctggtctcggacgattccgccggggcgatctaccggatctcctacgagaagtag

SEQ ID NO: 5225 - DNA, 318 bp, Methylobacterium sp.
atgatccgcccgcttctcctcctcgccgccaccctcgtcccgctgtcggcgcaggccggcgacgcggccgcgggcaagaagcgcgcgaccgcctgccagacctgccacggcatggacggcctctcaaagctcccggaggcgccgaacctcgccgggcaggtcgagccctacctcgtgaaggcgctcaccgagtaccgcgacggcaagcggcagaacgagatcatgaacgtggtcgcgaaggaattgtcggacgccgacatcgccaatctggcggcgtactacgcgggcatccagatcgacgtgctgccgccggggtaa

SEQ ID NO: 5226 - DNA, 3477 bp, Methylobacterium sp.
atgcgcctgatccgcctcgccctcgagcgctacggcgccttcacggaccgcaccgtcgcgttccggccggacgcgcgcctgcacgtggtgctgggcgccaacgaggccggcaagagcaccgcgctggcggcggtcaccgacctgctgttcggcttcgggaagacgacgccctacgccttcctgcacgacatgccgcagctgcggctcggcgccgagatcgccgccgccgacggccgccggctgtccttccgccgccggaagggcaacagccgcaccctcatcgacgccgccgacgcgccgctcgccgacgacgcgctggccccgttcctcggcggcctgtcccggactgtgttctgccgggccttcgggctcgacgcggcgagcctccgggccgggggccgcgagatggtcgacgtggagggcgaggtcggcgcgagcctgttcgcggcgggctcgggcctgcgcggcctcacggagctgcagacgacgctcgacgccgaggccgacgccatcttcgccccgcgccaggccaagcaccggaccttctaccaggcgctggagcgccacgagacggcgcggcgggcgatccgcgagcggggcctgcgcgccggcgactggcgcgccctgaacgacgagatcgccgcggcggccgcgcagctcgaggcgctccggtccgagcagaaggccggcgcggtcgcgcgcgcccggctggagcggttcaagcgcgtccgcccgatcatcgccgagatcgacacgctggagcggcgcatcgccgccgagaccgacctcgtcgacgcggatcccgcctggatcgcccgcctcggggccgccctggacgcgtgccgcgccgcggacgccgaggcggagcgggccgagaccgcgcgcgaccgggcccgcggcgaggccgaatcggtgccggtcgagccggggctgacccatcgggcggacgagatcctggcggcgttcagcggcacccgggagttcgagaagggcggcaccgacctgccccgcatcgagggcgacgcccacaaggtcggactcgatctggagcggctgcgcgcccggatcggcgtgcccgacctcgccgcgctggaggcccgccagcccccggacgccgcgcgggcgcggaccgagcggctgatccgcgacggtcggaccctggcggccgccgaggagcagatcgcccgcgacctcgccgccgcccgcgcggagcgggaacgcctcgcccgcgaggtggaggcggccgacgcggcccgggatccgaccccgctccgggaggcgctgaagcccctcgcccggctccacgagtggatcgccgcccgcgacaccctcgacggcgcgatccgccgggaggcggcgttgctgcgcaaccaggccgagcggctgtcgccgccggtgccggacctcgccgccctcgtgcggacgcccctgcccgcccccgacacggtcgcgcgctaccgtcagggcctcgaggccaagacccgcgagcacgagcgggccgccgaccggtgcgacgccgcccgccggcaggtcgcggtcacccgggcgcggctaagggagcgcgaggccggccggcccgtcgccacccgggagcggctcgacgccctgcgggcgacccgcgacgcggcgttcgcgccgctgcgcgacgccctcgcggccggccgggcggccgccgtcgccgaggtcgcggccttcgagcgcgcgctcctcgaggccgaccgcgtcgcggacgagcgcgcctccgacgccgcccgggtcgccgcccaggcggacgacctggaacggctcgccgctgaggaggcggaggccgcgcgggccgacgacgtcctcgccggtctcgccgcggagatcgcggcgggcgaggcggcgtggcgcgaggcgtggcggcccgccgggctcgtgcccggaccgccaaccgagatggcggcctggctcgccgaggtggagagcctgatcgaggccgagcagcgcctcgccgcgcagcggatcgaggccgaccggctcctggcacggatcgaggccgcgcgggggcccctggccgacctgcgcagccgcgccggcctcgacgccgcgccggacctcgagatcgccgccgcgctggacggtcttgaagcgcggatcgccgccctggcgagccgctgggaggccaacctgcagaccgccggcctgctgcgcgcggccggattgtccgtcgatcggctggaagcgagcctcgcggagaccgccgcccgccgcgccgcgtggcgggccgagtgggaggcggcgctgctccccctcggcctcgacggcacggccggtccggaggaggccgagggcgcgctggaggcgtggcgcagcgtgcccgaccggctggcggagcgggccgccctgcagcgccgctcggcggggatccgccgggacatggaggcgttccgggccaccgccgccgccctggtcgaggccctggcgcccgacctcgcggaggtgtcgcccgccggcgcggtccgatcgctccacggccgcctcgtcgccgcgcaggcccgcgaggcgcggcgcgccgaactcgaccgccgccgcgacgaggccgaggccgcccatcgcggcgcctgcgaatcgcgcgacgcggcgcgggcgacgctcgcccggcaggtggccgaggtgatgccggacctcgccgcggcaccgacgccggagatcgaccggctgttcggccgcctcagcgcgcgggaggcgctgcgcgccgagcgcctgcggctccgcggcacgctcgcgggcgcggccgacgggcttccggaggccgagctgcgcgccggcctggagaccgtgtcccccgaggcgatcgaggcggagctggcgcggctgtcgctcgaggccgacgagcaggccgagcgcgggcaggtcatcttcgcggaccgcgaccgggcggagcggcggcgggcggagctcgagggcggcaccggcgccgagctggccctcgcggagcgcaaggccgcggaggcggatctgcaggcggcttcccggtcctgggccgtgctgcggctcgccgggctgatgctcgggcaggcggtcgcccgccaccgcgcggggcagcaggacccgctcgtcacccgggcgggcgcgttgttccaggctctcaccggcggcgcgttctcgggtctggcgcagatctacgacgaggccgacacgccgaagctcgccgggcagcgcgccggcggcggcacggtcacgatcgagggcatgagcgagggcacccgcgatcagctctacctcgccctgcggctcgcctatctggaggattacgccggccgcgccgagccggccccctttatcggcgacgacctgttctcgaccttcgacgagacccggaccggctacggtctcgacgcgctcgcggcgatcggcacccgggtccagccgatcctgttcacgcaccaccgccacgtcgcggacatcgcccgcgaccggctcggcgactccgtcgacgtcgtgacgctctag

SEQ ID NO: 5227 - DNA, 1239 bp, Methylobacterium sp.
atgacggcgttcagcttcatccatgccgccgacctgcacctcggcagcccgctgtcgggtctggccgcgcgcgacgcggaactggcccggcggctcgccgcggcgagccggcaggccttcgaggatctggtgagccgggcgatcgagcggtcggtcgccttcgtcgttgtcgcgggcgacgtctacgacggcgactgggccgacaccacgatcggcctgttcttcgcccggcaggtcgcgcgcctcgaccgcgccggcatccggacgatcctcgtgcgcggcaaccacgacgccgagagcgtcatcacgcgctcgatcacgctgccggcctccgtccacgtcttcccgaccgcccgcgccggcaccctgcgcctcgacgcgctccgcgtcgcggtccacggccgcagcttccagggccgggccgtggaggagaacctctcgctcacctacccggccgccgtgccgggctggttcaacctcggggtcctgcacacctcctgcaccggccacgccgcccacgagacctacgccccctgctcggtcgccgacctcgcggcccggggctacgagtactgggcgctcggtcacatccacgagtacgccgagctgtcccgggatccctggatcgtgttccccggcaatctccagggccggagcgtgcgcgagtgcggcgagaagggcgccgtcgtggtcgacgtcgccgacgggcgggtgaccggcgtcagccgcctgcccctcgaccgggcccggttcgagcagatcacggtcgacctcgcggcggtgaccgacgcgcgcggcgccgtcgaggccgtcgaggcggcgctgaggcccctggccgggatcgcggcgcgccggctgctcctggtccgcgtccacctcgcggggacgacccgagcccacgacgccctggcggccgatcgcgagtccctgacggccgagatccaggcggccgcgcaccgcctgcacgaggacatctggctggagcgcctgaagatcgagacccgccgcccgcgcgccgcggcggagccgagcggcgccgccatcgaccccgcggcgctgctcgccgacctcgaccgcgaccccgagttccgcgcccgggcgaaggcggcgctggccgagatcgtcggccggatgccggggacggccgccgcggaggccgacctcgacgcggagttcgacgcgctctgcgccgaggccgaggccctcgtcctcgggcgcctcggcggccggcattgctga

SEQ ID NO: 5228 - DNA, 855 bp, Methylobacterium sp.
atggcccagagcctcgacatcgacctcctgcgcagcttcgccacagtggcggagacgggcgcgctgagccgggccgccgagcgggtcgggcgcagccaggccgccctcagcatgcagatgaagcggctggaggatctggtcgcgcaaccgctgctgcgccggacggggcgcggggtggtgctcacggtgcagggcgagcgcctcctcgtccacgcgcgccggatcctggcctcgcacgacgacgcggtggcggaactgtccggcgggcgcctcaacggcacgctcaggttcggctgcccggacgattacgcgcaggccttcctccccaccctgctgcgcggcttcgcgcacctgcatcccgacgcggcgatcgaggtggtctgcggcgcgacgccccgtctggaggaccggttcgcccgcggcgggctcgatctggccctcgtttcggtcccgctggcggtcgggcgggagatcctccggcgcgaggacctcgtctgggtcgcgccgcgcggcgccgccgcgccgtggcccgacccgctgccgctcgcgctcggcgaccctgacacgctggaccaccgtgcggctcgggccgccctcgacgcgagcgggcgcgcgtaccggatcgcctacgcgagcggcagcctgtccgggctactggcggtggcgcgctccgcccaagcggtcgcggtcctcacccgtgccgcggtcccgcccgacctgcgcgtcctgagccgcggcagcggcctgcccgcgctgccgcggatcggcctgacgatccgcctggacgaggtgcacgccgcaccgctgacccgcgccttcgccgcccacctgcgcgcggtgctgccgacgctctga

SEQ ID NO: 5229 - DNA, 666 bp, Methylobacterium sp.
gtgagcatcgcagacgccttccgacagacggccgcccagatcggcgctaacccgctcgatctggcgacggtcgcatcctacgagagcggcgggaagctcaacccggccgtcatgggcggggccggcgggcgctacgccggcatcttccagttcggcccgtgggagcagcagcactacggcgtctcgaaccggagcacggccgagcagcaggtcgaggcggccggccggttcctcaaggatcgcggcttcaagccgggcatgggcctgctcgatatgtactcggcgatcaacgccggccgggtcgggcgctacaacgccagcgacgccggcaacgggggcgccccaggcacggtacgcgacaaggtcgagaagcagatgggcggccacgtcgagaaggcgagggcgctgctcggcgcgctcggcggcgccccggcgtctgatgcgccggccgccggccagacaccgcaggcgggcacggatctcgccgcggcgcttgggccgggcgtcacgctgccgaccctggcgccggccgtcccggtcgtgctaccggccgagccggacccgacgatccaggcccagcaggcccagcagctccaggagcagcgcgcccagcaggagcagcagaggaagcaggccctgctgagcgtgagcgcgttctaccgctga

SEQ ID NO: 5230 - DNA, 726 bp, Methylobacterium sp.
atgcgcccgccgcttctcgccccgctgctcctgctctccgccctcgccctgctcgctagcccggcgcgcgcggaggagaacgagtgccggcggtccccctcgctcgcgtccggcgcgcccccgaccttcgggcgcatcactgcgccggggcgcacggccttcgtcaaggacgggctcgcccgcgccggctgcccggatccgagcgccgcctgccgcgagcgcgcctacctggtgaccgccgatcccgtcatcctcggcgagcgtcgcggcgcctatgtctgcgcccactatcggggcgcgggcgacgatatgggtaggaccggctggctcccgggcgaggccgtcgccgtcgagccgcccggtgccgtcgcgcctgcggactggctcggcacctggacccgtgcggaggcgcgcatccgcatcacccaggccgacaagccggggatgctcaccttcgggggcgacgcgacctggggcgccggcgatccggagcgggcgcgccgcggcggcgtccatatcggcgaattcgccggcacggtcgccccgcagggcgccgcggcgagcttcgccgtcggcgagaatggggcgctgccggtcgaggccggtgacgcctccgactgcaaggtctggctgcggcgggtcggtccctggctggtcgtcgacgacaacctcgcctgcggaggcgtcaacgtcaccttccgcggcctctaccgccgccagccatga

SEQ ID NO: 5231 - DNA, 2163 bp, Methylobacterium sp.
atgtcgaagctcgtcgtcgccgaggatctccgcaccttcctctccgaggaagcgctgccggggaccggcctctcggccgaccagttctggtcgggcttcgccgcgatcgtccgcgatctcgcaccgcacaaccggacgctgctcgaccggcgcgacggcctccaggccgacatcgattcctggcaccgcgaccatcgcggagcgccgcacgacccggcggcctacgcggcctacctgacgcggatcggctacctgcagccggagcccgagaccgtgcgggtgaccaccgagaacgtggacgcggagatcgccgccatcgccgggccgcagctcgtggtgccgatctccaacgcccgctacgcgctcaacgccgccaatgcccgctggggcagcctctacgacgcgctctacggcaccgacgcgatcccgcaggacggcgagctcgcccccggcgccgggttcgacccggcccgcggcgccgccgtcgtggccaggaccaaggcgttcctcgacgcgaccgcgccgctcagcgtcggctcctgggcggatgccgtgggcttctcggtgacggacggccgcctcgccgccgatctcggcgccggccgcagcgccggcctgaccggatcgtccgccttcgcgggctacaccggcgacgccgcggcgccgaccgcgctcctgctgcgccacaacggcctgcacatcgaggtcgtcatcgaccggacgagcccgatcggccgcaccgacccggccggcatcgccgacgtggtgctggaggccgccctctcgaccatcatggacatggaggattcggtggcggccgtggactcggccgacaaggtcgcggtctaccggagctggctcggcctgatgcgcggtgatctgaccgccaccctgtccaagggcggccgcacggtcgagcggcggctcgccgcggaccggaccttcacggcccccgacggcgggcgcctgaccctgccgggccggtcgctgatgctggtccggcatgtcggccaccacatgtacaccgacgccgtgaccctcgacggcgccgagatcccggagacgatcctcgacgcggccgtcaccgcgctgatcgccctgcacgacctgaagggcaccggtccggtccgcaacagccggaccggctcggtctacatggtcaagcccaagctgcacggtcccgaggaggtcgccttcgcggtcgagctgttcggccgggtcgaggcgctggtcggcctcgcgccgcggaccctcaagatcggcgtgatggacgaggagcggcgcacgacgctcaacctcaaggcggcgatcgccgcggcgtcggatcggctgttcttcatcaacaccggcttcctcgaccggaccggcgacgagatccacacctcgctggaagcgggtccggtggtccgcaaggacgccatgaaggcgaccgcctggatcaaggcctacgaggacggcaacgtcgatgccggcctcgcctgcggcctgcccggccacgcgcagatcggcaagggcatgtgggccgcccccgaccggatggcggcgatgctcgacgccaagggcgcccacccggaggcgggcgccaacaccgcctgggtgccgtcgccgaccgccgcgacgctccacgcgctccactaccatcaggtggatgtccgcgcccgccaggcggcgctcgccggccgggcgcccgcgacccgcgccgccatgctgaccctgccgctcgccgagggcgcgttcgcgccggaggcggtgcgggaggagctcgacaacaattgccaggggatcctgggctacgtggtccgctgggtcgaccagggcgtcggctgctccaaggtgccggacatccacgaggtcgggctgatggaggaccgcgccaccctgcggatctccagccagcacatcgccaactggctgcgccacgggatcgtggatcgcgacgaggtcgccgcggccctgcggcgcatggccgaggtcgtcgatcgccagaacgccggcgaccgggcctaccggccgatggccccgggcttcgacgggccggccttccgcgccgccgaggccctggtcttcgagggcgccagccagccgaacggctacaccgagttcgtgctgcaccggttccgccgggaggccaagcgcctggaggcccacgtccgggcggcctga

SEQ ID NO: 5232 - DNA, 915 bp, Methylobacterium sp.
gtgcgggccttctgcgccgtcgtggatctcggtacggtgacggccgcggcggcgacgctgcaggagaccaagggcagcgtcagccgtcggatctcccgcctggagcgggcgctgggcgtccggctgatggcccggacctcccgggcggtctcgccgaccgccgagggcctcgccttctacgccaaggcccaggagagcctgacgctcctcgacgaggcgaccgagaccgcccgcgacgcccgcacggtgccggccgggcacctgcggatcacgacctcgatcgatttcgggatcgaggtgatgccggagatcgtcgcgagcttccgggccgcctacccgcagatcaccgtggagatgctcaacaccgacgcgcgcctcgacctcgcggccaaccggatcgacctcgccctgcggctgggcggcgcggaggagaccggctaccgcgcgatggtcctcgcgaccctggcgctcgccctctacgccgcccccgcctacctggaacgccgcccggccccggcggatctcgccgatctgcgcgaccacgacctgatcctcgcccgggaacggatcggcacggccgggctgaccctctccgacgggcagggccgcacggagccgctgtcgctgagcccggcgatccgggtcagcgacttcgcgaccgcgctccgcctcaccctcgcgggcgccggcatcggccacctcccgagcctcgtggccgcccgggccgtggaggccgggcagatcgtgcgcgtgctcagcccctgggcgacccgcagcagcaccttgcgggccgtcaccctggccggtcgcgagcttccggcccgcgtccaggtcttccgcgagcacgtccggacagtcctggcctcgcgtggatgtcccggcgacagcgcgaaatcagaaggtgaatacagataa

SEQ ID NO: 5233 - DNA, 750 bp, Methylobacterium sp.
atgagactgaacggcaagatcgcgctggtgacgggggccggcagcggcttcggggccgggatcgcccagcgcttcgccgcggagggcgccagggtggcctgcgtcgacatcgacggcgcggcggccgagcgcgtcgcggcggcgctcggcgacaacgccatcgcgatcgccgccgatgtcgggctggccgccgacgtcgccgccagcgtcgccgagacgcggcagcgcttcggcgtgccgaatgttctcgtcaacaacgccggcaccacccaccgcaacaagccgctgatggaggtgacggaggaggatttcgaccgggtgttccgggtcaacgtgaagtcgatcttccactacgtccgggaagtcgccccgctgatgcgcgacgcgggcggcggcgcgatcctcaacgtcagctcgacggcggcgctgcggccgcgcccgggtctgacgtggtacaacgcctccaaaggggcggcgagcctcgcctcgaagtcgctggccctggagctggcgccctggaagatccgggtgaacgccctctgcccggtcatgggcgccacggggctcctcgagcacttcatgggcgtcctcgacacgcccgagaaccgcgaccgcttcatcgccacgatcccgctcgggcgcctgtcggaggcgagcgacatcgccgccgccgccctgttcctcgcctccgacgaggcggcgttcatcaccggcgtcgatctccccgtcgacggcggccgcacggcctga

SEQ ID NO: 5234 - DNA, 1140 bp, Methylobacterium sp.
atgccctcgtctcccgcctatctcgaccccgcgaccggggcgacctacccgatcgagacgccgcgctggcgctccgagacgggcggtccgctgatgatcaccgacctgccgggaatcgggcgggcgcagatcgacacgggccggcgctccctctggcgctacgccgccgccctgccggtggcggtggccgacccggtcacgctgggcgagggctgcaccccgctggtgcgccggccctggcggggcggccacgcccatttcaagctcgagtggttcgcgccctcgggcagcttcaaggaccggggcgcgtccgtgatgctgtcgatcctgcgccagcaggggatcgacgcggtgctggaggattcctccgggaacggcggcgccgcggtggcgacctacgcggcggccgccgggatgcgggccaagatcctggtcccggcctcgacctcgccggccaagaccgtccagatgcgggccgccggcgccgaggtcgagctgatccccggctcccgccaggacaccgccgacgcggccgtccggcaggcagactcgatcttctacgccagccacaactggcaggcccatttcctccagggcaccaagacgctggcctacgagctgtgggaggatctggggttccgcgcgcccgacaatgtcatcatcccctgcggcgcgggcagcaacatcctcggctgcgatatcggcttctcggagctgctgcgccggggggcgatcgcccgcctgccgcggctctacgcggtgcagccggcccactgcgcgcccctgcacgcggggttcgaggccggcgcggaggatttcgtgccggtcaccccgcgcccgacgctggccgagggcgcctcgatcgcccagccggtccgcggccgggaggtgctggcggcgctccgccgctccggtggcggcaccgtggcggtctccgaggacgccatcgaggcggccctgatggagctcgcccggtcgggcctctacgtcgagccgacctgcgccatggcggcggcggcgctcaccgacctcaccgcgcgcggcgcgatccggcccgaggagaccaccgtggtggtgctcaccggcaccggcatcaaggcgacgccgcgcatcgccgagcttctgggcctcgccccgtaa

SEQ ID NO: 5235 - DNA, 1134 bp, Methylobacterium sp.
atgagcatgatcgaccgcgagctccggcccgatgcgggcccggccgggacggcctccgccctcctcacgatcgatctcgcggccatcgcggagaattaccggcttctcgccgcgcgggccgggacggcgacttgcgcggccgtcgtcaaggcggacgcctacggcctcggcgccgaccgggtcgcgccggtcctggccgccgcgggctgccggcacttcttcgtcgcccaggtcggcgagggcgtcgccctccggtccatcctcggccccggcgcggtgatcgccgtgctcaacggcgccgccccgggcagcgaggtggcctgcgcggatcacgacctcgtgcccgtcctcaacgacctgtcccagctcgacggctggcagggcctggcccggcgacgcgcgcggcgcctgccggcgatcctccaggtcgataccggcatggcccgcttcggcctcgcgccggacgaggtcggcgcgctcctcgaccggccggacgccctcgcgggcctcgacctgcggctggtgatgagccacctcgcctgcgcgggcgagccggacagcccggtcaacgcggcgcagctctccgtcttccgggcggtccggcagcgcctgccgacggtgccggcgagcctcgcggcctcgtcggggatcttcctcggtgcggacttccacttcgacctggtgcgccccggcgccgccctctacgggatcgccccgcaggagggcgcgccgaacccgatgcggccggtgatcggcctgcgggcccgggtgatgcagacgcgccgcgtcccggcggggacgccggtcggctacggccacgcggcccgagtcgacagggacagccgcctcgccacggtcgcgatcggctacgcggacgggttcttccgcagcacggcgggcggcgcggcgtggttcggcggcgcccggctgcccgtggtcgggcgcgtctcgatggacagcctcgtcctcgacgtcaccgacgtggcgcccggcaccctcgggccggggacgctcgtcgacatcgtcgggccggagcgcgacgtcgacgccgtcgcggccgcggccggcacgatcggctacgaggtcctgaccagcctcggccatcgcttccaccgcatctatctcggagcctga

SEQ ID NO: 5236 - DNA, 909 bp, Methylobacterium sp.
atgaccaacgcaacaccccgcgccgcggtgatcggcctgggctccatgggctccgggatggccggctcgctcctgcgggtgggcttcgcggtctccgcctgcgacgtgaacccggacgcggtggcgcgcttcgcgaccgccggcggccgggccgccgcgaatcccgccgaggcggcgcgggacgccgacgtggtggtgagcgtcgtggtcaacgccgcccagaccgaggcggtcctgttcggcgaggacggcgccgccgccgcgatgccggagggcgcggtgttcgtctcctccgccaccatggacccggccgtcgcccgggcgctggcggcgcggctggaggccaccggccgccactacctcgacgccccgatgagcggcggcgccgcccgcgcggccgaaggcggcctcaccttcctggcctccggctcggcggcggccttcgccaaggcgcgtcccgccctcgatgccatggcgggcacgctctacgaactcggcgacgcggctggccagggcgctgccttcaagatgatcaaccagctgctcgcgggcgtccacatcgccgccgcctcggaggcgatggccttcgcggccaagcaggggctcgacctccggcgcgtctacgaggtgatcaccaagtcggccggcaattcctggatgttcgagaaccgggtgccgcacatcctcgacgccgactacagcccgaagagcgcggtcgacatcttcgtcaaggatctcggcatcgtgcaggacatggcccgcgccgagaagtacccggtgccggtggcggcggcggcccttcagatgttcctgatggcgtcgggcgccggcatgggccgggacgacgacgcctcggtggcgcggctctacgcccaggtctcgggggcgaagctgcccgagaaagcttga

SEQ ID NO: 5237 - DNA, 579 bp, Methylobacterium sp.
gtgccagccgaagacgccccgatcggccgcttcccgattccccgcctggagacgctgccggacgacatccgcgcgcggatcgaggcggtgcaggagaagtccggcttcgtcccgaacgtgttcctggtgctcgcccaccgtccggacgagttccgggccttcttcgcctaccacgacgcgctcatggacaggccgggcaacctgaccaaggccgagcgcgagatgatcgtcgtggcgacctcggccatgaatcagtgccagtactgcgtgatcgcccacggggcgatcctccggatccgcgccaaggatccgctgatcgccgaccaggtggcgatcaactaccgcaaggccgacatcaccgaccggcagaaggcgatgctcgacttcgccatgctggtcagccagtccgcgcaccaggtcggggagcccgcgttcgcggcgctcagggcccacggcttcgacgacgcggatgcctgggacatcgccgccatcgcggccttcttcggcctgtcgaaccggctggcgaacgtcagcaacatgcggcccaacccggaattctacgcgctgggtcgcggctga

SEQ ID NO: 5238 - DNA, 255 bp, Methylobacterium sp.
ttgaacatcgcgcaagacatccgtgagattctcggggcgaacgaagccttcgcagggaaggccgaccagctctccgaggatgacagcctgttcgatctcggcctggactcgttcggttccgtccagctgatgctgggcctcgaggagcgtttcagcatcgagttccccgacgaactcctgaaccgcaagtcgttctcgtcgatccgcgcgatccgcgaggccgtctccaccctgatccagcaggaagccgcatga

SEQ ID NO: 5239 - DNA, 972 bp, Methylobacterium sp.
gtgaccgccgcgctgcgcctgccggagggtctgggagccgcgggaccttacgtcccgcacccgctccacggttccggccgcgactggccggagacgaactgctacgtcgacctctggatcgaactcctgcacggacgcggcctcgtgccggaggcgatgctgggtttcaccctgcggcaggatttcgagggcgaccagttcaccttcttcaagccgcccaccggcgatatcgagcgcctctacggtctggaggtgctggaactcgcggtctacggtggcctcgagaaccacgccgtgatccaggctgcggccggccggccggtgctggtcgaggtcgacgcgatctacctgccggacacccaggggacgacgtacggacgcgagcacgggaagacgacgatcgggatcctggccctcgatccggtcgcgcaggagctcgattacctgcacaatgcgggtcgcttccgcctcgcggggaaggattacgccgggatcttcgggccggcgacgctgccgccctacgccgagttcgtgaagaccgtcgccccgccgctcggtccggcggatctcccggcggtcgcgcgcgaattgctcgtccggcatcgcgcccgggcgccccggcgcaaccccgtcctggcgttccgcgacaccctcgcggcgacggccgcggagctggtcgtccgcccgctcagcgtgttccacgcctacgccttcaacacgacgcgccagctcggcggcaatttcgagatgctcgccagccatctcacgtggctcgaggcccgggaagccggcggattcgcgcccgccgccgcggccgcggcggacctgagccgcgaggccaaggccttccagttccagctcgcccgcgcgttccaccgccgctcagccgagggcctggcgccgcgcctcgaccgcctcgcggcgacctacgaccgcgtcttcgcggatctcgaccgcgcgctggaccgctga

SEQ ID NO: 5240 - DNA, 1785 bp, Methylobacterium sp.
atgacgggtgaagtcgggtccgaggccgcggtgccggtaccggcgaccttcgacgggctgttcgggtggcttcatccggcggccgggacgcgcggcgtcgtcctctgcggggcctacggcttcgagcagatggccgcgcatcggccctggcgctccctggccgagggcctcgccgcggcgggctgcccgacgctgcgcttcgactatcccggcgagggcgactcggccgatctagacgaggcgcgggtcgctgcctgcgtcgctgcggttcgtaaggccatcgcgtacttgcgcgcgacgaccggcgtcgcggaaatcgtcgtcgtcggcctgcggctcggcgcgaccttcgcggctctggccggcgaggcggaggccgtcgaccgcctcgtcctgctggcgccggtcacgacagggcgcgcgtatctgcgcgagatgcggctgcgggcgcagaccatcggccgccttccggacgggtccgccccggcgcaggagccggacagcctcaccgtgggcggcttccggatggaggcggcgttcctcaccgatctcgccgacctgaacctcgcggggctcgcgcgggcgccggcccgccacgcgctgctcctcgcacccgagaccaaggcgctggccgcgcgcctcggcgctctcggctgcgacgtgacgacgggagcgttcccgggtctcgcggcgctcgtcgccgatccgatcttctcggatgtcccgaccgcggatttcgcccgcgtcatcggcttcgcgaccgacggcatggcggccgccgggccgcgacccggcggcatcgccaccgacgcgcaccggaacgggctgaccgggccgggctgggcggaggcgccggtccgcttcgggcgcggcctgatcggcatccgctgtcggccggaccgggcggagagcgcggcgccgacgatcctgttcgtctcgacgggcatgagcgtgcattccggatgggggcgccagaccacggatctcgcccggcgcctcgccgcggagggcatcgcgtcggtccggttcgacctgcgcggcatcggcgacagcgatgagcggccggacggccgcaagcccctcttcgccgcggacggcttcgccgacgtcacggcggcggtcgacctgatcgccggcgcgggcggcccgatcctgctggtgggcgggtgcagcggcgcctacgcggctttccacgcgctctgccgggaccgccggatcgacggcgcgctcctgctcaacctctactgcttcgactgggacccggatcaggacctcgaccaggtcatccggcagaccttcgggagcgcgtccacctacgcggccctgctcaagcggggcgcgacctggcgccggctgatccgcggcgagatccggatcgccgccatcgcctcggtcctcgcccggcgcggcatcgaggccgggatccgccggctccgccgggctctccgccccggtccgctcgggggctcgcccgcccggcgggtcgcgaccctccgtcgccggggcgcggagatccgcctgctctacagcgcgggcgatccaggcctcgcggccgtccgccgccatctgggacgctcgcccggaccggccgaccgccgtatcggcgcgcccgtgacggtggtgccgggcgtggaccacaatttcggctcccgcgaggcccaggcctgggtcgccgcagcgctgcaggatctcctgcgcgccgtccgccgtgcccacgcgacgcgcaccgtcgcggcgaaggccgccgcgacgggaagcggtctcaccctggcgggccggacgtga

SEQ ID NO: 5241 - DNA, 1185 bp, Methylobacterium sp.
gtggcggcggtccggcccctcgacggggcggcgccctgggtcccggcctggcgggccctgggccgggcgagcctggtgcgcaacccgttctacgaggcgggctacgccctggcggcccgcgacgcgttcggggcgggcgtccggctcctcctcgtcgccgaccggccccccgaggccgccggggcccggctcgtcgccgtctggccgttccggccgtcgcgccgccgctggggcgtgccgctgccgctgctcatgggctggactcacggctacgccccgttcggggcgccgctcctcgacggcgccgccccggaggccgccctggcggggctgctcgccgcgccgggcgccctcggcctgccgccgcgcctcctcctgccgaacgctccgaccgacggcctcctgcctgaactcctgacggggcatggcgggcgccgcgccgcctactggccgcacgaccgcggcctgctcgacctgaccggcctcgggccggaggcgcgggccgcctatctcgggcacctctccgggcagcgccgccgcaagctccgccgcgcccgcgcgcgcctggaggcggcggggcccgtgaccttcgagatcctcgccgcgcccgaatccctcggccccgccctcgacgcccacgtcgcactggaggccgccggctggaagggtcaggccggcacgagcctcgcgcagcggccggcggagatcgctttcctgcgcgccgccctggccgatctcagtgccgatcgcggggccgatcgcggggccgcggacggcgtgcggatcgcgcgcctgcgccggggcgaccggctcctggcctccctgatcctgccggtcaccggccgggaagcctgggtgctgaagatcgccaacgacgagacgcggccggagaccgcgccgggggtccagctcgtccaccggctgaccgaggcggtggccgcgggcgactggccgatcgaccggatcgattcctgcgcgcccccggacttcgccctcggcacaaccttctggaccgcgcgccggccgatcgcccatctgctggtggaggcgggccgcgatccgctgttcccggtggcccggaccctggagcgggcccgggagcgcgttgcccgggcgcgtctcaccatccgaagcgggcgatctgctccagccgcgcccgcgtcgccgccgcgtcgcggcccatga

SEQ ID NO: 5242 - DNA, 1194 bp, Methylobacterium sp.
atgatcctgtgcggcggcttcggcacgcgcctcggcgcgctgacttcggcgatgcccaagccgctgctgcccgtggtcggggagccgttcctggacgtcctgctgttcgagctcggccgccacggcttcaccgacatcgtgctgctggcctccttccacagcgagaagatccgcgcctacgccaccgacaacccggtcgcgcgacgcttcggcatgacgctgcgggtctcggtcgagccggagcaggccgggaccgggggcgccgtcgtgcacgcccttcccgaggccgacgagacctttctcctgctgaacggcgactcgtggttcgatgtgaacctgctgtccctgcccgctatggcggcccgtcatcccgaagcggcgatagtcctgtcgctccgtcgggtgccggacgccgcgcgctacggcgtcgcgctcctcgacggcgtccggatcaccgccttcctcgagcggccgcctgagccaggccccggtctcgtcaacgccggcgtctacctggtgcgccgcgatgcgctgatcggcctgccgccggcctgctcgctggaacgggacgtcctgcctgctctggtcgccgagggccgcgtggtcggcgaggcccacgacggctacttcctcgatatcggcgtgcccgagagctacgcccgggcccaggaagagatcccggcccgtcggagaagaccggccgcgttcctcgatcgcgacggcgttctcaatcacgaccacgggtatgtcggttccgtggaccggttccagtggatggcgggcgcgcgcgacgccgtccgcgcgctgaatgatgccggctacttcgtgttcgtcgtcacgaaccaagcgggggtcgcccgcggcttctacaccgaggctgacgtcgcccgtctgaccgcctggatgcgggacgacctgcgcgaggccggcgcgcatatcgatgatctacgctactgcccctatcatccggacgggacggtcgaggcctacagggcggtccacggatggcggaagcccgagcccggcatgatcctcgatctgacggtctattgggacatcgaccgcgcgcgcagcttcctggtcggcgatcaggagacggatctcgccgccggccgtgctgcggggctcgccgtgcaccacttcaggtcggacgacctgctcgccttcctgcgagaggtcgcactgacggggtag

SEQ ID NO: 5243 - DNA, 1194 bp, Methylobacterium sp.
gtgtccggtccgctcagcggtatccgcgttctcgagctcggtcagctgatcgccgcgcccttcgcgacgcggctgatggccgagttcggcgccgaggtcatcaaggtcgaggccccgggtgagggcgatcccctccggaagtggcgcaagatgcacgagggcacatcgctctggtggtacctgcagtcgcgcaacaagaagtcgatcgctgtcaatctgaagtcgcccgaggggctcgacatcgtcaagcagctcgccgcgagcgccgacgtggtggtcgagaacttccgcccggggggcctggagaagctcggcctcggctgggacgtgctctcggcgctcaacccgaacctcgtgatggtgcggatctccggctacggccagaccggcccgtaccgcgaccggcccggcttcggcgccatcggcgagtcgatgggcggcatccgcttcaccaccggaggcccggaggccccgccggcccgggtcggcgtcagcatcggcgataccctggcctcgctccacggcgtcatcggcgcgctgatggccctgctgcgggtcaagaccgggcagggcgcgggccaggtcatcgacgtctcgctcgtcgagagcgtgttcaacgtcatggagagcctcgtccccgagtacgacctgctgggcgaggtccgcacccgcacaggcggcgcgctgccgggcatcaccccgtcgaacacctacccgacgcgggacggcggctacgtggtcatcgccggcaacagcgatccgatcttccgccgcctgatgacggcgatcggccgtcccgacctcgcggacgacccggcgctgcgcaacaacgagggccgctccaggcaatccgccatgctggacggcaccatcgccgactggtcgaagaccaagaccgtcgaggaggcgctcgccgccctcgacgccgccgacgtgcccgccggccggatctactcggtggccgacatcgtggccgacccgcattatcaggcgcgcgacatgatcctgcaggcggagctgcccggcgggaccgcggtgaagatgcccggcatcgtgccgaagctctccgacacgcccggcgaggtccgctggcaggggccggccctcggcgcccacaccgattccgtgctcgccgagctcggtctcgacccggcgcgcatcgccacgctgcgcgagaagggagccgtggcatga

SEQ ID NO: 5244 - DNA, 1653 bp, Methylobacterium sp.
atgcccaaaggttcagatctcctcgtcgcggccctcgagaacgagggcgtcgaccgcatcttcgggattcccggggaggagaacctcgacgtcgtcgaatctctgcgcaactccaagatcgagctggtcctgacccgccacgagcaggcggcgagcttcatggccgccacccacggccgactcaccggccgccccggcgtctgcctctcgacgctcggcccgggcgccctcaacttctccaccggcgccgcctacgcccatctcggcgccatgccgatgatcatcatcaccggccagaagggcatcctgtcctcgcggcaggccaagttccagatcgtcgacgtgatctcgtcgatgaagccgatcaccaagatggcccggcagatcgtctcggcctcctcgatccccaccatcgtgcgcgacgccttccgggtcgccaccgaggagcggcccggcccggtgctgctggagctgcccgaggacatcgcctcggaagaggccgaggcggatctggtgccctcgcacccgatcgacatcccggtcgcccacccgaccgcgatcgcgcgcgccgcggagatgatcctgaaggccaagcgcccgctgatcatgctgggcgccgccgcgagccgcccccgcgccaccggcgagctcggcggcttcgtgcagcgcaccggcatcccgttcttcaccacccagatgggcaagggcacggtggcgggtgggaccgacctctacatgggcaccgcggcgctctcggagcgcgactacgtccacgaggcgatcgacagggccgacctgatcatcgccatcggccacgacacgatcgagaagccgccgttcttcatgggccaggccgaccagaaggtcgtccacatcagttacatgccggccaacgtcgagcaggtctactatccggatgccgaggtggtcggcgacctcggcccgacgctcaagctcctggccgacaagctcgacggcaagctgcccaacgcgggcgcgctgctgcacctgcgcgagcacatcctcggccatatcgccgaccgggccggcgaggaccgcttcccggtgacgccgcagcgcctcgtgcgcgacgtgcgccgagtgatcccggaggacgggatcgtgtgcctcgacaacggcatgtacaagatctggttcgcccggaactaccgcacctacgtcgccaacacgctgctcctcgacaacgcgctggccacgatgggcgcgggcctgccctcggccatgatggcggcgatgctctatccgaagcggcgcgtgatggcggtctgcggcgacggcgggttcatgatgaacagccaggagatggagaccgccgtccggctgaagctcaacctcgtggtgctggtgctcgacgactcggcctacgggatgatccgctggaagcaggcggtcgacaagttcgccgattacgggatgaccttcagcaacccggacttcgtcctctacgcgaagtcgtacggggcgaccggccaccgggtcgagtcggtcaacgacctcgtgccgacgctggaccgggccttcgcggcgggcggcgtccacctcgtggcggtgccgatcgactactcggagaacacccgcgtgctggtcgacgagctgcgcgccaaggtgaaggatttcgagccggccgagtga

SEQ ID NO: 5245 - DNA, 1317 bp, Methylobacterium sp.
atgaagatcctgatcgccgcgacgccgctcaccgggcacgtgaacccgctcctcgccatcggtcggacggtggcggcgcggggagacgacgtcctcgtgctgaccgatccggccttccggccgaaggtcgaggcggcgggcctgcgcttcacgccctacgcggacaaccacgcggccgagttccgcgagaccgagctgccggccggcccggagcgctaccgccgcgagttcgagcgccggttcgtggatcccatgccggtccaggccgccgccctgcgggcgctgatcgccgccgaggcccccgacgtgatcctggccggcagcatgttcctgggcgcgctgccgctgctcctcgacaccgcgccgcggccgcccatcgtgaccgtcaacgtcagcatcctgttcctcgaccggcccgaccacgcgcccgtgggcctcggcctgccgccggcccgcgaccgggacgacctcgtccgctacgccaccctgaaggccggcatggacgcggccttcgtcaacccggtgcgggcctacacggacgcgaagctcgcggcgctcggcctgccgcccctgccggcgtccctgccccactcgatcgtggtcctgccggacctgttcctgcagccgaccgtgccgggcttcgagtacgattacggcaccctgcctccgggcctgcgcttcatcggcctgctcgagccgccgacgccgcccgcgccgctcccggactggtggcccgacctggaggcggcgaacgcggcgggccagcccgtcgtgctggtcacccagggcacgctggccaacgcggatttcggcgagctggtcgagccgaccctgaccgccctggccgaccgggacgatctgctggtcctggccaccaccggcggccgcccggtggacgcgctgaaggttccggtcccggccaacgcccgggtgtcgtgcttcctgccgttccgcgaattgctgccgcgggtgagcgtgctggtgaccaacggcggctacggcagcgtctcgcaggcgctcgccgccggcgtgccgatcgtctcggccggcctgaccgaggacaaggcggaggtcaacgcgcgcatcggctggtccggcgtcgggatcaatctcaggacgaacgcgccgagttccgaggccgtcggcgccgcggtggcgcgggtgctcggcgagcccagcttccgcgcgcgcgccggggcgctgcgggacgccttcgcggcccgggacgccatggcgtcgatcctgacggctctggacgatctcgcgcgcgccgggaccgatgccgggaccgcgcgccgtctggcgaggtcggcgtga

SEQ ID NO: 5246 - DNA, 978 bp, Methylobacterium sp.
atgcagggatcgacgctgggatcgaaggcaggcccgaaggcaggctcgaagccgggatcgacgccgggctcgaggcgaggaccgggctggctggggcgtctcgccctgggcgccctggcggccctggccaccaccgccgggccggcgcgggcgcaggagaggccggccgcgaaggcgctcccgcccctcgtcttcaccggcatccccgaccaggacgagagccggctggtcgagcgcttcggcaaggtcgccgcctatctggaggccgagctcggcgtgccggtgcgctacatcccggtgaagagctacccggcggcggtcaccgccttcaccaacgggcaggtgcagctcgcgtggttcggcggcttcaccggcgtccaggcgcgcaaggccgtgccgggctcccaggcgatcgcgcagggcgccgaggacgcggcgttcaagacctacgtcatcgccaacgccgccaccgggctgaagccggagaaggatttcccgaaggccgtcgcgggcaggaccttcacgttcggcgcccgcgcctcgacctccgggcggctgatgcccgagtacttcgtccggcaagccttcccggggaagaccccggagcaggtcttcgcccgggtcggcttctcgggcgaccacacccggacgatccagctggtccagtccggcgccttcgcggtcggcgccgtcgactactcggtctgggacctcgactcgaaggccggcaaggtcgacccgaaggccgtctcggtgatctgggagagcccgaccttccccgattaccagtggaccgtgcggggcgacgtggagcagacctacggcgccggcttcaccgacaggctgcaggccgcgctgaccggcatcgccgacccggcgatcctggagccgttcgggcgctcgaagttcatccccgtgaccaacgcggcctacgagcccctcgtcgaggtcggacgctccaccggcctcctggactga

SEQ ID NO: 5247 - DNA, 1734 bp, Methylobacterium sp.
gtgagcgcacccgagatcccattcctcgccggcctcgacgcgccggcggtcgcggccgtgcgggcccggatggtgcctgtggcggtgccgggcggccggaccctgttcgagcagggcgagaccggggacgccctgtacacgctggtctccggcgcggtcggcgtctcggcccgcgaccatgccgggcggccgacgcggatcgcgcgcctgcggccgcctgagaccttcggcgagatggccctgctgtcggacgccccgcgggcggcgaccgtgatggcgctgcgcgattcgcacctcctgcaactcacccgcgacgccttcgaggcggtgatcgccgagcacccgcacacgctcctctacttcgcccggatgctcgccgaccgcctgcgggcgatctacgacggccactccgtccaccacgcgccgcggatcttcacgatcctggccgtgaccgaggggcccgatccggcgcgggtggcgcggcagctcgccaccgccttcgacgccctgctgccggggaagaccggctgcctcaccgactggccggagggcgccgacgaggcgtggttccaggccttcgagggcgcccacgcgcgcacgatcttcggggcgcacgacatcgactgcccctggtgccgccagagccagcggcggggcgaccacgtcctgctcctggccgagcccggcgcgccgccccggccgggcgcggcggcctatctcgaccgggtgcgctccgactggatccgcatggacctcgtcgtgcgccaggaccccgcggcccgccgcccgagggccctgcatccggaggtcgccgcgctgcccgcggcgatgcgcatccaggtccgggacggcgaccggggggatctgcatcgcctcgcgcggctcgccagcgggtcggcgcggggcctcgtcctcggcggcggcggggcgcgggggctcgcccatctcggggtgctcaaggccctcgacgaggtgtcctgcgcgcccgacttcgtgggcgggaccagcatgggcgcgatcatcgcggcgagcctcgccatgggctggagcgtcgcggagatccaggcccagatcgaggcgttcttcgccaccagcaacccgatcaacgactacacgctgccgctgcacgcgctgacccgcggcgccaaggtcgatgccggcctcgcggcgcgctacggcggcgtgcgcatcgaggacctctggctgccgttcttctgcgtctcgtcgaacctgacgaccggcaacaccatggtgcaccggtcgggcgacctgccgaaggccctgcgcgccagcatcgcgatccccggcctcctgccgcccgtgctgtgcgacgatggcgtcctggtcgacggcggcatgatgaacaacctgccggccgacgtcgcggccgggctggagcgcggcccggtcctggccgtcgatgtcgggaccgaccgggcgttccaggacatgccgcggcgcgggtggagcggccggctcatgcgcaagctgatcggctcgccgctggcgatgccgggcctggccccgctgctcctgcgcgccgccaccgtgtcgagcgacgcgcagagcctgatggcggcggcccacgcgaccgccgtgctcaagccccagctctccggcatcgacctccgggcgtggtcgcgcttccgggaatcggcggagctcggctaccgggagacccgcgcgggcatcgcgaccgggaccctcgcgcgctggctcgacccgatgcgctga

SEQ ID NO: 5248 - DNA, 1782 bp, Methylobacterium sp.
atgagcaccgaacgcctcgacatctgcggtcttgagcctgtcccggccgccctgaccccggggcgcccggagatcccgttcctggccgacctcgacggcgaggccgccgacgcggtccgggcgcggatgacctcggtcgccgtcgccgggggacggacgctgttcgaggagggggacgaggccgacgcgctctacacgctggtcagcggcgcggtcggcctctcgacccgcgacccgcgcgacggcggcgtgcgccgcctcatccgcctagccccgcccgacaccgtgggcgagctcgccctgctcaccggcgagccccgctcgatcaccgcgacggccctgcgcgacacgcacctcctgcggctctcccgagacgcgttcgcggacctgatcgctgcccatcccgggacgctgctctacttcgcccggatccttgccgcccggctgcgcatcgcccatacgggcgtgaccctgcgccacgcgccgcggagcttcgccgtcctggcggtgaccgagggccgcacggcgacggccttcggcgagcggctggcgcgggcgctcgatgccgcgctgccggggcggaccggctgcctgtccgaatggccgcccgaggccgacgaggcgtggttccaccgctacgagcaggggcacgaccgaacggtcttcgtcgcccaccagatcgactgcccctggtgccagctctgcctgcgccacgccgaccacgtcctgctgctggccgagcccggcgcgccgccacggccgggcgcggcagcttacctggccgcgatccgctcaccctggatccgcatggacctcgcggtggcgcagaccgccgaggcgcgcctgccgcgccccctgcatccggacgttgccgcgcttcccttctcgctgcggctccaggtccgtgcgaaccacgatggcgacttcgcgcggctcgcccggatcgcgtccggccatgcccgcgccctcgtcctcggcggcggcggggcccgtggcctcgcccatctcggcgtcctgcgggcgctcggcgaggccgggctcgacatcgacctcgtcggcggcaccagcatgggctcgatcctggccgccagcgtcgccctggactggagcctcgacgcgatcgagacccacacggtcgcgtcgttcgtcggacgcaaccccctcgacgactacaccctgccgttccacgccctgacgcgcggagccaaggtggatgcgggactggccgcccggttcggggatgcgcgggtcgaggatctctggcgcccgttcttctgcgtgtcctccaacctcacgaccggcaccgcaatggtccactgggcgggcccgctcgaccgggcgatccgggccagcatcgccattcccggcctgctgcctccggtggcgagcgcggacggcatcctcgtggatggcggcatgatgaacaatctgcccgccgacgtgatggccgatcttgaccgcgggccggtcctcgccgtggatgtcggcagcgacgccgccttccaggtcatgccgcggcaaggccggggcgcgcaggcgttccggcacgtcctcggcatctcggaacagcttcccggcatcgcgcacctgctcctgcgctcggccatggtgtcgagcgacgcccagaccatggcggccgtcacccgcgccgccgtcctgctcaagcccgctttggccggcgtcgaccttcgggcttggtcgagcttcgagacgacggcagagctcggctatcgctgcgcccgggaagcgctggactcgggccgcctgcgagcctggacatga

SEQ ID NO: 5249 - DNA, 1860 bp, Methylobacterium sp.
gtgaagcccgtgacggacccgatcctctcggtttccgacctcaccgtctccttccgctcggacgggcgctggcgcgaggtcgtgcacggcgtctcgttcgacgtgggcccgcgcgagaccgtggcgctcgtcggcgaatccggctccggcaagagcgtcagcgccctgtcgatcctgcgcctcctgccgcgggacgcgagccgcatcggcgggcgcgtgcgcttcgagggccgcgagctgctcgccgcccccgaggccgagatgcgccgggtgcgcggcgattccatcgccatgatcttccaggagccgatgacctccctgaacccagtcctgaccatcggcttccagatcgccgaggcgctgatccggcaccggggcctgtcgcggtccgccgccgaggcggaggcgctgcggctcctcgacaaggtccggatcccggccgcccggtcgcgcctgcacgagtacccgcaccgcttctccggcggcatgcgccagcgggtgatgatcgccatggcgctcgcctgccggccgaagctcctcatcgccgacgagccgaccacggcgctcgacgtcacgatccaggcccagatcctcgacctcatcaagagcctgcaggacgaggagggcatgtcggtcctcttcatcacccacgacatgggcgtggtcgccgagatcgccgaccgcaccgtggtgatgtaccggggccgcgccgtggaggccggcccgaccgcgcggattttttccgaacccaccgagccttatacgcgggcgctgctggccgcggtcccgcgcctcgggaccatggcgggccgggcccgcccgatgcgcttcccggtggtcgaccgggcgaccggcctcgcggcaccgacgcccgagacccccgacaccgtcagggccgccgagcgcccggtgctggaggtgcgcgacctgaccacccggttcgacatccgctccgggctcctcggccgcgtgaccggccgcgtccacgcggtggagcgggtctcgttcagcctcgcggccggcgagaccctggcgctcgtcggcgaatccggctgcggcaagtccaccaccgggcgctcgatcctgcgcctcgtcgagccgctctcgggctcggtcctgctcgacggcgaggacatcacgggcctcgatgccggcaccctccgcgcccgccgccagcgcatgcagatgatcttccaggacccgttcgccagcctcgacccgcgcctgagcgtcggcgcggcggtggcggagccgctgctgatcaaccgcctcgccgcgccccgcgaggcccgccggcgcgcggaggacctgctggcgcgggtcgggctcccgcccgagaccgccgggcgcttcccgcatgagttctccggcggccagcgccagcgcatctgcatcgcccgggcgctcgccctgaacccccgcctgatcgtcgccgacgaggcggtctcggcgctcgacgtctcggtgaaggcgcaggtcgtgaacctgatgctcgacctgcaggcggaactcggcctcgcctacctgttcatctcgcacgacatggcagtggtcgagcgggtcagccaccgggtggcggtgatgtatctcggcgagatcgtggagatcggtccccgggccgcgatcttcggagacccgcagcacccctacacgaagaagctgctggccgccgtgccggtcccggatccggcccggcggggcgagcggcacgcgctgccggacgacgagatccgcagtccgatccggacccccgactacgtgccgccggagcggctctaccgggaagtcgcgcccggccacgtcgtgcaggactggggcaccgagtgggacgcgggtgcccgccagggcgcggccgcctga

SEQ ID NO: 5250 - DNA, 768 bp, Methylobacterium sp.
atggaacggtcaggcgaagggcaggcaggttcggggcgcgcagactcgggacgcgccggcgcggtcggcttccgcccgctctaccggcaggtctacgacacgctgctgaagcgcctggccgacgcggtctggcagcccggccagatcctgccgagcgaggggcagctcgccgccgagctgggcgtcagccaggggacggtgcgcaaggccctcgacgcgctcaccgccgacagcctgctggtgcgccgccagggccgcgggacgttcgtggccgaccacgacgacaagcagagcgtcttccgcttcctgaagctgcggccggacggcgacggcaccggcatgcccacgagccgggtcacggggatcgcggaggcggccgccagcgccgacgagcgcgggcggctcgacctcgtgcggtccgcccgcgtggtccggatcgagcgcgtgcgcgccgtcgacgccaagctgtgcgtggtcgagacgatcagcgtgcccgccggcctgttcccgggcatcgcccagatcgagctgcccaacaccctctacagcctctacgccacccgctacggcatcacgatcgccaccgccaacgagcgcctgaaggccgtggcgatcgggccccgcgaggcggagctgctccaggtgcccgccggaacgccctccctcgagatcgaccgcgtcgccatcgacctcgaggagcggccggtcgagtggcgcctctcgacctgcctgacgcaggacatccactacctctcggtccttcgctga

SEQ ID NO: 5251 - DNA, 378 bp, Methylobacterium sp.
atgtccacccgcccgctcctcccggcctcgtccggccgcgcctccgacgccctcgaggaggcccagttccgcgcccgcatggcgcgcgtcggcccggacggcgcgcaccgcaccccgcgccggaaccgggcgcccgagcggcggcgcggcttccggctcggctggaagggttggctcgtcgtcgactgcctggtcgtgctgctggtggtggcgggggtggtggcgtggccgccggtccagtcttgccgcagtcaggaccagacggtcgggttctacgccggcgattccgtcggaaaatgcatccggcgcggcatcgccgaccgcctcgacaccgccgaccagcgcctcaagagcctgatccgccgctcgggccattga

SEQ ID NO: 5252 - DNA, 3084 bp, Methylobacterium sp.
atgatcccggtcctgacccgccacaccgaggccgtaccgctctacgccgcggcctgcgccgagctgcgcctgcgcggcttcgagggcgacctgacgctctcggacgccgaccgaacggtcttctccaccgacaactcgatctaccaggtggcaccgggggccgtggcctttccgcgcacccgcgacgacctcgtgcgcgttgccaagctcctcgcggatccgcgcttcgccgagatcgtgatccggccccggggcggggcgaccggaaccaacggccagtcgctgggccacggcctcgtcgtcgacacctcgcggcacatgaaccgcatcctggagatcgacgtcgcgaaccgcgtcgtccgggtcgagccgggggtggtgaaggaccagctcaaccgggaactcgccaagcacggcctgttcttcgcgccggaactctccacgtcgaaccgcgccacgatcggcgggatgatctcgaccgatgcctgcgggcagggctcgtgcctctacggcaagacccgggaccacgtcctcgcgctgacctgcgtgctcaccgacggcacggtctggaccgccgagccgctggacccggccgggctcgccgccgccaagggccgcgacgaccgcgtcggcgccatccaccgcaccgtcgacgccgtcgtcaccgagaacgcggcgctgatcgccgagcgcttcccgaagctcaaccgctgcctcacgggctacgatctcgcgcatctgcgcgacgcgggcggccggttcgacctcaagagcgtgatctgcggctcggaaggcacgctggcgctgatcgccgaggcggggctcaacgtgctgccgatcccgaaggcggcggtgctggtcgctctctcgtacatcgacttcgacgcggcgctgcgggacgcgcaggcgctgctgccgttcggcgccgcctcggtggagacgatcgattccacggtcctggcgctggcccgcaaggatccgatctgggccgaggtgcgggccttcttccccgacgatccggccgggcggccggtggacggcatcaatctcgtggagttcgtcggcgacgacgccgcgaccgtggaggcggccctcgcgcggctcaccgggatgctggaggccgagcgcggcaccgacacgaagcgcctcggcttcaccatcgcccggggcgacgcgatcgagcggctctggaccatgcgcaagaaggcggtgggcctgctgggcgccgccaagggcgacgcgcgcccgatcccgttcgtggaggacacggcggtcccgccggagcggctcgccgactacatcgcggagttccgcgcgctcctcgacggcaaggggctgcgctacggcatgttcggccacgtcgatgccggcgtgctgcacgtgcggccggccatcgacctcaaggacccggcgcagaacggcctgatccgcgaggtcacggagggggtggtcgcgctcaccgccaagtacggcggcctgctctggggcgagcacggcaagggcttccggtcggaattcgtgccggcgacgttcgggccgctgatgcccgcgctggaggcggtcaagcgcgccttcgacccggacgaccggatgaacccgggcaagatcgcctccgccaggggcgcgggcctgacccggatcgacggcgtcccgcgccggggcgagcgggaccgcgccatcccggcgccggtccgggaggatttcgacgaagcgctccactgcaacggcaacggcgcctgcttcagcttcgacgcggacgaggccatgtgcccgtcctggaaggcgacacgggagcggcgccactcgcccaagggccgcgcctcgctgatgcgcgagtggctgcgccgcgcggcggaggccggggtcgacccggccgccgagctggcgcggcagcgcgccgggtggctctccgacgtggcggcgaccctgcggagccgcctccgcggccggtccgaggccgacgacttctcccacgccgtcaaggaggcgatggacggctgcctcgcctgcaagtcctgcacggggtcctgcccgatcaaggtcgacgtgccgaccttccgggcgaagttcctggcgctctaccacacgcgctacgcgcggccgctgaaggaccatctcgtggcggcgctggagccgctgctgccgctggcggcgcgggcgccgcgcctcttcaacgcggtcctggccaacccgctggcccggctgatcctggcccgggccgggctggtggcgatcccggccctgtcgcccgtcgcgctcgcggcgcaactggcggaacgcggcgtcgccgtcgcgaccccggacgccctggcccggctggacccgcaggagcgcgcgcggtccgtgctggtggtccaggacgccttcaccagccacttcgacgcggaagtcgtgaccgacagctgcgacctcctcgccgccctcggcttccggccctggctggtgccctaccggccgaacggcaagccgctgcacgtgcacggtttcctggcgcggttcgccgccgtcgcccggtcgaacgccgcgatgctgcgcgacctcgccgggcacggcgtgcccctggtcgggatcgacccgtcgatgacgctgacctaccggtccgagtacgcgcaggcgctgggcggcgatctcccgaaggtccacctcctgcaggaatggctcgccgcccggctcgaccggatcgcgccggggcagggcgggcgcacgatgcggctgctgccccactgcaccgagcgcaccaacgcgccgggcgcggtgcgggactggcaggccgtgttcgcccatctcggcctgcggctcgaggtgctggccgccggctgctgcggcatggcggggacctacgggcacgaggcgcgccaccgcgccacctccgaggcgatctacggcctgagctgggcccgccacgtggccgaggcccccggctgcaccctgctggcggacggttattcctgccggtcccaggccaagctggtcgacggcgtgcggctgcgccacccggcccaggcgctgctggagcatgtccgcgcgtctgccgcgggcgcggcgcccttccatcccgagcgcgccgcggcggtggcgccgtga

SEQ ID NO: 5253 - DNA, 1146 bp, Methylobacterium sp.
atgagagtcgcgatcgtccattactggctcatcgggatgcgcggcggcgagaaggtcgtcgaggcgctctgcgacctctatccggaagccgacatcttcacgcacgcctacgccccgcaatccatgtcgccgaccatcagggcgcaccgggtcaggacctcgttcatcggccggttgccgttcgcgaccagccgatacaaatcctatctgccgctgatgccgatggccctcgagcagctcgatctgcggggatacgatctgatcatcagcagcgaatcgggtccggcgaaggggatcatcccaccatccgacgcgctccatatctgttactgtcactcaccgatgcggtacgtctggaacatgtaccacgattatcgcgagcggacggggctgctcacgcgcctgctgatgccgccggtggcccactacgtgcgcaactgggacgcggtctcggcgggccgggtgcacgagttcatcgccaactcggacacggtcgcacgacgcatcgagacctactaccggcgccaagccaaggtcatccacccgcccgtggatacggcggccttcgagatcgctccggatggccagcggggtgactaccatctgatggtcggcgaaatggtccgctacaagcggcccgaactggcgatccaggccttcaaccggttggagcagccgctcgtggtgatcggcggcggcgagatgctgcgtgagctgcgcagcatggccggtccgcacatcaagatcctcggtccgcagcccttcgaggtcttgaagcaccactacgcacggtgccaagccctgatcttccccggagaagaggatttcggcatcgtcccggtcgaggccatggcgagcggacggccggtcgtcgcgttcggcaagggcggtgtcaccgagacggtcatcgacggcgtgaccggcaccttcttccacgagcaatccgtcgacgcgctgatcgatgccgtccagcgctgccgggcgatcggggtggagccagagcgcctcgtccgccgcgcagccgacttcggtgtcggccgcttcgcggacgagatcagctgtttcgtcgacggggtcctcgcgcgcgagcgcttggcggcccctcgtcccccgcgtgagccgagccgcgcctatctggtccagtga

SEQ ID NO: 5254 - DNA, 453 bp, Methylobacterium sp.
atgcctgatctgcccgcccgcttcgccgagctcatcctggcgttcgcgccactgttcgtccaccgctcgtggcgacacgcgcaactgctgctgatcggtgcgatcctgaccccggggcggcgcacggtggcgagtgccctgcgcatcatgggtcgcgcgcaggatcggcggttcgtggacgttcaccgcatcctcaaccgcgccgcgtggagcccgcgtgctggcggccgtatcctgctcgggctgctgatcgccgctttcgctccacgcggtcccgtcgtcttggctctcgacgacacgatcgagcgccgccgcggcaagcggatcgcggccaagggcatctaccgcgatccggttcgctcctccgacagccatttcgtcaaggcgagcggcctgcgttggatgagcctaatggtgctcgccccgatcccctgggcggggcgcgtctgggcg

SEQ ID NO: 5255 - DNA, 921 bp, Methylobacterium sp.
tggatgagcctaatggtgctcgccccgatcccctgggcggggcgcgtctgggcgctgccgttcctgaccgcgttggtgccgtccgagcgcgcctgtcgcgaacgcggccgtcggcataagcctctgctcgatgtcggacgccaagtcgctctccaggctcgccgctggctgcgcgcacgcgacctcgtggtggtgggcgacagcggcttctcggccttgctgttcctcgacgcgatgcgccgcgcccgcatcacgacgatcacccgcctgcggctggatgcctctctctacgagccggccccaccgcggccgcccggcacgattggacgcccgcggaccaaaggcgcgcggctgccgacgctcgccgcgatcctcgcggccaaggacacgcgctggcacgcggtcgtggtgctcggctggtacgaggcgggcgagcgcacccttgagatcgcctccgggaccgcggtgtggcggcacggcggtctgccggtcgtgccgatccgatgggtgctggtgcgcgatccagagagccgttttgcaccgcaggccctgctctgcaccgaaccgatgcgcgagcccgcgcagatcgtgggatggttcgtgcgtcgctggaccgttgaggtcaccttccaggaagcgcgcgcccatctcagtgtcgagacgcagcggcagtggtcggacaaggccatcgcccgcaccacgccctgcctgctcgccctgttctcaatcgtcacgctgctggctgcacggctcccagtccgccaacggcaacggatcgcggccgccgcgtggtaccccaaaccgcgcccgaccttcgccgatgctctggccgccgcacgctatgcgatctggcgggagcggactttggcaatatcaccgcgccgacgcgcccgaacaaaaccccgcttccgtttgccagcg

SEQ ID NO: 5256 - DNA, 831 bp, Methylobacterium sp.
gtgctcgccaccgcgacgccgggcggcggcttcccggccttcggggaggccttcgccggcgcggtcgcggccgtggacccggccctgaccgtcgggcggcgcgccaccggcgggtcgtccgagaatgtcggcctcctccgcgccggccgcgtcgatctcggcctcgtgcagggcgagtacgcctatcctgccctcgcagagggcgccggcctgaccgtcctggcgccgatgtacccgacgccgggcctgttcgtagttccggctggcagcgcgatccgctccgtggcggatctgcgcgggcgcagggtcgtgctcggcacgcacaagtccgggctgaccgtcatgggccgcagcgtcctcggcgcctcgggcctcgatcccgagcgcgacatcagcccgatcctgctcgaccgggccggcgacggcccggccctggtgcgggagggccgcgccgacgcgctctggggcggcggcctcgactggccgggcttccgcgccctggccgcggatccgggcggggcccgcttcttcggaccgtccgaggccggtatcgcgcgcctcgcgcagcccggcgcggcgacgcggcgcctcacggttccggccggcagcttcgccgggcaggcggagccgatcgcgacggtgggatcctggagcttcgtgatcgcgcggcccggcctcgacgaggaggccgcctaccggatcgttcgggcgctggcgcggacggatcttaccgaagcgcagccgaaaaacctcgtcggcctcgtcccggcggaccgggtcaatcccgggaccgcccgcgtcctccgcgaagccggcgtcacgctgcgctga

SEQ ID NO: 5257 - DNA, 375 bp, Methylobacterium sp.
atgaccggcctcgctgactggatcgccaggttctcggagatggatccggagcgcgcgccgcctgtccccgcgatctcatacgcgacttggccgaccgttcacgccaacgcgctcgcgtttcttcgagaacgcggcgacgacgcggtcgcggccgggttcacctgcctcgaattgctgggggtgcattggggcgccgggttgatgcggccggacgccaccggcatcctgatgatgacccgccccgtgacgatcagctcggttgcccctaagctggcggtattctcgaacggccttgtctggcgcggcaactttaacgcgcgggagagcgtgccgatctgggagttctcagcgtcagccgggccgccgaggaagtag

SEQ ID NO: 5258 - DNA, 939 bp, Methylobacterium sp.
gtgacagccggtaccgcggcgcccgctcccggacctgaggcgacgccgcggctcgacgacctgagccgcgccgacgtgccgttccggaccggacatttccaggcctacgcgccccacgacttccaccgcatcgcctacgtggaatggggtgacccggacagtccgcacgtcgtcgtctgcgtccacggtctcagccgccagggccgcgatttcgacgccctcggctatcgcctcgcgaagctcgggtaccgggtgatctgcccggatctgccggggcgcggcctcagcggatggctgaaggacccggaactctacggcctgccgcaatacgccgccgacatggccgcgctcatcgctcatctgcgggtccccgggaagatcgactgggtgggcacgtccctcggcggcctgaccggcatggtcctggccgcggccgcccgctcgccgatccgccggatggtgatcaacgatatcggcccgttcctgccctgggcgcccatccgcgagatcgggtcgcgcctgcgcgacgcgcctcggctgcaccataacctcgcctcgggcgaatcgcgtctgcgcacggtgctgggcgcgttcgggcccctcaccgacgagcagtggcgccacatcgcgaagcacagcttctttcaagagctcaacggcggctggcggccccactacgatcccggcatcggcgacgcgttccgtccgggccgcgtctacagcgtgagcatgtggcgcgactgggacgcgatcacctgtccggtcctgctgctccgcggtgagcactcggaactgctcctcgcctcgacggccgacgagatgacgcgccgggggccgccgacgcgccgcgtcgagattcccgattgcggacacgcacccgcgctgctcgacgacgagcagttgcgaatcgtcaccgattggctcggcccggcggcgtga

SEQ ID NO: 5259 - DNA, 816 bp, Methylobacterium sp.
ttgtccagccccgcgccttacgcaacctggcggtgtggtctcggtgccctcctggccctgtgcctcgtcctgtcggcggagccggcaacggcccgcctcgtccaggccgaccttgcccgcgtcgcggtcgcgccgcccccgggtgcccgggccccgctcgacctcgccgccaccgacgcgggtaccgaccggccgaccaccctcgggcaggccctcggcggccgcgcggcccttctgctgccggtggattacacctgcgggaatgtctgcgaccccatgctgtccctgtcggtggacgcgctggcggccaccggcctgccgatcgacgactacgcccttgtgctggtcgggatcgatccccgcgacgacgccgcggccgcgcggcgcatgctggcggagacgctcggggatcgggcgggatccgtccggccccgggcgctcatcgtgtcggacgccgcgctcgcgcgcctcaccggcgcgctgggctatgaagctgtctacgatgccgggaccgacagcttcgcgcatcccgcagcggcgcttctcctcaccgccgacggccgggtggcccgtgtgctgtcgcccctggcgctgaccgggcgcgacctgcgcctcgccctgacggaagccggcgagggccgggtcggcagcatcgccgaccggctcaccctgctatgctacggctacgatgccgcgcgcggcgtctacacgcccctcatccagcggatcctgacggtggccgggatcgtcacgatcctggcgatcgcccttctcgtcgcgggcctgacgcgcctcgcgcaccggcgccggacctga

SEQ ID NO: 5260 - DNA, 144 bp, Methylobacterium sp.
atgcgcacgaagatcctgctcatcctcaccctcctcgtctacgtcaccaccggccgcgcccccggcatccgggagccgcgcaacccggacgcggagcacggcggcgggcgcctcgtggtcgcgaccaagcgggcctggatctga

SEQ ID NO: 5261 - DNA, 1785 bp, Methylobacterium sp.
atgccggctccggcgctacccctctcccgaccgcgcgggcggatcgaggcccgcacgctgctgtggatcctcgccgccctctgcatcgcgacgatgaacgcgccaaacgcggtttgggaaaccgtccagcacctgcgcgtcccggataccgacgacgcgatgcgccttgtggaagtgcgcgacctggtggccggccagggctggtacgacaacgtccagtaccggttcctgcccccgggcggcgtgccgagccactggtcgcgcctcgtcgacgcgccgatcgccggcctgatcctggcgctcacgcccctgacgggccccgcgctcgccgagggcctgacggcggcgctctggcccgtgctgctcttcgggctctacggctggctcctgtatcgcggcgtccggcacagcttcggcagccgtgccgcgctcctggccctgatcgcggccacgcagaccttcggtgtgacgatccagttccaggctgggcgggtggaccaccacaatctgcagatcctctcgatcctcggtctcgccttctgcatgatccgcgggggcctgcgacccggcctgatcggcgggatcctggcggccgtgtcgctggcgatcgggctcgagggcctgcccttcgtcgcgctggcggccctctttctcacgggcgactggtgcctgcgcggacggcccgcgctggcgtcgctcgcgggcttcggcctgggtctcggcctcgccgcccccgcgctgttcgccgtccagacggccccctcgctctggggtgtctcctactgcgacgcgctctcgccaccctggctctggctcaccctgggcggcctcgccctcggcgcgatcgccgccgccgcgggcgagcgcctcgcgacggttccggcgcgcctcgccctggcgggcgtctcgggcagcgtcctgctcgccgggttcgccgccgccttcccatcctgcctcggcggcccgttccccgacatgccgccgctggtgcggatccactggctgctcacggtcaacgagatggcgccgctggcgaagttcgtggcccgcggccagtgggaggcgctggtcttctacccggtcgtgatcctcgcgagcctcacggccaccgggatggcgtggcgcggtcccgaacgccgggcctggtcggtggccgcgctgttcctttggccggggctgatcctcggcgtcgcgcagttccgcggactctacatcgtgtccggcttcgtgccgctggtggcgggtgtggtcctcgaccgcgcgctggcgcgggccgccctgccggccggggcgcggcgctggcccgtcgcgctcctcggcgccgcgttggtcagcagcctctggatgatcccggcgctcctggcggagaccgttgcgcccggcctgcgcaccgcgcccgatgcggccgagaccaatgcctgcctcgacgatgccgcggtccgccccctgacgcacctcccggaaggcaccgtgctcgccccgatcttcatggggccgtcgatcctcctccgtacccggcacaggatcgtcgccgcgccctatcaccgggccattcccggcctcacggcggcgatcgaggggctgggcggcaccgaggccgacctcgaccgggtgctgacgacgttcgacgtccgctacctcgtcgcctgcccggcccggccggccgagaatctccaggcggagacggcgttcgccacgcggctcgccgcgggcgcggcccggagcgcgcgcctcgtgccgctggacgtgcccggtcccctcaaggtctggcgcgtcgcgccctga

SEQ ID NO: 5262 - DNA, 1503 bp, Methylobacterium sp.
atgagccaccacaccgagacgctggtgatcggcgccgggcccgcgggtctgactgccgcctacctgctgtcgaagaagggccgctccgtcaccgtcctagagcgggatccggcgcaggtcggcgggatctcgcgcaccgtctcgcacaacggctacctgttcgatatcggcggccaccggtttttctcgaagtcccaggccgtggtcgatctctgggacgagatcctccccgacgacttcatcgagcgcccgcgcctgtcgcggatctactatcgcgggcgctactacgcctacccgctcaaggccttcgaggctctgcgcaacctcgggatcctcaccagcgcggcctgcgtcgcctcctacctctacgcccgcctgcggccggtgccggagcccaagaccttccacgcctgggtccgcaaccagttcggcgagcgcctgttctcgatcttcttcaagacctacaccgagaaggtgtggggcatgtcgtgcgacgccatctcggccgactgggcggcgcagcgcatcaaggggctcgacctcggcgcggcgatccgcgacggcatcaagcggtcgctgggcctgcgcaaggcgccgaaggccggcggtccggtcatcaagacgctgatcgagtcgttccgctatcctcgccgcggccccggcatgatgtgggaggcggcggccgccaagatccgcgcccagggcggccagctgaagctcgaccgcggcgttgattccctcagctacgatgccggtaccggtatctggacggtggcggcccgccgctcggacggcagccgcgagaccttcacggcccgcaacgtcgtctcgtccgcgccggtccgcgagctcgtcgacgccatccggccgcggccgctcagcaccttcaacgcccgggcgctgaagtaccgcgacttcctgacggtggcgctcatcgccaagtcggacaagaacttcccggacaactggatctacatccacgacccgtcggtgaaggtcggccgggtgcagaatttccgctcttggtcgcccgagatggtgccggacgcggaccacacctgcctgggcctggagtatttctgcttcgagggcgacggcctctggaacgccgacgattcggaactcgtggagctcgccaagcgcgagatcggtcagatcggcctgatcgacccggccgacgtcgtcgatgcctgcgtggtccgccagccgaaggcctacccggtctacgacgaggagtatgccggccacgtcgtcaccgtgcggcgggagttggagcgggatttcccgagcctgcacctcgtgggccgcaacggcatgcacaagtacaacaaccaggaccacgcgatgatgaccgcgatgctgaccgtggagaacatcctctgcggccggcgccggcacgacgtctggcgggtgaacgaggacgccgagtataccgagtccggcgtgtcgggagccgacgtcgccctgggcagcgagcgccttgtcccgcgcaaggtggcctga

SEQ ID NO: 5263 - DNA, 957 bp, Methylobacterium sp.
atgcgcaccggcctgatcctcgacgattaccagcaggcggccctcgcgctcgcggactgggcgcgcctctccgaccgcgtctcggtctccgcgatcagccagcacatcccgaatccggacgacctcgttgcgcggatcgcgcaggccgagatcctcgtgatcatgcgggagcggacgccgttcccggcggctctgctggaaaggctgccgcggctggaactcctcgtcaccagcggcatgcgcaacctcgccatcgacctcgcggcggccagggcgcgcaacgtcgtggtctgcggcaccgattcgagcccgacgccgccgacggagttgacctgggcgctgatcctcggactggcccgccacgtggcgccggagagcctgaccctgcgcgcgggcggcccctggcagagcacgatcggcaccgacctcgcgggcgcgacgctcggcgttctcggcctcgggaagatcgggacgcgggtggccgagatcggtcgcgccttcggcatgcgggtgatcgcctggagtccgaacctcgacgatggccgtgccgcagccgccggggtggagcgggcggcctcgaaggaagccctgctggaggcgagcgacgtcgtcacgatccacctcgtgctgggcgaccggacccgcggcctcctgggcgcggccgagctgcgccgcatgcgccgcgacgcctttctcgtgaacacctcgcgcgcgccgatcgtcgatcaggccgcgctggtccaggcgctggaggagggctggatcgccggcgcgggcctcgacgtgttcgagaccgaaccgctcccggccgacagcccgttccggcgcctgccgaacgtgctggcgctgccgcatctcggctacgtgtcgcgcaacaactaccggaccttcttcacccaggcggtggaggacatcgaggcgtggctcgccggcgcgccgatccggcagctcggctga

SEQ ID NO: 5264 - DNA, 351 bp, Methylobacterium sp.
atgatcatctggtccggctggggaatgctgacggcgctgatcgcggcggcgggcctgatcggcagcgtgctgctcgatccggcgctcgcccgcctgggcgtcccgacgcccaccggcgtcatcctggtgtgggtggtggcggccggcttcaactggtggctcggcacccggctgaacggccggccgggccgcgaactgctcgacccgcgcacggggcagacggtgatcctgcgcccgcgccacaccctgttctggatcccgatgcagtactactccgtgctcatggttctgctcggtctgctcgccgtgatcggcgcgatgcacgcgggctcgccgggccggcctgtctga

SEQ ID NO: 5265 - DNA, 1161 bp, Methylobacterium sp.
gtgccggagcgccgggcccccctgccgctcctcgtcgccgtgaccatgaccggtacggtggcgctgcacatcttcgtgccggcgctggcggcggcggccgtcgacctcggcaccaacgccgccggcgcccagctgacgatcaccgtctacctgatcgggctcgcgggcggtcagctcctctacgggccgctctcggaccggtacgggcggcgcccgatcctgatcggcggactcggcctctacctcgccggtctgctgctcgcgatccccgcgccgaacatcggcgtcctgctcgtcgcccgcgtcctgcagtcgctcggcgcctgcggctcgctggtgatcggccgggcgatggtccgcgacgtctcgacccgcgaggacgccgcccggaaactcgcgatcctcaccaccgcgatgacgctgacgcccgcgctggccccggcgatcggcggcgtggtgaacgaggccttcggctggcgcgcggtgttcgtggtgctggccggcctcgtcgctgtgctgggcgcgctcgtggtcttcaccctgcccgagaccaaccgccacaaggtggcgctgccgggcttcgtcgccgtcctgtccggctacctgcgcctggtgcgggtcccggtgttccgggcctacctggtggcgggggcctgcggcggcacaagcctctacgccttcctggcggtggcgccgttcctcctcgtggaccggctcgggcgttcctcgcaggaggtgggcttcgactgcctgatcgtcgtgttcggcatggtcggcggcgccgtcctggcgagccggctcgccgcccgggtgccgatccgcaaggcggcgcggagcggcaacctcctctgcatcggggccgcgctgtcgctgctgatcgtggaccgcaccggcatgctcggcgtggtcagcctgatcgtgccgctcttcgtctacgcggtgggcgtcggtctgctcagccccaacgcggtggcggggctgatgaacgtcgacccgcacgcggccgggtcggcctccagcctctacggcttcacccagatgacgttcggggcgctgttcacggccgccgcctccgcgtggccggcgacctcggcgacgccggtggcgctggcgctgctcgcggccgggctgatcgccgcgctggcgctccggcgggcctga

SEQ ID NO: 5266 - DNA, 1149 bp, Methylobacterium sp.
atggaagcctataccgagatccgcgaggccgtcgccaagctctgcgccggcttcccgggaccgtactggcggggcctcgaccgggagatggcctacccgaccgagttcgtgaacgcgctgaccgagagcggctacctgtcggtgctgatccccgaggcgtacggcggctccggcctgccgctctccgccgccgccgcgatcctcgaggaggtgcagcgggcgggttgcaacggcggcgcctgccacgcgcagatgtacacgatgggcacgctgctgcggcacggctcggaggcgcagaaggccgagtacctgccggccatcgcggagggccgcctgcggctccaggccttcggcgtgaccgagcccacctccggcaccgacacgggcagcctgaagacgacggcgcgcctggagggcgaccactacgtcgtcaacggccagaagatctggaccagccgcgccgagcactcggacctgatgctgctcctcgcccgcaccacgccgagggccgagggcatgaagcgcacggacggactgtcggtgctcctcgtcgacatgcgcgcggcgaagggcaacggcctgacgatccggccgatccggaccatgatgaaccacgccacaacggaggtgttcttcgacaatctccgcgtgccggcgcagaatctcatcggcgaggagggcaggggcttccgctacatcctatccggcatgaacgccgagcggatcctgatcgccgccgagtgcgtcggcgacgccaagtggttcatcgacaaggcccgggcctatgccggcgagcggtccgtgttcggccggccgatcggcgccaaccagggcgtccagttccccatcgcgaaggcctacgcgaacatgcgcgcggccgagctcatggtccgcgaggcgctgaccctgtacgagggcggggccaatcccggggccgaggccaacatggccaagatgctcgccgccgacgcgtccttcgaggcggcgaacgcctgcatccagacccatggcggcttcggattcgccgaggagtacgacgtggagcgcaagttccgcgagacgcgcctctatcaggtcgcgccgatctccacgaacctgatcctcgcttacctgtccgagcacgtcctcggcctgccgcgctcgtactga

SEQ ID NO: 5267 - DNA, 1419 bp, Methylobacterium sp.
atgactgacctcctgcgctcgaccaccctgcgatgggcggtggggatcgccctgtggtcggtgcttctcgccctgacgatgttcgccttcatctactggcagacggcagcctacctgcgggaggaactcgccgagaccctgcggctggaagtccgcgcggccgcggccgaccccgccgccacggcgttgcgggtcgacacctggaccgccatggacccgcatgcccggcactatggcggcgacttcgctccggacggcgtccggcgcgcgggtaacctcgatgcgatgccgaaggggctgccgcgggacggggatgcctaccgggtgaacgccacggtggaggtcgggggccgcagccttgccgacgagatctgggccgcggccctggcgctgcccggcggcggcacggtggtgatcgcccacgacaccgacgacatcgaccgggtgcgggtcacgacgctgcgggcgctcggcctcgggctactgccgatgctggcgctctccgggatcggcggcctcgtcctcgcccgccggggccgcaggcggttcgccgccaccgaggtggcgctcgccgaggtgatgcgcggcaacctcggcaagcgcctgccggtcggaggtcggggcgatgagttcgaccgccttgccgccaacgtgaaccgcatgctcgacgagatcgagcaactgatgggcgaagtccgcagcgtcggcgatgccgtcgcccacgacctgcggacgccgttgacccgcctgcgggcccggctggaacgcagccgggcgcaggcgcgaacggtggcggaattgcacgaggcgatcgatcagggcctcgcctggatcgaccagacactcgcgatggtgacggccgtgcttcggatcggcgcgatggaggagggccgccggaccgccttcgcgccggtcgacctcggggaggtcgccgctgcggcggtcgacttcttcgagcccgaggctgaagagaggggcgtccggctcgtcctgtcggcggtggggcctttcaccgtccacggcgaccgggacctctgcttcgaggccctgtcgaacctcatcgacaacgccgtgaagttcgcgccccccagagggaccgtccgggtcgaggtcgcctggaccggccaagcgatcgaggtggccgtggaagataccggcccaggcctgccggcgagcgagcacgagaaggtcttccgccgcttctaccgcgccgagatgtcccgccagacccccggcaacggccttggcctcagcctggtcgccgccatcgccaagattcacgccgcaagcgtgagtgttcgcacgtcggaaaagggtggttgccgtttcgcgatgacgttcccgaatttgaccatcgaagaccgcacgtcttctagttattggatggattcgagaagatataagattggcaatacttga

SEQ ID NO: 5268 - DNA, 1146 bp, Methylobacterium sp.
atgagtttcgggctcgacgaggaccggaccgcgatccgcgagatggccctcggcttcgcggccgagcatatcgcgccgcacgccctcgactgggaccgcgacaagaccttcccggtcgagaccctgcgggaagcggccgccctcggcatggcgggcatctacgtccgcgaggatgtcggcgggtcgggcctgtcgcgcctcgacgcgacgctgatcttcgaggcgctcagcaccggctgcccgaccgtggcggcgttcctgtcgatccacaacatgtgcgcctggatgatcgacgcctacggcgacgacgatcagcgccgccgctggctgccgtcgctcatgggcatggagcggatcgccagctactgcctcaccgagccgggctcgggctccgatgcggcggcgctccgcacccgcgccgagcgggacggtgaccattacgtgctctccggcgagaagcagttcatctccggcgccggcgccagcgacctctacgtctgcatggtccgcaccggcgaggccggcccggcggggatctccgcgatcgtggtcgagaagggcacgcccggcctgtccttcggggccgacgagcgcaagatgggctggaacgcccagccgacccgcgcggtgcgcttcgacggcgtccgcgtgccggtgggcaaccgcctcggcgccgagggccagggcttcaggatcgccatgagcggcctcgacggggggcggctcaacatcgcggcctgctcgctcggcggcgcgcaggcggccctcgacaaggcgctagcctacatgggcgaccgccgcgccttcggggcgaagctcaccgacttccaggcgctgcagttccgcctcgccgacatggcgacgagcctggaggtgtcccgcaccttcctgcgccacgcggccgccgcgctcgacgccaaggacccggccgcgacccagctctgcgcgatggccaagcgccacgtcaccgacgcggccttcgaggtcgccaaccaggcgctgcagctgcacggcggctacggctacctcgccgagtacggcgtggagaagatcgtccgcgacctgcgcgtgcaccagatcctcgaggggaccaacgagatcatgcggctgatcatcgcccgcggtctgaccggggcgcgccgatga

SEQ ID NO: 5269 - DNA, 1473 bp, Methylobacterium sp.
atgcctgagttcgagaccccctccctgaaggaccgcgcgctgctggtcgatgcctgcctgatcggcggcgaatggtcgaaggccggttccggcagcatcgacgtcaccaacccggcgaccggcgcgctgatcgccaaggtgccgaatgccggcgccgacgagacccgccgggcgatcaaggccgcccacgaggcttaccccgcgtggcgcgccaagaccgccaacgagcgcgccgtgctgctgcgcaagctcgcggcgctcgtgaccgagcatcaggaggatctggcgcagatcctcaccgccgagcagggcaagtcgctgacggaggcccgcggcgaggtcgggatgtcggccgcctacgtgctgtggttcgcggaagaggcgcgccgcgtctacggcgacgtggtcccctccccctggggcgaccgcaagatcctcgtcaccaaggagccggtcggcgtcgtggcggcgatcacgccgtggaacttcccgtcctcgatgatcgcccgcaagatcgccccggcgctcgccgccggctgcccgatcgtgatcaagcccgcctcgcagaccccgctctcgggcctcgcctggggcgtgctgtgcgagcgcgccggcttcccggccggcacggtctcgatcctcaccggctcggcacgcgccatcggcgccgagatgaccggcaacccgctcgtcaagaagatcacgttcaccggctccaccgaggtcggcaaggtgctgctggagcaggccgcccacacggtgaagaaggtctcgatggagctcggcggcaacgcgccgttcatcgtgttcgacgacgccgacctcgacaaggcggtggccggcgcgatgctcgccaagtaccgcaattccggccagacctgcatctgcaccaaccgcttcctggtgcaggacgggatctacgacgccttcgcggagaagatggccgaggcggccaaccgcctgaaggtcggcaacggcgtcgaggacggcgtcgcccaggggccgctgatcgacatggcggccgtggagaagaccgaggcccatatccgcgacgccgtcgagaagggcggccgggtggtggcgggcggccaccgccacgcgctgggcggccagttcttcgagccgacggtgatcaccggcgccacgcccgcgatggcggtggcccgggaggagaccttcgggccgctggcgccgctgttccgcttccgcgacgaggccgaggcgatccgcatggccaacgacaccgagtacgggctcgcctgctacttctacacccgcgacctcggccgcaccttccgggtggcggaggcgctggaatacggcatggtcgggatcaacgaggggatcatcaccaccgaggtggcgcccttcggcggcgtgaaggaatccggcctcggccgcgagggctcgtaccagggcatcgaggattacctgaacaccaagtacctgtgcgtgggcggcctgggcgcgtag

SEQ ID NO: 5270 - DNA, 936 bp, Methylobacterium sp.
atgcccctcaccagcgacatcggcggcgtcgtcccgatcgcgccgaccccgttccatccggacggccggatcgacgaggtctccctcgaccggatgaccgacttcttcgggtcggccggcgtcgacggcctgacgatcctcggccagctcggcgaggccggcaagctcgaccacgcggagggaatcgccgtggcgcggcgcgttctcgggcgcacccggctgccggtgatcgtcggcgtcacggcgccgggcttcgcggccatgcggtcgctcgcccgggaggtgatggagctgggcgcggccggggtgatgatcgcgccgcccaacacgctccgcaccgacgaccaggtggtcggctattttcggaatgccgccgaggccgtgggcccggacgtgcccttcgtgcttcaggattatcccctcaccttctcggtccagatgacccccggcgtgatccgccggatcgtgtcggagaacccctcctgcgtgatgctcaagcacgaggactggccgggattggagaagatctcgacgctgcgcggcttcgaggcggacggctcgatgcgccacatctccatcctcgtgggcaatggcggcctgttcctcgatttcgagaccgagcgcggcgccgacggggccaataccggctacgccttcccggagatgctggtcgacgtggtccgcctcggccgggccggcgagcgcgacgccgcccacgacctgttcgacgcccacctcccctatctccgctacgagcagcagcagggcccgctggggctcgcggtccgcaagtacgtgttcatgcgccgggggatcttcgcctccgacgcgcagcgcaagccgtcgcaggcgctgaccgcgcaggcgaaggccgaggtcgagtacctgctgacccgcctcgcccgcaccgacgcgcgggcccggctcgcggcctag

SEQ ID NO: 5271 - DNA, 1836 bp, Methylobacterium sp.
gtggcgtgggagcaccataccggcgacctgcgcggcgacagccggacggatgcgaaggagttcaccttcgaggccacgccgatcaaagtgaacgggctgctctacctctgcacgccgcacaacatcgtccaggccctggagcccgagaccggccggctggtctgggcgttcgacccgaagatggcgcgagacggccagtaccagcaccagacctgccgcggcgtgtcctacaacgactcggccggctacgccccgcccgccgagaccgatgcggacagggccgccgctgtcgcggccgcggtcgccgagtgcccgcgccggatcatcgcggcctcggtcgacgcccgcctctacgcgctgaacgccgagaccggcgccccgtgcaggaccttcggggcggacgggttcgtcgacctgaaggcgcagatgccgaacctccggcgcgccgcctatcagcagacctcggcgccgctggtgacccggaacctcatcgtcctcggcagcgcgatcgccgacaactactacgcggacaacccctcgggcgtgatccgcgccttcgacgtgcgcaccggcgcgatcgtctggaagttcgacgccggcaagcccgacgcgaccgcgccgctgcggcccggcgagtcgtacgagcccaactcggcggtggcctggacgcagttctcggccgacgaggcgctggggctcgtctacgtgccgttcggcaaccggtcgcccgatcaggtgggtgtggcccggtcgaaggcggacgaggccctcatcgacgccctggcggcgctggatctggagacgggcgcgctgcgctgggcgttccggaccgcgtaccacgacctgtgggaccgcgataacccgtctcagccggtcctcctcaccctgccgcagggcgacgggacggtgccggcgatcctgatccccaccaaggtcggcaacgtctgggtcctcgatcgccgcaccggcgccccgattcggccggtctccgcggtcccggtctcgacccggaccgacatcccgggggagacgccgtccccggtccagccgatgtcgtccctccgcttcacgccggcgccgctgacggaggccggcatgtggggcgtcacgcccttcgaccagatccagtgccgcctcgccttccggtcgaaccgctacgacggcaacccgttcacgccgccccaggcttcggagggcgcgatcgtctggcccggcaatatcggcgtgttcaactggggttccgtggcagtcgatccggtccatcactggatgatcgcgacaccgcaatacctgccctatatctatcgcctgctcccgcgcccgccgggcgagccggagaggcgcctcctcggtgccgatcccgaggcgagcccggtcaacgagaatctcggcggccgctacgcggcctcgatcgcgcacatgcgctccgccctcggcatcccctgcagcgcgccaccctggggcgtgcgcgtcggcgtgaatctcgccgacggcaccgtcacctggaagcgccgcaacggcacggtcgcggggcagaaggtcggcggtctggccgtcccgcttcccctggagatgggcatgctggcccacggcggcaccctgaccacggcgggcggcgtcgcgttcacggccgccacgctcgacgaccgcatccgcggctacgacatgcagaccggcgaggtcctgtggtccacgacgttgccggccggcggccaggccaccccgatgacctatcgcggccgggacggccggcagtacgtggtgatcgcggcgggcgggcacggcgccctcggcaccacgccgggcgactcggtcatcgccttcaggctcgagtga

SEQ ID NO: 5272 - DNA, 2256 bp, Methylobacterium sp.
atgacgacaaccgacctgacgtccgccgggaccgcatccccggccggcggtcgcgcggcgatcctgcgcggggcccgcatcggggcggcagcggccgtcaccgtgatggtgctgctcctcgacctcatcagctactcccagctcatcttctcggggccgctggtggagagccgcgcggccggcctgtcggcgctgctcgcggcctacgtgctgggcagcctcgtcttcatcgcgctccgccgcaccgcgcggatctcgctgtccttcatcggcgcggccgcgatcgtgcaggcggcgatcgccgcggcggtcgccgggcagctcgaggccgcgggcgtcaccgatccggagacggtcggccagctcgtgctcgtcgcctgcggcgtctcgaccttcgccaccggcgtgatcttcgcgctgctcggcaccctgcgggcctccctgctggtgcagctcctgccctacccggtgctcgccggcttcctcggcggcgtcggcctgctgttcctgcgcagcggcgtgcagatcggcggccatgtcgacgacccgctcgcggccctgctccacgccgtcgatccggcgaacctcgatccgggccggatcgatgccggggcgctcgcgcgcatcgccctgaccctcgtgatcgggttctgcgccttctacctcccccggatcgtccggcactgggggacctacccgacggtgatcctgtcgagcctcgcggtggtccatctcgggctggcctggacgggcaccagcgtcgccgccgggcaggcatcgggatggctgatcgagccgctgccgacgggcacgctgctgcggccgcccgccatcggcagcctgacggccttcgatccgcacctgctcctgccgatctggcccaagatcgccaccctggtcgtcgtggcggtgatcatccagatcctctacgtggtgagcgtcgagctggagatccggcgcgacctcgacatcgaccggatgttcgtcgcctcgggcgccaccaacgtggtcggcagcgtgttcggcagctccgcgatgggcttcggccggacctcgacgctgctgctgcacaacatcggcggcggccactggctcggctggtggctgaccctcgcggtcatggcggcgctcctcatcgtcggcgcgagccccctggcgctgctgccccgcccgctggccggcggcgccctgatcgccatcggcatcgggctcctgttcaatctcggcgtcgccagccggaccctgccgggctgggagatcgccatcgcgctggtcgtgtgcaccgccaccgcgtatttcggggccaccacgggcttcctcgtcggcgtcctgctggcgatcctgatcttcggggtccagtacgggcagatcggcgcgatccgccggtcgctctccggggcggaccggcgcagcagcgtgatccgcggccccgacgccgccgcgcggctcgaggcggccggcggccggacccggatctacaccctgcagggctacctgttcttcctcaacgcgcaggcgatcttccgccgggccgccgcggaggccggggatctgcgcgtgctgatcctggatttccgcgagaccgtgggactcgacagctcggcgctgatcgcgttccgcaaggtcggccagctcgccgagcagcggcgcttcgaggtgctgctggtccacgtggatccggtcgcgcgcctgctgatcacccgcaacggcctcaccgccgacccgcgtgtccggatcctcgacacgctggacgaggccctgcgcgccgccgaggcgacgctcctggcggaggccggcggcgccggcccgggggaagtcgccgtcttcgcccggcacatggccgaccggctcggcagcacgttcggcccggacgacttcgcgccctacctgacggtccgcgagctcgcggcgggcgcggcgctgatgcgccagggggaggcggccgatgccctctacttcctggagcagggcctcgtctccatcgagatggaggtccccggccgcggcaacctgcgcctgcgcaccaccacggccggcacggtgatcggcgagatcgcgctggtccagggcgggcggcgcaccgccaccgccgtcgccgagagcccctgccgggtggtcgtcatcgaccgtgccgccctcgcgcggatggagcgggagcgcccggacctcgcgctcgccttccagcgcttcctgatcctggaactggccggcaaggtctccgacacgaaccggctgctcgaggccgagatgcagtga

SEQ ID NO: 5273 - DNA, 852 bp, Methylobacterium sp.
atgaagctctgtcgttacggtgaggttgggtccgagcggcctgctctggtcgatgctgcaggcgtcctccgcgacctctcgtcgatgtgccgtgatcttggtccgtccgaactcgcgcccgacggtctcgccaggatcgcacagacggatccgacgcggctgccccgggtagaaggaagcccccgcctcggcgttcccttcacaggcctctcgaagttcatctgcatcgggctcaactactcggaccacgcggccgaggccggcatggccatcccgagcgagccaatcatcttcctcaaggctccgagcgccgtctgcgggccgaacgacgacacgatccagccccgcgactcaaccaagctcgactgggaagtggaactcggcgtcgtgatcggatcgacggcgcagtacgtcaccgaggagcacgccctcgatcatgttgccggatactgcgtcgtgaacgacgtctcggagcgggccttccagcttcagtccagccaatgggacaagggcaagggatgcgatacgttcggtccaattggaccctggctcgtgacaaaggacgagatccacgatccgcagcagctcgacatgtggctcgacgtgaatggaacccgccgtcagacgggcaattcgcgcacgatgatcttcggcgttcgcgagatcatcgcgtactgcagtcggtacatgacgctcctgccgggcgacatcatcgcgacgggcacgccgccgggcgtcggcatggggatcaagcccaagcccgtctggttgcagccgggcgacacggtctcgctagggatagagggcctcgggcagcaaagccagcgcatccggcggaccgatcacggctag

SEQ ID NO: 5274 - DNA, 1287 bp, Methylobacterium sp.
atgcacatccacctcgacgcgctcggcggcgtcgccggcgacatgttcgccgccgccctgctggatgccttccccgagcatcggaccggcgtgtccgccagcgtccgggcggtcgacgcgcgcatcgcctgcgcggtcagcgcgcacaatgatgggatcctcagcggcgcgcgcttcaccgtgtcggcgcccggggcggagcccgggcccgcgccgcaccggcacgcgcataccgggcagcacgaccatccgcatgctcacgatcacagccacgatcacggccacgatcatgcccgcgaccacggccaccgtccctggttggagattcgcgccgcgctggaggcggcggatctcgcgccggcggtgcgggcgcacgcgctcggcatcttcgggcacctcgccgaggcggaggcccgcgtccacggcatcgcggtcgacgcggtggcgttccacgaggtcggtgccgccgactcgatcgccgacatcgtcgccgccgcccacctgatcgctgccctggaggcgcgtagctggagcgtctcggccctgccactgggctccggccgggtgcggacccagcacggtcccctccccgtcccggcccccgccacgacgctgctgctggcgggtttcgcgaccctcgacgacgggatccccggcgagcgcgtcacccccaccggggcggcgatcctgcgccacctctgcggcgacgatcccgggcgcggtcgcacccgggggatcctcgggcgcaccggcatcggcttcggtacgaaggtcctgccgggcctgagcaactgcctgcgcgccctcgtgctggaggacggcgccgcgtcccgcccgggccggcgggatctcgcggtgatcgccttcgaggtcgacgaccagtccggcgaggatctcgccacgggcctcgaccggctgcgcgccgagttcggcatcgtggacgtcgtgcagatgccggtcatcggcaagaagggccggatgatggcccggatccaggtcctggtccgtccggagagcctggaggcggcggtcgcggcctgcttccgggagaccacgaccatcggcctgcgttaccaccccgtggagggcgcggtgctcgcgcgcgccgcccgcacggtcgagcacgacggccggtcggttcgcgtgaagatcgtggcgcggccgggcggtcgcaccgccaaggccgaggccgacgacgcccgtgaccgagcgggccacgcggcccgggccgccctacgccgcgaggccgagcgcctcgccctggaacaggagcaggaggagcggtga

SEQ ID NO: 5275 - DNA, 759 bp, Methylobacterium sp.
gtgacgcgccagcatctggaatccgtcctcgccgggctcggccccgtcgcagtggcggtgagcggcggggtcgacagcctgacgctcgccaccctcgcccaccggctggcgccgggggcggctctcatggtccacgcggtctcgccggcggtgccggaggaagcgaccgcgcgcgtgcgcgccgagggcgcccgcgagggctggtccttacgggtgatcgaggccggcgagttcgccgacccggcctatcgggcgaacccggtcaaccgctgcttcttctgcaagaccaacctctacggcgcggtccggcgcgtcaccgaccgccagatcctgtcgggcgcgaaccgcgacgacctcggcgagtaccgccccggcctcgacgccgcccgggagcacggcgtgcgccacccttacgtggaggcggggttcgacaaggcgtcggtccgggcgctcgcccgcgacctcggcctcggggccgtggcggaattgccggccgcgccctgcctgtcgagccgggtcgagaccggcatcgccatcgagccggagaccctgaccttcattcacgcggtcgagcggctggtcggcggagcgctggcgaccgacggcgccggacgggccgtccgctgtcgggtccgcgccgagggcgtggtggtggaactcgatccggcgagcctcgccgccctcgacgccgagggtcgcgagacgctcggggcgggcatccgggacatggcgccggcccgtctcgccggcccggtccgc

SEQ ID NO: 5276 - DNA, 906 bp, Methylobacterium sp.
atgagcctcgcgctgggatgcgtcgccgacgactacacgggcgcctcggacctcgccaacacgctgaccaaggcgggcctgcgcacgatccagaccatcggcgtgcctgaggacagccggtcgctgccggaggccgacgcggtggtggtggccctcaagagccgctcgatccccgccgaccaggccgtggcgcgctcccgcgaggcggaggcctggctgcgggcccggggcgcggcccacgtgatgttcaaggtctgctcgaccttcgactccaccgacgcgggcaatatcggccccgtgatggacgccctgcgggcagaggccggcgagaccgtcgccctcgtcaccccggccttccccgagacggggcggagcgtctaccagggcaacctgttcgtcggctcggtgccgctgaacgagagcccgctcaaggatcacccgctgaacccgatgcgcgacgccaacctcgtgcgcgtgctcgggcgccagagcggcagtcccgtcggcctgatcgacaccgccacggtggcgaagggcgcggaggccgtggccgcccgcctcgacgccctcgcgcaggagggcaagggcgccgccatcgcggacgcaatcttcgacagcgatctcgaagtgctcggccgggcgatcgtcggccgcaagttctcggtcggcgcgtccggcctcggcctcggcctcgcccgggcgctcgcggccgacgggcggggaaccaaggacgccgccggcgcagccgtgggcgagccggtgggcggcgcctcggcctgcctcgccggcagctgctcgcaggcgaccctccagcaggtcgccgccgcggaggcgatcatgccggtgctgcgcgtcgacccggcgcggctgctcgcgggcgacgatgtggtcgccgaggccctggcc

SEQ ID NO: 5277 - DNA, 1008 bp, Methylobacterium sp.
atggacgacatccagccgtcggggcggctcgtcaccctcaccgacgtcgcccgcgaggccggggtcggcgagagcacggtctcgcgggtcctgcgcaaccatggctcctactccaagcgcgccggcgaacgggtggcggaggcggtggcccgtctcggctacgttccgaatcgcctcgccggcagcctcgccggccagggggcgagcgcgcggctcgtgggggtcgtcatcccgtcgctcgccaacgtggtcttccccgacctgctgcgcggcctcaccgccgccctcgacgccgacggcatcccctgcgtgatcggggtaagcgactacgacccggaccgggaggaggcgctggccgccgcgctcctgtcctggcggccggcggcgctgctgctcaccgggctggagcacaatcccggcaccgtcgccctggcgaaggccggtggcgtgcgcgtggtcgagatgatcgacacggacggggaggggatcgacgccgtggtcggcttctccaaccgggccgtgggggcggcgagcgcccgccacctcgtcgcgcgcggctaccggcggatcgcctatctcgggcacgatctcgcggtcgacctgcgggcgggcaagcggctcgctgggttcgaagccgcgctcgggcaggcgggcttggcgctccacggcaaggaaatccggacgggaccgtcctcgcccgcctcgggccgggccgggctggaggcgctgctggcgcgggtgcccgatctcgacgcggtctacttctccaacgacgacatggcgctcggcggctacttcgcctgcctgtcggcggggctggcggtgccgggacggatcgcgctgttcggcttcaacgggctcgacttcgcggcggcgatgccgcagcccctgtcgacggtgcgcacgccgcgcctggagatcggccggcaggccgccgcctgcctgaccggcgcaggcccgagaagaatcgatctcggattcgagctgatcgagggagcgaccgcatga

SEQ ID NO: 5278 - DNA, 681 bp, Methylobacterium sp.
atgagcgacgagagccggctgcgcgaggagatctgccgctacggccgctcgctgttcgagcgtggcctgacgccgggctcgtccggcaacatctcgctgcgcctgcccgacggcggctggctggtcacgccgaccaacgcgtcgctcgggttcctcgacccggcgcggatcgcgcggctggacgatgcggggcggctggtctccggcgacaagcccaccaaggagatcccgctgcacagcgcgctctacgagagccggagcgaggcgaaggccatcgtccacctgcactcgacgcacgcggtggcggtgtcgatgctgccggagatcgacccgcggcaggtgctgccgccgctgacaccctactacctgatgcggaccggcggcacggcgctcgtgccctactatcgcccgggcgacccggccgtggcggacgcgatccggggcctagcggggaagtacagctcggtgctgctcgccaatcacggcccggtggtggccggcgacagcctggagggcgcggtcttcgccaccgaggagctggaggagaccgccaagctctacctgctcctgcgcaacctcaacccgcggcagctgagccccgggcaggtggccgatctggtgagccatttcggcctgaccctgccggagccggacgaccatgccggccacgaccacgggtga

SEQ ID NO: 5279 - DNA, 1176 bp, Methylobacterium sp.
gtgacgacccgcggcgacagggccggcgacgtggccggcgatctggcaggcgacctggccggcgacgatgcgggcggcgcgcgggcggcgccggcgcggcggcggatctacctcgatcagacccatctgcgcgcccacgtgacggggatcgagcgggtcaccctcgacctgttcgccccggaccggctcgccccgcacgcggtgcggccggtgaccgcgggctccctgcccggcatgatcgccgcgcagcagctcggcctgccggcgcgggcgctgatggatcgggacgccctgttcctgttcccgggcttcccgcccgggccgctctgcgccgtcgcggcgtcgcgctgcctgctctacgtccacgacactttcctgctcacgcggacggaggatctgagcctgcgcagccggctctacatgagccccagcttcgccctggccctgcgctggtgcccgaacctgttcgtcaacagccgcaccaccggggcggacgtgcgcgcgctctgtgccaagcgcgcccgcgtcgccctgctgcggcccccggtccgcgacgccttcgggctcgcccacctgccgggaccggcagcctacgcgccggaccggccgctgcgcatcctggccatcggcaccatcgagccgcgcaagaactatccggcgaccctcgcgctcacggcggcgctgatccgcgccggcattccggcagagctccacctcgtcggccgggtcggctgggggcagcacgccttcctggaggcaccgccgccgttcctgcaccgccacgggtacctcgccgatgcagagctgcgcgccctcgcagggtcgtgccacctgctggtctccacctccaaggcggaggggctcggcctaccgctgctggaggtgcagcacggcggcctgccggtggtggcgccggacgacgcggtgttccgagaggtcctgggagcgtcagccctgctgatccggccggaggagcccgacgcggccgctgccgccctcgccggctggatccgcgacggcgccctggcccgcgccgccggaatgagtcgggccaacgtcgcgcgctggaacgcgatcgcggccgaggacggcgcgcgcttccggcgcttcctggccggcgatcccgcggcctacgatgcgctggagtcaattgtcgcacacgcgggcgccgcctga

SEQ ID NO: 5280 - DNA, 735 bp, Methylobacterium sp.
atgcacgagggcaccaccatcgccatcgtcgaggacgatcccgacatccgcgccctgctcgccggctacctggagggcgaggggttccgcgccgtcgccctcgacggcggcgcggccctcgaccgcctgatcgcggcgggccccgcgcccgacctcgtcgtcctcgactggatgctgcccggcgaggacggcctctccatctgccgccgcctccgtgacgccaatggcccgcccgtcgtgatgctgaccgccaaggacgaggacatcgaccgggtcctcggcctggagatgggcgccgacgactacgtctcgaagccgttcaatccgcgggtcctgctggcccggatccgcgcggtcctgcgacgggcccacggcgccggcggccagcccgccgcggccgcctccgagcgtctcagtgtcgccgacctcgtcgtcgatctcgcggcccgcacggtgatcaccggcgatcccgccgccgagatcccgctgaccagcgccgagtacgacctgctccactgcttcgtcacccggccgcagcgggtgctctcgcgcgaccagctcctcgactggacccggggccggaccgccgacgccttcgaccgcaccatcgacgtccaggtcagccgcctgcggcacaagctcgacgcctccggcagccaggccgcgtccctgctcaagaccgtgcgcaatgcaggctacatcctggccgccccggtccgctccggaacgccgtga

SEQ ID NO: 5281 - DNA, 231 bp, Methylobacterium sp.
gtgacagcggttcacaacgagcagaccaagctgctggcgacggccctgaacaacatcgccgttgcctacgtcgtcatcggcttcgtcacgccgatgatggccgcgagcttcggtgtgccgagtgcaccggcgctgcgcgtcgagaacgcgatcttcacgctcgtttggctggggaccggctgcgcactacattacggtgcgaggcgtgccctccggagcctgaagccgtga

SEQ ID NO: 5282 - DNA, 1017 bp, Methylobacterium sp.
atgcaggcgaccatgcacgacacgcagcacggcgaatccggcgcggccgccggcggccttccgaccttcgccgacgtggcccgcgccgccgagcggatcgccggggccgcgcaccgcaccccggtgctgacctcccgcacggccgacgcgatgaccggcggccgcctgttcttcaaggcggagaacctgcagcgggccggcgccttcaagttccgcggcgcctacaacgcgatcagcgcgctgccggaggcggcccgcacccgcggggtgatcacttactcctcgggcaaccacgcccaggcgatcgccctcgcgagccggctgctcggagcgcccgccaccatcatcatgccgggcgacgcccccgcggcgaagattgccgccacccgcggctacggcgccgaggtggtcctgtacgaccgctacacccaggatcgcgaggccctgggccacgaaattgcagaggcccgcagcctgacgctgatcccgcccttcaaccatcccgacgtcatcgccgggcaggggacgctggcgcaggagctgatcgagacggtcggccccctcgacgtgctggtggcctgcctcggcggcggcggccagctcgcgggctgcgccctcgccgccgcggaactgtcaccgggctgccgggtgatcggcgttgagccggaggcgggcaatgacgggcagctttcgttccgcgagggccggatcgtcacgatcccggtgccccgcaccatcgccgacggggcacagtcgacggcgctgggcgacctgaccttcgcgatcatccgcgcgcgggtgtccgacatcctcaccgtcaccgacgcgcagctcgtcgagaccatgcggttcttcgccagccggatgaagctcgtggtcgagccgaccggctgcctcgcggcggcggcggtgctgagcggcctcgtggacgtgaaggacaagcgcgtcggcgtggtgatcagcggcggcaacgtcgatctcggggccttcgcgcgactggccggcgaggccgcctga

SEQ ID NO: 5283 - DNA, 489 bp, Methylobacterium sp.
atgagcgccgacggtcccaccggcctgatcccggcgatcctcgcggggctgaccctgcgcggcagcggcctcctcaacgggcggccgccgcgcccggcggccaacacgcagcgccatcccgacgatcccgggcacgagacgcgcgacgtcaacgtccgcaacaccgtgctggtgatggcgggcctcgcgctcacggcgctggcggtcgtcggcacgatggtctggctgatgggcaccttcgcggcgagccagcgccgggcgctgcccgtcctgacgccgcagcagacgacgcggctggcgccgccgccgccgaacctgcaggccgatccctacgccgacctcgaccgcgagcgggccgagaccgcggcgcgcctctccggctacggctaccgggacgaggcccacacccgcgcccgcatcccgatcgggcgcgccatggacctgaccgtcggccgctccctcgaaccggcggagccggctgcgcgatga

SEQ ID NO: 5284 - DNA, 312 bp, Methylobacterium sp.
atgcggaaccccctcgcgaccctgagcgccgacgaccgcgccctgctccggaagcgcctgcgcacgcccgtcctcaccttcctggcgctgctcgccctgctcgccgtcaacgtgacgctgggcgccaccctccccttcgcgcaggtctggatcctggagctcgcggtcgtcgccgtgatggtggcgctgatcctcctcgtctccatggaggtgatccacgagccgccgctgatccggctgttctcggggctcggcttcttctgggtcgccatcatggtcggcatgacgctcaccgactatctcgcccgctga

SEQ ID NO: 5285 - DNA, 276 bp, Methylobacterium sp.
atgacgacgacgaaggacatccactcggccgatgcggcgatgatcgaacccaatcagacggccttcatcctcaaggtgacgcggcccgacgacgctgagctgtcgggccgattggtcatgttctacgccgcgattaccacctcggaggacgaggcgctggccatcgtgcgccgcgcggtgaaggccgatgcggaggtcgagccgacgggcgtccgcctctctcagcagaccgccagcgcactcgatctggaagcgggcctcgcgcgggctctctga

SEQ ID NO: 5286 - DNA, 417 bp, Methylobacterium sp.
atgggcggcctgttggctggcctggacgccgcggctgaggctctgacgacgctgatattcgacggcgtgcccctggccgtcatcgcgcactaccgcgaacatgttgtcgcgaataccgagcggttgagactgcagaaccccgtgatgaccaacatcgatgcgcattcgcccgacgcggcgttgatcatgaccaaccagacggccttcatcctcaaggtgacacggcccgatgacgcggaactctccgggcaactggtcctcttctacgcggcgataaccacctccgaggacgaggcgctcgccatcgtgcgccgtgccgtcaaggcggacgcagcggtcgagccgacgggggtccgcttgtctcagcaaacggccagcgcacttgttctggaagcgggcctcgcgtgggccctctga

SEQ ID NO: 5287 - DNA, 339 bp, Methylobacterium sp.
atggtcccgaacgcgctcaacatgctcctgggcgccgtgctcctcctcgcaccttggtacttggatctgggctacgagacggccgccgcgcgcaacgccttcgtgaccggaggcgccatcaccgtggtcgcactcctggccctcggcgagacctgcgcctgggaggaatacctcaccgtcgccctcgggctctgggcggccgtggcgccctgggttctcggcttcgccgacgcgacggcccccgtgtgggtgcacggcctgaccgggctcgcggtggccgccctggccgcgtacgcgctgtggcggctctacgtgtcgccccgggcgcgctccgtctga

SEQ ID NO: 5288 - DNA, 888 bp, Methylobacterium sp.
atgaacatcggattcattggcctcggcatcatgggcgcgcccatggccggacacctgatcgcggcgggccacagcctgttcctcaagtcccggcgcagcgtgcccgaggccctgctcgcggcgggcggcaccgcctgcgccaccgccgccgaggtcgccgagcgcgccgacacgatcatcctgatgctgcccgacaccccggacgtggagcaggtcctgttcggcgcgggcggcgtcgccgaggggctgtcgcccggcaagaccgtgatcgacatgagctcgatcgcgccgctggccaccaaggatttcgccgcccggatcgtcgagcggggcggcgcctatctcgacgcgccggtctcgggcggcgaggtcggggccaagaacgccgcgctctcgatcatggtcggtggcgaggccgggaccttcgcgcgcgccgagcccctgttcgccgcgatgggcaagacggtgacgcatgtcggcccggtcggctcggggcaggtcgccaaggtcgccaaccagatcatcgtggccctgaccatcgaggcggtggccgaggggctgctcttcgcctcgaaggccggcgccgaccccgccaaggtgcggcaggcgatcaccggcgggctggccacctcgcggatcctggagctgcacggcgcgcggatgatcgagcggaccttcgatcccggcttccgcatcggcctgcaccagaaggacctgaacctcgccctggacaacgcccggacgctcggcctcagcctgcccgccacggctctggcgcagcagctgttctcggcctgcgtggcccagggcggcgcggcctgggaccactccgccatggtgaaggccctggaggccctggcgaaccacgcggtcggcgacgccgcctga

SEQ ID NO: 5289 - DNA, 891 bp, Methylobacterium sp.
atggaccagccccgcggccgcgccttctacctgctggcggcggtcttcgccctctacgtcctgttcctctacgggccgacgctgaccatcctggcgctcagcttccagggcccgtccggcggcctgacctttccgatgaacggggtctcgacccactggttcgccaagctgtgggaaggcgtcggcgtgatcgacatctgggcggcgctgcggcgctcgctggccctcggcctcgtggtcatggcgctcaccgtgggaatcgcgttctacgccggcctcgccttccggaaggggtttcgcggggccggcctcgtcttcgccctggcggtgtcgagcctgatcgtgccctcgatcgtggtctcgctgggcatcggcctggagttccggctcctcgacgacgccgtgaaggcgatggccgccgcgaccggctggggattcctgcaggaccacggcacgctgatgggcctctacagctcggcgctaggcgcgcacctcacctggacgctgcccttcggcctgctgatcatgttcgcggtgttcaaccggttcgacccggcctacgaggaggccgcccgcgacctgggcgccagcggcccgcagacgctccggcacgtggtggtgccgatcctcgcgcccgcgctcgtcggcgtcgcgctgttcggcttcaccctgtcgttcgacgagctcgcccgcaccagccaggcgatcggcggccgcaacaccctgccgctggagctgcaaggcctgaccacgacggtgacgacgccggagatctacgccctcggcacggtcaccacggcggtctcggcactggtgatcgggaccgcgctcggcctgaccctctggctgcagaagcgccgggcgcggcgggcgctggcggggttgccgtag

SEQ ID NO: 5290 - DNA, 936 bp, Methylobacterium sp.
atgaccgatctcgccctgcccgccgccgcgaccgccgagcggaccgcggcgcccgccgtcgcggcgcgcccgcgcggccgcgccctcgcctatctccaggccgcgccgctggccctcgtcttcctggtcttcctggtggtgccgctggtgctcacggggatcgtctcgctctgggaatacaacgagtacgagatcatcccggcgctcaccctgcagaactacgccgacgtgttcgacggctgcctgtcggccgacctctgcacgaccgtgcgcacctacctgtcgacggtgaagttcgtcgtgctgacgctggcgatcaccctgccgctgggcttcgccatcgcgtacttcctggccttccacatccgctccggcacggtgcggatgggcctgttcctgctctgcacgatcccgttctggacctcgaacgtgatccgcatgatctcgtggatcccgctgctcggccgcaacggcctcgtcaacgacacgctgcgcaccctcgggctgatccgcgagccgatcgagggcttgctctactccgacttcgcagtggtcctggccttcgtgcacctcgacacggtgttcatgatcgtgccgatcttcaacagcctcgcgcgcatcgaccggcggctggtcgaggcggcgcgcgacggcggcgcgtccggcgcgcagatcctctggaacgtgatcctgccgctcgccaagcccggcatcgccatcgggacgatcttcgtgacgacgctggtgatgggcgacttcgtcaccgtcggcgtgatgggcgggcagcagatcgccagcgtcggcaaggtgatccaggtgcagatgtcctacctgcaattcccggccgccgccgccaacgccgtggtgctgctcgccgccgtgctgctgatgatcctcgggctcacccggatgatcgacctccggcgggagctgtag

SEQ ID NO: 5291 - DNA, 1257 bp, Methylobacterium sp.
atggacctttccccgagccgccgcacgctcctgaagggcgccgccgcgctcgtcgcgacgccggtgaccggcttcccggcggtgcacgccgccgagcccgtgaccctgcgctacctcggcaccgcggtgaaccagtccgccgacatcgcccggaaggtgaaggaggatctcggcctgaccatcgagtacatccccgtggtcaccgacgaggtgaccaagcgggcggtcacccagccgaactccttcgacctcatcgacaccgagtatttcagcctgaagaagatcctgccctccagcaacctgcagggcatggacgccaagcggatcaagctcgccgacaagatctcttcggtcttcaccaagggcgaggtcgcgggcaagaagatcggcgaccagggcacggcgcccaagaaggtcttctatctggagggcatcgactctaaaaaatttgccggcgaacagacccagtggatctcgctgatccccaccgtctacaacgccgacacgctgggcatccggccggacctgatcaagatcccggtgacgagctggaaggaactcctgaacccggccttcaagggcaaggcctcgatcctcaacatcccgtcgatcggcatcatggacgccgccatggtggtggaagcgaccggcgactacacctacggcgacaagggcaacatgacgaagcccgagatcgaccgcaccatcaaggtgctgatcgaggccaagcgcgccggccagttccgcgccttctggcaggacttcaacgaatccgtgaacctgatggcctcgggcgagacggtgatccagtcgatgtggtcgcccgccgtcaccaaggtgcgggcgcagggcgtgccctgcacctaccagccgctgaaggagggctaccgggcctgggcctcgggcttcggcatccccaagaccctgagcggccggaagctcgacgcggcctacgatttcatcaactggttcctgtccggctgggccggggcgtacctcaaccggcagggctactactccgccgtgctggagaccgcccaggcgaacatgcagccctacgagtgggccttctggatggaggggaagcccgccgagaaggacatcctcggccccgacggcaccctgatcgagaaggccggcgccacccgcgacggcggctccttcgacgcgcggatgggcgcggtcgcctgctggaacgccgtgatggacgagaacacctacatggtgcgcaagtggaacgagttcatcgcggcgtga

SEQ ID NO: 5292 - DNA, 996 bp, Methylobacterium sp.
atggatgtcgaactgatcggcttgaccaagcgctacggcgcggccattgcggtcgacggcatcgacctgaaggtgccgtctggcgcctattgctgcctgctcggcccctccggctgcggcaagaccacgacgctccggatgatcggcggccacgagcgcgccagcgcgggcgacgtggtgatcggcccgaaggcggtcggcgacgcggccccggccgcgcgcggcaccgccatgatgttccagagctacgcgctgttcccgcacctcgacgcgcgcgacaacgtcgccttcagcctcaagatgcgcggtgtcggcagggcggagcgccgcgccaaggcgatggcgatgctcgacctcgtgcagatgggccacctcgccggacgcctgccggcccagctctcgggcggccagcagcagcgcgtggcgctcgcccgcgctttggtcaccggcccgaaggtgctgctgctcgacgagccgctctccgcgctcgacccgttcctgcgcgtgcggatgcgggtggagctgaagcggatccagaccgagctggggctcaccttcatccacgtcacccacagccaggaggaggcgatggcgctctccgacctcgtggtggtcatgaatgccggccggatcgagcaggccgccgacccgcgcaccgtgttcgagcgccccgccaccgccttcgtggcccggttcatcggcggccacaacgtgatccggctgcccgacgggctcgtcgccgtgcgggccgaccggatgcggctcggtgccgaggccggtcccggcgcgctgccggcccgggtggtggcggtcgagtaccagggcaccagcgtccatgtcggcctcgatgccgacgggctggagcggacgcccgagagccccgccgccctcacggcgatcctcagcgacgcggatttcgcgagccgcccgctccgcctcggcgacacgatcccggtcggctgggacgcggccgccgcccaccacctcgatgcgtaa

SEQ ID NO: 5293 - DNA, 1428 bp, Methylobacterium sp.
atgcccgaattcgaccttgccatccggggcggcacggtggtcaccgcgagcgacacggtccgggccgatatcggcgtgcgcggcgggcggatcgtcgcggtggccgagggcatcgccgacgccgcccgggtgatcgacgcctccggcctgctggtcctgccgggcggcatcgacagccacgtccacatcgcccaggattccggccccggcatcgtcatggccgacgatttcgccagcgccacccgggcggcggcggccggcggcaccacctgcgtcatgcccttcgcgctccagccccggggcgcctcgctgcgcggggcggtcgacgcctaccgggccagggccgagggccagtgccacgtcgacgtggcgatccacatgatcatctcggacccgaccgaggcggtgctcggccaggagctgccggccctggtggccgacggctacacctcgttcaaggtcttcatgacctacgacgacctcgtgctgaacgaccgccagctcctcgacgtgttccacgtcgcgcggcggcagggcgcccgggtcatggtccacgccgagggctacgacgccatccgctacctcagcgagcggctggagcgggcgggcgagaccaagccttacggtcacgccctgtcgcgccccgaggtggtcgagcgggaggcggcccaccgggcgatcagccacgccgagctgatcgacctgccgatcgtgatcgttcacgtctcgggccgcgaggcgaccgagcagatcgcctgggcgcaagcgcggggcctgaagatccgggccgagacctgcccgcaatacctgaccctgacggccgaggacatgaaggggcttggccaggaggatctcatggcgggggcgaagtacgtctgctcgccgccgacgcgggacgtcgagagccaggaggcggtgtggtcggggatccggcgcgggatcttcgacgtggtctcgtccgaccattgcccgttccgctacgacgacccgcagggcaagctgaacccgcggggtaagacctccttccgctggatcccgaacggcatccccggcatcgagacgcggctgccggtgttcttctcggagggggtctcgaaggggcggatcagcctcaaccagttcgccgcactcaccgccacgaaccacgccaagctgtacgggctctacccgcgcaagggctcgatcgccccgggcttcgacgccgacctgactctgtgggatccgaaccggcgcgagaccatccgccaggcgaacctgcaccacggctccgactacacgccgtgggaaggcttcgacgtcaccggctggccggtcatgacgatcgcgggcgggcaggtcatcgccgaggacggccgggtcctgtccgagccggggcgcgggcgggtgctcgaccgggccgtcgatccggccgagcggcgggacgcctga

SEQ ID NO: 5294 - DNA, 1131 bp, Methylobacterium sp.
atggctgatcaggagaagccgaaggggccggccgcgccgctgaatctcacccccgccgcgctgctggccgaggtcggcaccctcggccgccgaatcagcgagggcgccaagctgttcgccgatgtcagcgacgccgatgtcgagatcgccaccacgccgaaggacctggtctggagccaggacaaggtcagcctctatcgctaccggccgctggccgagagcaagggcctgccgccggtgctgatcgtctacggcctgatcggccgctacacgatggccgacctgcaggaggaccgctcgctggtccgcaacctcctgaatctcggcctcgacctctacgtggtcgactggggcaacccgggccgggccgaccgctacgtcaccatcgacgactacgtggacggctacctcgccgagtgcgtcgccttcatccaggaagcggccgggcgggagaggatcagcctgctcggcatctgcgagggcggcgtcttcaccacctgctacgcggcgctctaccccgagaccgtcaacgcgatggtgctgaccatcacgccgatcgacttccacgccgacacgcgggagaatcgggccggccacggcttcatcaacgtctggacccgctcgctcacacccgaggatgtcgaccggctgatcgaggcgcagggctccctgcccggcgccttcatgggctcggtgttctcgatgatgacgccgatgcggaccatgacgaagtacaacctcgacctgctcgacgccctcgacgacaagaagaaattcctgaacttcctccgcatggagaagtggatcgccgaccggccggaccatcccggcgaggccgccaagcagtggctgaaggacctctaccaggacaacaagctggtcgagagcgccttcgagctcagcggccggcgggtggacctgaaggccatcacctgcccggtgctgaacgtcttcgcccaggacgaccacatcatcccgccggcgacctcgcaggcgctcaaggaccggattggcaccaccgactacaccgagctggggctgcccggcggccatgtcggcgtcttcgtcggcggcaaggcacagaagctgctgggctccggcatcgccgattggctgggccagcggggttag

SEQ ID NO: 5295 - DNA, 1203 bp, Methylobacterium sp.
atgaccgcgatcgacacccgggccttcctggccgacctgtacgaactgcgcgagatcggccggttccgcaccggcgtccaccggccgaccttctcggccgacgacatggaatcccggcgctggctgatggcccggctcgaggcctgcggcctggaggcctccatcgacgggatcggcaacgtgctcgggcgccaccgcggcccgggcccccacctgctggtcggcagccacatcgagacgcagaacgaggccggctggctcgacggggcgctgggcgtcgtggccggggtggcgctggcccgcgccgggctgcccgtcgacgtcgtcgccttcgccgacgaggaggggcacttctccggcggcttcctgggcagccgctcggcgatcggcgacctgaccgaggccgagatcgacgaggcccgcaaccgcaccgacggcacgccgctgcgcgcggcgctcgcgagcgccggccttgccggcctgccccggacgcgactcgacccggaccgctaccgcggcttcctcgagatgcacatcgagcagggcacgcagctcgaatccgccggcctgcacctcggcgtggtgagcggcatcgtggcgatctggcagttccggatcgacttcgccggcaaccaggaccacgccggcggcaccaccatggcggagcgccgggacgcgggcctctcggccgtgcggctgctggcggcgatcgaccgggagttcccgaaggtctgcgggccgcgcagcacctggaccacggggcggatcaccctggatcccggcggcttcagcatcatcccgggccgggccgaagtgtatttccagttccgcgacgtggcgatgcccgtgctggagcggatggaggcctgcctggaggcgctggtgcgggactcgaaccggcgcgagcgctgcccggccacgctgacggccctggccaaggcgatccccgccccctgcgacccggccctgatgcgcgccctctcggaggcggccgagagcgtctgccccggcgggtggcaggtgatgccgtcgggggccgggcacgacgcccagaacgtcgcccggatcctgccggccgcgatgctgttcgtgccctcgatcggcggcatcagccaccactgggcggaggataccagcgacgccgacctcgccctcggggtgcgggccctcggcgacgcggcggcgcgggtgctggcgggctga

SEQ ID NO: 5296 - DNA, 1089 bp, Methylobacterium sp.
atggaacgccgcagcttcctccagggcgccgtgctcggcgcgggcctcgcgggtgcgggcagcgcgggtgcggccgtgaacgcctccgccctccccggcaaccgcccgcaggatcccgcggacctgcccttcgtcaccgatcccggcgagcgccggggcgagatgctctaccgcccgttcgggaagagctccgaaaagatctcggcgatcggcatgggcgggttccatctcggcaagagcgccgtgacggacgacgaggcgacgcggctgatccatgccgggatcgaccgcggcatcaccttcatggacaattgctgggactacaacgaggggcgctccgagctgcgcatgggcgcggccctggcccagggcggctaccgcgacaaggtcttcctgatgtccaagatggacgggcggaccaaggaggaggcgctcaagcagatcgaccagtcgctcctgcgcctgcgcacggaccggatcgacctcgtccagcaccacgagatcctgcgctacgacgacccggaccgggtcttcgccgagggcggcgccatggagggcttcctggaggcgaagaagcagggcaagctgcgctacatcggcttcaccggccacaaggacccgcgcatccacctgcagatgctggaggtcgccgccgagcgcggcttccacttcgatgccgtgcagatgccggtcaacgtgatggacgcgcatttccgctcgttcagccacctcgtcctgccctacctcgtgcagaacggcatcgcgccgctcgccatgaagaccttcggcgacggggtgatcctgaaggcggacgcgccgatcaagccgctcgagtacctgcacttctcgctgaacctgccggtctcggtggtgatcaccggcatccagaaccagcgcgacctcgaccaggccttcgaggcggtgaagaccttcaagccgatggacaaggccacggtggccgagctgctgtcgcgctcgaagccctacgcgctggagggcaagtacgagctgttcaagacgagcgcaaccttcgacggcaccgccaagaacgcggcgtggctcggcgagggcgtggcgagcgtgaagaag

SEQ ID NO: 5297 - DNA, 681 bp, Methylobacterium sp.
gtgagcatctccgaagagttcaccctcgatttcgcccggcccgagcggatcgggctggaggaggcgatcttctgcgccggcaagagcccggagcagatcgacgcgatcctggacgccgcccgggcgcgcggcgcctcgctgctcctcacccgcctcgacccggagaagcgcgaccggctccgggacgccgcgcggctcgattactgcccggtctcgcgcacggcggtgttcggcgaggccccccggatcaccggtccggcccgggtcgcggtggtggcggccggcacctcggacgtgcccgtcgcccgcgaggccctgcgagtgctggcctatgccgggcgggcggcctcgctcttcgccgatgtcggcgtcgccggcctgtggcggctgacgtcgcggatcgaggagatccgcgcgcacccggtggtgatcgtcgccgccggcatggacgcggctttgcccagcgtcgtcggcgggctcgtggcgggcgcggtgatcgcggtcccgacctccgtgggctacggcgtcgcggcgggcgggcgcgccgcgctcgacgccgtgctggcgagctgcgcgccgggcatcacggtggtcaacatcgacaacggctacggcgccgcctgcgccgcactgcgcctgctccacgcagcgggacgcctcgccgcggggaccgaacgatga

SEQ ID NO: 5298 - DNA, 210 bp, Methylobacterium sp.
atgcccgacgcagccaacagcaacgtcgaaccgcagatcttcgacatgcgcgaggatcctgagggctggaccgtctacgacacccgcaccgatgagcccgcccgggtcaagggcgtgccgcagaccggcctggagatggagaaggcggacgacctcgtagacctgctgaaccgtctggcgcatcggaccggcgagcggttctcgctctga

SEQ ID NO: 5299 - DNA, 996 bp, Methylobacterium sp.
atggatcaccgccgactcggaaccgaactcaccgtctccgccctcggcctcggctgcatgggcatgagctacgcctatggcggccagcccgagggcgaggccaccgccacgctgcgccgcgccgtcgacctcggcatcaccctcttcgacacggccgagatgtacggcccgttcgagaacgagaagctggtgggcaaggccctggcgccggtccgcgaccgggtgatcatcgccaccaagttcggcttcaagatctccgagaccggccagggccccgaccggatcatcggcgtcgacagccggccggagcacgtgcgggcggtctgcgacgcctcgctccggcgcctcggcgtcgacgtcatcgacctgttctaccagcaccgggtggacccggccgtgccgatcgaggacacggtcggcgccatggccgatctcgtgcgggccggcaaggtccgggcgctcggcctgtccgaggccggcgcggccacgatccggcgggcccacgcggtccaccccatcgccgccgtgcagagcgagtactctctctggagccgcgaccccgaggccgaggtgctgccgacctgccgcgaactcgggatcggcttcgtgccgtacagccccctggggcgcggactcctgaccggcgcgatccgcgaccgcgacagcctcgccgccgacgattaccgccgcacgatgccgcgcttcgcggcggagaacctcgcggccaaccagcggctgctcgacacgctcgccgccctggcgcgcgacaagggcgtcaccccggcccagctcgccatcgcctgggtgctgaaccagggcgacttcatcgtgccgatcccgggcgcccgcaagatccggaacctcgaggagaacgcggcggcggccggtctcgtcctcgcggaggccgacctgcgcgccatcgcggacgcgatgcccgccgaggcggtgaccggcgaccgctacggcgccgccgggctggcgatggtcggtctctga

SEQ ID NO: 5300 - DNA, 1671 bp, Methylobacterium sp.
atgatgatgatcacgatcaaaggcaggcttctcgcgcttctggcggcactggggacgcttctcataggatcagcggcgctcagcaattatgcgctgtacaagaattacaggggcctcgaatcgatctacgccgacagggtcatgccgctcagccagttcggcaccatgcgcgacgccttcgatgccatcctgaccgcggcacgggatttcgagatccacgcgatccaggcggccgacgcggcgccgatcctcgagcgtcagttgacacgggcgaagaatgcctgggccgcctacctgaccacgtacctgacgcccgaagaggcagagctcgtcgcgaaactgacgccgcagctcgatcgggacgcggcgatcgtcgccgacctcgtccgcgccttgacgaccggggagaacgccaccgtgagcgcggcaaggaacgatctgctccgcgcgttggctccgacgacggcggccatcggccagctgtccgacctgcaggtgcgtgaggcgcgcgccgagttcgagcacgcggacgcgatggcgcggcgcctgcggatctggttcatcgggacactcttgggcgcagccctcgcggtcgggtacggcatccgcgtgatcctggtccaagtcacccgcccgatcgcccggaccacggcgacgatgacgcgtctcgccgcgggcgacctcgacgcacagatcgacggcgcgcaccgccgcgacgagatcggcgcgatgcttagggccgtccaggttttcaaggacgccctcgtcgcgaagcgcgcggccgatgcagccgccgacgccgaggcggccgcgaaggcgcgccgcgtcgagacgttggacagtgccaccgcggcgttccgtgcccggatggatcgcctgaccgaggcgctgtccgccagcgcctcgtccatggaagccgccgccgcgacgatggaccggagcgccggcgagaccgcgacgcagctgctccaggtgtcctcggcggccgagcagacatcggtcaacgttcagaccgtcgcggcggccggcgaggaactggccacgtcgatcgggtccatcaacggccagatcgcgcgctcctcggacatggcccaacgcgcggccgccgaggcgacggagaccaacgcgctcgtgatgagcctcgccgacggcgccgagcggatcgggaccgtggtcagcctgatcgccgggatcgccgcgcagacgaacctgctcgcgctgaatgccaccatcgaggcggcccgcgccggggaggcgggacgcggcttcgccgtcgtcgccaccgaggtcaaggcgttggcagcgcagaccgtccgggcgaccgagacgatctccgaacaggtcgcgaccattcagaaggagacccaccgcgcggtcgacgtcatccaggcgatcaccgccgctgtcctggaccttcggaccatcgccgcgagcgtcgcggccgcgatggaggagcaggaggcggtgacgcaggagatcgtgcggaacgtcggccaggccgccgacggcacgcaggcggtcacggtcacgatcgggcgcatcacgcaggcggcgggcgagaccggccggacggcggccgcggccctggacgcggccaccgccctgtcgcgacagtcggagaccctgaacgcggcggtcgcggagtacctggcggcggtgcgggccgcctga

SEQ ID NO: 5301 - DNA, 1740 bp, Methylobacterium sp.
atgacccccacgcagaccagccgcccgcccgccgaccgtgccgcgccgtggcagcgcctcgccgatctccggcttcgccacaagctcgcggccgtgatggccctggtgctcttggccatcggcgccctcagcgccctgagcttccacgacatgcgcggctcggcgctcgaggaccgcgcgctgatgaccaagcgcctgaccgaggtcgcacagagcctgctcgtccactacgaggcgcaggcccggacgggccagatgcccgtcgccgacgcgcagaaggcagcgctcgcggcgatcaccgccctgcgcttcggcagcgaggactacttcttcgtcctcgacgaccggggccacctgatcgccaacgccttcaacgccaagaacgtcggcaagcaggtggtggaccagaccgacgtccccggcggcaagcgctacttcgccgagatggtcgagaccgccaagcgcgacggctccggcttcgtcgactacatgaagccgcgccccggcggggccgtaccggtggagaaggtcgcgagcgtgcagatgttcaagccgtggggctggatcgtcgccaccggcctgtaccgggacgacgtccacgcggccgtgcgcgaccgcgcggtcaccatcggcctctggtccgccggcctcgccctgccgatcctggcgctgctcctgctcgtgggcaacaggctgtcccgcccgatcacccgcctgaccgcggcgatgcgcggcctcgcggacggcgacctcgcggtgacggtcgccgatcagcgccgcggcgacgaggtcggcgcgatggcgcgcgccgtccaggtgttcaaggacgccctgatcgccaagcgcgccgccgacgcggccgccgtggcggagaacgacgcgaagatgcgccgcgcccagatgctcgacacggtcaccgcccggttcgacgcgcaggtcagcgcgctgacgcagggcctgtcggcggccgcggtggagatggaggccacggcccgggagatgacgcgcaccgccgcgcggaccaccgaccagtcggtgcgcgtcgccgcgacctccgagcagacctccagcaacgtgcagaccgtggcggcggcgagcgaggagctggcggcctcgatcaacgagatcgcgtcccgcgtcgcccagtcctccgcgatggccgaccgggccggcacggacgtggcccagaccaacgccctgatgcaggtgctcgcccgcggcacggaccagatcagcgaggtgatgggcctgatcgccgggatcgccggtcagaccaacctgctggccctcaacgccaccatcgaggccgcgcgcgccggcgaggccggcaagggcttcgccgtggtggcgggcgaggtgaaggcgctggcctcgcagacggcccgggcgaccgagaccatcgcgacgcagatcgccgccatccagaacgagacccgccaggcggtcgagtcgatgcggacgatcggcggcacgatcgacgagatgcgcacggtggcactcagcgtggccgccgccatggaggagcagggcgcggcgacgagcgagatcgtccgcaacgtcacccaggcggcgcagggcacccaggcggtgagcaccgacatcgccgacgtccggcaggcggcccgcgagaccggcgcggcctccgaccaggtgctcagcgccgcgcaggaactggcccgctactcgacgagcctcggccaggaggtcacgaccttcctggccgccgtgaaggccgcctga

SEQ ID NO: 5302 - DNA, 258 bp, Methylobacterium sp.
gtgccgcgtagccatcaggaagcgaccgccgtgctgccggcctcgcggatcgaggtgagcccgcgccgcggcctgcgtcgcgaggaatcggctcgctacgtcggcgtcagcccctcgaaattcgacgagatggtccgggacggccgcatgccgaagccgaagcggatcgacgggtgcgtggtttgggacctccggcgcctcgacttggcgtgggacgcgctcggcggcgatgatgcggcgtcgaatccctgggactga

SEQ ID NO: 5303 - DNA, 789 bp, Methylobacterium sp.
atggcgcacgccgtgaccgccccggagaccccgccggcccgcagcaacgagcccctgaacgccgacagcgtgcgccgcgcccgggtcgacctcgccgcctgcctgcgctgggccgcccgcaacggcctcgaagaggggatctgcaaccacttctcggcggtgctgccggagcggcccgacctgttcctggtcaatccctacggcctcgccttcgcggaggtcaccgcgtcgagcctgctcctctgcgacttccacggcaacgtcctcgagggcgacggccagccggaggcgaccgccttccacatccacgcggagctgcatcggctgaagccccgcgcgcgggccgccttccacacccacatgccctacgcgacggcgctggccatgctggagggcgagccgctgatgtgggcgggccagacggcgctgcgcttctacggccggatcgccgtggacgaggcctacaacggtctcgcgctcgattcgtccgagggccggcggatcgccgagagcgccggcgaggcggacgtcgtgttcctgaagaaccacggcgtgatggtgctgggcgagacgatcgcggaggcctgggacgacctctactacctggagcgcgccgcgcaggcgcaggtcctggccatgagcacggggcgcgcgctcaaggccgtgcccgaggcgatcgtgaagcgcgtggcggcccaggaggcggccggccgcgccgagagcgcgcgcctgcacctggagagcgtcaagcgggtgctcgcccgggacgagcccgccttcctggcgtga

SEQ ID NO: 5304 - DNA, 495 bp, Methylobacterium sp.
atgcatcccgcttccctgacggcgatcggcgcggccgtcctggccgccggaccggccagcgccctggaggtcacccgcagccgcgacatcccggcaccgcccgccgcggtctgggcgctggtcggagatttctgcgcgatccagaactggcacccgcaggtccagcgctgcatcctgtcgggcgaggacgaggatgacggcatccgcgcgcagatccgcggcctcgtggtgaagggcggcaagggcacgatcgccgaggtcgagaccgcgcgcgacgagaccggcatgagctacagctacagcttcatccaggggcccctgccggtgcgcgcctacaacgcgacgctggcggtccgtcgcgacggcgcgggctccacggtgatctggagcgcgaccttcgacgccgagggcatgagcgacgccgacgccgtcgccgacatcacgggcgtgttcgacgccgggcttgccgggatcgcccgggaggcggccagatag

SEQ ID NO: 5305 - DNA, 798 bp, Methylobacterium sp.
atgccgcagatcaccgtcggaggactcggcctccgctaccacctcgagggacccgaggacgccccggtcgtcgccttctcgaactcgctgggggcgaccctggagatgtgggacgcgctgatgcccgcgctcgcggggcgttaccggacgctgcgctacgacacgcgcggccacggcgggtcggagacgcgcgaccggccggtcgcgatcgcggatctggccggcgatctcgcgggacttctggacgccctcggcatcggacgcgcccacctcgtcggcctctcgctcggcgggatgaccgtgcaggcgctggcgagcgccgatcccggacgcgcgctcagcgccaccctcatggcgacggcagccttcctgccgagcctgcagagctgggacgagcgcgccgcgaccgtgcgcgcccaggggacggcggccgtggtcgaggcgacgctggggcgctggttcacgccgggtttcgcggagcgcgcccccgaggcggtgcgggccgtccgcgagcgcttcctggcctgcgatccggccggctacgccgtgtgctgcggggcgatcgggcgcatggatctccggccggcgctcggagccatcaccgcgccgaccctggtgatcgccggccgcgacgatccgtcgacgccgccggccatggccgaggagatctgcggcggcatcgtccaggccgaactcgtcgtgctgccccgggcggcgcacctgctcgccgtcgagcgcgccgaggcggtcggcggctacctgcgcgccttcctcgaccgcgccgtgccgggcgcgtag

SEQ ID NO: 5306 - DNA, 753 bp, Methylobacterium sp.
atggcggatctcgaacaggcctggcgcgtggaggaggcctgcctcaacgcttggccgagcccgcgcgagctcctggtccaccgctacctgctgcgcgccgccggcggccgctcgaagcggcagaattccgtgaaccccatgcgcgggagcggcgcgcccggaccggccatcgcggcggcgcgcgcgatctacggccgcctggggcagcgcccgatcttccgcgtgccggccatcgccccgcagatggagccgctcctcgccggcggcgattacgatgtggtcgacgagacctgcacgctgatccgcggtctcgacgacctgccggttgcgcccgatccggccgtggcggtcgccgcggcgcccgggccggactggctggccctgcgcgacgcggtgaaccgcgcggatgaagcggccgcgcgggtgttccgcgacaccgtcgccgccctcgccctgccgcgggccttcgcggcggccgcggccgagggcggcatcggcgccatcgccttcggggtgctcgaccgcgagctgatggtcatcgaggcggtggcgacgcccgaacccctgcgcggccgcggccatgcccggcgcgcggtcggcgcgctgctgcgctggggccgcggggagggcgcccgggccgcctgcctgcaggtcgtcgccgcgaacacgccggcgcgggcgctctaccgcgccctcggcttcgagcatgaactgtaccgctatcactaccgggtcggaccggaacccggctga

SEQ ID NO: 5307 - DNA, 1392 bp, Methylobacterium sp.
gtgctgccggatcgagcgaccgcggacgccagcgcccgcgccgcggtcgggtcgggcgcgctgatcgcggcgcgcctcgagcggctgccgatgaccgccttccagcgcaacatcttcctcatcatcgccacggcgtggttcttcgattcgatcgatctcggctcgctcaccttcctcctcgggtcgatcaagaccgagttcggcctgacgaccgcccaggcgggactgctctcgagcatgagcttcatcggcatgttcgcgggcgcggccctgtcgggcatgctcgccgaccggttcgggcggaaggtggtcttccagatcagcatggtgttctgggggctcggcagcctctggtgcgcctacgccccggacgcgacgatgctgggctatgcccgcctgctgctcggcttcggcatgggcatggagttcccggtggcgctcgccatcgtctcggagttcctgccgacggccaagcgcggccgctacctcgccatcatggaagggttctggccgctcggcttcatcgcggccggctgcctcagctacgtgctgctcagctacttcgactggcgcgcggtcttcctcgcgcaggccgtgccggcgctgttcctgttcgtgatccgcttcctcgtgccggaatcgccccgctggctcgccgaccgtggccggcacgcggaggcggaccgggtgatggcgcagatcgagcggcaggtcgccctgcgcctcgacgggcgcccgcttcccgagccgaccgtcctgcccgagccggcgcggggcgagcggcgcttctcgttcctcgaactctggagccccggctacgccagccgcacggtgatgatctggctgacgtggttcttcgccctgctgggcttctacggcctcaccacctggctcggcgcgctcctgcaggaagcgggctacagcgtcgccaagtcggtcacctacacgatcctgatctcgctcgcgggcgtgccgggcttcatcgcctcggcgatcctcgtcgagcgctggggccgcaagcccacggccgtcctgatgctcctgggcagcgccgtggcggcctacctgtacggtcactcgccgtcgttcggctggctcatcgcctacgggctgatgatgcagttcttcctgttcggcatgtggtcggtgctctacgcctacacgcccgagctctacccgacgcgggcccgcgccaccggggccggctgcgcctcggccatcggccgcgtcggctcgctcatcgggcccttcgccatcggcctgatcctgccggtgctcggccacggcggcgtcttcgccctgggcgccggctcgttcgtcatcgccgccgcgagcgtcgggttcctcggtatcgagaccaagggcaagtccctggaagccatctcgcactga

SEQ ID NO: 5308 - DNA, 612 bp, Methylobacterium sp.
atggggagcccgccaccgaagcccggcagcctgcgcgcgcgaaaacggcaggagactctggaacggatcgccgagaccggcctgcggttgttcagccggcacggctacgaggccacgaccctggatgcgatctccgaggcggccggcatctcgcgtcgaaccttcttctactacttcaaatcaaaggaagagatcctgctggactggcagatgcgcggcttcggcgcggcgctgcgcaaggccgtcctggcccagccggagggcaaggtcccggtcgaggccgtccgggacgccctgctggcgctgtcgacgggtttccggacccaggagttcatcagtatcgatcgcgtcatgcggtccagcgagaccctgaaggcccgcaagcaggcggcctacggcctgcacgagcaggccctgcatgccgcgctgatcgagcgctggccggatcccgtccgcagcgccccgctgcgcctcgtcgccatggcgtcgctcggtgcgatgcgcctggcgatcgaggcctggatccaggcgggcggcgaccggcccgtggacgccttcctgcgggcggccttcgccggtctcacggccgagttctgcacaccgtcccgatag

SEQ ID NO: 5309 - DNA, 1356 bp, Methylobacterium sp.
atgagtgccagttcgaccggcgcgccgagcaccctgctcgccgccgccgacgcaggtcgccgcacccgcgtccgcctgctgatcgtcgcaatgctgttcgccgcgaccaccatcaactacgccgaccgcgcgaccatctcgatcgccggccccgacatggccaaggaactcggcctctcgccggtccagatgggctacgtcttctcggccttcgcgtggtcctacgtcctcgcccagatcccgggcggctggctcctcgaccgctacagcgtcaagtgggtctacgccgccgccgtcgccctctggtcggccttcacgctggtccagggcgccgtcggcttcttcaccggcctgaccgccgtggtgctgctcttcgccctgcggctcgccgtcggcctcaccgaggcgcctgtcttccccgccaatgcccggatcgtcgccgcgtggttcccgacccgcgagcgcggcatggcctcggcgttcttcaactcggcgcagtacttcgccacggtgctgttcacgccgctgatggcgtggatcgtccacaatttcggctggcaccacgtcttcaccagcatgggcctgctcggcatcgccttcgcggtgctctggctgcgcgtggtcgacagcccgaagaaccacccgtcgatgaaccaggcggagcgggattacatcgaggccggcggtgccctgctcgacatggacggccagagccggaccaagcagggcgatgccggccggacgctgcgccagctgctcgccaaccggatgctgctcggcatctatgtcggccagtactgcatcaccgtgctgacctacttcttcctgacgtggttcccggtctacctcgtcaaggagcgcggcctgtcgatcctgcaggccggtttcgcggcggttctgccggcgctgtgcggcttcatcggcggcatcctcgggggcgtgatctccgacctgctcctgcgccgcggcttctcgctgacggcggcccgcaagatcccgatcgtcggcggcatgctgctgtcgatgagcatcatcggctgcaactacgtccaggcggacgccctggtggtcggccttatggcgctcgccttcttcggcaagggcatcggcgcgctcggctgggcggtcgtcgccgacacctccccgcgggagagcggcggcctctcgggcggcctgttcaacaccttcggcaacaccgccggcatcaccacgccgatcgcgatcggctacatcgtccagagcacgggctcgttcaacggcgccctggtcttcgtcggcctgaacgccctcgtcgcctgcttctgctacctcgtggtggtcggcgagatccgccgcgtcgagctgaaggcccactga

SEQ ID NO: 5310 - DNA, 1146 bp, Methylobacterium sp.
atgagccacaacctgccgctgcgagggctgaccgtgctcgccctggagcaggccgtcgcagcgccctactgcacctcgcggctcgccgatgccggggcccgggtcatcaagatcgagcggccggaaggtgatttcgcccgcggctacgacgcggcggtcaacgggctggcgagctacttcgtctggctcaaccgcggcaaggagagcctcgtcgccgacatcaaggatccggccgatgcccgcctcctgcacgcgatcctcgcccaggccgacgtcttcgtgcagaacctcgcccccggcgcggcggcccgggcgggcttcggctcggcggagctgcgcgcgcgctacccccggctgatcacggtcgacatctccggctacggcgccggcaacgcctacagcgacatgaaggcctacgacctgctggtccaggccgagagcgggctcgccgggatcaccggccacccggcggggcccggccgcgtcggcgtctccgtctgcgacgtcgcctgcgggatggacgcccacgccgcggtcctcgaggccctgatcgcccgcgggatcaccgggcagggctgcgccctggaggtcagcctgttcagcggcgccgccgactggatgaacgtgccgctgctctacttcgaggggaccggccaggcgccccagcgggtcggcctcgcgcacccgtcgatctgcccctacggcgccttccccacggccgacggcagcctcgtgctgatctcgatccagaacgagcgcgagtgggcgagtttctgcgccggcgtgctcggcgagccggagctcgcccgggccgagggcttcgcgtccaacaacgcccgtgtggccaaccgcgccgcggtcgacctgcgcatcggcgccgagctggtgcggctgggccgcgaggcggccgccgcccggctgaaggcggcgggcacagcctacggtttcgtcaacacgctggcggacctcgccacgcaccccgcgctgatccgcgcggaggtccggacgccgtcggggccggcccggatcgtggcgccgccggtgctgatcgacggcgcggtccgcgccctcgggccggtccccgcgatcgacgagcacggggcgcggatccgcgaggaattcgcgccccgggctcgaggacagtga

SEQ ID NO: 5311 - DNA, 834 bp, Methylobacterium sp.
atgaccgacctcagcgcctggatcggccggacgcgggaggcgtccgacctcgtaaccccgcgcctcctcgccgagtttcgcgcgaccttcgcgccgcatctggcgccggtcaccgacgggatcgcgccgccggccctgcactggtgtctcgcacccgagaccccgccggccgagtccctcggcccggacggccacgccgccaagggcgggttcttgccgcccgtcccgctcccccggcggatgtgggcgggcgggcagatcgagacggtctcggacctgcgcgcgggcgacacggtgacacggaccgaaacggtgcgcgacgtcgcgttcaaggaggggcggagcggacgcctgtgcttcgtcaccgtcgaccacgcggtctcgaccggacggggcgtcgccatccgcgagcgtcaggacatcgtctatcgcgaggcggccggtgcgcagtcgggaatgaatgccgcgcccgagcgcgacgatcccgatgcctacgcgtcggcctgggcggtgccggcgacgccgacgctcctgttccgctactcggcgatgaccttcaacggccaccgcttccactacgaccagccctacgcgacgcgggtggaaggctacgccgacctcgtcgtgcacggcccgatgcaggcaacgctgctgataaacctcgccgcgacgctcctcggacgtgtgccgcggacgttcacgtatcgcgggctcgcgccgatgacggcgaaccaggtgtttcgggtctgcgggcgggtcgccgggacggcgttcgagggcgtgaccctcaacgcggggggccaagtctgcatgcgggcccgggccgacgggtga

SEQ ID NO: 5312 - DNA, 1698 bp, Methylobacterium sp.
atgaccgacgaaccgcacggcttcgaccgcgggctgaccaattacggcgaccgcgacttcgcccgctacctgcgccgctccttcgcgcgctcgatgggcatctcggtcggcctgctgaacaagccggtggtcggcatcgccatgacgccgtcgggcttcaacaactgccaccggggcatgcccgagctggtggaggcggtctcccgcggcgtgctggcggccggcgccctgccgcggccgttcccgaccgtatcgctcggcgaggttttcctcaacccgaccagcatgatgtaccgcaacctcatggccatggacaccgaggagatgatcggcgcccagccgatggacgcggtggtgctgatcggcggctgcgacaagaccgtgccggcccagctcatgggcgcggcctccgccgacctgccggcgatccagctcgtcaccgggccgatgtcgaccggccgccaccggggccagcggctcggcgcctgcacggattgccggggcttctgggccaagtaccgggccggcaccgtcgacgccgaggagatcgccgaggtcgagggccggctctccgtcacggccggcacctgcgcggtgatgggcacggcctcgaccatggcgtgcatcgccgaggcgctcggcatgtcgctgccgggcaccgcggcgatcccggcggtgcattccgaccggctggtggccgccgaggagaccggccgcgcggcggtgcggctgatcgagacgcggatccggccctcccaggtgatcacgcagaagtcggtcgagaacgcgatccgcgtgctgatggcggtgtcgggctcgaccaacgccatcgtgcacctcaccgccatcgccgggcggctcggcatccggatctcgcccgagcgcttcaaccagatctccgacgagacgccggtgctggtcgacctgaagcccgtcggccagggctacatggaggatttccacgccgccggcggcatgggcgcgctcctgcgcgaattgcgcccgctcctccatctcgacacgatggacgtggagggccggacgctcgccgagcgcctggacgagccggaggcctgggtcgaccgcgcggtcatccgcaccgcggaggatcccgtgtcgccggtcggcggcctggtggccctgtccggcagcctcgcgcccgacggggcgatcttcaagcgcgcggcggcgacgcccgacctgttcgagtcggagggccgggcggtggtgttcaccggcctggaggacctgtcggcgcgcatcgacgatcccgcgctcgacgtggcgcccggcgacatcctcgtcctgcagaatgccggcccgcacgcggccggcatgccggaggcgggctacctgccgatccccaagaagctggcgcaggcgggcgtgaaggacatggtgcgcatctccgacgcgcggatgtcgggcacggccttcgggtcgatcgtcctccacgtggccccggaggccgcggtgggcggaccgctggccgcggtgcgcgacggcgaccgcatccgcctgtcgatcaaggacaagcgcgtcgatctcctggtcgcgcaggacgagatcgcccgccggctcgccgaccaccggccgccgccggtcccggcccggggctacaaggcgctctaccggcgcagcgtcacgcaggctccggagggctgcgatttcgacttcctcgccaaggcggagggctga

SEQ ID NO: 5313 - DNA, 678 bp, Methylobacterium sp.
gtggcgaggctgctgctgatcgaggacgacggggacacggccggggacgtgcgcgacgacctgcgcgggcgcggccacgaggtcgcctgggccgcgaccgggccggacggcgctcgctcggcgcggcagggcggctgggacgcgatcatcctcgaccggatgctgcccggccaggacgggctcggcgtgctgcaggacctgcgccgggacggggaccggacaccggccctcgtcctcagcgcgctcggcgacgtcgacgagcgcatccgcggcctccgggccggtggcgacgactacctcgctaagcccttcgcgctcggcgaactcgccgcacggatcgaggcgctgctccgccgcccggtcgacacccgcgagacgctgctgcgggtcggaagcctggagatcgatctcatcgccgggacgggccggcgcggcgcgcgcgacctcgacctcctgcctcgggaactcaagctcctcgcctatctgatgcgcgcgcccggtcggatcgtcacacgtgcgatgctgttcgaggaggtctggaactaccgctttactccgaaatcgaacctcatcgacgtccatctcggccgcctgcgccgcaagctggaggcggccggggaggcgcccctgatccagaacgtccgcggcgtcggtttcaccctcacgcccgatgactga

SEQ ID NO: 5314 - DNA, 1215 bp, Methylobacterium sp.
gtgctgctcatcctggcggcgctggccgccgtggccttcgcgggatggacctgtcgcggcccactcctcgccggccttggcctcgccccgcccacggtccgcgaggcgaaggcagaccgttccgacgatgccccggcgaaccccgatctcgtcaccctcgacggggcggggcagacgcggatcggattggccttcggcacggcggagacccgccggatcgtgctcccggtgcgggcgccgggcaccgtcgccttcgacgagcggcgggtgacgcatctcaagccgcgcacgcagggacgtgtgctgagcctcgccgtccagcccggggaccgggtgacggcggcgcagacgctcgcgaccctcgatgccgccggcctcctcgacgcccgaaacgggcttcaggcggctgaagccgccctgggcgaggcgcgggcctccgaggcggtggcagcgctccaggtgaagcgtgggctggagcagctgaaattcggtggcgtggcgcaagccgaggtcgagcggcggcaggtcgatctcgccaaggcacaggcggcggtgaagtctgcgcaggcgaacgcggagatgtaccgggcgcagtaccagcgcctcgccccggccgagggcgccgcgccgggcaccagcgccgtggtcacgccaattgccggcgtggtgacgagcgtcggcatcaccctgggcgaggtggtcgataccgggcgcgacgccttcacggtggccgatcccacccgtgtcgtcgtgctggcgaacctctacgggcccgacatctcccgggtgaaagccggggatgcggtctcggtggagagcccggtgcccggccatccgcccttcgagggccatgtccgctcggtcaacgccgccctcgatccggcgacgaacacggctccggcgcgtatcgagctcgacaacccgcaggatctcctgcgcgccaaccttttcgtctcggtgacggtcgcagctgatctcggtcgcgacggcgtgaccatcccggcggcggccgtgcagcagacggacaccggccccatcgccttcgtgcgcacggacccggacaggttcgagcggcgggccctgacgctgggcatccagcgcaccgactgggtggaggtgcgccgaggcgtggcggcgggtgagagtgttgcaaccgcgggcagcttcggcctgaaggccatcctgctgcgcagccttctcggctcgacggattga

SEQ ID NO: 5315 - DNA, 894 bp, Methylobacterium sp.
atggcgcagaccatcgggttcatcggtctcggcaacatgggcgggcccatggcggccaacctcgcgaaggcgggccacaccgtgcgcggcttcgacctggtgccggcctcgctggaggcggcccgcgccgcgggcgtggctgtcaccggctcggccctggatgcggcccaaggggtggacgtcgtcatcaccatgctgcccgccgggcggcacgtggtcgaggtctggacgcagctcgccgaggccctgcccgccggcacgctcctgatcgattcctccacggtcgacgtcgagagcgcccgcaaggcccacgccctcgccgaggcgcggggctgcctgtcggtggacgcgccggtctccggcggcaccggcggcgcgaaggccgggacgctgaccttcatggccggcggcgccgcggccgccttcgccaaggccgagccgctgctgaaggcgatgggcaagaacgtgttccattgcggcgatgccggcgccgggcaggcggccaagatctgcaacaacatgatcctcggcatctcgatgatcggcgtcagcgaggccttcgcgctcggcgagaagctcggcctgtcgcaccaggcgctctacgacgtggcctcggtctcctcgggccagtgctggtcgctgaccacctactgcccggtgccgggccccgtgccgacctcgccggccaacaacagctacaagccgggcttcgccgccgcgctgatgctcaaggatctccgactcgcccaggccgccgccatcgccgcgggggcggcgacgccgctgggcgcggaagccgcgcagatctacggtctgttcgagggcgcgggccacgggggagaggacttttccgcgatcatccgtatgctccgcgggcagggaggcgagtcgtga

SEQ ID NO: 5316 - DNA, 1677 bp, Methylobacterium sp.
gtgaagatcgggctcggagcgaagctccacaccatcacggccaccgcgctgatcggcatcgtcgcggtctcgggcatcggcctcgtcagcctgaaatcccaggtcgagcaggaccggatggccaagacgcggaacctcacggacgtcgcctacggggtcgcggcctatttcgagggcgaggagcgggccgggcgcctgtcccgggccgacgcgcaaggggccgcgatccgggctctcaaggccctgcgctacgacgacaaggagtacttctgggtcaacgacatgcagccccgcatggtcgcccacccgatcaagcccgagctggagggcaaggatctcgccgccgtgcaggatcccaccggcaagcgcctgttcgtcgacttcgtcgagacggtgaagcggcagggccagggcttcgtcgactattactggccgaagcccggcgccgacgcccccgtgccgaagctctcctacgtgcgcggcttcgccccctggggctgggtgatcggcaccggaatctacgccgacgacaccgcggcgatcctgcgggacgcagcctggaaggcggcggccggcatgctcgtggtggtggcgctgatcggcctgctcgcggcgctgatcggccggcggctgacgcggccgctgcgcgcgctgaacggcgccatgcaccgcctcgcggccggcgagaacgccgtcccggtgccggcgcgggagcgccgagacgagatcggtgccatggcgggcgccgtgcaggtgttcaaggacgcgctgatcgccaaggtcgagtccgacgcccgcgccgccgccagcgccgacggggatgcccggcgtgctgccgccctcgaccggctgacccggtccttcgagacccgggccgggaccctgagccgcggactcgcgacggcggccgccgacctcgaggcgacggcgcggacgctgaccgtcacggccgcccacaccaccgagcgcaccggcgcggtggccgcgcaggcggccggcacctccgctgacgtccagaccgccgcggcggccaccgaggagatgtcggcctcggtccaggagatcgccgggcaggtgaaccgcgcctcggagatcgccgggcaggccgcgatcagcacccgccagggcgaggcgaccgtgcgggcgctcgccgccggcaccgagaagatcggcgacgtggtcgggctgatcgcctcgatcgccggccagaccaacctgctggcgctcaacgccacgatcgaggcggcccgcgcgggtgcggccgggcgcggcttcgcggtcgtcgcctccgaggtgaaggcgctcgccgagcagaccgccaaggcgaccgaggagatctccggccagatcggccggatccagggcgagacccgggacgcggtcgcggcgatcggcgcggtcggccggaccatcgaggagatgcgcggcatcgcggtcggggtcgcggccgccatggaggagcagaacgccgccatccaggagatcgtccgcggcgtggcgagcgccgccatcggggcgcagggcgtgtccgagaacgtcgtcgacctgcgccgcggcgccgacgagaccggtagcgcctccgagcaggtgctggcggccgcccgcgacctcacccgcggctcggacgagctcgatcacgccgtgaaggccttcctggcggaggtccaggcggcctga

SEQ ID NO: 5317 - DNA, 588 bp, Methylobacterium sp.
atggccagcgggcagaccagcgcggagcgcatgccggagatcccggccggcagcctgtccccggcgcaggaagaggcggcggccgcgttccgggccgagcgcggcgtcccggtcttcgggccgttcgtgccgctcctgcgcagccccgagctgatgctgtgcgcgagccggatgggccagtacctgcgctacggcagcgtcctgccgctgcggatcagcgagttcgcgatcctggtggtcgcgcgggaatggagccagccggtcgagtgggcgatccaccacccgatcgccctcgaggccggggtcgcccccgagaccgcgcgggcgctggccgaggggcgccgccccgacacgatgagcgccgacgaggcgctcgcctacgcgttctcgaccgagctgatgcgcaaccgcgcggtgagcgacgcgacctacgcggccctggtcgcgcgcttcggcgagcagggggcgatcgatctcaccggcatcaacggctactacgcgctgctcgccatgacgatgaacgtcgcccgcacggccctgccggagggcggccccgcggccccgccgctgccgccgctggtggggtag

SEQ ID NO: 5318 - DNA, 915 bp, Methylobacterium sp.
gtgagcgccgccgtcagtcccgccatgaccgtcgccgtcgtgggggccggcgctgtcggctgctactacgggttcctcctggcgcgggccggccacgcggtgacgctgatcggccgtcccgccctggtcgaggcggtcgagaaggccggtctcgtgctggagagcgcggccgggacggcctcggtgcccgtccgggcgaccgatacgggggcgggcgtgtcgggtgccgacctcgtgctggtctgcgtgaagtcgggcgacaccgaggcggcgggcgcgatgatcgccccccacctcgatccggccgccacggtcctcagcctccagaacggcgtcgacaacgccgagcggctcgccgccgtgctgggccggccggtcgtgccggtggcggtctacgtcgccaccgccatggccggccccggccatgtccggcacaacgggcgcggcgacctgatcctcggcgcctcggagacgagcgcgcgcgtcgccgccgcgttcgcggcggccggcatcccgaccaccgtctcggagaaggccgtcgacgcgctctgggcgaagctgatcatcaactgcgcctacaacgccctgtcggccctgacgcagctgccctacggccgcctggtgcagggcgagggcgtggtcgcggtcatcgccgacgtcgtgcaggaatgcgcgcgcgtcgcggaggccgagggcgtgtccgtgtcgcccggcatcctcgacgacgtgatggcgctcagcgccgccatggccggacagcgctcgtccaccgcccaggacctggcccgcggccggccgagcgagatcgaccacctcaacggcacgatcgtgcgccggggcgcggcgcacgggatcccgacgccggcgaaccggctgctgcacaccctggtcaagctcgccgagcggcgggactga

SEQ ID NO: 5319 - DNA, 306 bp, Methylobacterium sp.
atggcatcgatccgggagatcgcggacacgctgaggaagatcgccgcgccgggcatgaagccgaaggcgatccgttccgccatccgtgagcggcatccggaggcgagcaagaaggagatcgtccgcgccgcgttctacgccgtgacagaaggggcgaccgccgctgagggtgcgaccgcggagcttcacgacttcgcgctggctgagcgcatcgccgaggacaacgcggacgtggtcttgaaagcgagcaagcgcaagaggaagaagcgttcgtcggacgcatcggaccgatcgctggcgcactga

SEQ ID NO: 5320 - DNA, 591 bp, Methylobacterium sp.
atgcggcgccccatccgggcagcccgcgggctggtccccgccctcggcgggctgctgctcgccggcgcggcgctcgccgccccggacgcggcgatgcaggagcgtctcgccccctgcatcggctgccacggggccggcacgtcggcgacggagggcgtgccctcgctcggcgggcagctcccggactacgtggtcacgcagctcttccagttccgggagaagcagcgcgaggcgccgccgatgaacgaggtcgccgcaggcttttccgacgacgacctgcgcgcctacgccgacgcggtggcgacgctaccgccgcccggccgctccgggccggcggccgacgcggccctgacggagcgcgcgcaggcgctcgtcgccaagcaccagtgcaattcctgccacgggccggatctcgcgggccgggacgcgatcccgcgaatccgcgcgcagcgggaggagtatctcgccaaggcgctcgccggctacaagtcgaacgcccggcccggctacgaccccgccatgaacgaggtcgcgcagggcctgagcgaggcggacatcaaggatctcgcggcctacgtgtcgcggctctga

SEQ ID NO: 5321 - DNA, 1014 bp, Methylobacterium sp.
atggtgccggatacgcgcgtcggcacgacgttcggccacgaattcacgggcgttgttgaggaggtcggctccggcgtgcgcaatctcgccgtcggcgaccacgtgctggtcccgttcaacatcgcctgcggccgctgtcacttctgcaagcaggggctgttcgggaactgccacgaggcgaacgcgcaggcgaccgcggtcggcggcatctacggatactcgcacaccgccggcggctacgacggcggccaggccgagtacgtccgggtgccctacgccgatgtcggcccgtgcaagatccccgagacgatggacctcgacgacgcggtgctgctcaccgacgtcgtgccgaccggctaccaggcggccgagatgggcgggatccagcgcggcgacaccgtcgtggtcttcggcgccggaccggtcggcatcatggcggcgcgctgcgcgtggctgttcggggccgggcgggtgatcgtcatcgaccacgtcgagtaccggctcgacttcgcgcggcggtactgtcccgccgaggtctacaatttccgctcgatcggggatcccgtggtcttcctgaagaagaccaccgactccctcggggccgacgtctgcatcgacgcggtgggcggcgacgcggcggggagcgccctgcacaccctgatggggaccaagctgaagctcgagggcggctcggcggtggcgctccactgggcgatcaactcggtcaagaagggcgggatcgtctcgatcgtcggggtctacgggccgaccggcaacctgatcccgatcggcaacgtcctgaacaagggcatcaccatccgggccaaccaggcctcggtgaagcgcctgctgccgaagctgattgcccatatcgaggcgggccgcctgaaccccaaggacctgatcacccacaaggtgcccctcgaggaggccgcggatgcctaccacctcttctcggccaagctcgacggctgcatcaagccggtcctggtccccccgacggcacgcgcgtga

SEQ ID NO: 5322 - DNA, 495 bp, Methylobacterium sp.
atgagaaaccgtccgatcgatccgtcgacggtcccgggctggggcgtcgacgcggatccgcagaacgatccgacctacccgatgcgcgacatcgcgcgcgacgacagccggggcatgaactggacgcggccgccgcagcagcgggcgcgcgtcgaggtcctcacctcgatcgagtacaacgcccggccggcggtcgtcggcacgtcgaccccgccgcgcggcgtgagcggcgtcatccgccggcaggcgttccgctacagcgagtcccagtgggcgcactggctgatgctgatggccgccgaccgggtgaacgtggtcgagggcgtggtcgacgacctcgcgcggggccgcgtccccaacgtcccggccgagatgggcgcccgggccgagctggcccacaaccggtccgggctggcggggaagctcgcgctgaccggcgcggcgatcgggctcgggatcctggtctcgcgcctcgcccgcgcggagcgcctctag

SEQ ID NO: 5323 - DNA, 594 bp, Methylobacterium sp.
atggctgaggcggctgtccggcaggcgacctacgcggatctggaggcggtcccggagcatcgcgtcgcggagatcatcgacggcgtgctggagacgcatccgcggcctaggccgcggcacggcattgccgcggcccgcctgtcgggagagctggatcggccattcgcacgcggccgtggtggtcccggcggatgggtcttcatcatcgagcctgagcttcaccttggatcccaggtggtcgtgcccgatcttgcgggctggcgccgcgagcggatgccgaccgaaccagaggatgccttcatcgagacgcctccggattgggtctgcgagatcctctcgccgtcaacaactcgcctcgatcgcgggccgaagcgccggatctatgcagggtccggcgttggccacctctggctgctcgatccggctgccggcgtactcgaaggcttcgccctcgcggacggacgctgggtgctcctcgccacgatccagcgcggcgagaccgtcgcgcttccaccgttcgacgccgtcccgttccccttcgacgatctcttccccttcgacgatccggccgccccggccttgcccgagacctga

SEQ ID NO: 5324 - DNA, 1182 bp, Methylobacterium sp.
atgccggacaccggagtcgggacgcaggtgccgtcagcggagcccgacggggcatcgggtccgctccagacaccgtgcctcctcctggacggggcgcggctgcgcgcgaacctcgcggggctgcgggcgcacctggaccggctgggcgtcgccttccggccgcacctgaagacggcgaagtcgatcgacgtcgcccgcctggcgatgaccggtccggccggcccggcgatcgtctcgaccctgcgcgaggccgagtacttcgccgagggcggggtgcgggacatgatctacggcgtcggcatcgccccgcagaagctcgaccgcgtcggcgcggtccggcgccgctggggcgcggacctcgccgtggtgctcgactcgatcgagcaggcggacgcggtcgccgcctgggccgcgcggaccggcgaccgtctgccggtcctgatcgaggtcgacgccgacgggcatcgctccggcgtgaagccggccgacgcggcgctgctggtggcgatcgggcgcgcgctcggcgcgggggcggacctgcgcggcgtgctgctccacgccggcgacagctacggcctcagcgatcccgaggatctcgccgcggccgcggagggcgagcgcgcggcggcggtgacggccgccaccctcctgcgcgaggcgggcctgccgtgcccggtggtgagcgtcggatcgaccccgaccgcgcgctatgcccggaacctcgacgggatcaccgaggtccgtgccggcgtgttcatgttcggcgacctgttccaggccggcgtcggctccgtcgcggtcgacgacatcgcggtgagcgtgctcgccaccgtgatcgggcaccgccgcgacaagggctggatcatcaccgatgccggctggatggcgctgtcgcgcgaccggggcacggcccggcaggcggtcgatcagggctacggcgtggtctgcgaccgcgccggccgcccctacccggacctgatcgtcgccgacgccaaccaggagcacggcatcctggccctgcgcccgggctcccgcgccgccctccccgacctggccatcggcgaccgcgtgcgcgtcctgccgaaccacgcctgcgcgacgggcgcccagtacgaccgctaccacgtcctcgacgccgacgggcgggtcgccgccgtctggccgcgcatcaatggctggtag

SEQ ID NO: 5325 - DNA, 345 bp, Methylobacterium sp.
gtgtgccggcacaacaccggaacgggctgcgggatctacagcgaacgcccggaggcctgtgcccggtggtactgcctctggcgcaagatcgacgtcctgcccgacgcgctcaggcccgatcgatcgggcgtgatgttctcactggatatccgctcgcccgcggccgatgtggcggatgcggcctgcatcgtcgggcgcgcagtcgagggcgtgcacgccttcgaccggccggacgtgatcgaggccttcgccatgttcgtgcgcgagggctcctggcccgtgtggcaggcgaccgagcacgccacgaccctggtgcatccgggcccgcagatttcaccgccgtga

SEQ ID NO: 5326 - DNA, 1218 bp, Methylobacterium sp.
atggacttgcaccgcaccttcgccgaggtcgtggtgtgggaggacggccggctccggcatgccggccgggtcgacatgacccgcagcggcctggagggctttgcgcgcacgctgcgcgccgacgacgaggtggtgatcgaggcgaccggcaatgcaatggccgtctcgcacctgctgaacccgcacgtggcgcgcgtcgtgatcgccaacccgctacaggtgaaggcgattgcccatgcgcacgtgaagaccgacaagatcgacgccggcgtgctcgccaacctctatgcggctgggttcctgcccgaggtctggacgccggacgcggcgaccgagcggctgcgccggctcgtggcgcggcgcaaccaggtggtccgccatcgcacgcggctcaagaacgagacccacgcgatcctgcacgcccacctcgtgccgccgtgcccacatgccgacctgttcagccgggtcggccgggcttggctggaacggcaggctttgcccgatgacgagcaggcggcgataaggcgtcacctgcgcgaactcgataccctgagcgaggatctcgccgttctcgaccaggcgatcggcgaggcgacgctcgacagcccggtggtgcgtcgcctgctcaccgtcaccggcatcaacgtgacggtggcggccgggcttgccgccgcgatcggcgacgtgcgtcgcttctccagcccgcagaagctggtgagctacttcgggctcaatccgcgtgtgcgtcagtccggcctcgggctcgcccaacacgggcgcatcagcaaggcgggccgcagccacgcccgggcgatgctggtcgaggccgcctggaccgccgccaaggcgccggggccgctgcacgccttcttcgtgcgggtgcgtgcccggcgcggtcaccagatcgccgcggtggccacggcgcgaaaactcgccgtgctctgctggcacctgctgaccaaggaggccgactacctttgggcccgcccgggcctcgtggccaacaagatccgcgggctcgaactgcaggcaggccaaccacagaagaagggcaaccagcgcggtccggcctacgcctacaacatcaaggcgttgcgcgatcaggagatggagatcgctcggcgggcggagacagcctacgagcgggtcgtagcgcactggacgccgcgcccatcgaagacggtgcgcggacgcctcaaatcggcaaggctcgaatga

SEQ ID NO: 5327 - DNA, 1584 bp, Methylobacterium sp.
atgcaggccgagatcgaagccccgacccgcccgcacccggccggcgcgggggccgccggcgacgtgccgcgcacgatccgcctgagcgacagcgacaacgtcgcgatcgtggtcaacgccttcgggctgccggccggcacggtcttcccggacggcctggagctcgtcgagttcgtgccgcagggccacaaggtcgccctcaccgacatcccggaggccggcgaggtccgccgctacggcgaggtggtgggcatcgcgacgcaaccgatcccgcggggcgcctgggtggaggaatcccgcgtcgcgacgccggtcgcccccgccctcgacgccctggagatggccacccgcgtgccggcccccctgcccccgctcgagggctacaccttcgcgggctaccgcaacccggacgggtcggtgggcaccaagaacatcctggccatctcgatcagcgtgcagtgcgtcgccggcaccctcgacgtggcgatccggcggatcaagcaggagctgctgccgcgctaccccaacgtcgacgacgtggtcggcctgacccacgcctacggctgcggcgtcgccatcaacgcccccgaggcggtggtgccgatccggaccctccagagcctcgcgcagaacccgaatttcggcggcgaggtcatggtcgtcggcctcggctgcgagaagctcgtctcggagcggctcctgcccgacaacggcgcggccggcgacggggtggtgcggctgcaggacgagcgccaccgcggcttctcggccatgatcgacagcatcctgaccatggcggaggcccgcctggaggtgctgaaccgccggacccgcgagacctgcccggcctccgagctggtcgtcggcctgcaatgcggcggcagcgacgcgttctcgggcatcaccgccaacccggcgctcggcttcgcggccgacctgttggtccgctgcggcgccaccgtgatgttctcggaggtgacggaggtgcgcgacgcgatccacctcctcaccccgcgcgccaagtccccggaggtcgccgcggcgctggtccgcgagatggcgtggtacgacgcctacctcgccaagggcgaggccgaccgccgggccaacccgtcgccgggcaacaagaagggcgggctcaacaacatcgtcgagaaggcgctgggctcggtcgccaaatcgggcacgagcgcgatctcgggggtcctggcgccgggcgagcgcgtccgcgagaagggcctgatcttcgccgcgacgccggcgagcgacttcgtctgcggcacgctgcagctcgcctcgggcatcaccctgcaggtgttctccaccggccgcggcacgccctacgggctcgcccaggcgccggtgatcaaggtcgccacccgcacggagctggccgagcgctggtccgacctgatcgacctcgacgccggccgcatcgccaccggcgcggcgacgatcgaggaggtcggctgggagctgttccacctgatcctcgacgtggcgagcgggcgcaagcgcccctggtcggaccagtgggggctgttcaacgacctgaccctgttcaaccccgcgccgatcacctga

SEQ ID NO: 5328 - DNA, 921 bp, Methylobacterium sp.
atgtccgccgacctgcccgcggccgcgaccctcagccgcctcgacctgaagacgctccggctgttcgcggccatctgcgcggaggggaccctgaacggcgcggcccgccgggcggcaatcgcgccctcggcggtgagcaagcgcctcgccgagctggagcacgccctgggctgcaccctcctcacccgcgagccgcgcggcatgcggctcaccccggcgggcgagaccctgctgcaccacacccgccggatgctggcgagcgccgagcagatcgccctggaactcgccgagcacgcccggggcgtgcgcggcttcgtgcgggtgctcgccaacctctcggccatcgtggagttcctgcccgaggacctgcaggccttcctggccgcgcaggacgggatccgggtcgacctggaggagcggccgagcggcggcgtcgtcgccggcgtcgaggacgggttcgccgatctcggcctctgcgcgggcaacaccgacacccgcagcctcaccgcctacccgtaccggagcgaccgcctcgtcctggtgatgccggccgggcatcccctgagcggacgcggcgccgtcgcgctggccgacaccctcgactacgaccatgtcgggctgcacgcggagagctcgatctacgccgccctgcgcgacgaggcccggcgcctcggccggcccctgcggctgcgcatgcacgtcccgagcttcgacgcgatctgccgcatggcgcaggtcgggctcggcctcgggaccgtgccggagcgcgtctacgccctgctcggcccgccgatgcggctcgccgcggtgccgctcaccgatccctgggccgcgcgcacgctgcgcctcgtggtccgcccgggcgccctgtcgccggcggccgccctgctgctggagcatctccgggccgccggtcgctga

SEQ ID NO: 5329 - DNA, 675 bp, Methylobacterium sp.
gtggtcgtggccgacatcgcccgggaggccggcgcccgggtggcggcggatctcggggcgcaggcccggttcgccgagacggacgtcacccgcgaggcggacggcgcggcggcggtccggacggcgctcgacgcgttcgggcacctccacgggctggtgaactgcgccggcatcgcgccgggggagaaggtggtcggccgcgacgggccgcaccggctcgagaccttcgcgcgggcggtctcggtcaacctcgtgggcacgttcaacatgatccggctggccgcggacgccatcgcccgcgaggcaccggacgcgaccggcgcccggggcgtgatcgtgaacaccgcctcgatcgcggccttcgacggccagatcgggcaggccgcctacgcggcctcgaagggcggggtggtgtcgatgaccctgccgatcgcccgggagctcgcccggcacggcatccgggtggtcaccatcgcgcccggcatcttcgagaccccgatgatggcgggcctgccccaggacgtgcaggagacgctcggccagagcgtgccgttcccagcccgcctcggccgcccgtcggaatacgccgacctcgtccggcacatctgcgagaacccgatgctgaacggcgagaccatccggctcgacggggcgctgcggatgccgccgcgctga

SEQ ID NO: 5330 - DNA, 318 bp, Methylobacterium sp.
atgagcagccacgccgcgtccggcgcggggcgccgcaagccgcatcttctcgcccattccccccaggacaacgtcgccgtcgcggtgatcgagggcctgagcgcgagcaccgacgccttcggggtggtcaccgagaacgacagcaccttcgaggtccatgtccgccacgacatcccgatcggccacaaggtcgcgctcaccgacctgaaggccggcgacacggcgatcaagtacggccaggacatcggcaaggtcatcaaggacgtcgccaagggcgagcacgtccacgtccacaacgtcaagacgaagcgctggtga

SEQ ID NO: 5331 - DNA, 1287 bp, Methylobacterium sp.
gtgacgatgttcaaggaagccgctcagctcgaacacgagatcgccacccccttcgtcggcggtgcgcccgatcagttcgccaccaaggcgctcgcgaccgagcgcgcctcggagaactacacctccgccaccttcatgggctggcgccgggagaacggccgggtcggcgtgcgcaaccacgtcgtgctcctgccgctggacgatctgtccaacgccgcctgcgaggcggtcgccaacaacgtgaagggcacgatggcgctgccccacgcctacggccggctccagttcggcgaggacctggacctccacttccgcaccctgatcggcatcggctcgaacccgaacgtcgccgccgtcgtggtgatcggcatcgaggaccagtggaccaaccgcgtggtcgagggcatcgccaagaccggcaagccggtcatcggcttcggcatcgagggccacggcgacatcgcgatcgtcgccaaggcgagctaccaggccaagcgcttcgtgcagtgggccaccgagctccagcgcgaggaatgcccgatcgccgacctctgggtctcgaccaagtgcggcgagtccgacaccaccaccggcctcgcctcctgccccaccgtcggcaacatgtacgacaagctgatcccgcacgggatctacggggtgttcggcgagacctcggagatcaccggcgcggagcacctctgtcgcgagcgggcgatcagcccggaagtctccgacaagtggtacacgatgtggaaggcctaccaggacgacgtgatcgaggcccacaagaccgacgatctctcggactcgcagccgaccaagggcaacatcgcgggcggcctcaccacgatcgaggagaaggcgctcggcaacctcgagaagatcggccacgagtgccggttcatcgacgcgctgcagcccgccgaggcgcccgccaaggggcccggcctctacttcatggacacgtcctcggcggcggccgagtgcgtcaccctgatggcggcggccggctacgtggtgcacaccttcccgaccggccagggcaacgtcatcggcaacccgatcgtcccggtgatcaagatcaccggcaatccccggaccgtgcgcaccatgggcgagcacatcgacgtcgacgtgtcgggcgtgctcacccgggagatgacgatcccgcaggccggcgacgcgctcatcgacatggtggtgcgcaccgccaacggacggctcacggcggccgagtccctcggccaccgggaattcgtgatgacgaagctctaccgcagcgcctga

SEQ ID NO: 5332 - DNA, 942 bp, Methylobacterium sp.
atgcccaaggtcgtcatcagcgagttcatggacgaggccgcgatcgcggccgagctcgccggcctcgacgtgcagtacgatccgggcctcgtcgaccggcccggcgacctcgccgccgccgtggcccgggccgacgccctgatcgtgcgcaaccggacccaggtccgcggcgccctgctcgacgccgcccgcgacctcaaggtcgtcggccgcctcggcgtcggcctcgacaacatcgacgtcccggcctgccaggcgcgcggcatcgcggtctacccggccaccggcgccaacgacggcgcggtcgccgagtacgtggtcgccaccgcgatgctgctcctgcgcggcgcctacggggccacggcccgcgtggcggccgggacgtggccgcgcaacgccctgatgggccgcgagatcgccggcaagcgcctcggtctcgtcggcttcgggtcgatcgcccgcgagactgcccggagggcggcggccctcggcatgattgtcgccgcccacgaccccttcgtggccgcgggcgacccggcctggaacccggcctccggccccgtgcggcccctggcgctcgacgcgctgatcgcgcagagcgacgtgctctcgctgcacgtgccgctcaccgatcagacccgcgggctgatcgacgcgacggcgctggcgcggatgccgaagggcgcgatcctgatcaacgcggcaaggggcggcgtggtggacgaggcggccgtggcgcaagccctgcgctccggccatctcggcggcgcggcgctggacgtgttcgaccgggagcccctcgacgcggcttcgggcgccgtgttcgcggacgtgccgaacctgatcctgacaccgcacatcgccggggtgacgcaggaatcgaacgtgcgcgtctccgccgtcacggccgcggccgtccgccgccatctcacggagcgctga

SEQ ID NO: 5333 - DNA, 249 bp, Methylobacterium sp.
atggatgagccgggcggcgacggggcggggcggcgcgcgatgcgatcccgggcggcggtcgccctgacggatcggatccctgtcgcggccgcgcgcttcgcccgcgacgtccgcggatccaccgcgaccgagtacgccctgctcgggggcctgatcttcctcgtcgcggtcggcagcatccgctactacgtgtcccgcgtcagcgccgtctacggcgacatcaccgcggcggtgactcaggggcagtga

SEQ ID NO: 5334 - DNA, 1374 bp, Methylobacterium sp.
atgggccgcgtcgggctcctcgggcgcatcatgctgctcctgctcggggccctctccctgctcgtcctcgccaccgtggccctggatcactggcagcgccgggaggagcggctgcccgcgggctcgcgcttcccgcgggtcgaccaggccgccagcatcatgacgctgctgcgcgacgcggatcccgcccagaggccagccatcctgaaggcggtgagcggcgaggtgctgcgggccgagatcgtcgacgcgccgcccgacaccgtagacctgatccgcgagccccgcctggaaacgcggatccggcggatgacggccgagcccgccgaccgcgtccaggcctacaccgacgccgccctgctgcgccgcggcgtcgatccggccaacatcgcgcaggccgagcgcgccgggccggtcggccgcctcgcgctggcgacctaccggctgcccgacggccggtacgcggtgatcagcgcaaccgagcatcaccgctcgctcatgccgtggctgttcggtcagccgctgagcctctgggtggcggtgctcggcgccgcggcggccggtctcgtcctggtcggcacgcgccacgaactcgcgccgctgcgccgcctgaccgacgcggtctcccggttcgacggccgcgccccggagcgggtgagcgcgccccgaggggcgcccgagatccggcgtctcgcccaggcggtgcagggcatgcaggagcggatcgccggcctcatggccgagcgctcgctgctgatcggcgcgatctcgcacgacctcaagacctacctgacgcggctgcgcctgcgcgccgaggtggtggcggagccgctgctccgggacaagctcgtggcggatctcgacgccatgaccgagctgatcgaggcgtccctgggcttcgcccgcggcaccgccgtcgaggcgacccgggcgccggtggatctcgccgatctcgtcgccgtcgaggtggccgagcacgccgcccagggcgccacgatcagcctcaccggcgaggaggtgcgggacgccaccgtggccggcgacgcggtcgcgctgcgccgggtcgtggccaacctgatcgggaacgccgtcaagttcggacgctcctctgtggcggtggcggtgagccgggccgggacggtctgccggatcgtcgtcgaggatgacgggccgggcattcccgaggcggagcggacggcggtgttcagcccgtactaccgggtcgagcgctcgcgcagccggcagaccggcgggaccggcctgggcctcgcgatcagccggcagatcgccgaagcccacggcggaacggtggtggcggaggccggcgcgggcggcggcgcgcggctcgtcgtgaccctgccgagcctgtcctga

SEQ ID NO: 5335 - DNA, 1476 bp, Methylobacterium sp.
atgagcttcgaaccaataggcgccatcgcggtcgtcatcggcctgttctgtctgctgttcggcagggaatcggtggtgatcgccttcgtggtgttctgcaatctcggctcggccgcggcactcctgctgggcggcgccaacgtgcagccggcgcatctcttcctcgtgttcctgatgatcgcgacactgttccatcgcaacatgtcgacacgggtcctgagttcgttccgcctgcctgaaccgggcttctggcttctctgtctcactctctacggggtcgcgagcagctacatcctgccgcggctcttcgcgggtcagacctatatcgtgccgctgggaacatcgtcacacctgatcacgagcgacggcgtcgttcccctgggaccagtatccagcaatttcacgcagccgatctatctcatcggagatctggtctgtttcagtatcatcaccgctttcggttccacgaagaacgggattgagacgctcgcgaaggcgctcatcctctacgcggctgccaacatatgtttcggcatcatcgacgtgctcacggcggcaacgggcacgcaggaggccctgcaattcattcgcaacgctcagtacacgttccacgatgaggagagtgtcggcagtatgcggcggatcatcggggcttggccggaggcgtcggccttcgcgggaatgacgctgggaggttgcgggttcacgggcatgctgtggctctgtggccgcaagcccttggtgacgggacctctggcgttgatctcgctgttgttcgtgatcctgtcgacatcctcgaccgggctggtcggcgccgcggtgctgatcccgatgctctacgcgatcgcgttgctgcgatgcagcacgcgtcgtcaggaccgcttcagcgcctggctggtggtcgcgggtccgctggtcgcctgcgtcctcgtgctcctggccttctcggtcggcggcgtggctgagcgcgtctacgattacgtcgatacgcttgtcctgagcaaagccgagacgagttcgggtgttcagcgttcggcctggaacgcttatgcgtggcggaacttcatcgactcgagcggcctgggcgtcggcctcggaaccaatcgcacatcgagctttccgctcgcggtcctgtcgaatgtcggaattcccggagccgtcttctacgtgcttttcctggcgtcggtgttcggatttcggcgcggagcgccgcggacctacgcgagcgacatccgtgccgctggccgcgtcgcctgcctgtgccttctccccggcagcctcatcgcgggcccgaccgtcgatcagggcttgatattctacatcttcgccgccaccgcctgtgcctatcccgcacgtcatccagtcgggcatatcggtgtttccgcaactccgatcgagccggccgcggtcgcgatacggtcggggctcgccgaaccggctcgccattcggctcagaacgtatcactcgacacctga

SEQ ID NO: 5336 - DNA, 438 bp, Methylobacterium sp.
atgctcgcgctgatcggcagcttcctcgtgaagctcctcggctccgggatcgcggagccggtgctggcctactttaagcagaaggacaccagcgcccgggacatcgcggtcgccgggatcgatgcggaccggcagcgcgaccttgccgcgctccagggcgtcgtggaggcgaacaagctgaaggcggcctcgcaggcggcctacccctggatcgtctacctgatcgccgttccgccggcgctgcacgcggccagcatctacttcgacagcatgcccttctggacaccgtggggcgcgcacgtcgtcgggtcgtggggcgtgcccacgccgccgccgccctacggcgactggcagggcaagatcctgctctcgttcttcgtggtcgcgcctgtcgtccaggcgatccgcaccggcgccgccgcggtcgcgcgccgctga

SEQ ID NO: 5337 - DNA, 702 bp, Methylobacterium sp.
atgccgaacgagcgacccgagacacgcctcaaatgcgccctggtggtgcgcggcgctttcgacgcccacgtcgtcccggccttcgaggccgcggggggccggacggcgatccactgggcgccgacaaccgtcatcatgaagaccctcgccgagggcgagaccgccgacgcggtgctcgtcctgtcggacgccatggaccggctcgtcgccgaggaccgcgtcgagcccgagagccgggtcgacgtggtgcgctcgcgctacggcatcgccgtcaaggccggggctccgcatccggacatcgcgaccgtcgaggcgctgaagcgcaccctggtggaggcgcggtcggtggcctactcgcggaccggcgccagcgggatctacttcgccggcctgctgccgcggctcggcctcgccgacgcggtgaacgcccgggcaacgatcatcccgcagggcttcacggccgagaagctggtctccggggaggccgacatcgccgtccagcagatcagcgagctgatggtcgtgcccggcatcgaggtggtcggccccctccccgacccggtgcaggagatgacgaccttcgcggcggcgatcctgcgcggcgcggcggaccgggacggcgcggcccggttcctcgccgggctgaggacgccgcaggcggccgaggcctaccggaccagcgggctggagccggcctactga

SEQ ID NO: 5338 - DNA, 987 bp, Methylobacterium sp.
atggccgacaccgccgccctcgacgccgccccgatcgccgccgccgtaccgacgagtcgggacgacaaggcgctccaccgcctcatcttcgtgggcatcgcggtgctgctcgtcgtagcaccgctcgtcctgtaccccgtctacttgatgaaggtgctgtgcttcgcgctgttcgcgctcgccttcaatctcctgctgggctacggcggcctgctctccttcggccacgccgcctatttcggcatggcgagctacctctgcgcctacacggccaagagcctgggcttcacgccggaactggcgatcctcgccggcacggtcacggccgcgctgctgggtctggtcttcggcgccctggcgatccgccggcagggtatctacttctcgatgatcaccctggcgctcgcccagatggtgttcttcttctccctgcaggcgaagttcacaggcggcgaggacggcatccaggcggtgccccgcggcaacctgttcggcgcgatcagcctcgccgacgaccgggtcatgtacgcggtggtggccgtggtcttcatggccgggatgctgctgatctaccggatcatccactcgcccttcgggcaggtgctgaaggcgatccgcgacaacgagccgagggcgatctcgctcggctaccgcgccagccagtacaagctcgcggtgttcgtgctctcggcgacgctcgccggcctcgcgggctccaccaaggcgatcgtgttccagctcgcctcgctcaccgacgtgcactggtcgatgtccggcgaggtggtgctgatgaccctcgtcggcggcatgggaacggtgttcgggccgatcgtcggcgcgctggtgatcgtcacgatggagacgtatctggcgcagttcggggcctgggtgacgatcatccagggctgcgtgttcgtgctctgcgtgctgctgttccgcgagggcatcgtcggcctgatcgcccggctgatccgccggccgctctag

SEQ ID NO: 5339 - DNA, 1392 bp, Methylobacterium sp.
atgaacggcgggacgcaacccacccggcgcggcgtcggccgcctccggctgccgagcgccggcgccaagctgctcacgccgctgctcgtcggcctactcgtcgggctcctcgccgcgctgcgcccgctgcccgccgcggccctcaccgagatccagttctggcacgccctggacgggccgaacggcgagctggtgacccgtctcgccgagaccttcaacgcctcccagccggactaccgggtcgtgccggtctacaagggctcctacgccgagacgatcagcagcggcatcaccgcctaccgcaccggcgcggcgccgcacctgctgcaggtcttcgaggtcggcaacggcaccatggcggccgccgtcggcgccgtcaggtccgtcgccaccgtgatgcgggaggccgggctctcggtgacgcccgaggacttcctgccggtcgtcgccaccaattatcgggatgccgacggcgggatgctgtccctccccttcaacgtctcctcgacggtgatgtggatcaaccgcgaccggttccgtctggcgggactcgacgccaagcagcccccggcgacctggcccgaggtcttcgaggccgcgcggcggctcaaggcggcggacggcaagcggtgcgccctgtcctccgcctggccgacctgggtgcatatcgagcagctgtccgtctggcacgaccggccgctcgcgacccgctccaacggcttggacggctacgatgccgaactcgtcttcaatggcccgctccaggtccgccacctgcagaacctcgtcgacctgaagcgcgcgggcgtgttcgagtacaacgaccgcgtcaatcgcggcgagagccggttcgtctcgggcgactgcgcgatcttcctcacctcgtccagcctgtacggcaaggtcgccaccgcggcccggttcgattggacggtcgtgcccatgcccttctatcccgacgtcgtgccggagccgcagaacgcgatcctgggcggcggctcgctctacgtgatgcagggcaaaacgccggacgagtaccgcggcgtcgcccggttcctggccttcctgatggacgggcggcagcaggccgcgatgtaccggaacaccggctacatccccaccacgcgcgccgcctacgacgatgcggtggcggagggcttcttcgagcggcatccgcagctccacgtcgccgtgcaggaactcacccggcgaccgccgacgcgcaacaccgccggactgcgcctgggcaacatgctgcagatccgggacatctgggccgaggagctggaggcggcgctcgacggcgcgaaggcgccgcagcaggccctcgacgacgccgtggcgcggggcaatcaggtgctgcgggtgttccagcagcggaccaagaagtga

SEQ ID NO: 5340 - DNA, 624 bp, Methylobacterium sp.
atgcggctccggatcggcgtggccctggcggtggtcgtcatcgccgccgttgctctccttgccgggccgctgagccgcggcgacagcctgtccgacatcctgaccggccggacccccctgctcgccggcagcgcccgggcgcccggcggcagcgcggacctgaccggcaccgcaaccctcgcgtcggaccagcggccggcgaccctgcacgtcgcctgcgatccgggcggcaccggcctgtcggcggcgctgaccgtgccgcgcttcgccgagctggcgccgcgcttcgatttcgcgggcctcgaaggggccgacagcgagaagcccctcaccggcctcctggtctccagcgccggcagcgtgcgctccgtgcgcatgccggtccggggcgccgcgaccggggccgatgcgggcttcacgctgacggtggcgggcgcgcgccgcggcgaggatccgctgcgcggggtcgccctggccctcgtccagcccgggaccaagctgacctggacgcaggcgagcccgcgcggcgacgacccgaccctgacggccacgttcacggtgacggaggccgacgccgccgcgctgaagggcgccctgagcggctgcctcgcggcgccgttctag

SEQ ID NO: 5341 - DNA, 264 bp, Methylobacterium sp.
gtgctcgcggtcgcgtccgtctccgcggcgctgccggaggcggagatggcgcgctcggcccgggaggggccggcccaggagcgcccggaccgggagcgccgtctggcggatgccgtcttcgttcggccgctctatggcgcataccgccattgtggcggctcctgcctgaagagcggcgacctgtcgtggttctgcttcgccaggcagagctgctacctgagctgcgcgaccgcgccgccgcagatgaagtgcgccgtcccgtga

SEQ ID NO: 5342 - DNA, 1620 bp, Methylobacterium sp.
atgaacccgatcaagccgacacgccgatccctgatggccggaggcgtcgccctggcggcgctgggggcggcgtgccgcgccggcgcgcagggcgcggcccccggcaccctgacctacggcatctccatgaccgacctgccgctcacgaccggccagccggaccggggtgcgggcggctaccagttcaccgggctgaccctctacgaccccctggtcgcctgggaactcgacgtcgccgaccggccgggcaagatggtgcccggcctcgccaccgcctgggaggccgacccggccgatcccaaggtctggacgttccacctgcgggagggcgtggccttccacgacgggtcggccttcgatgccgacgcggtgatctggaacttcgacaaggtgctgaacaaggaggcgccgcatttcgaccagcggcaggcatcccaggtccgcccgcgcctacccggcgtcgcgagctaccggaaggtcgacgccaagaccgtccaggtcgtcaccaagacgcccgacagcctgttcccctaccagatgctctggttcctgatctcgtcgccggcgcagtacgagaaggtcgggaaggactgggcgaagttcgccttcgagccctcggggaccgggccgttccggatggggcagctggtgccgcgcgtgcgcctcgagctgctgccgaacaccggctactggaacccgaagcgggtcccgaagctcgcgaagctgaccctcgcctgcgtgcccgaggacctcgcccgggtgaacgcgctcctgtccggcagcgtcgacctgatcgagacgcccgcgcccgacgcggtgccgcgcctgaaggccgccggcatgcgggtcgtgggcaacgagacgccccatgtctggaactaccacctgtcgatggtggagggctcgccctggcgcgacctgcgcctgcgcaaggccgccaacctcgccatcgaccgcgccggcgtcgtcgagctgatgggcggcctcgcccagcccgccgtcggtcaggtccaggaatcgagcccgtggttcggcaagccgggcttcaagatccggaccgacgtcgaggcggcgcgcaagctcgtcgaggaggccggctactcggtgaagaaccccgtgaaggccacggtcctgatcccgaccggcggcaccgggcagatgctgtcgctgccgatcaacgagttcgtccagcagagctgggccgagatcggcatccaggtggcgttcaagaccgtggagctggaggtggcctacacggcgtggcgccagggcgccgcggatccgagcctcaagggcgtcagcgccggcaatatcgcctacgtcacctccgacccgttctacgcgatcctgcgcttctacgattcgcggcagatcgcgccgaacggcgtgaactggagccactaccgcaatcccgaggtctacgccctctgcgacaaggtgaaggcgagcctcgacgtggccgagcagaaccggctgctcgcgcgcatccacgaaatcgtcgtcgacgatgccgtgcaggtctgggtcgttcacgacaccaatccgcacgcattgtcgtcgcgggtgaagaactacgtccaggcgcagcactggtttcaggatctggcgacgctcgcctga

SEQ ID NO: 5343 - DNA, 228 bp, Methylobacterium sp.
ttggccgccgcgtcgctgacgctcctcgcgggctccgcctacgcccagggcaactcgccctacaacgcctcgggcgcgcaggccggcggcccgcgcggcggcctggagcgcgccggcgaggcggccgcgatggagcagggtgccgctccggccgcgcgtccgacgatgcgcaagcgcatgaagcacaagcggatgaagcatcatcgccggatgcgccaccacatgtga

SEQ ID NO: 5344 - DNA, 732 bp, Methylobacterium sp.
atgacatcacccttcctgggcgaattcctgggcacgatgaccctgatcgtgctcggcgacggcgtcgtggccggcgccctgctcaagcattccaagggcgagaacgccggctggatcgccatcacggcgggctgggccttcgcggtcctcgcgggcgtcttcgtggccaacgccaccggcagcgccgacgcccatatcaacccggccgtcaccgtggcgggcgcggtcagctccggcgatttcagcaagatccccgtctacatcccggcccagatgctcggcgccttcgtgggcgccgtgctcgtctggctccactacctgccgcactggggcgcgacccaggatcccggcctcaagctcgcctgcttctgcaccggcccggcgatccgcgacgcgaaggccaactggatctccgagatcatcgcgaccttcttcctgatcctgacgatctccgccctcgtgaccaccacgctgggctcggccggcgcgatcccgcgggccgtcgcgccctacatggtcggcatgctggtctggggcatcggcctgtcgctcggcggcaccacgggctacgccatcaacccggcccgcgacctcgggccacgcgtcgcccacgcggtgctgccgatcgccggcaagggcagctccgactggggctacgcgctgatcccggtggccgcgcccctggtcggggcggtgctggccgggctcttcgtccgggcgctggggatctga

SEQ ID NO: 5345 - DNA, 1620 bp, Methylobacterium sp.
atgaagccgttcgactgggtgaccgggtatccgtcgctgcggatgccgatgttcgggcgcaactgcgtggcgacctcgcacgctctggcggcgcaggccggcatccagatgctccaggccggcggcaacgcggtcgacgccgcgatcgccacggcggccgccaagaccgtcaccgagccgtgtagcaacggcctcggctccgacgccttctgtatcctgtgggacgggaaggcgctgcacggcctcaacgcttcgggcggggcttcggccgcctggagccgggactacttcctgaagaagtacggcgccgccgagcggccgccgatgcgcggctgggactcggtcaccgtgccgggcgcggtcgccgcctgggcggcgctgagcgagcgcttcggccggctccccttcgccgacctgatgcagcccgcgatccgcatcgccgagcgcggctacctcgcgccggtggtggtccagcagaaatgggcggccgcggcccggatcgaggcgatcacccgccagccgggcttctcggagttcttcctgccgcggggccgggcgccggatgtcggcgagctcgtgaccttcccgggcgccgagaagacccttcggctgatcggcgagaccaagggcgaggccttctaccggggcgagatcgccgaggcgatcgccgcgcacgcgcgggccaacggcggcgcgatgaccgccgccgacctcgcggcgttccgccccgaatgggtcacgccgaccgcgaaggactatcacggctacacgctgcacgagatcccgccgaacggccagggtatcgcggcgcagatcgcgctgggcctcctcgagcagttcgacctcggcggcctgccggtcgatgggccggagtcgcagcacctgcagatcgaggcgatgaagctcgccttcagcgacacctaccggtacgtcgccgacccccgcgggatggaggtgacgccggaggccatactcgaccccgcctacctcgcggagcgcgccaagctgatcgaccggaaccgcgcccaggtcttcgggccgggcaagccgcccgcgggcggcacgatctacctcaccgcggcggacgagtccggcatgatggtgagcttcatccagtcgaacttcatgggcttcggctcgggcgtggtcgtcccggactggggcatctccctgcagaatcgcggctacggcttcgtgctcgatccggagagccccaacgcggtggcgcccggcaagcgcccgttccacaccatcatcccgggcttcctcacgaaggacggagccccggtgatgagcttcggcgtgatgggcggcaacatgcagccgcaggggcacgtccagaccctggtgcggatgatcgaccacggccagaacccgcaggcggcctgcgacgcgccgcggtggcgggtgaacgagggcctcgacatcaacgtcgaggcggcgatgccgggcgcgaccctggaacgcctgaaggccctcggccacgaactcgaggtgatcgaggacagctaccaggatttcggcgccggccagttcatctggcggatgggcgatcccgccgtcgagggctacgtggccgcgagcgacccgcgccgcgacgggcaggccgtcgtctggtga

SEQ ID NO: 5346 - DNA, 522 bp, Methylobacterium sp.
atgaagacagccgccaagacacactcgaagacacactccaagacagccgccaagacgacccgcgcgacgctcgccctcgacaaggccggcatccggtacagcctccacgtctacgcgtacgatccggacgcgccgcgcatcggcctgcaggccgcggaggcactcggggtggacccgggacgcgtgctgaaaaccctgatggcgtcggtcgacggaaggacggtctgcctgctcgtggcctccgaccgggaggtgtcgatgaagcgggtcgccgccgccttctcgggcaaggccgcgtccatgctcaagccggccgatgccgagcggctgaccggctaccatgtcggcgggatcagcccgctcggacagaagcggtccttcccgacggcgatcgacgccggatccctgaccgagccggcggccgagatccacgtcaacggcggcggccgcggcctgcagatccggctgaccgagggcgatctcgccgccgtcctgggcgccctcgtcgtgccgctgacgtga

SEQ ID NO: 5347 - DNA, 1608 bp, Methylobacterium sp.
atgaccacggctcgcgccctgtcgatcggtttcgtcggaaacgtcgtcacaaacccgttcgggaaggtggcgggccgcctcgcggatctcgccacggtctcgtgcgagcatctacccatcggacagatcgagcaggtgctggcgggacccgccgccgccgacgtcctgatcgtccatctcgaccaccgctggttcttcgacgtcgccccggacgaggcggccgtggatcgcgcgcgcggcctcgccgagctggtctcggcgcggctcgcccgggcgccggggacgatcatcctcaacaccgtgccgttcgtgccggtctcgtccgtcgagagcgacctccacgaccagcttcaggcgctggcgcgggtgaacgcggtgctgttcgacctcgcccgggcgcaggagcgggtcagcgtcgtcgacgccgccggcgccctggcgctgctcggcttcgccaacgccttccgcgagcgcaaccggtacatgtaccagatgccctacggcccggccgccgtggacgcgctcagcgagcgctacgccgacgccgtcgcggcgcggctgcggtcgcgacgcaaggtggtcgtggtcgacgccgacaacaccctctggggcggcgtcgtcggcgaggacggcgtcgagaacctggaggtcgacagcgactatccggggatcgtccacacccagctccagcgccagctcctgcgcctgaagggcctcgggatcctgctctgcgcggtgacgaagaacaacgaggaggatttccgcgcggtcttcgcccagcgcgcgatgccgctccgcctcgacgatttcgtggcctaccgcagcaactggacggagaagagcgagaacatccgcgacctcgccgcggccctgaacctcggcctcgacagcttcatcttcctcgacgacaacccattcgagatcgaggaggtccgcgcccggctccccggggtcgagtgccacctgttcgaccggacgcgccccgagcaggcgctcaccctcctcgacgggatcgcgtcgctgcgcgcccggaacatcaccgccgaggacctggccaagaccgagcagtaccgcggcgaggccaagcgccaggagctgcagcgctccgccgcctcgatggacgagtacctcgcctccctcgagatccgggtgcacgtcgcccgcaacaatccgggctccctgcggcgggtcacgcagctgatcaacaagaccaaccagttcaacctgacgacgcggcgctacaccgaggacgaggtcgccaccgccatgcgggagggcggcgtctacgcggcccgggtggtcgaccggttcggcgacatgggcatcgtcggggtcgccatcgtccggggcggcgaactcgagacgttcctgatgagctgccgggcgctcggacgccgcatcgaggcccaaattctgcgccacgtctgccagcaggagggcgatcgggacctcagggcccagtatcgcccgagcgcgaagaaccggatggtcgagagcttcctggacgacaacggcttcgaacccttgagcgctggccccgagggcaagacgtaccgactgacacgaggaccggatgacaccccctacatccacatcgtcgcggagtga

SEQ ID NO: 5348 - DNA, 1272 bp, Methylobacterium sp.
gtggacgcggtcgagatccgcgacgccagcctcaccgccttctaccgatcgatgacgccaccggagcggcacaccttctgggcgtgcgccgccggctggtgcctcgacggcatggacttcatgatctacccgctggtgatcgggacgatcatggcgctgtggcacgtcgatgccggcacggccggtctcgccgccacggtgacgctgctggcctcggcgctcggcggctggctcgcgggcttcgtcgccgaccgcatcggccgggtgctgacgctgcagatcacgatcctctggttctcgctgttctccctcctctgcgccttcgtgcagaacttcgagcagctcctcgtcgcccgcgcgctcctcggcctcggcttcggcggcgagtgggcggccggcgccgtgctgatcggcgagacgatccgggccgagtatcgcggccgggcggtgggctcggtccagtccggctgggcgatcggctggggcctcgcggtcctgtcgcaggcggtgctgttctcggtcctgccgcccgagaccgcgtggcgctggatgttcgcggtgggtgccctgccggcgctgctggtcttctacctgcgccgctacgtgaaggagccggaggtcgccgccgaatcccgcgcccgggccgccgccacgggcgaccggccgcagatctgggagatcttctccgggccgatcctcaagaccaccctgctcgcctccctggcggcggcgggctgccagggcggctactacgcgattaccacctgggtgccgcgcttcctcaccaccgagcgccacctgtcgatcgtgtcctccaccggctacctcgcggccctgatcatcggctcgttcaccggctacctcgtgggcgcgtggctcgccgaccggctcggccggcggcccctcttcctgatcttctcgctgggcgccatcgcggtgatcgtcgcctacacgcagatcccgctctcgaatggcgtgctctgggtgctgggcttccctctgggcttcttcgcctccggctacttctccggcatgggcgccttcctgaccgaactgtacccgacccgcctgcgcggctcggggcaggggttctgctacaatttcggccgcggcatcggcgccctgttcccggcgctggtcggctacctcgcggagcgcgccggcctcgcctcggccatcgcgatcttcgcggccgtcgcctacgggatcttcttcctggcggccttcgcgctgcccgagacgcgcggcaaggtcctgcacgcggattcctga

SEQ ID NO: 5349 - DNA, 1254 bp, Methylobacterium sp.
atgacggtgcacattgctcgcgcgcagttcgtcgccaaggacgccgatcaactcggtacagcgctagtctctcccgagccgcggcacgcgctgaatgcgctcgaggtcggccgaattgcccggcacctcgtcatcttcacgccgaccccggacgatctggcgcggctgatcgcggcggcgcgcgcggatctgcccgatctcgcgcccctgcgcaccgtccagcgggtgatgtcgatcaatcccgacagcgtcctggcgatcgcccagcgccaccggttcgacgccgcggatccgcggggcgaggggttcgtggcctgcctgatgctgaacgccgacggcatggcggcgctcaaggccgggacgctcgacgcgtccgacccgccggccgcgatgctggccggccagcacgaacgcccggccgggatctacgtctgggccgtctacgcgcggcggcgcctctccggcggcgtcggtctcgtgttcgaccgcctgtcgagcccgacctaccggggcgtcgacttctacgcccgcgccgcaacccccgagggggccgacctcctgaccaccctcggcttcacggcgcagacctccgcccgcgggcccctgtaccatttcgcccgcgggccgaaggcggagccggcgcccccgtacgacacccaccggtccggcgggaccggcatcagcgtcgcggtcgcgcggaacatggaggatctgtcccgcgtgatcgccctgcgcgccgccgtctacatggcggagcaggcctgcccgtacgaggaggagttcgacggcaacgacctctcggcgacgcacctgatcggctatgtcggcgacgagccggcgggctgcctgcgcatccggttcttcgcggatttcgccaagatcgagcgcctcgcggtccgggccgagttccgcaacacgcgcctgtccttcgcgctggtccgcgccgggatcgagctggcccgggtcaagggctaccggcggctctacggccacgcccagaagcgcctcgtcggcttctggagccgcttcggcttccgcgtcttcgagggcgcgcaggagctggtcttctcggacttcgactacgtcgagatgctgatggaggcggagccgcacccgcaggcgatcggcctcggcgccgacccctacgtcatcatccggccggaggggcgctggcaccgggcgggcgccctcgaccgctcgcggagccgcgccgtgacccgcccgtccgtcgaccgggcggtggccgcgcgatga

SEQ ID NO: 5350 - DNA, 1281 bp, Methylobacterium sp.
gtggccattgatccgaggaatctcgcccagacggcgacactcacctacagccaggacttcgacacgctgccgctctgggacggcacttcgggtctcgacacgtccggcggcccgcagtggagcatccacgtcacgtcgaccgggacgcggcccttcaatcgggagcagcaatggtacgtccgcgccgatcaacccgacggcagcgcgctcccgaacccgttccgcgtccacgacggcatcctcaccatcaccgccgcgccgtccaatccgtctctgctccaggacctgggggatcagccctacacgtcgggcatggtcaataccttccacagtttcagccagacctacggctacttcgagatgcgggccgagctgcccgccggtcagggcttctggccggcgttctggctgctcccagcggacggttcctggccgcccgagatcgacgtgatggagatgctcgggcacgatcccgacacgctctacaccacggtgcacagcttggcgcccggccagacacccggcaaccacaccatgagccaggggatctccgcagtcgccgacatgagcggcggctaccacacctacggcgttgactggcaaccggacacgctgaccttctatttcgacggacaggagatctatcgtacgccgacgcctgccggtctggacaagcccatgtacatgatcgcgaatctcgccgtcggcggctcgtggccgggcgacgccgacgcgtcgacgccatttcccgcgcagatgaatattgactacatgcgggcttatcaggccagtccgggcgccgcggcgcttgagccggtttttcacttctacgacgccgcctcagggcggcatttctacacggcaagcgctgcagaacgcgcgcagcttgagagcaccccgtcgggctacgcctatcagggcgttggctgggccgcgcccgtgtcgtcgcctgccacggctgacgtctttcgattcaccaacccgacgaccggcgaccacttctacacgaccagcaccgcggagcgcgacgggctcctctcgggcggttccggctacaactatgacggtgttgcgttcgacgcctacgcgagttcgaccgccgcgggatcgcatgcgttgaccgtcgagcggttcgtcaacaccgagagcggacggcactactacgcttcaagcgccgatgagatcagctacatcgagcaaggtcacgccggcagcggctggattgatgagggtcatgccttcacgttgcatgctccgactgcgaacatgtttggcatgtaa

SEQ ID NO: 5351 - DNA, 264 bp, Methylobacterium sp.
atggccgacgacctgaacggactctccgacaaggctctctcgatcctcgccttcgcggcctatcaccggctcgtcagcggcgagacggtcacctcggtgatccgccgtgacggcgccggccacgaggccgacccagagggcgtgaaggagctggaggggcgcggcctcgtcaccgccggcgagagcgccatcgacctcggcgagaccgcgcaggcggcggtcgagacgatggtcgccgccctgcgcagagaggtcggccgctga

SEQ ID NO: 5352 - DNA, 1143 bp, Methylobacterium sp.
atggcaacgatccgaaagcgaacgcttccatcgggcaaggtccgatggctggcggggtattctgatggcggagggaagcgccgcttccgccaattcgagacgaagaaggaggcagacgccttcctcgtccaggcgcgcacccaggtcgcgaccggcgtgcacacgcccgactcggtctcgccgaccgtcgccgaggccgcggagctctggctgaagcgatgcgagcgcgacaagctcgagcggactacgctgctgcagtatcgcggccacctgacccaccacatcgggccccggctcggcgcggtgaagctctcgcggctcacggtgccactgatcaacgagttcgccgatcagctcctcacggccggccgctcacgggtgctcgtgtcccgggtgatggtgagcctgtcttcgatcgtgacggaggcgcagcggcgcgggctggtgacggcgaacaacgtgcggagcgccaaaccggtgcggcgctcatcccgcgaggacaaacggccggagatgcccagccgggacgagctgaaggcgatcattgcggcgacgcctgatcagtggcggccgctcatcctaacggcgatcttcaccggcctgcggggttccgagctgcgcgggctgacatggggcgatgtggatctgaggcgcggcgtgctgagcgtccggcagcgggtggatcgcttcaacaccttcgggccgccgaagtcgaaggccgggacccgggacatcccgctgccgccgaacctgctcaccaccctgaaggcgtggaagctcgcctgcccgaacgggccgctcggcctggtcttcccgacggtagacggtacggtccagggccacgccaacatcctccaccggtgcttctggccgcttcaggtaaaggccggagttacggtgctgaaggatggccaaaatgagcaggggagggcaatcaaggttccggaggcgaagttctcgctccatgccctgcggcatgccgctgcggcgctctggatcgaacaagggctatcgccgaagcgtatccagaccttgatgggccatgcctcgatcgcccagaccttcgatcagtacggctacctgttcgaggcccgagacgatgaagctgccatgatggcgggcgttgagaagggtctgctctga

SEQ ID NO: 5353 - DNA, 1572 bp, Methylobacterium sp.
atgccgatcgagacgtcgagagcctggggccgcggcgagctgtacgagaccctgtgcctcctcgtgatcggcgtcgggatctggttcgtcggcgtcacgctcgggaccttcgcgtacctgaacagcgtcgtcgccacctacaacctcacggacctgctgctcctcgccgcctgcatgggcgtggcgcagtggggcgccagcatccgcaaatcgatcatcctccggcggctcatgctcgagcgcgccgccgccgccgcgcaggccgaggcgatcgcccggcacgacgggctgaccggtctggcgaaccgtcgccgcttcatcgacgccgtggagcgggcgcacgcgccgggcgccgcggacgcggcggtgctcctcatcgacctcgaccggttcaagccggtcaacgacctctacggccacgcggccgggaacgcggtgctgtgcgccgtggccgagcgtctccagcagctcgtgccgtcgggcggcctggcggcccggctgggcggcgacgagttcgccatgctggtcccgctccgctacgagagcgaggcgctgcggcgcctcgcccaggcggtcctcgcgcgcatcgccgagccggtgacgtggaaccagaacgacctgaaggtcggcgccacggtcggcgtcgccgcggtgtcggccgagcagggggacgccgacgcgatcctgcacgcagccgacctcgccatgtaccagggcaagaaggacgggcgcggcaatgtccgcttcttccgcagcgccatggacgcggagctgcgcgcccgcgcccgcatggagacggaacttcgcctcgccatcgagacgggcgcgatcgagcccttctaccagccggtggtgtcgctccccgagaaggagatcgtcggggtcgaggtcctggcgcgctggcgccacccgacgcgcggggtggtgggcccgagcgagttcatcccggtggccgaggagaccgggatgatcgcggatctcagctacagcctgatccgccgcgcctgcctggatgcccgggcctggccgccgcacctgatcctcgcggtgaacatcgccccgcagcagttccaggacgcgtggctcgcccagcgcatcctcgggatcctgaccgagaccggtttcccgccgcagcgcctggaggtcgagatcaccgagagcgccctgatccaggacctggaggcgacccggacgaccctgctgtcgctgcgcgaactcggcgtgcgcatcgcgctggacgatttcggaaccggctattccagcctgtaccacctgcgcgaactgaagttcgacaagctgaagatcgaccgcagctacgtcgacgccatcacgatgagcgacgagcgggcgaagctcgtcgacgccatcatcaagctcggggcgagcctcggcctctccaccaccgccgaggggatcgagaccgacgccagcctcgactggctctccgaacagggctgccatttcggccagggctacctgttcggccacgccatgccgaaggccgagatggacggcgtgctcgccgccgcgcgatccccggccccgttccaggatctcgcgcgggcctcgtga

SEQ ID NO: 5354 - DNA, 1572 bp, Methylobacterium sp.
atgtatacgagtcgccgtcagattctgctgtccggaggcgccggcctcgtcgggctggccacgggcctcggacggcccggcctgagccgcgccgccgaccggccgctcctgacccacggcctccagtcgggcgatgtcggcaccgactcggcggtggtctgggcccggtccgaccggccggcccgggcgatcgtcgagtgggcgaccaccgagagcttcgccgacatccgcggcggcgtcttcgccgacgccctgccggagaccgacggcaccgtgaaggtggcgctgaccgggctgccggccggccaggacgtgttctaccgggtccgcctggaggacgtcgccgcgccgaccatcgtcgggccggcccaggtcgggcggttccggaccgcgccggcggaccggcgctcggtctcgttctgctggtcgggcgacacggcgggccagggctggggcatcgacgaggcccgcggcggcatgacgatctactccgccatcctgaagaaccggccggacttcttcatccattccggcgacacgatctacgccgacgggccgatccagtccgaggtgaagctccccgacggcagcctgtggcgtaaccgggtgaccgaggaggtcgccaagccggccgagacgctcgcggagttccggggccggcacaagtacaatctcaccgaccggaacgtcctggcgatgaacgccgccgtgccgatcctggcccagtgggacgaccacgaggtcaccaacaactggtggccgggggagccgctgacccgggccgagcacctgaagaagaagtacgccgacccgaacgtgctggccctgcagctgcgcgcggcgaaggccttccacgagtacatgccgatgcgcttcgagccgtcggagcccggccgggtctaccgcaagatcggctacggcccgctggtcgacgtgttcatgctcgacatgcgctcctaccggggcccgaacggcgagaaccggcagacggaatacgggcccgagtcctacttcctcgggccgcagcagatcgcgtggctgaagcgggcgctgctcgagtcccgcgccacctggaaggtgatcgccgccgacatgccgctcggcctcgtggtgacctacgacaccgaccgcaatttcggctcggaggcggtggcgcagggcgacgggccgccgctcgggcgcgagctggagatcgccgacctcctgcgcttcatcaagagcgcggggatccgcaacacggtctggctcacggccgacgtgcactacacggccgcccactactacgaccccgacaaggcgcagttccaggatttcgagccgttctgggagttcgtctccgggccgctgcacgccggcaccttcgggccgaacgcgctggacaacacgttcgggccgcagctgcgctacgtgaaggcgcccgacaaggggcaggtgaacctgtcgccggccgccggctaccagttcttcggccacgtggcggtggacggcgccaccgagcagatgacggtgaccctcaaggacgcggccgacaccgacctctggcacgtcacgctcgatcccgcgaaggcgtga

SEQ ID NO: 5355 - DNA, 828 bp, Methylobacterium sp.
atgcgtacggccctggcgcggttcgcgcgcaaccgcctcgccctcgcgggggcggcggtactcttcgggctggtcgtcctcgtggcgctcacgccgctcctctatcccggcgatccgttcgcgctcgtcggcccggccctccagccgccaggcggacagtttctgctcggcaccgacacgctgggccgggacgtggccgccgagatcgcgtacggcgcccgcacctccctgatcatcggcctcagcgccaccggggcggcgatcctgctcgggaccctgatcggcggtctcgccggctactaccggggcggcgtcgagatcgcgctgatgcggctcacggagttctttcagacgatccccgccttcgtgctggcgatcctgatcgtggccatcctgtcgccgtcgctgttcagcgaggtcgtggccatcgtggccgtctcctggccgggcatcgcccggctcgtgcggggcgagttcgtggcgctcggcggccgcgaattcgtgttggcttgcgacggcctgggggcgggcgacacgcggatcatcttccgccacatgctgccgaactgcaccgcggcgatcatcgcggtcggcacactcctgatcggcaccgcggtcctgatcgaggcggggctcgccttcctgagcttgagcgatcccaacgtgatgagctggggcctgatcatcagctcgggccgcgcggtcctccggtcggcatggtggatctgcaccttccccgggctggcgatcctgctgaccgtcctcgcgatcaacctcgtcggggacggcctgaacgaggtcctgaacccgaggctccgagagcgatga

SEQ ID NO: 5356 - DNA, 909 bp, Methylobacterium sp.
atggctatcgacacgattgaacacacgctgcgcgcgatgggaaacgcggcgcgaggcctggccgcgatcggtgcggccctgcgattgcggcaagacgcgatggaacacgcgcgggaagacgcgcgggaagatgcgccggaggtcgatcccgaggtggcgcgccgagtgctcgacgtggtcgccgccgtcatcccggggggcctcggtgacctcgaaccggagcgggtgtccgcgctcctggcatccgtcacccacgcgctcgaggaggcgcgggatctgctggatcacccggagcggccgccggtctggcaggttcgcgatcccgcgatgttgcaggctcaaggccaggcgtcgcgcagcgtcgtgcggcgcctggcggccttgtcgaccgagcgcccgtcgctcgcggccgcgctcaccgggcgcttcctggatgtcggcaccggcgtgggcggcatcgcgctggaggccgcggcactgtggccctcgctgcgggtcgtcggcctggacatctgggagccggccctggctttggcgcgcgcgaacgtggcggcgagcccctttcacggccgtatcgaactccgcctgcaggatgtgacgcggttcgatgactcggcgggctactcgctgacgtggcttccggcacccttcctctctcgggacgcggcccgaacagcgctcgatcggctgacggccgcgctcgagccgcgggggtatctggtggtcggactctacgcgccgccggcggatccggcggccgccgcgctcgctgccctgcggctggcccgcagtggcggacatctgtgggaatgcgcggccatggaggctgaacttcgcgcacgcgccttcaccgcggtcgagacctgtgcgggccagccggtcacgctcgtgatggggcagcgcgcgtag

SEQ ID NO: 5357 - DNA, 969 bp, Methylobacterium sp.
gtgaccgacgagacgccgcgcgccatgaacggggccgagagcttggtccggaccctcgtggagggcggggtcgaggtctgcttcaccaatcccggcacctccgagatgcacttcgtcgccgccctcgaccgggtcgagagcatgcgctgcgtcctgttcctgttcgagggcggggcgaccggcgccgccgacgggtacgcccgcatggccgacaagccggcctcgaccctgctccatctcgggcccggcctcgccaacgggctggccaacctccacaacgccaagaaggcgcgcacccccgtcgtcaacatcgtcggcgagcacgccacctaccaccgcgagtacaacgcgccgctcacctcggacatcgaggggctggcccatccgatgtcctcctgggtgcggaccggcatgagcgcgaccgagatcgggtccgacggcgccgccgccatcgcggccgcccggaccgccccggggcaggtcgcgaccctgatcctgccggccaacaccgcctgggatcccggcgccggccccgcgccggtgccgccgatccccgagcgggcgcgggccggcgacgacgcaatcgcggcggccgtgcaggcgctgcagagcggcgagcccgtgctcctgcatctcggcgaccgggccgtccagggcgagggccgggtcatcgccgaccggatcgcccgcaagaccggcgcccggctcatggcgatgacctccaacgcccggatcgaccgcggcgccggcaccgtgccgatcgagcgcctcccctacccgatcgaccagggcatcgacgccctgaagggcttccgccacatcatcctgatcggcgcgaccccgccggtgggcttcttcgcctacccgggcaagccgagcctgctggcgccggagggcagcaccacgatcacgctggccacacccgaggaggaccagatcgacgccctcgagcggctcgcccaggccgtc

SEQ ID NO: 5358 - DNA, 1392 bp, Methylobacterium sp.
atgcccgacatcgatcccgtacacgcctccgcggcggagctcggccgcgcgatccaggcgcggaccctctcgccggtcgacgccgtcgacgccctcctcggccggatcgaccggctggagccgaagctccgagccttcacggaggttttcgccgccgatgcccgcctcgccgccgagggggccgaccgggcgatccggtcgggccacgccgtggggccgctccacggcgtcccggtcgtgctcaaggacctgatcgacctggagggccggatcaccatgggcggctcggccgcccaccgggcgcgccgggccgcgcgcaccgcaacgatcgcccggcgcctcatcggccagggcatgatcgtgctcggcaagacccacacggtcgagttcgcctacgggggctggggcacgaaccagcatctcggcaccccgtggaatccctgggacgccgagacgccgcgcacccccggcgggtcgagcagcggcaccggcgtgtcggtggcggcccggatggcgccctggggcatcggcaccgataccggcggctcggtgcgcctgccggcctccttctgcgggctgacgggcctcaaggtgacggtcgggcgcgtctcgacctgggggatcgtgcccctctcgatgaccctcgacacgcccggaccgctggcccgcaccgtggaggacgcggcgctgctctacgaggcgatctccggccccgatccccgcgatccgacgacccgcggggtcgcgccggacgcgccctggccggccctgaaccgcggggtccgcggcctgcgcctcggccggatgccggcctcggagcgggacggggtcgcccccgacatgctggccgcctacgacgcggcgctcgacctcctggccggacagggcgccgagatcgtcgacgtcgtcctgccgttccggttcagcgactgcgtggccatgagccagatcaccaacgcggaggcctacttcgtcaacggagacctggcggaggatccgtccgcccagctcggcgacgccgtccgggcccggatcctggccggcgcgaacgtctcggcccaggagtatctcggcacgctccaccgccgggccgcgatgaagcagcagtacgacgccgccctcgcgggcatcgacgccctcctgacgccgaccacggagagcgcggccgtcgcgctcgacgccgtcgacgaggcgcatctcccgtcgcgcttcacccgtttcggcaacctgctcgatctctgcgccctggcgctgccgaacggcttcaccgcgtccgggctgccgctctcgctgcagatcgtctgccgcggctacgaggagacgacggccctgcggatcggacaggcctaccagcgcgcgaccgactggcacctgcgccggccgccggtgtga

SEQ ID NO: 5359 - DNA, 1176 bp, Methylobacterium sp.
atgaacccgttcaccttccagaccacgccgaacgtgctgttcgaggccggcgccgcgaagaagctgcccgagatcgtcggcagcttcggggccaagcgcgtcctgctcgtcaccgacaagggcgtgcgcagcgccggcctcacccaggccgccgaggcggcgctggcggaagccggcgtcaccctcgacgtctacgaggacgtggtcgccgacccgccctcgacggtgatcgaggcggcggccaagcgcgcccgggaactcgggaccgacctcgtcctgtcgatcggcggcggctcggcgctcgataccgccaagctcgtggcctacctcgctaagtccgacgagccgctcgattcgatctacggcgtcggcctcgccaagggcgaccgcctgccgctgatcctcgtgccgaccaccgccggcaccggctcggaggtgacgccgatctcgatcgtcacgacgccgaccaccgagaagaagggcgtcgtcgccccgaaactcctgcccgactgggcggtgctcgacccggagctgacgctcggcctgccgtcgcacgtcacggccgccaccggcatcgacgccatggtccacgccatcgaggccttcaccagcaagaacaagaagaacccgatctccgaccagctcgccaagcaggcgctggcgctgctctcggccaacatccgcaccgcctgcacggacgggaagaacctcgaggcgcgctccggcatgctgctcggctcgatgctcgccggcatggccttcgccaacgcgccggtggcggcggtgcacgccctggcctacccggtgggcgcgatcttccacgtgccgcacgggctctcgaacgccctggtgctgatgggggtgatgcgcttcaacctctcgcacgcggaggcgctctacgccgagctggcgccgatcctcgaccccgccgccgcggatctgccgcggcccgaggccgccaagcgcttcgtcgagagcctcgacgcgatctgccgcgactgcaaggttccggcctcgctggccgaagtcggcgtcgcccggcaggacctggagcgcatggccaccgacgcgatgaagcagacgcggctcctcgtgaacaacccgcgcgaggtgacctacgacgacgccttcgcgatctacgccgaggctctgggcgaggcgcggccggcggcgtga

SEQ ID NO: 5360 - DNA, 1188 bp, Methylobacterium sp.
atgaccgacgcggtgatcgtctcgaccgcccgcacgcccatcggcaaggcccatcgcggcgcgctgaacctcacccgcggcgccgacctcgcggcccacgcgatccgcggcgccctggaccgggcgcgcctggagcccgcggccgtcgaagaggtggtgctcggctgcggctatccggagaacgccacgggcggcaacgtcgcccgccacgccgcactcgtggcggggatcccggtcgagtcggccggcgtgaccgtctcgcgcttctgcgcctcgggcctcgaggcgatcgccagcgcggcgcggcggatcgtgctcgacggcgtgccggtggcggtggcgggcggcgtcgagtcgatcagcctcgtccagccgaaggtccagcgggagctgacccgcaacgcgtggctggaggcgcatctgccggcgatctacatgccgatgatcgagaccgccgacatcgtggcggagcgctaccggatctcccgggaggcccaggaccaattcgccctggagagccagcgacggaccgcggcggcgcaggaacgcgggctgttcgacgacgagatcgtcccgatgagcgccgtcatggcggtgaccgacaaggccaccggcgagacccgggaggtcgagacgcggctcgccaaggacgagggcaaccggccggacacgaatctggagggcctcgccaagctcaagcccgtgcgcggggagggcgcctacatcacggcgggcaatgccagccagctctccgacggggcctcggccagcgtgctgatgtcggccggcgaggcggcgcggcggggcctcgaaccgctcggcaccttccggggcttcgcctcggcgggctgcgggccggacgagatgggcatcgggccggtcttcgcggtgccgcggctcttggagcgccagggcctgcgcgtctccgacatcgacctgtgggagctgaacgaggccttcgcgtcccagtcggtctactgccgggacaagctcgggatcgaccccgagaaggtcaacgtcaacggcggcgccatcgcggtcggccacccgttcggcatgtcgggggcgcggctcgtgggccacgccctgctggagggccgccgccgcggcgcgcgctacgccgtcgtgaccatgtgcgtcgccggcggccagggctgcgccggcctgttcgagatcgcccggagctga

SEQ ID NO: 5361 - DNA, 1197 bp, Methylobacterium sp.
atggacctgcgcttcaccgacgaggaaatcgcgttccgcgatgaggtccggaccttctgccggacggagatcccggcggagatccggaagaaggtctcggaggggcgcagcctctcgaaggaggactacgtcacgagccagcggatcctcaacgccaagggctgggcggtgccgcactggccgcaggaatgggggggccgggactggaccccgatccagcgctacatctacaccgaggagctgttccaggcggcggtgccgctgccgcagcagttcaactgctacatgttcggcccggtcctggcgaccttcgggcggcaggaccagaaggaacgcttcctcccccgcgccgccaacctcgacgactggtggtgccagggcttctccgagcccggcgccggctcggacctcgcctctctgaagaccagggcggtgcgcgacggcgaccactacgtcgtcgacggccagaagacctggaccacgctcggccagcacgccgactggatcttctgcctggtgcggaccgacttcgaggccaagaagcagcgcggcatctcgttcctgctcatcgacatgaagacgcccgggatcaccgtgcggccgatcctgacgctggagggccggcacgaggtcaacgaggtcttcttcgattccgtgcgcgtgcccgtcgagaacctcgtgggcgaggagaacaagggctgggactacgcgaaattcctgctcgccaacgagcgcaccggcatcgcacggatcgggctgaccaaggagcggatcgcccggatcaagcggctcgcccgcgagatgccggccgggcccgggacgatgtgggacgatcccgccttccgcggccgcgtcgcggaggtcgaggtcgagctgaaggccctggagatcacccagatgcgggtggcggccaagcagggaagggcggattcggtcgagccggacccggcctcctcgctcctcaagatccgcggctcgcagctccagcaggcggcgaccgagctgctggtggagctcgccgggcccttcgccctggcggcgcccgcgcgcggggccggggccaacaacctgcccggcggcttcgactgggtcgacgcggcggcgccgagctacttcaacaaccgcaaggtctcgatctacggcggctcgaacgagatccagcacaacgtcatcgccaagggcattctggggttgtga

SEQ ID NO: 5362 - DNA, 1155 bp, Methylobacterium sp.
atggatttcgacctgaacgaggaccagtcgctcctgcgccacagcgtcgagcggctggccgccgacctctacccgtcgctggagagccggcaggcgcgactcaaggcgcccctcggcttccccgaggacggctgggcggccttcgcggaactcggcgtcgccggcctgcccttctccgaggatgagggcggcctcggcggcggcccggtcgagaccatgctggtcatggaggcggtgggccgcaacctcgtggtcgagcccctgctcgcgagcctcgtgctcggctcgacggccctgcggctcggcggcagcgccgcgcagcgggagcgcctcgtcccgggtctcgtcgccggcgacctgcgcctgaccctcgcccacaccgagcgccagtcccgctacgacctcgccgacgtggcgacgaccgcccgtcgcagcggcgacggctacgtgctgagcggggcgaagagcgtcgtgcctaacgccgacgcggccggcctgatggtggtctcggcccgcgtctcgggcgagcggcgcgccccgagcgggatcggcctgttcctcgtcccgaccgacaccgccggcgtcgccatcgaggcctacccgacccaggacggcggccgggccgccgaggtgtccttctccgacgtgacgctcccggccgacgcggcgctcggcgacccggagggcggcctgccgctcttggagcgggtggtggagcacggcatcgcggcgctcgccgccgaggcggtcggctccatggacgcgctccacaagctcacggtggagtacctcaagacccgcaagcagttcggcgtcagcgtcggctcgttccaggcgctgcagcaccgggccgtcgacatgctgatccagctggagcaggcccgctcgatggcgctctacgccgccatgatggtggacacacccgagccgcgcgcgcgggccgcggccctgtcggccgtgaaggtgcagatcaacaaggcctgccgctacgtcggccaggaggcggtgcagctccacggcggcatcggcatgacgctcgagtatatcggcgcccaccacttcaagcggctcgccatgatcgagtaccagctcggcgacaccgcccaccacctgcgccggatcacgcaggacgagaacgggctgctggcggcgtag

SEQ ID NO: 5363 - DNA, 858 bp, Methylobacterium sp.
atggaggtggaggccggcccgcgcgccggattcgacatcgggctcgacaccgccgagcccgacgtggccgagcccgacgtggccggggccggcgcgaaggaggaccggcacttcgtcacggcgctggcccgggggctgtcggtcctcgcctgcttcggcccggggcgcacgagcctcgccaaccacgacattgccgaggcctgcggcctgccgcgctccaccgtgtcgcggctgacctacacgctgaccaagctcggctacctgcagcacatgcccgagctcggccgctaccggctcggcaccgccaccatcgcgctgagctcggccgccctgggcggcctcgatatccgcgccatcgcccggccggtgctgcgcgcggtcgcggaggcggccaacgcctcggtcggcctcggggtgcgcgacaggctcagcatgcgctacgtcgactgccagcgcggcccggccgcgatctcgctcaacctcgacaccggctcgcgcatctcgctggcccgcagcgccatgggccgcgcctacgtggcggtctgcccggaccgggagcgcgcgggcatctacgaggacctgaaggcgctggatcccgtggcctggccggtgctgcgcgccggcctcgaccgggcggtggaggagcaccgggaactcggctgctgcacctcgttcggcgagtggcaggagacggtctgcgccatcgcggtggggttccatcccggcggcggcctgccgcccatgtcggtcaattgcggtgcccccaccgtcatcaccgacgcgcgcttcctcctggaggtggcgcgcccgagactgatcgacgccgtgcgcagcctcgacggcgtcatgggagcctga

SEQ ID NO: 5364 - DNA, 147 bp, Methylobacterium sp.
atgtccgccgcccgtagcgtcctgagccgcgtccgcgcctatctccggtaccgcgacaccgtcacccagctgtcccgcctgtcggaccgcgatcttgccgatctcggcatcaaccgcagcgagatccgcggcgtcgcccgcgtctga

SEQ ID NO: 5365 - DNA, 339 bp, Methylobacterium sp.
atgacctatgtcgtcaccgagaactgcatccgctgcaagtacaccgactgcgtcgaggtctgcccggtcgactgcttctacgtcggcgagaccatgctggtgatcaacccggacgagtgcatcgactgcggcgtctgcgaaccggaatgcccggccgatgccatcagggccgacaccgaaccggagatggcgggctggaagaccttcaacgccaagtacgccgatctctggcccaacatcaccgagaagaccgagccggccgacgacgccgcgacgtgggacggccgcgacggcaagctgctcgacctgttcgggactgccgacccggcatctgcctga

SEQ ID NO: 5366 - DNA, 696 bp, Methylobacterium sp.
atggacgtggtggtcggccacaagggcaaatcggccgcccgcctcaccttccgcggcaaggccagccactcggccctggcgccccagggggtcaacgcggtcgagtacgccgcccgcttcatcgagcatgtccgcctgtcggcggaggccatcgcccgggacggcgcccgcgacgcgctctacgacgtgccccacaccaccggcctgtcgagcgtggtccggggcggatcggcgctcaacatcgtgcccgacagctgcagcgtcgagttcgagtaccgggcgatcggcgcggacgatgccgccgcgctggcggcgtccgcgatcgcctacgccaccgggacgttggcgccgctgatgcgggccggcgatccggcctgcggcgtcgcggtcgagccgctgatcgattatccgggcctcgacaccgatccggaggcggcgatcgtgaccctggccaagcgcctcgcgggccgcaacggccacgccaaggtctcgtacggcacggagggcgggctgttcgagcggctcggcggcgtgccggccgtggtgatcgggccgggctcgatcgcgcgcgcccaccgggcggacgagtacgtcacccgggacgaactcgcggcctgcgcgggcttcgtgcggcagctgatcggcgcctgcgtgaccggctccgcggcggcgtcccagggtgcgctcccgggctga

SEQ ID NO: 5367 - DNA, 390 bp, Methylobacterium sp.
atgacccaggcgggtatcgaactggtgagagccgagcggcgtcgacgctggacgcgggcggagaaggagcggttggtcgccgcttcgtttgaaccgggtgtgtcgacctcggatgtcgcccgccgggccggtctccacgtcagtcagctgttccgctggcgcaagttgctgtgcgagcgtgtcggtgctcccacgccagcgctggtccccgtcgtgatcactcccacgtccgccgcgatgacggtcgagcctggtcgagcgcacaaccgcggccgtcgctccggcggagtgatcgagatcgatctcggcagaggccggcgcgttcgggtcggctccgacgtcgatgccgcggcgcttcggcgggtgctcgacgccctggagggccgatga

SEQ ID NO: 5368 - DNA, 240 bp, Methylobacterium sp.
gtgctgcgggcggcccatcggcacagcgcgcggcacgccgacgaggtcaggagcagcgtcctgtgcggatgcttcttctgcctcgaggttttcgcgccggacgagatcgcgggctggatcgccgatgagggcaccgccctctgtccccggtgcggcatcgacgcggtgatcggcgacctctccggctacccggccgggagcgccgcgttcctgcgggcgatgcgggacgaatggttttga

SEQ ID NO: 5369 - DNA, 330 bp, Methylobacterium sp.
atgcatcgccgggaccgggacatcgacgcggcggcgtaccaagcggaccgctacggctgggagccggacgacagggactgggacgacgaccgcgacacgcggcggccgcgcagaggcgtcttcggccggttcttctcgccgacgaagctcgcccttctcgcggtgccggccggccttttcttgtacggcagcttcgcggattgcagcgcccgcccggcggcgggctggctcgggctcgtcggggccggcgcctgcgcccgcaccgagatgctcggcaacgtcctgtcgatccaggacaacctcgcgcttctgaagcggctcatcgactga

SEQ ID NO: 5370 - DNA, 1686 bp, Methylobacterium sp.
ttgctgacgccgcggtggacgccgccggggcagccggccggtggcgcattcacggtctcggagatccgcttgtcccgctcagccctgaagaccctcgcccgcggcgtggccgcgagcacggtcgcgacgttcgcgctcgccgcgctgcccgcgcaggccgccaacgtcttccgcttcgccttccagggtgacttgaaatccctcgacccgtactccctcaaggagagcttcacggaagggatgcagcaggcggcctacgagtccctcgtcaccctcgacaagaacctgaaattcgcccccggcctcgcggaatcctgggagacgcccgagccgacccgctggcgcttccacctgcgcaagaacgtcaagttccacgacggcacgccgttcaccgccgacgacgtgatcttctccgcccagcgcgtccgcgccccgggctcgaacttcaccaccaacgtgcccgccgacgccgagttcgtgaaggtcgacgacttcaccgtcgacatggtgctgaagaagccgaacccgatcgccatcgcccagttcccgacctgggtgatcatgtcgaaggcgtggtccgagaagaacggcgtcgtgcagccgacgccgcccagcgccaccagcccgagctacgccacgctgcacgagaacgggaccggcccgttcgtgatcaccgagcaccagcccggcgtgaagaccgtcttcaagaaattcgacggctactggggcaaggtggagtcgaacctcgacgaggcgatcctgaccaccatcgccaacccggcgacccgcgtcgccgcgctcctctccggcgaggtcgactggatcgacccggtgccgctgcaggaccagcagcgggtcaacgccagcggcaccgccaccgtgatggcgggacctgagctgcgcacgatcttcctcggcatggaccaggaccgggacgagctgaaggattccagcgtcaagggcaagaacccgttcaaggacatcaaggtgcgcgaggccttctacctcgccatcgacgaggacacgatcgccaagcgcgtgatgcgcgggcaggcggtgccctccgcgctgatgatcgccccggccctctacgaccgcggcgccgagttcaagcgcccggccaccgacctcaagaaggccaaggagctgatggcccaggccggctacccggacgggttctcgctgaccatggattgcccgaacgaccgctacgtcaacgacgaggcgatctgccaggcggtggtctcgatgctggcgcgcatcaacgtcaaggtgaacctgaacgcccagccgaaggccaagtacttcgccaaggtgctggcgccggcctacgacacctcgttctacctgctgggctggaccccgtcctcgctggacagccacaacatcctctacgagatcgtcggctgccggaagccgggcgacaagtcgggccggggcagctggaacctcgcgggctactgcgacccgaagatcgacgcgatcgccgacaaggtcgagggcgagaccgacaagaccaagcgcgacgcgctgatcaaggagggcttcgacgtcctcaacgccgactggggctacatcccgctgcaccagcaggcgctggcctggggcgtctccaagaaggtccacctgacccagcgcgccgacaacctgctgctgctctactgggtgtcgaaggacccgcagtag

SEQ ID NO: 5371 - DNA, 981 bp, Methylobacterium sp.
gtgctcgccttcctgctgcgccgggtgatccaggcggccgcggtcctcgcggtcgtcgggctcatcgccttcgcgatgttccggttcgcgggcgaccccgtgaaccagatcgtcgggcccgacaccaccgtggccgagcgggcccagatccggacggatctcggcctcgacgacccggtgctggtccagttcgtccgctacgccggcaacgtggtgcggggccggttcggcatctcgtaccagttccggcagccggtctcgcagctgctcgccgagcgcatgccggcgacgctggaactcgccttctgcgccacgatcttcgccctcgtggtggggatcctgatgggcgtgtactgcgcgctgcgccgcgagtcctggctcgccgggctgttccaggcggtctcgctgatcgggatcagcctgccgaccttcctgatcggcatcctgctgatctacctgttctcggtgacgctcggctggctgccctcctacgggcgcggcgacacggtgcggctcggctggtggaccaccggcttcctgaccgcctccgggctcaaggcgctgatcctgccctcggtgacgctcggcctgttccagatgacgctgatcatgcggctggtccgcgccgagatgctggaggtgctgcgcaccgactacgtccgcttcgcccgggcgcgggggctcaccacgcgcgccgtccacctgcggcacgcgctgaagaacacgctggtgccggtgatcaccatcgcggggctgcagctcggctcggtcatcgccttctcgatcatcaccgagacggtgttccagtggcccggcatgggcctgctgttcgtccaggcggtgcagaacgtcgatatcccgatcatgtccgcgtacctgctgctcgtcgcgctgatcttcgtgaccatcaacctcgtggtcgacatcctctacacggtggtggacccgcgcctgcggctgcccgccgggcggacggcgtga

SEQ ID NO: 5372 - DNA, 2019 bp, Methylobacterium sp.
atgacggcagtcggatcgttcggaatcaacggtcggttcctcacccagccgatgaccggggtccagcgctacgcgatgaacgtcacccgggcgatgagcgcggccctggccgctcggggggagagcgcccccttgctgtccgtgccggacgcggaggatccccgtctcgcaggcacgccgctccgcaccgtcggaccggcgggtgggcatgcctgggagcaattcgtcctgccgcgcgcctggcccggccgattgctcaacctctgcaacaccgcccccgcgctgaaggcggatcaggtcgtctgcatccacgacgcgaacgtgttcaacgcgccggagagctacagcgcgtcgttccggaccttctacaggacgctccagccgcttctggcccgccgtgccgcgcggatcgccaccgtctccagcttctcggccggacagatcgccaaccatctctcggtgagagcctccgacatcgtcgtgctcccgaacgggcacgagcacgtgcgcgcctgggatccgcgacaggccgtccgggcgcccgcggccctggatcgggacgccgacggcctggagcgccccttcgtgctggccctcgggtcccgcgcccgccacaagaacctcgatctgctgctcaaactggcgcccgccttggatgagctcgggctcgacctcgtggtggcgggcggccaggcgaccatctacgccgccgaggacctgcggcgcggcgagaatgtccgccacctcggcttcgtcaccgaccacgacctcgcctacctgatggagcgcgccctgtgcctggccttcccctccctcacggaggggttcgggcttccggcactggaggcgatggcacgcggctgccccgtcgtctcgaccgaccgcgcgagtttgccggagatctgcgggtcggcggccctgctcgctccgccggaccggccggaacgctggctcgaccagatccgcgccctggccgcgagcccggacctgcgatcggacctgatcggccgcggtcgcgatcaggccgccctcttctcgtgggaggcttcggcgcagggctacctcgatctcatgcgggcgccgaaggtgcggacggccgcgcagccatccgcgcgatccgcgacaccgccatccccgcccagcatcgccgtcgccatcgcgacgctgggccgtcccgaggtggtgaccggcacgctgcggcggatcctggatcggcagaccctgaagcccgccgccatcctgatctcctgcgtcaccccggacgatgccggtgaggcggccgcgtggcccggcgtgacggtggtcacggggcgtcccggcctcgccactcagcgaaatgccgccctcgccgcgctgcccgaggcgatcgatatcgtggtcttcttcgacgatgacttcgttcccgaggccagctggctcgcagcagccgcgcagcgcttcgaagacgagcccgacatcgtcggcctgacgggcgacgtcgtcgcggacggcatcaaggggcccggactgcgcttcaccgaggtcgaccgcatgctcgccgcgctgggtccggtcgagccggcggcgcccatcgaggccttcagcccgtacggctgcaacatggcgttccgtcgctcggccatcggcacgctgcgattcgacgagcggctcgtcctgtacggctggctcgaggaccgcgatttcggcgcggccctggcggccagagggggccggctcgtcaaatgcatggaggcccgcggcgtccatatgggcgtgaaaggcggccgcatctccggcgatcggctcggctattcgcagattgtcaacccgctatacatgctgcgaaagggcacgatgaccctgtctcaagtcttcggccagattacccgcaacgtcctcagcaacgtgacgcgcttcgcggcccccgagccgttcatcgaccggcgcggtcggctgcgcggcaatctgcgcggcgccgcggacgtgctcctgggacggctggagcccgagcgggccctgaagatccggcggaaagcgtga

SEQ ID NO: 5373 - DNA, 651 bp, Methylobacterium sp.
atggcgatcgacccgaccctgcgcgacgcgctctccgccgtgacaccggcgagcctcgcccgcgccctggcgcgggccggggtgaaggcctgcacgccgcacgggctctcggcgcgggggagcggaaccgtggtcgggcccgcctacacgatgcggatgatcccggcccgtgacgacgccgcgggcgatctcgccgcggcgatcgacgccgtgcccgaaggcgccgtggtcgtgatcgatgccgcggcctccgcccttgccctgcccttcggagcgatcctggcggcacgcctcgcccagcgcggcgccgtcggcctgatcaccgacgcggccctgcccgaggagatcggcctccccgcctggtgccggccggccgcggccacaggggccctggccctggtcggcacgcaggagcgtgtcgcctgcggcggcgccgccatccatcccggcgatatcctggtcggcgacgcgagcggcctcgtcgccgtgccggcttcactcgccgagcgggtcgccctggaagccgtcgagcagcagcgcctcgatctctggatccagcgcgaggtcgagcgcggcgccgacctcgcgagcctccttccgccggacgccgcggcgctcgcccggttcgaggccgagacgaagccggcctga

SEQ ID NO: 5374 - DNA, 480 bp, Methylobacterium sp.
gtgagcgcggtggtcgtcatcgacccggacgccttcctcgagaccgagcgcggccgcgtctggacgcccgaacggaacgccgaggcgtggcggctggccctcgcggcgctgcgcgcggcgctcgccgcggactcggtcgagcggctcgtggtcgtgtgcgggctgcagggggccggcaagtccacctggatcgcccggcagcggcccccgctcggtcgcgtctgcttcgacgccgccttgcccggccggcggcaccgtgcgccgatcctcgccatcgcgagagcctgcggcgtcgccgcggaggcggtctggatccgcgcgccgctcgcggtcgccctcgaggggaaccggcggcgcgccgccgaccggcaggttcccgaagagagcatccgctccgtcgaccgtctgttcgagccgccgtcgcgcgcggagggcttcgcggcggtccggatcgtcgacgcgacgttccgcgccggctga

SEQ ID NO: 5375 - DNA, 1263 bp, Methylobacterium sp.
gtggatctcctgagcagcgatgaccgcctgttcgccttcggcaggcgggcggcctgggtgctggtgccgttcggcctcgccatggtcctcctcgtctacgggaccggcccggacccgcggcgcaactggtacggcgaccccctcggcaacgacttcgtccaggtctgggtggcgggccgctcggcgctggaggggcggggggcagacccctacgaccttccggtgcacctggcgaacctgaaggcggcctgcgggcaggcgtgccggttcgcctggcactatcccccggtgttcctcctgccggcagccgcgatggcactgctggatcttcagccggcctacctgctctggaccgcgctctccctcgccctgttcgccctcgcgatgcgggtcgcggccggccggcgggacgcggccctcgtcgcgctcgcgcacccgctcgtgctctgcaacctcgtctacggccagaacggcctgttcaccgcgtcgctgctcaccctcggcgcggtgctcgtcgatcgccgaccgtggctcgccgggctctgcttcggcctgctggcctacaagccgcacttcgcggccctggcccccctgctcctgctggttacgggacggcgcgcatgcctggccgcctgcgcatcgacggtgctggccctctgcctcgcatcgctggcgctgttcgggacggcgccctggaccggcttcctcggcacgctcggggacacgaaccggatcatcctgcagaacgcggcggcgagcctcaacctcaacgccagcgcgttcggcgcggtgcgcctgctcggcggctcgatggccgccgcctggacggcgcagggtctcgtcgccgttctggcgctcggcctcgctttccgcgcctggtcccggcccaccgacccgacgctgcgcgcggccgcgctcctcgtctccgcgccgctgctgtcaccctacctcccggtctacgacctggcgcccctcgtgccggccgtgctcctcctggcgctcgccgcgcaccgcgcgggcggcctgcggccgcgcgagcgggccctgctctgcgcggtgccgctcttcgcgatcgtccgggaggcggccgcgctgaccggcttccccctcggcctcgtgctgagcatggcgaccttcgcctgcatcgcggcgcgcatcgtgccgcggagcgtcaggccgagccgacggcgatccgggactggcggcaccgaggccggagtcctcacggagccagcggccgcgggatccggaagggcagcatga

SEQ ID NO: 5376 - DNA, 666 bp, Methylobacterium sp.
gtgcccgtcctcaccgtcctgacccggcgggcggcgcagctccggtacgacaggcgcggcggcgcggccgtcgagttcgccgtcatcctgccgatcctgctcgcgatctgggcgggcatgaccgaggtgacgcacgccatcgacgagtggcgcaagctgacgcagctcggccgcaccgtggcggacctgacggcgcagggcgacacacagaacccgatcagcaccaccgtgatgaacgacatcctcgcctccgccacggcggtgatgcgcccgttcgacacgtcgaaggtcaagatcgtggtcagcgcgatgggcaccgacgcgaaggacccgagcggtcctcctttggtctgctccagcgtcgccaacgccaacgggaccgcgcggagcccgggccccgcgcccagcctgaccgtgccggacggctaccggatgccgggcatgcgctacgtcctggcggaggtcagcatcagctacacgccgatgatcgggagcgcgctggtcaagctcgccaagggcgtgagcaacacgatcacgttcaccagcagcgcgccgtggccgacccgcggcggccaggcctacggcaccagcacctacacggaagtcgtcctgccggacgacaaacaatcgaactgcgatggcacgaagatcgtccgcaaaacctga

SEQ ID NO: 5377 - DNA, 669 bp, Methylobacterium sp.
atggccatcacgcagaccggcggcagctccgaaagcatccgcgccgcggtggccgccgcgctctcgccggagcgccggcgcctcgtcgtgaccgcggccgcccgcgaggcgcaggcccgcgccgaggcggcgtatcgcgaggagttcgggcgcctcccgaagacggagatctcggtcgacggccgcgccggcggcaacctcgatcagctgaatccggaccagggtgaggtggcgttccggttcgcccgggccaccgaggcgctggcgtggatctacgagcagatcgtggcgcactcgcccgtgctgtccggggagtacaagggcgcgcacatcatgctcgccgacgatcagaaggcggatccggccaacccgccgcccgccgagcggtacgtgttcatgaacctcaccgcctacggcaagaagatcgaggagggcgagtcctcgcaggcccccggcggcgtctaccaggccgtggccgtgctggcggatcgccgcttcggcaacagcgtgcgggtcggcttcggctacgagtcgccggtcctggactatgtcgcgggcgaggccggccggggcgcgcgggcccgcctccggcagcagccgacccgcgtcgccgccatgaagctcgaacgcgccacccgcgttcccgtcatcaccgtgaccctggcctga

SEQ ID NO: 5378 - DNA, 756 bp, Methylobacterium sp.
atgtcgagcgctgagaacagggtcgcgatcgtcacgggcggcagccgcggcatcggccgcgcggtggcgctgctcctggcggagcgcggctacgccgtctgcctgagctacgtgtcggacgccgccgccgcgcagggcgtggtggacgcgatcgcggccaagggcggacgggcgctcgccgtgaagggcgacgtcggcaacgaggccgacgtcatcgccctgttcaaggcggccgacggcctcggccgcctcgcggcgctcgtcaacaatgccggcgtggtcgacgtgaagtctgacgtcgccgacatgagcgtcgcccgcctgcagcgcatgatgaccaccaacgtggtcggcagcttcctgtgcgcgcgggaggcggtgcggcgcatgtcgatcaagcgcggcggggcagggggcgcgatcgtcaacctgtcctcggtggcggcgcgcctcggcggccccggccagttcgtggactacgcggcctccaagggcgccattgactcgctgacgatcgggctgtcccgcgaggtcgccgccgacggcatccgcgtcaacgcggtggcgcccggcatcatcgccaccgagatccacgccagcggcggcgagcccgaccgggtcgagcgtctcggccccggcgtcccgatgaagcgggccggcaccgccgaggaggtcgccgcaccgatcgtgtggctcctttcggacgaggcctcctacaccacgggcgccatcctcgacatcggcggcggccgctga

SEQ ID NO: 5379 - DNA, 870 bp, Methylobacterium sp.
atgcccgagatccgagactgccccgccccggacccgcatccggaaggcccgacccgctacgccgtgccggagggcgcggtcgacacgcacgcccacgtcatcggcctaccgccggactatcccctggtggcggaccgcagctacacgcccccggcggcgccggccgagcggtacctcgcgatgctcgacgggaccggcatggccaacggcgtgctgatccaggtcagcgtgcacggcaccgacaaccggctgatggtcgagacgctgcgcgcccaccggcggcgcctatgcggcgtcgcggtgatcccgctcggcctgcccgacgctgagctcgccgcgctgaaggaggccgggatcgtcggcctgcgcctcaacgtcctgttcggcggcggcgtcgggctcgacgcggtcgagtcctacggggcgctcgcccgcgagatgggctggcacctccagttcctgctcgatgcccgcgagctgccgccgatcgccggccgcctgtcgcggctgccggtgccgctggtcttcgaccatatgggccacatgccgacctcagccggcctcgaccatccgggcttcgaggcactgctcggcctcgtcgccgacggcaactgggtgaagctctcgggcgccttccgggattccgtgaccggcccgccctacgcggacacgatccccttcgcccgggcgctcaacgacgccgcgccggaacgctgcctctggggctcggactggccgcacgtggccgcctgggacggtccgccgcggacgcgggagctcctcgacctgatggccgactgggtgccggacgcggacaggcgccggatggtgttcgtcgacaacccgcggcggctctacggcttcgggtaa

SEQ ID NO: 5380 - DNA, 1014 bp, Methylobacterium sp.
atggaacaggcggaggcgatccgggacccgatgcccgactggcagagcatccgggtcttcctggcgctccagcggtccggcagcttccgctcggcggcgacgaagctcggcctgtcggtgaactcggtgcggcgccggatcgacgatctcgaggcgctgatcggcgcgccgctgctgacccgccacgtcgacggcatccgcctcaccgccgagggccacgcgatcctcgaggccgccggccgcatggaggcggccgccttcagcctcgtgcgcaccggcgagggcgcgcccttcgccgagaccggcgaggtgcggatcgccgtgacggaggggctgggagcgttctggctcgcgccgcggctcgtcgagtttcagcgcgccaacccgcgcctgaccgtcgacctgcgctgcgcgatggaatccgccgacgtcctgcggctggaggccgacgtcgcgatccagctgacgcggccgaccagcccggacctgcgcatcgtcaagctcggccggatccacatggtgccgtacgcggcgcggagctacgaggagacctacgggctaccgggtcgccccgaggacctggagcgccaccggatcgtggtgcaggacggcggccagaccgtcgccctcgaggattacgtgcgcacggtgccgggcttccccgcgaaggtcccgatcaccctgaaggtcaacgtcagcagcgcgtattactgggccatcgccaagggggccgggatcggcctgctgccgacctatgccagcgcgatcggcgcccaggtcgtcccggtggacaatctcggccgcttcagcgtcgacatctggctgacctatcacccggacgccgagcggatcacccgcgtgcggcggacgatcgactggctgcgggcctccttcgatccgaagcgctatccctggttccgcgacgagttcatccatccccgcgacctgccgggtgcggtgaagggcgcggccctccccgacctgttcgccggcttcatcgccatgacgccgtga

SEQ ID NO: 5381 - DNA, 429 bp, Methylobacterium sp.
atggaggccgatgcccccggaacggcggcgctgtcgcgggagcagtacgcggcgctggcggatttccgattccgtctccgccgcttcctggcgttcagcgaggccgccgcggcccgggaggggctgccgccgcagcagcatcaggcgctgctgaccctcgcaggccacgtcgggcgggcgcctgccacggtcggcctgctggccgagcagctgctcatcgccccccacagcgcggccgagctggtctcccgcatggtcgaggccggcctgctgaccaagacccgcgccgtcgaggacaggcggcggagcgagctgtcgctgacgccgcgcgccgaggccctgctgcggaccctcacggacgcgcatctcgcggagctgcgcgacctcgcccccgccctcaccgaggccctcgggcccgtgacgcgttga

SEQ ID NO: 5382 - DNA, 330 bp, Methylobacterium sp.
ttggagaagatcctggacggtgacgctgagagcatcctgcgcaaggccgtccagctcgcccgggacggcgatcctgtcgcactccgcctctgcctcgaccgtctgatcccgccccggaaggatcgcccgatcaccttcgcgctgccgccgatcgagacgaccgacgatctgccgaaggccacgggtgccatcgtggccgcggtcgccaccggcgagctgacgccttctgaggcggccgagatctccaagaccctcgacgtgcatgtgcgggcgatcgaggcgaccgagctgcaccgacgcatggccgcactggaggcgcgaggacgatga

SEQ ID NO: 5383 - DNA, 675 bp, Methylobacterium sp.
atggatgccctgaccctgatccgcgagagcctcgcgccgctggccggcaagcgggtcgtcgatatcgggtgcggccccgggacgctcgcgcggcggctggtcgacgcgggcgcgcgggtcaccgggatcgatcccggcgcggcggcgctcgcccgggcgcgggacgccgtgccggaggcgcgcttcgaggccgcgaccggcgaggccctgcccttcccggacgccagcttcgacggcgccgtgatgctgaattccctccaccacgtcccggacccggcggcggccctcgccgaggcggcccgcgtcctggccccgggcgggctgctcgtcgtggtggagcctctggcggagggcagcttcttcgacgcgctgcggccgatcgaggacgagaccgcaatccgcgccgccgcccaggacgccatcgcggccgccctcgcccgcggcgccttaacgtgccgccgcgacgcgacgatcgcgcggcgggagcgcttcgacaccctcgacgccttcctcgcccgcgtcagcgccgtggacccggcgcgcgaggcgaccatccgggaccggcggcccgtggtcgaggaggccttcctcaaggccgccgcgcgcgaggccgacgggcagttcggcctcgtccagcccctgcggatccacgtcctggagccggcggccgcctga

SEQ ID NO: 5384 - DNA, 531 bp, Methylobacterium sp.
atggcgggctgcctcgtcctcgtggtcgggccgagcggggccggcaaggacacgctgatccggctcgcccgagcggcgctcgccggcgacccgcgctacgtcttcccgcgccgcctcgtcacccgcccgccctcggccgatgaggacaacgacgagatcgacgaggccgacttcgcggagggctgcgcggccggccgcttcaccctgagctggcgcgcccacggcctcggctacgcgctcccggagacggtcggcgggcgggtcgccgacggccacgtggtagtctgcaacgtctcgcgccgcgtcgtcgcgcgggcgcgggcggccggcccgcgggtgagcgtcgtcgagatcacggcgccgcccgagatcctggcgcggcgcatcgccgcccgcggccgggcgcaggacggcgacttgtcggcgcgtctcgcccgggagggcggcgtcaccgcggacctgacgatcctcaacaccggcgccgcggacgaggcggccgcacggctggtcgcgcatctgcgcgcctgctga

SEQ ID NO: 5385 - DNA, 1137 bp, Methylobacterium sp.
atggacgacttcatcctcgagaacgcgaccctggtcctgccggaccgggtgcagcgcggctggctcgcggtgtctgacggcgcgattgccgagatcggcgaggggcgcccgcccgcgcgcggcctcgatctcggcggcgaccacctgatccccggcctgatcgagctgcacaccgaccacctggagagccatttcgcgccgcgcccgaaggtgcgctggcaccccctcggcgccgtcctggcctacgacgcgcagatcaccgcctcgggcatcaccacggtgttcgattcgctccgcgccggcagcgatccggacggcagcggcctcggctccgagctggagcaactcgccggcgccatcgccaccgcgcgcgccgctgacctgttccgggccgagcacttcacgcacctgcgctgcgaattgccctccctggacgtgctcgacacggtggcggccttcacggcccgctacccggtgggcctcatctctctgatggaccacacgcccggccagcggcagttccgcgacatggagaagtactacacctacgccacccgcggcggccggccgatggacgagatccgcgccaacaccgagcgcaaggttcgcgacgggcgggcgctcaacgcgaagaaccggccggccatcgtccagttcgcccgcgagatgggcatcccgctggcgagccacgacgacaccaccctggccgacgtcgacctcgcggtcggcgagggcgtgcggctggccgagttccccaccaccctggaggcggccgaggccgcgcaccggcagggcttcaccgtgatgatgggcgcgccgaacctgattcgcggcggctcgcattccggcaacgtcgcggccctggcgctggccgaggccgggcacctcgacatcctgtcgtcggactacgtgccggcgagcctgctgatggcggccttcctgctgcccgagcaggcgcccgggatcactctgcccgcggcgctcgccaccgtcacgtcgaaccccgcccgcgccaccggcctgaccgatcgcggcgccctggcgcccgggctgcgggccgacctcgtgcgcgtgcagcgggccgagggcgtgccggtggtccgcgaggtctggcgcgccggccggcgggtcgcctga

SEQ ID NO: 5386 - DNA, 1602 bp, Methylobacterium sp.
atgacatttcgccgcctgattgccgccgccctggcgggtaccgtggccctgacgggatcggccagcgccgagagcgtcctgcgcatcgccatgacggcgagcgacatccccaccacgacgggcatgcccaacaacggcttcgaggggatgcgcttcctcggctacccgatcttcgaggggctggtgcagtgggacctcaagagcaccaccaagctcgccggcatcatcccggcgctggccgagcgctgggagcaggacccgaacgacaaggcggtctggaccttccacctgcgccagggcgtgaagttccacgacgggacgccgttcaacgccgacgcggtgatctggaacctcgaccgctacttcaagaacgacagcccgcaattcgagccgcagggcgccggcatctcccgggcgcgggcgccgctagtcgggagctacaggaaggtcgatgattcgaccgtgcagatcaccaccacgcaggtggcctcgtacttcccctacatggtggtctacctgctcttcacctcgcccgcctccttcgagaaggccgggcgcgactggagcaaggtcgcggccctgccggcggccggcaccggcccgttccgaatcacccgcgtcgccccgcgggaggcggtcgatctcgccaagttcgacggctactgggacccgaaccggatggccaaggtcgacaaggtccggctgctgccgatcccggaggccaatgcccgtgtcgcggcgctgcgggccggccaggtcgactggatcgaggtgccggcgcccgacgcgatcccgtcgatgaagcaggcgggcttcaccatcaccacgggctcgtacccgcatgtctggccctacttcttcaacatgggcgccaaggacagcccgctgaaggacgtccgcgtccggcagggcctgaactactgcatcgaccgggccgggatcgtggagctcctgaacggcaccgccgagcccgcgagcgggtggctgaacgaccgggacccgaatttcggcagcccgaagaaccgctacaccttcgacgccgcgaaggggaaggcgctgctggccgaggccggctacaccgacaagaagccgctgagcctcaaggtgatgatctcctcctccggctcggggcagatgctgccgatgccgatgaacgagtacctgcaggagaacctgaagcaggcctgcaacgttgacctgaccttcaacgtggtcgagtggcaggtgctgctgaatgccggccgcgcgctccccgacgcgccgaccctccagggtgcgatggcgctgaacgtgtcgtcgccctcgtcggacccggccgtcatggcgcgctacttcgcgggcgaccgtttcccgccgaacggcttcaacttccccacctggaaggacgacccgttcgacgcggccctcaaggcgctcgccgagaccaccgacgcgaaggtgatcgacgcccagaccaaggtcgcccacgagcgcctcgtggacaatccgccctggctgttcgtcgtccacgacctcaatccccgcgggatgtccaagaaggtccagggtttcgtctcgccgcaatcctggttcgtcgacctcaccctcgtcagcgtgcagtga

SEQ ID NO: 5387 - DNA, 1638 bp, Methylobacterium sp.
atgagcgccgcgggggcgccgcgcggcggggtcgcgccgtgctcccggcgggtgatgaatctcgcccatttcctgcgccgcgccgcgcgccggttcccggacgcggtggggctcgcctggggtcagcggcgctggacctggggcgagctcgacgcccgggtcgacgcgatggcggcggcgctcgccgcccgtggcgtgaccaagggtgatcgcgtcctggtccaggcacgcaacagcaaccagctgttcgagtcgatgttcgtctgcttccggctcggggccgtctgggtgccggccaatttccggcagacgcccgcggagatcgcctatctcgcccgtgccagcggcgcctcgacgctgatctgcggcgcgggtttcccggagcacgccgccgccgtgcgcgaggcctgcccggacctggaccgcgtcgtggcgatcggcgacgcggccttcggggccgattacgacgcactcgtcgccgaccacctgggtgcggccgcgcccgtcgccgatgtcgagcacgacgatccgtgctggttcttcttcacctccggcacgaccggccgccccaaggcggcggtcctgacccacggccagatggccttcgtcatcaccaatcacctctgcgacctgatgccgggcacgacggaggccgacgcgtccctggtcgtggcgccgctctcgcacggcgccggcatccaccagctcgcgcaggtcgcggccggcaccaagacggtactgaccgccggcgagcggctggatcccgaggaggtctgggccctcgtcgaggcgtggcgcgtcacgaacctcttcaccgtgccgaccatcgtgaaactgctgaccgagcaccccgcggtgtcgacgcacgaccattccagcctgcgccacgtcatctacgcgggcgcgccgatgtaccgggcggaccagcagcacgcgctgcgggtgctcgggccggtgctggtgcagtacttcggcctcggcgaggtgacaggcaacatcacggtgctgccgccacgcctgcacgcggccgaggacgggccggacgtcaaggtcggcacctgcggattcgagcgtaccggcatgcaggtccagatccaggacacgcagggccgcgagtgcccaccgggcgccaccggcgagatctgcgtctgcggcccggccgtgttcgcgggctactacgacaatccggaggccaacgcggcggcgttccgcgacggctggttccggaccggcgatctcggccatctcgattccgagggcttcctgttcatcacgggccgcgcctcggacatgtacatctccggcggctcgaacgtgtatccgcgcgagatcgaggagaagctcctcacgcatccggcgatcaccgaggccgcgattctcggcgtgccggataccgcctggggcgaggtcggcgtcgcggtctgcgtcgcgcgtcccggggcagcggtgcaggagggagagctgatcgcgtggctgtccgcgaccgtcgcccgctacaagctgccccggcgcgtgttcttctgggaggccctgccgagatccggctacggcaaggtgacgaagcgcgcgatccgcgagggtcttgaggcgcggggcgacctgcccctcgacgggcaggcgaggccgcagacccgatag

SEQ ID NO: 5388 - DNA, 2067 bp, Methylobacterium sp.
atgaaccgacactcgaccagcgcgtccttcctgccgatcggtgcgacccgccccggtgggaccggagcctggcgcggccagcccttctcgcccgagacggagtcccaggtctcgatcctgaccatcgcgcggcagaactggcggtcgatcctggccttcgcagccgtcgggctggtctgcgccgggatctacgtcgcgaccgcgccggccatcttcacggcccgggcccgcgtctacatcgagagccgctccagcccggtgacggcccgcgacacgcccaatgccgggacgccgctcgagatcgccgaggtcgagagccaggtcgagtacatccgctcggagaagatcgcgctcgccgccgtgcaccggctcgacgagtcggccctgaaggatctggcggcgccgacgcacccgctcgtcgcgaaggtccgggagttcgtgaaggccgccaaggcgctccccctccggctgatcggggccgagcggccggtccaggaacacgcccccgtcagcccggaactgcgccaggcgcggacgctgcgcgagaacgtggaggccagccgcatcggtgccgcctacgtgatcgaggtcggctacagcgcggacaatcccgccacggcggccgccgtcgcgaacgcggtggccggggcctatgtcagcaccgagctggagaaccgggcccaggtctggaaggtcgccggcgagtggatgctgccgcgcctgaaggaactccagcagcgcgccagccaggcctcgcgcgaggcccagacctacaaggccgagcacaccatcatcgacctgggcaagcgcggcctcgtgggcgagcagcaggtcgaggagctcaacaccgccgtggccgcagcccggtccaagaccgtcgacgcccgcgcggtgcgcgaccagatccgcgggctcctcgattccgacatcgccgatccggggatcaccgaggccttcaaggacagcgtcatcatccagctgcgccggcagtacgtcgacctcgtgcagcgcgccgacgacctgaagcgccgcctcggccccgaccacgaggccgtccaggcgatccagcgggacatcctggcggccaagcagtcgctgcgcaccgagctcgagcgcctcgccgtgtccctcgaccacgactacgaggtcgctaaggcgcgcgaggacagcatgacggccgccttcgacgccctgatctcgaagacgctgatcatgagcaacgcccgcgtcaaggcgcgggagctcgaccgcaccgccgagacctacgaccagatctacaccaacctgctccagcgctacatcgacgccgtcaaccagcaatcctatccgcagccctccgcccacgtgatcacgcccgcgaccgtgccggaatccccgagcgcgccccgcggcagcctgatcatgctgctcggcctcctggtcggcaccgggttcggcgtgagcggcgccttcgcgcggcactggttcgaccggacgatccgtacgccccggcagctgaccgggcacggcctgacctgcctcgccgccctccccgagctgcggcgcgagcccggcttccgggcggcgctcgccctggcgcaggcccacgccaaccaggcgcagcgtccggccagcatcgaggcgttccgggcgagcgccgtgcggttcatgccgcaatcggtgttcgtcgagcgcctgcacagcctcaaggcccacgtcctgggcagcgaccgccgcggcccggtcttcgcgattggcgtcacgtccgtgggggccggcgcgggcaagaccctgttcgcgagcaatctcggccagctcctcgcccgcgcccgcgcgagctccgggcgggtgctgatgatcgacgccgacgtccggcaggggacgctctcgcggctcagccaggccaccgagcagcgcggcctcctcgacgtgctcgccggccgctgcggcgccaccgaggcggtccgcccgcagcccggcgaggtccgcctgctcgcctgcggcaaccgccacccgaacgatccccatttcagcgatctgatgaccccggagggcgtcgccgcggtgctgggggacggacgccccgcc

SEQ ID NO: 5389 - DNA, 282 bp, Methylobacterium sp.
atgaagcgccgcagcgcgcgaccgttcatggtcgaagtcaagcagacccgttcggcccgcacaacgctgactgccaccgaggcgcggccgcgcccggacaagatcctgtggccggaactggcgcaggccgccctcgcgccgcccgcacccgcgcccgcccctcaggcggcaccggcgccgcgcccggaacggaaggtgccggacgcgccggtgcgccgggtcctgccgagcctcatgccgatgttcgaggtcccggccgcgccggtcctcgaggccaatccg

SEQ ID NO: 5390 - DNA, 1167 bp, Methylobacterium sp.
atggtgtcggccccggcgcgggccgcggacccgatcaaaatcgggctgaccgggccctatacgggcggctcgtcttcgatgggtgtctcgatgcgggacggcgccaagctcgccgccgccgagatcaacaaggcaggcggcgttctcggccggccgatccagctgatcgagcgcgacgacgaggccaagaacgaggtcggcgcgcaggtcgcgcaggaactgattaacaaggagaaagtcgtcgcgagcgtcggcttcatcaataccggcgtggctctggccgcccagcgcttctaccaggaggccgagatcccggtcttcaacaacgtcgcgaccgggacgatcatcaccaaccagttcaaggagccggactacgacgccaactacgtcttccggaactccgcctacgacgtgctccaggccggcctgatggtcgacgaggccctcgcccagggccataagaagatcgcggtcctggcggactcgacgaattacgggcagctcgggcgcgaggacatcgagaagtatctcgcgaccaagaacgtgaagcccgtcgccgtcgagaagttcaacatcaaggacgtcgacatgacggcccagctgctgaaggcgcagcaggccggcgccgaggtgatcctggcctacggcatcgggccggagctggcccagatcgccaacggcatggccaagctcggctggaaggttccgatgatcacgagctggccgtcctcgatgcagagcttcatcgacatcgccggcacgaacggcaacggcgtgatcatgccgcagaccttcatcgaggatcagaccctgccgaagcgcaaggcgttcctcgagaactactacaagacctacggcgtcacgaagatcccgaccccggtggccggcgcccagggctacgactcgatctacctcctcgctgcggcgatcaagcaggccggcggcaccgacggcgcgaagatccgcgccgccctggagaacctgaacgagaaggtcgagggcgtggtcacgacctacgacaagcccttcacggccaaggaccacaacgccatctcgcgcaacatggtcgtgttcgggaaggtgcaggacggcaagatcgtctacgccaaggacgaggacgccaagaacgccggcgtggttcgcctgaaggagaagtcctcgaactga

SEQ ID NO: 5391 - DNA, 873 bp, Methylobacterium sp.
atggaaatcctgctccagctcatcgcgtccggcgtcgcggtcggcatgatctacgccgccatcgcgttcggctatcagctgactttcgcgacctcgaagaccctcaatttcggccagggcgaggcgctggccctcggcgccctgttcggcctgaccctggtgccgttcgtcggctactggctgatgatcccgctggtcctggtcttcggcttcgccctcggagccgtggtcgagcgcctcggcgtgcgcccggccgtgaagatcaagtccgagtacgggtggatcatggccaccatcgcgctcggcatcatcttcaagaatgtcgcggagaacgtctggggacgtgacgacctgaaattcccctccccgctgcccgagacggcgctccaggtcggcggcgtgcgcgtcctgccgatggaactgctgatcgtcgcgggcgcgctgctgatgatgctggcggtggagatcttcaatcgcaagtcgatctgggggaaggcggtcgtcgccacctccaacgacatcgacgccgccgggctgatgggcatcaacacccagaaggtgatcaccctctcctactcgatcagcgccatgacggcggccttcgcgggcgtgctggtggcgcccgtcaccctgaccggggcgacgatgggctccgtgctggcgctcaaggccttcgcggtggcgatcatcggcggcctcgaatccggcctcggcgtcatcgtcggcggcctgatcctcggtgtcgcggagacgctgaccggcttctacatctcgaccggctacaaggacgtgccgggcctgatcctgctcctcgtcgtcctctccatccgcccggtcggcctgttcggcaaggccgtcatcaagaaggtctga

SEQ ID NO: 5392 - DNA, 1221 bp, Methylobacterium sp.
atgtcgaggaacgccgccgccggggcgctggccctgctctgtctcgcgaccgcatcgccgtccggtgctgccgagccgggtgccgccgagcccgcagccgccgacgggccgtttaggccgacgcagcccgcgggctacttcttcgtcggcggtcgctacgccaccgcggccggcaagacgacggcgtccggccagatgttcgtggagtaccgcgttccggagcgggtgacgcagccctacccgatcgtcctggtgcacggtactgcccagaccgggaccaacttcctcggcacgcccgacggccggccgggctgggccgaccgcttcgccgcgcagggcttcgccgtctacgtcgtcgaccaggtcggtcgcggccgctcgggcggcgactcggatacctacggcccctacgcccgcctgcccgccgaggatctggagacggtgttcaccgggcaggagcgctccgcgctctacccgcaggcgaggctccacacgcagtggccgggcggcgccgggatccgcggcaacgccgccttcgaccagttctacctctcccaggtcccctacatcgccagcgcgctgaggagcgaggaactggtcgacccggcgctgatcgccctgctggagaagatcggcccggcgatcctgctgacgcattcgcaggcgggcgtcttcggctgggcggtgtcggatcagcggcccgatctcgtgaaggcgcacgtcgccgtcgagccgaacgggccgaccttctacgacatccgcttcaagggcggcgcggactggtacgagcgcgtcggggaggcccgggcgcggccctacggcatcacccgggtgccgctgcacttcgagccgccggtgagcggcccggcggacctgacggtggtccagacggagagcgccgccgcgcccgacaggatccgctgctggctccaggccgagcccgcgcgccgattgccgaacctcgcccgggtgcccgcggtgatcgtgaccgccgaggcgtcgttccgggccacgatggacgattgcaccgcggccttcctgacccaggcgggcgcgaagccggaccggctggcgctcgccgagcacgggatccgcggcaacggccacatgatgatgctggaatcgaacagcgacgccgtcgcggacgcgatcgccggctggatccagagtcgggtccagggccggatccagggccaagtcgaggcaccggcccggccttaa

SEQ ID NO: 5393 - DNA, 924 bp, Methylobacterium sp.
atggccgagaacaccgcgattgcttggacgacccacacgttttcgccgtggtggggctgcacgaaggtcgggcccggttgcgacaactgctacgccgacgcgctggaccggcgttggggcggtgcccactggggcgcgggcgtgccgcgccggctcgtgaaggactggtcgaagccgcgcaaatggaaccgggatgccgcgctgtcgggcgagcggccgtgggtgttctgcgccagcatggccgacgtcttcgacaacgaggtcgaccctctgtggcgcgcccggctctgggacttggtgcgcgagtgccggaacctgcgctggcagttcgtgaccaagcgcatcggcaacgtccggaagatgctgccccacgactggaacgagaacttcggccattgcggcctgctgatctcggtggtgaaccaggaggaggccaaccgggacatcccgaagctgctggcgacgccggcagcctggcgcggcctgagcatggagccgctcctgggcagggtcgacctgacccacctcgagacggccggcgacggcgagctgaacgcgctcaccggcttgtgggccacgtgcccgatcgtccaggccggccggcgcatcgtcatgacgaccgccaacctgccgccgctcgactgggtgatcgtgggcggagagagcgggcacaacgcacgcgcgctgtcgccaaactgggtccgcgcgctgcgcgaccagtgcgcggcccacggcgtgccgttcttcttcaagcagtggggtgagttcgcgccggttcacgagacccgcgcgggcgagcccggcatcgccggccggctctgggtcaacttcgacccggacaccgcggtctgccgcatcggcacgaaggccgcgggccgtcggctcgacggcgtggagcacgatgccatgccgagggcggcctag

SEQ ID NO: 5394 - DNA, 981 bp, Methylobacterium sp.
atgacggaaaccatcctctccgtgcgcgacctgacggtcgccttcgacacccgccgcgggccgctcaccgccatcgaccgggtctcgttcgacatcggccgcggcgagatcctgggcgtcgtcggcgagtccggggccggcaagtcggtgactggctcggcggtgatcggcctgatcgaccggcccggccggatcgccggcggcgagatccgcctgcgcggcgagcgcatcgacaacctctcccccgaggcgatgcggcgggtgcgcggcaagcgcatcggcatgatcttccaggatccgctgacctcgctcgacccgctgttccgcgtcggcgaccagatcgtagagaccctgcgcacccacaccgacctgtccgccaaggcggcgcgcagccgcgccatcgacctgctcgccgaggtcggcatcccggcgcccgagcggcgcatcgacggctacccgcacgagttctccggcggcatgcgccagcgggtggtgatcgcgctcgcgctcgcggccgagccggagctgatcatcgcggacgagccgacgactgccctcgatgtctcggtccaggcccagatcatcacgctgctgaagcgcctgtgccgcgagcacggcaccgcggtgatgctggtcacccacgacatgggcgtgatcgccgaggccgccgaccgggtggcggtgatgtatgcgggacgggtggccgagatcggcccggtcgcgtcggtgatcgccaagccgcaccacccctacgcggtcggcctgatgggggcgatcccgaccctgtcgcaggaggccgaaaggctgagccagatccccggatcgatgccgcggctcaccgccatcccgaagggctgcgccttcaacccgcgctgcccgaaggtcttcgcccgctgccgcgtcgagcggcccgagccgatcccggtcgacgcgagccgggtggcctgtcacctgtacgatgcagcggagcgcgcagcgtga

SEQ ID NO: 5395 - DNA, 981 bp, Methylobacterium sp.
gtgagcgcctacgtcgaagtcaccgacctgcgccgccagttcgacgtctcgaagccctggctcaaccgggtgatcgagcgcgagccgcggaaattcctcacggcggtcgaccgcgtcggcttcgcgatcgagaagggcgagaccttcgcgatcgtcggcgaatccggctccggcaagtcgacggtggcccggatggtggtcggcctgctgccgcccaccgccggcgaggtgcggatcaccggcgtctcgatgaccgacccgcgccaggccgcggcgcggcggcgcctgcgcgcccggatccagatgatcttccaggacccctacgcgtccatgaacccgcgctggcgggtggggaagatcatcgccgagccgatccgggccttcgacctgatccagggggagggggcgatccgcgcccgggtcggcgaactcctcggcctcgtcggtctccacgcggacgacgcccgaaaatacccgcacgaattctcaggcgggcagcgccagcgggtggcgatcgcccgggcgctggcgagccaggccgagttcctggtgggcgacgagccgacctcggcgctcgacgtctcggtgcaggcgcagatcctcaacctgatgcgcgacctgcaggaccggctggggctgacctacctgttcatctcccacaacctcgccgtggtccgccacatggcgacccgggtgggcgtgatgtatctcggccgcctcgtggaggtcgcgtccgccagggacctgttcgcgacgccgcgccatccctacacgcggatgctcctcgacgcggtgcccgacctcgcccatgtcggccgcgcccgggtgccggtctccggcgagatcccgaacccgatcgacccgccgcccggctgcaccttcaacccgcgctgcccgctcgccaacgaccgctgccgggccgaggtgccggcgctcctcgacggtgtcgcttgccacgccgtgcaggaagggcgggcctga

SEQ ID NO: 5396 - DNA, 408 bp, Methylobacterium sp.
atgcagacgacatcgccgagcgtcgaactcgccgcaaagatcctgagcgcctacgtcacgcgcaacagtgtcccggcgggaacgctgcccgacctgctctccgaggtacaccgctcgatcaccgccctggaccagccggcggagccgcaggtccggcggccgaccgaggcgcagatccgggcctcgatccggcccgacacgctcatcagcttcgaggacggcaagccctacaaggccctgcggcgacacctcacgatgcgcggcctcacgcccgaggcctacaaggccaagtggggcctgcccgtcgattacccgctggtctcggcggtctacagcgcccgccgctcgacgatctcccgccagatcggcgagggccagcgcctgcggatgcagcaggccgcggagtaa

SEQ ID NO: 5397 - DNA, 1401 bp, Methylobacterium sp.
atggcaaccatcctgatcgtcgacgacgacagagccctgcgcgacgggctcgccgagacggtgaccgatctcgggcacaccgcgctcccggtcgcctccggatcggaggcgttggcgcgtctgggcgagggtccggtggcggcggtgctcctcgacctgcgcatgcccggagacctcgacggcatggccacgctggagcggatccgatccctgccggagccgccgcccgtcacggtcctcacggccttcgcgagcccggccaacaccatcgaggcgatgcgcctcggggcgcacgaccacctgaccaagccgatcggccgggccgacctcgccgccgtcctcgacgcgatgctgcgcgacgcccgctccgatcccgtgggcgccgccccgccgccggaccatccggtcctgatcgggtcgagcgcgggcatgcggaaggtccagaagaccatcggtctcgtcgccgacaacgcgtccacgatcctggtccagggcgagaccggcaccggcaaggaggaggtcgcccgggccctgcacgccttctcgcggcgccgcgcgcggccattcgttccggtgaactgcgcggcgatcccggccgaggctctggagagcgagctgttcggccacgtccggggcgcccgcgcgggcgcgaccgccgaccgcgcgggcgccttccacgaggcagagggcggcaccctgttcctggacgagatcggcgacatgccggcggcgatgcaggcgaagatcctgcgggtgatccaggatggcgtcgtgacccctctgggaggccggcctgcccgggtcgatgtccgcctcgtggcggcgacgcatcgcgacctgccggcgctcgtcgccgcgggcgggttccgcgccgacctgtattaccggctgaacgtcgttccgatcaccctgccgcccctgcgcgagcgcctggccgacatcgtgccgctcgccgagcacttcctggtcccttcgggcaagcgcctgagcggcggggccgcctcgcgcctgctcgcctacgagtggccgggcaatgtccgcgagttgcgcaacgtcgtggagcgcgccgccatgctggtgcgcggcggcgtgatcgcggccgaggccatcgatctgccggccgcgcgacccgaccgccgcggcgaggacggcgcggccgactggctcgccggcgacctgcccggggccgtggcccgcctggagcggaccatgatcgcggccgcgctccgcgaggccgacggcaaccgcgcccgggcggcccgccggctcggcatccagcggcagctcctctacgccaagatcgagcgctacggcctcggcgcgccgggcaccgacctgtcggaagagacgacagacactgtcgggaatcccgacgcttcggccggcaccgacacggcctga

SEQ ID NO: 5398 - DNA, 441 bp, Methylobacterium sp.
atggcgaacccaacccccaagccgaagcagaccacagccatcgatcacggggtcggcagccgcatcgcgttccttcgggcggctaatggactgagccagtccgcgctggccagcgcgctgggcgtcagcttccagcaggtccagaagtacgagactggcaagaaccgtgtcggtgccggccgcctgcaggcgatcgccgagcggctcggcgttccggtctcgagcttcttcgagcccgagcccgaggctgcgaccgatagcggtcccgcgctgttgcgcgtcgctggcgccgtcgaactgctccgggcctacaatcagatcgccgacgatcagatgcgccgtgacgttctctccctcgtgaagtccgcggcgcggatcggtcagaccaagtcgtcggacgacgcggcaccgcaggcgggcggcgctccgcgtaaatcctga

SEQ ID NO: 5399 - DNA, 540 bp, Methylobacterium sp.
gtggggaacgacaacctgccggcgatctccggggagaccggccgcgccgcggcggagggcggcgtcgcccgggcacgcgaggcgtacgagcgcttcgccgaggcgggcgagatggcgctgaacgccttcgaggcctcgatggcgcagagcttcgagggctggcgcgcagtgatgggctccagccgcgaaaccgcgcaccagctcaccgacagcaacgtggccggcgcccgacggatgcgcgagcagtgggacgccgccggcgcccggctctacaacgccttcgaggacaacgcggtccacgccatggcggcgatgcgcgagatcggccaccggatgctcgtggcctccgacaccaatgtccgtgcgagcctcgacttcgcggagcgcgtcgccaaggcggcggatgcccgcgaggtcgcggcgctgaacatcgcgttcctgcaggagcaggcgcgccggctgaccgaccagatggtcgacctccatcagacgaccggccgtctcgcccgcgaggccgccgcgcgcacggagaccccgtga

SEQ ID NO: 5400 - DNA, 768 bp, Methylobacterium sp.
atggcggccccgttcgacctcgccggccgccacgtcctcgtcaccggggcctcgagcggcctcggccgtcacttcgccgggaccctggcccgcgccggcgcgcgactgtcgctcggcgcccgccgggccgacgccctcgccgagaccgtcgaccgcgtcgcggcggcgggcggggaggcccacgccgtcgtcatggacgtcaccgacgccgcgagcatcgagcgggcgctcgacgccgctgaggcgagtttcggaccggtggcggtgctggtgaacaacgccggcgtgacggcgacgaagccggccctcgacctcgcggaatccgactgggacgcggtgctcgacacgaatctcaaaggcgtctggcaggtcgcccaggccaccggccgccgcatggtccggcacggcgcgggcggcagcatcgtcaacatcgcgtcgatcctcgggctgcgggtcaccggcgggctcgcgccctacgccacttcgaaagcggcggtcgtccagctcaccaagagcctcgcgctcgagtgggcccgctacgggatccgggtgaacgccctcgcgccgggctacatcaagaccgagctcaacgacgccttcttcgagtccgatgccggccgggcgctgatcaagcgcatcccgcagcggcggctcggcgaggcggccgaactcgacgggccgctcctgctgctggcctcggaagccggcgcctacatgaccggcagcgtcctggcggtcgacggtggccacctcgtctccggcttgtag

SEQ ID NO: 5401 - DNA, 1293 bp, Methylobacterium sp.
gtgacgcggtccagcgcggatctccgcttcggcctcctgggcagaccgagcctcggccgccggtccgtccgctacggcgtcttcttcgccacgtacttctaccagggcctcgtcgcgggtttctcgctgacggcgctcgccaaccacctcgcggccaggggcgtcccggcgaccgaggtcgggctgcacttcgccctggccgggctgccctggacgctgcagcccctgctgtgggggccctgggtggaccgcgccggggacacgcggatgggacggcgccggcccttcgcggtcgcagcgctggtcggatgccacgcgacgctggcgctgctcctcgtcgccgggggcgatgccgtcggcgcgctcggcctggtcttcctcgtccacagcctgttcgcctcgctcctcgataccgcctgcgaccggatgatcatggaccacgtcccggcccgggagttcggccgggtcagcgcctgcacccgcgcgggcttcgtggccggaacgagcctcagcgccgctgtcttcggatggacgctcgcgagctggggtttcgccgcgagcgcccgctggctcctcgccgccgcgatcgtcgcgagcctgccgatgctgctggtccgcgaggcgccggccgatccgatctggtcgctcgagcgccggggaccggcgccgcggcgcctcccgttccgccgcttcctgcgccgcaccgtgatcgccctgcgccgcccgcgcgccctgcggctgctcgccctgtgcttcggcctcgacgcggccctcggcctgttcgagctgcccttctcgatcgacctcctccagcgtcagggctgggaggccgcgagcctgtcgcgcctccaggcggtcctgactctggtgagcggcacggccggcgccgtcgcggtgggattctggtcggaccgcgcgggcgcggcgtcgccgctgcgcgccctgctcctcggcagtgccgccaccttcgtgctcgccgggatcctgatcggcgccggcctcgtcggggccgcggcgccggcgatcctggcgctcaccagcgttctgcccggcctgctgatcgtcgccctgatgccggccctgctcgcggcgagccggggccgcccgggcgcggccacgcagttcgaggtgtacatggcggccatgaatctcggctcggtcgccgggacggcggtcgcgggctggctggccccggtcctgccgctccaggcggtcgccgccctcgtcgccgcaacgttcttcgcggccttccggatggcggggcgcggcgatctgctcggcgcccgccggtga

SEQ ID NO: 5402 - DNA, 201 bp, Methylobacterium sp.
atgacgaccgaaatcacgcgctcgcataccgtagagatcgtcccgtgcgtggacgatccgcggtgttttcgctggatcatccgcagccgcggcggcgcggtggtggagcactcaccctacgcgttcgtgacgcagaacggagcgcggatctccggagagtgctggatgcgcgagcatttcgccgacggccaggtcgcgtag

SEQ ID NO: 5403 - DNA, 435 bp, Methylobacterium sp.
ttgctcgcgtcagcctgctcggacgacggacgggaacgccgccgcgccctgggcgagaccccgacgttcgacgacgtcatgcgggtggccgacgcggagcgcggcgggcggctgttcggtcagtgcgccgcctgccacacgatcagcccgggggcgggcgatcggaacggacccgaactctacgacgtgctcggcaagccggtcgccagcaacagccggcgctacggttataccggggcgctccgggcgctgggcggcgtctggacaccggagcggatggacctctggctcgccgccccggcgaagctggcgcccggcacgagcatgaccttccgcggccttcccgatcccctcgatcggggggatctcatcgcctacctccggccccggtcgccgggggacggtgacgcagcggcgcgcccgtcgcggccttga

SEQ ID NO: 5404 - DNA, 1638 bp, Methylobacterium sp.
gtgaggccggccgcggcataccgggccgggcagcgcgccctggcggccggcttcatctcggcgctgctcctcggtcacggcccggcgtcggcgcgcaccttcgtgttctgctcggaaggcagcccggaatccttcgatcccgcccgcgccacgaccacaaccacgatgaacgccgcgtggcaggtctacaatacgctcgtggagttcacgcccggcaccacgacgatccgcccggccctcgccgaatcctggacggtctcggaggatggccggacctacgtcttcgccctgcgggacggcgtccgcttccacgccaacgcgcgcttcacccccacgcgcgccctgaacgccgacgacgtggtgttctcgttcgcccggcagaggcgctccgagcccgacggtgccgcgcagggcttcacctacttccacgatctcggcctcgccgacctgatcgaggccgtcgacgccccggatccgcgccacgtccgcttccggctgcgcgaggccgacaccaccttcctcgccaacatcgcgcaggccttcggcgccatcctgtccgccgagtacgcggccgccctcgcggccggcaacgcgtcggacgacctcgcccgggcgcccatcgggacgggcccgttcgtcttcgaggggtaccggccggatcaggtcctccgctaccgcgccttcccggattactggcgcggcggcgcggacgggagcgaaccgggcgagcggcccgacggtctcgtcttcgcgatcacgccgaacgcggcggtccggctgaacaagctgcgggccggagagtgccacgccatggcgttcccggcgaccggcgacctcgacgcgatccgggcggagccgggcctgacgctgctcgcgctggccgagctgaacgtcgcctatctcgccctcaacacgacccgcgcgcccttcggcgacgtccgggtgcggcgcgcggtcaacctcgccatcgaccggcgggcgatcgtggcgggcgtctacggcgacgcgggaatcctggcgcaggggccgctgccgcccgggatctgggcccacgacgcggacctgccggatacccccttcgaccgcggcgaggcgctgcgcctcctggccgaggccgggctcgccgacggcttcgacgtggacctgtggtatccgccagtcagccgaccctacaacccgaatggccggcgcgtcgccgacatgatccaggccgacctcgcgcaggtgggcatccgcgcgcgcccggtcacgcgtccctggaacgcgtaccgcgccgccctgtacggcggagagcccacgctgatgctctacggctggacgagcgacaacggcgacccggacaacttcctgaacgtcctgctcggctgcaaggccgcccagaccggcggcgccaacctcgcccgctggtgcgacccggcctacgaccggctggtcgaggccgcccgccgcaccggcgaccgggaggcgcgccaggctctgtaccggcaggctcaggccatcgcccggcgcgccatgccctgggtgcccctggcccacacaaaggtgcatctggcgctccgcaacgacgtgctgggcctgacgatggatcccctcggccgccacctgttcgagacggtgcggttccgcgatccccgctga

SEQ ID NO: 5405 - DNA, 471 bp, Methylobacterium sp.
atgagactcgccgtccccgctctcctggccgcgctggtgtccggccccgcctgcgcgcaatccttcgtgcccaccgaacgggccgcgatcgacctcgtgcgcgaccggcgcaccgccggcttcaccacggtggcgcggacgctggcctatgccgagcgcgcgaccggcggcgccttccgtctcggcggctaccgggtcgattaccgcccggacgtccccttcgcccgggtgcggatctgctatcgcctcgggatcgacccgccgacctgcggcctcgcttaccgcgtcgcggtcaatcctgcccatgtcgagccggccgaccgctacaacgggctgacgcgcgacctggagcacggcccgcaggccttcctccgggcactcgcccgggaggccgacctccagcgccagccggacgtcctgcggaaggtcgaggccgcgctcgagccctacaacccctacgactggcgctga

SEQ ID NO: 5406 - DNA, 378 bp, Methylobacterium sp.
atggtccgcgcgcacttcaccatccgcctcggcaacgcctcgctcccggcctcggcggctcagtgggtcgaggatgtcgaggccgcccggtcgaccgcgcgcacgatcgtgcaggggctgatgcgtcagcacggcggcgattcgcgcctcatggaggcggcgatggtgatcaccgacgacgacggcgccgttctcctggagatgtccttcttcgacacgctctacctgccggtcgagccggtccccgacgcggaccggcgccggccgcgcgcgccgcgcagggccgcgccgctcggactgaccgccgccctcggcccggtccggcgcctcgccggcgcgctgggcatgcgcgcgcagcagcccctgtcggggcgctga

SEQ ID NO: 5407 - DNA, 393 bp, Methylobacterium sp.
atgggcctgctcgacggtgcgaagaccctgatcggcgatgtggcggcggcggccgaccgggccctcgaggagaccggcagcggcaagctcgccctgtcgctggcgaagttctatcccggcggactcccggcctttctcgaccgcctgcgggagaccgggcacggcgaggcggtggcatcctggctcggctcgggcgcgcggcagacggtgccggagagcgccgtcgcggcctgcctcccggagggcgtgaccgagcgcctcgcctacgacctcggcgttccggaggcgcgcgtccccacggtgctggcggagttcctgcccgcggcggtcgccgaccagagcgagaacggcaccctgaagccgcagccgaatttcagcacccaggtccgctga

SEQ ID NO: 5408 - DNA, 1119 bp, Methylobacterium sp.
atgtacgtggccgtgaagggcggcgaggccgccatcgacaacgcccaccggctcctcgccgaggcgcgccggggcgacccggccgtgcccgagctctccgtggcgcagatccgcgcgcagatggcgctgctcgtcgaccgggtcatgaccgagggctcgctctacgatccggacctcgcggcgctggcgctcaagcaggcgcgcggcgacgtggtcgaggcggtgttcctggtccgcgcctaccggaccacgctgccccggttcggcgcctccgtgccggtcgacaccggggcgatggcggtcgagcgccggatttccgcgacgttcaaggacctgcccggcgggcaggtgctcggcccgaccttcgactacacccaccggctggtcgacttcgcgctcgccgccgagaccgcggttgaagccgggatggagcccgccgccgaggccgagccgcgggccgatgccggcgcctgcccgcgggtcaccgacctgctggcccgggacggcctgatcgagccctcgcccccggacgacggcgcgcccgcgggcgacctcacccgcgagccggtggactatcccgccgaccgggcgctccgtctccaggcgctggcccggggcgacgagggcttcgtgctcggcctcgcctactcgacgcagcgcggctacggccgcacccacccgttcgtcggcgagatccgggtcggggaggtcgcggtcgagtgcgtgcccgaggagctgggcttcgcggtgccgctcggccgcgtgcggctcaccgagtgccagatggtcaaccagttcaagggctcgggggcgaccccgccccagttcactcgcggctacgggctgagcttcgggcagagcgagcgcaaggccatggcgatggccctggtcgaccgggcgctgcgcgcggaggagctgggcgagccggtggcgagcccggcccaggaccaggaattcgtgctggcccactgcgacagcctccaggcgaccggcttcgtcgagcacctgaagctgccccactacgtcgacttccaggccgaactggaacttgttcgccggctacgcgccgagttcgaacagaaatccgacgccgtcgagatgcaggaggccgcggaatga

SEQ ID NO: 5409 - DNA, 588 bp, Methylobacterium sp.
atgctcgcccccggcttcgccgacccggtccacgacgcgcaggacacgttccgcgccgtgatggacgccctcgcccgccccggccgcgtccggcccctcgcgccgggcctcatgccacccgcgcccctgacgccggaactcgccgcggtcgcgctgacgctcaccgacgccgacacgccggtctggctcgatccggccctcgccgcggcgccggaggtcgcggaatacctgcgcttccacaccggcgcgccgctcaccggcgacccggccgcggcggccttcgcgctggtcagcgacccggcgcgctgcccgccgctggcccggttcgccgccggaacaccggcctatcccgacaccgccacgaccctggtgctcgccctcgacgcgctcgcggagggggaggggctgcacctgtccggccccggcatccgggggaccgcccggatcgcgccggcaccgctgccggacggcttcgcggcgcagctcgccgagaaccgcgtgggcttccccctcggcgtcgacctgatcctgacggcgcccggccgggtggccggtctgccgcgctccacgacggtcacggaggcctga

SEQ ID NO: 5410 - DNA, 411 bp, Methylobacterium sp.
atggccctctgtgccgaggcgagccgcgcggatctggaggcggccgtgtcggtcctcgacgcgcccgccgccgcggatctccggccgcccgagaccggcctcgtgatggcgtcgggccggatcggcggcgacggtcgcccgttcaatttcggcgaggtcagcgtgacccgggccgccatccgcctcgcggacggtccggcgggcttcgcctaccatctcggccgcgaccgcgcgaaggcgcggctcgccgcgatcctcgacgccctctggcaggatccggtgcggcgcgcccgggtcgaggccgccctggagcccgccgcccggcggctcgcggcttcccgggatcgggccgcccggcgcacggccgccacccgcgtcgatttcctgaccctcgcccgcggagaggattga

SEQ ID NO: 5411 - DNA, 744 bp, Methylobacterium sp.
atggatgcgcaggagcaggcggccggcctcgtccggggagaggggctgacggcgtggcggcagatcgccgacgcgctcacggccgagatcgcggcagggcgctacgtgccgggacagcagctgcccgccgaggccgccctggcggcgcggttcgcggtgaaccggcacacggtgcggcgggccctcgcggcgctggccgagggcgggctcgtgcgcgccagccagggccggggtaccttcgtggaggaggcgccgctcgcctacccgatcgggccgcgcacgcgcttctccgagatcgtcgccggggccgggcgcgaggcctggggcgacctcgtcgccgcgaccacggtcccggccgggaccgagcaggcggcgtccctggccctcgcccccggcgcgccgatcctggagctcctgacggtccaccgggcggacggcgccccgctctcgacggcgctgacctggctgccgctgccgcgcttcgcgggcttcgccgaggcctacgcggcgcgcggctcgatcacccgggccttcgcgacctgcggcgtccacgactacacccggctctcgacgcggatccgggcccgccccgcggattccgcggaggcgcagcgcctcgacatcgcgccggggcgggtcgtgctggtggtgtcgagcgtcaacatcgatcccgccggcgtgccgatccaggcgaaccgcaccctgttcgccgccgaccgcgtggagctggtgatcggcgggtga

SEQ ID NO: 5412 - DNA, 867 bp, Methylobacterium sp.
atgagcgcgcgtcccgaggccctgcgggcggcggcccgggccgacctcgcccgcctgcgcgcgcgctaccccgcgcagttccgcaccgactggttggggcgggcgcggctcgccgccctgctcgccgtcctggtggggctcgcggcgctcggctactggcgcctcgacttctcggtggcgcggatcctccacgggctcgggcggctcggcaccttcgcggtgctgatgctgccgccatcgccggagggccagttctggaccttcctgcacgcgctgggcgagaccctcggcatcgccttcctgggcacgctggcggcggcgatcctcgccttcccggtggcgttcctggcggcgcggaacgtcgtgcccaacccgttcgcgcgcttcgcggtccgccgcggcctcgacgtgatgcgctcggtcgacgtcctgatctgggcgctgatctggatcaacgtcgtcggcctgggcccgttcgccggggcgctcgcgatcgcgtgctcggatttcggggcgctcggcaagctgttctccgaggcgatcgagacctgcgacaagcgggccggcgagggcgtcgtcgcttcgggcggctcggcgctgcaccgcatccgcttcgggctgatccccggcgtgctgccggtgctggcgagccaggtcctgtacttcttcgagtcgaacacccgctcggcgaccatcatcggcatcgtcggcgcgggcggcatcggccagtacctcaccgagctgatccgcgtgctggagctgcagcaggtcgccttcctggtgctgatgatcctcgtgaccgtggcggcgatcgactgggtctcgacccgcctgcgccgggcgatcatcgggccggccgcgcgctga

SEQ ID NO: 5413 - DNA, 882 bp, Methylobacterium sp.
ttgcgcggcctgacacccctgtcgccggagcgggcagccgccctctccggcctctacgcggcggcgaccggcgaggcccgccgccgcacgctggcgggcttcgccctggtggcggcgctcgccgtggtcgccggcctgatcgccgaggtgcggccgctggtcttcgccgagaacatcggcaagttcaccgcctacattcagcagatcctgccgccgatcagcctcgagcacccgctggaggacgtccgcgcctggtactggggcctgcccaaatggctgggcctgctgggcgagaccctgctcatggcctatctcgggacgctgctcggggggctggcgggcttcgccctcagcttcgtggccgccgccaacctcgtgcggtcgcgcgtgctgcgcgtcggcgccaagcgcctcctggaactgtgccgcaccgtccccgaggtcgtgttcgcgctgatcttcgtcatcgccttcggcctcggcccgatggtgggcgtgctcgccatcgcgatccacaccacgggcgcgctgggcaagctgttctccgaggtggtcgagaacatcgacatgcggccggtcgagggcctgtcggcctcgggcgcgacctgggtccagacggtgcgcttcgcggtcctgccgcaggttctgtcgaacttcgcctcctacgcgctgctgcgcttcgagatcaacgtgcgcggcgccggggtgatgggcttcgtcggcgccggcggcatcggccaggaattcctcgtggcgatccgcaatttctactacgcggacgtgagcgcgatcctcgtgctgatcatcctgaccgtcttctgcatcgacctcgtcaccgagcgggtccgccaccgcctgatcggcgcggagcacgcccgatga

SEQ ID NO: 5414 - DNA, 936 bp, Methylobacterium sp.
atgatcacccgacgcaccctcgccgccgccgccgccgccacggccctcgccctcctcggcttgccggccgccgcccaggactggaaggcccagtttccggagctgacgctgggcgtgatcccggccgagaacgcctcgggcacggccgaccgctgggcgccgctcaccgcctacctgaccaagacgctcggcgtgccggtgaagctgcgggtggcgagcgactacgccgccgtgattgagggccagcgcgccggcaacatccagatcgcgtggtacgggcccgcctccttcgcgcgggccgtgatgaccggcgtgaagatcgagccgatcgtcaaccagaagcacgagaccggcgcctcgggctactattcggtggtctatgtgctggcctccagcccctacaagaccgtcgaggatctcaagggcaagaacctcgcgctggtcgatccgaactcgacctccggcaaccaggcgccgcgcttcttcctgaagcgggccggctacgacgtcgagaagttcttcggcaagaccttctacgcgggcagccacgagaacgccgtcctggcgctcacccagggcacggccgacgccgccgccaacctgtggaattccgagaccgacacgatggtcacccgcatggccgccaagggcatgctcaagaagcccgacggcacgccgatgcagcagtcggacttccgggtcgtcttcaagtccgacttcctgccggaggggcccttcgccatgctggcgagcctgccggacgacctgaaggccaagatccgcgacgccttcgtggccctgccgaaggccgacaaagccgccttcgaccggctctccgacggcaaggaccaggatctcacgccggtgaccctcaaggattaccagccgatcatcgacatgctgcggttcaacgacgagcagcgccggaagtcctga

SEQ ID NO: 5415 - DNA, 687 bp, Methylobacterium sp.
gtgtcgcgccgctacgccctctactggctgcccgccccggattcgcgcctcgaagccttcggccgggcgatcctcggcaccgacaacgtctccgggctgccggtcccgtacccggaggggctcggcgatctcgcacccgtcacggcgggcgcgcgggtctacgggttccacgccaccctcaaggcgcccctgcgcctcgccccgggcaccggggaggccgacctcgtcgccgccgcccgcgccctcgcggccgcgcacccgccggtggcggtggggccgctccgggtcgccgccctcgggccgttcctcgccctggtgccggaggccccgccgccggaactcgggctcctcgccgccgagtgcgtcgccgccctcgacccgttccgggcaccgctcacggaggccgagcgcgccaagcggcgcccggagcgcctcgacccgcgcggccgcgcgctcctcgaccgctggggctacccctacgtgttcgaggccttccgcttccacatgaccctgaccgacgccctgccggaggcggagcgcgacctctggcaccggcgcctgtccgcggcctacgccgccgcgggaccggagcccctgcggatcgacgccgtcagtctcctgacccaggacgggtcggagccgttccggctcctggcgcgcctgcccttcggagaggcccgtggttga

SEQ ID NO: 5416 - DNA, 480 bp, Methylobacterium sp.
atgaccccgtcggaccacgcggcgatgcggcgcgtcgcagacgtgtgcggcgacgaggccgacatcctggccctgtcggtggcccgcttcgtggcggccggctacatgaccagcgacgtcgcctgctggaacgcggccttcgacggggccgagcagctgctcgggccgacggaggggtgccgcttcgtcgcctgcgtggtcgcgatcatccgggcgctccgcgcggaacgcgacggcgactggtcgttcatgccggcgagctgctgccgcgtgaccggtcacgaatgcgcgctggtgaagctgatcaaccggggccggcagcgcctctgggcggatctcgaggccgccgcggccgagatcaccggccaggacgccgcgccgcgcctcgtagcggcggtccgcgccgcggtcgggccgctcgacgcggcggccgagcgcctcgccccggcctcctgccccgccggaacggttctgcactga

SEQ ID NO: 5417 - DNA, 318 bp, Methylobacterium sp.
atgaacgacgacactgagtacgacctcgacgaggtgaatgccacccgcgacgcggaggcggaagccaagacccgggcggagaaccgcgccgagcgtgcggaacgggcggagcgcatggctcgcgagggcgcccaggcgatggctgagcaccacgcggccatcaaggcgatggacgagcggacggtgcggctgcgctcgctccggctcgccaaggaggccgcggacgcgcaggccaaggcggccgagaaggaagccaaggcggccgccaagggcagcgcgaagaaggccgcgccgaagaagacgaccgcgaagggctag

SEQ ID NO: 5418 - DNA, 786 bp, Methylobacterium sp.
atgaatcctgctgcacgcccggcccgctccacccccgcaccgtcagccgtcacgccgatccgccccgccgagcggccacaccagcccttcaagatcgtgagctggaacctgctgcggcgcaccggcgcggcggtggacgacgtcgccgccctcgtggcgcaggagaagcccgacctgctgctgatgcaggaggcgacccgcgccatcggcttcctgctggaccggatcggcggccactatgcctgggcgcccctgccgggccggattcacgggctcgccatgtggagcccgaagccctgggcggccccgccccgggtcatcgcgctcccctccggcgccctcgtgcaccgcgtctgccagatcctcgatctcggcgagttcggcgtggccaacgtccacctgtcgcacgggcagatgctgaaccggcgccagctgcggcgcatcgtcagcgagctgccgccgcgagcggccgtgctcggcgactacaatatcgtcggcccggcgctgatcccgggcttccgcgacgtcggaccgcggcaatcgacccacgcgatggtcgaggtgctgccgctgcgtctcgaccgctgcctcgcccgcgggctcgtctgccacgcgcacgcggtgctgccgcggggacgctccgatcaccggccgatcgtcgtccatctcggcccggcgccggaggcgcacgcccccgcccgcttcaaaggtatggcagcagcagtcgcacgcctgcgtcgcgcagacggatcggcaggccgcgcgcggcgagatcctcccggctga

SEQ ID NO: 5419 - DNA, 321 bp, Methylobacterium sp.
atgagcaccatcgacctgctcggtctgacgctgtccttctacggcacgatgccgccgccgcggcccccgcggccgaaccgcaacggcgcgacctgggccgccgccgtgatcttcggcagcgtctgcctcgcgacgatcgggccgatgatcaccatctggagcttccaccggccctatgccgaggccaaggcgcgctgcatcgcctccggcggccgggtcctgtacggggccctcgacggcagcgggccctatcgctgcgagcggcccgcggccgccgcggccgccgcgcccattgcgcatccggccaagccggcggattaa

SEQ ID NO: 5420 - DNA, 471 bp, Methylobacterium sp.
atgtacggcgtccatcacccggcggcctccatcccactcccggctcgcgacgccgaccggcgcgcccggccgggcgcgcaaggagccgccagcgcggagcggcgcggcgcgccggccgtgccggtcgcggcgatctgtccgcaccgcgtctcgcgctgggcctggggcgagggcctgcgggccgggcaggccgttgcgctcctggtgcaggatctcgggcaggtcgaggccatgcgcctcggcctcacccgtctcgggctgcgcgtcgtctgcctcgactgcgccggccgcgacgcggcgctggcgggaagcctctcccagtcgggcgccgtgctggtcgtcgtcgataccgcgctcgccgacgcctatgccggcgtgatgggccggctcaccgcctatccggcggtgtggtggaacggtccgggcgccgacttcgcgagcctcgacctcgccctggccgagcacgcctga

SEQ ID NO: 5421 - DNA, 270 bp, Methylobacterium sp.
atgacccggacatgtctcgccgcccttctcgccctcgccaccgtcgcgcccgccagcgcccaggtcgaggcccggcccgtcgcgcccgctcccggcgcgccgggcgtggtgagccagcagatcgacgccaccgggaacgaagccgccgtgagctactcgcccaccggccggccggccgacacgatctccaacaactcggcggcggcgggcaacgccaaccagccgtcgcgggtcgcgccgcagggcggtggcggcggcggcagccggtga

SEQ ID NO: 5422 - DNA, 924 bp, Methylobacterium sp.
atgaccgagagcgtcgcgatcgtcggcgccggcctgatcggccgggcctgggcgatgatcttcgcccgtgccggctgggacgtgcgcctgttcgaccccgcggcgggcgtcgccgaggccgcgatcccgctctgcgccgaggggctgcgcaccctcgcggcgaacgacctctgcgcggaccccgcgggtgccgcggggcgcatccgcgcggccggcaccctcgcggccgccctcgacggcgtcgcgttcgtgcaggagaacggaccggagcggctggaggtgaagcggagcctcttcgcggacctcgacgccgcggcgccgcgggaggccgtcatcgcctcgtcctcctcggcgatccgctgctccctgttcaccgaggacttgccgggtcgggcccgttgcctggtcggccatccggtgaacccgccgcatctgattccgctggtggagatctccggcgcgccgtggacggcccccgaggcgctggtgcgggcccggcaggtctacgagcagatcgggcaggtcccgatcaccgtgctgaaggagatcgagggcttcatcctcaatcggctccagggcgccctcttggcggaggccttccgcctcgcctcggagggctacgtgaccccgcaggacctcgacaagaccgtggcggacggtctcggcctgcgctggagcttcatggggccgttcgagacgatcgagctcaatgcgcccggcggcatcgccgattactgcgcgcgctacaccggcttctacaaaaatcttgccgccgacccggcgccgccctcggtctacgaggcgccggccaccgaagcgatcctggccaactggcagccgccgaccgatctgcccgcacgcatgaaccgccgcgacgcgcggctggcggcgctccgcgcccacaaggcttcacggaaggactga

SEQ ID NO: 5423 - DNA, 822 bp, Methylobacterium sp.
atgtcacgaccgctcgaccggagatccgacgacaggatcgaggcgaccggtgtcgagggacggcgcagtgcgatcgtcgcctcggtccgccagcgcggcttcgtgacgatcgaggccctggcggcgcagttcggcgtcaccgtccagacgatccggcgcgacctcaacgagctgagcgccgaggggcggctggagcgctaccgcggcggcggcggcctgccctccagcgtcgagaacatcgattacgccgaccggcgagtgaccctgctgccggagaagagccggatcggccgcctcgcggcgagccgcatcccgtcgcactgctcggtcttcatcaacatcggcacgacaccggaggccgtcgcccgcgagctgacccgacacgacgatctcagcatcatcaccaacaacctcaacgtggcaatctcgctcgccgagacgaccgagttccgcatcgtcgtggcgggcggcaccgtgcggaaccgcgacggcgcggtgctgggtcagctcacctgcgacacgctcagccagttccgggtcgacgtggcggtgatcggcatcagcggcatcgacggggacggagcgctcctcgactacgattacgaggaggtgcgggcgacccagaccatcctggcccatgcccgaaaaaccttcctggtggccgaccacaccaagttcacgcggcgcccgatggtccaggtcgggcgcctggagcaggtcgacaccttcttcaccgaccgggcaccgccggccgagatcgtcgcgctcatggagcgccagggcgtcgccctggcggtcgccgacagcgcggacgaaccgtaa

SEQ ID NO: 5424 - DNA, 1350 bp, Methylobacterium sp.
atgctgaacgacagccgccacgccgcccgcaacacgccgaccgtgaccgccatgaaggtcgtgccggtcgccggccacgacagcatgctgctcaacctgtcgggcgcgcacggcccgtacttcacccgcaacctcgtgatcctgaccgactccaccggcgccaccggactcggcgaggtccccggcggcgagggcatccgcaagaccctggaggatgcccgggatctcgtggtcgggcagccgctcggcgcctggaacgcggtgctcaacgccatgcggacgcgcttcgccgaccgcgacgtcggcgggcgcggcctgcagaccttcgacctgcgcatcaccatccacgcggtcacggccgtcgaatccgccttcctcgacctgctcggccagtacctcgacgtgccggtcgcggcgctcctgggcgagggccagcagcgcgacgccgtcgagatgctgggctacctgttctacgtcggcgaccgcacccgcacggatctcgattaccgcgcgccgaccgcccgcgacggctggttccgcctgcgggacgaggaggcgctgacaccggaggccgtggcccggctcgccgaggccgcctacgaccagtacggcttcaacgacttcaagctgaagggcggcgtgctgcgcggcgaggacgagatcgccgccgtcaccgcgatccacgagcgcttccctaaggcgcgggtcacgctcgacccgaacggcgcgtggtccctcgcggaggcgatccgcctctgcaagggccagggccacgtcctggcctacgcggaggatccctgcggcgccgagggcgggttctcgggccgcgagatcatggccgagttccgccgcgccaccggcctgcccaccgccaccaacatgatcgccaccgactggcgccagatgaaccacgcgatccagctcggcgccgtcgacatcccgctggccgacccgcatttctggacgctcgccggctcggtccgggtggcccagctgtgccgcgaccacggcctgacttggggctcgcactcgaacaaccacttcgacgtgtcgctcgcgatgttcacccacgtggccgcggcggcgcccggtaacgtcacggcgatcgacacgcactggatctggcaggacggcgagcgcctgaccaaggagccgctggcgatccgcggcggcctcgtgcgggtgccggagcggccgggcctcggcatcgaactcgacatgtcggcggtggaggaggcccacgccctctatcgcgaccacggcctcggcgcccgcgacgacgcggccgccatgcagttcctgatccccggctggaccttcgacaacaggaagccctgcctggttcgttga

SEQ ID NO: 5425 - DNA, 495 bp, Methylobacterium sp.
atggagacgggcgggaccgccacgagccacgtgccggacgacctgaaggcggaggcgcaccggggcgatcccttcgcggccgccgtgcgggcgacccggatgccgatgatcatcaccgatccggcccagcacgataacccgatcgtcttcgtgaacgacgccttcctgaagctgaccggctacacccggatggaggtggtcggccgcaactgccgcttcctgcaggggcccgacaccgaggcggcggccgtcgatagtctccgcgcggccatccggcgggaggaggatatccgggtcgacctcctcaactaccgcagggacggctcgaccttccagaacgccctctacgtcggcccggtgcgggacgaggccggacgggtggtctacttcttcgcctcgcagctcgacgtcagcgagcactacgcgctgaccgccgagatcgagcggctgaaggccgccctggccgaggccgaggccaagctcgcggcccgctag

SEQ ID NO: 5426 - DNA, 201 bp, Methylobacterium sp.
atgctggaccatcatcgggacgcggccgtccaggccgagcgtcgcctggagcgttcggtcgccgccgccctgcgcgtcatcgcggccgcccacgacgagcggcaggccccgccggtcagcgcggcccgccgccgcctgagcgaggtctacggcgccacccgcctggcccggcgcctggagcaggagcgccggaccgcctga

SEQ ID NO: 5427 - DNA, 246 bp, Methylobacterium sp.
atgccacgccgcgtttactaccggatcagcgacagaccggacggccgcttcgacgccgtcgtgacgatcgagcccgacacggtcgtccgccgcgacggcttcgattcgctcgccgagctggaagagtggatcgacggcctgcgcgcgctgatggcggcgctcggcgcgccggtgtcgcaagcggacgcggcgggggcgccggccgagacagcgggcgcgccgggccggctgcgcacggcgcgctga

SEQ ID NO: 5428 - DNA, 108 bp, Methylobacterium sp.
atgtcaccggagatgcgggaatcgcgcgcggcgctcatcctgctcgccgcctcggtcggggcggtcctgattttcggcgccttcacgctgctctcgcagctcggctga

SEQ ID NO: 5429 - DNA, 303 bp, Methylobacterium sp.
atggagcgcctgttcatcatcctggctattctggtcttcgctgtcgccatcgtcgccgtggccgcgatggcggcgcgcggccggcgcgaacccctgcgcatgggttccgaactcgacatcgaggacgaggacctcgtcctcggctcggtcggaccgcgcaagagcccgatcgaccgcagcgcccaggtgctcgacccgcgcgtgctcgatctggacgcgatcgaactggaaccgatccgcgccctcgaccggacgcagcgcgacgcggcgctccgcggagatccgccgggagccgggcgatga

SEQ ID NO: 5430 - DNA, 1164 bp, Methylobacterium sp.
atggtcgcctcgatcgccctgccccggctgatgcgcgtcggcgccggcgcctcgcggctcctgccggaggtgctcggccagctcggcctgtcgcggcccttcgtggtcaccgatccctacctcgccggcagcggccgcaccgacacgctgctcgagcgcctcaccaaggcgggcgcgcaggccacgatcttctccgagaccgtgccggacccgaccgtcgcctccgtggaggcggcgctggcggcactccaggcgggcgatttcgactgcgtggtcggcttcggcggcggcagcccgatggacaccgccaaggcggtggcggtgctcgcccgccacggcggccacatgcgcgactacaaggcgccgcgccagcaggacgagcccggcctgccgatcgtggcgattccgaccaccgccggcaccggctcggaggcgacccgcttcaccatcgtgaccgacgaggcctcggacgagaagatgctctgcatcggcctcgcctacctgccggtggcggccctggtcgattacgagctgacgctcaccaagccgaagcggctcaccgccgataccgggatcgacgccctgacccacgcgatcgaggcctacgtctcgcgcaagtcgaacctgttctcggacgggctggcgcttcaggcgatgcggttgatcgccccgaacctgcgccgggtctggaccgatccgggcgaccgggcggcccgcgaggcgatgatgctcggcgcgacccaggccggcatcgccttctcgaacgcctccgtggcgctcgtccacggcatgagccggccgatcggcgcccatttccacgtggcccacgggctctcgaacgcgatgctgctgccggcggtgacggccttctcggctccggccgcgatcgaccgctacgccgcctgcgcccgcgccatgaagatcgccggcccggacaccgacgaccgctcggcggtgtcggccctggtgaccgagctcgaggcgctgaacgacgacctcgacgtgccgggaccgcgggaatacggcatcgacccggcccgctgggaggctctgctgcccaccatggcggcccaggcgctggcctccggctcccccgccaacaacccggtggagcccagcaccgacgagatcgtggccctgtaccggcgcgtctgggcgggatga

SEQ ID NO: 5431 - DNA, 327 bp, Methylobacterium sp.
atgcgtgccgcgtcccgcgcgctcctcgccctggcgctcgccctcccggcgggctccgcctgggcgcaggtgcagcagaacgacccgaacgccgccaacgcctcattcgccctgcagggccagatccggtcgctcaaccagcagcgggtctcggacttcaacacgctgaaccagacgttccagcgcaacgtccaggccgagtccttcgggccctacctgccctatcggggcgtccgcggggatgtgtaccggggccgccatatcggtcgcaacgggatcgtgcggcggggcggcggcctcaacacgagcgtctgcaccggctgctga

SEQ ID NO: 5432 - DNA, 729 bp, Methylobacterium sp.
atgggcgcccactggatcgagaatgcggcccggcactggcggcacgggcggatcgtcgggcaccgcttcgccgagcggcgtcccggcatccgcgcggccctccgggcggccgcgcccggcagcgtgctgctcgccggcaattcccacgcggagctcgtcggcgcgccggatctcggcggccggccctgcatcaacgtcgcggtcggcggcagcaccgcggccgattgcggccgccagctcgcggcgctgtgcgtcccggtccgctgcgcggccgcggtgctgatcatcggcaccaacgacatccagcgctggcgccatcccgagcgggcccgggtggtcgaccggttcgaggccgatgtccgggacatcctgcgccgcctggaggcctgggccgcgcaggtcttcgtcgccgcgataccgccgatcggtgccggggcgaccgggcgcgatcccgccgccgtcgcggtcttctcggatcgcctcgcggcactctgcgccgcggggggccgcaccttcttcgacccgttcgcgccgtggcgatccggtaccggcggcctcgccggtccgggcctccaccgggacggcgtgcatctggccgactacgcgcccctggccgcggcgctcgccagcgcggtggtgctcgatgcgctcccgctcgcgcccgtccggaggcccgtgccggccgcgcccctgcggatcctgcgcgccgcctggatcggccggccgtga

SEQ ID NO: 5433 - DNA, 987 bp, Methylobacterium sp.
atgaaggcggatcgaccggacggtgcgaggctgcgccgtgtcctcttcctgggagcgaccggcacaatcggccgggcgacggttcgggcactggtctcgcgcggtcacgaggtcgtctgcctcgtcaggcgccctgccgaaaccgcgatcccggcaggcgctaccgcccgcatcgtggatctgaccgacacggtgtcgctggcgcgcgacggtgtccgcggcgaacgcttcgacgccctggtgtcgtgcctcgcctcgcgcacggggctgcccgacgatgcctgggcgatcgattacggcgcgcaggtcgaggccttgcatgccggccggacggccggcgtcacgcacgtcgtgcttctgtcggcgatctgcgtccagaagccgatcctcgcttttcagcacgccaagcgcgccttcgaggcagagctgatcgcgtcggggctcgactacacgatcgttcggcccaccgccttcttcaaatcgctctcgggacagatcgatcgcgtgaaacgcggcaagccatttctggtgttcggggacgggaccctgacggcctgcaagccgatcagcgacgacgaccttggccgctatctcgcggactgcctcgacgatggggaccgccgcaatcgcgttctgccgatcggcggcccgggcgaggcgatcacgccgcgcgcgcagggcgagcggctcttcgccctgctggggcgcgaaccgcgcttcacgcacattccggtcgtgctgctggatgtgatcgtcgccgttctggcgacgatgggccgatgggtgccggccctggccgccaaggccgaactcgcgcggatcgggcgctactacgcgacggagtccatgctcgtcctggacccagcgaccgggcgatacgatgcccaggccactccgtcgacgggatcggagacactcttcgactactatgcgcgcgtggtccgtggcgaggcggtcgccgagcgcggcgaccacgcggtgttctga

SEQ ID NO: 5434 - DNA, 192 bp, Methylobacterium sp.
atgagcagcaccaccgacaagatcaagggcgtcgccaacgaggccctcggcaaggccaagcagggcatcggcgacgtgaccggcaacgacaagctcaaggccgaaggtgccgcccaggagctcaagggcaaggcccagagcactgtcggcgacgccaagagcgcggtgaagtccgccaccgacaagctctga

SEQ ID NO: 5435 - DNA, 258 bp, Methylobacterium sp.
gtgcaaacctacaccctcgccatcgccgacggcgtcctgttcgcctgcctgcccgacgaggccgacatctcggccgcgatcaccgacgcgaccgcgaccaattacgggttcggcctcagcctcgacatcgtccgcggggcgaccctgaccgacgcggcccgtcccgaggacgaggtcgtgtggcaggaagggccggacagcgagctgctcgacgcgcaggggcggcgctaccgctacgccgtccgccgaccctgctga

SEQ ID NO: 5436 - DNA, 1068 bp, Methylobacterium sp.
atgcaggaccccgtgagcgccgccggcgctccgctcgtgacgatcgccatgccggccctgaacgaggccgcgcacatcgccgacgccatcgcgtcggtgctgcccgaccgggacgccatcgcctgcgagctgctggtgctggacggcggcagtcgcgacgatacctgcgcgatcgtcgccgccctgagcgcccgcgacccccgcatccggctcgtccacaacgagcgccgcatccaggcggcggcgatcaacctcgccgcgcggctggcgcatcccgcctccgcctacctcgtccgcgccgattgccacgccgtctatccggaggggttcgtgcagaacctcgtcggcacgatgcgcctgcgccaggccgtctcggtggtcgtgccgctccggaccgtcggggtcacgccgctgcagagggcgatcgcggcggcgcagaacagccgcctcggcaacggcggctcggcccaccggcagggcggcatctcgggctacgtcgcccacggccaccacgcggccttcgaccggcgcgagttcctgcgggtcggcggctacgacgagaccttcacccacaacgaggatgccgaactcgaccggcggctctgcgcggcgggcgggcggatctacctcgccgccgagctcgccatcacgtacttcccgcgcgcctgcctccgcagcctcgcccggcagtacctccactacgggcgcggctgcgcgcggaccctcgagaagcacgccagcctgccgcgcgcccgccagatcctgccggccctggtcctgctctacgccgtcgcggccctgccgctggcggccctgatgcccgccctgctgatcccgctgctgctctatgccgggggctgtgtcctgagcggcctcgccctcgcgctgaaggcgcgggagcccgtcctggtcatgagcggcccggcggccgtgaccatgcacctgtcctgggcggcggggttcctgtcctatccgggctaccggcggacgctgctccgggccgccctgcgaaagaagcgccgcctgctcggcctcccgccgggatccgacgcggcgcgcgtcaactga

SEQ ID NO: 5437 - DNA, 219 bp, Methylobacterium sp.
gccgcggacctgcgggggctgggggcgctgggccggttccgggcgacgtgcgaggatctcgggactttctgcttcgccgacgcctgcggcggcgatcagatcgcggcggccgagggctgccgggcgcgctgcccgagcgcgtcgatcgtcgaggtcgtcccggccgcctgcccgctgccggacggtcggtccgtgccgatcctccgacgccgcggctga

SEQ ID NO: 5438 - DNA, 339 bp, Methylobacterium sp.
atgaagcacatcgacgccatcatcgcctggacgcccgtccgctgggcggagctgaagccggaaaccgccgggcaggtcgttgtcctgcccgcgcccgacgcggccggagaggccaagcgctacatgatgcgcgccggcgcgagctcgtccgccttggccaccctgtcggaggaggctcgcgtcgcgcgcctgttcatcgacttccagaccctggtcgtccgcgacgggatcgacccgcaggtcgcccaccgggcgttcctggcgatcgacgagtaccggttccgcatcgcccccgacaccgagggcgcggaattcgaggacccgcccgaggaagattag

SEQ ID NO: 5439 - DNA, 120 bp, Methylobacterium sp.
atgctgctcctcgccttcgaggtgctggtcgcgggcttcacccaagccatgatccagccggtccggcaaccgggaatcaccatcgagatgtcggtgacgccccaccacgtcgtgacctga

SEQ ID NO: 5440 - DNA, 708 bp, Methylobacterium sp.
atgaccgcgctactgaccttccaggacgtcgccaagagcttcaccctgcacctgcgcggcggcgtcgtgctgccggtggtcggcggcgtgagcctgtcggtggagcccggcgagtgcgtggtgctcggcgggccgtccggcgcgggaaaatcctcgctcctgaagatggcctacggcaattatcgctgcgacggcggcgcgatcctggtccgcgacggcgacacggtcgtggacgtcgtccgggccgatccgcgggcggtcctggcgctgcgggcgcgggtgatcgcctacgtgtcgcagttcctccgggtgatcccgcgggtctcggccctcgacgtcgtcgaggccgccggccgcgagggcggattgtccgaagcggcggcgcgcgggcgggccgagaccctgctggcccggctcaacctgccggagcggctctggggcctgccgcccgcgaccttctcgggcggcgagcagcagcgggtcaacatcgcccggggcctgatcgccgaccggccgctcctgctcctcgacgagcccaccgcctccctggacgccgagaaccgcgccgtggtggccgagctcgtgcgtgagaagctccgggccggggccggcgtgctcggcatcttccacgacagcgagatgcgcgacgctgtggcgacccgggtggtcgatgtcacccgcttcgcgccgcgcgcccgggcagcctga

SEQ ID NO: 5441 - DNA, 774 bp, Methylobacterium sp.
atgagcgaaaccctgcttcaggtccgcggcctgaccaagcgctacggggcccgcctcgcctgcgccgacgtgtcgttcgacctcgtccccggcgaggttctggcgatcgtgggcgaatccggttccggcaagtcgacgctcctctccctcatcgccaccgagctggcgcccgattccgggacggtcgcctaccggaatcgcgacggcgcgctgcgcgacctcgccaccctgagcgaggccgggcgccgggcgctgatgcgcaccgagtggggcttcgtccgccaggacgcggcccagggcctgcgcatggcggtctcggccggcgggaatgtcggcgagcggctgatggggctcggcgaccgccattacgggcggatccgcgcccaggccctcgactggctcggccgcgtcgagatcgccgccgaccggatcgacgacccgccgacgcgcttttccggcggcatgcgccagcgcctgcagatcgcccggaacctcgtcaccggcccccgcctggtgctgatggacgagccgacctccggcctcgacgtctcggtccaggcccggctcctcgacctgatccgccggctctcggccgagctgggtctcgcggtgatcatcgtcacccacgacctcgcggtggcgcggctcctctcgcaccggatcatggtcatgcgcgccggccgggtgatcgagaccggcctcaccgaccgcgtgctcgacgatcccgagcacgcctacacccagctcctcgtcgcctcggtgctcgccgcatga

SEQ ID NO: 5442 - DNA, 810 bp, Methylobacterium sp.
atgatccgccgggccatcctcaaggccatcgcggtgccgggctaccaggtgcccttcgcctcccgcgagatgccgatgccctacggctggggcaccggcggcgtgcaggtgacggccgcgatcctcggccgctcggacgtgctcaaggtcatcgaccagggcgccgacgacaccaccaacgcggtctcgatccgccgcttcttcgccaagacctccggggtggccaccaccacccgcaccgcggaggcgacggtgatccagacccgccaccgcatccccgagacgccgctcaccgaggggcagacgctggtctatcaggtgccgatccccgagcccctgcgcttcctcgagccccgcgagaccgagacgcgccagctccacgcgctggccgagtacggcgccatgcacgtgaagctctacgaggacatcagccgccacggccacatcgccaccacctacgcgtacccggtggaggtggcgggccggtacgtgatggacccgtccccgacgcccaagttcgacaaccccaagatggacgactgcccggcgctccagctcttcggcgcgggccgcgagcggcggatctacgcggtgccgccctacacgcgggtgcgcagcctcgacttcgaggaccacccgttccggatccaggcgttcgagcatccctgcgcgctgtgcggtgccgagggcgtctatctcgacgaggtgctgctcgacgatgcgggccggcggatgttcgtctgctcggacaccgaccattgcgagggccgccgcgcggacggccatgtcggcacgggggacgcgctatga

SEQ ID NO: 5443 - DNA, 1206 bp, Methylobacterium sp.
gtggatttcaccatctccccgcgcgtcgaggattaccgcgcccggatcgcggccttcgtggacgcgcacatcctgccgctggaggccgatccggccgcctatgacggccacggcaacatcagtctcgccgagctggcccggctgcgcggcctcgcccgcgcagagggcctgtggtgcctgcagctgcggcccgagaccggcggcgccgggctcgacaaggtcggcatggcggtctgctacgaggctatgaaccgctcgatcttcgggccggtcgtgttcaactcggccgcgcccgacgacggcaacatgatggtgctggagaaggtcgcgaccccggaccagaaggcgcgctggctcgcgccgatcgtggacgggcgggtccgctcggccttcgccatgaccgagccgcatcccggcggcggctccgatcccggcatgatccagacccgggccgagcggcggggcgacggctacgtggtcaccggccgcaagtggtacatcaccggcgccgaggaggccgagcacttcatcctgatggcgcgcacctccgacgacgcgcggaaggggctgaccgccctcctgttccacagggaccagcccggctggcggatcctgcgccgcatcccgatcatggggccggaggagcacggcggccattgcgagctgctgttcgagggcctggagatcccggccgagaacgtcctgatgaacgagggcgacggcctgaagctcacccagatccgcctcgggccggcgcggctgacccactgcatgcgctggctcggcctgtcgaagcgctgcgtcgagatcgcccgggcctacgcggccgagcggcacggcttcgggatccggctggccgaccgggagagcatccagctgatgctgggcgacctcgccatgcggatcgagatcgggcgcctcctggtgatgaaggccgcctgggccctcgaccagggcagcttcgcccgcaaggaggtgtcgatggccaaggtgcacgtggccaacctcctgcacgcggccgccgacacggcgatccagatcaacggcgcgcggggctactccaccgacacccccctcgagtggatctaccgctacgcccggcaggcgcgcctcgtggacggggccgacgaggttcacaagatggtcctgaaccgcaatctcgaggccgagggcgacgccttctggtcgtggggcgtcggggcctga

SEQ ID NO: 5444 - DNA, 285 bp, Methylobacterium sp.
atgtccaaacgcttctacttcgacgtcgagaacggtctggaaactatttgggacgaagaaggtgtcagggctgacagcctggaacaggcgctgcttgatgcacgtagtgttatcaaagaaatggcagaagatttggccgatgacgttctgagtggagaattgatgctggtggtccgcgatgaagcggggtcgctggtcgcacacctgccgatcgagaagtcgcagcaccgcttttccagttcgaagttcgagaatatgcaaaagctgatcaggcctcatcgctaa

SEQ ID NO: 5445 - DNA, 222 bp, Methylobacterium sp.
gtgtccgagcgcttctacttcgacctcgagagcggcgaggagacgatccgggacgaagacggcgtggaggtccgcaacctggccgaggccatggccgaggcgcgcagcgtcatcgccgagatggccgacgaggtctgcgcggccgatcccgatcggtcctggagcttggtcgtgcgcgacgccgccggctacgcccgccaccggctgccgatccggcggtag

SEQ ID NO: 5446 - DNA, 372 bp, Methylobacterium sp.
atgaccttcggggttcggcataggcgcccggccggggcgcggggctggtgggcgctcgccgcccgcgcgctcgcgctcgtcctggcgctgaccgtcgccgctccgggcgttggcctcgcggcggatctcgccttccacgcgggcggccaccacgaccggggccagggcccggccctcgacgcgccggcggcgcccgcgaccgtcgatcccggcctctcggagcacctccattgcggctgccatcaggcggcccgcctggaggcggccgagatcgcgcccccggccgccccgggccgggcgctgccgggtgccctcgcccagggccgcccctccgtcagtcccgaccgcctgccgcggcctccgcgcgcgtga

SEQ ID NO: 5447 - DNA, 399 bp, Methylobacterium sp.
atgcgccgcctcgtcctcgccgccttcgccgccgccgccctcgccgggcccgcgctcgccgccaacgaggcgccgcagacggtcgcgcccaaattcgagaccgtgccgcaggacgccgtgctcagctacaacctcatcggcctcaacgtcaccgacgcgcagaacaacacggtcggcgagatcaaggacctcgtgatcgatcacgggaagctgtccggctacatcgtctcggtgggcggcttcctcggcctgggcgagcgctacgttgcggtctcgccgagctcgatcgcgctgggctacgacgccgacgcgaagaagtggaaggccatcatcggcgccagcaaggaccagctgaaggcggcgccggagttcaagtacgagggcaagttcaagcgctga

SEQ ID NO: 5448 - DNA, 138 bp, Methylobacterium sp.
atgaacgatattgcgcaacgcgccgagcccgcggcggcgacgccggacctctggcaatccatcccgctcgaatgcatcctgagcgcggtcgccgtcctgctggcggcggggctcaagctcgccggcgtgatgtcctga

SEQ ID NO: 5449 - DNA, 786 bp, Methylobacterium sp.
atgcggatccgcgcggccctcctcctcctgctcctccccgccgccgtccacgcggagacgaaaccgatggcgcccgatccgacggtcctgcacgacctcgcccccaccggcacgctccgggcggcgatcaacctcggcaacccggtcctggcacagggcggcgccgacagccccgcgggggtctcggtcgacctcgcgcgggcgctggcggcccggctcggcgtgccggtggcgttcgtgaccttcccgggggccggcgcggtctcgggctcggcggcctccgggacctgggacatctgcttcctggcgatcgatccgaagcgggcggaggggatcgccttcaccgcgccctacgtgctgatcgccggcagctacctcgtgccggccgcctcgccgatccgctccccggaggcggtggaccgcgacggcgtgcgcgtctcggtggggcgcgggagcgcctacgacctgttcctgagtcgcgccctgcagcacgcgaccctggtgcgggcgcccacctcggccgaggcggtcacggccttcgcccgggacgggctcgacgtcgcggccggcgttcaccagcccctcgccgcctacgcggcggcgcacccggaggtgcggctgctgccggggcacttcatggagatcccgcaggcgatgggcctgccggtcgggcatccggccggcgccgcgtatctcgcggatttcgtcgcgcgggcgaagcgggacgggctggtgcggcgcggcctggaggccagcggacaggacccggatctggccgcgccgtga

SEQ ID NO: 5450 - DNA, 831 bp, Methylobacterium sp.
atggaccagttcgacgcgttccgggcgatgagcgagttctggacccgggccggcgcgggcttcttcaccccgggctccgggcagtccgcgcccgggttcggctggccgaccttcccgggcagcgacctcgcggatctcgccgcggcgcaggccaaactgaccgaggcctggaccgccgccagcgccctctcgcagacgctgacgcgctcgctccagggcggcccaggcgcgccggacccgaccgccggggcggtgctcgcccggatcttcgatccgcaggcctggctcggcggatccgccgaattcgacgccgccctcacccgcatggccgaggggccgcagctcgccgacctgtggcagaccgagcggcgctatgcggctctgttcaccgcctgggcgagcctgcggcgcgcgcagagcgagcatcaggccgtgatgctgcaggcctggacgcgggcggccgggaccttcgcccaggaggccaacacccgcgccgagaagggcgagagcttcgcctcggcccgggacatgatgagccggtggatcgagaccgccaacgcggtcctgctggaggtccagcgctccgacgcgttcctggcctcgcagcgggcggtcctgcgggcctccacggacctccgcctcgcccagcaggacgtcgcggccttcctgtccgagttctacggccagccgacccgggccgagctcgacgacgtccacaagagcctgaccgagctgcgccgggaagtccgggcgctccgccgcgagcgccggcaggccggcaagaccgcgagagccggcggttcacgggtcggggaggaagcccatggctga

SEQ ID NO: 5451 - DNA, 258 bp, Methylobacterium sp.
atgcagcccgccatccagcaggtgatcagagcgctcgccgaggatggtcgagccggcgcgatcaatatcgcggagcacgcggtcgattcctacctcgccgacgcgccgagcgagggcgacagggcgctgtcgcgggacatcctggtccgggatctcgccagcctccggggcgtcgccccgcatctcgcggccttcatcggccgggtcgaggcctacgtggcgagcctcgcccagccgtcgctgagccgggcggcctga

SEQ ID NO: 5452 - DNA, 192 bp, Methylobacterium sp.
gtgcagaccgccctcggcccccgggcccagagcaacttcaacagctcgctgttcaacgacgtgacgctgctcaagcggatcgaggccttcgaggccaagctcggcgagcccgagaagccgaagaccgccgactacaccggcaacatgttctcgcgcatcgccaaccgccgcgccgccgcgggcgccaagtag

SEQ ID NO: 5453 - DNA, 216 bp, Methylobacterium sp.
atgtcgtattcgattctggttcgcgatctcacccgcgagaccggcggtactcccaaacttctggcctacgacattcgcgaccgctcggcggccgagactctcgtgtcggtgatcgccacttcgtatcaggatcacggtttcaatccagcgacccgcgtccactggtttcgccacgcggacgggctgcgcgagatcttcacgtggccgcggtcctga

SEQ ID NO: 5454 - DNA, 1011 bp, Methylobacterium sp.
atgcagtatcgcacgctcggccgctccggcctcaaggtctcgccgatctgtctcggcacgatgatgttcggtggccccaccgacgaggccacggccggccgcgtcgtcgccagcgcccgggaggccgggatcaacttcatcgacacggccaacgtctacacggagggccgctcggaggagatcaccggccgggcgatcaaggccgagcgcgacgcctgggtcctggccaccaaggtcgccaacccgaccgggccgggcatcaacgaccgcggcctctcgcgggtccacgtgatgaaggccgccgaggacagcctgcgccgcctcggcaccgatttcatcgacatctactacctccacaaggaggaccacgacacgccgctggccgagacggtccgggcgatcgccgacctcgtgcgggcgggcaagatccgccatttcggcgtctcgaatcaccgctcgtggcgggtcgccgagatctgcaggctctgcgacgaggccgggatcgaccggccggtggtgagccagccctactacaacgccttcaaccggatgcccgagaccgagcacctgccggcctgcgcgcatttcgggctcggcgtcgtgccgtactcgccgctcgcccgcggcgtgctcaccggcaagtacgaccccgacgcgccgccgccggccgagtcgcgcgccggccgccaggacgcccggatgatgcagaccgagtggcgcccggaatccctgcgcatcgcccggaccctgagggagcacgccgaggcccgcggcatcacggccggccagttcgccaccgcctgggtgctgaacaaccggctcgtcacgggcgtgatcgccgggccgcggacggaggcgcagtggcaggaatatctcggcgccctcgactacgccttcaccccggaggacgaggcgctggtcgacgggttcgtggccgcggggcatccgacgacgccgggctacaacgatccggcctatccgctggaggggcgggtgccgcgcagcggctga

SEQ ID NO: 5455 - DNA, 885 bp, Methylobacterium sp.
gtggccgggatcgggcgggggcggtcgccgcgcctgccggacggcgtcacctacgcggcgatcgacctcctcgacgaggccgcgctcggcggcttcgtggcgcggttccggccgaccgcgatcctgcacctggcgggcctcgcctcggtggcggattctgcgagcggcccgggccagacgtggcgggtcaacgtcaacggcctgatgaacctcgtggccgcggtggaggcggtgccgggctgcaccttcttcttcgtcagttccggcgaggtctacggcagcgcgttcctcgccggccacgctctcagcgaggcggtcgagcccctgccgcgcaacacctacgcccggtcgaagtgggtcggcgagcagctgctccgcgacctgctgccccgcatcggcgtgaagctcgtcgtgctgcggccgttcaaccatatcggtcccggccaggacgagcgcttcgtcgtggcctccttcgcaggacagatcgcccggatcgaggccggcctcgtgccgccctgcctggaggtcggcaacctctcgtcctaccgcgacttcctcgacgtcgccgacgtggcgaacgcctacgccgacctgatcggccgcgcggactccctcgcggacgggagcgtgttcaacataagctcgggccagccgcggacgatcgccaacgtcctcgaggacctgcgcgcgcgagcccgggtccccttcgagatccgcatcgccccggagcgggtgcggccgaccgagatccccctggccgcgggcgatgccggccgcctccacgccgccaccggctggcagccgcgggtttcgtgggacgcggccctgacccgggttctggacgacgcgcgggcgcggctcgcggacgcgcgcgagacccgctga

SEQ ID NO: 5456 - DNA, 1083 bp, Methylobacterium sp.
gtgacccgcgccggctacttctacatcggcggccgctaccagaagctcggcgacaagaccgtgatggtcggccagatgttcgtgcagtcgcgcaccccggcccgggtcacgcagccctacccggtggtgatggtccacggcctcgcccagaccggcgtgaactacctcgccagcgcggacggccgcccgggctgggtgcagcgcttcgtcgagaagggctaccaagtctacgtggtcgaccaggtcgggcgcgggcgctcgggcaccaacccggaggtctacggcccctacgaccggctcggcacccgcagcctggagcgcacccacacggcgcccgaggtctacgacctctacccgcaggccaagctccacacccgctggccgggcggggccggcgtgcagggcaacgccgccttcgaccagttcttcgccagccaggtcccgttcctcgccaacagccagcagaccgaggaatgggtcgacccggccctggtggcgctgctggacaggatcgggccggcgatcctgctcacccacggccaggcggccctgttcggctgggcggcctcggacgcgcggccggacctcgtgaaggcgcacgtcgccgtcgagccgaacggcccgcccttcttcgacgtgcagttccgcggcggcaaggagttctgggagaagaccggcgacgggcgcgcccgcgcctacgggctgacccgcatgccgctgaccttcgacccgccggtccgggcgcccgaggacctgacggtggcgcaggcggccaaggggtccgattccaagtccgacagggccgcggacgggcggatccgctgctggctgcagggcgagcccgtccggtccctgccgaacctcgccaaggtgccggccgtggtggtgaccgcggaggcctccttccacgcgacctacgacgactgcactgtcgcgttcctgacccaggccggcgccaggccggacgtggtccggctggccgaccgcggcctccacggcaacggccacatgatgatgctggagacgaacagcgacgccgtcgcggacgtcctggccggctggctcgcggaccgggtgaagtag

SEQ ID NO: 5457 - DNA, 1188 bp, Methylobacterium sp.
gcccgggccgccccgaccccggccttcgcggcttccgcgaccccgcgcggccgccgcgtcgccttcttcgggcacgaccgggccgagcccacggtccggaagcgggtcgacgccatccgggacgccgggtggtcggtcatcgtgtacgccttcgagcgggaccgccccggcgctgtgccggccgaggccccggtggcggacgacatcgtccccctcggcctgaccgtcgaccgcaactacgcccgtcgcctgccgcgcctcgccgtcggcatcgcccgggcgctgcgccgccggcgcgacctgcgcgcggcggacgtgatctacgtgcgcaacctcgacatggccctcgtggcctggacggcggcgcgcctcgccgggagccgcgcgcgcctcgtctacgaggtgctcgacatccagcgcctgatggtgcggccggacgcgccgggacggatcgcccgcgcggtcgagcgctggatcctcggccgcagcgacctcctcgtggtgagcgccccggacttcatcgaccggtacttccggccggtccagggcttcgccggcgcctggcacctcctcgagaacaaggtcatgggccaccgcctcggcgaggtgacgacccggctcgaccgaacccggacggcggaaccgccctgggtgatcggctggttcgggacgctgcgctgccgccggagcctgaccatcctcgccgccatcgcggacgccctcggcgactcggtgcggatcgtcctggccgggcgtctctccgaggaggacatcgccccgcgcaccctggcggacacgctggacggccggccgaacatgtcgttccgcggcccttacgccaatccccgcgatctcccggagatctacagcgggatccacttcagctgggccgtcgattacctcgacgacggactgaattcggactggctcctgccgaaccgactctacgagggcggcctgtgcggcgccctgacgctggcgcgcgccgcgacggccaccggacgctacgcggtgtcggagggcctgggctgggcatttcccgagccgctcgccgattcggtgacggcgttcctgcggacgctgacgccggaggcctacgcggagcgacatgccggcctgctcggccgcgacctcagcacgttcgtcgatgtcggcggcatgcgcgatctcctggtccggctggactag

SEQ ID NO: 5458 - DNA, 1713 bp, Methylobacterium sp.
atggactggtcgacggcctgtccggactgggccgagcgcatcgtgcagcggcgctcgctcgtgccgttccccccgctgtttccaggtgaggccgaggcggcgctggcggtgttcaagtcgctgcggatcgtcgacctcccgggcaagccgaccttcggggaggccagcgagccgtgggtgttcgacttcgtccgtgcgatcttcggcgcctacgacgcggccgcggcgcgccgcctgatccgagagttcttcctgctcatcagcaagaagaacgggaagtcgaccatcgccgcggcgatcatgctgacggcgctgatccggaactggcgaagctcggccgagctgctgatcctggcgccgacgctggagatcgccaagaacagctacggccccgccgccgacatggtgcgagaggacgaggagctcgacgcgctcctccacatccaggacaacttccggcagatcacgcaccgcatcacgcgggcgacgctgaaggtggtggcggccgacacggattcggtgggcggcaagaaggccgccttcgtcctggtcgacgagctctggatcttcggcaagcggacgcacgccgacgcgatgctgcgggaggccaccggcggcctggtctcgcggcccgaggggttcgtgatctacctgtcgacccagtccgacgagccgcccgcgggcgtgttcaaggacaagctggactacttccgcgacgtgcgggacggaaaagtccaggaccggaagagcctcggcgtgctctacgagttcccgccggacatggtggagcgggaggcctacctcgatccggcctggtggttcgtcacgaacccgaacatcgacaagtcggtgagcgcggagtggctccaggacaagctgaccgaggcgcagcggggcgacggaagcgcgctgcgcacgcacctcgccaagcacctcaacgtcgagatcggcatgacgttgagggccaaccgctggcccggggccgagttctggatcccgcgcgccgcggcggccagcacgctgacttttgacaccctgctggagcggtccgaggtggtcacggttggcctggacggcggcggcctggatgatctctacggcctgtgcgtcctcggccgcgagcgccgcgccgatcgcgaggcggacgtcctgaagcagcggtggttcgcctgggcgcacgcctactgccaccgcagcgtgctcaagcggcggccgaacatcgcgagcaagctgctcgacttcgccaaggcgggcgagctgaccatcgttgatgacgacctcggcgacatcgaggacatcatcgccaagatcgaggcgatcaagctggccgggatcctcggcaacgtcgacgtcgacccggccggcctgggcgagatggtctcggcgctcggcacgatcggcgtgacgcaggaggccgacctgctcatcgccgtgccgcagggctacggcctcatgaacgcgatcaagacgaccgagcgcaagctggcgcgcgggacgctgatccacagcggggcggccctgatgaactgggccgtgtcgaacctgaagatcgagccgaccgcgaccgcgatccgcgcgacgaagcagaacgccggcgacgccaagatcgacccggtgatggccctcttcgatgcggtggtggggatgtctcagaaccccgagccggtgcggacacggtccgtctacgaggaacgcggcctgcgggtcgcctga

SEQ ID NO: 5459 - DNA, 342 bp, Methylobacterium sp.
atgaagcgcccactcaccaccaacttctccgcgccgccgccggagcgtgcccacccgcccgagccggcgcccgcggcggcgacttggcgcgacgtcgccccgttcgcggccgccctgatcgccaccctggaggcgatcgaggccgggcagaaggcggggccggcgatgcgggcgcaccgctccgccatgcgccgccagggcgaggcggctgccgcgctcggcggatccgaagcgctggaggccgtgctcaaccaagtcgcggacgccgacgcggcccgggccgagcggcgcctcgcgctcgtccgcgaggcctgggcgggtctgcccgggggaggggcgtga

SEQ ID NO: 5460 - DNA, 1464 bp, Methylobacterium sp.
gtgacggcctacagcctgcgcgcccggctgctggcgctctgggtcctgctggtcgcctccgctgccgccaccgcctacctgatgctcggcgtctacgaccagtcgacgggcgtccaggtggcgcaggccgatctcgcggtcgggcgggcctgccgcgacatcatcgaccggtacgccgccctcgtgcgtgcgcgcggcaagggcgtcggggaggccgacctcgtcggcaccgtctcggccgctttggcgcgcttcccgggcctcgagggcggaatctggagcgccgcgcgtgggtcggtggcctacgcctatccgacctacgagggatccgggccgaagaccgactttccggcggccgagcgcgacgtcatcgcggcgctgaacgcgcaggcgctgcgggtcgaccacgcggcctcggagcggcggccgagccggacccaggttctcatgctccaggcctgcccgctgcacgggccggaggccggcctgaccgcgtggtcgatgacgcgcgcgcacgtgaacgacggccccacctacacgcgcttcctcgcaggcctcggcttcctcgccgccacggtgctcggatcggccgcgttcctgagctggttcctgtacgggttctcggggcggatcgcccggctcgaggccgcgctcgccgcgccgcgcccggacggccaggacctgccccatctcgaccgcaccggcgagcgcgagctcgaccggctggtcgacgccctcaacgccgccggcgggcggctgcgggaggcccaggcccggatcgtggcgaccgagcgcctcgccgccgtcggccgtctggcggcgagcatcgcccacgagatccgcaatcccatcgcggcgatgcggctgaaggccgagaacgccctggtcagcggcgatccgaaccgcgccgccgtcgccctcgagaccgttctcggccagatcgcccgggtcgacacgctgctgcgcgacctcctcaacctgacgcaggcgcggccgctcagccgggtgcccacacccgtggcaccgctcctggccgagtgcgcgggcctgcacgaggatctggcgcgcgcgcgcgcggtccggatcgcggtcgaggccgacgggctgcccgccgcggaccacccgcatctcgaccgggcgcaggtcgcccgcgccgtcgacaacctgctgctgaacgccctgcagcacgcgccgccgggcgggcgggtccgcctcggcgccgagcgggtgacggtcgacggcgcgctgcggctgcgcctcagcgtcgccgataccggcaccggggtcgacccggcgatccgcgccagcctgttcgagcccttcgtcaccggccggcccgacgggaccggtctggggctcgcgatcgtgcgcgagatcgccgtggcgcatcggggcgaggcgaggctggtcgagggcgcgccggagaccacctttgtcctggatctgccatggcaaccatcctga

SEQ ID NO: 5461 - DNA, 942 bp, Methylobacterium sp.
atggcggaggcgatcgccctggtcgggtgcaaggggccggatcaggaggcggagtacctgcggatcctctcggcggccatgcccgaggagcgcctgatcccgttccggtcgatggacgacgcggcccgggcggccgcgcgggtcgccgtcgtggccaaccccgatccggccgaggtcgcggcgctgccgggtctcgtctgggtgcagagcctgtgggccggggtggagaagctcgtcggcgccttcgaccggccgctgccgatcgtccgcctggtcgaccgcgagatggcccgcaccatggccgaggccgtcctggcctggacctactatctccagcgcgacatgccggcctacgcccgccagcagcgggaccgggtctggcgcccgcacgcctaccgcaagccgtccgacacgacggtcggcctgctcggcctcggggcgctcgggaccgcggcggcggagcggctgaccggagccggcttccgcgtcgtcgggtggagccgcagccccaaggcggtgccaggcctcgacacggtccacggcgccgacggtctcccggcgatgctcggccggtgcgacatcctcgtctgcctcgtgccgctcacgccggagacacgggggctcgtgaacgccgagcgcctcgcggccctgaagcccggcgccgcgctgatcaacttcgcccgcggaccgatcgtcgtcaccgaggacctgatcgccgccctggacaagggccacctcgcccacgccgtgctcgacgtcttcgcggtcgagcccctgccggcggagtcgccgctgtggtcgcatcccggggtgacggtgctgccgcacgtctcggggccgaccgacatggattcggcggccgccacggtggcggccaacctgcgggcctatcggcggaccggccaggttccggacggcgtcgacgcggcgcgcggatactag

SEQ ID NO: 5462 - DNA, 1047 bp, Methylobacterium sp.
atgaccgcgatgctgatctacggcgccaccggctataccgggcagctcctggccgcgcacgccgtcgggcaggggttgcgcccgatcctggcagggcgcgatcccgacaagctgcggcctctggcggcccggctaaacctcgagatgcgggccgcgcggctcgacgatgccgcggggctgcaatccgccctcgcgggcgtggcggcggtgatccacgcggccggcccgttctcgcggacggcgcggccgatggccgaggcctgtctcgccgccggcgcgcactacgtcgacatcacgggcgagatcgcggtgctggaggccctcgcggccagggatgcggcggcgaaggcggccggcatcgtcctcctgccggcggcgggcttcgacgtggtgccgagcgactgcctcgctgcccacgtggccggccgcgttcccggtgcgacgcatctgcgcatctccatcggcgggttcggcggtttcagccgcggcacggcccgcaccatggtggagggcatcgcctggggcacgcgggtgcgccggaacgggcgcatcgtcgaattgccgagcccgccgcgcgccaccgccgatttcggaacaggaccgcgccggaccgtcgggctaggctggggcgacgtgtcgagcgcgtggtactcgaccggcgtgccgaacatcgacgtctacttcgaggccttccccgccatggcggcggcggccggcctgcccgccggcatccggcggatcatcgcgggcggcaccgcccagcgcctgatcaaccgcgggatcgaccggctgccggagggcccctccgcggccgcgcgcgagaaggcccgcagcaccttcctggcggaggcctgggacggcgccgggcgccgcgcggcgagccggatggagacgcccgagggctacacgctcacggccgcaacggccctggaggtcgcccgccgcctcgcctcgggcgcggtgccggcgggcttccaaacgccggtgacggccttcgggccagacttcatcctggaattcgcgggcgtggtgcgaacggacctgtga

SEQ ID NO: 5463 - DNA, 2928 bp, Methylobacterium sp.
atgtcccacgcgccggccggatcacccagcgagacaggtcaggccaccgacgccggcccgcgccggagcgccgggcggctcgacgaggccggggtcgccaagcagaagctcgtcgaagcgatcgagagcagctcggagggcttcgcgctgttcgacccggacgatcgcctcgtcctgtgcaacgggcacttccaggatttccatcccggcctgtcggccatcatcgtgcccggcgtcaccttcgaggccatcgccaacgccgtcgcggagacctgcgtcgtacggccggacgggatgagcatccaggcctgggtcgccgagcgcgtcgcccattaccgcgcgccgcgcggtccgcttctccagcagcgggtcgacggccgctgggtccaggtcaacgagcgcaagaccaacgacggcggcgtcgtcgccgtctacaccgacgtgaccgagatcaagcgcgccgagcaggtgctccaggcgacgcaggggcggctgacctacctgctcaccgcgtccccgtcgatgatctgcagcttcgaggtgggggggcgcaacgcgccgaccttcatcagcgagaacgtgcgcgatctcctcggctacgagcccggcgattacctggcgggccccgaattctggctggagcggcttcacccggacgaccgggaccgggtgctcgccgagttcccgcacctgctcgcggacgggcacaacgtcatcgagtaccggttcctgcacgcgaacggcacctatcgctgggtccgggacgagcagcgcctcctgcgggacgcgacgggccagcccgtcgaggtggtcgagtcctggagcgacatcaccgagcgcaaggaagccgagctggcgctgcagaagcagaccgccttcgtcgagctgctccaggccgccgccgcggccgccaacgaggccccgacggtcgaagacgccctgcgcttctgcctcgagcgcgtcgcgcagcacgccggctggcccatcggtcacgcccacatcctggcccgggacgggacgcggacgctgctcccaaccggcatctggcactgcgaccccggcgcggatgtcgcgcgattccaggctgccacggccgccacgtcgctggccgccggatcgggcctcgccggccgcgttctggtctcgggcgcgccggaatggagcgtcggggacccgtcgctggccgcggacccgcgcgcgccggctgcggtcgagcacggcatccgggcggggttcggctttccggtgacggtcgggcgcgacgtcgtcgcggtgctggaattcttcgcccgtgacgcttccccgccggacgcctcgctgctccgggtcatgagcaatatcggcgcgcagctcggccgggtgatcgagcgcaagcaggccgaggagagcctgcgtcaggcgaaggaggcggccgaggaggcgagccgcgccaagagcagcttcctcgcgaacatgagccacgagttgcggaccccgctcaacgcgatcatcggcttcacccggctggtgatgcggcgggcgaaggatgtcctgccggtcaagcagttcgagaatctcgagaagatcctggcgagttccgagcacctgctctcgctgatcaacagcatcctcgacctcgccaaggtcgaggcggggcgcatggaggtcaagccctcggacttcgccctggagccggtcctcgacctgtgcctccgcaccgtcgagcccctcgtcaagaacgagggcgtgcgccttgtccgcgacgtccgggacccgcccccgatgctgcgcacggacgaggagaagctgcggcagatcctgatcaacctgcttagcaacgccatcaagttcaccgaggccggatcggtcacgctccgcgtccgctcggtcgatgagggcatcgagttcgccgtgatggataccggcatcggcatcccggcgggcgccctgagcgcgatcttcgaggagttccatcaggtcgacaacagcgcgacccggtcccacagcggcaccgggctcggtctcgcgatcagccaccggctcgcgcgcctgctcggtggccggatcggcgtcgagagccgcgagggcgagggctcgaccttcacgctcaccatcccgccgcggatcgccggcggcgccgaggtgccgccgcccccgaagccggcgcccgccgccgtcaccgcgccgcgctcgggcgccaaggtcgtgctcgcgatcgacgacgatcccaacgtcgtctacctgctgaaggagaatctcgccgatgccggctacacggtcgtcggggcggcgagtggccaggaagggctggtcaaggcccgggagctgcagccgcgggccatcaccctcgacattatgatgcccggcaccgacggctggcaggtgctgcacgcgctgaagaccgatccgctgacccgggacatcccggtcgtgctgatctccatcgtcgaccagaaggagctcggcttccggctcggcgcgaccgactacatcgtgaagccgttcgagcgggaggccctgatcggcgccctcgcgcggatcgcccccgacaacgagcgcgtcctcgtgatcgacgacgatcccaacgtgcccgacctcgtgcgccagctgctcgactcggagcactgcaccgtcgactgggtggccgacggggcggccggcctggagcgcatcgcgcaggcccgcccgagcgtcatcctcctcgacctgctcatgccgcggatggacggcctcgccttcctggacgccctgcaggcggatcccgccgcccggtcgatcccggtcgtggtcctgaccgccgcgtccctggattccgccgagcgcggcatgctccgggagcgggtgctcggattgatcgacaagggcgggctcgatcgcgccgccctggtccgggaggtccgccgcgtgcttccggtcttggagaccgagaccgccgacggtgaccgatga

SEQ ID NO: 5464 - DNA, 414 bp, Methylobacterium sp.
atgggcctcgctgccgtagatgccgccgtgtccaagcgcctcgccgcgctgtgggcgcgctgcccggtgcgcaccatcaacggaaccgacggtgatgtgccgcgaagcccggccgcgtttctttctgtcgaatatccggtgatgtcgtccgcccagatcagcatcggcgcaccgggctcgaacgtctaccgcgacgagggtgcgatccggttcgtgctctcggcggttgccggcaagggtatcaagacgcccttgcagtggatcgacgagctcgccgcgctgttccgcggccagatcttcgacggtgtgcggaccttcgcaccgtcgccccctgtgatcgacgaccagaacgacaacggcgggtacttcctgctcacgttcgcggtgccgttcgagcacgactacctcggctga

SEQ ID NO: 5465 - DNA, 357 bp, Methylobacterium sp.
gtgaacccgcgccaggccatcgcgcagctcgatcggcagctggcccgcaacggccaggacgtcaagctcgtgcgcatcgtcgcggacggcgacgacgtgatcagcccggtcgtgcgcgcgttcgtgcgcggctaccggccgaacgagctgaccggcggcatccaacagggcgactccctggtggtgctgtcgccgaccggcctgccggctccgttcagcggcgcaggggaccccggtgccttcctccgccgcggcgaccgccttgagatcgccggccggtccccgcggatcgagtatgtcgacccggtgctgatcgacggcgtccgagtccggatcaacctgttggtgaggggctga

SEQ ID NO: 5466 - DNA, 462 bp, Methylobacterium sp.
atggacgccgtggaccggaagatcctcgatctcctccagcaggacgcgaccctcccggtggccgagctcgccgagcaggtcggcatcagcgcggcgccgtgctggcggcgggtgaagaagctggaggcgtccggggtgatccgccgccgggtggccctggtggaccgccgcaaggtcaacgtccccaccacggtgttcgtggccgtgaaggcgccgcgccacgccgccgactggtcggacgcgttccggcgggtggtcgccggcttcccggagatcgtcgaggcgtggcgcctgaccggcgagatcgactacctgctgcggatcgtggtgccggatatcgaggcctacgacgcggtctaccagcgtctcatcgccaagctcgacttctcgaacctgtcctcctccatcgccatggaggagatgaagtacacgaccgccgtcccgacgatctacgtggcgtga

SEQ ID NO: 5467 - DNA, 522 bp, Methylobacterium sp.
atgccgcagaccaccaccccgaccgacgtcgaggcgatgctggcgaacctcgcgcgctccgcgagccgctcgccggaggcctatctggcctcggcccgggcgaccctgatgcgcctcctggcccggccggatctgctcgacccgtcgcggctggtcggccgggggcctggcctgagccggaacctcctgttcggcaccgaggcgatcagcgtctgggcgatggtctgggcgcccggcacggtcacgccggtccacgaccaccattgctcgtgctgcttcggcctgctgcgcggcagcctgcgggagacgtggtatcgcccgatcagcgagacccacgcggtggcgaccatggacgccgtccgcgagcccggcttcgtcgcctgcatgatgcccacggggccgaacctgcaccggatcgccaatgacgggccggaggcggccgtctcgatccacgtctacggctacgatcaccgggcgcaggactcgtcgatccaccggacctacgcggtggcggcgggctga

SEQ ID NO: 5468 - DNA, 639 bp, Methylobacterium sp.
atgctcaccctcgatcacctcgtcgtcgtcgcgcccgatctcgcggagggcgtggcgcatgtccgggactgcttgggcatcgccatgcccgagggcggtcgccaccgcgagatgggcacgcgcaaccacctgctgcgcctcggcgacgccctgttcctggaggtgatcgccgtcgatccggaggcgccgccgccgtcgggcgcccgctggttcggcctcggcgacgcggcgcgggtgcgggccgactgggattcgggccggcggctgcgcggcttcgtcgcccgcgctgacgatctcgacggcctcctcgccgcgcacggcgcgctcctcggcgcggcggcgacgatgacccggggcgacctgtcctggcgcttcgcggtgcccccgggcggggcgtggccggcggacggggccgcgccctgcgcgatggggtggggaccgcgcggcaatcccgccgcgacgatgccggatctcggcgccggtctggaggcgctcgttctgacgcatccggatcccgacgccgtcgcggggcttcacgcggcgctgggcttggccgctccaccgcaggttgtggccggcccgggcccgcgctggaccgcccggatcagcacgccgtcgggcccgcggagcctcacctga

SEQ ID NO: 5469 - DNA, 462 bp, Methylobacterium sp.
atggcacgactgaacgtcaacggcgtcgtgcgtgaggtcgatgccgaggccgacaccccgctcctctgggtcatccgcgagcagatcggtttgaccggcaccaagtacggctgcggcatcgcccaatgcggcgcctgcaccgtgcatatcgacggggcggccgtccgctcctgctccgtgccgctctcggcgatcgaggcggggcagaagatcgtcacgatcgaggggctagccccggatgcccgccatccggtccagcaagcctgggccgagctcgacgtgccgcaatgcggcttctgccagcccgggatgatcatggcctcggcggcgctgctggcgcagaatgcgcgtccgagcgaggagcagatccgccaggagatcaccaacatctgccgctgcggcacctacaaccgtgtgctcgccggcatcaagatcgccgccgagcgcggccagtccggctga

SEQ ID NO: 5470 - DNA, 2196 bp, Methylobacterium sp.
atgagcctcgaatccaaggcctctccgaaggctgcccgccccagccgccgcacgctgctcgccggcgccggtctcttcaccctcggcttccacatcccgttccccgcacgggctgcaaccctcgacgcggcgcccaccgcgccggaggtcaatgcctgggtcgtggtgaagccggacgagaccgtggtcattcgcatcgcccgttcggagatgggccagggcacgctcaccggcctcgcgcaactcgtcgccgaggagctcgactgcgactgggccagggtcaccaccgagtatccgagcccgggccagaacctcgcccgcaagcgaatctggggtgattactcgaccggcggcagccgcggcgtgcgcgattctcacgagtacgtgcgaagaggcggcgccgccgcccgcacgatgctcgttgccgccgccgcgaagggctggggcgtccccgcggccgagtgccgcgtcgagcggggcgtgatcacccacggcccctccggccgcagcatcacttacggcgccgtcgccgcggaggcggccaggatcgagccgccgaaggacgtggtgctcaaggatccgaaggactggaccatcgccggcaagccgctgaagcggctcgacaccctgcccaagctcgacggcagccaggtctacgggatcgatctcaggctgcccggcctgctcaacgccgcgatccgcgactgtccggtgaccggcggcagcgtgcggagcttcgacgccgcggctgtgtcgggcatgcccggtgtccgaagagtgctccaggtcggcgacagcgcggtcgcggtggtggccgacacgttctggcgcgccaagaccgccctcgacgccctcccggtcgcctgggacgagggcccgaacgcaagggtctccagcgagaccatcgcggcgaccctgcgcgaggggctcgacgccgagcaggccttcgtcggcaacaaggccggcgatgtggccggcgccctcaagggcgccgccaaggtggtcgaggccgtctacggcgtgccgttccagaaccacgccacgatggagccgatgaatgccaccgcgctctggacgccggagcgctgcgaggtctggacgccgacgcagaacggcgaggcggctctggccgcgaccgccgacgccgccgggctgccggccacgtcctgcgaggtctacaagatccatctcggcggcggcttcggccggcgcggcgccacgcacgactgggtgcgtcaggcggtgctcatcgcgcgggagatgccgggcaccccggtcaagctgatctggacccgcgaggaggacatgacgcatggccggtaccacccggtcacgcagtgccggatgcgcgccgccctcgacggggacggcaacctgaccggcctgcacatgcgcatctccggccagtcgatcctggcctcggtcgccccccagcgcatggtcgagggccgcgacccggtcaccttccagggtctcaaccccggaggtccggaggccgcgatcggctacacgatcccgaacatcctggtcgaccacgcgatgcgcaacccgcacatcctgccgggcttctggcggggcgtgaacctgaacccgaacgccatctatctcgaatgcttcatggacgagctggcccacgccgccgggcaggacccgctcgccttccggctgaagctcatggacaaccacccgaagcaccgggccgtgctgcaggcggtggccgagcggatcggatgggccggcaagccgcccgagggcgtctaccgcggcatctgccagacgatggggttcggcagctacgtcgcgggcgcggccgaggtctcggtctccgaccagggcgagctgaagatccaccgtatcgtggcggcgaccgaccccggccacgcggtcaacccgcagcagatcgacgcgcaggtggcgggctccttcgtgtacggtctctcggccgcgctgtacggcgcctgcacggtgaaggacgggcgcatcgagcagacgaacttcgacagctatcccgtgatgcggatggatgcgatgccggcggtcgaggccatcctgatgccgtccggcggtttctggggcggcgtcggcgagccgacgatcgcggtcgccgcgccggccgtgctcaacgcgatcttcgcggcgaccggcaagcgcgtccgccagcttccgctgaaggacacggatctccgccgggcatga

SEQ ID NO: 5471 - DNA, 270 bp, Methylobacterium sp.
atgtaccgctgcacgctggcgctcctgctcggactcgccgccgggcccgcgctcgcgcagagcacgggctacgtcacgggtttcccgggcaaggatcccgcgggcgacgaggagatcggctgggggccggcctaccggcccgagacgagcttcgcgcagcccggcacgccgccgacccccggcgcgatcgccggccgcgcctatcgtgcccgaaccggccacggcgtctacgatcagatgcagggcgacggtctctatcggggccggtag

SEQ ID NO: 5472 - DNA, 1026 bp, Methylobacterium sp.
atgcgcatcgtccacacgcccgattcgagccggcacgatcccgaacgctacatgcggcgcggcgcgccgatcccgcatcccgagcaggcggcccgctacgcgatcctgcgggacgcggccgtccggggcggccacgacctcgccgagccggccgatcacggcctcgacccgatccgggcggtgcacgatcccgactacgtggcgttcctggccgaggcctgggcgcgccgggacgcgatccccggcatcggcgacgagatcctgaccggggccttcgcccggccgcagatgcaccggaagcccgccggcctcctcgggcgcctcggcctctacaccgccgacacctcgacaccgatccgcgccggcacctgggcggcggtctacgggtcggcgcagtgcgcggtcgcggccgccgacgcgacgctggcggcggggcacgcctacgccctgtgccgcccgcccggccaccacgcctacgcggattccgccggcggcttctgcttcctcaacaacagcgccatcgcggccgagcggttgcgcgccgcgaccggcggcccggtggcgatcctcgacatcgacgtccatcacggcaacggcacgcagggcatcttctacgcccgcgccgacgtgctgaccgtctcggtccacgccgacccctccgactacttcccgttcttcgccggctacgccgacgagaccggcgccggggcgggggcggggttcaaccgcaacctgccgctgccgccgggctcgggggacgcgccctggctcgaggccgtcgaggcgggcctcgcggcgatcgccgcgcaccggccccgggcgctcgtggtggcgctcggcctcgacgccgccgcggacgacccgatcggcgccctcgcggtctcccgggcaggcttcgtcggggcggcggagcggatcgcccgggccgggctgcccacggcgctggtccaggagggcggctacctctgcgcggccctgccggacaacctcgcggccttcctcgccgccttcgacgccgcgcgctag

SEQ ID NO: 5473 - DNA, 1035 bp, Methylobacterium sp.
atggcggatcaactcttgtccgatgctcggggcaccttcgtggacgtctcgttcatcatggccgcgcacgacgcggcgccctggatcgagacggccgtccgctccgccctggcccagaccggcgtcgccgtggaggtggtggcggtcgatgacggctcgcgggacgggaccgcctccgtgctggcgcgcctggcggaggccgatccgcgggtccgcgtcattcccctcgccgatgccggaccgggcacgccccggggcccgtccagcgcccggaacgcggccctgaacgccgcccggggccggtggatcgcgatcctcgacgccgacgacctgatcctgcccgaccgcacccggacgctgctcgatctcgcgctcgccgcggatgccgacatcgtcgccgacaacccgatcccgttcaccgacatgttcgacccgcaggggccggggatgctggagggcggccgggagccgtacctgttcgagatcgacctcgccaagtacatcgccagcaaccagctgctcagccgggtgaccaagctcggctacctcaagcccatgatgcgcgccgagatcctgcgccggcacggcatccggtacgacgagggcgtccggatcggggaggatttcctgctgtgcctggaagccctcgcggccggggcgcggttcgtggtcaccacctacgcgggctacggctaccggcgcgggcccacctccctgtcgcaccggctgcgccaggccgacatcgcgcgcctcgacgcggccttcgcggcccgggccgagcacggccgcctcgccgaggcgcggtcgcgctccgccgagatccgccacgggagccgcgcctaccgcgacggcctcgcggtgacgcggctgatcgcccaggtcatcgaggcggcccaggccggccgctggcgcgcgggcgcgaccctggcgctccggcatccccggatctggcggttcctggccgcgacgctgctggcggcggcgggcaagcgcctgcggccgcggccgcacgcccacccgatcggacagaggtaa

SEQ ID NO: 5474 - DNA, 570 bp, Methylobacterium sp.
atgccatccacccacgataccctgcccgacgacctgcccgtccccgtcgacgacggcgcggccgaccatctgcgcgggatgcgcctgcccgacgtggcgctcaccgccacggacggccgcacggtctcgctggcgcgcctgccgggccgcaccgtggcctacgcctacccgcgcaccggcgagccgggacggccgggcctgacgcccgactgggacgccattcccggcgcccggggctgcacgccgcaggcctgcgatttccgcgatcaccacgccgcgctgacggcccggggcgtcgcccaggtcttcggcctctcgacccagacgagcgcctaccagcgggaggcggccgagcgcctgcgcctgccgttcccgctgctggccgatccgcaccgggccttcgcgatggcggcgcgcctgcccaccttcgaggccggcggccaggtgctgctgcgccgcctcaccctggtgatcgacgacggcgtcgtgagcgagctgttctacccggtcttcccgccggaccggagcgcccggcaggtccgcgactggctcgacgggggcggcgcctga

SEQ ID NO: 5475 - DNA, 1029 bp, Methylobacterium sp.
gtgacctcacatctcgccatcaccatgggcgatccggccggcatcggcccggagatcatcgtcaaggccgccgcccggctgaaggaccggatcgacgcgggcgacctcaagctcgtcgtcatcggcagcgccccgtccctgcgccgcgcggagcgggcgctcggcctcctgcccgatcccgttcccgaggtcaccgaggacggcgactggccggcgctgtgctgcctccaggccgacgcggaaggcgctccgatcgagcccggccggctctcggccgacggcggccgcttcgcctacaaggcgatcgaggccggcgttcgcctcgccctggccggccggatcggcggcatcgtcaccgcgccgctcaacaaggaggcgctcaacagggccggctaccactatgccggccacaccgagatgctggcggagctgaccggcgtgcgcggctcggtgatgatgctggcccacggcaacatgcgggtctcccacgtcacgacccacgtcgccctggaggacgtgcccaagcgcctgaccccggagcgcctgcgcctcgtcatcgacctcaccgaccgggccctgaaggggctcggcctggccaggccgaagatcgcggtcgccgcgctcaacccccatgccggcgagggcggcctgttcgggcgccaggacatcgacgtcagcgcgccggtgatcgagaaggccaacgccgacgggctcgacgtgcacggcccggtgcccggcgacacggtgttcgtgaagctgcgggcgggccagtacgacgcggtggtggcgatgtaccacgaccaggggcacatcccggtcaagctcctgggcttcgagatcgacccggccacgggcaagtggatggacctgtcgggggtgaacatcaccctggggctgccgatcatccgcacctcggtcgatcacggcaccgccttcgacatcgccggcaccggcgtcgccaacgagcgcagcctgatcgaggcgatcgagttcgccgagaagctggcggcgaaccgtcagcccggttga

SEQ ID NO: 5476 - DNA, 216 bp, Methylobacterium sp.
atgctcgcgaacgcgcgcgatgcccgccggcgcacgaagctgaccagcgatctgcgtccgcccgaagcgggcgcgaacgccgatcccgtcctgtacggcgtggccgcgggtctggcggccctgttcccgccggtgatgctgggctcggaggcctcgccggagacgcaccgcgcctccgagacctcgcgggcgccggacgcgaccggcacccgctga

SEQ ID NO: 5477 - DNA, 723 bp, Methylobacterium sp.
atgagcagcactctccaggaccgcagcgtcgtcgtcttcggcggcacctcgggcatcggcctcgcggccgcccgccaggccgaggcggcgggcgcgtcggtcatcgtggtcggccgcgacgcggcgggcgccgagcgcgtcgcggcggagaacggcttcgccggctggcgcgccgccgacgtgacgcggcccgagacggtcgcggccgccctggccgacatcccccgcgtcgaccacctcgcgctgatggccggcaccttcgtggccggcaaggtccgcgaggccgaggtcgaccacctgaagcgggccttcgacgagcggatctgggccgcggcttatgccctgcgcgccctcggcgaccggctggccggcgacggatcggtcacgctcatctccggcgccctggcggaccgtccgaacgcccaggggaccgccgtgctggcggcggcgtcggccgcgatggaggcgttcgcccgcggcctcgccctcgaactcgcaccggtgcgggtgaacgcgctctcgcccggcaccaccgacaccccgctcctggcccgcacgctcggcgcccaccgcgacgcctacgtggccggcctcaccgagcggctgccgcagcggcgcctcggcaccgccgaggaggccggcgcagccgtcgtcttcctgatgggcaacggcttcatgaacggcgagaccctgcacatcgacggcggcggccgcctgatctga

SEQ ID NO: 5478 - DNA, 1767 bp, Methylobacterium sp.
ttgtcgtggttctgggggctcgggtttttctacgcgatccatgtcacgctgacatacggctggctcgggtttcttgccttcgccttgccgaacgcgaccggtctcggcctgttcggctggatgctcggcgcgccccgtcggaatctcgacgcgatcgtggccgccgtgcagggcccctacgccctcctgttcatgggggcccagttcttcgccgtcgcgatcacgatcttcggtttcgcggcctacgcgtggctccccctgttcggccacgacgccgccgtgggcgtgatcgcgctggtcctcgtcgcctgctcgctcggccacgccgtcccgctgcgcgggatccgcatcgtccattgcggagcgctggcggtcgggctcgccgcgagcgtgatcctgctcggcggtctgtccgcgcaccgggacggctggcaagtcccgctgcaggccttcgacgagcgcttctacgggctcgtcgtcccctcgctggtcggcttcctgctcggcccctggatggacatccagcattggcagcgggcggtcgagatccggcgctcgggcgggtcggtgcgcgcggcctacgtgaccggcgcgctcctgttcctcggtctcctgacgatcaacgcgctcatggccgcgcgggcggggctcggcatgccggtcgtctcgtccgacggcctgtcgggagcctacgcggccgtggcgcaggcgatcgggcgcgaacccgcgaccggcgtcgcggtggccttcgtgatctggacggcgatcgccgccgcgaccacgatcgacagcttctacagcgccacgcgctggctcgggatctcggtcacggcacgcagcaattccccactcctcgccttcgtgccggccggcctcgtggcgtcgccggtctggatcctcggtgccgcgctcgccacagcggcggcggcgatctgggcgaacctctcgctcctctacctgatgatgcccttcgccacgctcctcgtcggggcggcggcgtgtctcgtgtgcgagtcgctcggcgcgacccgccgctacgacccggtcctcacatccatgatcggggcgacggcgtgcctgatcttcgtgacgggctatctggccccgagctgggcgctgctggccatcgcgccgctgatcggcctgatcggcgcactcccgatgatcgcggaggtcctcggctggcgcgcggcgccgccggtcgcggagctgatcccggcggcggagcgggcgccgcgggcggcgccggtgcccgtggccgtggaccagaccgacgccgtcgcgtcgcacgggttcgacgggcactggttcgtcctgcgcctcatcccgacctacgacgacaccaactcggtcgggaacgtctacttcgccaattacgtgcgctgggtcgggaaggcccgcgagctgttcttcaacatctgcatgccggatttcgatctgaaatcgacggacttctacatcctgacgaagtccttccagcacgacttccgccgggaggcgatggagttcgagccggtcaccgtccgcatctcgatcgcgagccacaaccggaagtttgtgaccctggcgcacgagatccacagcgaggtcaacggcctcctcggccggggcgagcagtcgctgatgttcgtggacaccgtccactatcgcccgctcgatattccgcgggcgatcatcgagggcttcctgccctactggccgaaaacgtccccgcacgccgtcgcggacgggagcggcccgaccggcgtggcgccgctcggcgtctga

SEQ ID NO: 5479 - DNA, 729 bp, Methylobacterium sp.
atgcagacacctaccaacatcgtccggtttcgtcagcctgaggacatcgacgatcccctgacggacgtgctgcgcgccggtgcccgccgcctgctcgcccaggccgtggagctggaagccgaggcctttctgagtgcaatgcaggatcttcggctgccggacggacgcgcacgcctcgtgcggcacggccatggcccggagcgggcgatccagaccggcatcggcccggtgccggtggcgcgggtccgtgtgcgggatcgcggtgcgagcgggtccgaggaccggatccggttcacctcggcgctcctgccgaagtgggcgcggcgcacccgcagcctggatgcgctgctgccggtgctgtacctgcgcggcgtgtcgaccggcgacttccaggacgcgctggccgcccttctggggcgtgacgccccaaacctgtcgccggccgtcatcgcccggctgaccacgacctgggcggacgagtacgcccgctggcagggccgtgacctctcggcccgtcgctacgtctacgtctgggctgatggtgtctacctgcaggcccggatggaggagcaggccgagtgcatgctcgtgctgatcggggcgacgcccgagggtcgcaaggagctcgtcggcttccaggtgggcgtgcgcgagagcgcccagagctggcgcgagctgctcgtcgacgtgaagcggcgcgggctgtcgatcgcgcccgagatcgcggtc

SEQ ID NO: 5480 - DNA, 702 bp, Methylobacterium sp.
atggagacacctaccaacctcgtccgacttcgtcatcccgaagacctcgacgatcccctgaccgaggtgctgcgtagcggcgctcgccgcctgctcgcccaagctgtcgagatggaggcggacgcgttcctgagcgcgatgcaggacctgcggctgcaggatggacgggcccggctggtgcggcacggtcacgggccggagcgggcgatccaaaccggcatcggcccggtgccggtcgcgcgggtccgcgtccgagaccgcggcgcgagcgggtctgaggaccgggtccggttcacctcgaccatcctgccgaagtggacgcggcgtacccccagcctggatgcgctgctgccggtgccgtacctgcgcggcatctcgaccggcgacttccaggacgcgctggccgccctgctgggtcgtgacgccccgaacctgtcgccggccgtcatcgcccggctgacggcgacgtgggcggatgagtacgcccgctggcagggccgcgatctctccgcgcgccgctacgcctacatctgggctgacggcgtctatctgcaggcgcggatggccgagcaggcggactgtatgctcgtgctgatcggggcgacgcgcgagggcaagaaggagctcgtcgggttccaagtgggtgcgcgcgagagtgcccagagctggcgcgagttgctcgtcgacgtgaagcggcgcggg

SEQ ID NO: 5481 - DNA, 240 bp, Methylobacterium sp.
ctcgtcgacgtgaagcggcgcgggctgtcgatcgcgcccgagatcgcggtcggcgacggcgcgctcggcttctggcgggccttggacgaggtcttccctggcaccgctcaccagcggtgttgggtccacaagacggccaacgtcctcgacaaggtgccgaaatccgtccagccggccatgaaggcggacctgcgcgagatccacggcgcgccgacccgggcggcggccgaggcggcgctg

SEQ ID NO: 5482 - DNA, 219 bp, Methylobacterium sp.
gacctgcgcgagatccacggcgcgccgacccgggcggcggccgaggcggcgctggccgtcttcgtcgagaagtacggggccaagtacccccgcgccgccgcctgcctgaccaaggatcgtgacaggctgttggcgttctacgacttcccggccgagcactgggatcacctgcgcagctcgaacccgatcgagagcgtgttcgctacagtgcggcatcgg

SEQ ID NO: 5483 - DNA, 561 bp, Methylobacterium sp.
gtggacacgcagaccatcccggacgaactcaggaccttcttcgagaagtcccacatcgccgtggcgctggccgcggcgggcgacgacaacgtcctgctcctggtgaacgagcggttccaccagctcaccggctacacgggcgcggaggtcgtcgggcgcaattgccgcctcctccagcgcgacgccgacaaccgggaggcgcgggccaagatacacgccttcctggagaacgaccggcaggacacggtgcgcacgccgatcctgaatttccgcaaggacgggaagcccttcgtcaacctgctgtacatgtccaaactgaaggcgctgtcgggcgaggtgcgctttcttttcgcatcccaattcgacgtcagccgctcgcaacccgagttgctttccgcctacgatgccgaactcggccggaccctgtcccggctgaccccgacgcttgcggagagtgggctcgtcatcgagggctcgctgatgacgatcgccaacacggtcgccacggtcgcgcaggccaagctcaccctcgcggatctcgatgcaccaggatttccttag

SEQ ID NO: 5484 - DNA, 816 bp, Methylobacterium sp.
gtgagcgtcgccctcgcgtccgcgcccgccggcccgcaccgctggcagcgcttccccctgtggaagcggctggcgcggctcgccttcacgctctgcgcggtggcggccttcgtggcgagcctgcgcaccatcgaggtgatcccggaattcctctacgacgcccccgaccagctggccgacctgttcggccggatgtggccgatggatgccggctatgtcgggccgaccctgcgggcgctggtggagacgctccacatcgcgacgctcggcaccctgatcgccatcgcgatcgcggtgccgatcgggctgatggcggcccgcaacgtcacgcccaaccgcgcgctgaacctgttcgccaagttcgtgttcgtgacctcgcgctcggtgaactccctggtctgggcgctgctgttcgtggcggtgttcggccccggtccgctggccgggaccctggcgatcgcgctccgctccgtcggcttcaccggcaagctgttcgccgaggcgctggaggaggccaatcgcggctcgatcgaggctctgcaggccgcgggtgccggccggatgtcgacgctgctgctcggctactggccgcaggtgaagccggccttctggtcgatcgcgctgttccgctgggacatcaacatccgcgaatcggccgtgctggggctggtcggagcgggcggcatcggcgtcgcgctcgataccgccctgaacctgctctactgggaccaggtcgccgtggtgctcgccgcgatcttcggcgtcgtcatcctggccgagatcgtcgtgacggccctccgcgcccggacgctctga

SEQ ID NO: 5485 - DNA, 414 bp, Methylobacterium sp.
atggctatgtcggagccgatccggcgcctggagctcttcaccggggcgggccgacggcggacgtggtcggatgaggaaaaggcctccatcgtcgccgagagtgatgggccgggcacctcgatcagcgcggtggcacgccgacatggattgagcgccccgcagctgttcacgtggcggcgcctgatgcgtcaggctgagaggcccgacgatcagcgcccattgcagttcgtcccggccgttctgagtgtggccccgcacgagccgacgtctgccgagctgagcccagaactgggggagcgatgcggctggcacagcatcgaagtcgagatcgcaggcgccacggtccgcatcgctcagggcgcgagcgcggctcagatcgccgcggtgatccaggcgctgaaggcttgcccatga

SEQ ID NO: 5486 - DNA, 231 bp, Methylobacterium sp.
atgttggtcgacgaagagcgcatcgacgaggcagtgctcgcccttttgtggctgacgctccacgacgggcgtcgggcctggaaaggctttgactgggccgtgcttggccgtctccacgccaaggggctcatcgccgatccggtcggacgcgccaagtcggtggtgctgaccgacgagggcctgcgccaatccgaggcgctgtttcggaccctgttcacacgatccgactga

SEQ ID NO: 5487 - DNA, 231 bp, Methylobacterium sp.
atggcagtcgacgaggagcgcatcgacgaggcggtgctcgcccttttgtggctgacgctccacgacgagcgtcgggcctggaaaggctttgactgggccatgcttggccgtctccacgccaaggggcttatcgccgatcccgtcgaacgcgccaagtcggtggtgctgaccgacgagggattgcgccgctccgaggcgctgtttcggaccctgttcacacgccctgactga

SEQ ID NO: 5488 - DNA, 1296 bp, Methylobacterium sp.
gtgccctctctcaagctgtccaacccgttccgccgggccgccgaacgcccgtccctcaggcagcgcgccgccgaactgaaggccagtctcggccagcacgttgatgccgttcagcccgaggctacgccggccaaggctccggcagaggctgttggcgacgccgagctgctacggctcggcgcacagttcgagtttgcccgccagcgcgagatcgcggcctgcgaggcctgtaacgcggccgaccgagaggctgaccgacacatgcctgcgcgcccggcctgcttgatctatcgggcctccgacgaacgcctgaacgtccaccggacctcgatgatgcccgaggcgctggagggacgcgagatccgcagcgccgatgtcgagcggctgcgacgcatgatgccgatgacgcacgaggtgctgcgcccgatccgccacggcgagcgcgcccacatcgatcatccgggcctgaaactcgaaatcgtgccctacccggaggcgcaggcccgcgccgaggagatcgtggtcgcttacgatacgtggctcgctgagcgcatgcggatccacggcgaatacctcaccgaagcccttgatgacgccgccaacgatgcgggcgatgccgctgccgcactggctgagcgcatcgcaggcctgcccgccctgactgcagaagggtttcgggtgaagctccgggcgctctcgcactacaaccccaaagtgctgtcgtcggagatcacggacgagcccgaccccgaccagctcctgtcgcactcactctggcgcgacgtgcagggcgagataccggcaccgccccccgcggacacgctgaccgctgccatccttgatctgtggcgcgactgggccgtgaaggagaacgccgaggagtatgacgaggccctgcagggtcgccgcttcgctctcatcgacgcggctgaggccctgccggccacgatggagaacgttgcgccgaaggctctggcgctcgcgtggctggaatacgtcgaccactggcggcccaagagcgtgcgcggctcctacacgaccgatggccggcttgccttggacatccacgccgccgctgcagctcgatctccgacagcagtcccggccgtaccggcagctccgcgcgaacccagcctcgtcggcatgctcgacctcgcatccgcctcgctggacgacctgcaagccctccacgacatcgcggacctcgtcggcggcgtcgcctatgcggtctgctggcagagccgagcccatggcgacgggagctatgccggaagttgggtgacgacggaggtgtga

SEQ ID NO: 5489 - DNA, 198 bp, Methylobacterium sp.
ttgggcgatgccctgaccgatgtggagaccgcggccaacaacgaggctcggcggcgtgctcctacgaacaacgctgaccgcgaaacccggctggagatgctggcgctgccggtgatccagaacggcgatccggatgagaccgaagccttcgcccgcgagcttctggcccacgtcgcggccgagcgacagggccgctga

SEQ ID NO: 5490 - DNA, 2193 bp, Methylobacterium sp.
atgcgtttctcgatcaaggccaagctcggggtcggcttcggcgcgatcctcgttctcctggggacggccagcggggtcggctaccagaggctcacggccgccgacgcgacgatgaagtacgtcctgagccgcgccgagatccagaagcaggtcctcgagggcaaggcgcacgccatccgcagcgcgttcaacgtccgcggggccctgatcagcccggacgaggcgcagatgacggagttcgccaagcgctcggcgaacaaccacggtgacgccatggcgtccttggccaaggtgaagcccctgctcatgaccgacgagggcaggaggctctacgaggacctgtcggccaagtacgagaagcagaacgccctggggaaccgggctctggagctgacccgcgacaattccaacgggaagacctgggccgagatcaatgcggcgggtcgcccggcgctggccgccctgcgcacggacctcgacgccctgatcaacacggcgaccgacgcccagagccccgccggagagcggctcgcccgggtcgccgcggtgttcaagagccgggtcgagcgggcctgggggcagctgacctcggccaccgggaccacgagcgtcgacgcgctccagcagcgcgtggccctcgccaagcagtcgcgcgaggagatcaaccggtcggtggacgaactcgcgtcggcggcccaggcggcgggaatcgccgtgacggccgtccgcgagcggttcgggacctgggcgtcctccttccagcgggcgatcgccctcgtcgagatcggcagttcggtgaaggcggccgaggtcgcctcgggcgagtacgcgacggtgagcacgacggcgatcaacgccttcgagacgctggcggatcggcagaagcggttcatggacgacgccgcggcccaggccaacgcggaatccgcccagggtcagacgatcctgctgagcgtggcggcggccgcgctcctcatgggcctcggcatcgcgacctggctcgctctctcgatctcccgcggcctcggtcgtgccgtctcgctcgccgacgcggtgtcgatgggcgacctgagccagaccgcgaacgtcacgaccaacgacgagctcggcgacctcgtcggcgccatgggccgcatgaccgagaacctgaacgcgaccgcggcgctggccaacgcgatcgcccagggcgacctcaccgtggaggcccggccgctgtccgacaaggacacgatgggcctcgccctgcagaccatgctgtcgaagctgcgcaccgtcgtggccgaggcgaccgcggcggccggcaacgtctcggcggggtcccaggagctctcggcctcggccgagcagctgtcgcagggttcgaccgagcaggcctcgtcgaccgaggaagcctcggcctccatggaggagatggccgccaacgtgaagcagaacgccgagaacgccagccagaccgagacgatcgcccggcaatcggcccaggacgccgaggcgagcggcatcgccgtcggccgcgccgtcgaggccatgcagaccatcgcccagaagatcaccatcgtgcaggagatcgcccgccagaccgacctgctggcgctcaacgccgccgtggaggcggcccgggccggtgagcacggtcgcgggttcgcggtggtcgccagcgaggtgcgcaagctcgccgagcgcagccaggcggccgcggccgagatcggcacgctctcgtccgacaccgtcaaggccgcccagcaggccggcgacatgctcggcaagctcgtgcccgacatcaagaagaccgccagcctggtcgaggagatcaccgccgcctgccgcgagcaggatgtcggctcgggccagatcaaccaggcgatccagcagctcgacaaggtgacccagcagaacgccagcgcctccgagcaggtctcggccacgtccgaggagctggccacccaggccgagaagctgcaggcgacgatcgcctacttccggatcagcgagacggccgcgccggtggccggtgtcgatcaggcggtgacgcggctgcgcgcgaccgcggcgcggatgggcacgccctcggcggcgatccgctccccgagcgcgaaacgggcgggcgcgcgcggcccggccgggggcggcggcttcgccctcgacatgggcgagggcgacgcgcaggacgccgccttcacccgggtcgcctga

SEQ ID NO: 5491 - DNA, 579 bp, Methylobacterium sp.
atggtgctggcttccacgacagcctctgccctgcaggccgccggattcatcgggatctgggacacggacgtccgggccggccggtcgatgctggattcgggcgcggcctcgctgatggcgggggatccggggctcgccgggacgccgctgccgctggacgcggccctcggccggatccacccggccgaccgggactgggtgttcggccggatccgccacgtccgccagaccggcggcccggtttccctcgagttccgcgtcgtgaccgggacgggcgagatccgctggatcctcaaccgcggctgcctgacgcccgattcggacggcctcctgcgcgggcgcggcgcctacatcgacgtcacggacctccaccggcacgggatccagtccggggacatgaacggcgccatcaacggcgtcacgcacggcgccgccgacgggtcggacctgaacgccgcggccgaccacggcatccagatccacgcggcgctggagcgccacggcgatccctatctccgctcggtctcggggatgctgctccacgggatcggccgcgcgctggcgcggcgcgacccctga

SEQ ID NO: 5492 - DNA, 1653 bp, Methylobacterium sp.
atgacggacacccgtccgacccagaccgaggtccgcgagacgggctctcatccgttcgaggccggtctggcgcgccggccggccaactacgtcccgctgacgcccgtgagcctgctggcgcgggccgccgccgcagcgggcgggcggatcgccgtgatcgacggcgaccggcgcctcacctacgcggacctctacgcgcgctgccggcgcctcgccgcgggcctcgcggcccgggggatcgggccgctcgacaccgtggcgatcctggcgccgaacgtcccggagatgatcgaggcgcatttcgccgtgccgatgctcggcgcggtgctgaacccgctcaacacccgcctcgacgcggcgacgatcgcgttctcgctgcggcacgggggcgcccgtgcgctcctcgtcgaagccgagtacgccgcgctggccgcgcgggcgctcgcggaactcgccgagccgatcctcgtcgtggcgatcggcgcgagcgggatcgataaggccctgccctacgaggatctgctggccgagggcgatcccgactacccctggcgcggcccggaggacgagtggcagtcgctctgcctgctctacacgtcggggacgaccggcgaccccaagggcgccgtctacagccaccgcggcggctatctccaggcgctcggcaacgccgtcacgttcggcctgaccagcgagagcgtgtatctctggacgctgccgatgttccactgcagcggctggtcctacccatgggcgagcgtcgctgcctgcgccacgcaggtctgcctgcgcaaggtcgagccggcggcgatcttccggctgatcgccgagcacggggtgacgcatctgtgcggggcgccgatcgtcctctcgatgatcgcgcacgcgccggcccaggaccgggtgccgttcccgcagcgggtgcgctgcgcggtcggtggcgcggctccgtcctcgacgatcatccgcaccatggaggagctgggcttccaggtgacgcatctctacggcgccaccgagagctacggccccgcgacggtctgcctggcgcagccggactggaccgatctccccgacactgagcggcacgcccgcatggcccgccagggcgtgcccctggcgacgctcgaggcggtgagcgtcgccgacaccgtgaccgacgcgccggtgccgcgggacggcgcgacggtcggtgagatccgcctgcgcggcaacacggtgatgaagggctatctcggcaacccgagcgcgaccgaggaggccctcgccggcggctggtaccggaccggcgacctcgcggtctggcatcccgacgggtcggtggagatcaaggaccgggcgaaggacatcatcatctcgggcggcgagaacatctccagcctggaggtggaggaggtgctgatgcgccatcccgcggtgatgctggcggccgtcgtggcgcggccggatccgacctggggcgagagcccgtgcgcgttcctggaggtgaagcccggcgcggcggtgccgagcgaccaggagctgatcgcgttctgccgcgagcacatggcgcggttcaaggtgccgaagacggtggtgttcgggccgctgccgaagacctcgaccggcaagatccagaaattcgtcctgcgcgagcaggcgcggaccctctga

SEQ ID NO: 5493 - DNA, 195 bp, Methylobacterium sp.
atgcaagccgtcaccctgtcctcctcgcccgccgtcacccgtccgaccgcgcgcccgtccctgctccgcacgtggctgcagcggatccgcacccgccgcgccctggcggcgctccaccccgaccaggcccgggacgccggcctcgagccctgggacctgcgcgccgaggtcgcgaagccgttctggcgggcgtga

SEQ ID NO: 5494 - DNA, 612 bp, Methylobacterium sp.
gtgacgccaggttgtctcctcaagcgcctcgggcgcgacaccggcggcgcggccgctgtggagttcgccctggtggccctgcccttcctggcgctgtgcggcgcgatcatccagatcgtgttccagatgtgggcgacgcagaatttcgatcgcgcgctccagaacgcggtccggacgatcttcaccggccagttccagctcgacaccgcaggccagaccaatccggcgaccgtgctcgcgaccctgaaggcgcggatgtgcggatcgcccgtcagccccgtgcccaccgtcttcaactgccagaacgtcaagatcgacgtcgcgacctcgagcagcttcgcgagcgcgaccgcgaccaagccgatcgacaccgccacgggcacgtggagcacgagcttcggctccaactacaaatgcgcttcgcccgggacgatcgtgatcgtcacggcggcggtgccgtttccgaccttcttcaacctgatgggcctcaacacgaagcagttcaccagcggctccgcggagggatcgagcctgctgacatccacggcggtgttccgcaccgagccctaccagatcgtcggagcgagcccgtgcccgtcctcaccgtcctga

SEQ ID NO: 5495 - DNA, 591 bp, Methylobacterium sp.
atgcagaaccgaggtgctcgagctatctaccgtctcgccgacttggaggacggagcgaccgctgtcgagttcgcgctggtcgcgttcccgtttttggggatgctggcagtcatccttcagaccagcctgttggtgtgggccggccgcaatttggacgacgcgcttcagcgtgcaggccggacgatctacacggggcagttccagaaggcgaacaccggccagactgacaccagcgctttgctcgccgccatgaagaacacgatgtgcggtgcgagttcgagtcgcgtcgcaactgtattcgactgcaatgccttgaaactgaacgtagctctcagcagctctttcgccaatgggagcgtgccaacgcccgtcgatggcaaaactggcgactgggcaaagggcttcggcacgaactacagctgcgcacaacccggcgcgatcgtggtcgtgacagcagcagttaagtaccgtgtcgtcttcagcttcctgtatgccggcattccgggctttagcgacggatcccggctactacagtcgacggcagttttccgaaccgagccctatgacacatcgtcgggccaaggctgttga

SEQ ID NO: 5496 - DNA, 180 bp, Methylobacterium sp.
ttgatctcgcatccgcgcgggcgggtcgagcttcgacgctacgtcacgcggggcggccgcgtgccccgcgcctgcaacgacaaccgtcgggcgggatcgcaccacgcctggtactgggtcctggccgccggcgcgatgccgacgctggggctcctggcgatgctgtcgacactcctgtaa

SEQ ID NO: 5497 - DNA, 1755 bp, Methylobacterium sp.
gtgaccggcttcccggccgccctcctgcccctgcccgtcgcgatcccgctcgtggtctgcgccgcgatgctggcgaccgcgcacgtcctgcccggccgcctgcccgacatcctggcgacgctggcggcgctcaccgtggcggtgctctgcgccgtcatcgccacccgcgccgccgacgggccgctggtctactggttcggcggctgggagccgcgtgacggcgtccatctcggtatcggcttctcggtggacgaggccagcggctgggtcgcggccttcatcgggctgctctacgccctgaccttcgtgttcgcctggggcttcttcgaccgcacccacggccacttccacatcctgatgctgctgttcctggccgccatggttgggttctgcttcacccgcgacatgttcaacctgttcgtgtggttcgaggtgatgagcgtcgcggccttcgcgctcacggcctaccatctggccgaatcggcgctcgcgggcgccatcaacttcacggtggtgaacagcctcgcgggcttcctgatgctcggcggcatcgggctgatctacgcccagaccggcacgctcgacttcgagggcatcgcggccgcggtggcgcggggcggccgggatccggtggtggccggggcgttctgcctcgtcgcggccgccctgatgatcaagggcgcgatcgtgccgttccagttctggctcgccgacgcgcacgcggtcgcaccgagcccggtctcggtgatcttctccggatcgatggtctcgcttggcctgttcggtctcgcgaaggtgagcgccgtcgtgttcggcggctccgatcaggtccagcacgccctgccggggctcctcatcggcctgggcagcttcaccgccctcctcggcggctggatggcgctgctgcagcggcatctcaagcggctgctcgccttctcgaccatctcgcacgccggcatcatgctcaccggcctcggcgccctgtcggtcgacgggaccggcgggatgctcgtctacgtggtcgggcacgggctggtgaagggcgccctgttcatgatcgccggcatcctgctcgccacccaggccagcatcgacgagatcgccctgcgcggcctcggacgggggatctggcccgccggcatcgccatggccctggccgggctgctgctctgcggcctgcctctcggcgtgctcgaccagggcacgcgcctcgtccagggcgcgctctggcagcaggggcacggggtggcgctggcggccggtgccatcggcgcggcgctgaccggggccgcggtgctgcgggccgccggccggatcttcctcgggctggggcccgatcccggcgacgaggccggcgccccgagcgaggacgagcgcgagaaggccaaccggccgctctggctgatgctggcgccgtgctgccttctcctcgcgctcgatatcggtctgccggcggccctgatcgagcacgccctcccgcgggcggcgtcggccttcatgcaccggccggccgtgcacgcgctggcggaggggcccggctggctcccctgggcctcggtcgccgccgccctggccggcgcgggctacgggctgttccgcagacacctgcccgcgttcgtggtccggccggtcagcgcgacgcaatcggcgccgacccgcgcgctggaaatgctccatagcggcttgatcggcgattacgccgcgtggctcgccgtgggcgtggcggcgatcgcggctgtgctggccatggcctga

SEQ ID NO: 5498 - DNA, 420 bp, Methylobacterium sp.
gtgagtgcggccacaagtgtcctgccctacgcggtcgccgcgtggctgttcgggatcggcctctacggcatcgccacgagccgcaacttcatccacctcgtgggctgcctcggcgtgtgccaatcggcgacctacgtgctcctgctcggcctcggctatcgctggggcagcatcgcgccgatcttctatgaccacccgccgggaacgcccgccgtcgacccggtgatgcaggcgctggtgctcaccgacatcgtggtcggcgcgacgctcaccgccctcctcctcgtcctgaccgtccaggcctacaagcgcggcggcagcctggacccggagaagctccggccgatgcgcgcgggcggcaagtccgggcgcgacgcagggtccagccgcgtgcgcgacgcggagcggcacgccccgtga

SEQ ID NO: 5499 - DNA, 777 bp, Methylobacterium sp.
gtgagcccgcgcgcccgcgtcgcgctcctggccctcgcgggcctcgtcctcctcccgggcgcggccgcggtgatcgccggcctgccgcccttcggatcgacgatcgcccagtacggcgcgcgcatcaacgcgatcgtcccggaggcccggcacgtcgccaatatggtcagcgccatcaacttcgacctgcgcggcctcgacaccctcggcgaggagttcatgctgctcgccgccatcaccgggacggtggtgctgctgcgcgggcggcgcggcgagggcatgaccgggcgcgccatgcgccggcccggccgggccgtgatcccgcgctccgaggcggtggtgctggcctgccgcgtcgccggtccgctcaccgcgctgttcggcctctacgtcgtgctgcacgcgaccgtcacgcccggcggcggcttccagggcggcgtcatcctggcctccgggaccctgctgatctacctcggcgagggctatgccggctggcgcgacgccatccgcagccactggctcgacgccctggaggggggcggcgcgctcctcttcgcgctgtgcggactggtgccgatgctcaccggtgccgccttcatgcagaacgtgctgccgctcggcaccttccgcgacctgttctcgggcggcctgatgctggtcgagaatctcggcgtcgcaatggcggtggcgggcggtttcacgcagctcttcctggaattcatggaggagacccgcgaggccgacgcgcccgaggagccgggggaggaatccgcgtga

SEQ ID NO: 5500 - DNA, 252 bp, Methylobacterium sp.
atgacggtcatcctgccgctgctcttcgtgctcactgcggtctccggcaccgccgtggtcctcgtgcgcgaccccgcgcggcagatcttcgccatcgcggtcaacgggctcgtcctggcgatcctgttcgacgccctccaggcccccgacgtcgcgctctcggagttggcggtcggttcggcggcggtgccgctcctcttcctcgtggccctgatggccgtgcggactcagccgcccgaggaaaaatcgtga

SEQ ID NO: 5501 - DNA, 447 bp, Methylobacterium sp.
atgagtgtggaccggatcctcgcgccctccgacgcgctcgtcggcctgcgcgccgccggcaagggcgcgctgctcgaggagctggcccgccgcgccgccggcgccctcggcctcgccgcggagacgatcctccccgcgctgatccggcgcgagagcctgggctcgaccggggtcggcgacggcatcgccctgccgcacgcgcggctcgagggcatcgcgcgcccgtacgggatcctggcccggctgcgcgacccgatcgatttcgacgcggtcgacgaccggcccgtggacctcgtcgtcctgctgctgctcccggccgccgccgagggcgagacgctgaacgcgctggcctgcgtggcgcgtcgcctgcgcgatcccggggccgccgcggcgatgcgcggcgcgcgggacgcggcggcgctctacgcggccgcgacgggccggtaa

SEQ ID NO: 5502 - DNA, 420 bp, Methylobacterium sp.
gtgaccgatgaggtcggcaacgacccgctcgcggcggcccgcaacgcccgggaccggcccatgaagcggattctcatcgtcgaggacgtcgcgctcaaccgcgatctgctgacacagttgctcgaggacgagtacgagatcctgatcgccgtcgacggggccgccggcgtggacatggcgatcgcgcaccggccggatctcatcctcatggacctgtcgctgccgctcgtcgacggctgggaggcgacgcgccgcatcaaggccgacgcgaccaccgccgccatccccgtgatggcgatcaccgccaacgcgatgacaggcgacgaggaccgcgcgcgggccgccggctgcgatgacttcatgacgaagcccgtcgacgaggacctgctcttcgccaagctgcagcactggctcggctga

SEQ ID NO: 5503 - DNA, 1056 bp, Methylobacterium sp.
gtggagccagcccgcatcctcatcgtcgacgatgagcccttcaacctcgacctgctggagcaggagctggaactcctcggccacgccagcgtgcgggcggcgaacgggcgggcggccctcgatcggctgagcgagcagccgttcgacctcgtgctcctcgacgtgatgatgccggcgctggacggctacgccgtgctcgagcggatgaaagcccacgaggcgtggcgccacacgcccgtcgtgatgatctccgccctcatggagatcggcagcatcgtccggtgcatcgagctcggcgccttcgactacctgccgaagcccttcgagcccgtgatcctggaggcgcgcatccggtcctgcctggagcggaagcgggcgcacgaccgcgaggtggcgcatctgcggaccatcgagcgcgagcgcaagcgcgccgacgagctcctccacgccatcctgccggtctcggcggtcgcggagctgatggagaccgggcaggtcaagccacggctgttcggcgacgtcgccgtcctgttcatcgacctcgtcggcttcaccacctggtgccacgaccagagcccggacgtcgtcgtcgcggagatccagcgcctcgcggaagccttcgaggtcgtcgcgcaggcgcggggcctggagaacatcaagacgatcggcgacgccttcatggccacggccaacctgctgcggccccacgaggatccggtctccgccgccatccgctgcgccgccgacatggtggcgatcgcggccgaaggcgagccgggctggcggatccgcggcggcatccacatcgggccggtcgtcggcggcatcgtcggccggacgaagttcaccttcgacctgtggggcgacaccgtgaacgtcgccgcgcggctcgcgggcctcggcgacgggtgcgcgctgcacctgtcgcgcgaggccttcgcgcgcctgccggacccgcgcgacgtccggccgatcggcgcggtgacgctgaagggcaagggcgcggtcgacgtgtactgccacgccctcgcggccggcgacgcgaccccggcctga

SEQ ID NO: 5504 - DNA, 738 bp, Methylobacterium sp.
atgcgccctgccctcttgatcgccgccggcctgctgtgcggccgcctctacccggccgacgcggcggaacgccccgtcgtcgtcgagctgttcacctcgcagagctgctcctcctgcccgcccgcggaggcgctgatcggccgcctcgcccacgagccggcgggggcgcagggcgatgtcctgccgctcgcgttccacgtcacctactggaaccacctcgactggcgcgatcgctacgccctgccggccgccaccgcccgccaggaggcctacgcggcccgcctcggcggacccacctacacgccgcaggcggtgatcgacgggcaggtcgggctggtcggctccgacgaggccggcctgcgcgccgcgatcgcgcgcgcccggcaggccgggtccggtattcccgtgacgctggcccgcgacggcgagcaggtcgtcgcgcagatcggtgccggggccggcggcgccgcgggccgcgtcctcctgatcgggtacgatccgagccacaccacccgcgtgctgcgcggcgagaatgccgggcgcaccatcgagcaggccaacatcgtccggtcggtgcgcgagcttgggcactggtccggctccgccgcagccttcgcgtcggcgcgtcccgagggcgagacggcggccctgctgctccagtccgaggacgggcggatcctgggtgccgcacgcctcaccgcttcccccgccgcgacggtccgggaggccgtgcgatga

SEQ ID NO: 5505 - DNA, 855 bp, Methylobacterium sp.
gtgcacggctcgacctacccgtcctccacggccttcgacctgccgctcggcgggatgtcggccatggactacctcgcgggcctcggcttcgacgtctactgcgtggacctgccgggctacggcctgtccgggcgccccgccgccatggacgcgccgccggacgacaacccgccgctgatgcgcacgcccgacgccgccaaggtggtggggcaggtcgtcgacttcatcaagaagcggcgcggcgtcgagaagatcgacctgatgggctggtcctgggggacctccaccatggggctctacacaagcacccacaacgacagcgtcaaccgcctcgtcctctacgcgccgcaatggctcgcgcgcacgccgggcctgatcggcggcggcggcaaggtgggggcctaccgcaccgtcagccgggacagcgcccgggcccgctggctgaccggcgtgcccgaggacaagaaggccgacctgatcccggcgggctggttcgaccagtgggccgacgcgaccttcgcgaccgacgcggccggcgcgaagcggtcgccgccggtcctgcgcgcgccgaacggcacggtcgccgacaaggacgcctactgggcggccggcaagccgctctacgacccgggcgagatccgcgtgccggtgctgatcatccacgccgagtgggacgccgacctgccgagctaccaggcccaggaatacttcgccaagctcacgcgcgccccctacaagcgcttcgtcgagctgggggagggcacccacacggtgatgatggagaagaaccgcatgcagttcctccacgccgtcggggcgttcctcacggaggcggacccgcaggcgctgaactga

SEQ ID NO: 5506 - DNA, 1335 bp, Methylobacterium sp.
atggcaggaccgatcgcgaccgcggggaccgcggcgccccggacgggggcggaggccgcgcgcgaccggggcggctaccgcccggccctgtcgctgctggcgagcctgttcttcatgtggggcttcatcacggtcatcaacaacacgctgctgccgcacctgcgcagcgtgttcgacctcgactacacgcagaccacgctgatcgagtccgtctggttcatcgcctacttcgtcgcctcgatcccggcggccaagctgatcgagcgcgtcggctaccagcgcgccctggtgacgggactgggcatcatggcgctgggcacgctcgggatgatcctggccgcccaccgggtctcctacgcgatcacgctcacggccctgttcgtgatcgccagcggcatcaccctcctgcaggtcgccgcgaacccctacgtggcggtggtcggcccggccgagagcgccccggcgcggctcaacctcgtgcaggcgttcaactccctcgggacgaccctggcgccgctcttcggcggctacctgatcctcggccgctcggcctcgggcaacgccgccgccggggccgccctgaccccggccgagcgcctggccgacgcgcagtcggtgcagctgccctacctgatcgtggcggtggtgctcgtcgtcctcgccgtgatcatcgcccgcttcccgctgcccgccatgggtggctctggcggttccggcggcgccacggcccgggccgccagggccgaacgcgccggcctgtcgctctggcgccaccgcaacctcgtgctcggcgtgccggcgatcttcatctacctgatcgccgagatcggggtgtcgaacctgttcatcaacttcgtgtcgcagcccgagatcggcgacctgacccacgcccaggcctcgcgctacctgttcctgctctggggcggcatgatggtcggccgcttcgtcggcagctacctgatgcagcggcgcccggccgagaccgtgctggccggcgcggcgatcggcgcctgcgcggtgatgctggtggcgaccttcgcgaccggccacctcgccctgtgggcgctgatctcggtcggcctgttccacgcgatcatgttcccgacgatcttcaccctgggcatccgcggcctcggtcctctcaccgaggagggcgccgggctgctgatcatggcgatcgcgggcggctcgctggtggtggtgcagggctgggcggcggaccggtacgggctgcagcactccttcctgatcaccgccggctgcgagctctacgtcctgttctacgcgctctggggctgccggaccggcgccgcagcgcggccggccggcgcctga

SEQ ID NO: 5507 - DNA, 1050 bp, Methylobacterium sp.
gtggccaagaacatcctgatcctgggggcctcctacggctcgctcctgggcaccaagctcctgatggccggtcacaacgtgaccctggtgtgccggcggaagaccgcggacctgatcaaccgcgaggggaccgaggtccgcatcaagctgcgcgacgagaaggagcaccgcgcgatccactcgcgcgacctgcccggcaaggtcgacgcgatgccgccggaagacgtcgacgtgtcgcgctacgacctcgtcggcctcgccatgcaggagccgcagtacaacaaccacacgattcgcgtcctcatgatcaagatcgcggcggcgaagctgccgtgcctgtcgatcatgaacatgccgccgctgccctacctcaagcggatccccgcgctcgccgccatggacctcgaggacgcctacaccaatgccggcgtgtgggaccggttcgagccgggtctggtgtcgctctgctcccccgacccgcaggccttccggccgccggaggaggaggcgaacgtcctccacgtcggcctgccgacgaacttcaaggccgcgaccttcgcggacgagacccataaccggctgctccgggagctggaggccgacatcgacgccgtgcgcctcgacgggcacgacgtgccggtgaagctcaaggtgttcgactcgctgttcgtgccgctcgccaagtggtcgatgctgctgaccggcaattaccgctgcatcaccccgggcgagccgcaatccatccacgacgccgtccacggcgacctggcgcgctcgcgggcgatctacgaccacgtcgacggcatcgcccggaaactcggcgccgacccggccgatcaggtgccgttcgagaagtacgccaaggccgccgagagcctgctgaagccgtcctcggcggcgcgggccgtggcgaacggcgcgccctacatcgagcgggtcgacctgctggtgaagctgatctcgcaccagctcggcgagccgaacgccgagatcgaccgcaccgtcgagaccgtcgaccgcaagctcgacgagcgcatcatcgagggctga

SEQ ID NO: 5508 - DNA, 1977 bp, Methylobacterium sp.
gtgaccgacgccgcagacatgtcaccgcccgcccacggcgtcgccggctggccgttcgggcgcagcgccggcgcgccggcccgtcccccgtcgctccccgacgggcgtccgtggccgcggatccgcgtcgtcacggtggccggcgcggatgccgcgctcgccgagaccgtcgcgtcggtcctgcgccagggctacccggaactgcggcacgacctgctcgacccggcggccggccgcgccgcggtggcgcgcatcctgtcggctcccgatccggagcacctgttctggctccgcgccggcgacctgctcgcgccctgcgcgctgaccgccctggcgctggaggccgcgctcaccggcgccgacgcggtggcggggctgcgcgtcctgttcgacgacgccgtccgcggcctcgacggccccgggaccgcggacggcgggatcctctggcgacgggacgccctcgcgcacgcgatcctcgacgccgacgggaggctcgacgccgcctccgcctggtcggcgatccccgagagccgccgacgcctgatcggccgcccggtcctgctccacaggctcgacgcgccgccgcccccgcccaccgccggcctgtcgatcgtgtcgctgaccgggaccggcacccgcgggggcgcgggcgtggcccagcgccgcctcgccgaggcgctgacgctcgcgggccaccgggtcgcggaggtgacgctgagcggacgcccggaggccgccgagtggagcgacgacttcccgcaggcggaggccgcgatcgcggcggccgcccccgatctcgtcctcgccggcaacctgcacggcgccacccgcagcctcgacgtcgtcggccgcctggcgcggcgcggtccagtcggcctcgtgctgcacgacctcttccccctgacgggccggtgcgcccacccccgcgactgcgggcgcgccgcctcgggctgcgacgccgcctgccccggcccggacgagtacccggagctggcgcccggccggatcgccgggatgcacgagcgcaagcgcgcggtgctcgccggcgccgcgcccggatccccgacgcgaccctccgcgccctggctgctggccaattccgactggacgctggcgcgggcgcgcgaactcgccccgcccggcagcgtgatcgagcccgtccggctggccttcccgaccgccgtgttccggcccggcgatcgcgcggcgctgcgcggcacgctcggcctgccgcccgacgacgtcctgatcctcgtgtcctcggtcatcgtcgacgggcccgacaagggcttcgccgacctcagggccgcgctccaggccgtcgcggggccgggcgtcggcgtggtggcgatcggccggctcgacgacccggcccggctcggcgtcgcgaacctgtacgcgcccggcctcatcgccgacgaggcgctcctggccgcgtggtacggggcctgcgacctccacgtcaccgcaagccgtcacgagaccctcgggcagacgcccatcgaggccggcctgtgcggggtgccgacgctcgcctaccgcacctccggcctgacctcggccgtgatcgacggcgtgtcgggccgcctcgtgccggtgcggccgggcgccctcgccgaggcgctggccgcgctggtcggcgaccgcgaggcacgcgcgcggctcggcgccttcgcgcggatcgccctggagagccgctacagcccggccgcctccgcgctgtcgctggacgcggtcttccggcgtcacggtctgccgagcgccccgacgggcccgcatttcgcccccgggatgctcgggcacttccccttcgcggcagccctgcgagcgggcgcggccggcaccgtcccggcggtctcgcgcccgctcgtgcgccggctgcggcgggccaagcagatggtcttcgggcgtcggatgccgctcctcgtgcgccggtgcctctacctcgccggcgcgctgcgccggagccggccgtga

SEQ ID NO: 5509 - DNA, 2565 bp, Methylobacterium sp.
atgaacgtcaactcggccggcaagcgcccgattatgccggcctgggaacgtcgatgcctcgacgcctcgccggaggagatagctcgctggggcaccctctaccccgagagcaccaacaccggcctgctgtgcgggcatctggtcggcgtcgatatcgacgttctgcaacccgcgctcacggacgccatcgctgatcgcgcgcgccgcattctcggaccgacgccgctggagcggatcggtcgcgagcccaagctgctcctcggctaccggctcgcggttccggccgacaagatccagacggccgcgctccacttcaccgacgacccgcaggagaagccaaccaaggtagaggtgctgctgcggggccagcaatttgtggcgttcggcattcatcccgagaccgccgcaccctaccgctggcctgacgcctcgccgcttacggtcgacttcgccgaccttcccgagaccactgaggaagccctgcggctgttcgtggccgaggcggaggtgatcctgcgcgaggctggtgcggccaccaagcgtgagcgcaggcagaccgagcgcgcccgcgagaccaaaggccgccgcgcggccgggttcgggctcaacgagaagccaaaccgcgagaccatcgccgacgcgctgcgcagcatcccgaacgattttgactatgacgggtggatccggattgggttcgctctctacgacggcctgggggaggccggccgcgacctctgggaggactggtccgcgacctccccgaacgatgacgcggcgttcacatcgcggaagtggtcgagcttcgccggcggccggtccgtgaagatcgccaccctgttctggcacgctgccgagaacggatggcgtcggcctggcgctggccgatccggtgcgccgaagcgcgatcgtgctgagcgccgcgctagcgccgacccggaagccgagatcagcggggaggacgacggtcgccccgtcgtgcggttcgtcgctggcaaggtgccggaggcggtcgaccgcatggaggcgctactgctggcgtcccccgtcgagatctactctcgagccggcgcgctcgtgcggcccgtgatcgacgcggtgcccgcggccaagggccggatgacaacggtggcgcgtatgtgccccctcaccaccgtcagcctcgcagacatggcagccagaaccatgcggtttcagaggtacgacggccgcgccgaagactggctggacatcaacccgcccgtcgagatgacggcgacgctcctggcccgcgaggggcaatggcgggtgccggcggttgcgggcatcatcaccacgccgacgctgcgccccgatggctcgctgctgacggtcgcaggctacgacttggcgacgcggctctaccttgccctggatcccggcttcaccatgccgaagctgacggagcggcccgataagcgcgaggccgctgaagcgctgggcttcatcgagactctgttggccggcttccccttcgttgggccagttgaccgcgcagttgcgctatcgggcgtcctcacggctctggtccgcggcgtcctgccgacggcaccgctgcacgcgatccgcgcctttacccccggttcggggaaaagctacttggtcgacctcgctgccgtcatcgcgaccggccggcgctgcccggtgatcgccgccggcaagaccgaggaggagaccgaaaagcgcctgggcgcgctcctgcgcgatgcggtaccggtcgtgtcgatcgacaacgtaaacggcgagctgggcggcgacatgctctgccagctcacggaacgccctctcgtccgggtacgcatcctcggcaagtccgaggctccggaactcgagtgccggtcgaccaccttcgccaccggcaacaaccttgtgctgaccggcgacatgacccgccgtgcgctggtctgctccctcgatgctgaggtggatcgccccgagctgcgggacttcgactttgaccccattgcgacggtgctggctgaccgtggggcctacgttgcagcggctctgaccgtgatccgcgcctatcgcgtggcgggatcgccgtccgtctgcggggccatcggctcctatgaggactggtccgacatggtgcgctcgcccctcgtctggcttggccatgcggacccggtggcgagcatggagacggcccgcgaagaggatccggagctgtccgcgatccgcgagctgttcgagcactggcggtctcatctgcgcctatcgagcgggtacaccaccaacaccatcatccggacggcctgcgatcgggatgcgggcagccacttcgccggtcccggcgatttcaagctggccgagttccgcgacctgttgctacggcaggccggtgacggcggggcagtgaacagccgccgcctcggcaaatggctgtcccggatcaagggccgtgtggtcgacggccaccggatcgagatgaaggctgacgcgagcaacggcaaccgcttctcgctctgccaagtcagcgtccccgagtaccccgcaggcagcccggtcgcagccgactaccgcgcctcttcggcaccggagttctga

SEQ ID NO: 5510 - DNA, 1416 bp, Methylobacterium sp.
atgatcgcccggcacagcctgatctacgtcggctcccggggcttcgcggccgccctgaacatggcctccgtggcggtgttcacgcggctcgcgccggtggagagctacggcacctacctgtacgtcctgtcctgggcgctggtgctctacggggcgacctgccagtggccgaaattcgcgttcttcgccctctacgacgaggcgcgcgagcccgcgcaggtcggcaccgttgtgcggatcctgggcggcacgctgctcctcgccggcctcggcagcgcgctcgccgccgccctcggcctgatgccggcgcggatggcggccgcgatcctggcgctggccttcgggaccaccctgttcgagggctccaccgagatcgcccgcacccgcctgcgggccggggcggtggcggcctcggtgatgagccgcgccgtcctgatcctggccctcggcagcctggcgctgcacctctcgcaggatcccctgcacctcgccttcgcggtggcggccgcgaacgccctggcctccctgccggccgcggccacgatcgccccgatgatgcccggccgcggcagccgcgcggaggcgctgcggctgttcgcctacggctggccgctcgtcctctccttcgggacggcggcgctcgcccagagcctcgaccggctgatcatcgccaagacggtggggccggcggggctcggcgcctacggggccctggccgacttcctgaagcagagcttcatcgtgttcggcgaggcgatcgccctgtcgctgatctcgatcgccaagcgcgaggcgcgggtgggcgggatggcggcggcctccggggtgctgcgcgacgccgcacgggccatgacgctgatcgcggctttcggggccgtgttcttcctgtgcttcgacgatctggtcgtggcggtgctgctcgggcccgactaccgggccgaggcgcgggagctcgccccggtgctgatcctggcgagcatcctgatgatgttccgcgcctactatttcgggcaggtgatctacttcgcccgctccagcggcctggaggccgccgccgccttcgcgaccctcgccaccgtcgccgcgctgtcgctcctgctgatcccgcgcttcggcgccgccggggcggccctcgccttcgcgggcggccagagcgcggcctgcctcgtgctggtgctcggcgcccgccggaccggcacgacgatgccgctgccgctcgccgacatggccggcatcgccgggatcgcgctggcctgcggcgcggtgaatgccggcatcgccctggtccccggcggcctgttgccgccgggacaggccctgcgcctcgtcctgctcaccgccgccgccggggtgacggcgtggcgctacgacgtgctcggcttcgccggcgcgatccgccaccgcctcgcggcctga

SEQ ID NO: 5511 - DNA, 972 bp, Methylobacterium sp.
gtgcggctcgcccgtttcctcggttaccggctgctgctggcgatcccggtggtgctcggcatcgtcgtgctcaacttcttcctgatccacctcgcccccggcgatgcggcctcggtgctggcgggcgagagcggcgcggcgagtcccgaatacatggagcagctgcgccacaagttcggcctcgatcagccgctcgccacgcagttcggcgtctacctgctgaacatgctccacctcgatctcggctactcgttccgcaacgacagcccggtggggagcctgatcgttgaccggctctggcccaccgggctgctgatgctcaccgccttcgcggccgcgttgctgatcggcacgctgctgggcctcgtggcggcgaccgggcgcaattcttggcgcgacgcggtcatctcccttgtcagcctcgtggcctatgcgaccccgggcttctggctcgggctgatgatgatcgtggtcttcgccatccggctcggctggctgccgaccagcggctacgacacgatcggcgccgacaacgatggctgggacgaggtctgggatgtcggccgtcacctcgtcatgccggcggtggcgctcgccctgttctacctagcggtctacgcccgggtgatgcgcgcctccgtgctggaacaggtcggcatggactacgtcacgaccgcccgcgccaagggccagaccgaggcgcgggtgatgaccgggcacgtcctgcggaacgcgctgctgccggtggtcaccatggcgggcgtgcaggccggcaacctgatcggcggctcgatcgtggtcgagacggtgttcggctggccgggggtcggcacgctggccttcaacgcgctccagtcgcgcgacctcaacctgctcctcggcatcttcttcgtctcggcctgcctcgtggtcgtgatcaacctcgccgtcgacctcgtctacgtctgcctcgatccgcggctggagctctag

SEQ ID NO: 5512 - DNA, 345 bp, Methylobacterium sp.
atgaagaccctccgcactgaggcacggcaatccgcgcccccccaggacgccgagggcgcgggggtcgccctcggcgggcggccccggacgatccgcttcccgcccgtctggcacgcgtggttcgcccggcagtccgagccgcgcctcgcggccctcgacgagatggtcgacgcgcatctcgagcgccgcgcgctgcgccgctacctgcgccggctcaagcacgcgacggtgctcgccttcgtcgccgcggcggcggccgcgcactggttctccgaccaggtcgcgtggctcgccgcgcatatcccggccctgcgggccctctggaagctgctgacgggagcgtga

SEQ ID NO: 5513 - DNA, 330 bp, Methylobacterium sp.
atgagcgaatccttcccggacgcgcccgcgggcgccgccctcctgtcggtcgcccggcagagcctcctcgacgaggtcgcgccggccctgtcggggcgccagcgctacgtcctgctgatggccgccaacgcgatgggcgtggtcatgcgggagatcgcgcaggcgggcgcggcggccggggcctgggagcgggcgctgggcgccgccggatcgccgaccgagctggtcgcggcgatccgcgccggccggcgcgacggggacgcggcgctccacgccgcgctcgtcgagacgacacggatcgccgccggcatctggaaggccccgggctag

SEQ ID NO: 5514 - DNA, 1041 bp, Methylobacterium sp.
atgctggacgcggatcagaggacggcgctctgcgcctggatcggccggaccctggaggccgggtcggtcgcgctcgacgacgcccggccgctgaccggcggctcgatccaggagaactggatgctgtcgtgccgggtcgacggcgcgccccggagcttcgtcctgcgcaaggacgcggccgccaccatcgcgtcgagccgctcgcgggcggaggagttccggatcctgcgcgccgccttcgcggccggcgtgcgggtgccggagccggtcggcttctgcgcggatccgggggtggtcggggcgcccttcgcgctgatgggcctcgtcgccgggatcgggctggggccgcgcgtggtcaaggacacgagcctcggcggcgaccgcgcggcgctcgccgagcagctcggccgcgagctcgcccggacgcacggcatcctgccggcggccggcccgggaaccgccccggcggatgacctcgccttcctcggcgcgccggagccggagccggccctggccgagatccgcgcgctccgggcgagtctcgacgggatcggcgccgcgcgcccggccctcgaatggggcctgcgctgggccgagctccacgcgccgccctgtccccagccggtcctggtccaccgcgacttccgcaccggcaactacatggtcgatgccgagggcctgacggcgatcctcgactgggaattcgccggctggggcgacccggtccaggatatcggctggttctgcgccgcctgctggcggttcggccggcccgacctggaggccggaggcatcgccccgcgggccgccttctaccgcggctacgaggccgagagcgcgcgcgcgatcgacccggaggcggtgcgctactgggaggtcatggcgcatctgcgctgggcggtgatcgccctggagcagggccaccgccacgtctccggtcaggagacgtcgctggagctggcgctgaccggccggatggtgcccgaactcgaggccgcgatcctgcgcgagaccgcgcccgagcggtggggagcccgatga

SEQ ID NO: 5515 - DNA, 1179 bp, Methylobacterium sp.
atgaccgaggtcgtgatcacaggcgcggtgcgcaccgcgatcggcacgttcggcggcgcgctggccggcacgccgccctccgtcctcgccgcaagctgcgtcgcggaggcgctgcgccgcgccgggaccgcgcccgagacggtcgggcacgtggtcctcggcaacgtcatcccgaccgagccccgggacgcctacatcgcccgcgtcgcggcgatggagggcgggattcccgaggcggtgccggccctgacggtcaaccgcctctgcggcagcggcctgcaggcgatcgtctcggccgcgcagtccattctgctcggcgacaccgagacggccgtggccggcggcgccgagagcatgagccgcgcgccccacctcctgaccaccgggcggaccgggtcgcgcatgggcgacgccgtgctggtcgactacatgctcggcgcgctgaccgacccgttcggcaacggccacatgggcgtcaccgccgagaacgtggccgcgcgctacgccgtcccccgcgacgcgcaggacgccttcgcggccgagagccaggcccgcgccgcgcgggcgatccgcgagggccggttccgggagcagatcctgccgatcgaggtccagcgcaagcgcgagacggtggccttcgacaccgacgagcacccgaaggccacgagcgccgaggacctcgccaagctgcgcccggccttctccaagaccggcagcgtcacggccggcaacgcctcggggctgaacgacggcgcggcggccctcgtcctgtcgagcgccgcgcgggccgcgcgcgacggcgcgacgcccctcgcccgcatcgtcggctacgcccatgccggcgtggacccgtccgagatgggcatgggcccggtgccggcggtgcggcggctgctggagcggaccggcctgcgggcggcggatttcgaggtcatcgagtcgaacgaggccttcgcggcccaggcctgcgcggtctcccgcgaactcgacctcgatcccgacagggtcaacccgaacggcggcgccatcgccctcggccacccgatcggcgccacgggggcgatcatcaccgtgaaggccctctacgagctggcccggaccggcggccgctacgggctcgtcaccatgtgcatcggcggcggccaggggatcgccatggccctcgagcgcgtcccgtga

SEQ ID NO: 5516 - DNA, 1014 bp, Methylobacterium sp.
atgaggaccggcagcatgagcggcacccccctcctgtcgatcgagaacctgcaggtccatttccgcacccccgacggggtgaaccgggcggtggacggggtctcgttcgcgatccagtcgggcgagaccctggcgatcgtgggcgagtccggctgcggcaagtcggtgacctcgatgtcgatcctgcggctcctgcccgagccgccggcccgcatcgccggcgccatcaggttcgagggcaagaacctcctcgacctgccgaacagcgccatgcgcaagatccgcggcaacgacatcagcgtgatcttccaggagccgatgaccagcctgaacccggtgctgacggtcggccgccagatcggcgagaccctgcggctgcaccaggggctcggccgccgggaggccgaggagcgggccgtggagatgctgacgctggtcggcatccccgagccgcggcgccgggtgcgggaatacccccaccagctctccggcggcatgcgccagcgggtgatgatcgccatcgcgctcgcctgctcgccgaagctcctgatcgccgacgagccgaccacggccctcgacgtgaccatccaggcccagatcctcgacctgatgcgcgacctgaaggcccgggtcggggccgccatcatgctgatcacccacgatctcggcgtggtcgccgaggtcgccgaccgggtggtggtgatgtatgccggccgcaaggtcgaggaggcgccggtccgcgacctgttccggtcgccgcgccacccctacacccgcggcctgatgggggcggtgccgaagctcggcgccgtggagcacggcgccgacgcgcggctcgccgagatccccggcatggtgccgagcctcaagggtcggatcgagggctgcgtcttcgccgggcgctgcccggacgtgaccgacctgtgccgcgcctacgcgccggccctggagccgaaggcgccgggccacctcgccgcctgccactacgcgccgaaggacgccctcgcggcatga

SEQ ID NO: 5517 - DNA, 234 bp, Methylobacterium sp.
atgagcgcccccacactcatcgcgacggtgacgaagaacaacgtggaggaggttcgggtcagcctgaccaccttcaacggacttgacctcatcgacatccggaccttcgcgcggctgatcggtgcgcacggcgagccggtaccgacgaagcgcggcatctgcctgtgtcgggaccgtctgcctgatctcatccaagctctaatccaagcacaggagggcggcgcatcatgctga

SEQ ID NO: 5518 - DNA, 243 bp, Methylobacterium sp.
atgacgtccggaacactcgagaagccgctggatgtcggcggcccgctgagccgccgggcggcggcgctggccaacgtccgctggttccgcgcgctggcgtggcgcgccctgcgcgacggcggcccgcgggccgagctgcgggcgtccaacgcgcgggccgcggcgcggatcgtgctgcgccaggccaagcgggaggcgctcgtcgcccgtctggcgcgacaggccctcgacgcctccgtctga

SEQ ID NO: 5519 - DNA, 243 bp, Methylobacterium sp.
atgccgctctacgtcaaggatccgcaggtcgacgcgctcgcggcccagctcatgacgctgctgggcacgagcaagaccgacgcggtgcgccgcgcgcttcagaacgagatcgcccgccagacgaaccggcccgatctcgtcgcgcggacggccgacttcgtccgtgccctgcacgagcgtgccggtccggaccggaagcccgccgacgcggcgttcatcgacggtctgtacgagcgcacctga

SEQ ID NO: 5520 - DNA, 531 bp, Methylobacterium sp.
gtgacagacgtgatacgcccggccgcggaggccgaccttcccgccatcgcggcgatctacggcgacgccgtcgcctccagcacggccagcttcgagacggagccgccgacgctggccgagatgacgcgccgcttcgaggtgctgcgcgcgggcggctttccctacctcgtggccgaacgggacggcgcggtcgcgggctacgcctatgccggcccctatcaccagcgcgccgcctatcgctcgaccctcgaggattcgatctacgtcgcccggacggcccgaggaggcggggtcggccggcgcctgctcaccgccctgatcgcggcgagcgagcagatcgactgccggaccctggtcgccatcatcgccgagagcggctcacccgcctcgatcgcgctgcacgcgagcctcggcttcacgcccgtcggaacgctcgcgggagtcggccacaagcacgggcgctggctcgatgtgacactcatgcagcgcagcctgggacccggccgcagccttccgccgacgcggatctga

SEQ ID NO: 5521 - DNA, 720 bp, Methylobacterium sp.
atgatctccgtcaacgaggacatgaagcaggagatgctgcgccgcggcatctcggtgctgcacccggccccgttcggcctgccggaggattgcgtcttcgagccgccgtgcagcatcaagtggatgggcgtcgattactgcctcactatgggggcgttctcgtacgcggtcagcggctactatttcggggccgacatcgcccgctactgctcgatcggcgagagcgtccaggtcgggcgcggcagccacccggtccagtgcggctcgacctcgccgctgttctacacgcaccactcggcggtgttcgaccgcatcgacccgcgggcggaggattacgagatctccggcccgtatctctggcccaagcgggtgcgcatcggcaacgacgtctatatcggccacggcgccttcctgatgcccgacatcacgatcggcgacggggcggtgatcggcgccatggcggtggtgaccaaggacgtgccgccctacgcgatcgtggccggcagccccgcccggatcgtgaagatgcgcttcccggacgcgctgatcgagcgctacctgaaggtgcaatggtggcgctacgccttctgggacctgcgccagtgctcgatcaccgacccggagacgttcatcgacgccgtcgaggagcggatcgccgggggcatgcaggaataccggccggagccgatcccgatccggtcgctgctgccgggcgcctga

SEQ ID NO: 5522 - DNA, 675 bp, Methylobacterium sp.
atggcgaagtacaaagcgggtatcgtcgcggtcgccaaggacgagcacccatacctgcttgaatggctcgcctttcacttcgctatcggcttcgaccacatctgggtctacgacaacgaaagtgcgccgcccttatcgcggctcatctctcatagagccgcccgggagcatgttacggttgttcgctggccgaactccgccaacgggcggctacagatcgaggcctacaaccattttctacgaacatttggtcgcgacgtaacctgggccgcgatcatcgacgtggatgagatgatctgcctcaagcaggaccaaacgatcgggaccttcctaaatcgatttgacggcgcaagcgggatcgccctcaactggcgctacttcggcagctcgggacatcagacacacgagcctggcttgatgatcgagcggttccgcatggcggctgcgccagacaacgagcacaacgccggagtcaagagcttgcaccgggttgaggacgtggcattcatgctgccgcactactcattgtatcacggccaagcagtggtcgtttcggcgagcggaacccctgttccaaacgactggcgcattcccctcgacacgaacaatttcgcagtcgctcaggttaaccactacttcgtcaaatcggctgagggtaattacccaggcctgtga

SEQ ID NO: 5523 - DNA, 696 bp, Methylobacterium sp.
cccgagacgcccgccaccggcggcttcgtcgagaccgtctgggcgccgatccgcgacctcctcgcccggctcggaccgctcgccctgccggtgctggcgctggtcgcgggattccggatgcccggctacgtctcgaacgccatggcgatcccgctgttcaagacgctcggctacaccaacaccgacatcgccacggtgaccaagctgttcggcttctggatcgcgctcggcggcaccttcctggcgagcgccatcatcccgcggatcggcatgatggcgagcctgctgatcggcaccgtcacggcctcggcctcgcacctggccctcgcctatctcgcctggcacggcggccacggcggggcggcgttctggaccttcgcgctgaccgtcgggatcgacggcttcgcctacgccttcgcgtcgatcgtgctgatcacctacatgtcccgtctctcggccaccgcccacgcggcgagccagtacgccctgctgacctcgctctgcgccctgcccggcagcctgctcgccgggttctcgggcttcgtgatcgagtggaccgggttcgcgtggttcttcgtcggcacgtccctgatcggcgtgccggtggccctgctctgcctgctggtcgcccgccggcacgggccgatggagccggcggccgacgcggccggggacacgccgaatcgagccacttga

SEQ ID NO: 5524 - DNA, 1356 bp, Methylobacterium sp.
gtcgagcagggcgccctgttctacgagttctcgctcgatacccacgtccccgccgaccatctgctgcgcgccatcgaccgcttcgttgacctgtcgggcctgcgcgcgcacctgcagccgttctacagctcgacgggccggccctcggtcgaccctgagttgatgatccgcatgctgctcatcggctactgcttcggcatccgcttcgagcgccgcttgtgcgacgaggtccacctcaacctcgcctaccgctggttctgccggctcggactcgacggccgggtgccggatcattccaccttctccaagaaccgtcatggccgcttccgcgacagcgacctactgcgacgcctgttcgagaccgtgctcgcccgctgcatcgccgaggggctcgtgggcggcgagggcttcgcggtcgacgccagcctgatcaaggccgatgccaaccggcagaagggtgtcgagggtacgaacggcctgccacccgagagcgtcagccgcgccgcccgggagtacctggccgtgcttgacgacgccgcgttcggcgctgcgacgccggtcgtgcccaagctcgtctcccccgccgacccggccgcgcgttggacgggcgcggacggtgggctggcctacttcgcctacgcggccaactacctgatcgacctcgaccacgcggtcatcgtggacgtcgagccgaccaccgcgatccggcaggccgaggtcacagccgtcaagcgcatgatcgtgcgctcgcgcgagcgcttcgacctctacccggcacggctcgccggcgacagcggttacggatcggccgcgatgctgggctggctcgtccacgagcagggcatcgagccgcacatccccgtcttcgacaagtctgagcgccgcgacggtaccttcagccgatcagccttcacctacgaccctgacgctgacgcctacacctgcccggccggcaagcagctgcggcaacgtcagaaggtctacaggtcaccgcctccgctcgtcgacgcagacgggatgctgcgctaccgcgcgagcaagcacgactgcgatgcctgcgcgctgaagccacgatgctgccccaacgcatccgcccgcaagatcccacgctcgatccacgagggtgcccggcagatggcgcgcgacatctgcgcctcggaggcgggccgtacctcgcggcgggagcgcaagaaggtcgagatgctgtttgcccacctcaagcggatcctgaagctggatcggcttcggttgcgggggccggatggagcccgggacgaattccacctcgcggccgccgcccaaaacctacggaagctggccaagctgatcccgctggggcagccgagcctagcctga

SEQ ID NO: 5525 - DNA, 231 bp, Methylobacterium sp.
atgaagggcatgatgctcaacgccctgctgggcgtgatgctgggccgcttcggctcggtctggcggctgctggtcttcgtcccgatcgtcgcggccgaggtcggctacggcctcctcgtctacaacttgagcgccggcgcgtgcctgcggcgcgggacggcgctgctggtctgcgggcaattggccttcctgctcggcgccctgctgcggcccatcgccaacgagcggtga

SEQ ID NO: 5526 - DNA, 807 bp, Methylobacterium sp.
atgtcgcgcgcaggcatccgccggacctacggcgccatctcgggcgcggtcctcgtcttcatcgtgctgccgctggtggtcatcgtctgggtgtcattcttcgccaaccgcatcctcgccttcccggcgagcggctacaccctcgactggtacgcgcgcgccctcgacacggacgcctttcgcgatggcttcgtcaccagtgtggagacggcgctgttcgccacggcggcgagcctcaccctcggcgtgccggcgagcctcggcctggtgcgcggccgcttccccggccgcgacgccgtgcaggccctgctgcttgcaccgatggtcgtacccggcatcgtcggcggcgccgccctgttcatagccttcatcgaggtcgaggcgctgctcgacatccaggtggccggcacgctcggcggtctgctcgtggcgcacacgctgatcgcgctgccctggaccatccgtctggtcagcgcgtccctcgcgtcggccgatcgggcgatcgaggaggccgcggcgagcctcggagccgacccgctcaccgtgctgcggcgcgtgacccttccggcgatccggcccgcgatcgtcgcggccgccctgttctccttcgtgatctcgttcatcgatctggagaagtcgatcttcctcgtcggcccgggacgcacgacgctgcagatcgccctggtcaactacctcgaatggaacctcgacgggacggtcgcggccgtcgccgccgtccagatcctgatcgtcgggacggcgctcctcgtcagcgaccgctacgcgcgtctcgcccaagccttctga

SEQ ID NO: 5527 - DNA, 822 bp, Methylobacterium sp.
atgagtgacggtggttacggcggcctgccgtctcttgcgggcggcgatcttgggcttagcccgtccattcaggactggcttctgcagcaggcccgggcgcaggcacagaacggtgtcggccaagacgcgccgtcggccacgcctccgggcttcaccggctacaatccgcctaccccgccgacgggcgcgccgaccgacgtcgtgcagccccaggcacaaagcctcgccgcggcggccatgaacgcgctggggccatcgagcgcgcaggccgcgaccccggatcagggcgacatccggagccggttcatctcgacgctgcagcagggcggtctcacgaacccgaacggcctcggtgccgtcgcggcctacgcccagcatgaaagccgctacagtccctcgaacatcacgggctcatggtcggacccgagcgagagcggtcaggccggcacgtcgggcggtatcctgtcgtggcgcgccgaccgccttgccaacatgcgagccttcacccggggcgccgccgaccccgtggtggcgcaggccaacttcctgctgcaggagaacccgcagctcacgcaggccctgcagaatgcccagagcccgcaggaggccaaccgcctgatggcggatgcgtggaagttcgcaggctacaatcgccccggcggggagaacgcggcgcgactggcgacgacgcaggcctatgccaacagcttcggcggcgggggagctttgccggcgctgacagcctctcggaatggtggctcgatgggtttgatcctccctcggtgtcgcggacatagggagatcatttcgcggtcctctcgg

SEQ ID NO: 5528 - DNA, 891 bp, Methylobacterium sp.
atgagcgacaccgatttctcctgggacgatcagcgggccttcctcacagtgctcgacaccggcagcctgtcggctgcagcgcgggctctcggcctcacccagcccaccgtccggcaccgggtcgaggcactggagcgagccatcgggcagccgctcttcgtccgtggcgtgaacgggttggcgccgacgcccgaggcactcgggttggccgggcacgtccggcgcatggcccacgcgtccgaggcgttccggcgcgaagccgagggcggggcgttcgaggtcgccggcccggtccgcctgagcgtctcggacttcgtcggcatcgaggtcgtgccgccgatgctggcgaccctgcgggagcgccacccgcgcctcgcggtcgagctgctcctcaccaacgccaacaccgaccttcccagccaggaggcggacgtggcggtgcgcatggcgcggccgagccagaacgcgctcgtggcgcgccacgtcggcagcatcccgctcgggttcttcgcgtcgccggcctatctcgaccggaacggcgttcccgagaccgtcgcggacctcactcggcacgccatggtcgggcccgaccgcatgccggcctacgtcgcgatcctggacgccctgagtcgggaggcgggcgggccgctgaacgtcgccctgcgcagcgacagccatccggcgcagctcgccgctgtgagggccggcctcggcatcggcgtggtgcaggtgccggtcggcgagcgggacctcgtgcgcatcctgacggaccgcgtcgtgttcgacctcgaaacgtggatcgtggcgcacgaggacgtgcggcgcagcgcccgcatcgacgccgtgttcaaccacctcgtcgagtccttccgggcctactgcgcccagtag

SEQ ID NO: 5529 - DNA, 1791 bp, Methylobacterium sp.
atggacgagcgggatctgcgcggcctcatcgggcaggtgaaggacggccgcctgtcgcggcgcgccttcgtgcagcggatggtggctgtcggcctcaccgcgcccatggccggtctgatgctggccgggaacggggtcgcgatggcggccgatatccgggccggctacaagccgaccaaggccggcggcggcggcgcgctcaagctgctctggtggcaggcgccgacgctgatcaacccgcatttcgccgtcggcaccaaggatcaggacgcctcgcggatcttctacgagccgctcgccgcctgggacgcggacggcaacctcgtgccggttctggccgcctcgatcccgtccaaggagaacggggcgctcgccgccgacggccgctcggtggtctggacgctcaagcccggcgtgaagtggcacgacggcaagccgctcaccgccgacgacctcgtcttcacctgggaatacgcccgcgaccccgccaccgccgcggtgacggccggctcctacaaggattgcaaggtcgagaaggtcgacgacctcagcgtccgggtgctgttcgacaagccgacgccctactggtgcgacgccttcgtgggcatcgtcgggatggtgctgccgaagcacctgttcggaccctacagcggcgccaagtcccgggatgcgccgcagaacctcgccccggtgggcaccggcccgtaccggttcgtggagttccggcccggcgacatcgtccgcggcgcgcttaaccccgactaccacctgccgaaccgcccgtacttcgacacggtcgagatgaagggcggcggcgacgcggtctcggccgcccgggccgtgctccagaccggcgagtacgactacgcctggaacatgctgatcgaggacgaggtgctgaagcgcctggagaccggcggcaagggccgggtcgacgtcgtctacggcggcaagctcgagttcctgctgctcaacgccgccgacccgaacgtcgaggtcgatggcgagcgcgcctcgatcaccaccaagcaccccgccttctccgacccgaaggtgtgccaggcgatgaacctcttggtcgaccgcaagtcgatccagacctacatctacggccgcaccggcaagcccaccgccaacacggtcaacggcccggagcgcttcgtctcgaagaacacgagcttcgccttcgaccccgccaaggccaacgcgctcctcgacgaggcgggctggaagaagggttccgacggcatccgcgccaaggacggcaagaagctcaagctgctgttccagacctcgatcaacgccccgcgccagaagacccaggcgatcatcaagcaggcggccgccaaggccggcatcgagatcgagctgaaatcggtgaccggctcggtgttcttctcctccgacccggcgaaccccgacacctgcacgcatttctacgccgacatggagatgtacgcctacagcatgacgcaggccgatccggcgatctggctgctcatgtacgcctcctgggaggtggcccagaaggccaacaagtggcagggccgcaacgtcgtgcgctggcgcaacgccgcctacgacgaggcctacaacgccgcccagagcgagctcgacccggtcaagcgggcggcgctcctcatcaagtgcaacgaccttgcggtctccgagaacgtgctgccgctgatccaccgcgccgaggtctcggcggtgggcgccacgctcacggcgccccgcagcggctgggacaacgacctgtcgttcctgcccgactggtaccgggaggcctga

SEQ ID NO: 5530 - DNA, 1215 bp, Methylobacterium sp.
atggccttccaagtcgcccacgacatcctcaggcaggtcccggcccggttccgtcggcccgagatgcggcccgaggtggggtccgaggcggggtccgatgaccggcgcggatcgggcgcggcgatcccggccgccccgctcccggaggcggccgcgtcgtccagcgagccgccgcccgccgcgcaggcggccgacctgctccaggcctggctcggcctctcggcgcagcagcggacgctgctcgacgccctcgtcgccgagctcgggatcgtctccaccgacgtggaggccaacgtccacggcctgtccaaccgcttccagagcatcgccgccacgacctgcgagcagtcggagatcgtccgggggctcgtcgcctcggtgcagaccgtccggatcgacggccggaccctgcagctcggcgacgtcgccgccggcctcggcgagacgctcaccgccctgatcgagcggatcaccctgatgtcgtcccgcgggtcgaccctcgcgcagggtctggccggggtgctcgagggcctgtcgtcggtcgaggggagcgttgcgcagatcgagcggatcaaccgccagaccaacctgctcgccctgaacgccaagatcgaggcggcccgggccggcgccagcggcgcggccttcgcggtggtcgccgacgaggtgcgcggcctcgccacgaccatcaacgccctgtcggatgtcatcaagcagcagatcggcaccatggcggccggcctgcgcggcagccatgccctgctgggcgacatcgcggcgatcgacatgtccgaggagagccggaccgccgagacgcgcgtccgcatggtgatgcgggcgctggtcgagcagaacgcgcaggtcgcgggcatcctgcagcagaccgccgagaccacgcaggccatcacgcaggacgtgtcggcggcgatcgtggcgatgcagttccaggaccgggccaagcagcgcatccagaacgtcgaggggctgctgcgctcggccggcgcggaactcgggcggctcgccgaccacagcgtggaccgcgtcgcggcgccgggcgccgtggccgacccggcctggatcgcggcggcgatcgccggctgcaccctgggggaggttcgcgcgcgcctgaccgagcgcctgctcgggggtgctccggcctgcgagacgccggccgccgacgccgccgacgatctggacggcatcgacctgttctga

SEQ ID NO: 5531 - DNA, 420 bp, Methylobacterium sp.
atggtggcgacggagacgcgaccgcgggatgtcctcgtcgagccccgcaccgacccgatcggcctgatcgcgcacgattccgcgaagcccgggagacccgccggctcgcgcctgacggtgcacgcgacgcccgcctggtcccgcggacatctcgaggccccgcgcgacgcggtcatcgccgcgcttctcggggcggccgagaacgttctcggcgctgcgctccggccgtcccacgcggaggcgcatcgctggcgctatgcccaggtcgagaccgccctggagcaaccctgcctgtacgatccggacctgcgtctcggggcaggcggggattggtgcctcggcgcccggatcgaggcggcctacgacagcggtcaggccctggcccggtgcctcctggccgatttgggccggcccgcgtga

SEQ ID NO: 5532 - DNA, 762 bp, Methylobacterium sp.
ccacagcgccaccgaccgccgcgggacttcgccggacagcccgcccgtatccgcgccgcgaacaccgatcccacccatgacgagcgcgattctgtcgctctgacgccgggtggctcggcccctatcttcgccctcacgcggcggcggggccggtcgttcagacggggcaggggcgtgaacgagcacggaattgtcgcggtcctcggagccggcatggccggcgcggccgccgcgcgccggctggccgaggcgggcctccgcgtccgggtcttcgacaaggggcgcggggtcgggggtcgcatggcaacccgtcgggtcggtgagatgcagttcgaccacggcgcgcagttcatgcgcgcgcgcgggcccgccttcgcggccgagctcgaccggtggacgcagcagggcatcgtcgcgccctgggccggctccgaccgccatgtcggcgtgccgggcatgacggagcccgtccgcgccctgctctcggaccttccggtatcgagcgccacgaccatcgtgcggcttcgacggcagggagcgcgctggcacctcgaggacgcggccggcaccctgcacggcccgttcgacgccgtcgcgatcaccttcccggcccctcaggtcacggcgctgctcgaacatcgggcgtcgcgttgcccggtgtcgggcgagccacctacgcgccgtgctggtcgctcatggtggcgacggagacgcgaccgcgggatgtcctcgtcgagccccgcaccgacccgatcggcctga

SEQ ID NO: 5533 - DNA, 963 bp, Methylobacterium sp.
atggacaggcgccgcatcggccgctccgacctgacggtcgcgccgttctgcctcggcggcaacgtcttcggctggacggccgacgaggccacgtccttcgcgatcctcgaccggttcgtggagagcggcttcgacttcatcgacaccgccgacgtctactcccgctgggcccccggccacgtcggcggggagtccgagacggtgatcggcaagtggctcgtggcccgtccgggcgcgcgcgaccggatcgtcctggcgacaaaggtcggtatggacatgggcgaggccggcacggggctctcggcggcccatatcgagcgggcctgcgaggcctcgctgcggcgcctcggggtcgaccggattgacctgtaccaatcgcatctcgacgacgcgacggtgcccctcgaggaaaccctgagagcgcacgagcgcctgatcgcggccggcaaggtgcgggcgatcggcgcctcgaactacgatgcggcccggctcgcggaggcgctggcggtctcggcctccgcgggcctgccgcgctacgagtgcctgcagcccgattacagcctcgcccaacgcggctacgaggccgagcttgagccgctctgccgggccgagcagatcggcgtgatcggctacttctccctggcggccggtttcctgaccggcaagtaccgcagtgccgacgacgcggcgggacgcccgcgggagaaccgggtcgccaagtacctgaacccccgcggcctcgcgctgctcgacgtcctcgattcggtcgcgcaggcccacggcgcgagttcggcccaggtcgcgctcgcctggatcatcgcccgccccggcatcaccgcgcccatcgcgagcgccacctccgtggcgcagctcgacgagctgctcggcgccgtcaggctgaccctcgcacccggggcgatcgaccggctggatgcggcgagcgcgggcggcatcgagggctaa

SEQ ID NO: 5534 - DNA, 1293 bp, Methylobacterium sp.
gtgaaggtcgaggccctgcagccccgaccgcgactgaatggagacagaatcatcgtgcccggcgccccaaccgcgcgcggctccgagccgcccgatacgctgccgcgtccgaccatcgccggtaacgtcgccctcggcgtgacgcagatcgtcctgtggggcggcacgttcttcctcaccgccgtcgtctcggacccgatcgtcgccgagaccggctggccgcaggcgatggtggtgggcgcgctctcgctcgcgatcttcgtgtcgggcctgccggcgcccttcgtcggccgcatgatccggcgtcacggcggccggccggtcctgatcgccggcgccacgatcatcgcggccggcctcgtgctgatggctctcgcgcagaccctgccggtcttcctgctcgcctgggtggtcgccggtctgggcatggcggccgcgctctacgatccgctcttcgcggcgatcggccaggcctacggcgccaacgcccgcggggcgatgacccagatcgcgatctcgtcgggcttcgcggtctcgctctgctggccggccacgcggttcctggtcgatcaggtcggctggcgcggggcctgcctcacctacgcgatcctgtccgtcgccctcgtggtcccgctcttcgcctgggcgctgccggcacggagccaggccgcggtcgagcccgctgcggcaccccggccctacgcgccggccggctcgacagaggcggcgcgcctgccggccgagcgcctgctcgccgtgaccttcacgatggcggcgatgatcatgaccgccgtctcggtgcaactgctcaacctgctgcagactctgggcgtcggcgggaccgcagcggtggccctgaccggcctgatcggtcccgcccaggtcggcgtgcgcgtcgtcgaactcgccttcggccgccgcgcccacccggcctggtccctgctgctgtcgagcgccagcgtcgggctcgggctcctgctgctggcgactgcgccgtccctggtgtggctcgcgatggtgctctacggcgccggcaacggcatgcgcacggtcgtgcggggcacgctgccgctggcgctctacggacagcgcgaatacgcggcggcaatgggccggctcgcccgcctcccgctccttgggcaggcgatcacgcccctggcctgcggctatatcgccgaacgattcggtctcctgccgctgctcgaggtgatgctggccgtggcagcgatcaatctcggcctgtccctgtgggtgttcggcttcgcgatgcgccgccccagtgcgcaggcctga

SEQ ID NO: 5535 - DNA, 759 bp, Methylobacterium sp.
atgatcggagcggacctgtccggacggcgcgtcctcgtcaccggagcctcgtcggggatcgggctcgcgaccgtcgcgatcttcgcccgcaacggcgccaccgtggcgctgaaccacctgccggacgatccccgcggccccgaagaggccgcccggctcgccggagccggattctcggtgatcgcgctgcccggcgacgtgtcgcgggcgggcgaggccgaggcgatggttgcggccggcatcgaccggctcggtggcctcgacgtgctcgtcaacaatgccggcacgtcgggcacgaccacgcccatcgccttcgaggacctcgacgcgatgaccgaggatttctgggccacgatcctggcgaccaacctgctcgggccgttccgctgcgcgaaggccgcggccgcgaccctcacggcgagccgcggcgccatcgtcaacaccgcgtcggtggccggcctcgggcggcgcggctcgtcggtcgcctactcggcaagcaaggccggactgatcaacctgacccgcagcctcgcccgggcgctggcgccggacgtgcgcgtcaacgcggtggcgcccggcctcgtcgccacgccctggaccgagccctggtcggaggagcgcaaggcctcgaccgtggggcgcaccatgctcggccgcatggcccgcccggaggacatcgccgagacgatcttcttcctgggcgcgggcgcggcctacatcacgggcgagaccatcacggtcgacggcggagcgatctga

SEQ ID NO: 5536 - DNA, 204 bp, Methylobacterium sp.
atggcagtggcgagcaccgcgcgggcgaacaccctgatcgccgtgaagatggcgctgcgcttcgggctgccgctgatcgggctcgcggtcttcggccgcgccgtcgtcctgtcggtgggcggcgatatcgagcacggccagttcgccctgggcgtgctcctgatcctggcgggtttcacctcgaagctggtgccccgaccatga

SEQ ID NO: 5537 - DNA, 285 bp, Methylobacterium sp.
atgagcgtcgcgatcggctcggtcctggccctcgccgtggcgtccgcgtggctcgcggccctcgccgtctggcgcctgccctgggcgctcgaccggatgcacgccgtctcgttcctgaacgtcgcggccgcgatcctcgtgacgggggcggccttcctggccgacggcgtctccgggcgctcgctcaagatcctggtgatgatggtggtgttcctcgcctggtcggcggtcctgtcgcacgtctcgggccgggccgtgctgatgcgcgagggccgctcggcatga

SEQ ID NO: 5538 - DNA, 1089 bp, Methylobacterium sp.
gtgagcgacctgacgttcgagatccaaagtcatccggccccgcggaccgccgaggagcgggccgcgctgatggcgaatcctggcttcggcaaggtgttcacagaccacatggtggtggcgcgctacaccgccggccgcggctggcacgacgcgcggatccaggcgcgcgaggccatccccctcgatcctgccgccgcggtgctgcactacgcgcaggagatcttcgagggcctgaaggcctaccgcaccgcggacggcggcgcggccctgttccggccggaggccaacgccctgcgcttccgccgctccgccgagcggatggcgatggcgcccttccccgaggacgccttcgtcgaggcgatgcgcaggctcgtcgagatcgaccgcgcctggatccccgacacgccggacggcagcctctacctgcgcccgttcatgatcgccagcgaggccttcctcggggtcaagccggcctcggaatacctgttcgtgacgatcgcctcggccgtcggctcgtacttcaaggatccgaccggcaccgtgacggtgtgggtctcggagcacttcacgcgcgcggccccgggcggcacgggcgcggccaagtgcggcggcaactacgcggcgagcctcgcggcgcagtcggaggcggcgtcccagggctgcgagcaggtggtgttcctcgacgcggccgagcgccgctacgtcgaggagctcggcggcatgaacgtgttcttcgtcttcgaggacggaacgctggtgacgccgccgctctcggacagcatcctgcccggcatcacccgcgactcggtgatcacgctggcgcgggaggcgggcctgaccgtgaaggaggagccctacacgatcgacgcgtggcgcgccgacgtgcgggagggccgcctgaccgaggccttcgcctgcggcaccgccgcggtgatcacgccgatcggcaccgtgaagggtcgggaggagagcttcaccatcgggaacggcaaggccggccccgtggcccagcggctgcggagcctgctggtggacatccagcggggcaattccaatgacgcccacggctggttccagaagatcttctga

SEQ ID NO: 5539 - DNA, 1377 bp, Methylobacterium sp.
atgagcgccgcgctgcagatcgccctcccggacatcggcgactaccgggacgtgccggtcatcgagcttctggtgaagcccggcgaccgcctcgcggtggacgacctgatcctcagcatcgagtccgacaaggccaccatggaggtcccgtccccggtcgccggcgtcgtgcgcgagttgctggtgtcggtggggtcgaaggtctccgagggcacaccgatcctgacgctggagcctgccgagggcggcggggccgagaccgcggcggcaccgcctgccgcggccgcagcgccatcggcttccgggcagagcgccggtcccctctcccgagcgggagagggacagggtgagggatcagggttgtccggaaacggcccccccctcactccagccctcgcccgcacgggagagggagccggtcgcgcctcgccggagccgatgcgggccgctgcgatccaggcgacaagcggcgacgtgcatgccagcccgtcagtccgccagctcgcccgcgagctgggcgtcgggctcgaccgcgtcgccgccaccgggccgaaggggcggatcctgcgcgaggacgtgcacgccttcgtcaaggcggccctcaacgcgccggcccaggcgcccgccgccgcgtccggcatcggcgccggcctgccgccctggccggaggtcgacttcgccaagtacgggccggtgcggcgcgagccgctctcgcgcatccagagcctctcgggggccaatctcagccgcaactggctgacgatcccgcacgtgaccaacttcgaccgggccgacgtcaccgagatcgagtcgttccgggtcggcctcaacacggagacgcgcacgccgcccgcccgggtcaccatggtggccttcctgatcaaggcggcggcctcggcgctgcgcgcctttccgcggttcaactcctccctggagggtggcgacctcgtcctgaaggactacgtccatgtcggcttcgcggtggacacgccgaagggcctgatggtgccggtggtgcgcgactgcgaccgcaagggcctcatcgagatcgccaccgagatggcggcgatggccgagaaggcccggtccggaacccttccgggctccgacatgcagggcggctgcttctcggtctcgtcgctcggcggcatcggcggcgacggcttcaccccgatcatcaacgccccagaggtcgcgatcctcggcgcggcgcgctcgcgcaccgaggcggtctgggatggcaaggccttccagccgcgcctgatcctgccgctcagcctgtcctgggaccaccgcgtcgtggacggcgtcgccgccgcccgcttcctcggccacgtggcctcggtcctgtcggacctgcgccgcgccctactgtga

SEQ ID NO: 5540 - DNA, 930 bp, Methylobacterium sp.
atggcctcacagcggaaagtcatcatcacctgcgcggtgacgggcgcgatccacacgcccagcatgtcgccgcacctgcctgtgacgcccgaggagatcgccgacgccgccatcggcgccgccgaggccggcgccgccatcgtccacctgcatgcccgcaatccggagaacggccagcccgaccagacacccgaggccttcgccaagttcctgccggtgatcaagcagcgctcgaactgcgtggtgaacatcaccaccggcggcgcgccgaccatgtcgatcgaggagcgggtacgcccggccgcgaccttccagccggaggtcgcctcgctgaacctcggctcgatgaatttcggcctgttcggcatgctcgaccgcttcaaggacctgaagcaccagtgggagcgggactatctcggcaacaaggacatcatcttccgaaacaccttcggccagatcgagcacatcctgacgacctgcggcccgaacgggacgaagttcgagttcgagtgctacgacaccgcgcatctctacaacctgaaatacttcttcgaccgcggcctcgtgcaggcgccgctgttcatccagacagtcttcggccttcagggcggcatcggcgcgcatccggacgacgtgatgcacatgaagcgcacagccgaccgtctgttcggcgaccagtaccgctggtcggtgctcggtgcgggccgcaaccagatgaacatcgccgccatggcggccgcgatgggcggcaacgtccgcgtcggactggaagacagcctctgggacggtccgggcaagctcgccgagaccaacgccgcgcaggtccggcgcgtacgttcgatcatcgaggggctgggcctcgcggtcgcctcgcccgacgaggcgcgggagatcctggcgctgaagggcggcgacaaggtcgcgttctga

SEQ ID NO: 5541 - DNA, 1851 bp, Methylobacterium sp.
ttgacccgtcccgccccgtccctgcggtcgcaccagcgcacgctgatggccctggtcgcggccatggcgagcgggcaggcggcccatgtccggaggatcctggcggcggtcacgccgggcgggggcaagtcgctgctgccggtcatcgccgcgcaccggctgatcgaggcggggctcgtcgagcgcgtggtctgggtggtaccgcgggattccctgcggctgcaggccgaggaagccttcgccgacccgctgtggcgcgcggccttcgggcacgccctcagcgtccgggccgccgacaacgagcgcgacccggcgcggggcctggccggctacgtcaccacctatcaggcggtcgccgccgccccggcgctccatctcgcggaggcgcgggcgcaccgcaccctgctggtggtcgacgaggtccatcacctgccggtccccggtcgcccgggcgccgacgagacctccgcggaggattccgaggcgggggcgtggtcccgcgcgatgctgcccgtcatggaggcggcgaccgtgcgcctgtacctgtccgggacgctggagcgggcggacgggcggcggatcctcgggctgccctaccaggccgccgcgcccggccgcgggccggaagtcgacctctacgcccccggcctcgcggtcatcgggtactcgcgggcgcaggcgctggccgagcgggcggtgctgccggtgacgttcggcgccctcgacggcgaggcgagctggctggagggcggccggatcgcgggcgacagcccgcgcgtcgggccgcaccggctcggcgcgggcgcggtccggatcacaacccggccggcgctgttcaccgccctgcggaccggcttcgcccgcgaccttctgagcgaggcgttcttcgccacgaagcgcctgcgcgcccggcgccgggccgagcgcgatcttccgcccggcgaaccggcccgggggctcggcaagctcctcgtggtggcgcccgatcaggcgagcgcgcgggcctatctcgcgaccctgcgggactggatgccgaccgggcagggcgcgcgcgatgtccgtctcgcgacctccggtcagggcgacgcccacgcggccctggcggccttccggctcacgccggagccggccgtgctggtgacggtggcgatggcctacgagggtctcgacgctccggaggtcgcggtggtcgcggccctgacgcatatccgctcgcggccctggctcgagcagatgctcgcccgggccacccgggtcgacccccatgccggcccctacgacgggcagcaggcgctgatcttccaccccgacgacccgctcttcgcgcggttccggctcgaactcgagaccgagcagggcagcagcgtccggccgccccgcgagcggccggcgagcgccgtcgtgcccgagcggacccgctggcgcgacgacgagccgggcgggatcacacccctggagagcaacgcgatcgggatgcgctacgccctgctccgaccgcgcctccccgaaccggtccccgcggcgcccgcgcccgaaccgccctccgtcagcgagcggaccctgcgccagcggctcgccgcggcggtcgcggcccaggcggtggaggacgagacctccttgcgcgtaccccgcggcggcaacctcgcacaccgctacaacgccgttctcaagcgcgtgctcggcaagggccgcgcgaccatgaccctcccggaactggaggcggccctgtcctggctcgagcgcaaccgcctctccgaccatctcgaccgcctcgacggtgacgcccgctacgcgtggtccgcccggcagcgccgcggccgctggcagccggagcgcgccgccggccgctag

SEQ ID NO: 5542 - DNA, 1362 bp, Methylobacterium sp.
atgtccctttccgccaagctgcagcggcgcgccgacgagggccggcccgtccgggtcggactgatcggggctggcaagttcggctccatgtacctgtcgcaggcgccgcgcacgcccggcatccaccttgtcgcggtggccgacctgtcgcccgaccgggcgcgcgagtccctgcgccgggtcggctgggacgattcccggttcgccgcgcgcgggctggaggaggccgcgcgcggcggcacgaccctcgtgaccgaggatgccgacgcgatgatcgcgagcccgttcgtggacatcgtcatcgacgccaccggcagcccggccgccggcatccgccacgcgctcaaggccttcgcgcacggcaagcatatcgtcatggtcaatgtcgaggccgacgtgctggccgggccgctgctggcgcgccgggcggccgaggccggggtgatctactccatggcctcgggcgaccagccggcgctcatcgccgagctggtcgactgggcccgcaccatcgggctggaggtgatctgcgccggcaagggcaccaagtatctcccggcctaccacgcctccacgcccgacacggtctggggccattacggcttcagcgagagccaggtcgcggggggcgacttcaacccgcagatgttcaactccttcctcgacggcaccaagtcggcgctggagatggccgcggtggccaatgcctgcgggctcaccccgccgcgcgacggcctcgccttcccgccctgcggcgtcgacgacctgccgagcgtcctgaagcccgcggcggatggcggcctcctcaccgagcgcggcaccgtcgaggtggtctcgtcggtggagcgggacgggcggccagtcttccgggacctgcgctggggcgtctacgcggtgttcgaggcgccgagcgcctacgtgcgcgactgcttcgcgcagtacggcctcaagaccgattcgagcggccggttcgccgcgacctacaagccctatcacctgatcgggctcgagctcggcatctcggtcgcctccatcgcggttcgcggcgaggcgacgggggcgacgggcgactggcgcggtgacgtcgccgccacggccaagcgcgcgctgcgggccggggagcggctcgacggcgaaggcgggttcaccgtctacggcaagctgatgccggcggcggattccctggcgcaggacgccctgccgatcggcctcgcccacaacatggttctcaggaacgacgtgcccgcgggccggaccgtgcgctggagcgacgtcgccttcgacgccgatcaggaggcgatccgcgtccggcgcgagatggaggacctgttccgcggggcggcggggcgggctgccgggtag

SEQ ID NO: 5543 - DNA, 321 bp, Methylobacterium sp.
atggccttcgcctgcaccatccccgcgacgcccacgatccagcaggacgacggcgccgtgcgcatcacgcgctgggatttcccgcccggcggcgtgaccggctggcacgagcacggctggccctacttcgtggtgatgctggtggacgggatcctgcgcgtccacgacggcgcggcggtcagcgagacggccctcgcggccgggcaatcctacatgcgcccggcgggcatccggcacgacgtgatgaacgggtccgaccacccgatcgcgttcgtcgagatcgaggtgaagcgtccggacgcgctggtcacgctgccctga

SEQ ID NO: 5544 - DNA, 891 bp, Methylobacterium sp.
atgaacagcaccgacctgatgttcttcgcggcggtggccgagaccggcggcatcgggcgggcggcgacgcggctcaacaccgtccagtccaacgtcaccggccggatccgcgccctggagcaggccctgcgcgtgccgctcttccaccgcggcagccgcggggtgacgctgacccgggcgggggagcagctcctgccctacgcgctccaggtcgggcagctgctcgcggaggcgcgccacgccctgctggccgagggcgagccgcgcggacccctgcggatcggcgccatggagacgaccgcggccctgcgcctgcccggcccgctcgcggatttcgccgcgtgccacccggaggtggacatcgagctggagaccggcccgaccgagcagctgatcgcccgggtcctcgaccggagcctggagggggccttcgtggccggcccggtcgcccaggccgaccttgtggggatcccggtcttcaccgaggagctggtgctggtggcgcacccggccgtcggcgacctcgcggcgctgctcgaccggctcgccggggcgcgcgatgcgaaggtgctcgtgttccgggccggctgctcgtaccggaggcgcctggaggcgttcctggcccgccagggcctcgtgcatgtgcggcgcatggagttcgggaccctcgacggcatcctcggctgcgtggcggccggcctgggcgtgaccctggttccgcgggccgtggcggagccggcgcaccgcgccggccgggtctcggtccaccccgtgcccgacggggacggccacgtcccgacgctgctggtccaccgcgccgacgaccggccgagcgcggccttcgcgcggttcgccgagcagatccggacggcgctcccggatgtgacctag

SEQ ID NO: 5545 - DNA, 312 bp, Methylobacterium sp.
atgcatcgcgcgacgagccgccgcaccatgaaggcccgccgggattcccaccacggctggagcatcgagacgctgtcctacagcccgacgcggatcgtccgcctcggtgccgagaaggtcgcgatcctgttccccccagtcgaacccggcgcggcctggcagctgtacccgcatcccgacacgttcccgggcctcaacttcgagggcctgcccgagccgctgcgccccgaattcctcgccttcccggacctcccggaggtcgagcggttcctcggcatccgcgacgccgagcccgccgccctcgcggcgtga

SEQ ID NO: 5546 - DNA, 1143 bp, Methylobacterium sp.
atggcgttcaccgaatccgtcgccgcggcgctcccgtgccagcgccatctcttcgagatgcccgccgacgtcagctacctcgacgccgccgcctggtcgccgctgccgcgggccgtgcgcgcggcgggcgaggcggggatcctggtcaagagccgtccctgggaccatccccgcacggcggtcccgccctgggccgagcgggcgcgcgcggcggccgcccggctgatcggcgccggcgcggacgacatcgcgatcgtcggcgcggtcagccacgccatggcggtggccgcccgcaacctgaccctgaggccgggcaggcgcctgctccgcgtggccgacgagttcccgtccctgcgcttcgccttcgaccggctggccgaccgggagggtctggtggtggaggaggtgccgcgccccccgggcggcgactggaccgcggcggccgccgccgcgatcgaccggccgggcgccccgccgctcgccctcgccaccctgaccccgctgcactggaccgacggcagcctgatcgacctcgatcggctggctccctcggtccacgccgccggcgcggccctggtgatcgacgccacgcaggccgtgggagccgtgccggtcgacgtcgcccggtggcgcccggacttcctggccttcccgacctacaagtgggctctcggaccgtacggtctcgccttcctgtacgccgcaccgcaccggcaggacggggcggccatcgaggagaatatcgggaaccgcccgccggccgccggtgcccgccgctacgaccggggcgagctcaacgatccggtcgcgctgttcatggccgtgaccgggctggagcagatcgccgaatggggcgtgccggccgtcgccgcccggctgcgcgggctgacggaccgcttggcggacggggccgccggtctcggcctggcgccgttgccggcctccctgcgggcgccgcacatcctcggcctgcggccgcccgcgggtctgccgacgggcctcgtcgatcgccttcagcaggaccgggtctacgtgagcgagcgctccggagcgctgcgcatcagcccgcacgtctgggcggacgaggacgacctcgcgcgctgccttgccgcactgtccggtgccttccgggctatcacctga

SEQ ID NO: 5547 - DNA, 2154 bp, Methylobacterium sp.
gtgcgggcggctctcatcatgccttatgcttttcaccgggcgctcgtcgccctcggcgtcgtgttgacgaccctgccgggcgcccgggcggaggaggccgggcaggccgggcgccccgagcccgcgatcggcctcgacaccttgtcggtcaccgcgaccaagaccgccgtcccggccgtcgacgccctcgcgggcacgagcgtcgtcccgcgggccgcgctcgaccgtctccagcccgggcgcctgtccgaggtgctgcgcgacgtgcccggcgtgatcacccaggagaaccggaacgacccggcgcaggcgatcaacatccgcggcctccaggatttcggccgggtgaacgtcctggtcgacggggcccggcaggatttccagatctcgggccacggggccaacggcgtgttctacctcgatcccgagctcgtcggcggcgtcgacgtcacccgcgggccgaccgcgacggtctacggctccggcgccatcgggggcgtcgcggcgttccgcacccggtcgatcgacgacatcctggctcccgacgagagcgccggcttcgtgcagaagcagggcttcggcacgaacggccagcgcttcgtgaacagctcggcgctcggcgcccgcatcggcaccgccgcggacgtgttcgggcagttcgtcttccgcgataccgcgccctatcgcgacggtgccggcctgccggtgcccgacaccggcagcgagctgaacgcgggcctcgccaagctcaccctgcggccggccgaggggcacgcgctccacgccacggcgctcctgcagcgattcgccttcgtcaacggcggcgacaccggcgcgggggcccgcttcgccaacgccgtgcaggccgacaccgttaccttcggctaccggttcgcccggccggacgtgccgctcgtcgacctcagcctcgacggctacgcgaccacgacccgcgacgcgctgaccttcctgcaggactcgccgcgcggtctctacggccggctcggcacccgggccggcgaccgcctgacctacgacctcgccaccgcgggcttcgacgcccacaacaccgcccggttcgagaccggcccggtcgcgcacgcgctcacgctcggcggcgacggcgtggcgaatcgcgtccggaccgccgaccgagccggcggcttcggcgcggccttcacgccgtcggggcagcgggagctggccggcgccttcctccaggacgagatccgcgccgcgccgtggctgcgcatcgtcggcgcgctccggcacgacagctaccagctcgacggcggggcctatcgcgcgcgcggcgcgcgggtctcgccgaagatcacggtcggcgtcgcgccggtcggcggcctcgaactctacggcacctatgccgagggctaccgcgcgcccacgatcaccgagacgctgatggcgggcatccacccgttcccggccttcgcgatcctcccgaatccggccctgcggccggaggtggcccgcaccgtcgagggcggcgccaacctgcgcgccgacggggtggtggggccggaggacgcgctgcgggccaagctcgcgctgttcgacacggcggtcgacggcttcatcgacattcaggccgtcgggccggcctactacgtcccggcgattcccggcgtcccggcctcgatctgcgccgcccggcccgggcgcttcccctgcgtgattccggcacggtcctaccagtaccgcaacgtcgcccgggccgacctgtcgggcgcggagctggaggggacctacgactggggccggggcttcgtgtcgctcgccgccacccacgtcgacggccgcgaccgcgccacccgcgagagcctgctcacggtgccgccggaccggatcggcacgacgttgggcctgcgcttcctcgccgaccggctcgtcgtgggcacgcgcctgaccctggtggaggcccgcaccgacctgcccgccgccgcccggagccgggccaccaaggcctacggcctggtggacctcttcgccacctgcgcggtcaccgaccggatcaccgcggacgtcgccgtccagaacgtcctcgaccggcgctaccgcgcgtacaacgacgcgctggcgagcccgggcctcgtcgccaaggcgtcgctcagcatcgcgttcgcgacccggtag

SEQ ID NO: 5548 - DNA, 357 bp, Methylobacterium sp.
atggcggttctgacgagcgacggcgcgaccctgcgggccttcgccgattcggtgctgcgcgccgccgaggagaccctggaagaggtcatgccggtgacgctggcggtgatcggcggcgttctcgccgaggcggagcctggctcagtcgcgctccaggacgcggatggcggtccgcccctgctctgggcgaccttcgccggtcgccgcatggtgttccgctacaacgcgatgacggcgatgatcgaactgcgcgtcggcaccgcggagggctacccgttccgcctgttcggccaccggtcgctcccgatggacatcgtcaatttcttcggcagcctgcgcatggaggggcggatctga

SEQ ID NO: 5549 - DNA, 264 bp, Methylobacterium sp.
atgctgaaggttctcgctcccgccgccctcctcgtgagcctcgcggtgcccgcctcggcgctaccgctggtgcaggacgccgtctccgacggcgccgacggcgcccggatcatccaggtctacggcggctgcggtccctacggccatcgcggcccgtacggcggctgccgcaccggcggccagtggggcggctacatccgcggccgctcgtgcccggcgggcttccacatcggcccctacggccgccgctgctggccgaactga

SEQ ID NO: 5550 - DNA, 156 bp, Methylobacterium sp.
atggctcgcgaacttaaaaccggcaaagcgcagcacgtcacggccgaagatttcaacgagcggatgaagcgcgtgtttgccgacaagccagatccgcgcaaggccgagccgaggactaagggcttcaagaacagcaagccgcccacgaacgattga

SEQ ID NO: 5551 - DNA, 156 bp, Methylobacterium sp.
atggcacgcgaactcaagaccggcaaagcgcagggcgtcacgcccgaggacttcaacgagcgcgtgaagcggctcctcgccgacaagccggatccccgcaaggccgagccggcgcggaagaatttcaaggtcaacaagccgctcgtgaggaactga

SEQ ID NO: 5552 - DNA, 369 bp, Methylobacterium sp.
atgaacatcatcaatcgcctgatctccaagattatacaattctttctgggcagcgaatatgagcgaagaagcagtgccatggctaaagagaaagaggcgggcgtttacgttggagaaaccgcgacaaaggccaggaatttcgaagacgactatcatgccgccacgaatatgctgaggatgcggatggacaggagcttcccagacaacttccacgcaaggctgggctcgggtaaaaacagcccctacgattacggagaggatcgggcacttgccgtcgacaccacgtcgaccgcgatagctatggcgcttcggaacggagccaccgtgaaacaggcagccgaagcgggtgcggagagcgtaggcatctga

SEQ ID NO: 5553 - DNA, 369 bp, Methylobacterium sp.
atgaccatcgtccggtggctgatctccagaacggtccagttttttcttggcagcgcgcaggagcgcaggtccgatgcgatcgccaagcgaaaggaagccgggaccttcgagggggcatcggcgagcaagggccgggatttcgaagccaactacgccgcggcagctcagctcctcagaacgcggatcgatcgggaattccccgatgcctactacgcgcggctgagttccgggagaaacagctcctacgattacgggcaggatcgcgcgctcgccatcgacaccatgtcgatcgccatagcgatggcgttgcggaacggcgccaccgttccgcaggaggccgcggccggggcggcgagcatcggcatctga

SEQ ID NO: 5554 - DNA, 447 bp, Methylobacterium sp.
atgcgggttcaggcgatgacgatcccgtctgcggccgggcccgcgacgcgcggcgccccacgggcgcgcctgctgctcgtcgcgctgacgatcctcgcgcttccgctggccttcgtcgcggccgcgcgggtccccgcggcgcccgtcgatcccgacctcgtgcgggtgatccgcttcatggcgctgctcaagggcggcttcgccctggcggcgctggccggctgcttctggcgtctcgggcggcccgccgggtggcggagcgccgtctacgtggccggaccgccgctcatggtgctcggggcggccggcctgtggtctctgcgcgatcccgggctggcggcgctcggcatgcatctcggcctgttcgcggtcctggcggcggcgctgaccgaccgcgaggccctgcccgatcggctccgcgccgcgcgccgtcagatcgtctcgtag

SEQ ID NO: 5555 - DNA, 1005 bp, Methylobacterium sp.
atgcagattcccatcaagcgctccctggagcgcgtgcccggcggcctgatggtggtgccgctgttcctcggcgcgatcctccacacgctcttcccggacaccgcgaccttcttcggctcgttcaccggcgcgctgttcaacggcgccctgccgatcctggcggtcttcttcgtctgcatgggcgcgggcatcgacttccgcgccgccccggcgatcgcccgcaagggcggcgtcctgctggccgccaaggtcggcgtcgcggcgatcatgggcgtggtgttcgggcagatcctcggcgaggcgccggtggtcgggggcgccttcgcggggctgtcgacgctggccatcgtcgccgccatgaacgacaccaacggcgggctctacctcgccctgatgggccagttcggccgcccgaaggatgcgggcgcctacgcgatcatgagcctcgaatccgggccgttcctcaccatggtgacgctcgggctggcgggcctgtcggccttcccgtggccgaccctggtgggcagcatcctgccgctgctgatcgggatgatcctgggcaacctcgaccgcgacatgcgcgccttcctgtcgggggcggcaccggtgatgatcccgttcttcgccttcgccctcggcttcgggctcgacctcgccaaaatctggcaggcgggcctcctcggcatcggcctcggcgtggcggtggtggcgatcaccggggccgccctgttcgtcgccgaccggctcaccgggggcaacggcgtggccggcgtcgccgccgcctcgacggccggcaacgccgccgccgtgccggcgatcatcgccgccgccaacccggcctacaaggaggccgccggtcccgccaccgtgctggtggcggcgagcgtggtggtcacggcgctgctcgtgccgctgctgaccgccttcgtggcggggcgggtccgcccggacgcggccgaggaagatccggcaccggttcccagccccgcgccgaccgcaccctga

SEQ ID NO: 5556 - DNA, 1317 bp, Methylobacterium sp.
atgacatccctgcgcgtcaggctcttcacgatcctgctcctcgcgaccggcctgatctggctcagcgcggtcgcctggatctacctcggctcgaagcgcgaggtggagcaggtgctggacacccgcctgcaggaggccgcgcgcatggtcggctccctcgtgggggcggtcggcgcctcggctcccgacggaacgccggccaccatcccggcgccgacggcctacgagcggcagctgtcctgccagatctggtcgctggacgggcgcatggtcgcgcggtcgagcggggccccggagcggcgcctgaccgatgcgccagccggcttctccgagcgcgaggtcgacggcgagacctggcgggtgttcaccgtcgaggacgccgagaaaggcgtgcgcgtcatggtcggcgaccgcctgggcctgcgcgagcgcctcgtgacagatctcatcatgggcctcgtcacccccgcgctcctcgtcgtcccgttcctcgggatgctgatctgggcgagcctcgggcggggcctgcgacccttgcgtctgatggcccgagacctcgcgggccgcgacgccgacgacatgagcgccatcgacgccgggcgggcccccgccgaggtcaggccgttggccaacgccctcaacgggctgttcctcaaggtcgaggcggcgcgccggcacgagcgggaggtgacggccttcgccgcgcacgagttgcgcacgccgctagccgggctgaagacccaggcccaggtcgccatggccaccaccgacccggacgtggcgaaggcggctttgcgccagatcctggcggccgtggaccgcaccacccgcctcgtccggcagctgctcgacgcggcccggctcgacgccgccggggcgacgccgaccctggcggaggtcgacctgggggccctggtggcggagaccgtggacggcatgcggatgcccgcgggggtccgcaccctgatcgacccggggctacgcggctataccctgcgggccgatcccgagagcttgcgcctggctctgcgcaaccttcacgagaacgccgtgcagcacatggaggccggcacggtggaatggctggtgcgtcccgatggcgagggcgtcctcgtgcgcgacgagggacccggtattcccgccgaggaactgccccacgtcacgacgcgcttcttccgcgggcgccacaagagcgcgaccgggagcgggctcggcctcgccatcgccgagatggcgtctcgtcggagcgggctgagcctgcggctgcgtaaccggccggatcgcccggggcttgaggcggcgatcgtccgcgcctga

SEQ ID NO: 5557 - DNA, 1842 bp, Methylobacterium sp.
atgagcccgtctcaggaggagcggatcgcggccgagcagttgcgcctcgtcctggacggcgtgacgcagtcggtcgccgtcggtttcctcgtctcgacgctcatgctggccgtgctgtggagcctggtgccccacgccgtcctgctgagctggtacggcgcgttcctcgtcgagcggttcggggcggcggcctacgcgcatcgggtccgcgccgcgatcggcgagcccgaccgcgcccgccgggtcgagcgcgtcatcttcctgagcaagatcgtcgagggcgcgatcctgggatcgctgatctggatcgcgctgccgctccaggtcccggcggtgagcatcctgaccatgtcgctgctgggcgcgacctgcagcaacggcgtctcgctcctggcgccgcggcggcacctctacctcgccctcgtcgtgcccgtcgccgtcctggccgcgggaaccctctggtcgctcggcggcgcgccctaccgcgccctggcaatctgctcgatcctcttcgtggtcgggcagtacggtcaggtcgtgctcgccagccgccgcgtgcgggaatcgatcgagctccgcttcgagaacgcggccctcgtggagcagctgcgcgcggagaccgccgcggcgcaccgggcccgccgcgacgccgagcacgccaacaccgcgaagtcgcagttcctcgcggcggccagccacgacctgcgccagccggtccacgcccagggcctcttcctccaggcgctgagccagacggatctcgccgcgccgcagcggcggatcctgcagaacgcccagaccgcgaacgtcgcgtcgaccgacatgctcaacacgcttctggacttctcgcgcctggaggccggagtcatcacgccgcggccccgcgccttcgagctgcagccgctcctcgacaagatcgagaacgagctggccccgctggccgacgccaagcgcctgatctatcggacgccccagacggacctggcgatcgtctcggacgcggccctgctggagctggtcctgcgcaatctcgtcctcaacgccatccggtacaccgagcgcggcggcgtcctcatcggctgccggcgccggcgcgcgggcgtgtcgatcgaagtctacgacaccgggatcggcatcccggccgacaagcgcgaggacatcttccgggagttctaccagctcgggaatcccgagcgcgatcgtcacaagggtctgggactggggctggcgatcgcgcgcgggatcgccgcctcgctcgatcacccgctctccctctcgtcgaaggtggggagcggcagcgtcttccgcatcctcgtcccccggacgctcgacgccgggcgggacgccgggctcgacgacgcgcccgcggccgccatcgcggagagcggcggcctggtcggcgcccgcatcctgatcgtcgacgacgatgccatcgtccgcgacgcgatggtggcgctcctctccggctggggttgcctgtgccgggccttcgaggacccgaccgacgtcaccgacctgccgccgcaggggccgccgccggacgcgctgatctgcgactaccgcctgcgcaggggccagaccggcgccgaagccatcgcgacgctgcggcagcattggggacggccgatcccggcgatcctcatcaccggcgacaccgcgcccgtccgcatgcgggaggccttggacagcggggtccctctgattcacaagccggtccggcccgaccttctccagaaggcgctcgccgcgctgatcccgcccggccggccacccgtcggtcccgtgggcgcggaggttcggcgcggaccggagacgacggatctcgtccgcgcggagggatag

SEQ ID NO: 5558 - DNA, 723 bp, Methylobacterium sp.
gtgaccgtgccgggacgaatccggctgttctgcctgccctacgcgggggcgagcgccgcggtgttcgcgcagtggcgccgcggcctccccgacgcggtcgatgtcaggcccgtcgagctgccggggcgcggctcccggatcggcgaggcgccctgcaccgacccgcgggcgctgacgcggcgcctcgcggacgaggtcgccggttccgtcacgggctcctacgcgctgttcgggcatagcctgggggcgctgctcgccttcgagctggcgcacgaactccgcgcccgcgggatcgcggcgccgcgcgcgctgttcgcctccggatgcgccggaccggcggtgtgcgacggggcgtatttccgccgcccgcgcagtgacgcggacctgcgcgacgcgctgtccgcctacggcgcgacgccgccggaggcgctggccgatcccgccctgatggccctggtgctgccggtgctccgggccgatttccggctgcgcggcgcctacacctacgcggcgcggccggcgctggactgcccgatccaggcgctcggcgggacgcgggacgacgtcgcccgcgccgacctcgaggcctggggccgcgagacgcgcggccccttcgacctcgcgctgttcgagggcgaccacttcttcatccacgcgcggcgggggccggtgctcgacctcgtcggccggcggatcggcgcgcgggccgaggccgcggcctga

SEQ ID NO: 5559 - DNA, 807 bp, Methylobacterium sp.
atggctcacatcgagacggccgcgcccccgctcctgaagatcaggaagctgcacaagagctacggcaccaacgaggtcctgaagggcatctccctcgacatccacgagggcgaggtcgtgtcgattatcggtgcgagcggctcgggcaagagcacgttcctgcgctgcctgaacctcatggagacgccgacctccggcttcatggatttcgagcgcttcgccttcgactacgagcagggcgcccgccgccagccgacgccgcagcagctctgcgagttgcgggcgcggatcggcatggtcttccagagctacaatctctggccgcacatgaccgtgctggagaacgtcatcgaggcgccgatccgggtgcggcggatgccgcgccggcaggccgttgcggaggcggaggcactgctccagcgcatcggcctctacgagaagcggcacgcctacccgtcgaagctctcgggcgggcagcagcagcgcgtggcgatcgtgcgcgccctggcgatggcgcccaaggtgatgctgttcgacgaggtgacctcggccctcgatccggagttggtcggcgaggtgctggcgctgatgggctccctcgcggcggacgggatgacgatgctgctcgtcacccacgagatggccttcgcccgggatgtcggcacccgcaccctgttcttcgacggcggcgtgatcgccgaagacgggccgcccgacgccatcatcggcgcgccccggagcgagcggctgcgccagttcctccggcgcgtcctgcaccagcccgccgcgccgggacagacggcgtga

SEQ ID NO: 5560 - DNA, 1017 bp, Methylobacterium sp.
atgagcgccacgcccgcacccgccggccgcaccctgctggaggtcaacgacctcaagaagcatttctccctcggcggcggcctgctcggccgcgagagccgcgtgctgaaggcggtggacggcctgtcgttcacggtcgcccgcggcgagacgctctcgctcgtcggcgagtccggctgcggcaagtccaccgtcgccaaggcgctgatgcgcctctacgcgccgaccgccggccaggtggtgctcgacgggaagcgcatcgacgacctctcggccggggcgctccggcccctgcggcgccacatccagatggtgttccaggacccgttctcgtcgctcaacccgcggatgcgggtgcgggcgatcctggccgagccgatccgcaatttcggcctcgcccggaacagcgccgacctagagagccgcctcgccagcctgatggagcgggtcggcctgccgcgcgaggcgctcgggcgcttcccgcacgagttctcgggcgggcagcgccagcgcatcggcatcgcccgggcgctcgccgccgagccggacctgatcatctgcgacgaggcggtctcggccctcgacgtctcggtgaaggcgcagatcgtcaacctgctgcgcgacctgcagcgcgagctcgacctcgcgatgctgttcatctcgcacgacctcgccatcgtcgagcacatgacccaccgcgtcgcggtgatgtatctcggcaagatcgtcgagatcggcccccgccgggatctcttcctagcgcccaagcacccctacacccaggctctgctctcggcggtgccgatcccggagcccggggccgggcgcacccggatcgtgctcaagggcgacgtgccgagcccgatcaacccgccgtcgggctgccgcttccacacccgctgcccgcacgccttcgaccgctgccggaccgaggtgccggggctcgacgcggtgggcgccggccatctcgccgcctgccacctcaacgacacggccgcccccgcccgggcggcctga

SEQ ID NO: 5561 - DNA, 381 bp, Methylobacterium sp.
gtgacatcctcgaccggacaacgacccgccgtcctgctcattgaggacgaggcgatccagatgatggtcctgtccgacctcattgaggaggcgggctgcgacgtcgttgaggcgacgacgaccaccaaggccatccagatccttgagaaccggccggacatccggatcgtcttcgccgacctcgacatgcgcggatcggtgatggggctgcgcctcgcggcgctcatccgggaacgttggccgcccatcgagttgatcctcaccggcgcggtcaagcccgacctgtcgagcatcccggcgcggggcgtgtttcacgacaagccgttccagcaacgcaagctcgtccagtgcatccgcgagttcgcgtcggtcagccaatag

SEQ ID NO: 5562 - DNA, 1329 bp, Methylobacterium sp.
atgaccgcagccctgtccgggtcgccggccgccgccgaggccggcgcggtgacggagaccggcgtcgtccgcaaggtcgcgtggcggctcatgccgctgatcatgatctgctacatgttcgcgttcttcgaccgcatcaacatcagcttcgccaagttccagctccagagcgacctcggcttcagcaacgtcgcctacgggttcggcgcgagcatgttcgtcgtcggctacgtgatcttcgaggtgccctcgaacctgttcctctaccgggtcggggcgcggcgctggatcgcccggatcatgatctcctggggcatcgccaccgcgctgatgatcttcatccgcagcgagtggcacttctacgccctgcgcttcctgatcggcgcgatggaggcgggcttcgcccccggcatcctctattacctgaccatctggtttccggcctcgcatcgcggccgcatcacctcgttcatgttcgtggcctcggccttctcggggatcttcggcgcgccggtggcgggcctgatcctcggcggcctcaacggcgtcggcggcctcgccggctggcaatggctgttcctggccggcggcctgccctgcctcgtgctcggaatgctcgtgctgacgcgcctcgacgaccggatcgccgatgcccgctggctgtccgagcccgagaaggcgctcctgtcgagccggatcgcccaccacaaccgggacatcggcgaccactcgctgatcggggcgatcaagcagcccggcttcctgatgatcgcgctgatctacttcctgctccagatcggctcgtacggcctgaacttctgggggccggacctgatcaagaccgcgagcggcgggcaggcggcctcggtaggcttcctgacggcgatcccctacatctgcggggcgatcagcatggtggtgatcgggcgcctgtccgacgcctcgggcgagcggccgaaattcgtcgccggcctcgccatcgcggccgcgctcggcttcttcggcgccggcctgttcgacaagcacatcgtgccgctgatgttcgccctggcgctgttgggggccggcatcgtcgcctcgatcccgaccttctggacgctgcccgccaagctcgtcaccggcgtcggcgcggcgggcgggatcgcgctgatcaacacgctcgggcagttcggcggcatcgtcagcccggtgatggtcggctgggtgaaggacctaaccggctcgaccacgcccgcgctctacgggatcggcgtgctctgtctcgtggccgccggactcgcgctcttcgccatgccggcgagcctgcgccggagcgaccgcgcggcgtga

SEQ ID NO: 5563 - DNA, 414 bp, Methylobacterium sp.
gtgcccgagctcaacgccatcctggagacggcgctgtacgtcgcggacctcgaccgcgccgaggccttctatcgcgacacgatgggactgcgctgcctcttcaccgacttccgcatgcgcgccttcgacgtcggcggccgcggtgtcctcctgctcttcccggagggcgggtccctgcagccgatcgagacgccgggcggtctcataccgccccatgacggccgcggcccggcccatatcgcgttctcgatcgacgccgacgccctcgcgccctgggaggaccatctcgcggccgccggcgtggccgtcgaagggcgcacccgctggccgcggggcggcgtcagcgtctatttccgcgacccggacgggcacctgctcgaactggccacacccggcctctggaagggctactga

SEQ ID NO: 5564 - DNA, 123 bp, Methylobacterium sp.
cacatcgtgctggagcgcggcgacgcgcgggtcgacgtgaagtgcgccgacgacgacacgaccagggcctgcgccgacgtcaccctgcagatgctcgagaagctcgggacgctccggccctga

SEQ ID NO: 5565 - DNA, 804 bp, Methylobacterium sp.
atgagcaccgacctcctcgaacctccggatgccgccgcccgcggccccgccaaccggaagcgcgagacggacgcgctcctctacctcgacgacctgcgggtgaccttcgacggctacaaggccctgcgcggcctgtcgctgacgctggcccgcggcgagctgcgggcgatcatcggcccgaacggcgccggcaagaccaccatgatggactgcatcaccggcaagacgcggccggacagcggcatcgcgctgttcgacggcacccacgacctgctcaggagcgacgagccggcgatcgccgacctcggcatcggccgcaagttccagaagcccaccgtgttcgagagccacacggtcgccgacaacatcctgctcgccctcaaggggccccgcgcggccttcgcgtccctgttcggctggcgcaaccgggtggaggccgcccggatcgacgccctgctggagaccgtcggcctgctgccccatcgcggccgaccggcggccgacctgagccacggccagaagcagtggctggagatcggcatgctgctcgcgcaggacccgaagctgctgctcgtcgacgagccggtggccggcatgaccgacgccgagaccgccgagaccgcccgcctgctccgccggatcgccggcgagcacgccgtcctcgtggtggagcacgacatgcacttcgtccgcgacctcggctgccgggtcacctgcctgcacgagggcgcggtgctggccgagggctcgatcgacgcggtctcggccgacccgcgggtggtcgaagtgtatctcggacgatga

SEQ ID NO: 5566 - DNA, 702 bp, Methylobacterium sp.
atgaccatgctcgccgtcgacggcatcgacctctattacggcgccgcgcaggcgctccgcggcgtctccctgacggccgaggccgggcaggtcacgacggttctcggccgcaacggcgtcggcaagacctcgctgctgcgggcgatcgtcggccagcagccggtgcgctccggcgcgatccgcctcgacggtcgcccgatccagggcctcgcgccttacgaccgggcgcgcgccgggatcgccttcgtgccccagggccgcgagatcttcccgctgctcaccgtcaaggagaacctggagaccggcttcgcgccgctgaagcgccgcgaccgccacatcccgggggagatctacgacctgttcccggtgctcaaggacatgctgcaccggcgcggcggcgacctctcgggcggccagcagcagcagctcgccatcggccgggcgctggtgacgcggccgaagctcctcgtgctcgacgagcccaccgaggggatccagccctcgatcatcaaggatatcggccgggcgatcacctacctgcgcggcaagggcgagatgggaatcgtgctagtcgagcagtatttcgagtgggcccgcgacctctgcgattcctacgcggtgatggatcgcgggcaggtggtgctggctggcccccgggccgggatggtcgaggccgacgtcctccgctggatgtccgtctag

SEQ ID NO: 5567 - DNA, 261 bp, Methylobacterium sp.
atggagcaggccatgaccgcgcacgagcccgagccgctggacgagttcacccgcctgcacgccaagctgtccgccctggagatcgtgctcggcgtcctgatcggtcggctctccgaggagaacccggagatccgcgaggacgtgaagcgcgacgtggcggcgatcctgtcggacctgccgatcgacggcccgagcgaggagatgatcgccgccgaggttcgccgcgccgccgaggtgctgaccagcgtgtcgatcggctga

SEQ ID NO: 5568 - DNA, 717 bp, Methylobacterium sp.
gtgctcgccgtccccgacgccacgcgcaagggcaaccaggcctacgacctgatgcggcgcgagatcgtcgcctgccgcctcctgcccggcacgcgcttcactgaggccgaggtgatggagcggttcgagatcggcaaggcgagctgccggatcgcgctccagcgcctggcccaggaaggcttcgtcagctcgatgccgcggcacggctaccgggtcagcccggtgaccgtgaaggatgtcgacgaggtcttcgccctccggatggagctcgagcccctcgcggcgcggggcgccgccggccgcgtgaaccgggcgcatctggagcgcctggagcaggcttgccgccgcaagatcacggtggagatgggcaaccagatcgacttcttcctggaggccaaccggggcttccacctcgcgatcgccgcggcttcggggaacgggcgcctgtaccggaccctgtcgggcctcctcgacgagatgacccgcctcgtcgccctcggcttcggcgtgcagggggtgcggccgaacatcgagaacgaccacaccgcgatgatcgagcacctcgtggcgggcgacgccgacagcgccgccctcgtggcccgccgccacgtcgagacgttccgcgacatgaccctggagaaggtcatcgccagcctgcgcgacaccgcggtggtggcgccggtgcggccggcccgggtcgacgggggcgagccgtga

SEQ ID NO: 5569 - DNA, 1200 bp, Methylobacterium sp.
atggcacgacgcaaagcaccccgtattcctgatgcgatcctggaccagcttctggccggtgcggatccgaagacggccttcgaggccgatggcctcctggacgagttgaagaaggctctggccgagcgggcgctcaacgccgagatggaccaccatctggcgggcgaggacgctggcaacacgcgcaacggctatggccgcaagacggtcacgaccgagacgggccggatcgagctggcgatcccccgcgaccggcaggcgacgttcgatccgcagctgatcgcctggtatcagcgccgctttcccggcttcgacgacaagatcgtgtcgatgtacgcgcgcggcatgagcactcgagagatcgtcgcgcacctgcgcgagctctacgggatcgaggtctcacccgacctgatcagtgcggtgaccgacgcggtcctggaggaggtcgccgcctggcaagcccggccgctggagccggtctacccgatcgtgttcttcgacgccctgcggatcaaggtgcgtgacgagggcgtggtccgcaacaaggccgtccacatcgcgctgggcgtgcgtgccgacggctccaaggagatcctcggcctgtggctggagcagaacgagggcgccaagttctggttgcgggtcatgaacgagctcaggaaccgcggcgtcgaggacgtgctgctggccgtggtcgatggcctgaagggcttccccgacgcgatccgggcggtgttccccgaggcgctggtccagacctgcatcgttcacctcctgcgccacagcctcgacttcgtgtcctacaaggaccgcaagctcgtggcgggggcgctgaaggacatctaccgcgcgctcgatgccgcggctggcgaggcggcgttggcggccttcgaggcgagcgaatggggtcggcgctacccggccatcgctcagagctggcgacgagcctggggcgaggtgatcccgttttacgccttccccggcgaggttcgccggatcctgtacaccacggatgagatggacaagacccatcgcgccttccgtggtagttttctcagggcgcgggcgacctcgtggcgaagcgcggggcctcggctgcaagccccgccgggccgccttcattcgagccttgccgatttgaggcgtccgcgcaccgtcttcgatgggcgcggcgtccagtgcgctacgacccgctcgtag

SEQ ID NO: 5570 - DNA, 1221 bp, Methylobacterium sp.
atggcacgacgcaaagcaccccgtatccctgacgcgatcctggaccagctcctggccggggccgatccgaagacggccttcgaggccgatggcctcctggacgagttgaagaaggccctggccgagcgggcgctcaatgccgagatggaccaccatctggcgggcgaggaggccggcaacacgcgcaacggctatggccgcaagacggtcaccaccgagaccggccggatcgagctttcgatcccgcgcgaccggcaggcgacgttcgatccgcagctgatcgcccggtatcagcgccgctttcccggcttcgacgacaagatcgtgtcgatgtacgcgcgtggcatgagcacccgggagatcgtcgcgcacctgcgcgagctctacggcatcgaggtctcacccgacctgatcagcgcggtgaccgacgcggttctggaggaggtcgctgcctggcaggcccggccgctggagccggtctacccgatcgtgttcttcgacgccctgcggatcaaggtgcgtgacgagggcgtggtccgcaacaaggccgtccacatcgcgctgggcgtgcgcgccgacggctccaaggagatcctcggcctgtggctggagcagaacgagggcgccaagttctggctacgggtcatgaacgagctgaagaaccgcggcgtcgaggacgtgctgctggccgtggtcgatggcctgaagggcttccccgacgcgatccgggcggtgttccccgaggcgctggtccagacctgcatcgtccacctgctacgccatagcctcgacttcgtgtcctacaaggaccgcaagctcgtggcgggtgcgctgaaggacatctaccgcgcgctcgatgccgcggctggcgaggcggccttggcggccttcgagacgagcgaatggggtcggcgctatccggccatcgcccagagctggcgacgggcctggggcgaggtgatcccgttttatgccttccccggcgaggttcgccggatcctgtacaccacgaacgccatcgaggccctgaacgccacgctgcgccgggccgtgcgcgcccgcgggcacttcccgaccgacgaggccgcgctgaagctgctctacctggtcttgaaccgctccgagaaggcatggaagatgggcccgcgtgagtgggtcatggccaaggcgcagttcgccgtcatcttcggcgagcgcttcacacgggccatggcggcctga

SEQ ID NO: 5571 - DNA, 1221 bp, Methylobacterium sp.; identical to SEQ ID NO: 5570

SEQ ID NO: 5572 - DNA, 1221 bp, Methylobacterium sp.
atggcacgacgcaaagcaccccgtatccctgacgcgatcctggaccagctcctggccggggccgatccgaagacggccttcgaggccgatggcctcctggacgagttgaagaaggccctggccgagcgggcgctcaatgccgagatggaccaccatctggcgggcgaggaggccggcaacacgcgcaacggctatggccgcaagacggtcaccaccgagaccggccggatcgagctttcgatcccgcgcgaccggcaggcgacgttcgatccgcagctgatcgcccggtatcagcgccgctttcccggcttcgacgacaagatcgtgtcgatgtacgcgcgtggcatgagcacccgggagatcgtcgcgcacctgcgcgagctctacggcatcgaggtctcacccgacctgatcagcgcggtgaccgacgcggttctggaggaggtcgctgcctggcaggcccggccgctggagccggtctacccgatcgtgttcttcgacgccctgcggatcaaggtgcgtgacgagggcgtggtccgcaacaaggccgtccacatcgcgctgggcgtgcgcgccgacggctccaaggagatcctcggcctgtggctggagcagaacgagggcgccaagttctggctacgggtcatgaacgagctgaagaaccgcggcgtcgaggacgtgctgctggccgtggtcgatggcctgaagggcttccccgacgcgatccgggcggtgttccccgaggcgctggtccagacctgcatcgtccacctgctacgccatagcctcgacttcgtgtcctacaaggaccgcaagctcgtggcgggtgcgctgaaggacatctaccgcgcgctcgatgccgcggctggcgaggcggccttggcggccttcgagacgagcgaatggggtcggcgctatccggccatcgcccagagctggcgacgggcctggggcgaggtgatcccgttttatgccttccccggcgaggttcgccggatcctgtacaccacgaacgccatcgaggccctgaacgccacgctgcgccgggccgtgcgcgcccgcgggcacttcccgaccgacgaggccgcgctgaagctgctctacctggtcttgaaccgctccgagaaggcatggaagatgggcccgcgtgagtgggtcatggccaaggcgcagttcgccgtcatcttcggcgagcgcttcacccgggccatggcggcctga

SEQ ID NO: 5573 - DNA, 651 bp, Methylobacterium sp.
gtgagcgtgatcgtcctgaccccggcgaccgccacggcgctgaccacggtcgccaacgtccggtcggatctcggcctcgccgagggcatgccccctgatgcgcagattacgcgcttcatcaagcaggcctcgtctcgggtcgcgacctactgccggcgcgctttcgggcggcagaccgtgcgccagcggttcagcgggtgccggggtgtggtcgacgtgggcggcggtctcctgctggaccgctcgccggtcgtgcagatcctcggcgtgacggctgacggcgtcgagctcgcgccggatgccttcgaggccgacgaccgcttcctctacgcgctgcattccggcgatcgcacgccctggacggcccgcagcgtcgtggtcgattacgaggcgggctggctgctgccgagcgagactcggggcgatccggccgccaccgcggcggccgacttgccggatgacgtcgagcgggcggtgatccagctcgtcggcgtggctgtgtcgatcgccggtcgcgacgcgatggtgaagagcgagagcaccgagggcgtcggctcggtcgactggtacgtgcagggctcgaccgcctccctcccgcacccagaggccgaggcggcgcttcgcgactaccgccgggtgttgttcgcgtga

SEQ ID NO: 5574 - DNA, 228 bp, Methylobacterium sp.
atgacgccctccgacctcgaccgacgagccgaactgaccatctggcccaagggcgcaccggcccgcgccgcggaggggcggccgttcgcgaccctgcgcgaggccctcgccgtcgcgatcgcggcgatggaatccggcgaggcccagccctggatcatcaccgaggccggcgacatcctctcgccgcgctggatccaggcgaattcccgaccgcgggcgccgcactag

SEQ ID NO: 5575 - DNA, 396 bp, Methylobacterium sp.
atgagtgccgccacccgccgcgccgcgctcggcgccatcctcgccgccccgctcacgggtggggccgtcatggcccttccttccaatcggatgccggccgcaccgccgactaatctcgcaaaggcctgcgattgggcggtcgcccacgtggcttgggtcaaccagaacgacgagccggttgatgcatggcccgacgagcggcttgaggccgagttggctcgcttcgacgacgttcttcaccgcgtcgccgacgagcctgctacgggcctgtcggacctcgccgccaaggccaggatccttcggtgcgactgggaggctgctctcggcggtcacgatttgcaccccggcgagcgcgcgctcctcaccttcctcaaggaggtgtcggcatgcgcctga

SEQ ID NO: 5576 - DNA, 615 bp, Methylobacterium sp.
atgtccttccgcgcctccctcaagcacctgatccgccgccaccctgccagcagtctgcgcgaccgcgccgacgaactgcgcggtgccttgcccagccgccgggctgtcgtggccgggtcgatggcggctgtcgtaccgctgtcggggggcgccgcagcgcagacccgggagaccaccgagtacgccgatcatcgcgaccgtctgctggccgcctacgccgaggatcgggcctgccgatcaatcgacggcgaagcgcgggtcggctccctggaggacgtggcctgcaccttggtcgtgcgaaggtgctgggcgatcgcagacgagatcggggccttaccgcccccgcgcaccctcgacggcctcgccgtgatcgcactcgcggcgacgatcccttgggaggtgtcgcatcccgaaacgatgagtgagcgagccgccgtcgctctgatccggtctatcctggcgatgaccgggaccgagcttccgccccggttcagcgggttcggcgacgagccggacgccgcggagcgcgacgccgccctctacaccgcctctggcacactgccagcttgggccatcgccgaggccaaggccgactacgacttcgacgacgcctga

SEQ ID NO: 5577 - DNA, 564 bp, Methylobacterium sp.
atgcggttcgacgcctgctgggatccggcctgcggcgagggccacatgttcgaggtcctgctggagtatttcggcggcggcggctggggctccgacatcttcgactatggccgcggctatcgggtcgaggattttctcgacgaaggcacggtgatcgggtcgcccgaggacgggatggcgcccgagttcatcatcaccaatccgccgttccgtccggcaaccgcattcaccctgcgcgcgctgacgctggcccccgtggtcgcgatgctgctgcgcacggtgtgggtcgagggcgttcagcgctacgagaccctgttccgtgatcggccgccgacgctactcgcgccgttcgtcgaacgcgtgccgatgacgaagggccgctgggacccggatgctggcacggccacgtcctacgcttggttcgtgtgggtgcgcgggcgcgatccgcacgcgccgttctggatcccgcccggctgccggcagcggctgaccaagccaaccgaccgcacgcgcttcgctgttcagacggcgacgcccctcttcgacctcgcggcagcggagtag

SEQ ID NO: 5578 - DNA, 5292 bp, Methylobacterium sp.
atggtcgccgtcaaccagatcgcggtgaacgagacccgcttcgtctacacgacggagggggtcgatcgcgttcgcgcgcagaacgagcaagtcgcgtcctcgctcgacaaggtgacgtcggcctccggtaaggccacggatgccgagggcaaagccgcgtcgtcgtcggacaaggcggcgcaggcccgggcgaagctcgccgcggtccaggagcgatttcagcggcagatgcaggccgaggcgcagatcctcggcatggcgcagtcgcagcaggacgcgctgaccgccgccaccgagcgcttcgccgatgcccagtctcaggccgcccggtccgcctctgcgttgcagagcgcggccaacgacaacaccggggcgctggagcggcagggcgaggcgttcaaggccgccggcaagttcgcgctggagcacccgatcatcgtggcggccgccagcgtcgcggcggcccgggcgctgtccggcttcgccgccacggcggccgggtcgctggcgaccgcgtccgccgtgacggcgcggtatgccgcgacctcgaccgagatgggcacgacggtcgccgccggcgcggctctggcgtcgcgcgggctctccggcctgtccacgggcgcggccgcggcggcggtcggcctggagaccttcgccacgaaggcggccggcctcacgaccaccaccagcctgctgtcgcgcgccctttcgctcgtgccggcctacttcctgccgatcgccgcggccttcgcggtgttcgagttggcctcggcggcgatcaagaaggcctacgcggacctcaaccagctcgtgcagctcggtgagaaggcgcagagcctcgacatcggcgcaccgttcctgaagagcttcgaggccatcgcccccaagatccaggcgacgaaggatcagatcgacgccgcgatcggcaaggcctccagcttcctcaaggactcctggggttccggcaacggcctgtcgaagctgttcaacgacatcagctcgacgggcgtggccggggcgggtggcctgcaggcgacggccctctcggacaccgccacctcgatccaggagcgcatccaggcggccctcgccggcatgaaggagcttgacgagctcggcctgcacctcgccagcatccaggtgggcgagaaggtattcgggccggagttcgtcgagcgcctacgggtcagcaacacctcggccgagcagctgtccgcggcgctccaggccgccgccgagaaggaggtgctgaagcaggagcaggtcgaccgggcgctcgcgctgaaccgccagatctccgacacgaagcaggccatcagcgaggcatgggcggtcacggtcgacttctcggccgccgcgctgctgctgaatgaggcgtggctgaagatcctccaggccgtgcagtgggtcgtcgagacgatcaacagcgccatcagcgccgtcggcaacttcgcgtccgcggtggcctccggcatcggcggggccttcgacgcggtcagcaacaaggtgagcggcctgctgacccagatgggcgtcctgtcggcgcagcagaaggtcgtggccagcgagacgccgaagatcgacggcacctatggcccgcagcagccgaccatcacggctcggcagttcccctacgtcttcgggccggaggcgccgaaggccgcggccgcggcggcgaagcagtcgaagcaggcggctcaggaggcggtcagctcctacgacaacctgatccagcgcacgaaggatcggatcgaggagctcgacctcgagacccagtcggtcggcaagtcgtccgaggcggtgatcaagctgaagctcgcccacgacctggagcgggcggccaagaaggacgggatcaccgtcaccgccgagatgcgggcggagaccgaccggctcggcaccagcctcgccgcctcgaccgagaacctcgccaacgcgaagcgccagctggagctgacccgggaggcgcagcgcgagctcggcgacaccttcggcaccttcgcggaggatgtgatcctcggcgggcagaagatgagcgaggcgttcgcgggcctcgccaagacgctcgcctccagctccctgaaggcgctcctcaccggccagggcgggctcgccggcctgttcgggaccgcgggcgagaagagcagcgacctcggcggcttactcggcggcaagatcagcttcggcagcctattcggcggtggatcgtcaaacgacgccggctcgccgctgcctggtgcgcagggcccgtccctgcccagcagcagcctgttcggaggcctgttcgacggagagaagatcacgaaggcgctgggcctcggggccgagagcggaatcggcaacgcgctgtcgaacgcgctgaagcccaaggggaacggcgggatcctgtcgtcgccgctgggcggcgcgatcgcgtccgtcggcgccggcgcggccatcggctacagcagccagagcccgctgatgggcgcgctcggcggcggcctcgccggcctcgccagcggcaacccgctgctcgcggtagcgggcgccggcgcaggcctcctcggcggcctgttcggtcagagcgaggccaagaagcaggccaagcggcaactccagcaggagcttcaggcccggcgcgaggccctcgaccaggcgcgcccgcagatcgagcagctcgccctgaccttcgagggcggctcaatcggcaacatcggcaagacgatctccgatgcgctgagccaggccaagcaggcgatcaagaccgccagcgacggcggcgatcaggccctcgccgacaagctgatgaaggactaccagtcctacgtcgcgcgcctgaccgcggtgttcgcggagggcttcaacggtgtcgcggccgagatgcaggccgggtttggcgccggcggcccgttctctcaggccatctcctccgtccagcagctcggcgaggtgctcaagggctttgtcacggatgccggtcggctgagcccggccgctgtcgcagcggcgcagaccgcggcggtgaccggcgccctcgcggcgctccagccgcccccgaacctgtccgcgacccagaccgagctcgcccggatcaacggcacggccaccggcctcaaccaggtgctgaaggatctcggcctgtccgcggaccaggcggccgccgcgatcaaggacggcacgaacaaggctctcgacgcgctgcggacgaagttcagcgacgacctcggccgcaagatcaacgacgccctgaacaaggggtatctgaacgacgcggcagacctcgtgaaggaggtagcgagcctctcgcaggatgcgtccgcgatcggtggcgacctcgggcaggtggacacctacttcaccgcggccgcgcagaagatcgtggacggcagccagcttgccggcagcgccttcgacgagctgatcacgaagttcccggagctcgccggcaaggtccacgagttctccgagaccgcgtccatgagcgcggaccaggcggccaaggccgcgcaggaggcgctgtccgccatccaggaccggatgcgcgggtacgaggaccggtacgtcgcggccaccttcgagaccgagagcctgccgggcaagctgctggcgttcgaccgggccgcggagtgggagcgctggcaggagggcgcgaagggcaaccaggcgatcgtcgagctcgagcgggcgcagggcgccgagcggctcaagatcatcaacgacttcgccaaagccgccacggaggcgctgaacgcccgtctgaagggctacgcggaccggctcttcaacgccggcaacgacacctcgaccctcggcggccagcttgccgcctacgaccggcaggcgcagcaggagcgcgaggacgaggccaaggccggcggccaggccctcgtgcagttggagatgacccaggcggccgagcgcgcgaagatcgtcgccgactatgccaagcaggcggccgacgcgctcaagcagcagatgtccgcggcgcagaccgccttcgagacgttcgtcaagaacatcaagacgtacctggacaatctgcgctcgggtggctcctcgccactgtcgccgaaggaccgtctcgccgcggcgcagagccagtacgacgcgcagctcgcgctggcccagggcggcgaccggaccgcgctcgacaacatcacgcagtacagcgatgcgctgctcgccgcgtccaagggctacaacgcctccggcgagggctaccaggcgacctatcagaagatcctggacgacctggcgaagctgccgacgcaggtctcagccgagcagttcatcgtcgatgcgatcaacgacagccgcgacgcgatcgtgtccgccaccgacgcgatgaagctggagctgaaggagggcctgatcgcgaacagcccgcagctcatcgccgcggcgctcctccagtatttcaacatgctggacacgtcggtgaacgggctgctcgactatagcgagttcacggcaggcctcggaccgctcgccaccgaggcggagcagcagcaggcccgggccatcttcaacgccatcgacgcgaatggcgacggccagctcagcaagctggaattgcagaacgcctcatcctaccggctcgagcagtacaccgcctccacggacgccaacacagatcaggcgaacaacatcggcaacgcccagaaggcgacgatggacaatcaggccgcctacctgaacagcatcaacaacctgaccaatgcggcctacgcgacgcagcagcagctcgtgagcctcaacgcaagcatcaacagccagaacgctttcatccagcagaataccggcttcacgaacagctatctcgccacgcagggccaatacttcggcgacacgtacctgctgcaggggcagatcctgaacaacctgcgctcggccaacgccaagaacggcgccccggtctacgcgacgggcggttgggtgagcggcccgggcaccggtacgtcggatagcatctcggcccgcctgtcgaacggcgagttcgtcgtgaacgccgcctccgcccggctgaacgggccgctccttgaggcgctgaacgacaaccgccccttcgcgatgccgaccatcggcgtgccggctggtggcgggcgcgacgatgccgcgctgatcgccgagctgcgggcgctgcgggcggaggtcgcgcggctgactcagctcgccgatgagggcaacagcatcgccgcggaggggcactccggcacgcgggctgcggtggggcggaacacggcggcgctcgagaccggcaacaccgtggcctcgcgcaagtcgctcgagcgccccgtgaaggccgcctga

SEQ ID NO: 5579 - DNA, 1266 bp, Methylobacterium sp.
atgacgcccggcgccccgagcgccaagatcctcgtcgtcgacgacgagccggatctcgaggcgctgatcacccagaagttccgccgccagatccggcagggcctcgtcacgttcctgttcgcccacgacgggcaggaggcgctggaccgcctggccgagagccgcgacgtcgatctggtcgtctccgacatcaacatgccgcggatggacgggctgaccctgctcgccaagctgcaggagctggccgagcgcccctcgatcatcatcgtctcggcctacggcgacatggcgaacatccgcacggcgatgaaccggggcgccttcgacttcctgacgaagccgatcgacttcgccgacctcgagacgacgatcgagcggacgctgcgccacgtcgaggacctgcgcgaggggcggcggcggcaatcgctcgccgagcgggcccacgcctccctggcccggtacttctcgccgaacctcgccgagcggctcgcgggggacgcgtcgggcctcgagctcggcggccaccgccgcgacgtggcctccctgttcaccgacatcgcgggcttcaccggcctggtggagagcctcgacccggcgcagctcgccgagatcctcaacggctacttcgccgagatgaccgacgtggtcttcgcccacgaggggacggtggccaagatcgtcggcgacgccctgcacgtcctgttcggcgcgccgggggaccagccggaccacgcggcgcgggcggtggcctgcgccctcgccctggacgaggcggccgagggcttccgcgggcgctggcgcgagcgcgggatcgagatcggcgtcacgcggatcggcgtccatgccggcccggcgatcgtgggcaatttcggcggcggccgctacttcgactacacggcctacggcgacaccatcaacacggccgcccgtctggagaacgccaacaaggccttcggcacgcggatctgcgtcagcgacgccgtcgtgatccgcgccggacagttccgcggccgccccctcggcgacctcctcctgcgcggcaagcagacggccctgcgcgcctacgagcccctgacggaggcggcctacggcgacgcgctgctcgcccagtaccaggacgcctacgccaagctcgatgccggggaggccggcgccctggccgccttcgcggccctggtcggtctgcgccccgacgacggggtcgcggccttccacctgaagcggctgctgaacggcggcagcggcagtcgggtcgaggtccgctga

SEQ ID NO: 5580 - DNA, 1176 bp, Methylobacterium sp.
atgccagcatgcgacgcgaccgatccggccgccctccgcggttccgacgaccgcacggccacccagcagcgcctgtccacgcggctgctgttcctgatcgtcggcctcgccaacgccacctgggcgcccctggtgccgctggtgaaggaccgcgccggcctcgacgcggccgggctcgggctgctgctcctcaccttcggcatcggctcgatcctgaccatgccgagcgccggggcagcggccgcgcggctcggcttcaggccggtcctgctcgccggcacgctggcgctcggcctcgccctcccggtgctggccgtggcctcggggctcgtgaccctcaccctggggctgctgctgttcggggccgggatgggagcggtggactgcgtcatgaacctgcaggcggtcgcggtggagcgccggagcgggcacccgatgatgtcgggcttccacggcctctacagcctcggctgcatcctgggggcgctgatcgccagcggcctgctggcggcgggcctcggcgcgggctggagcgtgctgatcctggtcgccggcatcgcggccctgttcgccgccgcttggcccggcatcctgccgacggacaggggagggacgcgcggccccgccttcgcgctgccccgcggcccggttctggtgctcggcctgctctgcttcgtggtgttcctcaccgagggctcggccctcgactggagcgcggtgttcctgatccagcagagggggctcgacccggcctgggcggcgctcggctacgcggccttctcggtgacgatgacggccggccggctcgcgggcgaccgggtcgtggcccggctcgggcgccggagcgtggtcgtcctcggcggcctgctggcggccgtcggcctcacgctctcggtcctcgtcccggcctgggaggcggcgctcgccggctacgccctggtcggggcgggctgcgccaacatcgtcccggtcctgttcacggcggccggccgccagagggcgatgcccgagagcgtggcggtgccggcggtgacgacgctgggctatgccggggtgctggcgggcccggccctgatcggcttcgccgcgcaggcgctcggcctccccgcggcgctcctgatcgtggcggccctgctcgtcggcgtggcggcggccgggcgctccctgcgggtgtga

SEQ ID NO: 5581 - DNA, 1692 bp, Methylobacterium sp.
atgtccgcgctcctcgtcaccctgtccgccaccaccgtcgccgcggtgctcgccctgccacgggcggccgagcgcctgcagctctcgcgggcgaagcatcgctcgctcaccggccacgcccgcatggcccggcgcgtcgccgggctgatcccgaactacgcctactcggagcgcgccttcttccggtcggacgatccggacgaggcggtggcgcgccggcgcgaggccggcttcgcgcggctctccgacctgttccgggcgcgcttcgcccggacacgcgccgagaccgaggcggtccgcgacgggctctcggatctccagttcaccgggctctaccgggtgcccttccagtacgcccggcacgtgcgcgcccatctcggcaccggagccttcgcggccgccgccgccggcgtcaccgtcacggacctcgacagcaacgtcttctacgacctcgccggctcctacggcgtgaacctgttcggcgtcgacttctatcgggcctgcctggaggagggcgcggcgcgggtctcggccctcggtcccgtgctcgggccgctccatccggtcgtcaccggcaacgtcgcgcggctgaaggcgatctcgggcctcgacgaggtctcgttccacatgtccgggaccgaggcggtgatgcaggccgtgcggctcgcccgctaccacaccggccgccgccggatcgtccgcctgtgcggcgcctatcacggctggtggggcgaggtgcagccgggcatcggcaacccggtcccgacccgcgacacgctcaccctggccgacatgtccgaacggacgctgcgggtgctcgccagccgacgcgacgtcgcctgcgtcctggtgaacccgctccaggcgatgcacccgaatgccggcgcgcccgccgattccgcgctggtcgacagcggccgcagggcgtccttcgatcgcgccgcctacaccaagtggcttcacgacctccgggcggtgtgcagcgcccgcggcatcgtgctgatcctcgacgaggtcttcctcggcttccggctggcccgcggcggcgcgcaggcgtatttcggcctgcgcgccgacatggtcacctacggcaagaccctggggggcggcctgccggtcggcgtcctctgcgggcgcgccgacctgatgcgccggtacagggaggaccggcccgtcgacatctgcttcgcgcggggcaccttcaacgcccatccctacgtgatgggcgcgatgggcgcattcctcgaccggctggacagcccggcggtggccgcactctacgccgacctcgacgcgacctgggacgcgcgcgcgcgtcacctgaacgcccggctggcggaggccggcctgccggtgcgggtcgccaacatgtcgacggtgtggacggtcctgtacaccgagccgtcgcgctacaactggatgctgcaattctacctgcgcgccgaggggctggccctgtcgtgggtcgggaccggccggatgatcttcagcctcgcgtacgacgacgcggccttcgaggccgtggcgacgcgcttcgaggcggcggcgcgggccatgcgggcggacggctggtgggacggcggcgcgccgagcgaccgggcgatccgccggtcgatcctgcgggaggtcgcggccatccgcctgggcggcctcggggcccgcctgggtctgcgcgcgccggatcagggctga

SEQ ID NO: 5582 - DNA, 906 bp, Methylobacterium sp.
atggccgcgcgcctcgccctcctcggcctcggcgcgatggggcaccccatcgcccgcaacctcgcggccaagcggggctccgacgccgagacgctcgtcgcgatcgacaccgacccggcgcgcctcgccggcctcgccgcgccgggcctcgtcgccaccaccgatcccgggcaggccgccggcgccgacgtgctgttcctgtgcctgccgaacggcgacgccgtcgaggcggccctcctcggggacggcgccctggcggagcgcctcgccccgggggcggtcgtggtcgacctcagcaccatcgcgcacgccaaggccctcacggtcggccgcgccgtggcggcgaccgggcgcgccttcgtcgacgcgcccgtctccggcgcgccggccggtgccgaggccgggacgctcaccgtgatgtgcggcggcgcggccggggcggtcgcgcgggtgcgcccgctcctggagcggatcggcacgacaatcctgcacatgggcccggccgggtccggccagctcaccaagacgatcaacaacgtgctctacgacatcaacatcgcggcgctggccgaggtgctgccgatggccgtcgccatggggctcgacccggatcaggtcgcccaggtggtcacgacgggcacgagccggagctacgcggcgcagtacttcgtgccgcggatcctccggggccagttcgacgagggctacccgatgggggcggcctacaaggacctcgtcgccgccgcggcggtcgcggcggagaacggcttcccgatgccggtcaccgcggccgccaccgccacctaccagaccgccctgcgccggggccacggcgaccgggacaagggcgccatggtgctgccgttcgaggatctgctcggggtccgggtgcggtcgcgccggtag

SEQ ID NO: 5583 - DNA, 888 bp, Methylobacterium sp.
atggcgagcaccaccgtcatcacctgcgccctcacgggctccttcgacacgccgcggaagaacccggccgtgccggtgagcccggaggccatcgcgcagtcagccctcgaggccgccgccgccggggcggccgtggtccacatccacgtccgcgaccccgagacggccgcgccgagcatggagctcgcccattaccgcgaggtggtggagcggatccgcgagaagaacgacgccgtgatcctcaacctgaccacgggggcgggaggccggttcgtgccgggcgaccccgacccgtcggtcgccggcccgggcacgaccttcgtgggaccggaggcccgcacccggcatgtcggggcgctgcggccggagatctgcaccctcgacatcgccacgatgaatttcggcgagcacctgttcctcaacacacccggccacctgcgggcgatggcgggtcacatccgcgacgctggcgtgaagcccgagatcgaggtgttcgacctcggccagatcgagctggcccggcacctgatcgccgaggggcatctggcgcgcccgccgctgttccagatctgcctcggcatcccctggggggcgcccgcgacgccggaggccctcgtggcgatgcgcgcccgactgccggaggacgcggtctggtcggccttcggcatcggccgggaggagttcccgatcctcgcggtcgccgccggcatgggcggcaacgtccgcgtcgggctggaggacaacctgtacctgtcccggggcacgctcgcgccgagcaacgccgccctggtggagaaggccgtgagcctgctggcccacatcgaccgggagccggccacgcccgatcaggcgcgggcgatttttggattgacgccgcggggcggttga

SEQ ID NO: 5584 - DNA, 951 bp, Methylobacterium sp.
atgggcgagatcgcgatcgtcggcggcggcgtgatggggcacggcatcgccctggtgctggcgctcgccggccacggcgtgcggatcaccgacacgcggcccgagacccgggcgcggatccccggcctgatggaatccgccctcgcgaccctgcgggaggccggcgccgccccggagggctgggatgccgcgcggctggcccgggccgtccgggtcgaggcggcgctcgacgcggcggtctcgggcgccggcctcgtgatcgaggcgatcaccgagaacccggaggccaagcgcgcgctcttctccgagctcgaccggctctgcccggccgacacgatcctcgccagcaacaccagctacctcgacgtcttcccgctgatcccggaagcccggcaggcgcgggcgctgatcctgcactggtacacgccgccctacatcgtcgacctcgtcgacgtggtgccggggcccggcacggacccggcggtcgtcgccgccatggccgagttcgtgcgcggcctgggccaggtcccgatcgtgctcaagcgcttcatccccggctacgtcgccaaccgcatccagcaggcgatcagcgccgaggtgttccggctcctcgacgaggacgtcgccgcgccgaaggacatcgacgacgcgatcgtccacgggctcgccttgcgcatcccgatcctcggccacctcgccaaggccgacttcaccgggctggagctgacgcagcgggcgctcgccaacggcagctacgcgccgccgccgccgcgcacccgctccgagaccctcgacgccctctgcgccgccggccggaccggggtgatggcagggcgcggctacttcgactggggcgggcgcgcgcccgaggagctgttccgcgagcgcgaccgcaagctcctggcgctcaaggcggcgatggccgggatcggccggatggagggatcatga

SEQ ID NO: 5585 - DNA, 1170 bp, Methylobacterium sp.
atgacgcgcgcctgcatcgtgggctgggcccacacccccttcggcaagctcgaggagcccgatgtcgaagggctgatcgcccgcgtctcgggtgaggcgctggcccatgccggcgtcgaggagtcgcaggtcgacggcatctacgtgggctcgatgaacaccggcttctcgaagcagggcttcgagggatcgctggtggcggtgaaccggccgggcctcgcccacgcgccggcgactcacttggagaacgcctgcgccaccgggtcggcggcgctctacgcggccctcgacttcgtcgacagcggccgcggccgcgtggccttggtgatcggcgccgagaagatgacggccaagaccgtcgccgagaccggcgacatcctgctgggcgcttcctaccggaaggaggaggccgacatcgagggcggcttcgccggcgtgttcgggcgaatcgcggcgggctacttccagcgctacggagaccgcagcgaggagctggcccgcatcgccgccaagaaccaccgcaacggcgtcggcaacccctacgcgcagctgcgcaaggacctcggcttcgacttctgcaaccgggtctcggagaaaaacccctacgtggccgcccccctgcggcgcacggattgctcgctgatctcggacggggcggcggccctggtggtggccgatgccgagaccgccgagggcctggagcgggcgatcggcttccgtgcccgggcgcacgtcaacgacatcctgcccctgtcgcgccgcgacccggcggagttcaagggcgcgcggttggcctgggagaaggcgcgggcccaggccgggatcgccaacgaggacctctccttcgtggagacccacgactgcttcaccatcgccgagctgatcgagtacgaggcgatgggcctcgccgcgccgggcgagggttaccgcgtggtgcgcgaggggttcgccgagaagggcggccggctgccgatcaacccgtccggcgggttgaaggccaagggtcaccccgtgggggcgaccggcgtgtcgatgcacgtcatggcctgcctccagctcatgggcgaggccggggagatgcaggtgcccggggcggagctcgccgggatcttcaacatgggcggtgcggcggtggccaactacgtgtcgatcctggagcggcggcgctga

SEQ ID NO: 5586 - DNA, 768 bp, Methylobacterium sp.
atggatctggggattgccggcctgcgcgtcctggtgacggcgggcgctgccgggatcggtcgcgagatcgtcgacgccttcctggacgaaggcgcgcgcgtcttcgcctgcgacatcgacgccgaggccctggccgcgctgccggacaccgtcgggcgcagccggaccgacgtcgccgaccgcgacgccgtcaccgcgatgatggaccaggcggtcgagttcctcggcggcctcgacgtgctcgtcaacaatgccgggatcgccggtccgaccggccgggtcgaggagatcgcccccgaggagtgggatcgctgcctcacggtctgcctgaccagccagttcaactgcgcccgtctggcggtgccgcatctccgccagagcgccaacgcctcgatcgtcaatctctcctcggccgcgggcaagttcggcttcgccctgcgcagcccctacgcggccgccaagtggggggtgatcggcttcaccaagtccctggcgatcgagctcggcaacgccgggatccgggtgaacgcgatcctgccgggcctcgtcgccggggatcgccagcgccgggtgctcgaatcgaaggcccagcagcagggcaccagcttcgccgacatggaggcgcgggcgttctcgttcgtgtccgtgaaggagtacgtcacggcgcggcaactcgccgatcagatcctgctgctctgctcgccgcgcggccggacgatctcgggtcaggccatctccatcgacggtgacacgcggatgctgtcctga

SEQ ID NO: 5587 - DNA, 702 bp, Methylobacterium sp.
ttggcgctggccgacctgccccagctcgagcggcggaccctgtccgacaccgtctacgaggccctgtcggacctgctcgcctcggggcggctggcgccgggcgaccggctgtcgctgcgccagagcgcggcggccctcggcgtctcggtcatgccggtgcgcgaggcggtgagccggctcgcggcggacggcgtgctggaggtggcgccgaatcgcgtgatccgggtgccggtcatgggcgcggccgcgttccgggccctggtcgagacccgcatcgcggtcgagggcatcgcggtggcccgggcggccgagcggcggacgggggccgaactcgcggcgatccggagcgccgaggcggccttccgggccgaggccgaggcggcggagcccgacagggcgcgcgccgtccagctcaaccgcgacctgcatttcgccatctacggcgcctgcgggctggggcccctgcaggagatcatcgcgcggctctggctgaaggccggaccggtgatcaacctggatctgcgcgcccacccggagcgcctcctccagggcttcgctctgcgccggcacgccgaggccgtggccgccatcgagatccgggacggcgcggcggccgcggccgcgatcgccgccgacatccgggaagccgcggaattcatcttgacccgcggcggattgcgggacgttcagggagaggattga

SEQ ID NO: 5588 - DNA, 1377 bp, Methylobacterium sp.
atgatgccgatgaccgacactgccttcctcgaccgcctcgccgcgatcgtcggaccgtccggtctcgtcaccggcgcggagctgcgcgggcgctcggccaactggacgcgcccgaccgagccctgcgccgccctggcgctggtccgcccgcgcagcacggaggagacgagcgccgtcatggccgcctgccgcgcggcgggcgtcgcggtggtcccgcggggcggcgccaccggcctcgtcgacggcacgctctgccagcccgacgagatcaccctgtcgaccgagcggatgaccggcatcgagccggtggacccgctcggcatgacggtggtggtcggcaccggcgcgacgctcgagagcgtgcaggacgccgcgtccgcggcgggcctgttcttccccctcgatctcggggcccgcggctcggcgacgatcggcggcgcgatctccaccaatgccggcggcctgcgggtgctgcgctacggcatgatgcgcgagatggtgctcggcctggaggcggtgctcgccgacggcacggtcgtgtcgtcgatgcggccgctcatcaagaacaacaccgggctcgacctcaagcagctcttcctcggcaccgagggcacgatgggcatcgtcacgcgggcggtcatccgcctgcggccggagcccgccggctacgcgacggcgctgatcgcgtgccccggagtcgacgacggcgcgcgggtgctgcgggcggcgcagagcgccttccaggggcgtgtctcctcgttcgagggcctgtggccggacttctaccggctgatgacggcgcccgggcgcgcgaccgcgccgctcggcccggactacccgttctacgcgatcatcgaggtcgagtgcgtccccgaggaatccgaccggttcctcagcctgctggaaggtctgatgggcgacggcacgatcctcgacgccgtggtcgccgcctcggaggagcagcgccgcggcatgtggcggatccgcgaccgcgtcgagcacctgaacgccgacgggatcgaccgggccttcgacgtgagcgtgccgctcgcgcggatggacggctacgtccgcggcgcgctcgaccggctcgcggcgatcccgggctgccgggcggtcgtctacgggcatatcggcgacaacaacctccactggaacaccacccgcctcgacgccgccggcaacgcggcgatcgacgcggcgatctacgagccgctggcggagctgaacggctccgtctcggcggagcacgggatcgggctcgagaagcgggccaagctgaagctgtcgcgctcgcccgaggagatcgccgtcatgcggctcctgaagcgggcgctcgatccggacaaccggctgaacccgggcaagatcttctga

SEQ ID NO: 5589 - DNA, 1194 bp, Methylobacterium sp.
atgtcgttatcgggcctgaccgcgcggaagatcctgcccgccgacggatgccggggtgccctcgtgggccgggtgtggcggccggacgtggccggtccgagcgtcgtcgcgatccgcgccgacgcggacggcacggcccgaatcgtcgacgtcaccgccgccttcccgacggtcagcgacctgtgcgaggcccgagaccccgctgccgccctgcgcggcgcccagggcgaggacctcggcagtctcgacgcggtgctggccaacacgccgccggacgcgcgcgacgccaccaagccctggctcctggctccggtcgacctccaggccctgaaggcggcgggcgtgacgttcgccacctcgatgctggagcgggtgatcgaggagcgcgcccggggcgatctcgccgccgcggcggcgatccgcgccgaggtcgagcgcctggtcgggcacgacctgcgccggctgaagcccggctcgcccgaggccatggccctcaaggaggtgctggtcgcgcagggcgcctggagccagtacctggaggtcggcatcggcccggacgccgagatcttcaccaaggcgcagccgctctcggccgtcggctgcggcgcggacgcgggcctgcacccggactcgcactggaacaaccccgagcccgaggtggcgctggcggtcgcctccgaccagcggatcgtcggggcgacgctcgccaacgacgtgaacctgcgcgacttcgagggccggtcggcgctgctcctcgggaaggccaaggacaacaacgcctcctgcgccgtggggccgttcctgcgcctgttcgacgacacgttcggcctcgacgacgtccgccgcaccaccgtgaccctcgaggtcaccggcacggacggcttccggctggagggcacctcgccgctctccgagatcagccgcgacccggaggagctggcggaggcgctgatggggcggacgcacgactaccccgacggcgccctcctcctcctcggcaccatgttcgcgccgatccaggaccggcacgggccgggcctcggcttcacccacgccgacggcgaccgcgtcgtggtggcgagcccggaactcggcagcctcgtcaaccgcatgcgcccctgcgacgcctgcgaaccctggaccttcggcgcccgcgcgctgatgcggaacctcgccgcgcgcgggattctgtga

SEQ ID NO: 5590 - DNA, 1062 bp, Methylobacterium sp.
atggcctcggtgggaatccgcgaggttcgcaaggctttcggatcgacgaatgtcctgcacggcgtgtcggtggatatccgggacggtgaattcgtgatcctcgtcggcccgtcgggctgcgggaaatcaacgctcctgcggatgatcgccgggctcgagaacatctccggcggcgagatccgcatcggcgagcgcgtggtgaacgatgtgccgcccaaagagcgggacatcgccatggtgttccagaactacgccctctacccgcacctcaccgtccgcgagaacatggcgttctcgatgcggatccggaaggcgccggcctccgagatcgatctccgggtcaacaaggccgcccagatcctcgggctggctcccctgctggaccgctacccgcgccagctctcgggcggccagcgccagcgcgtcgccatgggccgggcgatcgtccgcgacccgcaggtcttcctgttcgacgagccgctgtccaacctcgacgccaagctccgcgtggcgatgcgcaccgagatcaaggagctgcaccagcgcctgaagacgacgacgatctacgtcacccacgaccagatcgaggccatgaccatggccgaccggatcgtggtgatgcacgacggggtcgtggagcagatcgggccgcccctcgaactctacgaccggcccgacaacctgttcgtcgccggcttcatcggctcgccggccatgaatttcatgcccggcaaggtccgggcgaacgggcgtctgaccttcaccaccgagaccggcctgtcgatcccgctcgccgacgcgccttccggggtcgacggtcggccgctcatcctgggcgtccgccccgagcatttcgacctcgcgcccgaggggatcgccgcggaggtcgtcgtcgtcgagccgaccggctccgagaccatgctggcggtgcgggccggaggccaggacctcacctgcgtgctgcgcgagcgcgtgcgcgagcggccgggcgagacgatctccctgcggccgaaccgcgtgcatttcttcgacgccgagaccggccgtcgcctgccgaactga

SEQ ID NO: 5591 - DNA, 1311 bp, Methylobacterium sp.
atgtccgttctcgatcgccggtccctcctcgcgggcgccgcagcgacaggcctcgccgccggcggcgacctcttcggcttcgccaaggcctgggcgcagaacgcggagtggaagcccgagccgggggcgagcctgtccctcctgcgctggaagcgcttcgtgccggccgaggacgaggccttcatgaagctcgtcgacgccttcaccaaggcgacgggcgtcaaggtcacggtgaccaacgaatccttcgacgacatccagcccaaggcgtccgtcgccgccaatacgggccaagggcccgacatggtctggggcctgttctcgttcccggcgctcttccccgacaagtgcctgccgctcgaggacgtggcggaatccctcggcaagaagtacggcccctggttcccgtccgccgaggcctacggcaaggtgaagggcaagtggatcgcgatccccgtggcgttcaacggcggctatccgaactaccgcatctcggcgatgaagaaggccgggttcgacaagttccccaccgacaccgcgggcttcctcgaactctgccgcggcctgaagaagaacaacacgcccgccggcttcgccctcggccacgcgaccggcgacggcaacacgtggtgccactgggcgctctggtcgcacggcggcaacctcgtcgacgccaacgagaagatcgtcatcaactcgcccgagaccgcgaaggcgctcgaatacgtcaagtcgctgtacgagaccttcgtgcccggcacggtgtcgtggaacgattcgtcgaacaacaaggccttcctggccggcgacctgtacctgaccaacaacggcatctcgatctacgcggcggccaagaaggacaacccgaagctcgccgaggacatggaccacgcggtctggccgatcggcccggtcggcaagcccaccgagttccagctcgccttcccgatcctggccttcaagtactcgaaggcgccgaacgcctgcaaggcgttcatcgccttcatgatggaggcctcgaactacaatccctggctggaggcggcccagggctacctctgcgagccgctgtcgaactatccgaagaacccgatctggacgagcgacccgaagaacgcggtcttcgccgaggcgggacggcgctccctggcggcgggcggcctcgcgccggtgagcgagcggatcgccgcggtgctggccgacttcgtgatcgtcgacatgttcgccagccactgcaccggccgcgaggacgtgaagggcgccatcaagaacgccgagcgcgctgccacccgcatcttccggaacacctga

SEQ ID NO: 5592 - DNA, 957 bp, Methylobacterium sp.
atggcgaacacggccctgacgcagcccgccccggccgcaatcccgacccgctcggcctggcagcgcgtgcgcgcgagccgcggctgggcggggttctggttcatgctgccgacggcgctgatcctcggcctgttcctggcctacccgctcctgaagggcatctggctgtccttcaccaacgcgcggatcggccgcgagggcgtcttcgtcggtctggagaactacgagtggctctgggacgacgatgtcttctggctctcggtgttcaacacctgcctctacacggcggtggcgtccgtggtgaagttcggggtcggcctctacctcgcgttgctgctcaacaaaaacatgccgttcaagtcgatcatccggtcgatcgtgctgatcccgttcgtggtgccgaccgtgctgtcggctatcgccttctggtggatcttcgacagccagttctcgatcatctcctggtcgctgcgccatctcggaatgatcaacggcaacatcgacttcctcggcgagccggccatggcgcgcgcctgcgtgatcttcgccaacatctggcggggtgtgccgttcatcgccatcacgctgctcgccggcctccagacggtctcgccctcgctctacgaggccgcgacgctggacggcgcctccaactggcagatcttctcgcggatcaccctgccgctcctgaccccgatcatcgcggtcgtgatgaccttctcggtgctgttcaccttcaccgacttccagctgatctgggccatgacgcgcggcggcccggtgaacgccacccacctgatggcaaccctgtcgtaccagcgcggcatcctctcggggacgctcggcgagggcgcggccatcgccaccgccatggtgccgttcctgctcgcggcgatcggcatctcgtggttcggcctgcagcgcagggcctggcaatccgggggtaacgaccgatga

SEQ ID NO: 5593 - DNA, 888 bp, Methylobacterium sp.
ttggaggcgcggccggcggggctcacggacaattcggagggcatggcctatctcgagcgcctgccccggcggctcgtgacgacctacctgccgctcctcctcatcctcgccgtgctgctgttcccgttctactggatggcgctgacggccatcaaaccggacgagcagttgatcgacatggagcggttcaacccgttctgggtcgtggatccgacgctcaagcacatcaacaagctcctcttcgagacgcagtatccgcgctggctctggaacacgatgtacgtctcggtggcggcgaccgtgctgtcgctgttcgcgagcgtgctcgccgcctacgcctgcgtccgggtacgctaccggggcgccggctgggtcggggcggcgatcttcctcgcctacctcgtgccgccctcgatcctgttcatcccgctcgccaccatcatccaggcctacggcctgttcgactcgccgatcgccctgatcctcgcatacccgacgatcctgatcccgttctcgacgtggctcctgatgggctacttcaagaccattccctacgagctggaggaatgcgcgctgatggacggcgccagccggtggcagatcctcaccaagatcatcctgccgctcgccttcccggggctgatctcggcggggatcttctcgctgaccctgtgctggaacgagttcatctacgcgctgaccttcctgtcctcgacgcagaacaagacggtgcccatcgccgtggtgagcgagttcgtggacggcgacgtctacaagtgggggtcgctgatggccggcgcgctgctcggctcgctgccgctggtgatcctctactcgttcttcgtcgagtactacgtctccgcgctgaccggcgccgtgaaggagtag

SEQ ID NO: 5594 - DNA, 1503 bp, Methylobacterium sp.
atgtccggcaatcggggcgcctcgggcggccccggccgggagaacgccatgtcgatgaatcgccgctcgctcatcggggccgcgggcctcgccctgacggcgcccgccctgcagggcgcgcaggcggccgaggccgcgaagccagccgcgaaggcagcgccgccgcacgtcacgaagatcctcgcgcagtggatcctgggatcctcctacgacacgctgccggagcccgtccgacgcgagggcgtgcgcagcttcctcaactgggtcggggtggccatcggcggctcgcaccacgagaccgtcgacgtggcggtctcggcgctgcagcccttctcggggccgccgcaggccgggctgttcggccggaccgagcggttcgacatcatgaacgccgccttcctcaacggcgtgtcgagccacatcttcgacttcgacgacacccacctgaagacgatcatccacccggccggcccggtcgcctcggcgatcctggcctacgcggcgatgaagcccgtctccggcaaggacttcctcgacgccctggtggtcggcatcgaggccgagtgccggatcggcaacgcggtctacccgaaccactacgatgccgggtggcacatcaccggcaccgcgggcgtgttcggatcggccgccgccgcgggcaagctgatggggctcaccgagcagcagatggtctacgccctcggcctcgcggcctcgcagccggtgggcctgcgcgagtcgttcggctcgatgaacaagagcttcaacccgggccgggccgcgtccaacggcctgttcgcggcgatcctggcggccaagggcttcacctcgtcggacggcatgatcgaggccaagcgcggctgggccaacacgatctccaccaagcaggactggtcgcagatcaccgacggcctcggcacccgctacgaggcgcagctcaacacctacaagcccttcgcctgcgggatcgtcatgcacccgacgatcgacgcggcgatccagatccgcgaccaggaccgcgtcaagccggaggacatccagcgcgtcgacctgaaggtccacccgctcgtcctggagctgaccggcaagaccgcgccgaagaccggcctggagggcaagttcagcatctaccacgccgccgcggtggccttcgtggagggcgcgggcggcgagaagcagttcagcgaccgggcggtgaacgatccgcgggtggtggccctgcgccagaaggtggtcccggtgatcacccccggcgtcgatcccgcgcaggtcgacatgaccgtgacgctgaacgacgggcggaccttccaccggcatatcgagcacgcgatcggcagcgtcgagaagccgatgtcggacgcgcagctggaggcgaagttcaccgacctcgccgccgggatcctgccggacgcgcaggcgaagcgggtgatgcagctgtgctggtcgctgccggagctgaaggatgcgggcgacgtggcgcgggccggcgtcgcgggggcctaa

SEQ ID NO: 5595 - DNA, 825 bp, Methylobacterium sp.
atgaccgagccgatctccgccgcggcccatgcccgcacgatcctggccgcgcacgagcatcgccgcccgatcgcgccgctgaccgactgggatccggccctcgacctgccggcggcctaccgggtggccgaggcggtccgggtcctgcgcggggagcgcggcgagcggccggtcggctacaagatcggcttcaccaacacgaccctgtgggagcgctacggcgtccgcgcgccgatctgggggcacgtctacgacacgaccctgcgcgaccgggccgccctgtcggggccggtgccgctcgccgccttcgtcgagccgcggatcgagccggagatcgtgttcgggctggcgcgcgcgcccgagcccggcatggatgccgaagcgctgatcgcctgcctcgactgggcggcgagcggcttcgagatcgtgcagtcgctctatccgggctggcgcttcgcggcgcccgacaccgtcgcggccttcggcctgcacgggctgctggtggtgggcgagcgggtgcggatcgccgcggacgcgcgatcggtctggctcggcgagctcgccggcttcaccgtcgagctgctgcgggacggggccgtcgcggaccggggcggcggcggctgcgtgctcgggacggggccgctcgccgccctggcccacctcgtcgatgcgctggctaacgatccggtggccccaccgctcgcggccgggacggtcgtcacgacgggcacgctgacggacgcgctgcccgtcgcctccggtcagcgctggcgcacttccctcgacgggctgcggcttcccggcatcgaccttgccctgatctga

SEQ ID NO: 5596 - DNA, 942 bp, Methylobacterium sp.
atggccaaggacggtttcgcacgagcctacgcgcgcgtgcgcgtctacgagggcggcaacgtcgacgatccgcgcgatcccggcggccgcacgtcccgcggcgtgacgcagcgcgtctacaccgcctggctgcgccgccagggcctgccgagcgcggacgtctggaccgcgaccgacgcgcagatccaggcgatctaccgcgcgctgtactgggacaaggccgcctgcgacgagctgccggccggcgtcgacttcgtcgtgttcgacgcggcgatcaacagcggcgtcgggcagtccgtccggtggctgcagcgcagcctcaatggctaccccggcgcggtcgacggtgcgatcggcgacgtcaccctgcacgccgtcggtcaggacgaggacaacgatgccttgatcgcccggatctgcgcggcccggctcggcaccctgcggggcctcaagacctggcggacctacggcaagggctggtcggcccgcatcgccaacgcgcagaagatcggccagggctgggcctcgggcagcgtcggccccgcgccggtcgccgtcgaccaggtcggcggccatcgcaaggcggtggtgtccccggagacgatcacccggccgctgctctcgaccgcttcgaccacagtggtgacctcggcctccgcggtcgccgcgccggtgtccgagatcgggcagcagctcgaggtgatgcgcgattggttctcgtggatgccgtacgtgctcggcggactggcggtggtggccggcgtcgccggcatcatcgtgaagtacgggcacgcggtggccgacaaggtccaggcgggctcagccacccaggcggtggacgtgagcgccgacgaggacctgccggcggtggccgtggacgacgccgtcgctccggaggcgccggccgctgcgccgccggcggccgcggcggaggccgcctga

SEQ ID NO: 5597 - DNA, 1203 bp, Methylobacterium sp.
cggatcgacccggccctgccggaccgcaagccgctgccccgcccggacctgcgcctgcgccggatcgccgtcggcccggtggcggtgttcggcgcctcgaacttcccgctggccttctcggtggcgggcggcgacaccgcctcggcgctggcggcgggctgcccggtggtggtcaaggcccatcccgcccatcccggcacctcggaactggtcggccgcgccgtccagaaggcagtggccgcctgcggcctgccggaggggaccttctcgctgctgttcgatgccggccagtcgatcgggcaggggctggtggccgatccccggatcgccgccgtcggcttcacgggctcgcgccggggcggcaccgccctgatggcgatcgcggccgggcgcccgtcgccgatcccggtctacgccgagatgagcagcatcaacccggtgctgctgttccccggcgcgctcgccgcgcggggcgcggcgatcggcaaggccttcgcggcctcgctgacgctcggcgccgggcagttctgcaccaatcccggcctgatcctggcgctgcccggcccgggcctcgacgccttcctggaggcggccggcgcggccctgcgcgagtctccggccgcgaccatgctgacgcccggcatccagcgcgcctaccgcgaggccgtggcgcgggtggccggccacgccgccgtcacccgcatcgccgagggggcggagggcgcggcgacccagggccgagcgaccctgttcgccgcggattcggacgtgttcctggcggatcccgagttgcaggaggagatgttcggcgcctcggggctcgtggtgcgctgcgcggacttcgccgcgatgcgggcggtcctggagcgtctggagggccagctcacggcctcgctgcacctcgcgccggaggatcacgcggccgcccgggacctgctgccgctcctggagcgccgcgtcggccggatcctggtggacggcttcgggaccggcgtcgaggtggctcacgccatggtgcatggcgggccctacccggcgacctcggacgggcgcacgacctcggtgggcagcctcgcgatcgaccggttcctgcggccggtgagctatcaggacgtccccgacgcccttctgccggcggcgctccaggccgctaatccgctgggcctgccccgccggatcgacggcacgcccgagcgccgctga

SEQ ID NO: 5598 - DNA, 3120 bp, Methylobacterium sp.
gtgttcgtcgtcggatcgtcggagaaggccggcctcgccggcgcggcgcagtccctcgcgcgcccgctgacccggcgcctcaagggccgccgccgcgccgaaccccgccaggcggacctcgtccgcgcggtcaaggaatccggcctgttcgacccggcctggtacgcgaggcgctaccccgacgtggtcggcgaggggatcgacccggcggtgcactacgcggtccatggcgggcgcgaggggcgctggccgcacccgctgttccacggcgacctctacctcgattccgttccgggcctccgggccgagggcaccaacccgctgctccactacctcgaccgcggcgccgcggcgggcatccgccccaacccactgttcgacccggactggtacgcgacgcgctacctcggcggcgcggagcaccgcgcccgggccttcgctgacttcctgtcgcggggcgacaccgacccgtcgcctcagttcgacaccgcctggtacctgtcccgctacccggatgcccgggcggccggcggcaacgcgctgagccacttcttcgagaccggccggaagcagggctacctgcgcaacccggaggagttcgccggcctttcgcggcacgtcgacctgatccgccggtcgggcctgttcgacgccgcgttctaccgggagcgctgccccgaggccgagaccagcgggctcgagcccctggagcactacgtgatggccggcggctaccgccgctacgcgccccacccgctgttcgaccccgactggtacgcggcccagtccgccgcggtgcgagccgacagcctcaacccgctggtccattacctggagcacggcgccgccgagggcctcgatccgggtccctggttcgccacgcgctggtacaccgagacctttctggccggcgacgcggccgggcagaacccgctggcgcatttcctcgccgacggcggccgcacgacgagcccgtcgccgcgcttcgacgcgccctggtaccgcgcccgctacccgaaggtcgcgacgctcggcctcaacccgctgatcgactacgtcaccaccggcctggaggcgggccgcctgacccgccgcgtccccggggccgcggtgccggaagcctcggacgcgcgcctctcctgcctgaagcgcgagccccggcggcacggccgcacggccctgttcatcacgcactgccccgaggggcggatccgcggtcacgtcgagccctacctgcgggccttcgcggagaacgggaccgacctcgtcctgatcatcgccgccgaccagcacaagaacgccgtgccgcaggcgatcctggatctctgcgcctcggtctacctgcgcgagaacagcggcttcgacttcgccgcctgggcgcatgtcctcctggaggacaccgacctcctcgattccgagacgctctacctcgccaacgacagcctcgtcggccccctcgaccgcgacgacttcgccggcctgctcgccaagatcgacgccttcccggaggcggtgatcggcctcgccgacaatttctactacagccaccacctccagagcttcttcctggccctgaagcggcgctgcctgtcctcgtacgcgttcaaccacttcctcctgtcggtggcgaactggccggacaagaacgcggtcatcaccgagtacgagctgaccttctcgcagcggatgcgggcggccgggctcgggatgcgcagcctgttctcggcccagaacaagcacatgtcgctggtcaacgacccgcgcaacaaccgcaccctgttcgactgggagaacatgctcagccagggcttcccgttcgtgaagcgctcgctgctgggcgagcacgccgcgatcggcggggcggcggtgcgggaggcgatcgccgagcgcggcttcgacctcgaccggctcgacgtgacctacacgtatccgggcgccaggatctgggcggacctgcgcaggccccgggcgccggagcggccgctgcgcgtcgcctacgtctcgccgatgaactacgccaatggcctcggcgtcgcggcccgcagctacgcccgcgccctgcatcggacccccttcgcgctgaacgtccacccgatggagcggccgttccacgtccacgcccgggtggcgcccgcgtggcaggcccggaccttctcgggccccgccgacgtcgcgctggtgcatttcaacggcgacagctggcactcgctgatgagcgaccggcagcgggcgatcgccgcgcaggcgcggctgaagatcgggctgttcgtctgggagacctcccacgtgcccggcggctggctaccgaccgtcgacggcctcgacgcgatctgggcgccgacggagttctgcgcggcgatcttccggcaaatcaccgacatcccggtcgacgtcgtgccctacgtggtcgagaacgaggccggcgagccggtgagcgccgccgccaaggcgaacctgcgcaaggccttcgcgatcgacccgtccaggcgggtgatcctctacgccttcgacggctccagctacctcgcccgcaagaacccacacgcgctgatccgggccttccgggcggcgggcctcgggcaggccggctggcagctcgtgctgaagaccaagcacgtcttcgacctgcccgaggagggcaagaagctcctcgacctcgtgggcacgtccggcgacgtcgtggtgatcgatcagccgctctcccagaacgagctcggcgcgctgttcgacctctgcgcggtctacgcctcgtcgcactcctcggagggcttcggtctgacgatcgccgaggcgatggagatgggcaaggtcgtggtcgccaccgattacggcggctgccgcgacttcctcgacgccacctgcggcttccccgtgaaggcggaggtcacggccctcgaccagacctacggcccgtacctgcgcggcgccgagtggggccaggtggacgaggcggacctcacccgggccctcaacgacgcggcccgggcggtgaccggcggcgacgcggcccggatcggcgccgccgcccgggcgcgcatccgcgagcggctgtccatcggcgcggtggcgcgggccatggaggcgagcctgacccgcctcctggccgccgaacggtcctga

SEQ ID NO: 5599 - DNA, 801 bp, Methylobacterium sp.
atgagcgcagccacacagtcgaccgtcgcggaccgggatgcggcccccgccgatcacgccgcgatccgcgcgatgcgcgtcgacctcgcggccgcctaccggctgatccaccggctgggcctcgacgacagcatctacacccacatctcggcccggctgccgggggccgggcaccggttcctgatcaacccctacgggatgcgcttcgaggaggtgacgccggagaacctcgtcaccgtcgacatcgacggaaaggtgctggaggatccgatggggctcggcatcaacccggccgggttcacgatccacagcgccattcacgccgcgcgccacgacgcgatctgcgtgctgcacacccacacggtcgcgggcgtggcggtctcctgccaggaggaggggctgctgcccctgaaccagtggtcgatgcagttcacggggcgcgtcgcctaccacgcctacgagggcatcgccctcgacctcgacgagcggcagcggctggtggccgatctcggcgacaagcccgtgatggtgctgcgcaatcacgggctgctgacctgcgggcgcacggtcggcgaggcgttccggctgatgcacaacatggaacgctcgtgccgggcgcagctggcgatccaggcggcgggcgcgccggtgatccggccctcctccgccatcgccaccaagaccgccgggcagtacgccgccggctacgaccgcgtcgtggtccagggggcgcccgacaacgaatgggcggcgttcaagcggatgctggcgcggacggatccggacttcgcgcgggcctga

SEQ ID NO: 5600 - DNA, 780 bp, Methylobacterium sp.
atggatctcggcttgagcgggcgccgggcgctcgtctgcgcggcgagcaagggactgggcaagggctgcgccctggcgctcgcccgggagggcgtcgcggtgacgatcacggcccgcaccgcggagacgctggagcggaccgcggaggagatccgcgccgcgacgggcgtcaccgtcaccgccgtagcgggcgacatcgccaccgaggccggccgggccgccgcgctcgccgcctgccccgagcccgacatcctggtcaacaatgccggcggcccgccccccggcgatttccgcgagtgggaccgcgacgcctggatccgggcgctcgacgccaacatgctggcgccgatcgcgctcatcaaggcgacggtcgacgggatgatcgaccgcgggttcggccggatcgtcaacatcacctccggcgccgtgaaggcgccgatcgagcatctcggcctgtcgaacggcgcccgctcggggctgacgggcttcgtggccggcctggcgcgcaagaccgtgcggcacggcgtgacgatcaacaacctgctgcccggccccttcgacaccgaccggatccgcagcaacgccgccgcgggggccgccaaggccggcacctccgtggaggcgttcctggaggcgcgggcccgcgacaatcccgccggccgcttcggccaccccgacgagttcggcgccgcctgcgcgttcctgtgcagccagcaggcgggcttcatcaccgggcagaacctgctgatggatggcggcgcctatcccggcacgttctga

SEQ ID NO: 5601 - DNA, 1221 bp, Methylobacterium sp.
atggccgacaccctcgtctccgccgcgcccgtcgacctcgccgccgcgctgtcggcgcgcatccgcggcatcggcacgagccagatcggcctcgtggcggatcgcgggcgggacgacccggaggtggtgaagctgtggatcggcgagggcgacctgccgacgccgcccttcatcgtcgaggccgcacaccgggcgatgctggccgggcacacccgctacaccacgtcgctggggctgccggcgctgcgcgcggcgctcggggcctaccacgcccgccactggggcgtggagatcccgccggaccggttcggcgtcacggcgggcggcatgaacgcgatcatgcaggcggcccaggtgctgctggagccgggcgacgagatgatcatcccctccccggcctggcccaatctcggcgaggcggtccgcatcgccggcggcgtgccggtgacggtgccgtaccgccgcctgccggacgggcgcttcgcgctgccgctcgccgacatcgcggcggcgatcacgccgcgcacccgggtgatcatggtgaactcgccctcgaacccgaccggctggaccatgccgcgcgccgagatgacggccctgcgcgacctcgcccgggagcgcggcctctggatcctctcggacgaggtctacgcccacttcacctacggcaaccggatcgcgccgtccttcctgcagatctgcaccgaggacgaccggctgatcgtgaccaacaccttctcgaagaactgggcgatgaccggctggcgggccggctgggtgatctatccccgcggcctcgcgccgaccttcgccaagctcgggcagtacagcacgacctcgatcccgaccttcgtccagcacgcctgcatcgcggcccttgaggaaggcgacggcttcatccgcacgatggtggaccgctgcgccgaggcccgggcgatcctggtggaggggctgtcgcgcctcccgggcgttacggtcgcgccgccggacggggccttctacctcatggcccggatgggcggcgacgagccgagcctcgacctggcgctgcgcctgctgcgggaggccaaggtcggcgtggcgcccggcaccgccttcgggcccgagggcgagggcctggtgcggatgtgcttcgccatcagcccggacctggcgcgggaggcggtgcgccggctcgcgggcgtgctcgggacccggctgccggccgcggcggcgcactga

SEQ ID NO: 5602 - DNA, 657 bp, Methylobacterium sp.
ttgcggcacaagaccgtggcggcggccgtcgcggactcgctccgcgagcagatcctgaacggtgaactgccgccgggggtgcagctgcgccaggacgccctggcggaggagttcgggatcagccggatcccggtgcgcgaggccctgctgcagctggaagccagcaagctcgtgcggatcgtgccgcatcgcggggcggtcgtgacgggcctctcgctgcaggaggtcgaggacatcttccagctgcgcgtccagctcgagccggaactgctcctgctctccgccccgcacctgacccccgacgacatccgcgatctcgacgccctctcgaaggagtacggcgcggcgctggagaccggtcaggtcctccggtggggcgacctgaacagccgcttccacctcgacctgatccggcacgccggccggccgcggtcgctggcgatcgtgtccgcgctgctgcaggattgcgagcggccgacgcggctgcagatcgcgacctccgaggacgcgacccgcgcggtcagcgagcacgcgcagatcctggccctgtgcgaggaccgcgcgttcgaggcggcggccgcgtgcctgcggcgccacatcgagcatgtcggcgcctcgctcatcgccctctaccggggggcgctcgccgaggcctga

SEQ ID NO: 5603 - DNA, 606 bp, Methylobacterium sp.
atggcgaacggggtctccgcgcggcggtactccgccgtggcgatcctgctgcactggacgagcgcgctgggcgtgctcgtcctgatcggcctcgggctgaccatgacgcacgcggccctggcgccgctgcgccagttccagctctaccagtggcacaagtcggtcgggatcaccgtgctggcgctgaccgccctgcgcgtcctctggcgcctgacccaccggccgccgccgcacccggccgggatgccggtgcgggagcgtcgggcggcggcggctgcccatcacctgctgtacctgctgctcgtcgggttgcccctgaccggctgggccgtggtgtcgctgtcgccgttcaacatcccgacggtgctgtacgggatcgttccctggccgcacctgccgctggcggccctcgtccccgaccccgccgtcgccgaggccgtcctgaagcgggtccacgccctgggggcgtggttcctggcggctttgctcaccgtccacgtggcggcggccctgcgccaccacctcctcctccgcgacgacgtgctgcgccgcatgctgccggggcaccggccgtcacccaccccgaccgtggagccgacccgatga

SEQ ID NO: 5604 - DNA, 1104 bp, Methylobacterium sp.
atgccggcggtcgccgagtccccgcagaacgcccgccggaatgccgcgatgacgcccgcgcccacgttcacccccgacatcgccgcgcgcttcgccgccgtcgccctcggccatgtcggccgcgagtatccgaacaagccgggccacgtcctggccgggccggcggatgcccgcacccccgcggccctgcacccggccttccacggcagctacgactggcattcctgcgtccacggcacgtggctgctggcgcgggtgctgcggctgttcccggacggcccgcaggccccggcgatccgcgcccggctcgacgcgcagctgacccccgcgacggtggcgggggaatgcgcctacttcgccgccccgaccgcccggggcttcgagcggccctacggctggggctggctcctgaagctcgccgacgcgctcgccgcgctccccgagcgccgctggtccgaggccctggcgccgctggccgcggtgatcgtccggcgcttcgcggagttcctgccggtggcgtcctacccggtgcgggtcgggacccatttcaacaccgccttcgcgctgcgcctggcggccgattacgcggagggcgcgggggatgccgggctgaccactttgctgcacgacaccgccgtcggctggtacggggaggacgcggattgcccggcctggggcgagcccggcggcgacgacttcctctcctccgcgctgatcgaggcggagtgcatgcgccggctgctgccgcccgcccgcttcgcgccctggttcgaccggttcctgcccggtctcgcggcgtcccggcccgcgaccctgttccgtcccgcgggcgtgaccgaccgctccgacgggaagatcgcccatctcgacgggctgaacctcagccgcgcgtggtgcttccgcgcgctcgccgcgtctctcggcccggacgatccccgtcggccgccgctccgcgcggccgcggaggcgcacctcgcggccgggctcccgcacgtcaccggcgactacatgggcgagcactggctcgcgaccttcgcgctgctggccctcgaggccggtgcagagaccggtgccgcgggcgacgcccaggacggcgggaagtaa

SEQ ID NO: 5605 - DNA, 1227 bp, Methylobacterium sp.
atgcgtgcgatcatgttggggctggggctacttctgggagcgggccccgcgctcgccggcgaggccgcccagctcgggccccggcccttctacctcgtcgaccagctgaagcccggccctctcaaggacaggctcgccgcctgcggcgtcgaccggacctacacgccccggaccttctcgatctcgcaccgcggcgcgccgctgatgttcccggaacacacccgggagggcctgctcgccgcgtaccggatgggcgccgggatcatcgagtgcgacgtggccttcaccaaggaccgccagctcgtctgccgccacagccagtgcgacctgcacacgaccaccgacatcctcgcccggcccgagctcgcggcgaagtgcacgcagggcttcacgccggccgacccggccaccgggcggaaggcctcggccaagtgctgcaccagcgacctgacgctggacgagttcaagtcgctgaacgggaagatggacgcgtccgacccggacgccaccacggtggcggcctacatgaacgcgacgccgcgctggcgcaccgacctctacgccggcaccggcacgctgatgtcgcacaaggagtacatcgcgctggtgaaggggatggggcggaaattcacccccgagctgaaggcgccccaggtcccgatgccattccaaggcacctacacgcaggacatgtacgcccagcagctggtcgacgagtacaaagaggccgggatcccggcctccgacgtctacccgcagagcttccagctccgcgacatcctctactggctggagaaggatccggaattcggccggcaggcggtcttcctcgacgaccgggacgagaccgcgcagggcttcgaccccgagaagcccgccacgtggcagcccggcatggccgagctcgcccggaagggcgtgaagatcctggcgccgccgctgtggatgctggtccggccgggcccggacgggacgatcgagccctcgacctacgcccgggaggccaaggcggccgggctggggctgatcgcgtggtcgctggagcgctcgggccccctgaagggcggcggcgggtactattaccagtcgatcaagccggtggtcaccggcgacggcgacatcctgcggctgctcgacgtcctgcacggtcaggtgggcgttctgggggtcttctccgactggcccgcgaccacgaccttctacgccaactgcgtcggcgccccgtag

SEQ ID NO: 5606 - DNA, 1254 bp, Methylobacterium sp.
atgctgagtgaggacgtgcacgaccgcgacgggtctcgcgcggacgagacggtcacggaccggcgccacggcgacgcgcgtcgcgccgcgaccaaaccggcgaagaagcgctcgggcgcggccggcctgatcctcctgctgctcgccgtcgcgggcggcggtgcctacggctacacgcgcctgaaccagcccgcggtgaaatcccgggcggcggccccgctgccggtgcccgtcaccctcggcacggtcgagcaggggccgttcgcccttgtgtcgaacggcctcggcaccgtccaagcgtacaacaccgtccaggtgcgcacgcgcgtcgacggcgagatccagcaggtcgcgttccgcgagggacagaccgtccgcaagggcgacgtgctcgtgcagatcgacccgcggccctaccaggcggcgctggatcaggcgaaggccaagaaggagcaggacacggccaacctcggcaacgcgaaggcggacctcgtccgctacaccgggctgggcgccttcgcctcccggcagcagaccgagacgcagacggccctggtcgcccagctcaccgcgcaggtggcgtccgaccaggcggccatcgacaacgcctcgacgcagctcggctacgccacgatccgcgcgcccatcgacggcgtcacgggcttccggcaggtcgatatcggcaacatcgtcaacgcggccggccagaccccgatcgtgacgatcacccaggtcgagccgatcttcgtggtgttcacggcccccgaggatcagctgcccgccatcaccgcggccctcaaggccggtgacgtgccggtggaggcctggacgtcggacgggcagaccaagctcgccgacggcaagctcgccctgttcaacaaccaggtcgacaccgcgacggggacgatccgcctcaaggccgtctacgagaacaggaaccacgcgctgtggccgggcctgtcggtctccaccaagatgcgggtcggcacggtcgcggtcgccacgacggtcccggacgacgcgatccagcacgggcccgacgggctgttcgccttcgtggtggacgatgccagccgggcgcatcagcgcgcgctgaaggcgggccgctcggattcggggcggacgcgcgttctcagcggcgacctccggcccggcgagcgggtgatcgtcgccggacagtacaaggtgcaggacggcagcctcgtggccgatccgcacgcggcccacaccgcgcaggcggaggcggtccagtga

SEQ ID NO: 5607 - DNA, 240 bp, Methylobacterium sp.
atgaagacatttttcgtgcagatcaaatgcgagatcggcaagacttacgccgtgtccgacgcgctcgtcgcgatggagatcgcgtcggagatctactccacggccggacgattcgacatcatggccaagttccacgtggacaacggcgtcgatatcgggctgttcgtgaacgacttcctcctacgcctcgacggcgtgaaggattccgagacgatcatcgccttcaaggccttccactga

SEQ ID NO: 5608 - DNA, 1239 bp, Methylobacterium sp.
atggacgcacgtcgcagcgacagcttcaagagcgccgacccggtcgcgggtgcgccggtcaccgccccgaccatcgcggctgtcacacccccggtctccgcgccgatcccggccaccgtctccgcatcggcgccgcgccgccgccgcgcgcggatcgtgctgcccctcctcggcctgctcgcgctcggaggggccgggacctacggctggcactggtggagtgtcgggcgcttcctcgaggtcaccgacgacgcctatctccaatccgacaaggtcacggtggcgccgcgcatcgccggcaccgtcgccgaggtgctggtcggcgacaaccagccggtgaaggccggggacgtcatcgcccgcctcgacgaccggtcctaccgggtccagctcaagcaggccgaggccgaggtcgagaaggaccgggcgcagatcctgggcgtcgcctcggcgatcgtccagcagcgggcgcaggtcgcctcgtcgcgggccgacctcgccaacgccgaggccgccctcaccttcgcgcagcaggaatacacccgctaccagaacctgctgcagaccgggtccggcacggtgcagcgccagcagcaggcggaatccgacctccgccagcgccacgccgcccgcgacaaggccgccgcctcgctcgacgccgcgcagaagcagatcgacagcctgcaggcgctcgaggccagcacccgcgcgagcctggagggcgcgcaggccaaggtcgagggcgtgaggctcgacctgagctacaccaccatcctggcgccgatcgacggcgtggccggcgaccgggcgctgcggatcgggcaggtcgtctcggccggcaccgggctcctgaccctcgtgccgatgggccgcgacatctacctcgtggcgaacttcaaggagacccagaccggccgcatggtcgagggccagcgcgtcaccttcacggtcgacgccttcggcgaccacacgttccggggccggatcgagagcttctccccgggcaccggctcgcaattcgcgctgctgccgccggagaacgccaccggcaacttcaccaaggtggtgcagcgcgtgccggtgcgcgtcgccctcgacccgtcggatccgctcatcgcccgcctgcgcccgggcctgtcggtggaggccacggtccacacccaggatccggtggagccggtgcggcccgcccggccgaggcccgctccggccctcgtcagcgaggccctgcctcgatga

SEQ ID NO: 5609 - DNA, 960 bp, Methylobacterium sp.
atgggcgcctacatcctgcgacgcctcctgatcgcgattccgagcctgctcggcatcagcctgatcctgttcaccgtcctggcgctcgcgccgggcgacccgttcggcgagctcgccagcaacccgaacgtgcccccggaggtacgggcggccctgcgggtgaagttcggcctcgatgacccgatcctcacccgctacctgcactggctcaccgccatgctgcagggcgactggggcttctcgttcgcgagccgggtgaacgtcgacacactgatcctgcagcggctgccgacgaccctgttcgtggtcggctcctcccaggtgctggcgctgctgatcgcgatcccgatgggcctctacgcggcgcgccggccctactcgctcgccgaccaggtcgccaacaccctggccttcgtgggcttctcgctgccgaccttcttcaccggcctgctgttcatcctgctgttctcgatcaagctcggctggctgcccttcgtctaccaggccgacttgccgggatccggactgccctgggtctgggccaatgtccggcaggcgatcatgccggtggcggtgctgggcttcttccaggccgcctcctacacccggtacgtgcgcgcctcggcgctggacgtcgcccggctcgactacgtcaccacggcccgcgccaagggtttacctgagggcaccgtgacccgccggcacatcgcccgcaacgcgctgatcccggtggtgacgctcgtcgccctccagatcccggcggtgttcggcggcgccatcgtcaccgagcagatcttccggatccccggcatcggctcgctgctgatcgacgccatgctggccaacgacacgccagtggtgatggcggtgaccttcgtgttcgccggcctcgtcatcctgttcaacctcgtcgcggacctgctctatggctggctcgaccctcgcatcgccctccgatga

SEQ ID NO: 5610 - DNA, 933 bp, Methylobacterium sp.
atggctggctcgaccctcgcatcgccctccgatgaggcgcctgccctcgcccgcgcgccggcctcgccggggcgggagacgtggcggcgcttccggcggcaccggctggcgctcgccagcgtcggcgtgctggcgctcctcgtcgccggcgtggtgttcggcggcctgctctggccggtcgccatcgacgacatcgacttcgcggcccagctccagggcccgtcctgggaccacccgttcggcaccgacgatctcggccaggacctgctcgcccggatgatctacggcgggcgggtctcgctcgccgtgggcttcgccgccatggcggtggcgagcctgatcggggtgctggtcggcgcgctcgccggcatgtcgcgccggttcctcgacccggtgctgatgtggctgaccgacctgttcctgtcgctgccgcagctgccgctgctgctcctcgtgatctacctgttccgcgacagcctgaaggccgtgttcggcagccagggcggcgtattcctgatgatcgtcgcggtgatcgggggcctgcgctggatgccggtcgcccggctggtgcgggcgcagttcctgtccctgcgcgagaaggagttcgtggaggcggcccgctcgcagggggcgacgaccgggcacctcgtgcgccgccacatcctgccgaacgcgctcggtccggtgatcgtggcggcctcgatcgaggtctcgtccgcgatcatcgcggaatcgaccctgtccttcctggggctcggcttcccgcccgacatcccgacctggggacggctgctgttcgacgccaaggatcacctcgacgtcgcgccgcactgggcgctgttcccggggggcgcgatcttcctgacggtgctgtcgatcaacttcatcggcgacggtttgcgggatgcgcttgatccgcggcgggtgctctag

SEQ ID NO: 5611 - DNA, 879 bp, Methylobacterium sp.
atgagcgcccccggccttctgtcgcgccgcgccctcctggccgccgtcgcggccggggcgctcgccccgcgcgccgccgccgcgcaggcggccacccgcatcgccgccctgggcggggccgtcaccgagatcctctaccgcctcggcgccggcggccggatcgtcgcggtcgacacgaccagcctctacccgcccgaggcgctgcgcgagaagccgagtgtcggctacctgcgggcgctctcggccgagggcctgctggcgcagcagcccgacctgatcattgccgccgagggggccgggccgccggccgtcctggcgcagctgcgcgaggccgggctgcgcgtcgagacggtgacggagccgccgaatcccgagggcgtgctggacaagatcgagacggtcgggcgcctcgctggcctggagcgcgaggccgaggcgctcgagaccgatgtccgcgcccgtttcgccgacctcgcgacccggcgcgcccggatcgcccgggcggcccgggccctcgtcgtcctgtcgatccagggcggccggaccgtcgtcggcggcaccggctcctcggcggacggcatcctggccctggcgggcatcgccaacgcggccgcgggcctggagggcttcaagccgatgaccgacgaggccatcgtggccgccgcccccgacgcggtggtgatgatgcagaacggtcccgagccgccgaagcccgagagcatcttcgcccccggcacggccctcggccagacgccggcgggggcgcggggccggctggtggccatggacggcctctacctcctcggtttcgggccgcgcacgcccgaggccgccaccgacctgatgcgggcgctctacccggacctgccgcgtgactga

SEQ ID NO: 5612 - DNA, 825 bp, Methylobacterium sp.
atgtatgacccgaccctgctcacggcccgcgacctgaccgtcacggtggcggggcgggacctcgtgcgcgacgtctccctggcggtggagggcggcaccctgcaggtggttgtcggcccgaacggggccggcaagtcgaccctcgtccgcctgctcagcggcgccctgcgccccacgagaggcactgtcgcctatggcggtgcgcccgtggagacgatcccgccctggcgcctcgccgcgacgcgggcagtgctgccgcaggcggcgcgcctcgccttcccgttcgcggcggccgaggtcgcccggatcggcctcgacggcatcggccggggcctcggggcccgcgaccgggcggcgatcctggcccgagccctcgcgcgggccgacgtggcgcatctcgccgaccgggcctacccgaccctctcgggcggggagcaggcgcgggtgcagttcgcccgggtcctctgccagctggaggccggccgcacggtcgcggaccggcaggtgctgttcctcgacgagccgaccgcgagcctcgacctccggcaccagggcgcgctgctcgacgccgccgccgggctggcggcgaccggcgtcgccgtggtggcgatcctccacgacctcaacctcgcggccgcctacgccgaccggctgctggtcctcgacgggggccggctggtcgccggcggccggccggtcgaggtcctgaccgacgacctcatcgccggggtcttcggcgtccgctggccggtcgggcgggtgcccgcgggcggccagcccttcctcctgccgcaccggggtgcggccggtcgcgcgcgggactga

SEQ ID NO: 5613 - DNA, 750 bp, Methylobacterium sp.
gtggatgcggtgaggcaggagcggggctcggagaacgtcacgctgcccctcgcctcggggtcgcgccgcatccacggctcggtcgcgcgcgatctgggcgcggcgatcctcggcggccgctacgcgcccggggacgtactgcccggggagatcgaattctctgagaaattgaacgtctcgcgcaccgcctatcgcgaggcgatccgcatcctgagcgcgaaggggctcgtggagagccgcccgcgcaccggcacccgcgtcagccagcgcagccgctggaacctgctcgatcccgacatcctggcctgggccttcgagtcggagccgagcgagtccttcatccgcgacctgttcgagctgcggatgatcgtggagccggccgcggccgcgctcgcggccgagcggcgctccggcctcgacatcgcccggatgggccacgccctggaggagatgggccgccacggcctcgccaccgaggccgggcgggcggccgaccaggccttccacaacacgatcctggaggcggcccgcaacggcgcgctgatcgccctgtcgagctccatcgccgccgcggtcacgtggacgacgatcttcaagcaccgccgccagggtctgccccgggacccgatgccggatcaccgcgccctctacgacgcgatcgtggcgggcgacccggacgccgcccgcgcgacgatgaccgagctggtccgcctcgccctcgccgacaccgagctggcgatgcggccctga

SEQ ID NO: 5614 - DNA, 909 bp, Methylobacterium sp.
gtgaacgaccgcgcgctccgctacctgctggccgtcgtgcgcgcgggctcggtccgggcggccgccgaggtgctgaacgtcgccgcctcggcggtgagccggcagatcatcgagctggaggcgcaggtcggcgagaccctgctcgagcgcctgccccggggcgtggtccccaccgaggccggccgcctcgtcgccgagcacgcgcagcggcaggccgacgaggcggccctgctggaggaccagctgaagcgcctgcgcggggtgcagcggggcacggtcagcctgcgctgcggcgccggcttcctgatcgacctcctcgacaacgccctggccggcttcgcccaggaccatccgggcatcgcctatcaggtcgagatcggcacgaccgacgggatcctggcggcgatcgcccggggggacgcggatatcggcctcgtctacaacccgcccgcgcacccggatgtccgcgggatcgtctccgcccggcagcccctgctcgctgtcctgccgaacgggcatcccctcgccggcgggtcggcgccggtcccgctgcgcagcttcgccaccgagcccgccgccctcctgccccccgaccacggggtccggcagctgatcggccgcgtcgaggccgacggcggcttccggctggtgccgcggctggagacggcgtccttcgagctgcaccgccgcttcgtgatggccgccatgggcgtcgcattcctgccccgcttcgtggtcgcggccgagctgcgcgacggcctcctcgcggctttgccgctgcgcgaagccatcctgtccgaggcgagcgcccacctcgtcgtccgcgcggggcggcgcctgccggagggcgcggcgcggctgctcggctggctggccgaccacatggtggcgttccggccgccgacctga

SEQ ID NO: 5615 - DNA, 1359 bp, Methylobacterium sp.
atggcaacaccgaccacgccccacgcggcggacgcggccgccttcgagagccgaacgatgcggaaggtcggcctgcgcctgatccccttcctcgtgctctgctacttcatcgcctacgtcgaccgggtgaatgtcggcttcgcggcgctgaccatgaaccacgatctcggcctctccgccgcggccttcggcctgggcggcggcctgttcttcgtggcctacgtcctgttcgaggtgccgagcaacctcgccatggagcgcgtcggcgcgcggatctggatcgcgcggatcatgatcacctgggggctcgtcggcatcggctcggccttcgtcaccggtccgctcagcttcgccacggcccgcttcctgctgggcgcggccgaggccgggttcttccccggcgtgatcctgtacctgacctactggttccccaaggcctaccgggcgcggatcgtggcgatgttcatggtcgcgatcccgctctccagcttcttcggctcgccgctctcggcggcgctgctcaccctcgacggcgccgcgtccctgcgcggctggcagtggctgctgatcatggaggcgattccggccgtcctcctcggcgtcgccgccctcgcgctgctgccgagccggccggccgaggcgaccttcctgagcccggcggagcgcggctggctgacggaccggctggagaccgagcagcgcgccgccgaggcgagcgccgggcaccacgcccacggcctcgcggcggtctgggcggtgctcgcgagccggcaggtctggctgctcgccgtggtctacgcgggcagctcggccaccagcaacacgctgtcgctgtggatgccgcagatcctcaaggggttcggcctcagcaacctgcagaccggcctgctgaacatgatcccgttcggcatcgcctcggtcttcatgatcgtctggggcctgcgggcggaccgcagcggcgagcggatctggagcacggccctgccgctggcgctgacctcggcgagcttcgccctgacgctgctgacgggctcgctctgggtgacgctggtcctgctctcgctggtcctgctcggcaactacgcgatcaagggcccgttcttcgccctcgccacggagacgctgccgccggcccagacggccgccggcatcgcggcgatcaacaccctggcgcatctcggcaccggggcgatcacctcgctgatcggcgtgctgcgcgagcagaccggcagctttcccgtcgccctgctgccgctctgcgcgctcaccggcgtcggctgcgccctggtcttctggatcggccggcaccagccgcgggcggcgaccgtcggggcgaccccgtcggccgcgcgggtctga

SEQ ID NO: 5616 - DNA, 3183 bp, Methylobacterium sp.
gtgggcgcggcgctctccgcgtcgtgggcgatcggcggatcgggcggcaaggggggcaacggcggcgaggcccgcatcgagagcagcagcaccgtgaccaccgccggtctcggggcggacggcctggccgtcctcagcatcggcggcggcggcggtgtcggcggcttggccagcgcgacggcgatcacgacgcccctggccacgccgagcgggcagtcgctgccgagcttcgccttctccaccgcgatcggcggctcggggggcggcggcggcaacggcggcggcgccacggtcgccggcagccaagcgaacaagggcctgacgctcaacctgaccgtcggcgggtcgggagggaccggcgcccggggcggatctgtctgggtcgataaccgcggctcggtgaccaccaccggagccgaggcgcatgccgtcgtcgcccagagcatcggcggcggtggcggaagcttctcggcgccctccgccgaggccgccgccgacacccccgacgccgacacccccgccgctgcggcggagaggacggaatcatccaaggagccggccgcgagccaggttcagagccagaccaagagcgagacgaagggcgggacgaagagcgacgcccaagcgctggcggacgccctgctcgccgcgctcgacatcgagcggatcgccccaccggaggatccggccggcgtctccgagaaatccggcagcctgacgctcggcggatccgggcgcgtggcgggcgacggtggcggcgtgacgatcgcgcaatccggcacggtcgccacgacgggcttcggggcggtgggcatcctggcgcagagcatcggcggcggcggcggcctcgcctcggtggcggccggtccgggcggccaccgctacacgttcgggatcggcggcgcgggcggcgcctcggggagcggcggcccggtcgcggtgagcctgaccgcgggcgcgcaggtctccaccgtcggcgacgcggcgccggcgctgctgctgcagtcgatcggcggcggcggtggctacggcggcgcgcaccaggcgatgggatacgcggtgccctacgccctgcgcgacggttccggcggcaatggtgggacgatccaggtgacgctggaggagggcagcgcgatccgcacgtcgggcacccagtcccacggcctcctcgcccagagcctcggaggcggtggcggcctgctcctggacctcaccggcccggccgccggggcgtcgggccagagccgtctgaacgcgaccggcaagggcggcgacatctccgtcgcgtcgtccggatcgatcatcgcgtcgggcctcgacgcgaacgcgatcttcgtccagtccggcgtccaacgcaccgacgggagcctcgaacccgacccggagcggggcggcaggatcaacctccaggtgaacggcctcgtcacgggtggcagcggcaccggagcggcgatccgcatcgacggcgggcgctccaatacgatcgtgatcggcgggcgcgccgtggtcagcgcggcttcgggccgggccatcgtcggcgcattctccgccggcgagatcaacaattacggcaccgtgatcggcgacgtggacctggccgccggcccggcggggggcgtcaccttcgtcaacggtggtttccagaacacgggagggacctcggcgatcctgcgcaccggacccgagggcgtcatcgccctggggccgaacggccgcctgcacaacagcgccaccctcgacatcggcggcgtcggcaaggtcgcccgagcgacggtgaccggcaatttcgagcagagcgagtacgggcggatgctcgtcgacgtggcgcccctggcgccggagggggccctgcgcgccgatctcctcaccgtcaccggcaccgcatcgctgaagggcctcgtcgagccgcatctgatcgacgggctgctgcccggccggtacaccttcctccgggccggtcaggtcgcggagagcggcgccatggctgtcggcggcagcatccattccggcgcggttccgatctcctggtcgatcgtcgcgtcgggcgacaccctctccctggtcccgagagcccggttcacggagccggtgggcgtcacgctcacgccggaccagcgcagcgtcgcacagggcctgcaggacgcctgggacggcaataccaggcagctcggaactctctacgggcgcttcctctcggtcgacagccagaaggcctacgccgccgccctcgacgagttgaagcccgagtccaaccaggacatcctgaccgaccggacgctcgacacccgcaaaggccttcagcgggccatgagctgcccggccttcagcggtaccggcacgctcctgcgggagggcgagtgtgtctgggggcggatcacgagcgcccgcacgaccttttccgcgaccgcggaggacggcggctatcgccagaccgccctcagctaccagaccggcctccagaccgagttcgcccctgactggttcttcggtctgaccggcgcctacacccgcgccgtccagagcgatcccgaccggatcaccgggacgaccagcgatgccggcgatgtctcggcggcgctcaagcaccagatcggcccttggctgctcgcggcatcggccaatctcggctattcctgggccgacaacaagcgcctgatcgacttcggcggcgccacggcgacggcgcgcagcaagtccgggatcctcacggcgggcgggcggctgcgggcaagctaccaagtcctgttcggcgattggtatctcaagccctacgcggatctggatctgctctacagctacagtcccgcctattcagagaccggggcccccggcttcaacctcgacatgcgaccggtcgccaagacgctggtggcgttcagcccgatgctggagatcggcggccggatcgacctcgatgcggggcgctggatccggccttacggtatcctcggcgtgacgctcctctcggacgaccatttcaccggtagggcgagcttccaggggaccggcgctctcggcctgttcgcgacggaatcatcgatccccgatcgcctcggcgagatggggctgggctttcagatcagcctcggtggcggcatcgaggtgaccggcgagtatcagggtcaagtcggcgatcacttcctctcgcatgcggggacggctcggatgcagctgcgcttctga

SEQ ID NO: 5617 - DNA, 1101 bp, Methylobacterium sp.
atggggtaccggccaggtcagctctgtgtcccacgccgcgaccggcagatccgcgatggcggacggctcgtcgtcgcggccaccaccggcctggtcctggtccttgacctgccggcgcgcgccgcggagcgacctcggcccgaggtggtgaccgccaccagcggccgcgatggaaaggccaacgtcatcgcgtcgaatgtcgtcgcgacgcccggtgctgacggccctgacctgtccttgatcgatgtcgatgctgcagccgccggcaacgaccctgccgcgacgatccgaaccggttcggtgggcggagcgggcgggcgcggcgacgcgatcgtggggctggcatccgtcccgggcgcgagcggcgggcgaggcggtgccgtcgcggtgacgctcggagaggatgtgagcggagagggggatcaggtcggctacacgacgcgcgcccgcgtctcccggctccagtttcggccgatcccgcggttctgggtcttctcccggggtgggaacggcggcgacgcccagaaggatgtcggcgccggcggcgatgccgggccggcgaccctgaccctgtcgtcccgcatcgcgaccgaggggcaggccttcctgggggttcgggtcagtgcggtcggcggcgatgccggccgcgggggcaccgacgccgaccagaccgcctccagacggggcggcgccggcggcgcggccgcgctcacggtgacacgctccgggcaggtgacgaccgacggtgtcggggcgaccgcggtgatcgtcgagtccatcggcggcgcgggctcgatccgcgggtcggggaccttctacagcaaccccttcgtgacgtcgggcggcgcgggcggcaccgcgcgcctcgacatggccgggaccatcaggacctccggcgactatgccctcggcggcctcgtccagagcatcggcggcaacggcgggatacagcccgatgccggcggccggcccggtggccggggcggtgacggcgggaccgtcacggtgacccagagcggcacgatcgtcacggagggcgactacgccctgggcctcgtcgcgcaatcggtcggcgggccgggcggccagggcggcggcggc

SEQ ID NO: 5618 - DNA, 1419 bp, Methylobacterium sp.
gccacctccacgctgggcgggacgggcggcggcggcggcaatggcggcatcgtcaccgccgcgaatagcggcgcggtgcgcacgtccggggacggcgcgatcggcatccaggcccagagcatcggcgggggcggcggcaatggcgggggcgcgaccgcgacgagcaacagcctgagcctcaagcagaatgtcacggtctcgcggagcgtcggcggcaccgcgggcgtcgccgggatcggcggcgcggtcacggtcacgcagtccggcagcgtcaccaccgggggagccggcgcggtcggcatcctcgcgcagagcatcggcgggggcggcggcaacggcggcaacgcctcgagcctcgcggcccccggcttctccttcgacaagaccctgaacggcctcgtcggaaagctcccgatcgccgataccctctcggtgacggagacgatcggcggcgggagggggaagggcaatgtcggcggctcggtcacggtgacgaaccagggcgcgatcacgaccggggggtcgaacgcccacggcatcgaggcgcagagcatcggcgggggcggcggcaacggcggcaccgtgtccggatcggccgtcggcaagctcaccgtcggcctgacgctcggcggccagggcggcagcggcggcagcggcggggacgtgaccgtcaccaatgccgccgccggcgtgatcgcgaccagcggcgacggctcgcacgggatcgtggcgcagagcatcggcggcggcggcggcatgggcggcagcgtcgcggcgcgggacgtttccgaccccgacaccgtcggaacgatctggacgcagatcaagaagacgatcggtgtcgccgcctatcaggagtgggcgaaggacaaggagaacaaggacgatctcgatcgattcctgaaggacatcaagtccagcgacacgtacaagagcctggcggaccagctcaagaactcggatttcggcaaggcgctcaagtcctacagcggcagcgtctcgagctatctggacgcgcagaagaagggcgccaccaagctgcccgacgccgcgttcaccctgtcgctcggcgggagcggcgcgcagggcgggaacgggggtacggtctcggtcgagaacggcggcaccgtccggacgatggggatcggcgcgcacggcatcctggcgcagagcatcggcggcggcggcggccagggtggcctcgcctacgcggaggcgaccaacaggacgaccgtgacggcgacgctcggcggcacgggcggcagcggcaacatcggcggcacggccaagatcgtgaacaccggttccgtcgccaccgcggacgatgccgcctacggcctctacgcgcagagcatcggcggcggcggcggcaacggcggcggcgccacggtcgccggcagccaagcgaacagggcctga

SEQ ID NO: 5619 - DNA, 426 bp, Methylobacterium sp.
gtggaccagcaagcggaccagcaatcggaaccgggcaccgtcttcggcgccaccatcccgttcgtggatcactgcgggatcgaggcgctcgacgtccgcgcgggccggacgcggcttcgcctcgccctgcggccggagcacgccaacaacctcggcatcgcccatggcggcgcgctctgcaccctgctcgacgtcgccctggggacggcggcgcggctgcgggcggggcgccccgtggtgaccctcgacatgcagacccgcttcctcgcccccggccgcggcgtcctgaccgccgagggacgggtcacccgggcggggcggtcggtgatcttctgcgaggccgagatccgcgacgaggccggggagctggtggcgaccgccacggggctgctcaagcccgtcggcgagcggccggcgcccgcgtag

SEQ ID NO: 5620 - DNA, 1299 bp, Methylobacterium sp.
atgacaccgacccgtcgatcgctgctcgccgcccccctcctggcgatgccggccctccggacccgggcgggcggcgggtccgtggtcgtcgtcggcgccggggccgccgggctcgccgcggccaccctcctgcggtccgccgggcagagtttcaccctcgtcgaggcccgggaccggatcggcggccgcgccttcaccgaccgggcgctcggcgccgcgtgccggttcgacgccggcgccgagtacatccactgggccgagcgcaatccctgggcgcccatcgcccgggcggccggggcgcacgtcgcccgcgaggacggctgggcgcgccggctcgtcgtcgacggccgtccggccaccgccgcggaggcggcgcagcggcgcgcgggcttctccggcctcgacgcgctgctcgccccgaagggcggcgacccgtccctggcggaggcggcccgggccggcggccccgacgccgccctggcggcggccggcctgagccggctctccctcggcgaggatcccgagcgggtctcggccgtggactacgaccggctctggtccggctccgacctctggatcgacggctacggcgacctcgtggcgcggcacttcgccgacctgccggtcagcctcggctgccccgtgcgggcgatcgactggtcgggccgcggggtccgggtcgagacggcgcggggcacgatcgcggccgcggccgccatcgtcacggtgccggtcggcgtgctgaaggccggggccgtggcgttcgcgccggacctgccggacgccgcccggacggcgctcgatggcctgtcgatgggcgcctacaccaagatcggcctgcgcctcgaccccgcgcgcctcgacggtgccgacctcggcgacgcggtctcggtggcgacgggcggcccgacgatctacttcgagatgcagcccttcggccggtccctggcggtggccaatctcggcggcgacctcgcgcgcgacctgtgccgggccggcgaggcggaggcggtggccctcgccaccgagcgcctggtcgcggtcctcggcggcggcgcccgcagcgccgtcgaggccgggcgcctcgccggctggtggacggacccgcacgcccggggctcctactcgatcgccgcgcctggccacgcggaagcccgcgaccgcttgcgcgccccggtcggcgggcgcgtgttcttcgccggcgaggcgctggccggcggcggcgccatgacggtgggcggggcgacgctcgacggcgagcgcgccgcccgggcggtgctgaaggcgctgggcgcctga

SEQ ID NO: 5621 - DNA, 1065 bp, Methylobacterium sp.
atgcgcttcggcccgcgctggttcctgctggtggcgccgtgcctcggcgccctggcggggctcctctacggggtgatcttcgggatcgccccgctgaccgggacggcgatccgcggcgcgatcatcggcacgccgatccttctctacgagcgccagctgctggcgccgcgcctgcgcgaccgcatccgcggcctcgcgacgccgctgttcctgctcgccacggtggcgctctacatcgcgctgatcgtggtcgggaacgcggtcgccagcacggtgctgaaccagctgttccgcttcatgtacagcgagcggaacgcgatgctgatgtcgcaatcgggcctgctctacgcgctcggcatctcggccctggtggtgttcgtgttccgggtccgcgacctgatcggccccggcgtcttcgccaacctgctgatcgggcgctaccaccggccgatcagcgaggagcggatcttcctcttcctcgacgtgaccgggtcgacgcgcttcgccgaccgccacggcgaccgcgcggcgcaggcctatctcgggcaggtgttcaacgccctggcgctgccggtggcccgcgcccgcggctccatcgacgattacgtcggcgacctcgcgctggtgacctggacgatggagcggggcctgcgcgacgccgcctgcctgcgctgcgtcttcgccttccaggagcggctcgccgccgaggccgagagctggcgggatcgcttcgggcaggtgccggagttccgcgccgcgctgcattgcggcccggtcgtgaccgccgagatcgggctggagcggcacaagatcgcgtatttcggcgacgtcgtgaacacgacggcccggctggaggccctgtcgaagaccttgggcgtcgacgtcctcgtctcggccgacctcctcgcccggctcggcccgttgccggacgacctcgtggcggaggatctcggcgcccacgccctgcgcggccgcgccgagcccctggcggtggcggcgatccggcgccggctcgccgtcgcggcgcccgcgcggccgctgccgcgccgcgccgcgaccgcctga

SEQ ID NO: 5622 - DNA, 1047 bp, Methylobacterium sp.
atgagcgatgccccccgcctgaccagtctcgcccacggcggcggctgcggctgcaagctcgacccggccaccctgcgccagctcctcgcccagcagccggcggcgggcccgttcgagcggctcctcgtcggcaacgagaccgcggacgacgcggcggtgtgggagctcgaggacggcacctgcgtcatcgccaccacggacttcttcaccccgatggtggacgaccccgtcgatttcggccggatcgccgcgacgaacgccatctcggacgtctacgccatgggtggccggccgctcttcgcgctcgcgatcctcgggatgccgctcggcaagatcgacccggacgtcgtcgcgcggatcctgcgcggcggcgcggagcaatgcgcccaggccggcattccggtggcgggcggccactcgatcgacgcgccggagccgatctacggtctggcgctgatcggaacctgccgccgcgaggcggtgcggcgcaacgccgacgcggtggccggcgacgccgtcctgctcaccaaggccctcggagtcggggtctactccgcggcgatcaagcgggcgaccctcgacgaggccggctaccgcgacttcatcgcgaccacgacgctgctcaaccggatcggaaccgacctcgccgccgagcccgccgtgcacgccctgaccgacgtgaccggatttggcatcctggggcacggcctggagatcgcccgcggcgccggcctcaccctcgccctcgaggccgacgccctccccctgctgccgcaggcggaggcgctggcgcgcgcgggcgccgtgaccggcgcctcgcaccgcaactggacggcgttcggcgaggcggtggacctgccggccgacttccccgagtggcgccgccacctcctgaccgatccgcagacctcgggcgggctgctggtgacctgctcggccgaccgggccgacgcgatcctggcgcgcatccgggcggccggctatccggcggcggcccggatcggccggatcgaggccggcccggcgcggatccgcgtggcggcctga

SEQ ID NO: 5623 - DNA, 1314 bp, Methylobacterium sp.
atggccctggccgcaacgccgcgcgtgcgccgcatccagacgatctcgctcgccctgctggtgacggcgggcgtcgtcaactacgtcgaccgggccaccctggcggtggccaacccgctgatccgcgaggatctcggcctctcaattcccgacatgggcctgctgctctcggccttcctctgggcctacgccttcgcgcagctgccggccggggcgctcgccgaccggctcggcccgcgcctgacgctgacgctcggcctgacctgctggtccttcggccagatgctcggcggcgcggtgacgtcgttctggcagttcgtgagcgcgcggatcgtcctcggaatcggcgaggcgccgcatttcccgacctgcgcccgggtctcccgcgactggttcaacatccgccagcgcggcaccgccacggggatctggaactgcgcctcctcgctcgggaccttcctggccctgccgctgctgaccttcctgatggtgagcttcggctggcgggcgatgttcgtcatcatgggcgcggccggcctcgtcctcgcggcgatcgtctacctcgtgttccgcaacccgcgcgagaccgacctgacgccgggggagcgggctttcctggaggagggcgatgtcccgaacgcgagccgcgcggtcacctggagcgcgtggcggcggctcttcgggttccgcaccagctgggggatgatcgtcggctatttcggctgcatctacatgacgtggctctacaccgcgtggctgccgagctacctcgagatcgagcggcacttcaccctgcagaagaccggcctcgtcggctcgatccccttcgccttcggcgtgctgggcgggatcctgggcggccgcgtcgtcgacgtcctcgtccgccgcggcgtcgacccgatccgcagccgcaagatcccgatggtcggctccctggtggcgaccgccgccttcacggtggtggcggcgctgacgccgagcgacaccctcgcgatcgcctgcatctcggcctcgctgttcctggtctacatgagctcgtcgtcggcctgggcgatggcctccgtggcggcgccggccagctgcacggcgtcgctaggcgccatgcagaatttcggcggctacatcggcggcgccctggcgccgaccgtgacgggcttcatcgtcggcggcacgggccatttctccatggccttcatcaccggcgccgtgatcgccctggttgcggccctgggctactggacgctgatccaggatcccatcgccgacgagggtccggcgagcgccgccgtcggcgcgctcggggccgcgcgctag

SEQ ID NO: 5624 - DNA, 1233 bp, Methylobacterium sp.
atggcggcggggaaatcgatgggtgcagttcaggaacgcgaaccggcgacacgccgcgcggccacggatttctacgacagcctgccccggttcaccgccttctccagcctcatggatccaggcctctaccggcccctgcccgcggattggtggctcggcgtggccgatgtcgtcggctcccggaagcagatcgggcttggccgctacaaggcggtgaatgcggccggcgcagccataatcacggccgtctccaacgcactcggccggcgcgaattccccttcgtcttcggcggcgacggggccagtttcgccgtcgccccggacgacgtggacgccgcgagagacgcgctggcggcgacggccagctgggtccgcgaggcgctgcaactggagctgcgcaccgctctcgtgccggtctcggccgtgcgcgatcgcgcgctcgacgtgcgcgtggcgcgctacgcgcccagcgcccacgtttcctatgccatgttcagcggaggtgggctgccctgggcagaggcagccatgaaggccggcgagcatgccctcgcaccggccgcgtccggcacccagcccgacctgaccggcctctcctgccgctggcaggagatccgtccccggcacgagctgatgctctcgctcatgctcgtgccccagcacagcggcgacgcgccggccttccggcaactcgtgcaagagatccttcagacggttgagatcagcgccgaggtcgcgcgcccgatgcaggacgcgggaccggagatgcgcggaccgtgggcaggactggacctcgaactgcgcgcgatgccgggctcgcgcaggagccgcttctgggccaagctccgcctcgcggcgcgatcgataccggaatacctgatctaccgcacgggcgtgcggatcggcgcgttcgatcccgccgtgctgcggcgggagatcgtgggcaacaccgacttccgcaagtacgatgacgcgctgcggatgacgctggattgcacccgcgccttcgccgatcgactcgaggcgcagctcgccagcgcggaggcgcaggggatctgccatttcggcctgcagcgccagtcggcagcgcagttgacctgcatcagccctccggtccccggcagcgggcacatgcatttcatcgacggtgccggtggcggctatgccgcggcggcggcgaatctgaagggtcgcgcggccgatggcggtgcctcggctcagacccgcccgtga

SEQ ID NO: 5625 - DNA, 834 bp, Methylobacterium sp.
gtgctcggtcgggtcgaccatcgctcccggttggtcgtcgaacgccgggtcaacggtgccggatcgcacccgaggcaagcctatccctgcaacgagctcatcgtgatgctcggcggccgcgctgtcgtacgacgcaccggtgacggtcaggacgagaagtgcctcgccggggccggaacggcctggaccggaccggtcggattcatggagaaggcggaactctcggaggccatctcgtgcctccacgtgtgcctgccgcgggccctcatcgagcacagtgccctggcggactacggcatcgacgcctcgctggtcgaactcgccttcgtcggcggcttggccgatccgctcctcgtcagcttcgcgcgggcgttcgagggcatgctcggcaggccacaatcgccgacggaccggttgttcgtcgatggtctgacgaccgctttggcggcccacctgatcgccaattacacggtcgaccgctggaagccgtccaccgctccgcgaaagctcgacgagcgccgcctcaagcgagtgaccgattacatcgaagcgcattacgccgaacccattcccctcgaacgcctcgcggccgaggcctgcctcagccccttccacttcgcgcgcctgttccgcgaggcgacaggcctgaccccgcatcgctacgtgacggaccggcgggtccgagcggcccgggaggcgctggcgcttggtcgggccacgctgatggagatcgcggtcgagcagggctttggcacccaggacaacttcacgcgggtgttccgcaggagcaccggcctgacgccggggcagtaccgggccacggtccgtcgctga

SEQ ID NO: 5626 - DNA, 945 bp, Methylobacterium sp.
tacaacccgttcgacgggacgctggccggctccttcagcgggcacccgcaccgcgacccgctgaccggcgagacgcacgccgtcgcgtatgacggccgcgtctgggacagcgtgcgccacgtcgtcctcgcgccgagcgggcgggtcgtgcgcgatgtgccggtcgcggtcgcgcacggcccctgcatccacgattgcgcgctcacggcgcgcttcgtgatcgtgctggacctgccggtcacgttctcgttccgggccctgctcgccggctaccgcttcccgttccgctggaaccccggccacggggcccgcgtcggcctcctcccgcgtcagggcgacggcgccgacatcctctggtgcgccgtcgagccctgcttcgtgttccacaccgccaacgcctacgacgacgcggacgggcgggtgatcctcgatgtcgtcgcctacgggacggtgttcgcctcgcccgggggcgggctcgacgcgccgggccggctcgagcgctggacgatcgagccgtcgacgggtcgggtcgagcggcgcgtgatcgacgcggcggcgcaggaattcccccgcatcgatgagcggcgcctcgggcagcgccaccgctacgtctacacggtcagcgtaccggccgacggcaacacgcagctcgccggtgcgacgcagctctacaagcacgacctcgcgacgggcgcgcgccacgtgcacgatttcggtcccggtcacgtcccgggggagttcgtcttcgtgccggcgcggaccggggccgatgaggacgagggctggctcgtcgggctcgtgatcgacaccgccggcgacgtgaccgacttcaccgtcctcgacgcgcgggcgttcgacgcccctcccctcgcccggatccgcatcgggcaccggatccccccgggcttccacggcaactggttcccggcgcgcgcgccggcctga

SEQ ID NO: 5627 - DNA, 1026 bp, Methylobacterium sp.
atgaccctgcgctggacgcggcggcccgagggctcgacctggggggatttcggccccgacgacgagctggggcgcctgaacctgctcacccccgagaaggtgctgcagggcgtcgccgaggtgcgcgaaggggtcaccttctgcctcagcctgccgctggacctgccgggcggcaacgtcctgaacccgcgccgccacccgccgcagatcaccccgacgcgccgcgccaacggccggccgaacatgaacttcccggtctgcgaggaggtcgacggcgccaccgacgtgatctgcgacgaccgcgcgctgatccacctgcaatactcgacgcagtgggactcgctcgcccatgtcggctcgctgttcgacgcggacggggcgggcgccgcgccgaccttctacaacggcttccgcggcggccgcgacatcgtcgggccgagcgcgccggaggcggcggatgagccgtcccgggcgaagcgcctcgggatcgagcgcctcgccgagaccggcatgcagggccgggccgtgatgatcgacctgcgcgcccatctcggcgacgccaagacccgcgtcggctacgaccagctcgcccggatcctggaggccgacggcgtcgtggtggagccgggcgacatggtctgcctgcacacgggcttcgccgagcggctgatcgcaatgggcggcgagccggatccgaagctggtccacaacctctgcgccgggctcgacgggcgcgatccgcgcctcctcgactggatcacccgcaccgggctgtgcgcgctgatcgccgacaactacgcggtggaggcctacccggctggtcccggccccgcctgctgcgcgacgctgccgctccacgagcactgcctgttcaagctcggggtcaatctcggcgagctgtggcacctgacgccgctggccgactggctgcgggcccgcggccgctaccgcttcctgctcaccgccccgccgctgcgcctgcccggcgccgtcggctcgccgacgacgccgatcgccacggtgtga

SEQ ID NO: 5628 - DNA, 414 bp, Methylobacterium sp.
atgctcacgccgttccacctcgcctaccacgtcaccgacctcgacgcggcgcgccgcttctacgggggcgtcctcggctgccaggagggccgcagcaccgagacctgggtcgatttcgacttcttcggccatcagctgtcgctgcacctgggcgagcccttcgccaccacccggagcgggaaggtcggcgaccacacggtgatgatgccgcatctgggcgtggtgctgccgctcgacgcctgggaggcgctcgccggccgcgtcgaggcggccggcatcgccttcgacatcccgccggtcgtccgcttcgccggcgagcccggcgagcagcgcacgatgttcttcttcgacccgagcggcaacccgatcgaggtcaagggtttccgggatctggccggcgtcttcgcgcactga

SEQ ID NO: 5629 - DNA, 813 bp, Methylobacterium sp.
atgacggggccggccccgggcgccccggcggacggggccctcgaccacgtcgtgatcaacgtgctgcggcggatggacgaggcggcggacctgttcgccgccctcggcttccggctcacgccccgcggccaccactcgctgggctccgtcaaccacctgatgatgacggcgggcccgtacctcgaactcgtgggcgtgcccgagaccggtccgcagcggcaggacgtcctggacagcccgttcggcctgaacgggctcgtcgtcgcgagccgggacgccgacgcggcccacgcgcggctggccgctctggggctggcggccggaccgcccgtcgccttctcgcgcccggtcaccgtcgacggccgcgaggcggtggcccggttccgcacggtgcgggtgccggccgaccggttcccggcgggccgcctctaccactgcgagcacctgaccccggatctggtctggcgccccgaatggctcgaccatccgaacgggttctcggggatcgacgcgctgacgatcgagagcccggcgctggaggccgacgccgcgctctacgcggccgcgagcggcgccccggccgaggcgtcgggcggcgtccggaccctccggctcggtgagacgcgggtggcgatcgtgccggggccggtcgcccgcttcgccgccctggcactgcgcttccgcggcctcgacgccctcgaggcccgcgcggccggcctcccggaggcgggctggctccggcacgggccgggcgcggccacgctgacgcttccggacttcgacctcaacctcccgtgcagggcggccccatga

SEQ ID NO: 5630 - DNA, 1074 bp, Methylobacterium sp.
gtgagcgcgtccagaccgatccgcgtcctgatcgtcgacgactcggcctccgtccgccagacgctgtgcagcatcctggggacggcgcccgacatcgagatcctgggcaccgccgccgatccgttcatcgcggcgcgccgcatccaggaggagatcccggacgtcatcatcctcgatctcgagatgccgcgcatggacggcctgaccttcctgcgcaagatcatggcgcagaagccgctcccggtgatcgtctgctcgaccctgaccgaggccgggtcccggatcctgttcgaggtgctggaggcgggcgccgtcgacgtgctgccgaaaccccgcgtcgacacccgccagttcctgctcgaatccacggtccgggtctgcgacgcggtccgggccgccgcccgggccaagctgcgcgggagccggccgtcccggccgctggtggaggcgaagctctcggccgacgtcgtcctgccgccgcccgtgcccgggcgcgtcgtggccgggtccgaccggatcatctgcatcggcgcgtcgacgggcggcacggaggcgctgcgcgacgtgctcgaggtgctgcccgccgagtcccccggtctcgtcatcgtgcagcacatgccggagcacttcacggcggcgttcgccaagcgcctgaatggcctctgcgcgatcgccgtcaaggaggcggaggacggcgatcccgtggtgcgcggccgcgccctgatcgccccgggcgggcggcacctcatggttgagcgccggggcggcagctacgcggtgtcggtgaaggacggtcccctcgtcgcgcgccaccgcccgtcggtcgacgtcctgttccggtcggctgcccgggccgcggccgcgaacgcgctcggcatcctgttgaccggcatgggcgacgacggcgccgccgccctggcggccctgcgggcggccggcggccgcaccatcgcccaggacgaggcgagctgcgtcgtgttcgggatgccggccgagctgatccgcctcggcggcgcgaccctgacgctgcccgcccgctccatcccggcccagctcgtcggctggctgtcctga

SEQ ID NO: 5631 - DNA, 849 bp, Methylobacterium sp.
atggaggccgatccgggtcacctgagcgaccggcatttccgctcggtcgccgacctcgtccagcagcatgccggcatccagctcccgccggccaagcgcaccatggtcgaggggcggctgcgcaagcgcatgcgcgccctcgatctcccgaccctggaggcctacggtcgccacctgttcgaggccggccacctcgcggacgagttcccgcacctcgtcgactgcgtgacgacgaacaagaccgacttcttccgcgagcccgcgcatttcgacctgctgcgccagacgatcgtgccgcggctggcggcgcggggcgaccggccgctgctcaaggtctggagcgcggcggcctcgaccggggccgaggcctacacgctggcgatggtcctgcacgacatggccgccgaccggttccgctacgccatcctcgggaccgacatctcctcggaggtgctcgaccgtgcccgcacggcgatctacccggccgagatgctcgacgcggtgccgccggacctgcgccgccgctacgtgatggtcgcgcgcgatccggcccggcgcgagggacggatcgtgccggagctgcgcgcccgggtgcggttccagcggctcaacctgatggacgagacctacccgatcgaccgggacgtcgacctcgtcttctgccgcaacgtgctgatctacttcgacaagccgacccagaaggcggtggtcgcacgcctggccgggcacctgcgccccggcggctacctgatcgtcggccattccgaatccatggcgggcgtcggcgtggccggcctcgaccagatctcctcgaccgtcttcagcaagctgcgggaatccggccggtga

(The sequence listing continues in the following parts.)

What is claimed is:

1. A method for suppressing a disease caused by a plant pathogenic fungus, wherein said method comprises applying a composition comprising a *Methylobacterium* strain comprising NLS0089 (NRRL B-50933) to a plant or a plant part in an amount that provides for reduction of incidence and/or severity of disease caused by said plant pathogenic fungus in said plant, plant part, or a plant grown from the plant part relative to incidence and/or severity of disease in a control plant, control plant part, or control plant grown from the control plant part that had not received an application of said composition, wherein the plant pathogenic fungus is selected from the group consisting of a *Rhizoctonia* sp., a *Fusarium* sp., a *Pythium* sp., a *Septoria* sp., a *Cercospora* sp., and a *Sclerotinia* sp.

2. The method of claim 1, wherein said composition further comprises *Methylobacterium* strain NLS0017 (NRRL B-50931) and/or *Methylobacterium* strain NLS0020 (NRRL B-50930).

3. The method of claim 1, wherein said *Methylobacterium* is at a titer of at least about $5\times10^7$ colony-forming units per gram, or at least about $5\times10^7$ colony-forming units per milliliter.

4. The method of claim 1, wherein said plant part is selected from the group consisting of a leaf, a stem, a flower, a root, a tuber, and a seed.

5. The method of claim 4, wherein said plant part is a seed, and wherein $1.0\times10^3$, $1.0\times10^4$, $1.0\times10^5$ to about $1.0\times10^7$, $1.0\times10^8$, $1.0\times10^9$, or $1.0\times10^{10}$ CFU of said *Methylobacterium* is applied to said seed.

6. The method of claim 1, wherein mycotoxin levels in said plant or plant part are reduced by at least 50%, at least 75%, at least 85%, or at least 95% relative to a plant part obtained from the control plant, plant part, or plant obtained therefrom.

7. The method of claim 1, wherein said composition is an essentially dry product having 5% or less water content.

8. The method of claim 1, wherein said plant is selected from the group consisting of a rice, soybean, peanut, tomato, wheat, corn, barley, millet, sorghum, oat, and rye plant.

9. The method of claim 1, wherein the plant pathogenic fungus is a *Rhizoctonia* sp.

10. The method of claim 1 wherein said plant or plant part is at least partially coated with said composition.

11. The method of claim 1, wherein the plant is selected from the group consisting of a *Brassica*, alfalfa, sunflower, safflower, tobacco, potato, cotton, sweet potato, cassava, coffee, coconut, pineapple, citrus, cocoa, tea, banana, avocado, fig, guava, mango, olive, papaya, cashew, macadamia, almond, sugar beet, sugarcane, lettuce, green bean, lima bean, pea, cucurbit, ornamental, conifer and turfgrass plant.

12. The method of claim 10, wherein the plant part is a plant seed.

13. The method of claim 12, wherein the seed is from a cereal plant selected from the group consisting of a rice, wheat, corn, barley, millet, sorghum, oat, and rye plant.

14. The method of claim 1, wherein the composition further comprises an additional active selected from the group consisting of an insecticide, a fungicide, a nematocide, a biopesticide, and a beneficial microbe.

15. The method of claim 14, wherein the composition further comprises a pesticide selected from the group consisting of metalaxyl, ipconazole, and imidacloprid.

16. The method of claim 1 wherein said plant is treated by applying said *Methylobacterium* as a spray or as a seed treatment.

17. The method of claim 1, wherein said disease is a foliar disease and wherein the plant is a corn, wheat or soybean plant.

18. The method of claim 17, wherein said disease is a foliar disease caused by a *Septoria* sp., or a *Cercospora* sp.

19. The method of claim 1, wherein said disease is white mold and said plant pathogenic fungus is a *Sclerotinia* sp.

20. The method of claim 1, wherein said plant pathogenic fungus is a *Pythium* sp.

21. The method of claim 1, wherein the plant pathogenic fungus is a *Septoria* sp.

22. The method of claim 1, wherein the plant pathogenic fungus is a *Cercospora* sp.

23. The method of claim 1, wherein the plant pathogenic fungus is a *Fusarium* sp.

* * * * *